United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 8

SEQ ID NO: 311088 - RNA, 16 nt, Human
auuuccagauuaugca

SEQ ID NO: 311089 - RNA, 22 nt, Human
ugggcugccagcucuccagaug

SEQ ID NO: 311090 - RNA, 22 nt, Human
agccccuuccaguucucagauc

SEQ ID NO: 311091 - RNA, 21 nt, Human
augugaaaccuuccacgcuga

SEQ ID NO: 311092 - RNA, 22 nt, Human
ucauugcaccccagucccagcu

SEQ ID NO: 311093 - RNA, 22 nt, Human
ggcuugcuucuuguccaggaau

SEQ ID NO: 311094 - RNA, 17 nt, Human
cucuccuuccucugagg

SEQ ID NO: 311095 - RNA, 22 nt, Human
ggaaguagaaguaaugaaauca

SEQ ID NO: 311096 - RNA, 22 nt, Human
uugcauuguugcaaugaaguau

SEQ ID NO: 311097 - RNA, 22 nt, Human
ugugacaugugucaucuuuucu

SEQ ID NO: 311098 - RNA, 22 nt, Human
gugcaugucggggugcauguca

SEQ ID NO: 311099 - RNA, 22 nt, Human
ucaguguaaguuauguagaugu

SEQ ID NO: 311100 - RNA, 22 nt, Human
gucugucauacggcuuauguaa

SEQ ID NO: 311101 - RNA, 22 nt, Human
ccucagugaccuauugcauuca

SEQ ID NO: 311102 - RNA, 22 nt, Human
ugauucacagacuucacaaggc

SEQ ID NO: 311103 - RNA, 22 nt, Human
uuucuuaggcucuaaaaugacu

SEQ ID NO: 311104 - RNA, 22 nt, Human
agggcagaaaccaccuugaugg

SEQ ID NO: 311105 - RNA, 22 nt, Human
auuucacucucccugccacuua

SEQ ID NO: 311106 - RNA, 22 nt, Human
gcaguguuuuucaaugcuucca

SEQ ID NO: 311107 - RNA, 22 nt, Human
uguaugcuuuccaaaaaugcug

SEQ ID NO: 311108 - RNA, 22 nt, Human
cuucucagaucucagcuuugag

SEQ ID NO: 311109 - RNA, 22 nt, Human
uuuguuuacucauucauugaug

SEQ ID NO: 311110 - RNA, 22 nt, Human
uauuucugaggcccaggaagug

SEQ ID NO: 311111 - RNA, 22 nt, Human
ucacugcaaggaggcuucucaa

SEQ ID NO: 311112 - RNA, 22 nt, Human
caaauaguaugagcaaugauuc

SEQ ID NO: 311113 - RNA, 22 nt, Human
ggugccaggcuguagucagggu

SEQ ID NO: 311114 - RNA, 22 nt, Human
agauuuagugguggaauuuugg

SEQ ID NO: 311115 - RNA, 22 nt, Human
agauaugugcgucuuagauuga

SEQ ID NO: 311116 - RNA, 22 nt, Human
ggcaaaaaccauaauuacuuuu

SEQ ID NO: 311117 - RNA, 22 nt, Human
caaaugaaguccaaagggcuua

SEQ ID NO: 311118 - RNA, 22 nt, Human
agggauguaaauucuucuucuu

SEQ ID NO: 311119 - RNA, 15 nt, Human
cagucccagggaccc

SEQ ID NO: 311120 - RNA, 22 nt, Human
uucagagccacuucaagucuaa

SEQ ID NO: 311121 - RNA, 18 nt, Human
acauuucucucugcguga

SEQ ID NO: 311122 - RNA, 22 nt, Human
ccagcccugccagagagagcug

SEQ ID NO: 311123 - RNA, 22 nt, Human
cggggcugcgcucuuccugccg

SEQ ID NO: 311124 - RNA, 22 nt, Human
uggcagagcccagaacugagca

SEQ ID NO: 311125 - RNA, 22 nt, Human
aauuaacaaauguagcugugau

SEQ ID NO: 311126 - RNA, 22 nt, Human
aacucagcauccugcacagaga

SEQ ID NO: 311127 - RNA, 22 nt, Human
aaucauaauuguauacauucau

SEQ ID NO: 311128 - RNA, 22 nt, Human
uuuuccagauuggacuuagucc

SEQ ID NO: 311129 - RNA, 22 nt, Human
uucuuuccccauggaguucgga

SEQ ID NO: 311130 - RNA, 17 nt, Human
cugagcauccgugcucu

SEQ ID NO: 311131 - RNA, 22 nt, Human
uaagcugugggagauuggcaua

SEQ ID NO: 311132 - RNA, 22 nt, Human
ugauuuccaguugcugggugcu

SEQ ID NO: 311133 - RNA, 22 nt, Human
cccagcuccagagccagaaaca

SEQ ID NO: 311134 - RNA, 22 nt, Human
uacaguauggaaaauguauagu

SEQ ID NO: 311135 - RNA, 22 nt, Human
aaauuucaguuaccuuuacguu

SEQ ID NO: 311136 - RNA, 22 nt, Human
gcaggaugggagcuucacuuug

SEQ ID NO: 311137 - RNA, 22 nt, Human
gagcuuaggccagggacaggga

SEQ ID NO: 311138 - RNA, 22 nt, Human
cucuucuugccugaugaggcag

SEQ ID NO: 311139 - RNA, 22 nt, Human
aaucaguuagaaggaagagaau

SEQ ID NO: 311140 - RNA, 17 nt, Human
ccucacagggaccagac

SEQ ID NO: 311141 - RNA, 22 nt, Human
gacagcagacagaacuaccugc

SEQ ID NO: 311142 - RNA, 22 nt, Human
uaacucugaauccucacagcag

SEQ ID NO: 311143 - RNA, 22 nt, Human
aucaguuugagugcugugucaa

SEQ ID NO: 311144 - RNA, 21 nt, Human
gcccucaggggaggauggccu

SEQ ID NO: 311145 - RNA, 22 nt, Human
uccugccucacaguugaaguuu

SEQ ID NO: 311146 - RNA, 22 nt, Human
gcagccacacuguuacagaaug

SEQ ID NO: 311147 - RNA, 22 nt, Human
agccuggcuguaaccucauggu

SEQ ID NO: 311148 - RNA, 22 nt, Human
gcagcagaguuugggagauggu

SEQ ID NO: 311149 - RNA, 22 nt, Human
ucuuugaugugguuaauuauga

SEQ ID NO: 311150 - RNA, 22 nt, Human
uaugcacacauuagcacagggu

SEQ ID NO: 311151 - RNA, 22 nt, Human
cagguaggauggaagggcucaa

SEQ ID NO: 311152 - RNA, 22 nt, Human
augccaggccccacgcugggca

SEQ ID NO: 311153 - RNA, 22 nt, Human
uaaagaugcuauagugaaggag

SEQ ID NO: 311154 - RNA, 22 nt, Human
gcuccucugucaaaugagagug

SEQ ID NO: 311155 - RNA, 22 nt, Human
agguggggugagcugcagacua

SEQ ID NO: 311156 - RNA, 22 nt, Human
cuggcucaggguggucuggguc

SEQ ID NO: 311157 - RNA, 22 nt, Human
aaaaagauguccugaaguuuag

SEQ ID NO: 311158 - RNA, 22 nt, Human
cucuugggagugcucuggagaa

SEQ ID NO: 311159 - RNA, 22 nt, Human
uccauggggcccaggaugagag

SEQ ID NO: 311160 - RNA, 22 nt, Human
gcacagaacuucucuuaguagg

SEQ ID NO: 311161 - RNA, 22 nt, Human
ugaaauguuugaagaccacuga

SEQ ID NO: 311162 - RNA, 22 nt, Human
uuuccucuaaacgcauuugcuu

SEQ ID NO: 311163 - RNA, 22 nt, Human
acugcagccuuugggcucauaa

SEQ ID NO: 311164 - RNA, 22 nt, Human
ugccucaggcaccuggcagguu

SEQ ID NO: 311165 - RNA, 22 nt, Human
agaaaucucaguaucucaggga

SEQ ID NO: 311166 - RNA, 22 nt, Human
ucagggcucaccagccucugcc

SEQ ID NO: 311167 - RNA, 22 nt, Human
uucaggauaugugauaucugaa

SEQ ID NO: 311168 - RNA, 22 nt, Human
gucccagaggcuuuggccacag

SEQ ID NO: 311169 - RNA, 20 nt, Human
aaagagaagccucaccuugu

SEQ ID NO: 311170 - RNA, 22 nt, Human
cagagcugcagauugaaggcau

SEQ ID NO: 311171 - RNA, 22 nt, Human
ccugaggacacacgcugcagga

SEQ ID NO: 311172 - RNA, 22 nt, Human
gaacacaucacauuuuacagug

SEQ ID NO: 311173 - RNA, 18 nt, Human
cauuguacaaugcuuuau

SEQ ID NO: 311174 - RNA, 22 nt, Human
gcucccuguucucagccaugau

SEQ ID NO: 311175 - RNA, 22 nt, Human
uccugccugcaaucccagcacu

SEQ ID NO: 311176 - RNA, 22 nt, Human
aagaaagggagaaggauggugu

SEQ ID NO: 311177 - RNA, 22 nt, Human
ucauaaagcauuucagcuuuug

SEQ ID NO: 311178 - RNA, 22 nt, Human
uuagauaauguagagauaugag

SEQ ID NO: 311179 - RNA, 22 nt, Human
aucugacaaccuauugacuuga

SEQ ID NO: 311180 - RNA, 22 nt, Human
guuuccauggcucuguuaaugg

SEQ ID NO: 311181 - RNA, 22 nt, Human
cugcuguguugccagugucacc

SEQ ID NO: 311182 - RNA, 22 nt, Human
cucaggagacaguguccacaug

SEQ ID NO: 311183 - RNA, 22 nt, Human
aaacagaaauuuccucaugcuc

SEQ ID NO: 311184 - RNA, 22 nt, Human
cacugaaauauuaauaucuuau

SEQ ID NO: 311185 - RNA, 22 nt, Human
cuggcagcauggagccugugcu

SEQ ID NO: 311186 - RNA, 22 nt, Human
gcaagcaagcagguagagcuga

SEQ ID NO: 311187 - RNA, 22 nt, Human
agauuucaaugugagcauuagu

SEQ ID NO: 311188 - RNA, 20 nt, Human
aaacauucauguacaaguga

SEQ ID NO: 311189 - RNA, 22 nt, Human
uuauuacacugaaagaauugcg

SEQ ID NO: 311190 - RNA, 20 nt, Human
gccuggaggcagagauaaag

SEQ ID NO: 311191 - RNA, 22 nt, Human
guaacaaaguuucuaggugcug

SEQ ID NO: 311192 - RNA, 22 nt, Human
cugugcaagacuuacuuuaaua

SEQ ID NO: 311193 - RNA, 22 nt, Human
ucugugugcccuaaagccugcu

SEQ ID NO: 311194 - RNA, 22 nt, Human
gcugccuuuugcuccucccacc

SEQ ID NO: 311195 - RNA, 22 nt, Human
ucacauuucugauuauaccaaa

SEQ ID NO: 311196 - RNA, 22 nt, Human
auuugcaugcuucuauugugaa

SEQ ID NO: 311197 - RNA, 22 nt, Human
gggagguucuguucgcacuuga

SEQ ID NO: 311198 - RNA, 22 nt, Human
ccaggccuggacggguggccug

SEQ ID NO: 311199 - RNA, 22 nt, Human
ccccuucuguguccugucagcc

SEQ ID NO: 311200 - RNA, 22 nt, Human
aagccaggcugcacuugcuggg

SEQ ID NO: 311201 - RNA, 22 nt, Human
uccuugaauccuagcauccuau

SEQ ID NO: 311202 - RNA, 21 nt, Human
gugcucugggcagcagagggc

SEQ ID NO: 311203 - RNA, 19 nt, Human
gcacugaagaguuggucac

SEQ ID NO: 311204 - RNA, 22 nt, Human
ucucccacagucucccauggcu

SEQ ID NO: 311205 - RNA, 22 nt, Human
ucuuccaguguagacaucugcc

SEQ ID NO: 311206 - RNA, 22 nt, Human
cacucugaugguuucuguucaa

SEQ ID NO: 311207 - RNA, 22 nt, Human
gggacagaaggaagugagcaca

SEQ ID NO: 311208 - RNA, 20 nt, Human
cucugcuuuaggagagucag

SEQ ID NO: 311209 - RNA, 22 nt, Human
agucccagugagaugagccacg

SEQ ID NO: 311210 - RNA, 22 nt, Human
ucugucacuuauuaagauggau

SEQ ID NO: 311211 - RNA, 22 nt, Human
gggggaggugaaugcaauaagg

SEQ ID NO: 311212 - RNA, 22 nt, Human
caaagccucugauuucacuugu

SEQ ID NO: 311213 - RNA, 22 nt, Human
ugaaauauuuagagaguaaguu

SEQ ID NO: 311214 - RNA, 22 nt, Human
gcuggcucccauugguccuucc

SEQ ID NO: 311215 - RNA, 22 nt, Human
uguagaaacuacacaugcaaca

SEQ ID NO: 311216 - RNA, 19 nt, Human
auacagauguauccaugau

SEQ ID NO: 311217 - RNA, 22 nt, Human
guuuuuccuugcugaggacccg

SEQ ID NO: 311218 - RNA, 17 nt, Human
aggcagcucagaacauc

SEQ ID NO: 311219 - RNA, 22 nt, Human
uacaguuuguuacauuguuagu

SEQ ID NO: 311220 - RNA, 22 nt, Human
agcaggaaagaaaaaucugugu

SEQ ID NO: 311221 - RNA, 22 nt, Human
cacccacccacugcucauuggc

SEQ ID NO: 311222 - RNA, 22 nt, Human
aauauaugugguauugaccagc

SEQ ID NO: 311223 - RNA, 22 nt, Human
ucucccacgguacaggauaaac

SEQ ID NO: 311224 - RNA, 22 nt, Human
agaaugcuccagagcugaaaga

SEQ ID NO: 311225 - RNA, 22 nt, Human
auggagggaaaaguggagagcc

SEQ ID NO: 311226 - RNA, 23 nt, Human
aaggucacagaacuuagcaagcc

SEQ ID NO: 311227 - RNA, 22 nt, Human
ugccagcucccuuuucuccucc

SEQ ID NO: 311228 - RNA, 21 nt, Human
gaaggagaaagcaagugcugc

SEQ ID NO: 311229 - RNA, 22 nt, Human
ucucaggguuuccugggggcug

SEQ ID NO: 311230 - RNA, 22 nt, Human
cuggaagggucuacuuagcaga

SEQ ID NO: 311231 - RNA, 17 nt, Human
guccuggugugugagga

SEQ ID NO: 311232 - RNA, 22 nt, Human
uaugcacauauaaccugcacug

SEQ ID NO: 311233 - RNA, 22 nt, Human
agcugucuaccugcagaguccu

SEQ ID NO: 311234 - RNA, 22 nt, Human
aagugacacauggcacuucuau

SEQ ID NO: 311235 - RNA, 22 nt, Human
auggccuggggagcaugggaag

SEQ ID NO: 311236 - RNA, 20 nt, Human
agaggccaguuaggagucua

SEQ ID NO: 311237 - RNA, 22 nt, Human
acugcagggcauccuggccaag

SEQ ID NO: 311238 - RNA, 22 nt, Human
guuauguaucuugauugggugg

SEQ ID NO: 311239 - RNA, 20 nt, Human
ucagugauuuugaagaggaa

SEQ ID NO: 311240 - RNA, 22 nt, Human
uggagcagcaucacuuugagcu

SEQ ID NO: 311241 - RNA, 22 nt, Human
agaugcugucacacacacuguu

SEQ ID NO: 311242 - RNA, 22 nt, Human
aaggaaagacauauaaaugacu

SEQ ID NO: 311243 - RNA, 22 nt, Human
ggggcacacuuuugguagauau

SEQ ID NO: 311244 - RNA, 22 nt, Human
acaaagcuagagaagagaauug

SEQ ID NO: 311245 - RNA, 22 nt, Human
aucuggcuuggguguggguagc

SEQ ID NO: 311246 - RNA, 18 nt, Human
gggcucugauccuucacc

SEQ ID NO: 311247 - RNA, 22 nt, Human
uagaucugauacaauucaucug

SEQ ID NO: 311248 - RNA, 22 nt, Human
uucaggaucacuaaacccucca

SEQ ID NO: 311249 - RNA, 22 nt, Human
ugacagaaauaguucuuaauuu

SEQ ID NO: 311250 - RNA, 22 nt, Human
agcagggcagugaucagaaagg

SEQ ID NO: 311251 - RNA, 19 nt, Human
gcuggcagauguggccgug

SEQ ID NO: 311252 - RNA, 19 nt, Human
uuugaaagaguuuuauugg

SEQ ID NO: 311253 - RNA, 22 nt, Human
ugcagaaggccugacauugcac

SEQ ID NO: 311254 - RNA, 22 nt, Human
ugaaggccuaacuuccagugcu

SEQ ID NO: 311255 - RNA, 22 nt, Human
gggcacugcuggaggcucccug

SEQ ID NO: 311256 - RNA, 22 nt, Human
agggcugcaccggggcuucgcg

SEQ ID NO: 311257 - RNA, 22 nt, Human
aggggagguguccccaaaucuc

SEQ ID NO: 311258 - RNA, 22 nt, Human
ugaaugaguuuggcugcuguuc

SEQ ID NO: 311259 - RNA, 22 nt, Human
cagggccagcgcccaggcccag

SEQ ID NO: 311260 - RNA, 22 nt, Human
uggccuuguguuuuagagaaag

SEQ ID NO: 311261 - RNA, 22 nt, Human
guggagcccugccuugcucaug

SEQ ID NO: 311262 - RNA, 22 nt, Human
agauggggcagaauggagccau

SEQ ID NO: 311263 - RNA, 18 nt, Human
aauuuccauaugaauugc

SEQ ID NO: 311264 - RNA, 22 nt, Human
ccuggguacccuuggcggccuu

SEQ ID NO: 311265 - RNA, 22 nt, Human
ccucagggccaucucugucccu

SEQ ID NO: 311266 - RNA, 22 nt, Human
uaacacaugucugggaugugaa

SEQ ID NO: 311267 - RNA, 22 nt, Human
cagaguccuggacacagagaca

SEQ ID NO: 311268 - RNA, 22 nt, Human
ucugguuagccaauaaugccaa

SEQ ID NO: 311269 - RNA, 22 nt, Human
ggcugccugggagcccuccucu

SEQ ID NO: 311270 - RNA, 21 nt, Human
ccagacuggccuaugugguag

SEQ ID NO: 311271 - RNA, 22 nt, Human
ccugccugcuuucugcuuugca

SEQ ID NO: 311272 - RNA, 22 nt, Human
aucuggcugacuuugugggaca

SEQ ID NO: 311273 - RNA, 22 nt, Human
uaucuacaggugucagguaaga

SEQ ID NO: 311274 - RNA, 22 nt, Human
cucagaaucugccaaguucagg

SEQ ID NO: 311275 - RNA, 21 nt, Human
agagagggagaugaaacaucc

SEQ ID NO: 311276 - RNA, 22 nt, Human
uuagaaacccagacucuuaggu

SEQ ID NO: 311277 - RNA, 22 nt, Human
gaaaugcagaaccugagaccau

SEQ ID NO: 311278 - RNA, 22 nt, Human
uagaaacauucaguugcagucc

SEQ ID NO: 311279 - RNA, 22 nt, Human
uccagcagguccgagacaaguu

SEQ ID NO: 311280 - RNA, 22 nt, Human
cccaggaggccaagguugcagu

SEQ ID NO: 311281 - RNA, 19 nt, Human
gcuuuggagggagguucua

SEQ ID NO: 311282 - RNA, 22 nt, Human
gugcugaggugggugggcagcc

SEQ ID NO: 311283 - RNA, 18 nt, Human
ucucuuuuccccucauug

SEQ ID NO: 311284 - RNA, 23 nt, Human
agaggccaacuucuugccccucc

SEQ ID NO: 311285 - RNA, 22 nt, Human
cuggcagcguguuuaugaacau

SEQ ID NO: 311286 - RNA, 22 nt, Human
agagaaaacucauugagguguc

SEQ ID NO: 311287 - RNA, 22 nt, Human
gagcucccuggagguucagaua

SEQ ID NO: 311288 - RNA, 22 nt, Human
aagcugggacuuagcgcagaua

SEQ ID NO: 311289 - RNA, 22 nt, Human
agaugaagacucaggagcaggu

SEQ ID NO: 311290 - RNA, 22 nt, Human
ucaaaugcacguagagaaaaua

SEQ ID NO: 311291 - RNA, 22 nt, Human
uggccucuuacgacauagccuu

SEQ ID NO: 311292 - RNA, 22 nt, Human
agagucugaggcagcugcagcc

SEQ ID NO: 311293 - RNA, 22 nt, Human
gaagcagcuggugagauggagc

SEQ ID NO: 311294 - RNA, 22 nt, Human
agagcagugcugaagaguaggg

SEQ ID NO: 311295 - RNA, 19 nt, Human
uggcuucuguuuucauguu

SEQ ID NO: 311296 - RNA, 19 nt, Human
ugucacugucauggcccag

SEQ ID NO: 311297 - RNA, 22 nt, Human
cucucaggcuugggucguggca

SEQ ID NO: 311298 - RNA, 22 nt, Human
aggaagaaaacuaauuagaugg

SEQ ID NO: 311299 - RNA, 22 nt, Human
cugaaggagaaggccacuguuc

SEQ ID NO: 311300 - RNA, 22 nt, Human
ccuggggucacuugcagccgca

SEQ ID NO: 311301 - RNA, 22 nt, Human
acagagcuuaggaugacuccca

SEQ ID NO: 311302 - RNA, 23 nt, Human
ucacagggcacuggcugggguug

SEQ ID NO: 311303 - RNA, 22 nt, Human
ucuguucauaguaguguauaug

SEQ ID NO: 311304 - RNA, 22 nt, Human
uuaaauauuuucagcaggguca

SEQ ID NO: 311305 - RNA, 22 nt, Human
aucuaagaguuaacaucaagaa

SEQ ID NO: 311306 - RNA, 22 nt, Human
gcagcuuuguggagaggcccau

SEQ ID NO: 311307 - RNA, 22 nt, Human
agggauggaagcucgucugcaa

SEQ ID NO: 311308 - RNA, 18 nt, Human
gccugcaggcacgggggu

SEQ ID NO: 311309 - RNA, 22 nt, Human
gcugcaggcgccugcggucucu

SEQ ID NO: 311310 - RNA, 22 nt, Human
agagugggugaucucuguuguc

SEQ ID NO: 311311 - RNA, 23 nt, Human
uggcuucugccccauucucucca

SEQ ID NO: 311312 - RNA, 22 nt, Human
uggugugggcguggcaggcaag

SEQ ID NO: 311313 - RNA, 22 nt, Human
uuagagucaaaauggcauguua

SEQ ID NO: 311314 - RNA, 22 nt, Human
agugcauugcaucucugcuuca

SEQ ID NO: 311315 - RNA, 22 nt, Human
ugguaaagaaggcuagaucuga

SEQ ID NO: 311316 - RNA, 22 nt, Human
cuaauacucauuucuguaacuc

SEQ ID NO: 311317 - RNA, 22 nt, Human
uggccuggaaccuggcagggac

SEQ ID NO: 311318 - RNA, 22 nt, Human
aauguauaaaguguuaauaacu

SEQ ID NO: 311319 - RNA, 22 nt, Human
ugacaccacaacuagccauuga

SEQ ID NO: 311320 - RNA, 22 nt, Human
aacauuuaugauugagguaaau

SEQ ID NO: 311321 - RNA, 22 nt, Human
cuucccuuggugaacagagcau

SEQ ID NO: 311322 - RNA, 22 nt, Human
cgcugggcgccgaccugcuggc

SEQ ID NO: 311323 - RNA, 22 nt, Human
uccuggccugucuggaguagcu

SEQ ID NO: 311324 - RNA, 22 nt, Human
cuggggcucacuuuggucaggc

SEQ ID NO: 311325 - RNA, 22 nt, Human
gcaggggcuacucugagcuucc

SEQ ID NO: 311326 - RNA, 22 nt, Human
ugcaguggugguaaagaugcuc

SEQ ID NO: 311327 - RNA, 22 nt, Human
ucuucagacuccaaauguuuua

SEQ ID NO: 311328 - RNA, 20 nt, Human
caggcacacucauuccugcu

SEQ ID NO: 311329 - RNA, 22 nt, Human
cuucuucacacuggucugaagc

SEQ ID NO: 311330 - RNA, 22 nt, Human
ucuggcucuuugggugauugua

SEQ ID NO: 311331 - RNA, 22 nt, Human
gcuggagggguaauaggauggg

SEQ ID NO: 311332 - RNA, 22 nt, Human
ggcagggucuggacugaaagcu

SEQ ID NO: 311333 - RNA, 22 nt, Human
uggaggaugccauccaggauac

SEQ ID NO: 311334 - RNA, 22 nt, Human
gagugugggcacgggggccuug

SEQ ID NO: 311335 - RNA, 22 nt, Human
agagcuggggcauaaaugccac

SEQ ID NO: 311336 - RNA, 22 nt, Human
aucuggcuggauucuuagcguu

SEQ ID NO: 311337 - RNA, 22 nt, Human
uacagugucccuuuuucagaca

SEQ ID NO: 311338 - RNA, 22 nt, Human
accucugccaagaugugcuccc

SEQ ID NO: 311339 - RNA, 22 nt, Human
ggcacugggagaggugagacgg

SEQ ID NO: 311340 - RNA, 22 nt, Human
auuuacagaagcauguaauagc

SEQ ID NO: 311341 - RNA, 19 nt, Human
cugcucaggucagucuguc

SEQ ID NO: 311342 - RNA, 22 nt, Human
uaugcacgucuauuuaugaaga

SEQ ID NO: 311343 - RNA, 22 nt, Human
cccaggagauggagguugcagu

SEQ ID NO: 311344 - RNA, 22 nt, Human
augaggcauuccacucaaacuc

SEQ ID NO: 311345 - RNA, 23 nt, Human
caguacuuaguguagcguuaauu

SEQ ID NO: 311346 - RNA, 22 nt, Human
ugaagcuuuccuguggucagga

SEQ ID NO: 311347 - RNA, 21 nt, Human
aggagcuguguuagcuggucg

SEQ ID NO: 311348 - RNA, 22 nt, Human
cuggggugucucgucugccauu

SEQ ID NO: 311349 - RNA, 22 nt, Human
uucaggauucuuucagacuggg

SEQ ID NO: 311350 - RNA, 22 nt, Human
agaaguuguagguuugcauauu

SEQ ID NO: 311351 - RNA, 22 nt, Human
uuucuugaccacuauguugaua

SEQ ID NO: 311352 - RNA, 22 nt, Human
aagaacaacugcuuuaaaagca

SEQ ID NO: 311353 - RNA, 22 nt, Human
gcuguguuugacaguagcagac

SEQ ID NO: 311354 - RNA, 22 nt, Human
ggcuccuggcaucuggugggua

SEQ ID NO: 311355 - RNA, 22 nt, Human
uagaaaagauaacauucugugc

SEQ ID NO: 311356 - RNA, 22 nt, Human
cccagcucaucaggagccgccc

SEQ ID NO: 311357 - RNA, 22 nt, Human
caggugcucccagagaagugcu

SEQ ID NO: 311358 - RNA, 22 nt, Human
gcagcugcaggcaggcuugcug

SEQ ID NO: 311359 - RNA, 22 nt, Human
uaagacaugguugaucuagugu

SEQ ID NO: 311360 - RNA, 22 nt, Human
cauagagugauguaagguaugu

SEQ ID NO: 311361 - RNA, 23 nt, Human
ugccucaguggaaugugagggug

SEQ ID NO: 311362 - RNA, 22 nt, Human
caaagguaguauauauauuguu

SEQ ID NO: 311363 - RNA, 22 nt, Human
cccugggcagucugcacuucag

SEQ ID NO: 311364 - RNA, 22 nt, Human
uggaaauggaucugaugagucu

SEQ ID NO: 311365 - RNA, 22 nt, Human
cacugcuuuaaggcugaguaac

SEQ ID NO: 311366 - RNA, 22 nt, Human
uguuuaagcugaugagguaucg

SEQ ID NO: 311367 - RNA, 23 nt, Human
agggcugaugccauugcagcucu

SEQ ID NO: 311368 - RNA, 22 nt, Human
auaaagaggauguauuuacagc

SEQ ID NO: 311369 - RNA, 22 nt, Human
gugagcagaacagguggcuucu

SEQ ID NO: 311370 - RNA, 22 nt, Human
aaucaguucuacaucuuaucca

SEQ ID NO: 311371 - RNA, 18 nt, Human
ggagagugagaucaaaca

SEQ ID NO: 311372 - RNA, 22 nt, Human
auacauauccacaggagauaaa

SEQ ID NO: 311373 - RNA, 22 nt, Human
gauuuuauuagcccaaacuuug

SEQ ID NO: 311374 - RNA, 22 nt, Human
ugauuaacugucuauuaaucau

SEQ ID NO: 311375 - RNA, 22 nt, Human
gagcagagacaguacaacuggc

SEQ ID NO: 311376 - RNA, 22 nt, Human
aucagugcuaaagcaaaugccc

SEQ ID NO: 311377 - RNA, 22 nt, Human
gauuucuucauuuguggugaau

SEQ ID NO: 311378 - RNA, 22 nt, Human
uggagccagcccaggccccucu

SEQ ID NO: 311379 - RNA, 22 nt, Human
ugcagccaucgcagagucugua

SEQ ID NO: 311380 - RNA, 22 nt, Human
ccagcucucagcgggagacuca

SEQ ID NO: 311381 - RNA, 22 nt, Human
aaguucaaggcagguccugagg

SEQ ID NO: 311382 - RNA, 22 nt, Human
agcucccagaagccagagucgg

SEQ ID NO: 311383 - RNA, 22 nt, Human
ucauugcauuuauucacuggca

SEQ ID NO: 311384 - RNA, 22 nt, Human
ccucaggggucacugugaggag

SEQ ID NO: 311385 - RNA, 22 nt, Human
caguuaaaggcccaauaucugg

SEQ ID NO: 311386 - RNA, 22 nt, Human
ggggcccagcaccccuccucgc

SEQ ID NO: 311387 - RNA, 22 nt, Human
cagcagugaugugugaggguuc

SEQ ID NO: 311388 - RNA, 18 nt, Human
gaggccugagaaccaggu

SEQ ID NO: 311389 - RNA, 22 nt, Human
guugaaagaugucuugguuccc

SEQ ID NO: 311390 - RNA, 22 nt, Human
aauugucaaacacaaauaagag

SEQ ID NO: 311391 - RNA, 22 nt, Human
cucccugggcagauguggcucu

SEQ ID NO: 311392 - RNA, 22 nt, Human
uccagccaugcaugacaaucac

SEQ ID NO: 311393 - RNA, 22 nt, Human
ccugccuggcuuccagaagaga

SEQ ID NO: 311394 - RNA, 19 nt, Human
acccagagcccuuugcagg

SEQ ID NO: 311395 - RNA, 22 nt, Human
auauucguggucaaguaaggcc

SEQ ID NO: 311396 - RNA, 22 nt, Human
gcugccuguggcccuucugggu

SEQ ID NO: 311397 - RNA, 22 nt, Human
uacuuucuguccuucuguuaaa

SEQ ID NO: 311398 - RNA, 22 nt, Human
uccucuggcucuuucccuagga

SEQ ID NO: 311399 - RNA, 22 nt, Human
ugaaaucuucacuaagucucuu

SEQ ID NO: 311400 - RNA, 22 nt, Human
ugggcagaguugugaugaacug

SEQ ID NO: 311401 - RNA, 22 nt, Human
cccaggagagaggccaguuggc

SEQ ID NO: 311402 - RNA, 22 nt, Human
cagcacugcugcuguacacaca

SEQ ID NO: 311403 - RNA, 17 nt, Human
ggcaccagacggagagu

SEQ ID NO: 311404 - RNA, 22 nt, Human
acacauuuacauguuuacguau

SEQ ID NO: 311405 - RNA, 22 nt, Human
ggaugagguagaugaacaaggg

SEQ ID NO: 311406 - RNA, 22 nt, Human
caauacaauuaccaguuaauca

SEQ ID NO: 311407 - RNA, 22 nt, Human
ucugcaucauuuuucagagccg

SEQ ID NO: 311408 - RNA, 22 nt, Human
gcaggcagguggcaucuuguga

SEQ ID NO: 311409 - RNA, 19 nt, Human
cagucccaaauucuuguca

SEQ ID NO: 311410 - RNA, 22 nt, Human
uuacaucuaaacugugaacaau

SEQ ID NO: 311411 - RNA, 22 nt, Human
uauuccuaagucccaacuacau

SEQ ID NO: 311412 - RNA, 22 nt, Human
auuuuuaugacaaaccauccuc

SEQ ID NO: 311413 - RNA, 22 nt, Human
cacagaaguuucauagucucga

SEQ ID NO: 311414 - RNA, 22 nt, Human
gcucccucugcucaggcacuug

SEQ ID NO: 311415 - RNA, 22 nt, Human
cucugagcagaggccguggcua

SEQ ID NO: 311416 - RNA, 19 nt, Human
acauuuaaauucagaucuc

SEQ ID NO: 311417 - RNA, 22 nt, Human
acauugaugaaaagguaucauu

SEQ ID NO: 311418 - RNA, 22 nt, Human
uuacauaacgguaugaaaaaug

SEQ ID NO: 311419 - RNA, 22 nt, Human
uggcagcaaguucuugggaggu

SEQ ID NO: 311420 - RNA, 22 nt, Human
ucaguccucacuugguucuaag

SEQ ID NO: 311421 - RNA, 22 nt, Human
cuguuuauacgacagguggagg

SEQ ID NO: 311422 - RNA, 22 nt, Human
gucaggggccaugggccaagga

SEQ ID NO: 311423 - RNA, 22 nt, Human
acagaauugauggaaaucucag

SEQ ID NO: 311424 - RNA, 22 nt, Human
gcuucccacagcuggacugggg

SEQ ID NO: 311425 - RNA, 22 nt, Human
ggaggggaggauuaaugacaaa

SEQ ID NO: 311426 - RNA, 22 nt, Human
auguaugaugcuaggcucucag

SEQ ID NO: 311427 - RNA, 22 nt, Human
caggcaccccaggugagcacug

SEQ ID NO: 311428 - RNA, 19 nt, Human
auauauguauacaaugugg

SEQ ID NO: 311429 - RNA, 22 nt, Human
augguguagcaugugauaugac

SEQ ID NO: 311430 - RNA, 23 nt, Human
uccugaggaauggcaucucacau

SEQ ID NO: 311431 - RNA, 22 nt, Human
uacagauacagaucuagauaca

SEQ ID NO: 311432 - RNA, 22 nt, Human
accucaguucaauucaguuaga

SEQ ID NO: 311433 - RNA, 22 nt, Human
gcccagucucuucuggcccugu

SEQ ID NO: 311434 - RNA, 22 nt, Human
aagauacauaaagguagagucu

SEQ ID NO: 311435 - RNA, 22 nt, Human
gcagcuggcccugacacgcaga

SEQ ID NO: 311436 - RNA, 23 nt, Human
uccagggauuaaugaagucaguc

SEQ ID NO: 311437 - RNA, 22 nt, Human
uaugaccuuaggaagcaagaag

SEQ ID NO: 311438 - RNA, 22 nt, Human
gcaucuaauccaguccagcauc

SEQ ID NO: 311439 - RNA, 22 nt, Human
gggccagagcuuggcagcuggg

SEQ ID NO: 311440 - RNA, 22 nt, Human
cugaggcaugaaugugggcuuu

SEQ ID NO: 311441 - RNA, 22 nt, Human
uggcagagcaaaaagauagaau

SEQ ID NO: 311442 - RNA, 22 nt, Human
cugccuuugcccuugacacugu

SEQ ID NO: 311443 - RNA, 22 nt, Human
accacugcccauggugaaaacu

SEQ ID NO: 311444 - RNA, 22 nt, Human
aaggcccuaauagagcacauau

SEQ ID NO: 311445 - RNA, 22 nt, Human
gucagagagggcacgugcacac

SEQ ID NO: 311446 - RNA, 22 nt, Human
aaacugcugguugcuggccagc

SEQ ID NO: 311447 - RNA, 22 nt, Human
agcauggggcuccgcaaugaac

SEQ ID NO: 311448 - RNA, 22 nt, Human
uguucagagacagaaauucuaa

SEQ ID NO: 311449 - RNA, 22 nt, Human
agaagccagcuucagcugcccg

SEQ ID NO: 311450 - RNA, 20 nt, Human
auacacauucauagaaaaau

SEQ ID NO: 311451 - RNA, 22 nt, Human
gaaauguguuguucauuucuaa

SEQ ID NO: 311452 - RNA, 22 nt, Human
uggcuuccugcacagugucugc

SEQ ID NO: 311453 - RNA, 22 nt, Human
agucucugucguagaucagcgu

SEQ ID NO: 311454 - RNA, 22 nt, Human
cuggagccggaccagggacggu

SEQ ID NO: 311455 - RNA, 22 nt, Human
ccagcucccugaagccuggucu

SEQ ID NO: 311456 - RNA, 22 nt, Human
ugaagacacauacaagggaaug

SEQ ID NO: 311457 - RNA, 23 nt, Human
guggagccacaucacaggcuccu

SEQ ID NO: 311458 - RNA, 22 nt, Human
gcugucaggaacaugccuuggu

SEQ ID NO: 311459 - RNA, 22 nt, Human
ccugccugcaaaaugggacaag

SEQ ID NO: 311460 - RNA, 22 nt, Human
ugaaaugauaucugauaacaaa

SEQ ID NO: 311461 - RNA, 23 nt, Human
cccuggagcuagucugagcagag

SEQ ID NO: 311462 - RNA, 22 nt, Human
uuugaagagccacagugaaauu

SEQ ID NO: 311463 - RNA, 22 nt, Human
acagccagaggagccaggcugg

SEQ ID NO: 311464 - RNA, 22 nt, Human
gggugcaggcagcccaggcagg

SEQ ID NO: 311465 - RNA, 22 nt, Human
aggccagacagcuagaaacagg

SEQ ID NO: 311466 - RNA, 20 nt, Human
aggaagccaaaggcugucuu

SEQ ID NO: 311467 - RNA, 22 nt, Human
uguaugugcuugagaagguggg

SEQ ID NO: 311468 - RNA, 22 nt, Human
uccucaguauuguggagcagau

SEQ ID NO: 311469 - RNA, 22 nt, Human
uggcagcuuccugcucauagga

SEQ ID NO: 311470 - RNA, 22 nt, Human
caggccucuauggucagcugag

SEQ ID NO: 311471 - RNA, 21 nt, Human
gcaggggauagaaauggucug

SEQ ID NO: 311472 - RNA, 21 nt, Human
ugauuuccagaaaauuggccc

SEQ ID NO: 311473 - RNA, 22 nt, Human
cugcuguguaucauuuuagaug

SEQ ID NO: 311474 - RNA, 22 nt, Human
agucacuguucugucaugucaa

SEQ ID NO: 311475 - RNA, 22 nt, Human
aagcugcccuguguuagaguuc

SEQ ID NO: 311476 - RNA, 22 nt, Human
uggcgugcccuccagacuuggc

SEQ ID NO: 311477 - RNA, 22 nt, Human
uagaaucuaguucauucauuug

SEQ ID NO: 311478 - RNA, 22 nt, Human
uuagauaacaguagaauaucaa

SEQ ID NO: 311479 - RNA, 22 nt, Human
ggcagcaguccauggcccaagg

SEQ ID NO: 311480 - RNA, 22 nt, Human
gugggagcuuuggcaucaggcu

SEQ ID NO: 311481 - RNA, 23 nt, Human
ugcuguccaacagacuggccaug

SEQ ID NO: 311482 - RNA, 22 nt, Human
caugccaguuuugagaugcacc

SEQ ID NO: 311483 - RNA, 22 nt, Human
acagagguguuccagaccuagg

SEQ ID NO: 311484 - RNA, 20 nt, Human
ugcuggggacauacagggug

SEQ ID NO: 311485 - RNA, 20 nt, Human
cagagccaagagcagcaucu

SEQ ID NO: 311486 - RNA, 21 nt, Human
uaugaacaugaccaauagucc

SEQ ID NO: 311487 - RNA, 22 nt, Human
gaaggaaaacagaucugccuga

SEQ ID NO: 311488 - RNA, 22 nt, Human
aaagagccagcuaccucaguuu

SEQ ID NO: 311489 - RNA, 22 nt, Human
aaggcagagggcuggaucagag

SEQ ID NO: 311490 - RNA, 18 nt, Human
uggagccagcucuaggau

SEQ ID NO: 311491 - RNA, 22 nt, Human
ggcuuccuggagaaggucugag

SEQ ID NO: 311492 - RNA, 22 nt, Human
ugggcugcugcggugcucuugg

SEQ ID NO: 311493 - RNA, 22 nt, Human
ugucaccaguuccaggaaauaa

SEQ ID NO: 311494 - RNA, 21 nt, Human
ucuccaguauccuucucugag

SEQ ID NO: 311495 - RNA, 22 nt, Human
acuccuggggauccauuccuuu

SEQ ID NO: 311496 - RNA, 22 nt, Human
aauguugagcuugaaaguaggu

SEQ ID NO: 311497 - RNA, 22 nt, Human
cucaagacugaucgcaguggaa

SEQ ID NO: 311498 - RNA, 22 nt, Human
ccugugugucugucacugcaca

SEQ ID NO: 311499 - RNA, 22 nt, Human
gcagggcuauuggaaggagaug

SEQ ID NO: 311500 - RNA, 22 nt, Human
aggcugcagugcagguaggauu

SEQ ID NO: 311501 - RNA, 22 nt, Human
cagagccagcccacuguucccg

SEQ ID NO: 311502 - RNA, 22 nt, Human
ucugucugcgcuugcccuggug

SEQ ID NO: 311503 - RNA, 22 nt, Human
uuucaaaccuacuuguauguuu

SEQ ID NO: 311504 - RNA, 22 nt, Human
ucugagagcuguagaagccuau

SEQ ID NO: 311505 - RNA, 22 nt, Human
ucauucagguugggcaaguguc

SEQ ID NO: 311506 - RNA, 22 nt, Human
caaugugucaggaaaagggcca

SEQ ID NO: 311507 - RNA, 19 nt, Human
gugcuuuuuaagagcucag

SEQ ID NO: 311508 - RNA, 22 nt, Human
acauuuagcuguacaaucuaug

SEQ ID NO: 311509 - RNA, 22 nt, Human
cuuauuauaaaauccuguuuga

SEQ ID NO: 311510 - RNA, 22 nt, Human
cuguccuaugaguacucacuag

SEQ ID NO: 311511 - RNA, 22 nt, Human
auuauugugauaggugucagug

SEQ ID NO: 311512 - RNA, 22 nt, Human
ucagagaacacagaggugaugu

SEQ ID NO: 311513 - RNA, 22 nt, Human
ggaaggagggcggcaaugauga

SEQ ID NO: 311514 - RNA, 22 nt, Human
acauguguauagccuguauaga

SEQ ID NO: 311515 - RNA, 22 nt, Human
aaauuucaguuggaaugagcuc

SEQ ID NO: 311516 - RNA, 23 nt, Human
cagugcugguucugccugugggg

SEQ ID NO: 311517 - RNA, 22 nt, Human
gugguaauuuaauccuacacug

SEQ ID NO: 311518 - RNA, 22 nt, Human
ugucaaagccugaaucacauag

SEQ ID NO: 311519 - RNA, 22 nt, Human
uacagucuuuggaaagagauag

SEQ ID NO: 311520 - RNA, 19 nt, Human
uggcugggugccaauggcc

SEQ ID NO: 311521 - RNA, 22 nt, Human
auuguacaugcagugagucauc

SEQ ID NO: 311522 - RNA, 22 nt, Human
auucaguuaaaaacuguacuuc

SEQ ID NO: 311523 - RNA, 22 nt, Human
augauguugauaaauuacuuua

SEQ ID NO: 311524 - RNA, 22 nt, Human
acuugcugguggcauuuacagu

SEQ ID NO: 311525 - RNA, 22 nt, Human
gugggcuucuguuagggaggcu

SEQ ID NO: 311526 - RNA, 22 nt, Human
aaaaagguugauccagauuagg

SEQ ID NO: 311527 - RNA, 22 nt, Human
acaguguuauuucugaguaaug

SEQ ID NO: 311528 - RNA, 22 nt, Human
uaaaugugucuauggacccgcc

SEQ ID NO: 311529 - RNA, 22 nt, Human
cugggaggugcagcaaaaauca

SEQ ID NO: 311530 - RNA, 22 nt, Human
aguggggaagagcaugggcccu

SEQ ID NO: 311531 - RNA, 19 nt, Human
aggagaaguagcagaaauu

SEQ ID NO: 311532 - RNA, 22 nt, Human
ccugucuggaacauggccuguu

SEQ ID NO: 311533 - RNA, 22 nt, Human
ccaggaaugaaauguagauaaa

SEQ ID NO: 311534 - RNA, 22 nt, Human
augcacagacccaaaggccauc

SEQ ID NO: 311535 - RNA, 22 nt, Human
agggagaaaauuggaugcacaa

SEQ ID NO: 311536 - RNA, 21 nt, Human
acaggcucuggggaugcuggg

SEQ ID NO: 311537 - RNA, 22 nt, Human
uuucauaauagugcaguuuguu

SEQ ID NO: 311538 - RNA, 22 nt, Human
cugcucugugguccaugagaca

SEQ ID NO: 311539 - RNA, 22 nt, Human
cagggccucauccucagagauu

SEQ ID NO: 311540 - RNA, 22 nt, Human
uaaaagcucuucuguugaguua

SEQ ID NO: 311541 - RNA, 22 nt, Human
aagggcagcuauuaucgucauc

SEQ ID NO: 311542 - RNA, 22 nt, Human
cuacauuaaauuggcuuacuua

SEQ ID NO: 311543 - RNA, 22 nt, Human
uuuccuugccuccuguccuucu

SEQ ID NO: 311544 - RNA, 22 nt, Human
auuguauaacagcauguauuuu

SEQ ID NO: 311545 - RNA, 22 nt, Human
cuggagccugcaguuuucacuu

SEQ ID NO: 311546 - RNA, 22 nt, Human
uuaaauuccagccucauaauag

SEQ ID NO: 311547 - RNA, 22 nt, Human
aggccucuucagggagcaugga

SEQ ID NO: 311548 - RNA, 22 nt, Human
ucugauuagcaguuuagggaaa

SEQ ID NO: 311549 - RNA, 23 nt, Human
acauuacuuagccagagucucag

SEQ ID NO: 311550 - RNA, 22 nt, Human
auagaacagaaacagaugcaca

SEQ ID NO: 311551 - RNA, 22 nt, Human
uaacagaaauagaaaugagagu

SEQ ID NO: 311552 - RNA, 22 nt, Human
agugcuuuauguuguugugcaa

SEQ ID NO: 311553 - RNA, 22 nt, Human
uugcugaaaucuaugacauccu

SEQ ID NO: 311554 - RNA, 22 nt, Human
gcuggccuuugaggaagcugcg

SEQ ID NO: 311555 - RNA, 22 nt, Human
agauauguuuguauauauuugu

SEQ ID NO: 311556 - RNA, 21 nt, Human
ugugucacuaacuagaggcua

SEQ ID NO: 311557 - RNA, 22 nt, Human
cuucucagcauuuugucagucu

SEQ ID NO: 311558 - RNA, 22 nt, Human
uguccucacaggaaugaacuuu

SEQ ID NO: 311559 - RNA, 22 nt, Human
ccagcucuuuuggcugagugag

SEQ ID NO: 311560 - RNA, 22 nt, Human
ucaaaugcugccuuugugugcc

SEQ ID NO: 311561 - RNA, 22 nt, Human
cucugggcacauuuuccaggac

SEQ ID NO: 311562 - RNA, 22 nt, Human
uagaaauaaaucugcagcuggg

SEQ ID NO: 311563 - RNA, 22 nt, Human
acuugaauuauauuucuagaga

SEQ ID NO: 311564 - RNA, 22 nt, Human
aaguucuuucuggaaggucugc

SEQ ID NO: 311565 - RNA, 22 nt, Human
gugcuuccccaagccacagccu

SEQ ID NO: 311566 - RNA, 22 nt, Human
ccacagggccuuuccugcuggc

SEQ ID NO: 311567 - RNA, 22 nt, Human
gugggaugcaguggugaguggc

SEQ ID NO: 311568 - RNA, 22 nt, Human
uuucaaauggagucgugaaaug

SEQ ID NO: 311569 - RNA, 22 nt, Human
ccagggugaccagcuggccuag

SEQ ID NO: 311570 - RNA, 22 nt, Human
ggcuucuccagguacugagcau

SEQ ID NO: 311571 - RNA, 22 nt, Human
cucccuggaggcccagaccugg

SEQ ID NO: 311572 - RNA, 22 nt, Human
uccuucaagaugccacagcuuu

SEQ ID NO: 311573 - RNA, 22 nt, Human
ucucagagaucuuucugcaugu

SEQ ID NO: 311574 - RNA, 22 nt, Human
ugaaagcagcaccaauaccauu

SEQ ID NO: 311575 - RNA, 22 nt, Human
cuugccuucuuuuccuauagaa

SEQ ID NO: 311576 - RNA, 22 nt, Human
gagcugggauucaucuaugucu

SEQ ID NO: 311577 - RNA, 22 nt, Human
ugucucugugagaucugacgau

SEQ ID NO: 311578 - RNA, 22 nt, Human
cugcuuugauuagaagaguaca

SEQ ID NO: 311579 - RNA, 22 nt, Human
cugagcugcggcaggcaccugg

SEQ ID NO: 311580 - RNA, 22 nt, Human
ccagcagaggggcggagugcag

SEQ ID NO: 311581 - RNA, 22 nt, Human
cuggccgguauuugccucuggg

SEQ ID NO: 311582 - RNA, 22 nt, Human
ucugccuucgcugcucccugaa

SEQ ID NO: 311583 - RNA, 22 nt, Human
ucuuugcaggagcccuuugaac

SEQ ID NO: 311584 - RNA, 22 nt, Human
aaaugcaauuguauguacucca

SEQ ID NO: 311585 - RNA, 22 nt, Human
uuugacauuauccuguuacugg

SEQ ID NO: 311586 - RNA, 20 nt, Human
cguaaggcaagugcugcauc

SEQ ID NO: 311587 - RNA, 22 nt, Human
gaagcccauuuguacagcacau

SEQ ID NO: 311588 - RNA, 22 nt, Human
ccagcuucucucugaugcagcu

SEQ ID NO: 311589 - RNA, 22 nt, Human
aggcucaggcaggaauggcgga

SEQ ID NO: 311590 - RNA, 22 nt, Human
ccucaggguggcaucagaucuu

SEQ ID NO: 311591 - RNA, 22 nt, Human
caggguggcacucagcgcaucu

SEQ ID NO: 311592 - RNA, 21 nt, Human
ugguggagugugcugagcaug

SEQ ID NO: 311593 - RNA, 22 nt, Human
ugcaccauguaaguggccacgu

SEQ ID NO: 311594 - RNA, 22 nt, Human
cagcucuggggcagagugacua

SEQ ID NO: 311595 - RNA, 22 nt, Human
guucacauccuugugaggauuu

SEQ ID NO: 311596 - RNA, 22 nt, Human
uggccuggcugcccugucugga

SEQ ID NO: 311597 - RNA, 22 nt, Human
aaaugcuacauacacaucaggg

SEQ ID NO: 311598 - RNA, 22 nt, Human
cuaaucaucuuucucuuaaagc

SEQ ID NO: 311599 - RNA, 22 nt, Human
uacuuccuguuuccaugucugu

SEQ ID NO: 311600 - RNA, 22 nt, Human
gagcagggagacaacucuggug

SEQ ID NO: 311601 - RNA, 19 nt, Human
agcuccugggcucugggcc

SEQ ID NO: 311602 - RNA, 22 nt, Human
cagguggguacaucacagagac

SEQ ID NO: 311603 - RNA, 22 nt, Human
agugaaaacacuaguucuugcc

SEQ ID NO: 311604 - RNA, 22 nt, Human
uucaaaugcaaguuacuacuuu

SEQ ID NO: 311605 - RNA, 22 nt, Human
gggcacugcuuugcucugucac

SEQ ID NO: 311606 - RNA, 22 nt, Human
gcagagccaggagagacccuug

SEQ ID NO: 311607 - RNA, 22 nt, Human
uggaagcuguggcauaacugag

SEQ ID NO: 311608 - RNA, 22 nt, Human
uggcucagccauucguguugcc

SEQ ID NO: 311609 - RNA, 17 nt, Human
accagccucuccugggg

SEQ ID NO: 311610 - RNA, 22 nt, Human
cugggcugugguguggcccaaa

SEQ ID NO: 311611 - RNA, 22 nt, Human
gcccaugguuacuuuucuggcu

SEQ ID NO: 311612 - RNA, 22 nt, Human
uaauuucuagggacuaaggugc

SEQ ID NO: 311613 - RNA, 22 nt, Human
aaguuugagagccuuuaguaua

SEQ ID NO: 311614 - RNA, 22 nt, Human
cugcaggcccccuuccuggagu

SEQ ID NO: 311615 - RNA, 22 nt, Human
ugguggggucaucgucagaugc

SEQ ID NO: 311616 - RNA, 19 nt, Human
uguuggugcggauguggag

SEQ ID NO: 311617 - RNA, 23 nt, Human
uuuuccuuuggacaggcuguauu

SEQ ID NO: 311618 - RNA, 22 nt, Human
cucucagugccacacagccauu

SEQ ID NO: 311619 - RNA, 20 nt, Human
ucacauccucucccaacaug

SEQ ID NO: 311620 - RNA, 22 nt, Human
caaauagugucacauugugagg

SEQ ID NO: 311621 - RNA, 21 nt, Human
cugguguagcacucaggugcu

SEQ ID NO: 311622 - RNA, 22 nt, Human
ugcauguuaagaaaauauugag

SEQ ID NO: 311623 - RNA, 22 nt, Human
ugugcuucuugcagcuccugua

SEQ ID NO: 311624 - RNA, 22 nt, Human
uggugguuaugcgcuuuguggg

SEQ ID NO: 311625 - RNA, 22 nt, Human
caggccuggcugcagcucgccu

SEQ ID NO: 311626 - RNA, 22 nt, Human
ucacauacacuaggauauuuuu

SEQ ID NO: 311627 - RNA, 22 nt, Human
cuguuuuugugcugugucuccc

SEQ ID NO: 311628 - RNA, 22 nt, Human
auuugcuuaucuccacaguugu

SEQ ID NO: 311629 - RNA, 22 nt, Human
ucaguguccggagccugagugc

SEQ ID NO: 311630 - RNA, 22 nt, Human
ccaccaggacagcccugagggg

SEQ ID NO: 311631 - RNA, 22 nt, Human
cccagcucuggaagguggggga

SEQ ID NO: 311632 - RNA, 22 nt, Human
auccaggguguggagagagcuc

SEQ ID NO: 311633 - RNA, 22 nt, Human
uugauguacagaauuguucaca

SEQ ID NO: 311634 - RNA, 22 nt, Human
cagccagcuggcacugugagua

SEQ ID NO: 311635 - RNA, 22 nt, Human
gcagaagcugggcagcgaggug

SEQ ID NO: 311636 - RNA, 22 nt, Human
aguuuagaguucaaauuaguuc

SEQ ID NO: 311637 - RNA, 22 nt, Human
gaaggcaggcuucugauuaggu

SEQ ID NO: 311638 - RNA, 22 nt, Human
cacacaugaaucccuaguaccu

SEQ ID NO: 311639 - RNA, 22 nt, Human
gaaaauguuuguccggagcuga

SEQ ID NO: 311640 - RNA, 22 nt, Human
uacaugucuacaugcauuuuug

SEQ ID NO: 311641 - RNA, 22 nt, Human
acauuucuggaguuucucaaca

SEQ ID NO: 311642 - RNA, 22 nt, Human
gcagcaggagaguuuguccugc

SEQ ID NO: 311643 - RNA, 17 nt, Human
cugcuuugugcaacgcu

SEQ ID NO: 311644 - RNA, 22 nt, Human
gaaggucaccuccccucucugg

SEQ ID NO: 311645 - RNA, 22 nt, Human
cuucuugcugggggccucagug

SEQ ID NO: 311646 - RNA, 20 nt, Human
gagccuuccccucaccacug

SEQ ID NO: 311647 - RNA, 18 nt, Human
aggccagcccugcuacug

SEQ ID NO: 311648 - RNA, 22 nt, Human
auaguacacauccuacaauguu

SEQ ID NO: 311649 - RNA, 22 nt, Human
uagauuucucauucauagauug

SEQ ID NO: 311650 - RNA, 20 nt, Human
uggagcuguaaucuugucug

SEQ ID NO: 311651 - RNA, 22 nt, Human
uugaaggacauccuauuucuag

SEQ ID NO: 311652 - RNA, 21 nt, Human
aagcaggacauaugaugcccu

SEQ ID NO: 311653 - RNA, 22 nt, Human
gcagagcuucuguccuucagga

SEQ ID NO: 311654 - RNA, 22 nt, Human
guccucuggugaaagcauuccc

SEQ ID NO: 311655 - RNA, 20 nt, Human
augcaaacucacaaaauacc

SEQ ID NO: 311656 - RNA, 22 nt, Human
ucugcucugggccagcuauuaa

SEQ ID NO: 311657 - RNA, 22 nt, Human
aagcagaauuucccacuaguug

SEQ ID NO: 311658 - RNA, 22 nt, Human
ccaagggcugcugaggugucca

SEQ ID NO: 311659 - RNA, 22 nt, Human
ggagucaggagcaggcugggcu

SEQ ID NO: 311660 - RNA, 22 nt, Human
gagagcugauagaugagcuacu

SEQ ID NO: 311661 - RNA, 22 nt, Human
cccuggaggcggauguugcagu

SEQ ID NO: 311662 - RNA, 22 nt, Human
uccaguggagugugggggugaa

SEQ ID NO: 311663 - RNA, 22 nt, Human
acuuuuuacaggguguauacca

SEQ ID NO: 311664 - RNA, 22 nt, Human
aaggcagcccuggcucagccug

SEQ ID NO: 311665 - RNA, 22 nt, Human
ucacagcaaaagugugcagagc

SEQ ID NO: 311666 - RNA, 19 nt, Human
agagaccacagagcugccu

SEQ ID NO: 311667 - RNA, 20 nt, Human
cagagaccugucuucacaga

SEQ ID NO: 311668 - RNA, 23 nt, Human
ggucccaguggagaggccucacc

SEQ ID NO: 311669 - RNA, 22 nt, Human
aaauuaguacauugcaaagucc

SEQ ID NO: 311670 - RNA, 22 nt, Human
auggaaauaucuuuagagcuua

SEQ ID NO: 311671 - RNA, 22 nt, Human
gucauauacacugcauguaauc

SEQ ID NO: 311672 - RNA, 22 nt, Human
augcaguagauaggcacuuuua

SEQ ID NO: 311673 - RNA, 21 nt, Human
ucacaugcccauuacuggagc

SEQ ID NO: 311674 - RNA, 22 nt, Human
uacauaguuccauuuacaggaa

SEQ ID NO: 311675 - RNA, 22 nt, Human
cagcuccccaugguuccugaag

SEQ ID NO: 311676 - RNA, 22 nt, Human
cuagaauugcauucuaugaaua

SEQ ID NO: 311677 - RNA, 22 nt, Human
uaaaugcagauuccugagccua

SEQ ID NO: 311678 - RNA, 18 nt, Human
uccagagguguuggagcc

SEQ ID NO: 311679 - RNA, 22 nt, Human
augaugaagaguaacaggcuga

SEQ ID NO: 311680 - RNA, 22 nt, Human
gccaggcuccccggaucccugg

SEQ ID NO: 311681 - RNA, 22 nt, Human
cacugaagccugggaguaagac

SEQ ID NO: 311682 - RNA, 22 nt, Human
uuucuguagugugguauguagg

SEQ ID NO: 311683 - RNA, 22 nt, Human
uuggaaagauuauuauuaugaa

SEQ ID NO: 311684 - RNA, 22 nt, Human
aggcacuguacuagguacaggg

SEQ ID NO: 311685 - RNA, 22 nt, Human
gggaguggguuuggccuaggcc

SEQ ID NO: 311686 - RNA, 22 nt, Human
uggagcuggaauuucugggccu

SEQ ID NO: 311687 - RNA, 22 nt, Human
gcagugugaccgagcuugcuuc

SEQ ID NO: 311688 - RNA, 22 nt, Human
uccugagggcucggggcucaug

SEQ ID NO: 311689 - RNA, 22 nt, Human
ugagguaggugguaagagauac

SEQ ID NO: 311690 - RNA, 22 nt, Human
ugggggugugccagggaccucc

SEQ ID NO: 311691 - RNA, 22 nt, Human
aaaaugcaugagaaugugcucg

SEQ ID NO: 311692 - RNA, 22 nt, Human
cucuucaauagauuguugaggg

SEQ ID NO: 311693 - RNA, 22 nt, Human
cugggauccacgggcucccaag

SEQ ID NO: 311694 - RNA, 22 nt, Human
cccagacuccucuggcuggugg

SEQ ID NO: 311695 - RNA, 21 nt, Human
uccuccuccacuaggcuagcc

SEQ ID NO: 311696 - RNA, 22 nt, Human
acagguggcauaggcaguuuga

SEQ ID NO: 311697 - RNA, 22 nt, Human
gccaggcugcuggcugcugucc

SEQ ID NO: 311698 - RNA, 19 nt, Human
agugucaucagcuacucag

SEQ ID NO: 311699 - RNA, 22 nt, Human
ccuguggcacaugcagggauuc

SEQ ID NO: 311700 - RNA, 22 nt, Human
auaugugugaugcauggacuaa

SEQ ID NO: 311701 - RNA, 22 nt, Human
gcagagccugggggucugcgga

SEQ ID NO: 311702 - RNA, 22 nt, Human
uaacacauagauauuuuaacuu

SEQ ID NO: 311703 - RNA, 22 nt, Human
agagaaaugauuccugggcaga

SEQ ID NO: 311704 - RNA, 22 nt, Human
ggcucaggaugagccuucucau

SEQ ID NO: 311705 - RNA, 22 nt, Human
uaagauaugguaggaaguuugg

SEQ ID NO: 311706 - RNA, 22 nt, Human
augagcugggccauccagugau

SEQ ID NO: 311707 - RNA, 22 nt, Human
ucugggagauccaagcagaacu

SEQ ID NO: 311708 - RNA, 22 nt, Human
cgaugguucuggcugcuuguau

SEQ ID NO: 311709 - RNA, 22 nt, Human
ccagagcuucggggcggcugua

SEQ ID NO: 311710 - RNA, 21 nt, Human
uccauuguuuucccaggguuu

SEQ ID NO: 311711 - RNA, 22 nt, Human
uguuaucugagcaacgucgacg

SEQ ID NO: 311712 - RNA, 22 nt, Human
uauuuuaaagugaagggucuug

SEQ ID NO: 311713 - RNA, 22 nt, Human
gaggcucagagggagcaugguc

SEQ ID NO: 311714 - RNA, 22 nt, Human
ucuucaaaaaauauccaucagu

SEQ ID NO: 311715 - RNA, 22 nt, Human
gcugucugagaacaugguggaa

SEQ ID NO: 311716 - RNA, 22 nt, Human
cagugcagaggccagggaggau

SEQ ID NO: 311717 - RNA, 22 nt, Human
ccaaggaggccccaggucagcu

SEQ ID NO: 311718 - RNA, 22 nt, Human
gcacugaaugcuuuuacuguaa

SEQ ID NO: 311719 - RNA, 22 nt, Human
cugcccugugaggguccuuggg

SEQ ID NO: 311720 - RNA, 22 nt, Human
gccagggagucugggccacaga

SEQ ID NO: 311721 - RNA, 22 nt, Human
ucagagaguuacacaaauuguu

SEQ ID NO: 311722 - RNA, 22 nt, Human
ugagcagaguuguuucuccuga

SEQ ID NO: 311723 - RNA, 22 nt, Human
ggcuucccaaggagccaggaug

SEQ ID NO: 311724 - RNA, 22 nt, Human
agguggggaaaccagcgauccc

SEQ ID NO: 311725 - RNA, 20 nt, Human
ggagagcagggaagacagua

SEQ ID NO: 311726 - RNA, 20 nt, Human
aggaacuggaagggaggaaa

SEQ ID NO: 311727 - RNA, 22 nt, Human
cagcucugguccagggagggca

SEQ ID NO: 311728 - RNA, 22 nt, Human
aucaguuuggaacauucaggcc

SEQ ID NO: 311729 - RNA, 22 nt, Human
ugcuagaauaccuaccuggagg

SEQ ID NO: 311730 - RNA, 22 nt, Human
ucaggggcccuucccucagcag

SEQ ID NO: 311731 - RNA, 22 nt, Human
caaugaaaauuuaaguugcagc

SEQ ID NO: 311732 - RNA, 22 nt, Human
acugagcugcaagucagggagg

SEQ ID NO: 311733 - RNA, 22 nt, Human
agggcuggagccacagcuggga

SEQ ID NO: 311734 - RNA, 22 nt, Human
aucuucucauguguaaugaggu

SEQ ID NO: 311735 - RNA, 22 nt, Human
uaaaacuuaacuauccagauua

SEQ ID NO: 311736 - RNA, 18 nt, Human
caugucugcgccacaagg

SEQ ID NO: 311737 - RNA, 23 nt, Human
cucugcaggagagugggcagggc

SEQ ID NO: 311738 - RNA, 22 nt, Human
agcagcugccagagagaguucc

SEQ ID NO: 311739 - RNA, 22 nt, Human
cuucaggauuuaggaagaugaa

SEQ ID NO: 311740 - RNA, 22 nt, Human
gagccaaggguugccauggaga

SEQ ID NO: 311741 - RNA, 22 nt, Human
aaggcacucagccuugggacag

SEQ ID NO: 311742 - RNA, 22 nt, Human
gcugucacucuccggccuuccc

SEQ ID NO: 311743 - RNA, 22 nt, Human
uggcucaggauaauuuucccaa

SEQ ID NO: 311744 - RNA, 22 nt, Human
ccuggcacgaagggcugagguu

SEQ ID NO: 311745 - RNA, 22 nt, Human
uugucugucccagcuugugcau

SEQ ID NO: 311746 - RNA, 22 nt, Human
aaaguguugggauuacaggugu

SEQ ID NO: 311747 - RNA, 22 nt, Human
cugggggucuugaaagggagag

SEQ ID NO: 311748 - RNA, 22 nt, Human
guggaaugaauagauuugcauu

SEQ ID NO: 311749 - RNA, 22 nt, Human
uucagugucaauuuuuaaauau

SEQ ID NO: 311750 - RNA, 22 nt, Human
uuuauuguuguuagucauaagu

SEQ ID NO: 311751 - RNA, 22 nt, Human
uauaauguuuuccauggacuga

SEQ ID NO: 311752 - RNA, 22 nt, Human
aaggcacuguacuaguuaguua

SEQ ID NO: 311753 - RNA, 22 nt, Human
ggcacucagagauucaggcugu

SEQ ID NO: 311754 - RNA, 22 nt, Human
aggcuggcuggcaggggacaca

SEQ ID NO: 311755 - RNA, 22 nt, Human
gaaggagacccugaagaugcug

SEQ ID NO: 311756 - RNA, 22 nt, Human
aaaggaagauugagcuuuucca

SEQ ID NO: 311757 - RNA, 22 nt, Human
aaaacuaaauacgcuuugccuc

SEQ ID NO: 311758 - RNA, 22 nt, Human
ucagaggguggcugggagcauc

SEQ ID NO: 311759 - RNA, 22 nt, Human
gugcagggagcccagaaggucc

SEQ ID NO: 311760 - RNA, 22 nt, Human
gcucagugguauucggaaacug

SEQ ID NO: 311761 - RNA, 22 nt, Human
uggcucaggcuugaaaauagau

SEQ ID NO: 311762 - RNA, 22 nt, Human
aaaucucaauuugaauuguagc

SEQ ID NO: 311763 - RNA, 22 nt, Human
gccucugcucucagguagccuc

SEQ ID NO: 311764 - RNA, 22 nt, Human
uauuaguagcuugaaauuggug

SEQ ID NO: 311765 - RNA, 22 nt, Human
gcccugugccagucacgcugug

SEQ ID NO: 311766 - RNA, 22 nt, Human
uuccauuuauucuuguccagau

SEQ ID NO: 311767 - RNA, 22 nt, Human
uggcccugucccuggagccugg

SEQ ID NO: 311768 - RNA, 22 nt, Human
uguagcacagagcuuugacacu

SEQ ID NO: 311769 - RNA, 22 nt, Human
uaugagaagguauggugacuug

SEQ ID NO: 311770 - RNA, 22 nt, Human
gggagagagagcucauguugaa

SEQ ID NO: 311771 - RNA, 22 nt, Human
ccagcccuccuccaucagagga

SEQ ID NO: 311772 - RNA, 22 nt, Human
ccuggaaggugaugguacagca

SEQ ID NO: 311773 - RNA, 22 nt, Human
cauaaguuggguaauauaauga

SEQ ID NO: 311774 - RNA, 22 nt, Human
caggaggaacaagagguucugg

SEQ ID NO: 311775 - RNA, 22 nt, Human
accugagaaugggggcaugugu

SEQ ID NO: 311776 - RNA, 22 nt, Human
acauacauauguuuaaaugcau

SEQ ID NO: 311777 - RNA, 22 nt, Human
caguucuuuguggggaguucuc

SEQ ID NO: 311778 - RNA, 22 nt, Human
caggguagacaguaggugucug

SEQ ID NO: 311779 - RNA, 22 nt, Human
gcaguguuacuuggaguacuaa

SEQ ID NO: 311780 - RNA, 22 nt, Human
gucaaauauacuaagagguaaa

SEQ ID NO: 311781 - RNA, 22 nt, Human
gcccucagaugggaaaggaggg

SEQ ID NO: 311782 - RNA, 20 nt, Human
cagcugccuggcucugggau

SEQ ID NO: 311783 - RNA, 22 nt, Human
ucucagugcagagaggcuaucu

SEQ ID NO: 311784 - RNA, 22 nt, Human
uuacuuugaugaucaaugagcg

SEQ ID NO: 311785 - RNA, 22 nt, Human
cuggcagcccaaccuagagucu

SEQ ID NO: 311786 - RNA, 23 nt, Human
uggcagcuguguaagagaaagca

SEQ ID NO: 311787 - RNA, 22 nt, Human
uugcauuuuuagaugcuucugu

SEQ ID NO: 311788 - RNA, 22 nt, Human
acagcaagccagcuugucacug

SEQ ID NO: 311789 - RNA, 22 nt, Human
agaaugcauuuuguguagcuau

SEQ ID NO: 311790 - RNA, 22 nt, Human
cugcaucacagcaggaggcaca

SEQ ID NO: 311791 - RNA, 22 nt, Human
augcuuuuccaggagaaauaua

SEQ ID NO: 311792 - RNA, 22 nt, Human
agcaugaaagcauaggacaguc

SEQ ID NO: 311793 - RNA, 22 nt, Human
acugggaggcaaagagcaagga

SEQ ID NO: 311794 - RNA, 22 nt, Human
ccagccaggcauugcaaacuga

SEQ ID NO: 311795 - RNA, 22 nt, Human
uucaaugagcccaagaacguga

SEQ ID NO: 311796 - RNA, 23 nt, Human
acuuuagauaaauuaugugcaca

SEQ ID NO: 311797 - RNA, 22 nt, Human
ucccagggacucucugccuucc

SEQ ID NO: 311798 - RNA, 22 nt, Human
aggccagcuguuacuagagcca

SEQ ID NO: 311799 - RNA, 20 nt, Human
gagagcuggaaauaaagucc

SEQ ID NO: 311800 - RNA, 22 nt, Human
gaucauuuacuuguucuggacu

SEQ ID NO: 311801 - RNA, 22 nt, Human
agcagcagaggucagaaaggua

SEQ ID NO: 311802 - RNA, 22 nt, Human
aggcugucaucuuugcaggcag

SEQ ID NO: 311803 - RNA, 22 nt, Human
gcccuuccuuagacagcaggau

SEQ ID NO: 311804 - RNA, 23 nt, Human
ggccauggagacuuagaaugggc

SEQ ID NO: 311805 - RNA, 20 nt, Human
uguacacaguacuuuacaau

SEQ ID NO: 311806 - RNA, 22 nt, Human
ucuggcuccaggaccgggcaca

SEQ ID NO: 311807 - RNA, 22 nt, Human
uugcagcagggugaauucacuc

SEQ ID NO: 311808 - RNA, 22 nt, Human
cuccagggagcugcgggagcca

SEQ ID NO: 311809 - RNA, 22 nt, Human
gaggaugugucuggucugggca

SEQ ID NO: 311810 - RNA, 22 nt, Human
gcucugcucuugacuuaccagg

SEQ ID NO: 311811 - RNA, 22 nt, Human
uagggcagcugcaucaggcacu

SEQ ID NO: 311812 - RNA, 22 nt, Human
uuugaauguuuuagguacuuaa

SEQ ID NO: 311813 - RNA, 22 nt, Human
gggucuggcaugcugagaugga

SEQ ID NO: 311814 - RNA, 22 nt, Human
cugccucugcgucccacagagu

SEQ ID NO: 311815 - RNA, 20 nt, Human
uugauucccucuaaacucgc

SEQ ID NO: 311816 - RNA, 22 nt, Human
acagaugaugugcacagauaga

SEQ ID NO: 311817 - RNA, 22 nt, Human
aaaguaguuagucaugugaaaa

SEQ ID NO: 311818 - RNA, 22 nt, Human
ugcuacaauucacaucuggaua

SEQ ID NO: 311819 - RNA, 22 nt, Human
cacugaagcuuucauucucuug

SEQ ID NO: 311820 - RNA, 22 nt, Human
aagaauucacugguagagucaa

SEQ ID NO: 311821 - RNA, 22 nt, Human
caaggccaagucucugugaaga

SEQ ID NO: 311822 - RNA, 22 nt, Human
aagauggaguaguguaaugguu

SEQ ID NO: 311823 - RNA, 22 nt, Human
gccugccucaaaaucccaguuc

SEQ ID NO: 311824 - RNA, 22 nt, Human
gcagccugaugaucuggguugu

SEQ ID NO: 311825 - RNA, 22 nt, Human
cccccaaggccaggcugagacc

SEQ ID NO: 311826 - RNA, 21 nt, Human
uauacaugugugcauacgugu

SEQ ID NO: 311827 - RNA, 21 nt, Human
gcagagcuggaaccaggaccc

SEQ ID NO: 311828 - RNA, 22 nt, Human
gcuggccauggggagugaggag

SEQ ID NO: 311829 - RNA, 22 nt, Human
uaagaacagauaaaguuucccc

SEQ ID NO: 311830 - RNA, 22 nt, Human
gcugcugcgcuugucuacuguu

SEQ ID NO: 311831 - RNA, 22 nt, Human
agucugucugucacuucugcag

SEQ ID NO: 311832 - RNA, 20 nt, Human
gaggcucugggcauggcgcc

SEQ ID NO: 311833 - RNA, 22 nt, Human
caucaucaaaagugacagagaa

SEQ ID NO: 311834 - RNA, 22 nt, Human
uccuggagcuuccuucauggua

SEQ ID NO: 311835 - RNA, 20 nt, Human
acuggagccaucucagccua

SEQ ID NO: 311836 - RNA, 22 nt, Human
cucaggauagcugcgcagccug

SEQ ID NO: 311837 - RNA, 22 nt, Human
aucuguucuucaaaauauuaca

SEQ ID NO: 311838 - RNA, 22 nt, Human
guaacacagaaaugaaauucca

SEQ ID NO: 311839 - RNA, 22 nt, Human
aggcacuggucuaccccuuagu

SEQ ID NO: 311840 - RNA, 22 nt, Human
uugaggagucaggggcacggaa

SEQ ID NO: 311841 - RNA, 22 nt, Human
ccagggcaucacauccaguguu

SEQ ID NO: 311842 - RNA, 22 nt, Human
gauguguuuccaggauuuguuu

SEQ ID NO: 311843 - RNA, 22 nt, Human
ugucuagggagcugcucaggcu

SEQ ID NO: 311844 - RNA, 22 nt, Human
ucucagaguuuagagcugagcc

SEQ ID NO: 311845 - RNA, 22 nt, Human
uucuuuugggaauuacguaugc

SEQ ID NO: 311846 - RNA, 20 nt, Human
ccuggaagagcuccccaggc

SEQ ID NO: 311847 - RNA, 22 nt, Human
cucagcugcagccuggcuggca

SEQ ID NO: 311848 - RNA, 22 nt, Human
gaagcagcuaggaucuucauuu

SEQ ID NO: 311849 - RNA, 22 nt, Human
ggcucugggucuguggggagcg

SEQ ID NO: 311850 - RNA, 22 nt, Human
gaggucagucagaccaggguuu

SEQ ID NO: 311851 - RNA, 22 nt, Human
agcaccaugaccuugccauuga

SEQ ID NO: 311852 - RNA, 19 nt, Human
uagcugccuguuaccucca

SEQ ID NO: 311853 - RNA, 22 nt, Human
agcugcagagguuugugcaaca

SEQ ID NO: 311854 - RNA, 22 nt, Human
uaagacacaugcguacaagaua

SEQ ID NO: 311855 - RNA, 23 nt, Human
uucauuugucuacuucacuuguu

SEQ ID NO: 311856 - RNA, 22 nt, Human
gagugugucggucagcguggcg

SEQ ID NO: 311857 - RNA, 22 nt, Human
aaggggagaugucaugggcccu

SEQ ID NO: 311858 - RNA, 22 nt, Human
ucuacuguagugaugcugcagu

SEQ ID NO: 311859 - RNA, 22 nt, Human
auuuauguaucuguguagauca

SEQ ID NO: 311860 - RNA, 22 nt, Human
ggcugaaguguaguggcucacu

SEQ ID NO: 311861 - RNA, 22 nt, Human
caagagcugaggcuggagaggu

SEQ ID NO: 311862 - RNA, 22 nt, Human
gcaguggcaugaugugggcuca

SEQ ID NO: 311863 - RNA, 22 nt, Human
aaagaauuuguacacccuacua

SEQ ID NO: 311864 - RNA, 22 nt, Human
cauuuuaagaugaccugguuuc

SEQ ID NO: 311865 - RNA, 22 nt, Human
auaacuuucuucacccuugcug

SEQ ID NO: 311866 - RNA, 22 nt, Human
uuccuccacgugacaggagcca

SEQ ID NO: 311867 - RNA, 22 nt, Human
cucugagggcucgagggacgcg

SEQ ID NO: 311868 - RNA, 22 nt, Human
ucugaagaacugaguaaacaug

SEQ ID NO: 311869 - RNA, 22 nt, Human
ugggcagcagcaaagccagacu

SEQ ID NO: 311870 - RNA, 22 nt, Human
aaugauggucauggcaacuuuu

SEQ ID NO: 311871 - RNA, 22 nt, Human
auguccuuugcuucucuggucc

SEQ ID NO: 311872 - RNA, 22 nt, Human
ucucagggccccaaaggcuagu

SEQ ID NO: 311873 - RNA, 18 nt, Human
ugcugggguagaauccac

SEQ ID NO: 311874 - RNA, 22 nt, Human
ugggccuguggcuuggcucuag

SEQ ID NO: 311875 - RNA, 22 nt, Human
gccagccuucuguggccugcaa

SEQ ID NO: 311876 - RNA, 22 nt, Human
caggccaggcugcauuugcccc

SEQ ID NO: 311877 - RNA, 18 nt, Human
ucaagacaucaugaaaua

SEQ ID NO: 311878 - RNA, 22 nt, Human
uccucugccccagaugaaauuu

SEQ ID NO: 311879 - RNA, 22 nt, Human
agucccagcuacucaagaggcu

SEQ ID NO: 311880 - RNA, 22 nt, Human
uucaaucauuuuuacauagucc

SEQ ID NO: 311881 - RNA, 22 nt, Human
cagagugaaaacugagcucaaa

SEQ ID NO: 311882 - RNA, 22 nt, Human
auuuguacaaauuuauguuagu

SEQ ID NO: 311883 - RNA, 22 nt, Human
ggcagcuguggacgucgucauu

SEQ ID NO: 311884 - RNA, 17 nt, Human
cccugccaccaggaagc

SEQ ID NO: 311885 - RNA, 19 nt, Human
cagaccuguccagccugug

SEQ ID NO: 311886 - RNA, 22 nt, Human
aggcacugggaauaugcugagg

SEQ ID NO: 311887 - RNA, 22 nt, Human
ugaaggaaagagggaacauccc

SEQ ID NO: 311888 - RNA, 20 nt, Human
agcuggagaagggcccuucc

SEQ ID NO: 311889 - RNA, 22 nt, Human
ucuccuuuaagauuuccucagg

SEQ ID NO: 311890 - RNA, 23 nt, Human
acagagaucuugacuuguaugga

SEQ ID NO: 311891 - RNA, 22 nt, Human
cccagcucucucaguucugcuu

SEQ ID NO: 311892 - RNA, 19 nt, Human
uuucccagcccuugcugug

SEQ ID NO: 311893 - RNA, 22 nt, Human
aauuagagaucaguucuuugac

SEQ ID NO: 311894 - RNA, 22 nt, Human
gaggggcuggguagggcaaccc

SEQ ID NO: 311895 - RNA, 22 nt, Human
agauuucacaugcugcucuauu

SEQ ID NO: 311896 - RNA, 22 nt, Human
uucuuguauauaaaaaucauuu

SEQ ID NO: 311897 - RNA, 22 nt, Human
aagaacauuuuguagaaugaca

SEQ ID NO: 311898 - RNA, 22 nt, Human
uagacauuuggaguuuuaugac

SEQ ID NO: 311899 - RNA, 22 nt, Human
uuuauuauucucuggagaaugu

SEQ ID NO: 311900 - RNA, 22 nt, Human
gcagcugggacacugaggccag

SEQ ID NO: 311901 - RNA, 22 nt, Human
cauuuguaggaugcuucuuguu

SEQ ID NO: 311902 - RNA, 22 nt, Human
auaugucgcuacaucauuagau

SEQ ID NO: 311903 - RNA, 22 nt, Human
cagggagaaaucuccaggaggu

SEQ ID NO: 311904 - RNA, 22 nt, Human
uuccagagcaguuuucagauca

SEQ ID NO: 311905 - RNA, 22 nt, Human
ugcugccagggcucugcccaca

SEQ ID NO: 311906 - RNA, 21 nt, Human
uugaaggaucacuucuguacc

SEQ ID NO: 311907 - RNA, 22 nt, Human
ugggccuguugggguugaguua

SEQ ID NO: 311908 - RNA, 22 nt, Human
gaaggccauuagagccugugcc

SEQ ID NO: 311909 - RNA, 22 nt, Human
gucacuguuuccuauuauauuu

SEQ ID NO: 311910 - RNA, 22 nt, Human
ugguaaauauguccauucucuu

SEQ ID NO: 311911 - RNA, 22 nt, Human
gccagagcagaauagaguggcc

SEQ ID NO: 311912 - RNA, 22 nt, Human
cagcugaguuacucugaggucu

SEQ ID NO: 311913 - RNA, 22 nt, Human
agaguucugcucuucucaguga

SEQ ID NO: 311914 - RNA, 22 nt, Human
caggagugagaugcgaucacuu

SEQ ID NO: 311915 - RNA, 22 nt, Human
guggagccaggaucuccgcaca

SEQ ID NO: 311916 - RNA, 22 nt, Human
ggcucaggccagaccacgacuc

SEQ ID NO: 311917 - RNA, 22 nt, Human
cuucucuucccagggacacagg

SEQ ID NO: 311918 - RNA, 22 nt, Human
gggcugugggacccggcacuuu

SEQ ID NO: 311919 - RNA, 22 nt, Human
gcuggcucuucaguggagauag

SEQ ID NO: 311920 - RNA, 19 nt, Human
aacuagaaagguuuugaga

SEQ ID NO: 311921 - RNA, 22 nt, Human
ggccucggcccacugcugcggu

SEQ ID NO: 311922 - RNA, 22 nt, Human
cccagccugucuuucccaauga

SEQ ID NO: 311923 - RNA, 22 nt, Human
ccugggcucuauccugacccag

SEQ ID NO: 311924 - RNA, 22 nt, Human
ugggcaggauaauaucucaugu

SEQ ID NO: 311925 - RNA, 20 nt, Human
gccugagcuccgccuccugu

SEQ ID NO: 311926 - RNA, 22 nt, Human
augcuguggaugccuugcccca

SEQ ID NO: 311927 - RNA, 22 nt, Human
gauuucaaguaucuugggcgag

SEQ ID NO: 311928 - RNA, 22 nt, Human
gaggugggagggcagucccuaa

SEQ ID NO: 311929 - RNA, 22 nt, Human
aggagcagaacuguuguggagg

SEQ ID NO: 311930 - RNA, 22 nt, Human
ccagggugugggcgucggcacg

SEQ ID NO: 311931 - RNA, 22 nt, Human
ugucuguaagguguuuauguua

SEQ ID NO: 311932 - RNA, 22 nt, Human
cagccacuggugccaggcuguu

SEQ ID NO: 311933 - RNA, 22 nt, Human
ugagcccuaagggucaagcagg

SEQ ID NO: 311934 - RNA, 22 nt, Human
agagcugaggauccagcugagc

SEQ ID NO: 311935 - RNA, 22 nt, Human
aggcagugcagaguccucuucu

SEQ ID NO: 311936 - RNA, 22 nt, Human
agaggccggccgagcccauggg

SEQ ID NO: 311937 - RNA, 21 nt, Human
agcucagccgggcacaguggc

SEQ ID NO: 311938 - RNA, 22 nt, Human
agcccuggcccggcugugcuuu

SEQ ID NO: 311939 - RNA, 22 nt, Human
ucucaggaagauuagggcuaag

SEQ ID NO: 311940 - RNA, 22 nt, Human
ucagggcaccaaaaaagaugcc

SEQ ID NO: 311941 - RNA, 22 nt, Human
agggccugggguagcuuacugc

SEQ ID NO: 311942 - RNA, 22 nt, Human
agugucuuucauauccuccauc

SEQ ID NO: 311943 - RNA, 19 nt, Human
uggcaucuguaaaauggug

SEQ ID NO: 311944 - RNA, 22 nt, Human
gggacuggcacagggcugggag

SEQ ID NO: 311945 - RNA, 22 nt, Human
caacagaagguguacuacugaa

SEQ ID NO: 311946 - RNA, 22 nt, Human
agguggguaucaugagagauua

SEQ ID NO: 311947 - RNA, 22 nt, Human
caguacuuugaagauauuuuag

SEQ ID NO: 311948 - RNA, 18 nt, Human
ugucucaggcugaaacag

SEQ ID NO: 311949 - RNA, 22 nt, Human
ucacuuauaaaaugcaagaucu

SEQ ID NO: 311950 - RNA, 22 nt, Human
acugaaggaaacuuuuguguuu

SEQ ID NO: 311951 - RNA, 22 nt, Human
ggugcagaucuuucucuucagg

SEQ ID NO: 311952 - RNA, 22 nt, Human
uucuccagagggcucugcagga

SEQ ID NO: 311953 - RNA, 22 nt, Human
ugguccagaugccuuggcuuua

SEQ ID NO: 311954 - RNA, 22 nt, Human
ccucagggacuccaugcugcag

SEQ ID NO: 311955 - RNA, 22 nt, Human
agugacagcugggaaggugaaa

SEQ ID NO: 311956 - RNA, 22 nt, Human
uugcaucuaccauaucaaagau

SEQ ID NO: 311957 - RNA, 22 nt, Human
aaaaauaggucaaccguguaug

SEQ ID NO: 311958 - RNA, 22 nt, Human
aguaacaagugccaacguuaga

SEQ ID NO: 311959 - RNA, 17 nt, Human
ucaggauguagcaguag

SEQ ID NO: 311960 - RNA, 22 nt, Human
ucccagagccaagcuauggaug

SEQ ID NO: 311961 - RNA, 22 nt, Human
cguguggucccggcaaggcaag

SEQ ID NO: 311962 - RNA, 22 nt, Human
guguuuccucacuucucugacu

SEQ ID NO: 311963 - RNA, 22 nt, Human
uguacauuuagagcucaauaga

SEQ ID NO: 311964 - RNA, 22 nt, Human
ugccucuguugagccuuggcug

SEQ ID NO: 311965 - RNA, 22 nt, Human
agcugguucauucauucauggu

SEQ ID NO: 311966 - RNA, 22 nt, Human
cuagagaggcagauguccugug

SEQ ID NO: 311967 - RNA, 22 nt, Human
auuucaguguugguuagcaagc

SEQ ID NO: 311968 - RNA, 22 nt, Human
ccuccugggacaggcuggcaca

SEQ ID NO: 311969 - RNA, 22 nt, Human
gccugggaagacuaagugggag

SEQ ID NO: 311970 - RNA, 22 nt, Human
uugggaaggcguggaagcagaa

SEQ ID NO: 311971 - RNA, 22 nt, Human
cuugccuucuguuccuauagaa

SEQ ID NO: 311972 - RNA, 23 nt, Human
uuucaacuccugccauuauuucu

SEQ ID NO: 311973 - RNA, 22 nt, Human
ggccuuggggaggauggugucc

SEQ ID NO: 311974 - RNA, 20 nt, Human
acauugauuauguuuguaga

SEQ ID NO: 311975 - RNA, 22 nt, Human
guuauguacuuuuuaaaucuug

SEQ ID NO: 311976 - RNA, 22 nt, Human
ucuucagauggccaguuguccc

SEQ ID NO: 311977 - RNA, 22 nt, Human
auguuagaaggaauguuaaaag

SEQ ID NO: 311978 - RNA, 22 nt, Human
aggucauuggggacuaucuccg

SEQ ID NO: 311979 - RNA, 22 nt, Human
cagccagcuucagauccaagcc

SEQ ID NO: 311980 - RNA, 22 nt, Human
ccagggccaguaagauuggcau

SEQ ID NO: 311981 - RNA, 22 nt, Human
aagaaucauccugcaagagucu

SEQ ID NO: 311982 - RNA, 22 nt, Human
ugcaucuguucagagcugucga

SEQ ID NO: 311983 - RNA, 23 nt, Human
ucucaggacacacaugucuauca

SEQ ID NO: 311984 - RNA, 22 nt, Human
uaagacaauucuucagucacaa

SEQ ID NO: 311985 - RNA, 17 nt, Human
caaggccagcaucuuca

SEQ ID NO: 311986 - RNA, 19 nt, Human
aucagcaagguaggaugug

SEQ ID NO: 311987 - RNA, 22 nt, Human
uuaaaauuuccccaccauguau

SEQ ID NO: 311988 - RNA, 22 nt, Human
aauucuugguccuaguguauaa

SEQ ID NO: 311989 - RNA, 22 nt, Human
gaggcugcuguuagcccugggc

SEQ ID NO: 311990 - RNA, 22 nt, Human
cccagagcuccgguccugccca

SEQ ID NO: 311991 - RNA, 22 nt, Human
uauuucuuucagguauguguug

SEQ ID NO: 311992 - RNA, 22 nt, Human
ccccuuccuuccucagacagcc

SEQ ID NO: 311993 - RNA, 22 nt, Human
uucucugagauagacuaagugg

SEQ ID NO: 311994 - RNA, 22 nt, Human
cagugucuccagaugcuccaau

SEQ ID NO: 311995 - RNA, 18 nt, Human
ugaacagaugaguugaag

SEQ ID NO: 311996 - RNA, 22 nt, Human
cccuguccuuggcugugaggcu

SEQ ID NO: 311997 - RNA, 22 nt, Human
cugcagagcagccaguccccca

SEQ ID NO: 311998 - RNA, 22 nt, Human
aggaaggguucuuugugaaaga

SEQ ID NO: 311999 - RNA, 22 nt, Human
ccugggcuugcaucugugcugg

SEQ ID NO: 312000 - RNA, 22 nt, Human
caguacuugggggguucuaagu

SEQ ID NO: 312001 - RNA, 22 nt, Human
uggggggcacuucagcacaaug

SEQ ID NO: 312002 - RNA, 22 nt, Human
uuuccucugggcccugccaccc

SEQ ID NO: 312003 - RNA, 20 nt, Human
cacaagagaauacacacugg

SEQ ID NO: 312004 - RNA, 22 nt, Human
caaagugcuaggauuacaggcc

SEQ ID NO: 312005 - RNA, 22 nt, Human
cucagaguccccaguggguuug

SEQ ID NO: 312006 - RNA, 22 nt, Human
agccagagcugaugucauucuc

SEQ ID NO: 312007 - RNA, 22 nt, Human
cucaggauugugccuagggaga

SEQ ID NO: 312008 - RNA, 21 nt, Human
gggccuggcugcgcaggacgg

SEQ ID NO: 312009 - RNA, 22 nt, Human
agccacaggaaacagagacagc

SEQ ID NO: 312010 - RNA, 22 nt, Human
aaauuuuguauucuaguucuag

SEQ ID NO: 312011 - RNA, 22 nt, Human
uauugacagagggucagaagag

SEQ ID NO: 312012 - RNA, 22 nt, Human
aaggaaaggaugagcaugcauu

SEQ ID NO: 312013 - RNA, 22 nt, Human
ucucauucauacccuacaugcu

SEQ ID NO: 312014 - RNA, 22 nt, Human
uuccaggauggcaauaaugaau

SEQ ID NO: 312015 - RNA, 22 nt, Human
ugagagucucagaccuccuggu

SEQ ID NO: 312016 - RNA, 22 nt, Human
ugggccugaguuugggaacugg

SEQ ID NO: 312017 - RNA, 22 nt, Human
uaucuacuccucuuucagaugc

SEQ ID NO: 312018 - RNA, 22 nt, Human
gucuucuguaagaugagguccc

SEQ ID NO: 312019 - RNA, 22 nt, Human
guuuucaaggggauuuaacuga

SEQ ID NO: 312020 - RNA, 22 nt, Human
uucuucucagggucccacaugg

SEQ ID NO: 312021 - RNA, 22 nt, Human
guuccacaaaauguacccaguu

SEQ ID NO: 312022 - RNA, 22 nt, Human
cagagccuuaguucuccuagaa

SEQ ID NO: 312023 - RNA, 22 nt, Human
gagguacagaguguuccaaugu

SEQ ID NO: 312024 - RNA, 22 nt, Human
acuccugggugcugaccagcgu

SEQ ID NO: 312025 - RNA, 22 nt, Human
ucaaugaugcugaagguagcgu

SEQ ID NO: 312026 - RNA, 22 nt, Human
auauuucaugggguuccauacu

SEQ ID NO: 312027 - RNA, 20 nt, Human
aggcacuggggauagguaag

SEQ ID NO: 312028 - RNA, 22 nt, Human
gugcugggcuccaccccagagg

SEQ ID NO: 312029 - RNA, 22 nt, Human
aagggcaggaaaagauggaugu

SEQ ID NO: 312030 - RNA, 22 nt, Human
aaggucauugguucugaauucu

SEQ ID NO: 312031 - RNA, 22 nt, Human
uagggcagaguccaggaugggc

SEQ ID NO: 312032 - RNA, 22 nt, Human
agcugccaaguuucucaguuua

SEQ ID NO: 312033 - RNA, 22 nt, Human
aguguuguaugggaugacugcu

SEQ ID NO: 312034 - RNA, 22 nt, Human
uuucuugacugcuuaggaaugc

SEQ ID NO: 312035 - RNA, 22 nt, Human
uggcacugccaaccugcuaggu

SEQ ID NO: 312036 - RNA, 23 nt, Human
agggcccaagccuggacagcagg

SEQ ID NO: 312037 - RNA, 22 nt, Human
aaaggcaggcuuucacaucuca

SEQ ID NO: 312038 - RNA, 22 nt, Human
acaguguucuuggcgcugagug

SEQ ID NO: 312039 - RNA, 18 nt, Human
aggaagcaggaggaaggc

SEQ ID NO: 312040 - RNA, 23 nt, Human
ggcuggaagaaaacagaauuguu

SEQ ID NO: 312041 - RNA, 22 nt, Human
cccaggccagaacuugguugcu

SEQ ID NO: 312042 - RNA, 22 nt, Human
ucaacagaagugauagcuauua

SEQ ID NO: 312043 - RNA, 22 nt, Human
cuagccaugggcauuaaaggua

SEQ ID NO: 312044 - RNA, 22 nt, Human
aaguuucauuguucauguaaca

SEQ ID NO: 312045 - RNA, 22 nt, Human
guuauaaauaccuaauaggauu

SEQ ID NO: 312046 - RNA, 20 nt, Human
uccugagauuuaagggguuc

SEQ ID NO: 312047 - RNA, 22 nt, Human
uuccuuugggaaaucacuaagg

SEQ ID NO: 312048 - RNA, 22 nt, Human
gcaguguugacuaugguaugag

SEQ ID NO: 312049 - RNA, 22 nt, Human
uaucuguuguaguacagaugau

SEQ ID NO: 312050 - RNA, 22 nt, Human
guucuucacauuucauugagga

SEQ ID NO: 312051 - RNA, 21 nt, Human
aguugcauaggccagccaucc

SEQ ID NO: 312052 - RNA, 22 nt, Human
ucucugcugagaagggcuggca

SEQ ID NO: 312053 - RNA, 22 nt, Human
auguaaacucacauuuucuuca

SEQ ID NO: 312054 - RNA, 22 nt, Human
caugagauaauuuuucuccagu

SEQ ID NO: 312055 - RNA, 22 nt, Human
aggaagccaugguggacgucua

SEQ ID NO: 312056 - RNA, 22 nt, Human
gagggugguggcuuaaggugcu

SEQ ID NO: 312057 - RNA, 19 nt, Human
gcaggcacagcccugggug

SEQ ID NO: 312058 - RNA, 22 nt, Human
ugaaacauuugaugaucuuugg

SEQ ID NO: 312059 - RNA, 22 nt, Human
auaacuuagaguaggcaaaagu

SEQ ID NO: 312060 - RNA, 22 nt, Human
ucacuucacacccacuaucaug

SEQ ID NO: 312061 - RNA, 22 nt, Human
aaugcacauauauguguauaca

SEQ ID NO: 312062 - RNA, 22 nt, Human
gugcagcagggggaagacagug

SEQ ID NO: 312063 - RNA, 21 nt, Human
gggaaauuaggauugcucauc

SEQ ID NO: 312064 - RNA, 22 nt, Human
gcaugugucuccccaguggagg

SEQ ID NO: 312065 - RNA, 22 nt, Human
cugcugucuuuauuucacugcu

SEQ ID NO: 312066 - RNA, 22 nt, Human
ccugggaggcuguuuccagccu

SEQ ID NO: 312067 - RNA, 22 nt, Human
gggcagaggcucuggcccaucc

SEQ ID NO: 312068 - RNA, 22 nt, Human
uccuuggcagcagggagcauga

SEQ ID NO: 312069 - RNA, 22 nt, Human
uaauaguuaugguugguucuca

SEQ ID NO: 312070 - RNA, 16 nt, Human
cuuccucuucacuggc

SEQ ID NO: 312071 - RNA, 22 nt, Human
cugacccauauaagaguggagg

SEQ ID NO: 312072 - RNA, 22 nt, Human
cauugucacccaaagcucauag

SEQ ID NO: 312073 - RNA, 22 nt, Human
agcagcuuacauguggccuauc

SEQ ID NO: 312074 - RNA, 22 nt, Human
cccuggaggagcuuagagcuug

SEQ ID NO: 312075 - RNA, 22 nt, Human
guggcucucgccagccugcggg

SEQ ID NO: 312076 - RNA, 22 nt, Human
acagggucauuuuaugaucugu

SEQ ID NO: 312077 - RNA, 22 nt, Human
uggagggcaucuguggucaggc

SEQ ID NO: 312078 - RNA, 22 nt, Human
caggaaagggaugggcugccac

SEQ ID NO: 312079 - RNA, 22 nt, Human
uccacuggaacaacucugaggc

SEQ ID NO: 312080 - RNA, 22 nt, Human
agaaagggucacugaaagagga

SEQ ID NO: 312081 - RNA, 22 nt, Human
gccuggagcccaguguggggcu

SEQ ID NO: 312082 - RNA, 22 nt, Human
uggagagcacaguuccugcuuc

SEQ ID NO: 312083 - RNA, 22 nt, Human
cuggguggaaagugcugagaau

SEQ ID NO: 312084 - RNA, 21 nt, Human
ugcagcugacacugguaugcc

SEQ ID NO: 312085 - RNA, 22 nt, Human
ucagagaguuagugucuuagcu

SEQ ID NO: 312086 - RNA, 22 nt, Human
gauuucuugauaaguaguguga

SEQ ID NO: 312087 - RNA, 22 nt, Human
uuggaaggcccugccuagcagg

SEQ ID NO: 312088 - RNA, 22 nt, Human
ggcucuggugaggguaggagau

SEQ ID NO: 312089 - RNA, 22 nt, Human
ugucauugaggaaaacuaggug

SEQ ID NO: 312090 - RNA, 22 nt, Human
aggggagguggcagaaaugugc

SEQ ID NO: 312091 - RNA, 22 nt, Human
gaaacauauuaauccagugaaa

SEQ ID NO: 312092 - RNA, 22 nt, Human
cuucuucaagagaaugggagac

SEQ ID NO: 312093 - RNA, 22 nt, Human
gggcacugaaugccaagcuagg

SEQ ID NO: 312094 - RNA, 22 nt, Human
ugcugaggagguggcugugcuu

SEQ ID NO: 312095 - RNA, 22 nt, Human
uguguccuucugggagucccag

SEQ ID NO: 312096 - RNA, 22 nt, Human
auauucacugagcauaaagcca

SEQ ID NO: 312097 - RNA, 22 nt, Human
ucugggcucuuaguguacccuc

SEQ ID NO: 312098 - RNA, 22 nt, Human
uggcagcacuagguacugagcu

SEQ ID NO: 312099 - RNA, 22 nt, Human
gcagagacuccacugucuugug

SEQ ID NO: 312100 - RNA, 22 nt, Human
gaggaggcuggcgccgccugcc

SEQ ID NO: 312101 - RNA, 23 nt, Human
uuucauaugguguggaugaagaa

SEQ ID NO: 312102 - RNA, 22 nt, Human
ugccucugugggccuuccuggc

SEQ ID NO: 312103 - RNA, 20 nt, Human
aggcucagcugagcucuugg

SEQ ID NO: 312104 - RNA, 22 nt, Human
agacaaaugguaauuaugucua

SEQ ID NO: 312105 - RNA, 22 nt, Human
augggcugugagguccggcagg

SEQ ID NO: 312106 - RNA, 22 nt, Human
aaaucagucccucuuggaauuu

SEQ ID NO: 312107 - RNA, 22 nt, Human
gauguagagggaagauuuuaaa

SEQ ID NO: 312108 - RNA, 22 nt, Human
auuaaagaaacccagcauguga

SEQ ID NO: 312109 - RNA, 22 nt, Human
caggcuggagugaguguagugg

SEQ ID NO: 312110 - RNA, 22 nt, Human
gcucccacaaccuucuugcucc

SEQ ID NO: 312111 - RNA, 21 nt, Human
gccagagcaguacaaugaggu

SEQ ID NO: 312112 - RNA, 22 nt, Human
cugccacuuacuaggcauggug

SEQ ID NO: 312113 - RNA, 17 nt, Human
uuucaucugggaccacc

SEQ ID NO: 312114 - RNA, 22 nt, Human
uccugaggagaagagugcuagg

SEQ ID NO: 312115 - RNA, 22 nt, Human
ugucuuccucuuggcuugagcu

SEQ ID NO: 312116 - RNA, 22 nt, Human
aaaucugggucaagguggagug

SEQ ID NO: 312117 - RNA, 22 nt, Human
aaagauuugaaauuaggcauca

SEQ ID NO: 312118 - RNA, 22 nt, Human
ucugggagcacacgcagugauc

SEQ ID NO: 312119 - RNA, 22 nt, Human
ggagggagucagcugauuagaa

SEQ ID NO: 312120 - RNA, 20 nt, Human
cccuccagcaaccaggacuu

SEQ ID NO: 312121 - RNA, 22 nt, Human
ggcugucugugguggagcguug

SEQ ID NO: 312122 - RNA, 22 nt, Human
agcugggccugagcuggaagcu

SEQ ID NO: 312123 - RNA, 22 nt, Human
aggggccucgcaggaccgcucc

SEQ ID NO: 312124 - RNA, 22 nt, Human
ggacagagcccugguggccuaa

SEQ ID NO: 312125 - RNA, 21 nt, Human
gcugucucuggcuccugggaa

SEQ ID NO: 312126 - RNA, 22 nt, Human
auaaggcaagcugucaguuugu

SEQ ID NO: 312127 - RNA, 19 nt, Human
augaggaacugaggcucag

SEQ ID NO: 312128 - RNA, 22 nt, Human
caguacuuaacuuauaggagag

SEQ ID NO: 312129 - RNA, 22 nt, Human
cagcccucaaaccacuuccagg

SEQ ID NO: 312130 - RNA, 22 nt, Human
ccagcugauucgguggugguug

SEQ ID NO: 312131 - RNA, 22 nt, Human
uacaaguaaauuguagauacca

SEQ ID NO: 312132 - RNA, 18 nt, Human
acagaacucaggggcacc

SEQ ID NO: 312133 - RNA, 22 nt, Human
uaccuugggcuauuaucuuuga

SEQ ID NO: 312134 - RNA, 22 nt, Human
caugaagcauguuuugucauga

SEQ ID NO: 312135 - RNA, 22 nt, Human
auauaauacaaccugcuaagug

SEQ ID NO: 312136 - RNA, 22 nt, Human
uucaggauccccaccgcguuua

SEQ ID NO: 312137 - RNA, 22 nt, Human
uugcauugaucccagcuugggc

SEQ ID NO: 312138 - RNA, 22 nt, Human
cugccgagugggucaugaggca

SEQ ID NO: 312139 - RNA, 22 nt, Human
aggcccugcuuuccagagcuca

SEQ ID NO: 312140 - RNA, 16 nt, Human
agaggccuugaggaag

SEQ ID NO: 312141 - RNA, 22 nt, Human
ccacagccauuccagggaggcu

SEQ ID NO: 312142 - RNA, 22 nt, Human
aggcugaggcagguggaucauu

SEQ ID NO: 312143 - RNA, 22 nt, Human
gcuucucucucagacugcaagc

SEQ ID NO: 312144 - RNA, 22 nt, Human
agaggacacaucuuuccucaaa

SEQ ID NO: 312145 - RNA, 22 nt, Human
gccuguccacuaaacagccaag

SEQ ID NO: 312146 - RNA, 22 nt, Human
gccaggcugaggcucuggaaga

SEQ ID NO: 312147 - RNA, 22 nt, Human
aucaggaucugcaucauaagaa

SEQ ID NO: 312148 - RNA, 22 nt, Human
ggggagaauuacauggcgugga

SEQ ID NO: 312149 - RNA, 22 nt, Human
gaaaacuauuggccuagaacaa

SEQ ID NO: 312150 - RNA, 19 nt, Human
uccuuugaauaucaguuga

SEQ ID NO: 312151 - RNA, 22 nt, Human
agcuuccucaccucagaggucu

SEQ ID NO: 312152 - RNA, 22 nt, Human
uccugggccuguacuccauccg

SEQ ID NO: 312153 - RNA, 22 nt, Human
ugaagcaggugaauggaugucg

SEQ ID NO: 312154 - RNA, 22 nt, Human
gccucaggacuggcauacucau

SEQ ID NO: 312155 - RNA, 17 nt, Human
ucuggccuuccugaacu

SEQ ID NO: 312156 - RNA, 22 nt, Human
gucagcaggguccccuugagug

SEQ ID NO: 312157 - RNA, 22 nt, Human
agaggcuguuacacucccagau

SEQ ID NO: 312158 - RNA, 22 nt, Human
ccucagagaaagguauggcuga

SEQ ID NO: 312159 - RNA, 22 nt, Human
ugcucuguauucuauggcaguu

SEQ ID NO: 312160 - RNA, 20 nt, Human
acaauagauuugagcaaagu

SEQ ID NO: 312161 - RNA, 22 nt, Human
gaggagagagggacugucugca

SEQ ID NO: 312162 - RNA, 23 nt, Human
aggcugcagaagaauagggucau

SEQ ID NO: 312163 - RNA, 22 nt, Human
ccaaggcuucccagagaugcuc

SEQ ID NO: 312164 - RNA, 22 nt, Human
caaggagaguaauugaaugaga

SEQ ID NO: 312165 - RNA, 22 nt, Human
uggggcuggcuauugucucccu

SEQ ID NO: 312166 - RNA, 22 nt, Human
cugcagugcaagcccagaugga

SEQ ID NO: 312167 - RNA, 22 nt, Human
ucagacaaguaaaauaauguaa

SEQ ID NO: 312168 - RNA, 22 nt, Human
ggagcauguggggugagcaggg

SEQ ID NO: 312169 - RNA, 23 nt, Human
guggccuccccggaaugccucgc

SEQ ID NO: 312170 - RNA, 22 nt, Human
cugcugugagcacuccagccug

SEQ ID NO: 312171 - RNA, 22 nt, Human
auugcagcuggucaggguaauu

SEQ ID NO: 312172 - RNA, 22 nt, Human
cagcucugugcaggccugggga

SEQ ID NO: 312173 - RNA, 22 nt, Human
gcaaggaccuuugagcgugcca

SEQ ID NO: 312174 - RNA, 22 nt, Human
gucacacucagaaugacuagag

SEQ ID NO: 312175 - RNA, 22 nt, Human
ucugcuguaaagaauuucugcc

SEQ ID NO: 312176 - RNA, 22 nt, Human
aggaugggccugggauaugcuu

SEQ ID NO: 312177 - RNA, 22 nt, Human
gcuuuguguagaaggaggaugg

SEQ ID NO: 312178 - RNA, 19 nt, Human
uugaggggccaggggagau

SEQ ID NO: 312179 - RNA, 22 nt, Human
ucccagagauuuccucuccuuc

SEQ ID NO: 312180 - RNA, 22 nt, Human
cugagccaguagucagggacaa

SEQ ID NO: 312181 - RNA, 20 nt, Human
cugggcucaagugauccucc

SEQ ID NO: 312182 - RNA, 22 nt, Human
aggcacaggaaugucauccagu

SEQ ID NO: 312183 - RNA, 22 nt, Human
auacaagacucagcacagacgg

SEQ ID NO: 312184 - RNA, 22 nt, Human
gccucugcaccaguacugugcc

SEQ ID NO: 312185 - RNA, 22 nt, Human
auacagugccccuuuucacaug

SEQ ID NO: 312186 - RNA, 22 nt, Human
ucagagugaccuuacauggucu

SEQ ID NO: 312187 - RNA, 22 nt, Human
caugcuuuaccaaagcagugau

SEQ ID NO: 312188 - RNA, 22 nt, Human
agggguggccugccuuacuccc

SEQ ID NO: 312189 - RNA, 22 nt, Human
cucuggaguucuucaagcuacu

SEQ ID NO: 312190 - RNA, 22 nt, Human
acauuucuaucauccuguaaug

SEQ ID NO: 312191 - RNA, 22 nt, Human
agccccugggaguagcugcugc

SEQ ID NO: 312192 - RNA, 22 nt, Human
gagucccaugaugauagccaca

SEQ ID NO: 312193 - RNA, 22 nt, Human
uggccacccagcugacgccuuc

SEQ ID NO: 312194 - RNA, 22 nt, Human
ccagaggaggggggucuuucug

SEQ ID NO: 312195 - RNA, 22 nt, Human
agcagagccaggucucucugua

SEQ ID NO: 312196 - RNA, 22 nt, Human
cccagcucucugcucuuagccu

SEQ ID NO: 312197 - RNA, 22 nt, Human
uugaaagaagaagcugcgaugu

SEQ ID NO: 312198 - RNA, 19 nt, Human
ucaaagucugagucacuuu

SEQ ID NO: 312199 - RNA, 22 nt, Human
uuggaaauugcaagugauuugc

SEQ ID NO: 312200 - RNA, 22 nt, Human
ccucuucugagugagacucccu

SEQ ID NO: 312201 - RNA, 21 nt, Human
ggagauggguaucgccugggc

SEQ ID NO: 312202 - RNA, 22 nt, Human
uggcucagagccuugagagcug

SEQ ID NO: 312203 - RNA, 22 nt, Human
ucccagaggacuguuggugcua

SEQ ID NO: 312204 - RNA, 19 nt, Human
gggcuccuugggccucucu

SEQ ID NO: 312205 - RNA, 22 nt, Human
ucagcaaugugauacugugcaa

SEQ ID NO: 312206 - RNA, 23 nt, Human
cagguggcuccacgagggguggg

SEQ ID NO: 312207 - RNA, 22 nt, Human
cacuucaauuaacuucagcauu

SEQ ID NO: 312208 - RNA, 22 nt, Human
cugaggucuagacaccccaggg

SEQ ID NO: 312209 - RNA, 20 nt, Human
cagagacccaggcuucagcu

SEQ ID NO: 312210 - RNA, 22 nt, Human
uuugauaagagcugcugaaacu

SEQ ID NO: 312211 - RNA, 22 nt, Human
ccuggccugcucggcucuuaag

SEQ ID NO: 312212 - RNA, 22 nt, Human
uacaugcucaguaacuuucagu

SEQ ID NO: 312213 - RNA, 22 nt, Human
uuuacugaacugcuaguacagg

SEQ ID NO: 312214 - RNA, 22 nt, Human
ugcagccaccaccucugcugaa

SEQ ID NO: 312215 - RNA, 22 nt, Human
uuugcagucuggccugcuuugg

SEQ ID NO: 312216 - RNA, 22 nt, Human
cugagccagcgggcucacuuuu

SEQ ID NO: 312217 - RNA, 22 nt, Human
ggggauggaauguaguagugau

SEQ ID NO: 312218 - RNA, 22 nt, Human
aguacugucagcaggguguuga

SEQ ID NO: 312219 - RNA, 22 nt, Human
uggaaagacauucagccgcugg

SEQ ID NO: 312220 - RNA, 22 nt, Human
aguaaauaacagagaaaauggg

SEQ ID NO: 312221 - RNA, 22 nt, Human
agaggucauaucucagaagaga

SEQ ID NO: 312222 - RNA, 22 nt, Human
aguccuggguucugguguuuug

SEQ ID NO: 312223 - RNA, 20 nt, Human
cagcaggaaaagugccucag

SEQ ID NO: 312224 - RNA, 22 nt, Human
agccagggagguggagguugca

SEQ ID NO: 312225 - RNA, 22 nt, Human
uacaaaugaguuguaugaacca

SEQ ID NO: 312226 - RNA, 22 nt, Human
gaagcucucaaacucuccccuu

SEQ ID NO: 312227 - RNA, 22 nt, Human
cagggccacccucugcugggug

SEQ ID NO: 312228 - RNA, 22 nt, Human
caugaagcuugaagcaguccac

SEQ ID NO: 312229 - RNA, 22 nt, Human
ccauuguaaagaguauacuuug

SEQ ID NO: 312230 - RNA, 22 nt, Human
cccaggcugaguuagagguguc

SEQ ID NO: 312231 - RNA, 22 nt, Human
uaucuuuaacuugcaguauuua

SEQ ID NO: 312232 - RNA, 22 nt, Human
cugcaggacgaccgccucaucu

SEQ ID NO: 312233 - RNA, 22 nt, Human
ccagggcaacgcugucucagag

SEQ ID NO: 312234 - RNA, 22 nt, Human
uaacacaugguuaguacacaau

SEQ ID NO: 312235 - RNA, 19 nt, Human
gacagugcaguuguaguac

SEQ ID NO: 312236 - RNA, 22 nt, Human
uaaaugugaccuucauuuuaua

SEQ ID NO: 312237 - RNA, 22 nt, Human
ccucugaggucauggacuuggc

SEQ ID NO: 312238 - RNA, 22 nt, Human
ucuuugaaagcuguucuagagu

SEQ ID NO: 312239 - RNA, 22 nt, Human
ucaguguuugguuucagaauug

SEQ ID NO: 312240 - RNA, 22 nt, Human
ugcuggaggaguuuacuguggc

SEQ ID NO: 312241 - RNA, 22 nt, Human
ccagcuggcacuguggcugccc

SEQ ID NO: 312242 - RNA, 22 nt, Human
ggcugccaggagaagcucagug

SEQ ID NO: 312243 - RNA, 22 nt, Human
caggggcucugagauugucuaa

SEQ ID NO: 312244 - RNA, 22 nt, Human
cagagggcacaugguuuccuca

SEQ ID NO: 312245 - RNA, 22 nt, Human
uuugcagugauucuugcaguga

SEQ ID NO: 312246 - RNA, 22 nt, Human
guccugggaaggaagccaggga

SEQ ID NO: 312247 - RNA, 22 nt, Human
augcacaagaggcuagaaaaga

SEQ ID NO: 312248 - RNA, 20 nt, Human
uuccagagaucugcauuuua

SEQ ID NO: 312249 - RNA, 19 nt, Human
gcauuucucuuuacagcca

SEQ ID NO: 312250 - RNA, 17 nt, Human
gguguauggggagggaa

SEQ ID NO: 312251 - RNA, 22 nt, Human
uuccucucaacaugccugccgg

SEQ ID NO: 312252 - RNA, 22 nt, Human
gcaaagucugcaucuggaucag

SEQ ID NO: 312253 - RNA, 22 nt, Human
cagcccagcacuaaguagauuu

SEQ ID NO: 312254 - RNA, 22 nt, Human
ccagagcccgggaccuggacuu

SEQ ID NO: 312255 - RNA, 22 nt, Human
agggaguuagaaauccaggaua

SEQ ID NO: 312256 - RNA, 22 nt, Human
agauguuccagccaaugggaau

SEQ ID NO: 312257 - RNA, 20 nt, Human
acuuucucgguuucucaccu

SEQ ID NO: 312258 - RNA, 22 nt, Human
augcugagacuggagcagcugg

SEQ ID NO: 312259 - RNA, 22 nt, Human
cagucucucuccuugcaggcgu

SEQ ID NO: 312260 - RNA, 22 nt, Human
agugugggugagggaggcccuc

SEQ ID NO: 312261 - RNA, 22 nt, Human
ugacacaggcagcucccagcac

SEQ ID NO: 312262 - RNA, 22 nt, Human
aucaguuauuuuuaagcuauaa

SEQ ID NO: 312263 - RNA, 21 nt, Human
ugcucaugcaaugcaugucca

SEQ ID NO: 312264 - RNA, 22 nt, Human
ggcacugggcaccggcugaggg

SEQ ID NO: 312265 - RNA, 22 nt, Human
aagaauugguuuccucugucau

SEQ ID NO: 312266 - RNA, 22 nt, Human
gcaaugauauugaagugaugaa

SEQ ID NO: 312267 - RNA, 22 nt, Human
cugcugugcauauuuaucuagg

SEQ ID NO: 312268 - RNA, 22 nt, Human
acuuggagagcauugcugggga

SEQ ID NO: 312269 - RNA, 22 nt, Human
aagugacaccucuucccuuucc

SEQ ID NO: 312270 - RNA, 17 nt, Human
gcugccaccuuuggagc

SEQ ID NO: 312271 - RNA, 22 nt, Human
ggccucaguuucuucaacugua

SEQ ID NO: 312272 - RNA, 18 nt, Human
aaggcuucaaagaguaga

SEQ ID NO: 312273 - RNA, 22 nt, Human
aggcuccuuguucaucauccau

SEQ ID NO: 312274 - RNA, 22 nt, Human
uuucaguucaguuuauuauauc

SEQ ID NO: 312275 - RNA, 22 nt, Human
gaacccaguccaggugcagccu

SEQ ID NO: 312276 - RNA, 22 nt, Human
uuugaauagcauaggauuacau

SEQ ID NO: 312277 - RNA, 22 nt, Human
agccuucaaccuagcuagagca

SEQ ID NO: 312278 - RNA, 22 nt, Human
ugaaagcacaaguucuaacagg

SEQ ID NO: 312279 - RNA, 22 nt, Human
agauauuuguaucuugcuauug

SEQ ID NO: 312280 - RNA, 22 nt, Human
uuuuguuguaauauaccuaucc

SEQ ID NO: 312281 - RNA, 22 nt, Human
ugagccuggccugcagagacca

SEQ ID NO: 312282 - RNA, 22 nt, Human
ucaaaguuuuugagaauuacau

SEQ ID NO: 312283 - RNA, 22 nt, Human
uagauauggccgucuguuuuaa

SEQ ID NO: 312284 - RNA, 22 nt, Human
guucaaagcuccugguacagua

SEQ ID NO: 312285 - RNA, 19 nt, Human
ccaggccaucccaguuccc

SEQ ID NO: 312286 - RNA, 22 nt, Human
aaacauugcuaaauaaugcugc

SEQ ID NO: 312287 - RNA, 22 nt, Human
ccagcagcuguggcuuugccuc

SEQ ID NO: 312288 - RNA, 22 nt, Human
ugugccuggcauucugggcuuc

SEQ ID NO: 312289 - RNA, 22 nt, Human
uauuucugauugcucaugaggc

SEQ ID NO: 312290 - RNA, 22 nt, Human
agagccaggacugugucucacu

SEQ ID NO: 312291 - RNA, 22 nt, Human
cugagauggccacugggucuca

SEQ ID NO: 312292 - RNA, 22 nt, Human
cagcaggguuaagugacucacc

SEQ ID NO: 312293 - RNA, 22 nt, Human
cacaggugcuccucggggagcu

SEQ ID NO: 312294 - RNA, 22 nt, Human
aagagcuggucacagguccauu

SEQ ID NO: 312295 - RNA, 22 nt, Human
aagagagaacucccuucgccag

SEQ ID NO: 312296 - RNA, 22 nt, Human
uucuucaaauagcagggaguca

SEQ ID NO: 312297 - RNA, 22 nt, Human
uucagcagucguccaggaaaag

SEQ ID NO: 312298 - RNA, 22 nt, Human
cuggagggugagccucaucucu

SEQ ID NO: 312299 - RNA, 22 nt, Human
acagggccauuaucuguucuag

SEQ ID NO: 312300 - RNA, 22 nt, Human
caagauaagaucauuuacacua

SEQ ID NO: 312301 - RNA, 22 nt, Human
ccccuuccacagugcuuccuaa

SEQ ID NO: 312302 - RNA, 22 nt, Human
auuucauagauuguaaaucccu

SEQ ID NO: 312303 - RNA, 19 nt, Human
ugaggccaaggucacagau

SEQ ID NO: 312304 - RNA, 22 nt, Human
gagcagcucgagaaggaagcag

SEQ ID NO: 312305 - RNA, 22 nt, Human
gaggccacagcuaucagggaca

SEQ ID NO: 312306 - RNA, 22 nt, Human
aaaaugauauccugacuuuuau

SEQ ID NO: 312307 - RNA, 22 nt, Human
uuucacaaaugucuuuaacuug

SEQ ID NO: 312308 - RNA, 22 nt, Human
caucacccggaacugugucugc

SEQ ID NO: 312309 - RNA, 22 nt, Human
uuccugguaaauuauguccagg

SEQ ID NO: 312310 - RNA, 22 nt, Human
ucaguuuuaagguuugagaauu

SEQ ID NO: 312311 - RNA, 22 nt, Human
uggcucaggugugagcugaaga

SEQ ID NO: 312312 - RNA, 22 nt, Human
gagaaagcuucuuucccacagg

SEQ ID NO: 312313 - RNA, 22 nt, Human
guccucuguuagaaaugugcuu

SEQ ID NO: 312314 - RNA, 22 nt, Human
ccuuccuggcuguccgccugau

SEQ ID NO: 312315 - RNA, 22 nt, Human
ccagcuccagguagaugggcag

SEQ ID NO: 312316 - RNA, 22 nt, Human
guuauacauauguguuaacaaa

SEQ ID NO: 312317 - RNA, 21 nt, Human
agagcuggccugccaggcccu

SEQ ID NO: 312318 - RNA, 22 nt, Human
gggagcugguuccugcccucca

SEQ ID NO: 312319 - RNA, 22 nt, Human
ugcacagcgggugucugucagg

SEQ ID NO: 312320 - RNA, 20 nt, Human
gccuggcacccggggcuggc

SEQ ID NO: 312321 - RNA, 22 nt, Human
cagccaucaguaaagacagcuu

SEQ ID NO: 312322 - RNA, 22 nt, Human
uuugaaaggagcuuuauccaga

SEQ ID NO: 312323 - RNA, 22 nt, Human
auuugucuagugguauucacgu

SEQ ID NO: 312324 - RNA, 22 nt, Human
agcucccagaguccucugccca

SEQ ID NO: 312325 - RNA, 21 nt, Human
agcagaacagucgagcacugc

SEQ ID NO: 312326 - RNA, 22 nt, Human
cucuguccuugcacaguuccua

SEQ ID NO: 312327 - RNA, 22 nt, Human
gugugccagacaugaugcuaug

SEQ ID NO: 312328 - RNA, 22 nt, Human
aggagaggcaucaagaaaaucg

SEQ ID NO: 312329 - RNA, 22 nt, Human
aggcccugggcaguucuguagc

SEQ ID NO: 312330 - RNA, 22 nt, Human
agaggcuccuucacucuggcac

SEQ ID NO: 312331 - RNA, 22 nt, Human
uaacacaugguucugucaggaa

SEQ ID NO: 312332 - RNA, 22 nt, Human
ccuggcagguggagguugcagu

SEQ ID NO: 312333 - RNA, 21 nt, Human
uaugagaaaacugaggugcau

SEQ ID NO: 312334 - RNA, 22 nt, Human
uugcagggaccugcagaaagcu

SEQ ID NO: 312335 - RNA, 22 nt, Human
acuggcagccacaacuggcagg

SEQ ID NO: 312336 - RNA, 22 nt, Human
cugacagucucauugauuugcu

SEQ ID NO: 312337 - RNA, 22 nt, Human
aagugacaaaaggguauccaaa

SEQ ID NO: 312338 - RNA, 18 nt, Human
gucacuguguuucugagc

SEQ ID NO: 312339 - RNA, 17 nt, Human
gagugcugguggagcuc

SEQ ID NO: 312340 - RNA, 22 nt, Human
uugugaguagugccgcaauaaa

SEQ ID NO: 312341 - RNA, 22 nt, Human
cuggagccggcgagccccagcc

SEQ ID NO: 312342 - RNA, 22 nt, Human
gcuggcugggucccugagaggc

SEQ ID NO: 312343 - RNA, 17 nt, Human
gcucccugaggacagcu

SEQ ID NO: 312344 - RNA, 22 nt, Human
ugucccauggauaccaggcuau

SEQ ID NO: 312345 - RNA, 22 nt, Human
gcuguucucuguaacaugcauu

SEQ ID NO: 312346 - RNA, 22 nt, Human
cugcagcuguagaggacagugg

SEQ ID NO: 312347 - RNA, 22 nt, Human
ugauuucccuguagccucugaa

SEQ ID NO: 312348 - RNA, 22 nt, Human
uuaacacagggggagacaaagu

SEQ ID NO: 312349 - RNA, 22 nt, Human
uucagaaagugaaucuuguuau

SEQ ID NO: 312350 - RNA, 22 nt, Human
ggcugccugaacuuuggggaaa

SEQ ID NO: 312351 - RNA, 22 nt, Human
cugggagcccgcguccuggugg

SEQ ID NO: 312352 - RNA, 22 nt, Human
gaacaauagugguaacaaagcc

SEQ ID NO: 312353 - RNA, 22 nt, Human
uugcugaaguuaaugcuugcaa

SEQ ID NO: 312354 - RNA, 22 nt, Human
uaugaacucuggagucugagug

SEQ ID NO: 312355 - RNA, 22 nt, Human
agccucugugacucacagguca

SEQ ID NO: 312356 - RNA, 22 nt, Human
aggccagcagcaugacggcauc

SEQ ID NO: 312357 - RNA, 22 nt, Human
acuguucauuuggauuucucug

SEQ ID NO: 312358 - RNA, 19 nt, Human
cauaauacaguggaucuga

SEQ ID NO: 312359 - RNA, 22 nt, Human
agggguggagaguguugccagu

SEQ ID NO: 312360 - RNA, 22 nt, Human
uccugccucuccaugcuaacua

SEQ ID NO: 312361 - RNA, 22 nt, Human
uagaauucaagauucaacaggc

SEQ ID NO: 312362 - RNA, 22 nt, Human
cgccaggcuugguagcucaugc

SEQ ID NO: 312363 - RNA, 22 nt, Human
ugcaccugagaggucucugagg

SEQ ID NO: 312364 - RNA, 22 nt, Human
ucugaggcauacccaggccccc

SEQ ID NO: 312365 - RNA, 22 nt, Human
ccagucccagcucugccaugcu

SEQ ID NO: 312366 - RNA, 22 nt, Human
auacauauaugguacuuccugg

SEQ ID NO: 312367 - RNA, 22 nt, Human
caaggaaacaugaaaugcauug

SEQ ID NO: 312368 - RNA, 22 nt, Human
uucaggauccccuugaugggcu

SEQ ID NO: 312369 - RNA, 22 nt, Human
uuuguuuagaaagagauuggug

SEQ ID NO: 312370 - RNA, 22 nt, Human
caugaguuuuuuaguucaugca

SEQ ID NO: 312371 - RNA, 22 nt, Human
gucuggagccacccuaagcauu

SEQ ID NO: 312372 - RNA, 22 nt, Human
agacaaagaaaccguagaagca

SEQ ID NO: 312373 - RNA, 22 nt, Human
agcuguguagggaaucagagaa

SEQ ID NO: 312374 - RNA, 22 nt, Human
aaaggccacacagagcagggag

SEQ ID NO: 312375 - RNA, 22 nt, Human
uauguuauuuucauacaacaga

SEQ ID NO: 312376 - RNA, 22 nt, Human
aguuauaugugaaaacacguau

SEQ ID NO: 312377 - RNA, 22 nt, Human
ggagcuguuggcagcuaucuug

SEQ ID NO: 312378 - RNA, 22 nt, Human
uagugaaauuuaugcacagcua

SEQ ID NO: 312379 - RNA, 22 nt, Human
uuugaaagucaaccuuccaguu

SEQ ID NO: 312380 - RNA, 22 nt, Human
aaaaguguccagauuaugaaga

SEQ ID NO: 312381 - RNA, 22 nt, Human
gccucugcaacuccgccuuggu

SEQ ID NO: 312382 - RNA, 22 nt, Human
agucaaagcuacaggcauuuga

SEQ ID NO: 312383 - RNA, 22 nt, Human
cuguggaauugaugcuuagugu

SEQ ID NO: 312384 - RNA, 21 nt, Human
gaugaagcaaucuuucuguug

SEQ ID NO: 312385 - RNA, 22 nt, Human
auuauauugaguauaaccagag

SEQ ID NO: 312386 - RNA, 22 nt, Human
uguacaguauauuucaaagcca

SEQ ID NO: 312387 - RNA, 22 nt, Human
uacaacauuguguugcuucaua

SEQ ID NO: 312388 - RNA, 22 nt, Human
ucucaggaagugauauugagac

SEQ ID NO: 312389 - RNA, 22 nt, Human
gccaccagguuagauccagccu

SEQ ID NO: 312390 - RNA, 21 nt, Human
ucagcagcaucugccuagagu

SEQ ID NO: 312391 - RNA, 22 nt, Human
caaggccaaagggccacuguca

SEQ ID NO: 312392 - RNA, 22 nt, Human
cugggcacuugcucacagcucu

SEQ ID NO: 312393 - RNA, 22 nt, Human
acaaggaggucuggggggcccu

SEQ ID NO: 312394 - RNA, 22 nt, Human
ugcuugggaauguggagucaga

SEQ ID NO: 312395 - RNA, 22 nt, Human
agggugcauguuugcaagagug

SEQ ID NO: 312396 - RNA, 22 nt, Human
cuggugagacgguugacaggag

SEQ ID NO: 312397 - RNA, 22 nt, Human
agcugcucuuugaaggacacuu

SEQ ID NO: 312398 - RNA, 22 nt, Human
gcagugggcaacaagagcugga

SEQ ID NO: 312399 - RNA, 22 nt, Human
uuuaaauuuguguuuagagggu

SEQ ID NO: 312400 - RNA, 22 nt, Human
cugcugugagugguucuugccu

SEQ ID NO: 312401 - RNA, 17 nt, Human
cucugcagugcauggcu

SEQ ID NO: 312402 - RNA, 22 nt, Human
uggcucagcaagacauugaccu

SEQ ID NO: 312403 - RNA, 22 nt, Human
agucucagggccacccggggaa

SEQ ID NO: 312404 - RNA, 22 nt, Human
gcugagcugaggcagggcuggg

SEQ ID NO: 312405 - RNA, 22 nt, Human
ucauaaaacacaccagguaguu

SEQ ID NO: 312406 - RNA, 20 nt, Human
ccagaagagaugaucaucca

SEQ ID NO: 312407 - RNA, 22 nt, Human
uauguacuaacuuucauucuag

SEQ ID NO: 312408 - RNA, 22 nt, Human
ugauacagucagcucacaauug

SEQ ID NO: 312409 - RNA, 22 nt, Human
gcucaaggcaggcagacaugag

SEQ ID NO: 312410 - RNA, 22 nt, Human
cccagccucugggcucacccaa

SEQ ID NO: 312411 - RNA, 22 nt, Human
aagauauucaaagauuuauuag

SEQ ID NO: 312412 - RNA, 22 nt, Human
aucuuucagagcuccaucaggg

SEQ ID NO: 312413 - RNA, 22 nt, Human
ucuuucagccacuuaccugucu

SEQ ID NO: 312414 - RNA, 21 nt, Human
uaaaugugagcagggcugggc

SEQ ID NO: 312415 - RNA, 22 nt, Human
ugcucucucaggccuggcccac

SEQ ID NO: 312416 - RNA, 22 nt, Human
aagaaauggcuucaucugagua

SEQ ID NO: 312417 - RNA, 22 nt, Human
ugagccugcugucgcuggaccc

SEQ ID NO: 312418 - RNA, 22 nt, Human
agcugagcauuugauccaccuc

SEQ ID NO: 312419 - RNA, 22 nt, Human
ggcugcaggcaggguauccacu

SEQ ID NO: 312420 - RNA, 22 nt, Human
cauguacaaaaggcaaaugccu

SEQ ID NO: 312421 - RNA, 22 nt, Human
agggaaauuaaugugagcaaug

SEQ ID NO: 312422 - RNA, 23 nt, Human
gucagggcuggggucagagugac

SEQ ID NO: 312423 - RNA, 22 nt, Human
ccucaguguguggauguuagag

SEQ ID NO: 312424 - RNA, 22 nt, Human
gccucugcugacaagauggaca

SEQ ID NO: 312425 - RNA, 22 nt, Human
uuguacaaauaggaaccucuga

SEQ ID NO: 312426 - RNA, 22 nt, Human
ugcaggagaaaguacggagcgu

SEQ ID NO: 312427 - RNA, 22 nt, Human
uguaauggaagugggauugcau

SEQ ID NO: 312428 - RNA, 22 nt, Human
caggcugucugaauggaggccc

SEQ ID NO: 312429 - RNA, 22 nt, Human
caggaugagaggcccagggaag

SEQ ID NO: 312430 - RNA, 22 nt, Human
agcccugggaggccagcuugua

SEQ ID NO: 312431 - RNA, 22 nt, Human
accaucagucacauguagagaa

SEQ ID NO: 312432 - RNA, 22 nt, Human
aaaugcagaucccugaaucuca

SEQ ID NO: 312433 - RNA, 22 nt, Human
aggcugggaaauguagucuucc

SEQ ID NO: 312434 - RNA, 22 nt, Human
agacacugccacuucuguuccc

SEQ ID NO: 312435 - RNA, 22 nt, Human
uaaacagaaagcagauguacuu

SEQ ID NO: 312436 - RNA, 22 nt, Human
ugaacauauucaccucuaaaua

SEQ ID NO: 312437 - RNA, 22 nt, Human
gaggagaagcuaagaaacacag

SEQ ID NO: 312438 - RNA, 22 nt, Human
gaguaagagcuggcuuuggugu

SEQ ID NO: 312439 - RNA, 22 nt, Human
uguacuaaggcuguguagaugu

SEQ ID NO: 312440 - RNA, 22 nt, Human
aagauauagauaaaacuaugca

SEQ ID NO: 312441 - RNA, 22 nt, Human
ucaggagauggucuuuauaggc

SEQ ID NO: 312442 - RNA, 22 nt, Human
uuccauaaucaccuuauucuuu

SEQ ID NO: 312443 - RNA, 22 nt, Human
ccugggcagguguggcuucccc

SEQ ID NO: 312444 - RNA, 22 nt, Human
agcuucuggaagccuggcagca

SEQ ID NO: 312445 - RNA, 21 nt, Human
ggccugagcaccuguccaccu

SEQ ID NO: 312446 - RNA, 22 nt, Human
uucuuacagaguuuacagagcc

SEQ ID NO: 312447 - RNA, 22 nt, Human
cagcaggggaacugugggccag

SEQ ID NO: 312448 - RNA, 22 nt, Human
uuguaugaucaaaagaaaugua

SEQ ID NO: 312449 - RNA, 21 nt, Human
aauaaaacaguuggugucaau

SEQ ID NO: 312450 - RNA, 22 nt, Human
aggugcagcugacaccaugugg

SEQ ID NO: 312451 - RNA, 22 nt, Human
cacagcuuccauuagaaugaga

SEQ ID NO: 312452 - RNA, 22 nt, Human
uggcucaguaaucgagucuccu

SEQ ID NO: 312453 - RNA, 22 nt, Human
uuuugaaagggugauuuggcuu

SEQ ID NO: 312454 - RNA, 22 nt, Human
auacaacagaaaaugauuauuc

SEQ ID NO: 312455 - RNA, 20 nt, Human
aguguacagacacuagaaau

SEQ ID NO: 312456 - RNA, 22 nt, Human
ucagcagugcagggugaggcag

SEQ ID NO: 312457 - RNA, 22 nt, Human
aaggccagccugagagcuaaca

SEQ ID NO: 312458 - RNA, 22 nt, Human
uccacuuuagcaaugauugaau

SEQ ID NO: 312459 - RNA, 22 nt, Human
aagggagguaaagcuauuuaaa

SEQ ID NO: 312460 - RNA, 22 nt, Human
acccugccgugggcugcuugug

SEQ ID NO: 312461 - RNA, 22 nt, Human
aggccuguuccaggccccuuuu

SEQ ID NO: 312462 - RNA, 22 nt, Human
cccaggaggcagagguugcagu

SEQ ID NO: 312463 - RNA, 22 nt, Human
uuuccucuccaccaggaggucu

SEQ ID NO: 312464 - RNA, 22 nt, Human
ccagucccgcaugguccagaau

SEQ ID NO: 312465 - RNA, 23 nt, Human
agggguggucaguacccgcagug

SEQ ID NO: 312466 - RNA, 22 nt, Human
agcagcucugagaggccagcac

SEQ ID NO: 312467 - RNA, 22 nt, Human
ccugaagcaaggguaggcaggu

SEQ ID NO: 312468 - RNA, 22 nt, Human
aauuucagaacccaaauuagcg

SEQ ID NO: 312469 - RNA, 22 nt, Human
cuucucagucaccugugagucu

SEQ ID NO: 312470 - RNA, 22 nt, Human
cccuuccucccaggcuucugug

SEQ ID NO: 312471 - RNA, 22 nt, Human
ccaaggcuccucagcuggucuu

SEQ ID NO: 312472 - RNA, 23 nt, Human
aaccagauaaauggcuccagggc

SEQ ID NO: 312473 - RNA, 22 nt, Human
uuaugguaauuaaaacauguau

SEQ ID NO: 312474 - RNA, 22 nt, Human
augcuacagcaucucucaucag

SEQ ID NO: 312475 - RNA, 22 nt, Human
uuuccucugaugcugacuugga

SEQ ID NO: 312476 - RNA, 22 nt, Human
cauaauuugauaugcuugaugg

SEQ ID NO: 312477 - RNA, 22 nt, Human
uuuguuaaauauuuauugagug

SEQ ID NO: 312478 - RNA, 22 nt, Human
acugaaggucucagcaaggaug

SEQ ID NO: 312479 - RNA, 22 nt, Human
uccuguaguugcuaaguuuguu

SEQ ID NO: 312480 - RNA, 22 nt, Human
gcugauguaagacuuuugguuu

SEQ ID NO: 312481 - RNA, 22 nt, Human
gggagcuggagcuggaagacuc

SEQ ID NO: 312482 - RNA, 22 nt, Human
uuagccauguugaagauuuaga

SEQ ID NO: 312483 - RNA, 22 nt, Human
agcccugggauacaguaaaagc

SEQ ID NO: 312484 - RNA, 22 nt, Human
acuggcaguuugagaaugcauu

SEQ ID NO: 312485 - RNA, 22 nt, Human
agaauucucuuccauugaaaca

SEQ ID NO: 312486 - RNA, 22 nt, Human
uagaacauaagucauucauuug

SEQ ID NO: 312487 - RNA, 22 nt, Human
uggcuggcaaggcuggagucag

SEQ ID NO: 312488 - RNA, 22 nt, Human
ugaggcaguucuuacuuguauu

SEQ ID NO: 312489 - RNA, 22 nt, Human
agagcugagaauguggcuuccu

SEQ ID NO: 312490 - RNA, 22 nt, Human
uaugcacaauaugaucuauuug

SEQ ID NO: 312491 - RNA, 22 nt, Human
cagcugcccugccuugcccuua

SEQ ID NO: 312492 - RNA, 22 nt, Human
uuguauuucuccacuuucuguu

SEQ ID NO: 312493 - RNA, 22 nt, Human
agccaagcacucaacuccugga

SEQ ID NO: 312494 - RNA, 22 nt, Human
ucagauggguuuugaaggaugu

SEQ ID NO: 312495 - RNA, 22 nt, Human
ggacggggagcuggaaagggga

SEQ ID NO: 312496 - RNA, 22 nt, Human
uuccauaauaggcuuaagugaa

SEQ ID NO: 312497 - RNA, 22 nt, Human
gaggcccaggucaagcagccac

SEQ ID NO: 312498 - RNA, 17 nt, Human
aggcauggucuggggug

SEQ ID NO: 312499 - RNA, 22 nt, Human
aagcagaugggacuccaaggca

SEQ ID NO: 312500 - RNA, 22 nt, Human
ucaguguuauuagaugagguuu

SEQ ID NO: 312501 - RNA, 22 nt, Human
uaaggcacgcauaagagggggc

SEQ ID NO: 312502 - RNA, 21 nt, Human
acagcagacaggcuuaggacc

SEQ ID NO: 312503 - RNA, 21 nt, Human
ugacugaggcuucuucacaca

SEQ ID NO: 312504 - RNA, 22 nt, Human
gagggcacucgagacuacggca

SEQ ID NO: 312505 - RNA, 22 nt, Human
uuuucauuuacauuagggaaga

SEQ ID NO: 312506 - RNA, 22 nt, Human
cgucuuccucuuacgaugcgcu

SEQ ID NO: 312507 - RNA, 22 nt, Human
cugccuccugccgugcagcuuc

SEQ ID NO: 312508 - RNA, 22 nt, Human
augcagcugugggcaagaaaug

SEQ ID NO: 312509 - RNA, 22 nt, Human
aggcacugaaggaagcuugcgc

SEQ ID NO: 312510 - RNA, 22 nt, Human
aaaguuacuaucacaaugaaau

SEQ ID NO: 312511 - RNA, 22 nt, Human
augaaauguaugagucuggguu

SEQ ID NO: 312512 - RNA, 22 nt, Human
uaugcauaugaccccaagcuug

SEQ ID NO: 312513 - RNA, 22 nt, Human
ggaggccaaggugggcggauca

SEQ ID NO: 312514 - RNA, 22 nt, Human
uaaacauggauucugaucacag

SEQ ID NO: 312515 - RNA, 22 nt, Human
agccuggauccauguggcuacc

SEQ ID NO: 312516 - RNA, 22 nt, Human
guaacagaggguuugcagauau

SEQ ID NO: 312517 - RNA, 22 nt, Human
agggugcagaaggagccuagga

SEQ ID NO: 312518 - RNA, 22 nt, Human
ggagcugugcagugacuacaga

SEQ ID NO: 312519 - RNA, 19 nt, Human
gcagcugugggaagagcca

SEQ ID NO: 312520 - RNA, 22 nt, Human
gcacccagccagcaucucagag

SEQ ID NO: 312521 - RNA, 22 nt, Human
ucaaaguccuugcuuuuucugu

SEQ ID NO: 312522 - RNA, 22 nt, Human
ggcugcagggcagcuggugugg

SEQ ID NO: 312523 - RNA, 22 nt, Human
ucuuugaacuuggcugaucucu

SEQ ID NO: 312524 - RNA, 22 nt, Human
ccaggcuggauuuugcaguuca

SEQ ID NO: 312525 - RNA, 22 nt, Human
uggccuggggaccugugagacc

SEQ ID NO: 312526 - RNA, 22 nt, Human
auguuuccgugagcauccuuga

SEQ ID NO: 312527 - RNA, 22 nt, Human
augcuauacucaaagaaauuca

SEQ ID NO: 312528 - RNA, 22 nt, Human
aagguacagaaauuaacaagga

SEQ ID NO: 312529 - RNA, 22 nt, Human
ccuguucacccuccaugcacag

SEQ ID NO: 312530 - RNA, 22 nt, Human
uacacacaugcauuugccuuau

SEQ ID NO: 312531 - RNA, 22 nt, Human
uagagcugcuggacuguaacag

SEQ ID NO: 312532 - RNA, 22 nt, Human
cuuacauuuaaucaugugucau

SEQ ID NO: 312533 - RNA, 22 nt, Human
acagaacuuccugcuggagugg

SEQ ID NO: 312534 - RNA, 22 nt, Human
ugcucugggcaacagccucccu

SEQ ID NO: 312535 - RNA, 19 nt, Human
cugccuguuauggagagaa

SEQ ID NO: 312536 - RNA, 22 nt, Human
cauauaaauacaacauguguua

SEQ ID NO: 312537 - RNA, 20 nt, Human
aacagggggcugcagagggc

SEQ ID NO: 312538 - RNA, 22 nt, Human
ucaggccuucagaccuggcccg

SEQ ID NO: 312539 - RNA, 22 nt, Human
aggccugggcaagaaggggcgu

SEQ ID NO: 312540 - RNA, 22 nt, Human
uguccucuuccagugcuccuuc

SEQ ID NO: 312541 - RNA, 22 nt, Human
aaggggaagagaccgcagaguc

SEQ ID NO: 312542 - RNA, 22 nt, Human
cuaaaugcccuacaaugacugg

SEQ ID NO: 312543 - RNA, 22 nt, Human
cuggugguucaggagaauggcu

SEQ ID NO: 312544 - RNA, 22 nt, Human
gcuccuggcuccaggcagccaa

SEQ ID NO: 312545 - RNA, 22 nt, Human
uuacaguauuguuaaacucuuu

SEQ ID NO: 312546 - RNA, 22 nt, Human
ucuuuggaucccaacuggcugg

SEQ ID NO: 312547 - RNA, 22 nt, Human
aagauuucucuccuggaaagca

SEQ ID NO: 312548 - RNA, 22 nt, Human
ucaggcugugggcacuggccau

SEQ ID NO: 312549 - RNA, 22 nt, Human
ucaguguucagcggugugugca

SEQ ID NO: 312550 - RNA, 22 nt, Human
cgggcagaucacacagggcuug

SEQ ID NO: 312551 - RNA, 22 nt, Human
ccagcucucuuugaagcauaaa

SEQ ID NO: 312552 - RNA, 22 nt, Human
acauugcugcauucuccuuccc

SEQ ID NO: 312553 - RNA, 23 nt, Human
aggauguaggauguauggcagag

SEQ ID NO: 312554 - RNA, 22 nt, Human
ggcucugcugguaagaugccuc

SEQ ID NO: 312555 - RNA, 22 nt, Human
cugcaggauucucccaguugga

SEQ ID NO: 312556 - RNA, 22 nt, Human
ugguccuggggaucugcaguga

SEQ ID NO: 312557 - RNA, 22 nt, Human
ccucagaugucuuaaggcacug

SEQ ID NO: 312558 - RNA, 22 nt, Human
augaagucugcacaugcaugug

SEQ ID NO: 312559 - RNA, 22 nt, Human
ggggugggguuacucauugugc

SEQ ID NO: 312560 - RNA, 22 nt, Human
ggcaggugugagaucgaggcca

SEQ ID NO: 312561 - RNA, 22 nt, Human
gagauggggucagcugggacau

SEQ ID NO: 312562 - RNA, 22 nt, Human
aggguggccaugagggagagau

SEQ ID NO: 312563 - RNA, 22 nt, Human
ucaggagaaucagggcuguccu

SEQ ID NO: 312564 - RNA, 22 nt, Human
cugagccagggccacacaugga

SEQ ID NO: 312565 - RNA, 22 nt, Human
cuguauuuucaugccuacguac

SEQ ID NO: 312566 - RNA, 22 nt, Human
uucauguauuuaucauguaaau

SEQ ID NO: 312567 - RNA, 22 nt, Human
gaucuucucuuuaguagaaaca

SEQ ID NO: 312568 - RNA, 22 nt, Human
gcacccaggcuugggcagcaac

SEQ ID NO: 312569 - RNA, 22 nt, Human
aaacagcuaauggccaggaaua

SEQ ID NO: 312570 - RNA, 22 nt, Human
ggcagaaggccucccagcuccu

SEQ ID NO: 312571 - RNA, 21 nt, Human
aaucauacaaaacaugucagg

SEQ ID NO: 312572 - RNA, 22 nt, Human
uuuguaugugauaagacuauuc

SEQ ID NO: 312573 - RNA, 22 nt, Human
gagcugccaagauuacaaucag

SEQ ID NO: 312574 - RNA, 22 nt, Human
aggagagaauguuccaggcuug

SEQ ID NO: 312575 - RNA, 22 nt, Human
uccuucagcuacucaguuucca

SEQ ID NO: 312576 - RNA, 20 nt, Human
uggcccuguuuucuccaggc

SEQ ID NO: 312577 - RNA, 22 nt, Human
gucaaguuaagauaaggucaug

SEQ ID NO: 312578 - RNA, 22 nt, Human
caggacagagcccagacugugu

SEQ ID NO: 312579 - RNA, 20 nt, Human
ugggccuguggcagaagucu

SEQ ID NO: 312580 - RNA, 21 nt, Human
ccugccaggaaacugaguguc

SEQ ID NO: 312581 - RNA, 22 nt, Human
cagaccagcucuaugaacccaa

SEQ ID NO: 312582 - RNA, 22 nt, Human
auaugagaauuggaaaauauca

SEQ ID NO: 312583 - RNA, 22 nt, Human
gcaggguaggugacagguaguc

SEQ ID NO: 312584 - RNA, 22 nt, Human
uggagaagucaaagugaacagg

SEQ ID NO: 312585 - RNA, 22 nt, Human
ucucuaguugaggacugagcag

SEQ ID NO: 312586 - RNA, 22 nt, Human
cagggugccaaagaacaaauau

SEQ ID NO: 312587 - RNA, 22 nt, Human
uuauucuuuaaacauauauguu

SEQ ID NO: 312588 - RNA, 22 nt, Human
ugaacagauggcccagcagagg

SEQ ID NO: 312589 - RNA, 22 nt, Human
ugaccaaagaguugcuuguauu

SEQ ID NO: 312590 - RNA, 23 nt, Human
aaguucaagucacagccugucuu

SEQ ID NO: 312591 - RNA, 22 nt, Human
ucagcaguuuuauaugcagcuu

SEQ ID NO: 312592 - RNA, 22 nt, Human
ccagcugacgaugccuggucuc

SEQ ID NO: 312593 - RNA, 22 nt, Human
guguguuuagcauuagcagggg

SEQ ID NO: 312594 - RNA, 22 nt, Human
cccagggacagaugggcagcua

SEQ ID NO: 312595 - RNA, 22 nt, Human
uggcacugagcagccgcggcag

SEQ ID NO: 312596 - RNA, 22 nt, Human
ggauaagaaaauuguaauaacu

SEQ ID NO: 312597 - RNA, 22 nt, Human
ugucucagaauggcucauaaua

SEQ ID NO: 312598 - RNA, 22 nt, Human
ucuggcaggcaaucggcucugg

SEQ ID NO: 312599 - RNA, 22 nt, Human
aaucacuuuucucuaauguagc

SEQ ID NO: 312600 - RNA, 22 nt, Human
uggcagcuggagggcaauggcc

SEQ ID NO: 312601 - RNA, 22 nt, Human
guccacauaggaacccagcuuc

SEQ ID NO: 312602 - RNA, 22 nt, Human
gaagcagcuagcccacuaguca

SEQ ID NO: 312603 - RNA, 22 nt, Human
auaugaaaauguuuuagcugua

SEQ ID NO: 312604 - RNA, 22 nt, Human
uauaauuuaucaugucacaguu

SEQ ID NO: 312605 - RNA, 20 nt, Human
ccucaguguccuggacuggg

SEQ ID NO: 312606 - RNA, 22 nt, Human
uauguguacaucugguugagca

SEQ ID NO: 312607 - RNA, 22 nt, Human
ccuggggcucaagauggcgccg

SEQ ID NO: 312608 - RNA, 22 nt, Human
ugugauauuugaguauugucaa

SEQ ID NO: 312609 - RNA, 22 nt, Human
cagaggcugaugugggaugggc

SEQ ID NO: 312610 - RNA, 22 nt, Human
aggagagagcugagcuuugcug

SEQ ID NO: 312611 - RNA, 22 nt, Human
uuugggcaggcuuuucccuaga

SEQ ID NO: 312612 - RNA, 22 nt, Human
ucacaacucuuuccauuuaaua

SEQ ID NO: 312613 - RNA, 22 nt, Human
ccugggcagggcuggacucuca

SEQ ID NO: 312614 - RNA, 22 nt, Human
cuccagggaugagacagaguag

SEQ ID NO: 312615 - RNA, 22 nt, Human
ccuguucauuuguauuugucuu

SEQ ID NO: 312616 - RNA, 22 nt, Human
gggcuggcucccagguguugaa

SEQ ID NO: 312617 - RNA, 22 nt, Human
acagggucaagggugcuacaag

SEQ ID NO: 312618 - RNA, 22 nt, Human
uucauuacugcgguagucacac

SEQ ID NO: 312619 - RNA, 20 nt, Human
uaugaagauaugugaacagc

SEQ ID NO: 312620 - RNA, 20 nt, Human
aaucucaguauccuaugcaa

SEQ ID NO: 312621 - RNA, 22 nt, Human
uguauaaacuuaagcaggaacc

SEQ ID NO: 312622 - RNA, 22 nt, Human
cugagcugggacucaguagcaa

SEQ ID NO: 312623 - RNA, 21 nt, Human
ugaaugcuucgucauccuggc

SEQ ID NO: 312624 - RNA, 22 nt, Human
ucccagcccagauuugugugac

SEQ ID NO: 312625 - RNA, 22 nt, Human
gcaguguuuacauauuagaaac

SEQ ID NO: 312626 - RNA, 22 nt, Human
auguaauuuauguuauccauaa

SEQ ID NO: 312627 - RNA, 22 nt, Human
uucugagacaauugagagucua

SEQ ID NO: 312628 - RNA, 22 nt, Human
agauaacuuuuggguauucaug

SEQ ID NO: 312629 - RNA, 22 nt, Human
cugcagcugucucuacugggca

SEQ ID NO: 312630 - RNA, 22 nt, Human
uuuggaauguaguuuaaucauc

SEQ ID NO: 312631 - RNA, 22 nt, Human
gugcucacugugagacguccug

SEQ ID NO: 312632 - RNA, 20 nt, Human
cucugcugcccgccggcugc

SEQ ID NO: 312633 - RNA, 22 nt, Human
aagacauuacuggaaucugacu

SEQ ID NO: 312634 - RNA, 19 nt, Human
ugaaggagggggauggcca

SEQ ID NO: 312635 - RNA, 22 nt, Human
ugucucugggugauucaguccu

SEQ ID NO: 312636 - RNA, 22 nt, Human
gagcugccagacaugggaauga

SEQ ID NO: 312637 - RNA, 22 nt, Human
ggcagagccuucuggagcucgc

SEQ ID NO: 312638 - RNA, 22 nt, Human
cagcuguucuugggacagacag

SEQ ID NO: 312639 - RNA, 22 nt, Human
ccaaaauguuugaaugcaugug

SEQ ID NO: 312640 - RNA, 22 nt, Human
ggcagagguagcuggaaccagg

SEQ ID NO: 312641 - RNA, 22 nt, Human
gaaugcacacgugugugcaugc

SEQ ID NO: 312642 - RNA, 22 nt, Human
auaaggcaucucucaguuagca

SEQ ID NO: 312643 - RNA, 22 nt, Human
cuggagcuaggaaguccaagau

SEQ ID NO: 312644 - RNA, 22 nt, Human
aagaacaguugggaggugagcc

SEQ ID NO: 312645 - RNA, 22 nt, Human
uucaagauggcaccagugagug

SEQ ID NO: 312646 - RNA, 21 nt, Human
ucaggggcuguguuuuccauc

SEQ ID NO: 312647 - RNA, 22 nt, Human
auuauguagcuaaaaauugugu

SEQ ID NO: 312648 - RNA, 22 nt, Human
ucuuagcacagcuauauaaguu

SEQ ID NO: 312649 - RNA, 22 nt, Human
aggccugagccccagguuuguu

SEQ ID NO: 312650 - RNA, 22 nt, Human
caaggcaggaagccugucuuau

SEQ ID NO: 312651 - RNA, 22 nt, Human
gaggagguuccggguggagaag

SEQ ID NO: 312652 - RNA, 22 nt, Human
gaggagaagcuauuggaaggac

SEQ ID NO: 312653 - RNA, 22 nt, Human
agacagggucuugaucagagcu

SEQ ID NO: 312654 - RNA, 22 nt, Human
aaauaguucagcuuguaaaccc

SEQ ID NO: 312655 - RNA, 22 nt, Human
cucuggccgcagcucagcucug

SEQ ID NO: 312656 - RNA, 22 nt, Human
aaaaaugcuuggacuuaauaaa

SEQ ID NO: 312657 - RNA, 22 nt, Human
caggguggcacaucacagcauu

SEQ ID NO: 312658 - RNA, 22 nt, Human
ugcccugugugugcaagcacug

SEQ ID NO: 312659 - RNA, 22 nt, Human
ccugcccagcuucaccucaggc

SEQ ID NO: 312660 - RNA, 22 nt, Human
agcugagcucaggcugauguaa

SEQ ID NO: 312661 - RNA, 20 nt, Human
guggccuguccuguuguggg

SEQ ID NO: 312662 - RNA, 22 nt, Human
uaguucuacucaaagugugauc

SEQ ID NO: 312663 - RNA, 22 nt, Human
ucuucucaguuucucuaggaug

SEQ ID NO: 312664 - RNA, 22 nt, Human
uucucugaguacguuucagugu

SEQ ID NO: 312665 - RNA, 19 nt, Human
aagggcugggcaccucacu

SEQ ID NO: 312666 - RNA, 19 nt, Human
ucuggcuccgccucuuagu

SEQ ID NO: 312667 - RNA, 22 nt, Human
ccugagaccaaguugcagccau

SEQ ID NO: 312668 - RNA, 22 nt, Human
caguagccacuagacacaugua

SEQ ID NO: 312669 - RNA, 22 nt, Human
cacauguuuggcaugucaccaa

SEQ ID NO: 312670 - RNA, 22 nt, Human
ggcucugcccagguggacagca

SEQ ID NO: 312671 - RNA, 22 nt, Human
agaggcaggaagagcugauuuu

SEQ ID NO: 312672 - RNA, 23 nt, Human
ccacuagcaccuguucaacuucu

SEQ ID NO: 312673 - RNA, 20 nt, Human
aaaaucucccagaaacuuau

SEQ ID NO: 312674 - RNA, 22 nt, Human
ucacaaaugaggaaaucgagca

SEQ ID NO: 312675 - RNA, 22 nt, Human
gcuggcuugauaguuucugcuu

SEQ ID NO: 312676 - RNA, 22 nt, Human
ucagcugcucaaauuuauguca

SEQ ID NO: 312677 - RNA, 23 nt, Human
ucaugcccaggcuccagauguca

SEQ ID NO: 312678 - RNA, 22 nt, Human
ggacagcccauacacaugucug

SEQ ID NO: 312679 - RNA, 21 nt, Human
agcagcugcaguuucuaucug

SEQ ID NO: 312680 - RNA, 22 nt, Human
cccagccugugacagccguccu

SEQ ID NO: 312681 - RNA, 22 nt, Human
uggaggaaaauuacuggggucu

SEQ ID NO: 312682 - RNA, 22 nt, Human
aggaguguggccagggcucugg

SEQ ID NO: 312683 - RNA, 22 nt, Human
aggcuucuaggguuggcagcgg

SEQ ID NO: 312684 - RNA, 22 nt, Human
uuguaacagcuguuuauauagu

SEQ ID NO: 312685 - RNA, 22 nt, Human
aucuuucuccauauacaucuuu

SEQ ID NO: 312686 - RNA, 22 nt, Human
caggugggcguggcgagaaggc

SEQ ID NO: 312687 - RNA, 22 nt, Human
ggagcuggccgccuaugugcag

SEQ ID NO: 312688 - RNA, 22 nt, Human
ggucucagcuggaguccuuggu

SEQ ID NO: 312689 - RNA, 22 nt, Human
gcagcguggggacaggagcuca

SEQ ID NO: 312690 - RNA, 22 nt, Human
cuggccuucagacucggacuga

SEQ ID NO: 312691 - RNA, 22 nt, Human
ugaaaugaaugugauucgauag

SEQ ID NO: 312692 - RNA, 22 nt, Human
caggagugaguuggggucuaca

SEQ ID NO: 312693 - RNA, 22 nt, Human
gcugucacaagcaucuggggca

SEQ ID NO: 312694 - RNA, 22 nt, Human
gugucccaggagaggagacaau

SEQ ID NO: 312695 - RNA, 22 nt, Human
acugcuuuuagaaaucuauaga

SEQ ID NO: 312696 - RNA, 22 nt, Human
uauuucuugaguggucaguuuc

SEQ ID NO: 312697 - RNA, 22 nt, Human
ggugaagggugucauggcauuu

SEQ ID NO: 312698 - RNA, 21 nt, Human
uaacacauuuugguacuuugg

SEQ ID NO: 312699 - RNA, 22 nt, Human
cuguggcuaggaagcuguggga

SEQ ID NO: 312700 - RNA, 20 nt, Human
guccugggagccacagcaca

SEQ ID NO: 312701 - RNA, 22 nt, Human
aagaauguucuuguagucauga

SEQ ID NO: 312702 - RNA, 23 nt, Human
agagcuuagggaauucacaugag

SEQ ID NO: 312703 - RNA, 22 nt, Human
ccaggccuggccaggggaugcc

SEQ ID NO: 312704 - RNA, 22 nt, Human
uaagaacaguagaacaguaggu

SEQ ID NO: 312705 - RNA, 22 nt, Human
gcugcagccaaauucauuguca

SEQ ID NO: 312706 - RNA, 22 nt, Human
cagaguucaaagccugcuggga

SEQ ID NO: 312707 - RNA, 21 nt, Human
cacaggugggucagugaggcc

SEQ ID NO: 312708 - RNA, 22 nt, Human
uuaaaaugcagauucugauuca

SEQ ID NO: 312709 - RNA, 17 nt, Human
cagacagauauccuggg

SEQ ID NO: 312710 - RNA, 22 nt, Human
aaauguguguauguacauauau

SEQ ID NO: 312711 - RNA, 22 nt, Human
gcuggagguuucaccugaguuu

SEQ ID NO: 312712 - RNA, 20 nt, Human
agaauucuuacccuuugaug

SEQ ID NO: 312713 - RNA, 22 nt, Human
gagaagcaauuuccaacugugc

SEQ ID NO: 312714 - RNA, 22 nt, Human
agugccaggagcaaggagcucc

SEQ ID NO: 312715 - RNA, 22 nt, Human
aaagccuugcccgucacuggga

SEQ ID NO: 312716 - RNA, 22 nt, Human
uccugggcccaggcugccaggg

SEQ ID NO: 312717 - RNA, 22 nt, Human
ggagauggcucugcaaggucua

SEQ ID NO: 312718 - RNA, 22 nt, Human
caggcagcugcuggguucagcc

SEQ ID NO: 312719 - RNA, 22 nt, Human
ggucccaggcugcgggcuggug

SEQ ID NO: 312720 - RNA, 22 nt, Human
aaaugaacucuuccugcauccc

SEQ ID NO: 312721 - RNA, 22 nt, Human
agugcagccgagaucaggugcu

SEQ ID NO: 312722 - RNA, 22 nt, Human
aggcacaguggcucacaccugu

SEQ ID NO: 312723 - RNA, 22 nt, Human
uaaccauauuuuccauuaaguu

SEQ ID NO: 312724 - RNA, 17 nt, Human
ccagagcuacugagacu

SEQ ID NO: 312725 - RNA, 22 nt, Human
uucacaggcuuggagguggggg

SEQ ID NO: 312726 - RNA, 22 nt, Human
caaaugugacuuuugggcuucu

SEQ ID NO: 312727 - RNA, 22 nt, Human
guucuucagucacaucacagaa

SEQ ID NO: 312728 - RNA, 22 nt, Human
aacaugaaguuuucuauaguga

SEQ ID NO: 312729 - RNA, 22 nt, Human
aagcugccugggaggaagggcu

SEQ ID NO: 312730 - RNA, 22 nt, Human
uuaaacagucccagaggcugac

SEQ ID NO: 312731 - RNA, 22 nt, Human
uaggggugaggccaggcaucag

SEQ ID NO: 312732 - RNA, 22 nt, Human
gaaaggagggaaacagagcggu

SEQ ID NO: 312733 - RNA, 22 nt, Human
cuuuguagcugcuucugauuua

SEQ ID NO: 312734 - RNA, 22 nt, Human
ucccuggccauuccucuaggcc

SEQ ID NO: 312735 - RNA, 22 nt, Human
gacaucauagggugggaggaaa

SEQ ID NO: 312736 - RNA, 22 nt, Human
ugugugaaggagccacuguuca

SEQ ID NO: 312737 - RNA, 18 nt, Human
ugcuggcaacuacuauug

SEQ ID NO: 312738 - RNA, 22 nt, Human
caggcuugcugcuagagcacuu

SEQ ID NO: 312739 - RNA, 20 nt, Human
ugaugguucuuuccggguug

SEQ ID NO: 312740 - RNA, 22 nt, Human
cuguggcuuucucugccuccuu

SEQ ID NO: 312741 - RNA, 22 nt, Human
ucucaguggguuaaaagagaag

SEQ ID NO: 312742 - RNA, 22 nt, Human
uggaguucucaggugagggcuu

SEQ ID NO: 312743 - RNA, 22 nt, Human
gaaggccauugcguccugggau

SEQ ID NO: 312744 - RNA, 22 nt, Human
aauuucagaccauuugcaauua

SEQ ID NO: 312745 - RNA, 22 nt, Human
uuugcaguuucauugcugaaau

SEQ ID NO: 312746 - RNA, 22 nt, Human
uagaaaucauuuagaaguauug

SEQ ID NO: 312747 - RNA, 22 nt, Human
caggauagaaaggccauggagu

SEQ ID NO: 312748 - RNA, 22 nt, Human
cuggcuuccaugcuguaguggc

SEQ ID NO: 312749 - RNA, 22 nt, Human
aaaaguaauugcaauuuuguag

SEQ ID NO: 312750 - RNA, 22 nt, Human
cacccaggcuagagugcagugg

SEQ ID NO: 312751 - RNA, 22 nt, Human
gccuggagcucaugugggcauu

SEQ ID NO: 312752 - RNA, 22 nt, Human
uauuuccauguuagaacuaagu

SEQ ID NO: 312753 - RNA, 22 nt, Human
acagucuugagcaucagccaga

SEQ ID NO: 312754 - RNA, 22 nt, Human
cuguccuuacugcuucuggcuu

SEQ ID NO: 312755 - RNA, 22 nt, Human
ccaggaagcggugagggcugcc

SEQ ID NO: 312756 - RNA, 22 nt, Human
cuuuuccacugagccucacaaa

SEQ ID NO: 312757 - RNA, 22 nt, Human
gacagugcauuuccuggcaugg

SEQ ID NO: 312758 - RNA, 22 nt, Human
aagugaguggccuggagaggug

SEQ ID NO: 312759 - RNA, 20 nt, Human
agacccuguguccuguggcc

SEQ ID NO: 312760 - RNA, 20 nt, Human
acuguucaagggccuggugg

SEQ ID NO: 312761 - RNA, 22 nt, Human
gaagagcuaaaggcacaggcuu

SEQ ID NO: 312762 - RNA, 22 nt, Human
gccaccucuuugucucugccgc

SEQ ID NO: 312763 - RNA, 22 nt, Human
ggguggggcccaggaaaucuau

SEQ ID NO: 312764 - RNA, 22 nt, Human
ggugauuuucgaguuucauguu

SEQ ID NO: 312765 - RNA, 22 nt, Human
cuugaaagcacuuaguaaauua

SEQ ID NO: 312766 - RNA, 18 nt, Human
cagcugccagcucaugga

SEQ ID NO: 312767 - RNA, 22 nt, Human
ucagaagagcuggugcugccug

SEQ ID NO: 312768 - RNA, 23 nt, Human
augcucugggcugugggaccugc

SEQ ID NO: 312769 - RNA, 22 nt, Human
uuccagaauuuuguucugcuug

SEQ ID NO: 312770 - RNA, 22 nt, Human
gcuggguggaucggaggcucug

SEQ ID NO: 312771 - RNA, 22 nt, Human
aagggcagcuuaaauugguagc

SEQ ID NO: 312772 - RNA, 22 nt, Human
uacugcauaacuggcauguggg

SEQ ID NO: 312773 - RNA, 22 nt, Human
ugagaauuacaaaugagucaca

SEQ ID NO: 312774 - RNA, 22 nt, Human
uagaauucauguuacuguuagc

SEQ ID NO: 312775 - RNA, 22 nt, Human
aauguacaaggguuccaguuuu

SEQ ID NO: 312776 - RNA, 22 nt, Human
ugucccucugaggcuucccugg

SEQ ID NO: 312777 - RNA, 22 nt, Human
gaaggccacuuuguguugagaa

SEQ ID NO: 312778 - RNA, 22 nt, Human
ggagccagagucugcaguguaa

SEQ ID NO: 312779 - RNA, 19 nt, Human
uccaccccagccagcucug

SEQ ID NO: 312780 - RNA, 22 nt, Human
gaaaucugcccagugcacuggu

SEQ ID NO: 312781 - RNA, 22 nt, Human
guauccuuugcggaaauuucua

SEQ ID NO: 312782 - RNA, 22 nt, Human
acuguucaagcaaaugacauug

SEQ ID NO: 312783 - RNA, 19 nt, Human
ggaccagguccugggcagc

SEQ ID NO: 312784 - RNA, 22 nt, Human
cugagggcaugaacauuccaua

SEQ ID NO: 312785 - RNA, 22 nt, Human
ccuccagcugccucagucucuu

SEQ ID NO: 312786 - RNA, 22 nt, Human
aguguggguuuuauggagcccu

SEQ ID NO: 312787 - RNA, 22 nt, Human
uuagugucuucuucauccucug

SEQ ID NO: 312788 - RNA, 22 nt, Human
agguauuauuagcaucucuauu

SEQ ID NO: 312789 - RNA, 22 nt, Human
ucugucaggagauuggcagcug

SEQ ID NO: 312790 - RNA, 22 nt, Human
aguguuccacacaucuggggaa

SEQ ID NO: 312791 - RNA, 22 nt, Human
gagacugcauuguccaaggguu

SEQ ID NO: 312792 - RNA, 22 nt, Human
auguucaaacuuuuuacacacc

SEQ ID NO: 312793 - RNA, 22 nt, Human
acuggcaggcugcuggccggcg

SEQ ID NO: 312794 - RNA, 22 nt, Human
gcuaggagauugagcucugaag

SEQ ID NO: 312795 - RNA, 22 nt, Human
ggccugaggcgucccagcugug

SEQ ID NO: 312796 - RNA, 22 nt, Human
cccuggagcugcuugcauguug

SEQ ID NO: 312797 - RNA, 22 nt, Human
augagugugaaguuagcucagu

SEQ ID NO: 312798 - RNA, 22 nt, Human
uugaacagcuguuacauuguua

SEQ ID NO: 312799 - RNA, 22 nt, Human
aaaauuauggaguaucccaaag

SEQ ID NO: 312800 - RNA, 22 nt, Human
cuccucugucuaccacgagggu

SEQ ID NO: 312801 - RNA, 22 nt, Human
ggccaagauggaaggagagaug

SEQ ID NO: 312802 - RNA, 22 nt, Human
ggagaccagaaggaagcuucga

SEQ ID NO: 312803 - RNA, 22 nt, Human
ccuggccucgugcucacggcuc

SEQ ID NO: 312804 - RNA, 22 nt, Human
cuguggggaagauagaaccgac

SEQ ID NO: 312805 - RNA, 22 nt, Human
ugcaccauuuugucaggcuacu

SEQ ID NO: 312806 - RNA, 22 nt, Human
cugagcugaaacuugagaggcu

SEQ ID NO: 312807 - RNA, 22 nt, Human
aggcaguggcugagaccagggg

SEQ ID NO: 312808 - RNA, 22 nt, Human
gcugauccuuuuaugucuagcu

SEQ ID NO: 312809 - RNA, 22 nt, Human
guuccaggcaagugggauagga

SEQ ID NO: 312810 - RNA, 22 nt, Human
uccaguggguugcugagggagg

SEQ ID NO: 312811 - RNA, 22 nt, Human
uucuucagucccacuagccaca

SEQ ID NO: 312812 - RNA, 20 nt, Human
cagcucugggcaggucgagg

SEQ ID NO: 312813 - RNA, 22 nt, Human
uuucacauuuaggcgugaauug

SEQ ID NO: 312814 - RNA, 22 nt, Human
gggaagaagacauggugaaggc

SEQ ID NO: 312815 - RNA, 21 nt, Human
ugaaaucugaugggacaaaug

SEQ ID NO: 312816 - RNA, 22 nt, Human
acaaaaguguaggaauuccuua

SEQ ID NO: 312817 - RNA, 22 nt, Human
agaagccauugaagcagaccuc

SEQ ID NO: 312818 - RNA, 22 nt, Human
agggagcaugggugaagcaggc

SEQ ID NO: 312819 - RNA, 22 nt, Human
ugcucuggagggugaagcuuuu

SEQ ID NO: 312820 - RNA, 22 nt, Human
aaaauguguuuaugcauuucgu

SEQ ID NO: 312821 - RNA, 21 nt, Human
ugaagccugaggcauagcccc

SEQ ID NO: 312822 - RNA, 22 nt, Human
uaaggcacacaguugcugcaug

SEQ ID NO: 312823 - RNA, 22 nt, Human
cagcaauaaugucuacaaaucu

SEQ ID NO: 312824 - RNA, 22 nt, Human
cagcaguggccaucuguguggu

SEQ ID NO: 312825 - RNA, 22 nt, Human
ucauacaauucaaucucugauu

SEQ ID NO: 312826 - RNA, 21 nt, Human
ugcuucucuagaucaacuacu

SEQ ID NO: 312827 - RNA, 19 nt, Human
cucagcuguagcucaugug

SEQ ID NO: 312828 - RNA, 22 nt, Human
cacagaaaaaggcuugaaaauc

SEQ ID NO: 312829 - RNA, 22 nt, Human
agggagcuguggucagcucagu

SEQ ID NO: 312830 - RNA, 22 nt, Human
caguucuuauuuggccaguguc

SEQ ID NO: 312831 - RNA, 22 nt, Human
agcagccauccuuagagaaaga

SEQ ID NO: 312832 - RNA, 22 nt, Human
aaaggugacacucugccagcug

SEQ ID NO: 312833 - RNA, 22 nt, Human
ccucuggggguccucagagucu

SEQ ID NO: 312834 - RNA, 22 nt, Human
agagaggcgaguuaccugugcu

SEQ ID NO: 312835 - RNA, 22 nt, Human
acuuucugcaguguuggaaaug

SEQ ID NO: 312836 - RNA, 22 nt, Human
gaggaaccacucugagaagcca

SEQ ID NO: 312837 - RNA, 20 nt, Human
uuuuuccuucucuacaggca

SEQ ID NO: 312838 - RNA, 22 nt, Human
ggcuuggaaaugguaaugagcu

SEQ ID NO: 312839 - RNA, 22 nt, Human
ugugaaagauacuaggcagagg

SEQ ID NO: 312840 - RNA, 22 nt, Human
uuuguuaauucuuauguuagag

SEQ ID NO: 312841 - RNA, 22 nt, Human
gcugccugguuucucagcugca

SEQ ID NO: 312842 - RNA, 22 nt, Human
caagggcucacggucugcuggg

SEQ ID NO: 312843 - RNA, 22 nt, Human
uguaggaguccaaucaggagac

SEQ ID NO: 312844 - RNA, 22 nt, Human
ccacaggggucucuguagcuga

SEQ ID NO: 312845 - RNA, 22 nt, Human
aaaaucugcuuccuuuuacaga

SEQ ID NO: 312846 - RNA, 22 nt, Human
cucucagugccugcccuaggcu

SEQ ID NO: 312847 - RNA, 23 nt, Human
uggcucugagagguucagaugcu

SEQ ID NO: 312848 - RNA, 21 nt, Human
guccucagcugaugggagcug

SEQ ID NO: 312849 - RNA, 22 nt, Human
agccacagggggugagggacaa

SEQ ID NO: 312850 - RNA, 22 nt, Human
ggcagcaguaggagcuaaucuu

SEQ ID NO: 312851 - RNA, 22 nt, Human
agagugaagguugacacuucac

SEQ ID NO: 312852 - RNA, 22 nt, Human
uuuacuuuugguaaggucauuu

SEQ ID NO: 312853 - RNA, 22 nt, Human
ccagcaccuugaucuuggaguu

SEQ ID NO: 312854 - RNA, 19 nt, Human
gcuggggccugaccagaca

SEQ ID NO: 312855 - RNA, 22 nt, Human
aggccuuccucggagacaggga

SEQ ID NO: 312856 - RNA, 22 nt, Human
caggaugggauguagugggccc

SEQ ID NO: 312857 - RNA, 22 nt, Human
uuccuguccgcaauggccuggg

SEQ ID NO: 312858 - RNA, 23 nt, Human
ugucauugugacuacagaaccag

SEQ ID NO: 312859 - RNA, 22 nt, Human
cucuggccagagccugcgggaa

SEQ ID NO: 312860 - RNA, 22 nt, Human
ucccagagacagagccuccucc

SEQ ID NO: 312861 - RNA, 22 nt, Human
ugggugggagcacccugucugg

SEQ ID NO: 312862 - RNA, 22 nt, Human
ucucuggccgagagucccuggg

SEQ ID NO: 312863 - RNA, 22 nt, Human
uccucccacauaggacaauggg

SEQ ID NO: 312864 - RNA, 22 nt, Human
ggcugagggccagggcuagucu

SEQ ID NO: 312865 - RNA, 22 nt, Human
gagagcaggaggcagcgggacg

SEQ ID NO: 312866 - RNA, 21 nt, Human
cagcccagagcaguggggcca

SEQ ID NO: 312867 - RNA, 22 nt, Human
acaguaauauugaugcucguca

SEQ ID NO: 312868 - RNA, 22 nt, Human
gugagagcugcuccagaucucu

SEQ ID NO: 312869 - RNA, 22 nt, Human
agguaaagacagugaaagaggg

SEQ ID NO: 312870 - RNA, 22 nt, Human
aaauucuuucauggcuaauaag

SEQ ID NO: 312871 - RNA, 22 nt, Human
uuauuuaauuuucucacucaga

SEQ ID NO: 312872 - RNA, 22 nt, Human
caggaucccuggccuccgccca

SEQ ID NO: 312873 - RNA, 22 nt, Human
ucagaggugguaaaggacagca

SEQ ID NO: 312874 - RNA, 22 nt, Human
aggagcuggguuccuuuggugg

SEQ ID NO: 312875 - RNA, 22 nt, Human
uguauagaguuggaagaugacu

SEQ ID NO: 312876 - RNA, 22 nt, Human
gauuucaaggaguuuucacagu

SEQ ID NO: 312877 - RNA, 22 nt, Human
uauaauuuggggaaaguggugu

SEQ ID NO: 312878 - RNA, 22 nt, Human
uucugucacagugcugguauca

SEQ ID NO: 312879 - RNA, 22 nt, Human
uuccaggaauucagcucucagu

SEQ ID NO: 312880 - RNA, 18 nt, Human
gugacagcugcuagcuca

SEQ ID NO: 312881 - RNA, 22 nt, Human
gccuggugguauccuggcaaga

SEQ ID NO: 312882 - RNA, 23 nt, Human
uggccucuccccaccuggcagaa

SEQ ID NO: 312883 - RNA, 22 nt, Human
gcaguguugguuugcucugcag

SEQ ID NO: 312884 - RNA, 22 nt, Human
cuguuuaucuaggaguugcagg

SEQ ID NO: 312885 - RNA, 22 nt, Human
uguauuuuuagaccuuuagacc

SEQ ID NO: 312886 - RNA, 22 nt, Human
gcuuggcauugaccauuaucau

SEQ ID NO: 312887 - RNA, 22 nt, Human
aguaaaauuguauuggaaaaca

SEQ ID NO: 312888 - RNA, 22 nt, Human
gcuguccucuuggacucagggc

SEQ ID NO: 312889 - RNA, 22 nt, Human
gaucucugaaucugaagccuuc

SEQ ID NO: 312890 - RNA, 22 nt, Human
cacuguaucuuuuccaaagucu

SEQ ID NO: 312891 - RNA, 22 nt, Human
uauguacaguccuuaacuuaaa

SEQ ID NO: 312892 - RNA, 22 nt, Human
auguguacaaccaagcacuaaa

SEQ ID NO: 312893 - RNA, 22 nt, Human
auugucuuuccacugagaaguu

SEQ ID NO: 312894 - RNA, 22 nt, Human
uccauaagcagguucuuccuga

SEQ ID NO: 312895 - RNA, 18 nt, Human
uggacaggguggagaaaa

SEQ ID NO: 312896 - RNA, 22 nt, Human
ccagcccuucccaacuggccag

SEQ ID NO: 312897 - RNA, 18 nt, Human
aggcacagagcauacaua

SEQ ID NO: 312898 - RNA, 22 nt, Human
uccuguggcguuaucaugugau

SEQ ID NO: 312899 - RNA, 22 nt, Human
gaggccugguagccgagcccca

SEQ ID NO: 312900 - RNA, 22 nt, Human
uaugccugauaacugugucucu

SEQ ID NO: 312901 - RNA, 22 nt, Human
gcagaaggucaaagcaagaugu

SEQ ID NO: 312902 - RNA, 22 nt, Human
cagagccauccaggugccuguu

SEQ ID NO: 312903 - RNA, 22 nt, Human
uuacuuugcuuucucauuacag

SEQ ID NO: 312904 - RNA, 22 nt, Human
aaauacauacacuguacguggc

SEQ ID NO: 312905 - RNA, 22 nt, Human
ugaaaucuuagccauucugccu

SEQ ID NO: 312906 - RNA, 18 nt, Human
uuugcaaaggaaguaugg

SEQ ID NO: 312907 - RNA, 22 nt, Human
auaauuuacuaagcucuaccuu

SEQ ID NO: 312908 - RNA, 22 nt, Human
ggccucugccccagccacaccu

SEQ ID NO: 312909 - RNA, 22 nt, Human
auauaaguuaguggucauguuu

SEQ ID NO: 312910 - RNA, 22 nt, Human
gugcccaggcccaaggcaccac

SEQ ID NO: 312911 - RNA, 22 nt, Human
cuucuuaaugacagauuaaaau

SEQ ID NO: 312912 - RNA, 22 nt, Human
gcugcuucucugauggagucca

SEQ ID NO: 312913 - RNA, 22 nt, Human
cacaguguagacuaauaauaga

SEQ ID NO: 312914 - RNA, 22 nt, Human
acugucugcuggccccugguua

SEQ ID NO: 312915 - RNA, 22 nt, Human
ucagaagaagagacuccacagc

SEQ ID NO: 312916 - RNA, 21 nt, Human
gccagccuguuuaccuguggu

SEQ ID NO: 312917 - RNA, 22 nt, Human
ugcuguggcaguuuauguauag

SEQ ID NO: 312918 - RNA, 22 nt, Human
uauauuaacacccacuugccuc

SEQ ID NO: 312919 - RNA, 22 nt, Human
aagcccagaugggagcauuuca

SEQ ID NO: 312920 - RNA, 22 nt, Human
accucccagcucugagcuuggg

SEQ ID NO: 312921 - RNA, 22 nt, Human
ccuguucaauauucuuccuugu

SEQ ID NO: 312922 - RNA, 22 nt, Human
cugggacacccaaggaaagagc

SEQ ID NO: 312923 - RNA, 22 nt, Human
cucuggagugcagccugguggc

SEQ ID NO: 312924 - RNA, 22 nt, Human
gccugggugucgaucacuagug

SEQ ID NO: 312925 - RNA, 22 nt, Human
cuccaggccauggcugcggagg

SEQ ID NO: 312926 - RNA, 22 nt, Human
ucagaacaauugggaaccauua

SEQ ID NO: 312927 - RNA, 22 nt, Human
gccaggcuggccagcaccuucu

SEQ ID NO: 312928 - RNA, 22 nt, Human
ucucagagagaugaaacuucca

SEQ ID NO: 312929 - RNA, 22 nt, Human
agcacagguacggagaugcuac

SEQ ID NO: 312930 - RNA, 22 nt, Human
auucuccaucaccacuggcacu

SEQ ID NO: 312931 - RNA, 22 nt, Human
cugugcuggcagaccuggaguu

SEQ ID NO: 312932 - RNA, 22 nt, Human
cacugccuccccaggcuccaca

SEQ ID NO: 312933 - RNA, 22 nt, Human
ccugaggggcugcaggccagcu

SEQ ID NO: 312934 - RNA, 22 nt, Human
gcucucugaggugcuggcagag

SEQ ID NO: 312935 - RNA, 18 nt, Human
gcuggcugcacuucugcu

SEQ ID NO: 312936 - RNA, 22 nt, Human
cacugcaguaacucuaggacug

SEQ ID NO: 312937 - RNA, 22 nt, Human
gcucuguguucccuccaggcuc

SEQ ID NO: 312938 - RNA, 22 nt, Human
ccugucuggccaccagggcgau

SEQ ID NO: 312939 - RNA, 22 nt, Human
agucccaggcagccgagccggu

SEQ ID NO: 312940 - RNA, 22 nt, Human
aauggcugggaguguauuuugg

SEQ ID NO: 312941 - RNA, 22 nt, Human
uuuccucuuauacaguguuuau

SEQ ID NO: 312942 - RNA, 22 nt, Human
uguggcugcucaggugcagacc

SEQ ID NO: 312943 - RNA, 22 nt, Human
cccagcucugcagaccugcccu

SEQ ID NO: 312944 - RNA, 23 nt, Human
aggaggccugaaacugaggcuga

SEQ ID NO: 312945 - RNA, 22 nt, Human
gauucacucauauuuuacguuu

SEQ ID NO: 312946 - RNA, 22 nt, Human
uggaaauguauuugggcaugcc

SEQ ID NO: 312947 - RNA, 22 nt, Human
guggguggaggcgucgagggca

SEQ ID NO: 312948 - RNA, 19 nt, Human
gcuucccaccagccagccc

SEQ ID NO: 312949 - RNA, 19 nt, Human
gcugcucugggucucaucu

SEQ ID NO: 312950 - RNA, 22 nt, Human
aagccaggaagagagccuucac

SEQ ID NO: 312951 - RNA, 22 nt, Human
ucagaacagaagcuggcuauaa

SEQ ID NO: 312952 - RNA, 22 nt, Human
gcagagcuaucuucuggauuug

SEQ ID NO: 312953 - RNA, 22 nt, Human
gcccagccccuggguggacgug

SEQ ID NO: 312954 - RNA, 22 nt, Human
aggugcagaaaaaaguccuuua

SEQ ID NO: 312955 - RNA, 22 nt, Human
gcacacaguauaugcucauuaa

SEQ ID NO: 312956 - RNA, 22 nt, Human
uagauuuccucuuccucauucc

SEQ ID NO: 312957 - RNA, 22 nt, Human
gcaggugguccccguggagugg

SEQ ID NO: 312958 - RNA, 22 nt, Human
aaguuuaagguggaaguggugg

SEQ ID NO: 312959 - RNA, 19 nt, Human
uaaaaugucuguggucagu

SEQ ID NO: 312960 - RNA, 22 nt, Human
ccucugccaccucccacgaggc

SEQ ID NO: 312961 - RNA, 22 nt, Human
caaggccaguccauuuuggaag

SEQ ID NO: 312962 - RNA, 22 nt, Human
gcucugggaacugacugccuuc

SEQ ID NO: 312963 - RNA, 22 nt, Human
cucuccucugaaguggugaccc

SEQ ID NO: 312964 - RNA, 20 nt, Human
uauuugaaauggccaagugu

SEQ ID NO: 312965 - RNA, 22 nt, Human
ucagcaguggcucucaugcagu

SEQ ID NO: 312966 - RNA, 22 nt, Human
agaggccuccgaaaggugggcu

SEQ ID NO: 312967 - RNA, 20 nt, Human
ucucaggcccccuccuugcu

SEQ ID NO: 312968 - RNA, 22 nt, Human
agccacgucccugucaggguca

SEQ ID NO: 312969 - RNA, 22 nt, Human
uugcauaaaugcuuaaaauuug

SEQ ID NO: 312970 - RNA, 22 nt, Human
agcagccauagauagcaugcaa

SEQ ID NO: 312971 - RNA, 22 nt, Human
ccaggagucuggaugagguguc

SEQ ID NO: 312972 - RNA, 22 nt, Human
ccagcccugauuagagaauguc

SEQ ID NO: 312973 - RNA, 22 nt, Human
ggcucuggcguccaauggagcg

SEQ ID NO: 312974 - RNA, 18 nt, Human
ggcucaggcuauccuaac

SEQ ID NO: 312975 - RNA, 22 nt, Human
ugccuugcacauaauauacauu

SEQ ID NO: 312976 - RNA, 20 nt, Human
ucacaucuggcagcugauga

SEQ ID NO: 312977 - RNA, 22 nt, Human
acagccagggucucaggaggcg

SEQ ID NO: 312978 - RNA, 22 nt, Human
aagccagguguugugguaagag

SEQ ID NO: 312979 - RNA, 23 nt, Human
cccagcagauuguaaagugucca

SEQ ID NO: 312980 - RNA, 22 nt, Human
cucucuucccgugaguguugca

SEQ ID NO: 312981 - RNA, 22 nt, Human
uaugaaaugguaguaggaaggg

SEQ ID NO: 312982 - RNA, 22 nt, Human
acugucacuccaacugagucgu

SEQ ID NO: 312983 - RNA, 22 nt, Human
ccagggcagaaaaagagggaau

SEQ ID NO: 312984 - RNA, 22 nt, Human
ccugggcaggaugggcccggug

SEQ ID NO: 312985 - RNA, 22 nt, Human
cccucagcuccacccucagcag

SEQ ID NO: 312986 - RNA, 22 nt, Human
cucacuggcaagacuacaggug

SEQ ID NO: 312987 - RNA, 22 nt, Human
cugcuggggucagagcacuggg

SEQ ID NO: 312988 - RNA, 22 nt, Human
gcucuggacuggggccugagaa

SEQ ID NO: 312989 - RNA, 22 nt, Human
uguaguaagugcgcaauaaaua

SEQ ID NO: 312990 - RNA, 22 nt, Human
gcugcucucagagcucaugcug

SEQ ID NO: 312991 - RNA, 22 nt, Human
ugcugcuguuuccuacaucuca

SEQ ID NO: 312992 - RNA, 22 nt, Human
ucaguguucuggauuuggggca

SEQ ID NO: 312993 - RNA, 19 nt, Human
cagaguacaccagauagga

SEQ ID NO: 312994 - RNA, 20 nt, Human
aauuuacucacagaaugaau

SEQ ID NO: 312995 - RNA, 22 nt, Human
aauguuaaaaccuucagugcuu

SEQ ID NO: 312996 - RNA, 22 nt, Human
gcacugcaucuacuggcaagua

SEQ ID NO: 312997 - RNA, 22 nt, Human
aauguaugugcaucauuuacau

SEQ ID NO: 312998 - RNA, 22 nt, Human
ggcaucuguccaucucuccagc

SEQ ID NO: 312999 - RNA, 22 nt, Human
acauucuagaagucuuugcaau

SEQ ID NO: 313000 - RNA, 21 nt, Human
ucaguccuguuagccuuuggg

SEQ ID NO: 313001 - RNA, 22 nt, Human
uugcucaggcuuagagcuacua

SEQ ID NO: 313002 - RNA, 22 nt, Human
uggcccugcuuaugucucucuu

SEQ ID NO: 313003 - RNA, 22 nt, Human
ugaccuuauuugaaaauagaga

SEQ ID NO: 313004 - RNA, 20 nt, Human
ucucccaggcucagggaaga

SEQ ID NO: 313005 - RNA, 18 nt, Human
agcagaauucuaggguuc

SEQ ID NO: 313006 - RNA, 22 nt, Human
cugggccugucagggcuuuuug

SEQ ID NO: 313007 - RNA, 22 nt, Human
cacaaaaguaggaggcaggcgg

SEQ ID NO: 313008 - RNA, 22 nt, Human
caucuggcuagcuaucauugug

SEQ ID NO: 313009 - RNA, 22 nt, Human
ugaaccagagucuccagugguu

SEQ ID NO: 313010 - RNA, 22 nt, Human
gagaaagauguaggcugggagg

SEQ ID NO: 313011 - RNA, 21 nt, Human
ggagggcagcccagacuggcu

SEQ ID NO: 313012 - RNA, 19 nt, Human
uccuccuuacuuccucuug

SEQ ID NO: 313013 - RNA, 22 nt, Human
gagugguaggcaguguuaggaa

SEQ ID NO: 313014 - RNA, 23 nt, Human
gcagacagagcagacuaagacaa

SEQ ID NO: 313015 - RNA, 22 nt, Human
agggacacugaugagaaauucu

SEQ ID NO: 313016 - RNA, 22 nt, Human
aguucucaagacaauuaccugu

SEQ ID NO: 313017 - RNA, 22 nt, Human
aagaugauguuguguuuucacu

SEQ ID NO: 313018 - RNA, 22 nt, Human
uucugucucuguguuuacauua

SEQ ID NO: 313019 - RNA, 22 nt, Human
ucaaagcaucagucaauuuagg

SEQ ID NO: 313020 - RNA, 22 nt, Human
gaaggagagaaaggcaauucug

SEQ ID NO: 313021 - RNA, 22 nt, Human
caccagggcucugagcucugaa

SEQ ID NO: 313022 - RNA, 22 nt, Human
aauguacaaaagucagccaacu

SEQ ID NO: 313023 - RNA, 22 nt, Human
ccuggggagccgccugagcccc

SEQ ID NO: 313024 - RNA, 22 nt, Human
ucaguguuggcuacaucugccu

SEQ ID NO: 313025 - RNA, 18 nt, Human
agccuggaggguugaagu

SEQ ID NO: 313026 - RNA, 22 nt, Human
cucucuggcuuggcacggagau

SEQ ID NO: 313027 - RNA, 22 nt, Human
gagcugugagggacacauugcu

SEQ ID NO: 313028 - RNA, 22 nt, Human
ccugccagcauggcuuaucucc

SEQ ID NO: 313029 - RNA, 19 nt, Human
aggccugggguuuugcacu

SEQ ID NO: 313030 - RNA, 22 nt, Human
gcagagcucaagguguucagcu

SEQ ID NO: 313031 - RNA, 22 nt, Human
gggcagccucggugccugcugc

SEQ ID NO: 313032 - RNA, 22 nt, Human
gccaggcuggaaagaacagaca

SEQ ID NO: 313033 - RNA, 22 nt, Human
aaucuucauuuugacaagauuc

SEQ ID NO: 313034 - RNA, 22 nt, Human
ucaucuugcugccauugcuuua

SEQ ID NO: 313035 - RNA, 22 nt, Human
ucagugucuugggcuugaaugc

SEQ ID NO: 313036 - RNA, 22 nt, Human
uuuauuuauccuucuggauugc

SEQ ID NO: 313037 - RNA, 22 nt, Human
aagauuuccuggauguaauucc

SEQ ID NO: 313038 - RNA, 22 nt, Human
aucauucuagcuguuguguuga

SEQ ID NO: 313039 - RNA, 22 nt, Human
acccacgaagaugagcggcaug

SEQ ID NO: 313040 - RNA, 22 nt, Human
auuuuacuuugugaauauugac

SEQ ID NO: 313041 - RNA, 22 nt, Human
ucagggugaaccaggcaggaau

SEQ ID NO: 313042 - RNA, 22 nt, Human
cauuugaaugagauugcuguaa

SEQ ID NO: 313043 - RNA, 22 nt, Human
uuccaggacaagauguuucagg

SEQ ID NO: 313044 - RNA, 21 nt, Human
gggagcuggaaacugggugac

SEQ ID NO: 313045 - RNA, 22 nt, Human
acaugcauacaagcacauguag

SEQ ID NO: 313046 - RNA, 22 nt, Human
cacagggccuugugugacugca

SEQ ID NO: 313047 - RNA, 22 nt, Human
cccagagcugagucugauauau

SEQ ID NO: 313048 - RNA, 17 nt, Human
gaaagguccuagaaauc

SEQ ID NO: 313049 - RNA, 18 nt, Human
agcagcugugccacacug

SEQ ID NO: 313050 - RNA, 22 nt, Human
uuuccucugagugagcugggag

SEQ ID NO: 313051 - RNA, 22 nt, Human
augccacugacauggacaauuu

SEQ ID NO: 313052 - RNA, 22 nt, Human
gccaguuccuguggagucagag

SEQ ID NO: 313053 - RNA, 23 nt, Human
acagggcauugcuggccucgagg

SEQ ID NO: 313054 - RNA, 22 nt, Human
gauuucuuugcaagcuguguuc

SEQ ID NO: 313055 - RNA, 22 nt, Human
cuggcucucugagauauugagu

SEQ ID NO: 313056 - RNA, 22 nt, Human
guuuauaugaacuucauaccca

SEQ ID NO: 313057 - RNA, 22 nt, Human
acugucuguccugcucuccgug

SEQ ID NO: 313058 - RNA, 22 nt, Human
aucuggcucaccuggguaaaua

SEQ ID NO: 313059 - RNA, 22 nt, Human
gcugcuuccuuuccugcugacc

SEQ ID NO: 313060 - RNA, 22 nt, Human
caggcugcggucggcucugguc

SEQ ID NO: 313061 - RNA, 22 nt, Human
uuuccauauuuggucuuuggga

SEQ ID NO: 313062 - RNA, 22 nt, Human
uuuccuuguuauuauuuguccu

SEQ ID NO: 313063 - RNA, 22 nt, Human
cagaacugggcagggagcagag

SEQ ID NO: 313064 - RNA, 22 nt, Human
cucuggaaaaccacuagcagga

SEQ ID NO: 313065 - RNA, 20 nt, Human
cccuggccuguuucaugccc

SEQ ID NO: 313066 - RNA, 22 nt, Human
acagcuuuucaauucugcugag

SEQ ID NO: 313067 - RNA, 21 nt, Human
ccaggcagagcugugaguucu

SEQ ID NO: 313068 - RNA, 22 nt, Human
auacaaagacaaaucucaaucu

SEQ ID NO: 313069 - RNA, 22 nt, Human
ugggggacugcacuggcgucag

SEQ ID NO: 313070 - RNA, 22 nt, Human
ggcugcuugcuguuucuuggau

SEQ ID NO: 313071 - RNA, 22 nt, Human
augcaguacagauaauucuaca

SEQ ID NO: 313072 - RNA, 20 nt, Human
gucagaggacccuagagcga

SEQ ID NO: 313073 - RNA, 22 nt, Human
ccgggcgggggcucucgucacc

SEQ ID NO: 313074 - RNA, 22 nt, Human
agauacauuguucuaagcauug

SEQ ID NO: 313075 - RNA, 22 nt, Human
gcaggccuccccugcuggagcu

SEQ ID NO: 313076 - RNA, 22 nt, Human
agcgggugcugugucagcccuc

SEQ ID NO: 313077 - RNA, 22 nt, Human
ccagggcuggguuugucggugu

SEQ ID NO: 313078 - RNA, 22 nt, Human
cugaggccagcugcagagcucu

SEQ ID NO: 313079 - RNA, 22 nt, Human
ugauuuccaugaagcugaaggc

SEQ ID NO: 313080 - RNA, 18 nt, Human
ucucuucuuggcagucaa

SEQ ID NO: 313081 - RNA, 22 nt, Human
guccugugucccagagaaagag

SEQ ID NO: 313082 - RNA, 22 nt, Human
gcucagccgaacuucagagcag

SEQ ID NO: 313083 - RNA, 22 nt, Human
cugaaggauuuaguucuuugcu

SEQ ID NO: 313084 - RNA, 21 nt, Human
aaagugguaaggauuauuuug

SEQ ID NO: 313085 - RNA, 21 nt, Human
ccacaggggcuccccugucag

SEQ ID NO: 313086 - RNA, 22 nt, Human
acuuuauuuccuauugcaucca

SEQ ID NO: 313087 - RNA, 22 nt, Human
ccaggcagagugcuccagaaag

SEQ ID NO: 313088 - RNA, 22 nt, Human
ccaggagguggagauugcagug

SEQ ID NO: 313089 - RNA, 22 nt, Human
cugaagaggacgcagcagcaag

SEQ ID NO: 313090 - RNA, 22 nt, Human
uugggcucaggaguuugagacc

SEQ ID NO: 313091 - RNA, 16 nt, Human
gcuggagggagggguu

SEQ ID NO: 313092 - RNA, 22 nt, Human
ucuggcuccaccuccuuuacua

SEQ ID NO: 313093 - RNA, 19 nt, Human
gggcuuggggcugaagccu

SEQ ID NO: 313094 - RNA, 22 nt, Human
aagaggaacugggggcugaguc

SEQ ID NO: 313095 - RNA, 22 nt, Human
gcagcuggggccacacuuaggc

SEQ ID NO: 313096 - RNA, 22 nt, Human
cagaggcagaggucaucucugg

SEQ ID NO: 313097 - RNA, 22 nt, Human
gagacacaaacacauuuagagg

SEQ ID NO: 313098 - RNA, 22 nt, Human
uuguaacagcugcuuaauagag

SEQ ID NO: 313099 - RNA, 22 nt, Human
ccagcacugcucucagacugag

SEQ ID NO: 313100 - RNA, 22 nt, Human
uccuuucccuuuccauccuggc

SEQ ID NO: 313101 - RNA, 22 nt, Human
augagcuucccagacaggaugg

SEQ ID NO: 313102 - RNA, 22 nt, Human
gucaggaugagggaugaggagu

SEQ ID NO: 313103 - RNA, 22 nt, Human
gcagaggggaagcugaggaauu

SEQ ID NO: 313104 - RNA, 22 nt, Human
aagacaagcaucaaaucaggca

SEQ ID NO: 313105 - RNA, 22 nt, Human
agagccuggggauuggcaaggg

SEQ ID NO: 313106 - RNA, 22 nt, Human
gcaagcuggcuguuagaggaug

SEQ ID NO: 313107 - RNA, 21 nt, Human
ggggcagagcuaggcccugca

SEQ ID NO: 313108 - RNA, 22 nt, Human
ggggugagaucaaggaagcccu

SEQ ID NO: 313109 - RNA, 22 nt, Human
auaauuaauuucaguaaucucc

SEQ ID NO: 313110 - RNA, 22 nt, Human
gcagggaccugccacugcuguc

SEQ ID NO: 313111 - RNA, 22 nt, Human
agagcucaagacgcucacagua

SEQ ID NO: 313112 - RNA, 19 nt, Human
acaaagcugugagcagcuu

SEQ ID NO: 313113 - RNA, 22 nt, Human
aggagccaguuccaccccagga

SEQ ID NO: 313114 - RNA, 20 nt, Human
cccugcagccaugggagugg

SEQ ID NO: 313115 - RNA, 22 nt, Human
gcugucugcaagccaggaaaug

SEQ ID NO: 313116 - RNA, 22 nt, Human
uauuugaagauucuucugaugu

SEQ ID NO: 313117 - RNA, 22 nt, Human
ccaggcauccauugcuuccucu

SEQ ID NO: 313118 - RNA, 22 nt, Human
guauuugauagauuucaaagga

SEQ ID NO: 313119 - RNA, 22 nt, Human
uuuccuaguucuaagaaaugua

SEQ ID NO: 313120 - RNA, 22 nt, Human
aaagaacaauguggaaucuccu

SEQ ID NO: 313121 - RNA, 22 nt, Human
aaggccagacaggaccacaucu

SEQ ID NO: 313122 - RNA, 18 nt, Human
uccugccugcgggcuccc

SEQ ID NO: 313123 - RNA, 22 nt, Human
uccaagaagucaucuaaacugu

SEQ ID NO: 313124 - RNA, 22 nt, Human
auugcuguggaaauauaagaug

SEQ ID NO: 313125 - RNA, 22 nt, Human
cuggcaggcagacuucugcaag

SEQ ID NO: 313126 - RNA, 22 nt, Human
uuacaguaugaucaacuuuuca

SEQ ID NO: 313127 - RNA, 22 nt, Human
ggggagaguccuuuccaguucc

SEQ ID NO: 313128 - RNA, 22 nt, Human
gucuggaggaggaagaaggcac

SEQ ID NO: 313129 - RNA, 22 nt, Human
gcugggaggaucucucccuguc

SEQ ID NO: 313130 - RNA, 22 nt, Human
gcugagcuagaaaaggaccaca

SEQ ID NO: 313131 - RNA, 22 nt, Human
ugggaguguucuuggcuugcuu

SEQ ID NO: 313132 - RNA, 22 nt, Human
acuuuguauaagacaauaaaga

SEQ ID NO: 313133 - RNA, 22 nt, Human
aauuuccaaauuucugucacac

SEQ ID NO: 313134 - RNA, 22 nt, Human
uuguaacacuuuucuauuaaua

SEQ ID NO: 313135 - RNA, 22 nt, Human
uccaaagggaagcgcuuucugu

SEQ ID NO: 313136 - RNA, 22 nt, Human
ugagcuggucuugaguguagcu

SEQ ID NO: 313137 - RNA, 22 nt, Human
cucugagguccuacagugaccc

SEQ ID NO: 313138 - RNA, 22 nt, Human
agggagagaaguuauacaagau

SEQ ID NO: 313139 - RNA, 22 nt, Human
ucuuagaaguuuauggcacgga

SEQ ID NO: 313140 - RNA, 22 nt, Human
cugaagagcucuccuguccccu

SEQ ID NO: 313141 - RNA, 22 nt, Human
uuguaacaggcacucugugcca

SEQ ID NO: 313142 - RNA, 22 nt, Human
ugucccagcagcuggguucucu

SEQ ID NO: 313143 - RNA, 22 nt, Human
cacaagucuguggucuccaaca

SEQ ID NO: 313144 - RNA, 22 nt, Human
ccagagcccagcacacggugcu

SEQ ID NO: 313145 - RNA, 22 nt, Human
ucuuagaaugucaacugauguu

SEQ ID NO: 313146 - RNA, 20 nt, Human
auugucagccuucagaggag

SEQ ID NO: 313147 - RNA, 22 nt, Human
cauaauuuuccaugguuugcua

SEQ ID NO: 313148 - RNA, 18 nt, Human
gggaucaggcugccuagg

SEQ ID NO: 313149 - RNA, 22 nt, Human
gagaggcugacuggcuguccug

SEQ ID NO: 313150 - RNA, 22 nt, Human
ugagccuggagucguggagggg

SEQ ID NO: 313151 - RNA, 22 nt, Human
ccuggacucaggcugugggcac

SEQ ID NO: 313152 - RNA, 23 nt, Human
gggaccagcuagggcugugaccu

SEQ ID NO: 313153 - RNA, 22 nt, Human
ucaguuuuuguuugccagauag

SEQ ID NO: 313154 - RNA, 22 nt, Human
acaacaggguaaggcaggccau

SEQ ID NO: 313155 - RNA, 23 nt, Human
uggggagaguuacccuggaagcg

SEQ ID NO: 313156 - RNA, 22 nt, Human
uuauuccauuauuucacuuagg

SEQ ID NO: 313157 - RNA, 20 nt, Human
cgugcugugaccuugagcau

SEQ ID NO: 313158 - RNA, 22 nt, Human
ggggagcagaagcagcaacaac

SEQ ID NO: 313159 - RNA, 22 nt, Human
ugagcuucaaaauaugugaauc

SEQ ID NO: 313160 - RNA, 22 nt, Human
gcagagugagccgaggcugcuc

SEQ ID NO: 313161 - RNA, 22 nt, Human
ucaucuucuauuaauagggaga

SEQ ID NO: 313162 - RNA, 22 nt, Human
cagagccagcuguccuuggcau

SEQ ID NO: 313163 - RNA, 22 nt, Human
ucugaaauagaagugucuuucu

SEQ ID NO: 313164 - RNA, 22 nt, Human
ugggggagccuucacaguagcu

SEQ ID NO: 313165 - RNA, 22 nt, Human
agcaaaguagcugcuguucuua

SEQ ID NO: 313166 - RNA, 22 nt, Human
caaugauggcuaggcagcugcu

SEQ ID NO: 313167 - RNA, 22 nt, Human
aagccagcauuuucccauuccu

SEQ ID NO: 313168 - RNA, 22 nt, Human
uacuaaauaguuuaauuccuca

SEQ ID NO: 313169 - RNA, 22 nt, Human
gucauucuuaacaacucaguag

SEQ ID NO: 313170 - RNA, 22 nt, Human
cuuugcaaacgauuaccacaug

SEQ ID NO: 313171 - RNA, 22 nt, Human
gugguuuucuccaacccagaac

SEQ ID NO: 313172 - RNA, 22 nt, Human
gagggcugcaaugagacagaga

SEQ ID NO: 313173 - RNA, 22 nt, Human
auucuucaaagagugucaaagu

SEQ ID NO: 313174 - RNA, 22 nt, Human
ugccuggcaacuguggugggcu

SEQ ID NO: 313175 - RNA, 22 nt, Human
gcaguguuguuaaaagauuaga

SEQ ID NO: 313176 - RNA, 21 nt, Human
ugaaaguuggagucaaaugua

SEQ ID NO: 313177 - RNA, 22 nt, Human
aguaugaagauuauaauuuuuc

SEQ ID NO: 313178 - RNA, 22 nt, Human
cugcuggccuagcccauccucu

SEQ ID NO: 313179 - RNA, 23 nt, Human
uguaugaauaugccacaguuuaa

SEQ ID NO: 313180 - RNA, 22 nt, Human
cagggcagggagcuuagaauga

SEQ ID NO: 313181 - RNA, 22 nt, Human
uuucaucuucccagagaccuug

SEQ ID NO: 313182 - RNA, 22 nt, Human
acaguguuuuaugagaauuguu

SEQ ID NO: 313183 - RNA, 21 nt, Human
aaguggagaagaaaagcugga

SEQ ID NO: 313184 - RNA, 22 nt, Human
auguuuuauauuuugcagcagu

SEQ ID NO: 313185 - RNA, 22 nt, Human
ccucuggguaucuguggaagua

SEQ ID NO: 313186 - RNA, 22 nt, Human
ugaugguuuuauuaauaggacc

SEQ ID NO: 313187 - RNA, 22 nt, Human
agcagccacagcagaucugagu

SEQ ID NO: 313188 - RNA, 22 nt, Human
agccccaggcccggacgccucu

SEQ ID NO: 313189 - RNA, 22 nt, Human
cggagccugcuuguugcagcug

SEQ ID NO: 313190 - RNA, 22 nt, Human
ucaauucaacacaugcacauug

SEQ ID NO: 313191 - RNA, 22 nt, Human
uccguauuugacuauugcaccg

SEQ ID NO: 313192 - RNA, 22 nt, Human
ugcagcugaggccagcuaugcc

SEQ ID NO: 313193 - RNA, 22 nt, Human
auguaucagaaauagcauuggc

SEQ ID NO: 313194 - RNA, 22 nt, Human
ccugucacgaugacugcacucu

SEQ ID NO: 313195 - RNA, 22 nt, Human
ugaaaugagagcacagaauaaa

SEQ ID NO: 313196 - RNA, 22 nt, Human
uagcagagcagggaucagagcc

SEQ ID NO: 313197 - RNA, 22 nt, Human
ugcagucuggauguccucagau

SEQ ID NO: 313198 - RNA, 22 nt, Human
gcccugugcgacucuagagguu

SEQ ID NO: 313199 - RNA, 22 nt, Human
cugcccuguggcucugagucau

SEQ ID NO: 313200 - RNA, 22 nt, Human
aagagcuggaguuugcagcccu

SEQ ID NO: 313201 - RNA, 22 nt, Human
ugaaaucuacccuauucagggu

SEQ ID NO: 313202 - RNA, 22 nt, Human
uggcccugugugcaggcugcac

SEQ ID NO: 313203 - RNA, 22 nt, Human
uuucuguaaggacuuaaugcaa

SEQ ID NO: 313204 - RNA, 22 nt, Human
uggcucagagagggagugugga

SEQ ID NO: 313205 - RNA, 22 nt, Human
cucagaguucuccugggaggug

SEQ ID NO: 313206 - RNA, 22 nt, Human
cacugccugugagcugugugcc

SEQ ID NO: 313207 - RNA, 22 nt, Human
aauucugugcaggcagagcuau

SEQ ID NO: 313208 - RNA, 22 nt, Human
aggcagagcugauguucuguga

SEQ ID NO: 313209 - RNA, 22 nt, Human
uucauucugggcucuaaggaac

SEQ ID NO: 313210 - RNA, 22 nt, Human
ggcugcagguugguuggcagcu

SEQ ID NO: 313211 - RNA, 20 nt, Human
ucugcccaccccggcuccca

SEQ ID NO: 313212 - RNA, 22 nt, Human
ucuguucaguuguaccuucccc

SEQ ID NO: 313213 - RNA, 20 nt, Human
acugccuugguucaguaggu

SEQ ID NO: 313214 - RNA, 22 nt, Human
acauuucuuugcuagacagcag

SEQ ID NO: 313215 - RNA, 22 nt, Human
aggagagagaacacuugggucc

SEQ ID NO: 313216 - RNA, 22 nt, Human
gggagggaucugcuaggcaaug

SEQ ID NO: 313217 - RNA, 22 nt, Human
agagcuggccagggaucacucu

SEQ ID NO: 313218 - RNA, 22 nt, Human
agccuguccagaggacagggcu

SEQ ID NO: 313219 - RNA, 22 nt, Human
cauaccuuucucaagcacaugu

SEQ ID NO: 313220 - RNA, 22 nt, Human
cagugauguuucugcaucagag

SEQ ID NO: 313221 - RNA, 22 nt, Human
uguacuuccccaaugacagcac

SEQ ID NO: 313222 - RNA, 22 nt, Human
ggcugggcuccgggagcaugcg

SEQ ID NO: 313223 - RNA, 22 nt, Human
cccuucccuucugggagaucca

SEQ ID NO: 313224 - RNA, 22 nt, Human
acuggaaaacacuacuacaugc

SEQ ID NO: 313225 - RNA, 22 nt, Human
caggaaggcccaccuguccugu

SEQ ID NO: 313226 - RNA, 19 nt, Human
ggagccuggagcacgugcc

SEQ ID NO: 313227 - RNA, 22 nt, Human
ucucagagugguggucccucug

SEQ ID NO: 313228 - RNA, 22 nt, Human
augauacaucuucaugucagug

SEQ ID NO: 313229 - RNA, 22 nt, Human
uggcucagaggggaagugguuu

SEQ ID NO: 313230 - RNA, 22 nt, Human
ccagcccucacugaggccucuc

SEQ ID NO: 313231 - RNA, 22 nt, Human
uucagaauauuuguuuuacaug

SEQ ID NO: 313232 - RNA, 22 nt, Human
uaaauguaccuucugccuuacu

SEQ ID NO: 313233 - RNA, 22 nt, Human
ucucagagggaggauuacugcc

SEQ ID NO: 313234 - RNA, 22 nt, Human
uaagauaaguggguugagaugg

SEQ ID NO: 313235 - RNA, 22 nt, Human
uggcucagcugacucggcuucu

SEQ ID NO: 313236 - RNA, 22 nt, Human
gggugggaacaggaugccagga

SEQ ID NO: 313237 - RNA, 23 nt, Human
gagagcugacugucaagacuguu

SEQ ID NO: 313238 - RNA, 22 nt, Human
gcugccaccguggagaugagug

SEQ ID NO: 313239 - RNA, 22 nt, Human
aaauacagaguugcuuaaaagc

SEQ ID NO: 313240 - RNA, 22 nt, Human
ccagccagcugcccuuggggcc

SEQ ID NO: 313241 - RNA, 22 nt, Human
ccaguguuacggcuugaacuau

SEQ ID NO: 313242 - RNA, 22 nt, Human
ggcuggguuauuuauggccaag

SEQ ID NO: 313243 - RNA, 22 nt, Human
aguaugaaccuggguucuggau

SEQ ID NO: 313244 - RNA, 22 nt, Human
accuggagucauuugaggagua

SEQ ID NO: 313245 - RNA, 20 nt, Human
gacaggagaguuagguaggu

SEQ ID NO: 313246 - RNA, 22 nt, Human
ccugggucuugguucaugcucu

SEQ ID NO: 313247 - RNA, 22 nt, Human
gggcugccuuucuucugggagc

SEQ ID NO: 313248 - RNA, 22 nt, Human
acaaggcugaacagugaagccg

SEQ ID NO: 313249 - RNA, 22 nt, Human
cugggcuucucccccuggcaga

SEQ ID NO: 313250 - RNA, 22 nt, Human
aggcacugauucuguuuuccau

SEQ ID NO: 313251 - RNA, 22 nt, Human
uacacuuuuuacuacagauucu

SEQ ID NO: 313252 - RNA, 20 nt, Human
ccucaggaugagggugagca

SEQ ID NO: 313253 - RNA, 22 nt, Human
ccagaggcauguucaaagcaau

SEQ ID NO: 313254 - RNA, 22 nt, Human
agccaugcaccuuacucuugcu

SEQ ID NO: 313255 - RNA, 22 nt, Human
caaggagaaaacggcuucugaa

SEQ ID NO: 313256 - RNA, 22 nt, Human
ugcagaggaccauuguccugga

SEQ ID NO: 313257 - RNA, 22 nt, Human
auaagcauguuagaauauuuga

SEQ ID NO: 313258 - RNA, 22 nt, Human
uuccugagggacuuuugagauu

SEQ ID NO: 313259 - RNA, 22 nt, Human
ugcagaagcagagaguugccaa

SEQ ID NO: 313260 - RNA, 20 nt, Human
uggcggggaugagggaguua

SEQ ID NO: 313261 - RNA, 22 nt, Human
aggcccugcccagagcuccucg

SEQ ID NO: 313262 - RNA, 22 nt, Human
cuuguacaggaauccaugguau

SEQ ID NO: 313263 - RNA, 22 nt, Human
uugcugugucugauggcugaga

SEQ ID NO: 313264 - RNA, 18 nt, Human
uuaagagcugaaagggga

SEQ ID NO: 313265 - RNA, 22 nt, Human
gagagcuggguucaaguagcug

SEQ ID NO: 313266 - RNA, 22 nt, Human
ugccaggcuaaguggaggacuu

SEQ ID NO: 313267 - RNA, 22 nt, Human
ugguccagacauuucugaggua

SEQ ID NO: 313268 - RNA, 22 nt, Human
ccugccuggaucagccauccug

SEQ ID NO: 313269 - RNA, 22 nt, Human
caggugggagccacagcguaca

SEQ ID NO: 313270 - RNA, 22 nt, Human
uucaagaucgaguuuaaaguga

SEQ ID NO: 313271 - RNA, 19 nt, Human
ucauuguugguuugucggg

SEQ ID NO: 313272 - RNA, 22 nt, Human
gcugagaguguaggauguuuac

SEQ ID NO: 313273 - RNA, 22 nt, Human
uguacaauagcuauuaucucca

SEQ ID NO: 313274 - RNA, 21 nt, Human
ucucugggcccuccugugggg

SEQ ID NO: 313275 - RNA, 22 nt, Human
ggccucagaccggagcuggcca

SEQ ID NO: 313276 - RNA, 22 nt, Human
gccuggguuccaugaucuccag

SEQ ID NO: 313277 - RNA, 22 nt, Human
ugccugaugcaggaguaucaga

SEQ ID NO: 313278 - RNA, 22 nt, Human
aaacucugcacugcgguaaggu

SEQ ID NO: 313279 - RNA, 22 nt, Human
uggccugcagaggcuguggggc

SEQ ID NO: 313280 - RNA, 21 nt, Human
agguggggcugcaccucugcu

SEQ ID NO: 313281 - RNA, 22 nt, Human
uaugcuuuuaaccuguaacuga

SEQ ID NO: 313282 - RNA, 22 nt, Human
uucugugaaucuuuuuucccac

SEQ ID NO: 313283 - RNA, 22 nt, Human
ucccagaggcuccagucucuau

SEQ ID NO: 313284 - RNA, 22 nt, Human
ggcucaagcagucugccugccu

SEQ ID NO: 313285 - RNA, 22 nt, Human
cucacugucuguacuagcugau

SEQ ID NO: 313286 - RNA, 22 nt, Human
ucaaaugcuguauuguaguaau

SEQ ID NO: 313287 - RNA, 22 nt, Human
gggcuggaggaccggccucgga

SEQ ID NO: 313288 - RNA, 22 nt, Human
gugggcuggacccuccugcucc

SEQ ID NO: 313289 - RNA, 22 nt, Human
gaucuucuauguaaugaagugu

SEQ ID NO: 313290 - RNA, 22 nt, Human
caguacuucuuggaaacuggau

SEQ ID NO: 313291 - RNA, 22 nt, Human
augugacaauauuuggucuuau

SEQ ID NO: 313292 - RNA, 22 nt, Human
ggcagccuccagggcacuggug

SEQ ID NO: 313293 - RNA, 22 nt, Human
ucaugcuuauugcauauuugga

SEQ ID NO: 313294 - RNA, 22 nt, Human
aggcugggaaauguauuccagc

SEQ ID NO: 313295 - RNA, 22 nt, Human
agaaaucacaggaggcagaagg

SEQ ID NO: 313296 - RNA, 21 nt, Human
ucaaagcacauauuugcacau

SEQ ID NO: 313297 - RNA, 22 nt, Human
uuuccaagagcuuauuucugaa

SEQ ID NO: 313298 - RNA, 22 nt, Human
agugacugggcagggcagggcc

SEQ ID NO: 313299 - RNA, 22 nt, Human
gagagcacaugaacauggagga

SEQ ID NO: 313300 - RNA, 22 nt, Human
caggccucagagaguggcgggg

SEQ ID NO: 313301 - RNA, 22 nt, Human
aagauuucugcuuuuggaggca

SEQ ID NO: 313302 - RNA, 22 nt, Human
cugccuggcauggagaagagaa

SEQ ID NO: 313303 - RNA, 22 nt, Human
uucagaaugugaccuuauuugg

SEQ ID NO: 313304 - RNA, 22 nt, Human
gccuggcacucacugaagaggc

SEQ ID NO: 313305 - RNA, 22 nt, Human
auaugugaaguggguuauuuug

SEQ ID NO: 313306 - RNA, 22 nt, Human
agcuugaguuuuggaugaagug

SEQ ID NO: 313307 - RNA, 22 nt, Human
ggagcuguguuauccauuccca

SEQ ID NO: 313308 - RNA, 22 nt, Human
uuugggaacucuaucauggaaa

SEQ ID NO: 313309 - RNA, 22 nt, Human
uggagcugacucacaccagcua

SEQ ID NO: 313310 - RNA, 22 nt, Human
cauugcacuucugcuuuuccuc

SEQ ID NO: 313311 - RNA, 23 nt, Human
ucaguuuuggcuguucaguguug

SEQ ID NO: 313312 - RNA, 22 nt, Human
acaugcaugucuaugggcaggu

SEQ ID NO: 313313 - RNA, 22 nt, Human
gggucccaggaaggagcagugu

SEQ ID NO: 313314 - RNA, 22 nt, Human
ucuggagcuuccucauuuacag

SEQ ID NO: 313315 - RNA, 22 nt, Human
agagacagaucugagggaccuc

SEQ ID NO: 313316 - RNA, 22 nt, Human
uggcagaggcucugugauguug

SEQ ID NO: 313317 - RNA, 21 nt, Human
augaagucuaugcuucugugu

SEQ ID NO: 313318 - RNA, 22 nt, Human
agucccagcucugccacuuacu

SEQ ID NO: 313319 - RNA, 22 nt, Human
auguguaggugaaucgaggcug

SEQ ID NO: 313320 - RNA, 22 nt, Human
uccugccugagcguggaggagg

SEQ ID NO: 313321 - RNA, 19 nt, Human
ucaaagcaagcauguucug

SEQ ID NO: 313322 - RNA, 22 nt, Human
cccagcuugcccaggacugagg

SEQ ID NO: 313323 - RNA, 22 nt, Human
caugcacagugauaucugaaga

SEQ ID NO: 313324 - RNA, 22 nt, Human
ggaggccaccugaccugcuguu

SEQ ID NO: 313325 - RNA, 22 nt, Human
ccauccugcauugcuauucaga

SEQ ID NO: 313326 - RNA, 22 nt, Human
caaauaguuuuucauguauuau

SEQ ID NO: 313327 - RNA, 22 nt, Human
gaggugggaugugugugcuacu

SEQ ID NO: 313328 - RNA, 22 nt, Human
uagagcauuuagaggggcagga

SEQ ID NO: 313329 - RNA, 22 nt, Human
agaacagaagggaggaaggccu

SEQ ID NO: 313330 - RNA, 22 nt, Human
gggcagagacucagaaacagaa

SEQ ID NO: 313331 - RNA, 18 nt, Human
aaaugcuaggcuacauga

SEQ ID NO: 313332 - RNA, 22 nt, Human
gcugcucuacccaugcaucugu

SEQ ID NO: 313333 - RNA, 22 nt, Human
auuguaauuuuagagaaagugg

SEQ ID NO: 313334 - RNA, 22 nt, Human
guugggaaggcaagaaguagaa

SEQ ID NO: 313335 - RNA, 22 nt, Human
cugcuccacaccuccauuuccu

SEQ ID NO: 313336 - RNA, 22 nt, Human
cucucugaggcaggccuguggg

SEQ ID NO: 313337 - RNA, 22 nt, Human
ggaaagagcuaaaagggugaga

SEQ ID NO: 313338 - RNA, 22 nt, Human
ggugaggcccagugaucugugu

SEQ ID NO: 313339 - RNA, 22 nt, Human
uaacacacugaaggugagaugg

SEQ ID NO: 313340 - RNA, 22 nt, Human
agcugcucuugggugacuucaa

SEQ ID NO: 313341 - RNA, 22 nt, Human
ccugcagguccccggaugcgca

SEQ ID NO: 313342 - RNA, 16 nt, Human
aggaggggaauuagga

SEQ ID NO: 313343 - RNA, 22 nt, Human
uaggacaggugaggggcugugg

SEQ ID NO: 313344 - RNA, 22 nt, Human
uggcagcagggaggccaguguu

SEQ ID NO: 313345 - RNA, 22 nt, Human
cuugcugugugguguucucaga

SEQ ID NO: 313346 - RNA, 22 nt, Human
auguagaauuccuucuacuuug

SEQ ID NO: 313347 - RNA, 19 nt, Human
acaaaugauguugcacuga

SEQ ID NO: 313348 - RNA, 23 nt, Human
ucucagugaaucucagaauucgc

SEQ ID NO: 313349 - RNA, 22 nt, Human
ugagggcugcuuccagagcuag

SEQ ID NO: 313350 - RNA, 23 nt, Human
uggauaaagcugugcugcauagg

SEQ ID NO: 313351 - RNA, 22 nt, Human
uuucauugucuacauaugacau

SEQ ID NO: 313352 - RNA, 23 nt, Human
acucagugagggccuugggcugc

SEQ ID NO: 313353 - RNA, 22 nt, Human
cucugguguccuuuagaauuua

SEQ ID NO: 313354 - RNA, 22 nt, Human
uguuaacaucuuggacucguga

SEQ ID NO: 313355 - RNA, 22 nt, Human
cugucauugagccugucagggc

SEQ ID NO: 313356 - RNA, 22 nt, Human
aggauccugcgcuuugggggag

SEQ ID NO: 313357 - RNA, 22 nt, Human
uuccuugaaaguuugaacugac

SEQ ID NO: 313358 - RNA, 20 nt, Human
cuguuaaaagguaugaauuc

SEQ ID NO: 313359 - RNA, 20 nt, Human
gcaaggcacagugaggaggg

SEQ ID NO: 313360 - RNA, 22 nt, Human
aucuuguuauaagagauaaugg

SEQ ID NO: 313361 - RNA, 22 nt, Human
aucccuggacggcgccucccca

SEQ ID NO: 313362 - RNA, 22 nt, Human
gcccaucaucacuguggaggcu

SEQ ID NO: 313363 - RNA, 22 nt, Human
gggcgagggcgaaagcgagagc

SEQ ID NO: 313364 - RNA, 22 nt, Human
aaggccugggaguacugggaca

SEQ ID NO: 313365 - RNA, 22 nt, Human
aggcugggaagguaaaguugua

SEQ ID NO: 313366 - RNA, 22 nt, Human
agugcuggauuacaggcgugag

SEQ ID NO: 313367 - RNA, 22 nt, Human
uagcugccaaaagggugggcua

SEQ ID NO: 313368 - RNA, 22 nt, Human
cacaaaugugcagaaaugugag

SEQ ID NO: 313369 - RNA, 22 nt, Human
gccaccccaaccucccuaaguu

SEQ ID NO: 313370 - RNA, 22 nt, Human
ccaaagucagugcucagucguc

SEQ ID NO: 313371 - RNA, 22 nt, Human
aaucuucacagaaaaaugucug

SEQ ID NO: 313372 - RNA, 22 nt, Human
aaggagaagucuguugagauug

SEQ ID NO: 313373 - RNA, 22 nt, Human
caaggccagggaauuuuucugg

SEQ ID NO: 313374 - RNA, 22 nt, Human
ccagaagggcuauugcagugac

SEQ ID NO: 313375 - RNA, 22 nt, Human
agcagagcugcaguggccugcu

SEQ ID NO: 313376 - RNA, 22 nt, Human
caauaugcaagcuauuaaguau

SEQ ID NO: 313377 - RNA, 22 nt, Human
ugucacauugaauaugauuuau

SEQ ID NO: 313378 - RNA, 21 nt, Human
gcugagagguugggaaguuca

SEQ ID NO: 313379 - RNA, 22 nt, Human
uuucuguaaguggcaaauaaug

SEQ ID NO: 313380 - RNA, 22 nt, Human
agacacugauguucagcucaau

SEQ ID NO: 313381 - RNA, 22 nt, Human
acagggccaggugagaggugcu

SEQ ID NO: 313382 - RNA, 22 nt, Human
agagcuguucaacguagcaaug

SEQ ID NO: 313383 - RNA, 17 nt, Human
cucacggaggaugaauc

SEQ ID NO: 313384 - RNA, 22 nt, Human
agccagugcaacagcagugaag

SEQ ID NO: 313385 - RNA, 22 nt, Human
gauuucuguaacacuucagaua

SEQ ID NO: 313386 - RNA, 22 nt, Human
caaugaaagcaacugccuauaa

SEQ ID NO: 313387 - RNA, 22 nt, Human
cuggagcuaauaauccaucuga

SEQ ID NO: 313388 - RNA, 22 nt, Human
uauguguuugacacccugcaag

SEQ ID NO: 313389 - RNA, 22 nt, Human
ugcugccacauuuaaagagggg

SEQ ID NO: 313390 - RNA, 20 nt, Human
ccugccugccucggcucauu

SEQ ID NO: 313391 - RNA, 22 nt, Human
uuagaaaaaggcuguggucuua

SEQ ID NO: 313392 - RNA, 22 nt, Human
acucugccaucccaggugcugu

SEQ ID NO: 313393 - RNA, 22 nt, Human
cacagacccagaagggaugaag

SEQ ID NO: 313394 - RNA, 22 nt, Human
uuuauuuaaagucguguguuaa

SEQ ID NO: 313395 - RNA, 22 nt, Human
gcucugucaacagcuagcugug

SEQ ID NO: 313396 - RNA, 22 nt, Human
uggcucagagcagggacucugg

SEQ ID NO: 313397 - RNA, 22 nt, Human
ccccagcugcauacuugccaag

SEQ ID NO: 313398 - RNA, 22 nt, Human
ccagagccagagaggugccugc

SEQ ID NO: 313399 - RNA, 18 nt, Human
cugcugugucgucugggc

SEQ ID NO: 313400 - RNA, 22 nt, Human
uccuuggcaugccgucuucucc

SEQ ID NO: 313401 - RNA, 21 nt, Human
ggcagaaguagcauggacggg

SEQ ID NO: 313402 - RNA, 22 nt, Human
gcuguauuuaacaacuggcuca

SEQ ID NO: 313403 - RNA, 22 nt, Human
gggaaccagccgcuuccgccuc

SEQ ID NO: 313404 - RNA, 22 nt, Human
agcaauauuuaaagguuugcaa

SEQ ID NO: 313405 - RNA, 22 nt, Human
acccugagggguauagcagaag

SEQ ID NO: 313406 - RNA, 22 nt, Human
acaaaguuugugguauuccaag

SEQ ID NO: 313407 - RNA, 22 nt, Human
ccagggcugagcugugaccaug

SEQ ID NO: 313408 - RNA, 22 nt, Human
gagagcuggccagcuucaguau

SEQ ID NO: 313409 - RNA, 22 nt, Human
aaucagaauuuauugaaucuuu

SEQ ID NO: 313410 - RNA, 21 nt, Human
ugccagcauuaaacagucauu

SEQ ID NO: 313411 - RNA, 23 nt, Human
acagcaagaggaccagaugugag

SEQ ID NO: 313412 - RNA, 22 nt, Human
uuucuaaaugguggcugcauug

SEQ ID NO: 313413 - RNA, 22 nt, Human
aauaacuucaguucuuacauua

SEQ ID NO: 313414 - RNA, 22 nt, Human
gagaacaggcucuggagucaga

SEQ ID NO: 313415 - RNA, 22 nt, Human
cauuucugggagacaugcuaga

SEQ ID NO: 313416 - RNA, 22 nt, Human
gcagcugcuguggcaucaagcu

SEQ ID NO: 313417 - RNA, 22 nt, Human
acaaacuaccuacagauguuca

SEQ ID NO: 313418 - RNA, 22 nt, Human
uggacucagaaguguucuuuua

SEQ ID NO: 313419 - RNA, 22 nt, Human
uaagaacaagauguuccuguuu

SEQ ID NO: 313420 - RNA, 22 nt, Human
agcuggggguuggauaagggua

SEQ ID NO: 313421 - RNA, 22 nt, Human
aucuggguucaccaugcuccug

SEQ ID NO: 313422 - RNA, 22 nt, Human
cucugagcccgcugcagcccca

SEQ ID NO: 313423 - RNA, 22 nt, Human
acauuucuuuucaucucuauau

SEQ ID NO: 313424 - RNA, 23 nt, Human
ucugggcaccuuguugacaugau

SEQ ID NO: 313425 - RNA, 23 nt, Human
ucauggaacugggcaaucuugaa

SEQ ID NO: 313426 - RNA, 22 nt, Human
ugccagcacaaguuaagagauc

SEQ ID NO: 313427 - RNA, 23 nt, Human
cagaagcaccuguugacugcugc

SEQ ID NO: 313428 - RNA, 21 nt, Human
aaaaugugagcgugaugcuua

SEQ ID NO: 313429 - RNA, 22 nt, Human
caagccucagaaucuucuccau

SEQ ID NO: 313430 - RNA, 22 nt, Human
agagcuguagcuuccuagagcc

SEQ ID NO: 313431 - RNA, 22 nt, Human
agggccuggcuucacuuucuca

SEQ ID NO: 313432 - RNA, 22 nt, Human
cugguucauccccuuccaggaa

SEQ ID NO: 313433 - RNA, 22 nt, Human
ucccagagcaguacuccaggag

SEQ ID NO: 313434 - RNA, 22 nt, Human
agcaggguuuggggauuggcac

SEQ ID NO: 313435 - RNA, 22 nt, Human
acaggcugccuaccaaguauca

SEQ ID NO: 313436 - RNA, 22 nt, Human
acagaacugggaaaugcacaua

SEQ ID NO: 313437 - RNA, 22 nt, Human
uauucacaggcacgaaauauug

SEQ ID NO: 313438 - RNA, 22 nt, Human
auuacaguaacagcuacaaugc

SEQ ID NO: 313439 - RNA, 22 nt, Human
cagggcugguuugucgaagaaa

SEQ ID NO: 313440 - RNA, 17 nt, Human
ucuguccagggagugug

SEQ ID NO: 313441 - RNA, 22 nt, Human
cucuggcuucuaccuugcaguu

SEQ ID NO: 313442 - RNA, 22 nt, Human
ccugucuguccucucaugagcc

SEQ ID NO: 313443 - RNA, 22 nt, Human
gagacacacacaggagguggca

SEQ ID NO: 313444 - RNA, 22 nt, Human
gcacagggcugccaggcggcuu

SEQ ID NO: 313445 - RNA, 18 nt, Human
aucucccauuggccaagg

SEQ ID NO: 313446 - RNA, 22 nt, Human
agguaugagauaaaucaaugaa

SEQ ID NO: 313447 - RNA, 22 nt, Human
aucaggaugcugucaguuacca

SEQ ID NO: 313448 - RNA, 22 nt, Human
aaacaugagcaucucuucaagc

SEQ ID NO: 313449 - RNA, 22 nt, Human
gaauauuuuuaaagggacuaau

SEQ ID NO: 313450 - RNA, 22 nt, Human
aaagauuuaagaauaauuugug

SEQ ID NO: 313451 - RNA, 22 nt, Human
gggcccacuggcugucugaccc

SEQ ID NO: 313452 - RNA, 22 nt, Human
cuggcuggccggagcgaggcgg

SEQ ID NO: 313453 - RNA, 22 nt, Human
uucacaaaacacuauuuucugg

SEQ ID NO: 313454 - RNA, 19 nt, Human
gagguggguccccgcagcc

SEQ ID NO: 313455 - RNA, 22 nt, Human
augggaugaacuugaucugcuu

SEQ ID NO: 313456 - RNA, 22 nt, Human
cagccucucuguaucucaggau

SEQ ID NO: 313457 - RNA, 22 nt, Human
cagcuggguuuaguggggugug

SEQ ID NO: 313458 - RNA, 22 nt, Human
uggcccucagucuugcuccugc

SEQ ID NO: 313459 - RNA, 22 nt, Human
ucauuuguacuugugugcuugu

SEQ ID NO: 313460 - RNA, 22 nt, Human
aauaacuuuuaaaagacccugg

SEQ ID NO: 313461 - RNA, 22 nt, Human
cacuggggugggccugguagag

SEQ ID NO: 313462 - RNA, 22 nt, Human
uccucagacacccugcuggcuu

SEQ ID NO: 313463 - RNA, 22 nt, Human
cagcugagcucccaggccauca

SEQ ID NO: 313464 - RNA, 22 nt, Human
cagcuucccuuggcugagcaga

SEQ ID NO: 313465 - RNA, 22 nt, Human
uagcuuuaccauagaagaguau

SEQ ID NO: 313466 - RNA, 22 nt, Human
caggggcucccugggugccagu

SEQ ID NO: 313467 - RNA, 22 nt, Human
aaggguggauuucugagcucua

SEQ ID NO: 313468 - RNA, 22 nt, Human
agcagcauucucugguaugggg

SEQ ID NO: 313469 - RNA, 22 nt, Human
agaaagaacgcacuugugcugc

SEQ ID NO: 313470 - RNA, 22 nt, Human
uggcaccaggcgggguggcugu

SEQ ID NO: 313471 - RNA, 22 nt, Human
gcucugagcacugugcggcugg

SEQ ID NO: 313472 - RNA, 22 nt, Human
aggaccaacauagcagcagugg

SEQ ID NO: 313473 - RNA, 22 nt, Human
uacauauacugagugauuugcu

SEQ ID NO: 313474 - RNA, 22 nt, Human
aauuuguuaaaagugagugaca

SEQ ID NO: 313475 - RNA, 22 nt, Human
uacauuccauguguguguauuc

SEQ ID NO: 313476 - RNA, 22 nt, Human
gucaggauuuacaaacuucagu

SEQ ID NO: 313477 - RNA, 22 nt, Human
gcagaagucagaccaucugaau

SEQ ID NO: 313478 - RNA, 22 nt, Human
ggacacaaaagugaauaaaaua

SEQ ID NO: 313479 - RNA, 21 nt, Human
gccaccccuggcacaggugcu

SEQ ID NO: 313480 - RNA, 19 nt, Human
auggaaaaugccagacuga

SEQ ID NO: 313481 - RNA, 22 nt, Human
caaggaaggagagaugaugggu

SEQ ID NO: 313482 - RNA, 22 nt, Human
ggucucagcccucgccagcagc

SEQ ID NO: 313483 - RNA, 22 nt, Human
gcagcugcuggaaguuccugcc

SEQ ID NO: 313484 - RNA, 22 nt, Human
cagguacacucccuugugcuga

SEQ ID NO: 313485 - RNA, 22 nt, Human
gggggcuguccugugcauugua

SEQ ID NO: 313486 - RNA, 18 nt, Human
ugucucugaauuccagug

SEQ ID NO: 313487 - RNA, 22 nt, Human
ccugucugaaggcagggggaug

SEQ ID NO: 313488 - RNA, 22 nt, Human
cugggaaauggcuucgagcuca

SEQ ID NO: 313489 - RNA, 22 nt, Human
ggaggccaaagugugggcggcu

SEQ ID NO: 313490 - RNA, 22 nt, Human
acuuucucaggaauucacagac

SEQ ID NO: 313491 - RNA, 22 nt, Human
ucacaguuauagucuguagaau

SEQ ID NO: 313492 - RNA, 22 nt, Human
cagaaaauaaaguuucuacgca

SEQ ID NO: 313493 - RNA, 22 nt, Human
ccugugaggucaucugugguaa

SEQ ID NO: 313494 - RNA, 22 nt, Human
uggccuggugcucaggcaguag

SEQ ID NO: 313495 - RNA, 22 nt, Human
cacaagagagugcgcguugcaa

SEQ ID NO: 313496 - RNA, 22 nt, Human
uggcugggccgggccuugugcc

SEQ ID NO: 313497 - RNA, 22 nt, Human
ccacagggacuguuaaaacccu

SEQ ID NO: 313498 - RNA, 22 nt, Human
cuauugaauuaacuauuaaagu

SEQ ID NO: 313499 - RNA, 22 nt, Human
caccagcuacagacuacugugu

SEQ ID NO: 313500 - RNA, 22 nt, Human
ggaaggagccauaucauaucca

SEQ ID NO: 313501 - RNA, 22 nt, Human
cuggcuggcaaguagaacacaa

SEQ ID NO: 313502 - RNA, 23 nt, Human
aguuuuucugcaugguucuguau

SEQ ID NO: 313503 - RNA, 22 nt, Human
gugcuaggauuacaggcauggg

SEQ ID NO: 313504 - RNA, 22 nt, Human
aauguauggauucaugucugug

SEQ ID NO: 313505 - RNA, 22 nt, Human
agagccugucugccuuucuacc

SEQ ID NO: 313506 - RNA, 22 nt, Human
cucccacuccuggcucaccaca

SEQ ID NO: 313507 - RNA, 22 nt, Human
caguuauuaugaggucauuagg

SEQ ID NO: 313508 - RNA, 22 nt, Human
gggaguggagagcaauggauga

SEQ ID NO: 313509 - RNA, 22 nt, Human
cugcugugauugggagaaaccg

SEQ ID NO: 313510 - RNA, 22 nt, Human
ccuggauucaagucuuucuuuc

SEQ ID NO: 313511 - RNA, 22 nt, Human
aaggcacuacgcugcuggggcg

SEQ ID NO: 313512 - RNA, 21 nt, Human
gcacagggacagaucaucaca

SEQ ID NO: 313513 - RNA, 22 nt, Human
ggagcagagcauuucacagccu

SEQ ID NO: 313514 - RNA, 22 nt, Human
uggaaugacagagagucugaau

SEQ ID NO: 313515 - RNA, 22 nt, Human
uggcagaggaggcucagauuga

SEQ ID NO: 313516 - RNA, 22 nt, Human
ucuucagagacucugagccccu

SEQ ID NO: 313517 - RNA, 22 nt, Human
ucacauucucagcaucuauaca

SEQ ID NO: 313518 - RNA, 22 nt, Human
agcagccagagucugaacauua

SEQ ID NO: 313519 - RNA, 22 nt, Human
agaaauguuacaguuguuauuu

SEQ ID NO: 313520 - RNA, 17 nt, Human
uucaaugauuaaugcau

SEQ ID NO: 313521 - RNA, 22 nt, Human
aaggcagauauaaagacuagag

SEQ ID NO: 313522 - RNA, 22 nt, Human
aaggccaugaccacuugcugug

SEQ ID NO: 313523 - RNA, 22 nt, Human
accugccucagugcagcuggau

SEQ ID NO: 313524 - RNA, 22 nt, Human
caggaacauuuaaccacagggu

SEQ ID NO: 313525 - RNA, 19 nt, Human
gaaggagagcugaguuagg

SEQ ID NO: 313526 - RNA, 22 nt, Human
ggcucaggacacagugguuuag

SEQ ID NO: 313527 - RNA, 22 nt, Human
gcuaccugagcaagagcuucaa

SEQ ID NO: 313528 - RNA, 22 nt, Human
cuggacagaaagggcugcugug

SEQ ID NO: 313529 - RNA, 22 nt, Human
agguggcuccucccauggcugg

SEQ ID NO: 313530 - RNA, 22 nt, Human
cagcugccuguauuguccucau

SEQ ID NO: 313531 - RNA, 22 nt, Human
ugaggugaagaguggagcucag

SEQ ID NO: 313532 - RNA, 22 nt, Human
uuuucaguaaugucuacauaau

SEQ ID NO: 313533 - RNA, 22 nt, Human
cacuggaauucaagauacugag

SEQ ID NO: 313534 - RNA, 22 nt, Human
uacagaaaaacuggcauugaag

SEQ ID NO: 313535 - RNA, 22 nt, Human
cacaaugcguacauauaucaaa

SEQ ID NO: 313536 - RNA, 22 nt, Human
aggcccagggcugcucucugaa

SEQ ID NO: 313537 - RNA, 22 nt, Human
uggccugccuucgcugagcuga

SEQ ID NO: 313538 - RNA, 22 nt, Human
ggcagggcaggaaagucaggaa

SEQ ID NO: 313539 - RNA, 22 nt, Human
aaaugucugagacuucugaacu

SEQ ID NO: 313540 - RNA, 22 nt, Human
cuguccugauggugccacuggu

SEQ ID NO: 313541 - RNA, 22 nt, Human
uccagggauguccuguagcacu

SEQ ID NO: 313542 - RNA, 22 nt, Human
cagaagaaaguggggagacaag

SEQ ID NO: 313543 - RNA, 22 nt, Human
uuccucucucuugccagaaugu

SEQ ID NO: 313544 - RNA, 22 nt, Human
auucuucacaaauauauagaag

SEQ ID NO: 313545 - RNA, 22 nt, Human
ggagccagcagggugacacuga

SEQ ID NO: 313546 - RNA, 22 nt, Human
agcuggccuguuagagcugagu

SEQ ID NO: 313547 - RNA, 22 nt, Human
gagccaggcaccuucuguguug

SEQ ID NO: 313548 - RNA, 21 nt, Human
acaugcauagagagauuucug

SEQ ID NO: 313549 - RNA, 22 nt, Human
ucugcagcgugcaggcuggugc

SEQ ID NO: 313550 - RNA, 22 nt, Human
ugcuuuaaaccauggaugugag

SEQ ID NO: 313551 - RNA, 23 nt, Human
ccugugugcccuuaauucacagc

SEQ ID NO: 313552 - RNA, 22 nt, Human
ucucagagauucagggagaagu

SEQ ID NO: 313553 - RNA, 22 nt, Human
cauugcucaggcccagcaggaa

SEQ ID NO: 313554 - RNA, 22 nt, Human
cagagcugcaaaugccccuccg

SEQ ID NO: 313555 - RNA, 22 nt, Human
ggcucagggaaugaggaagaau

SEQ ID NO: 313556 - RNA, 22 nt, Human
cuugcugucccuugguaugaac

SEQ ID NO: 313557 - RNA, 22 nt, Human
gucaggauuauuuuauuaaaag

SEQ ID NO: 313558 - RNA, 22 nt, Human
ucagcagauggguuguguuggc

SEQ ID NO: 313559 - RNA, 22 nt, Human
ccuuccuuucagggcuaugccu

SEQ ID NO: 313560 - RNA, 22 nt, Human
ccucgaccuccccaggcucagg

SEQ ID NO: 313561 - RNA, 22 nt, Human
ugcucuggaguggcuugugcac

SEQ ID NO: 313562 - RNA, 22 nt, Human
ggcaccagcaggcaccgaugcc

SEQ ID NO: 313563 - RNA, 19 nt, Human
ucccgcccacugagcgugc

SEQ ID NO: 313564 - RNA, 22 nt, Human
cagaugaggcaaccucauugcu

SEQ ID NO: 313565 - RNA, 22 nt, Human
cagcucccagagugaccagcag

SEQ ID NO: 313566 - RNA, 22 nt, Human
gcucccagauuucagccuugug

SEQ ID NO: 313567 - RNA, 22 nt, Human
ucuguaucacccguucccagaa

SEQ ID NO: 313568 - RNA, 22 nt, Human
uuauuuugguaaauguuugccu

SEQ ID NO: 313569 - RNA, 21 nt, Human
gccacguuucagucuucucag

SEQ ID NO: 313570 - RNA, 22 nt, Human
gcagaugguggggcaggaaaau

SEQ ID NO: 313571 - RNA, 22 nt, Human
aaaugcacaggagaaccaauuc

SEQ ID NO: 313572 - RNA, 22 nt, Human
gugucccaaagauuagaaauca

SEQ ID NO: 313573 - RNA, 22 nt, Human
ucaaguauaucuagucauuagg

SEQ ID NO: 313574 - RNA, 22 nt, Human
aaacacagggauauauauucca

SEQ ID NO: 313575 - RNA, 22 nt, Human
uggaaagaaaaacaggccauga

SEQ ID NO: 313576 - RNA, 20 nt, Human
gccugcagagaaggucagag

SEQ ID NO: 313577 - RNA, 22 nt, Human
aggaggcugguucaggccauau

SEQ ID NO: 313578 - RNA, 22 nt, Human
gcagggcucugcuguaguccua

SEQ ID NO: 313579 - RNA, 22 nt, Human
ucauuucaaugauacuacuaag

SEQ ID NO: 313580 - RNA, 22 nt, Human
uuuguaaagucuguucugaguu

SEQ ID NO: 313581 - RNA, 22 nt, Human
gcagggugauagugaggcucag

SEQ ID NO: 313582 - RNA, 22 nt, Human
ucuucuucccaucccucaaaug

SEQ ID NO: 313583 - RNA, 22 nt, Human
ucacaauacucacucaauggcu

SEQ ID NO: 313584 - RNA, 22 nt, Human
aggagccaagcagaacuaagga

SEQ ID NO: 313585 - RNA, 22 nt, Human
uauuucuggcuuugagggugau

SEQ ID NO: 313586 - RNA, 22 nt, Human
cugggaggcacuauucaggagg

SEQ ID NO: 313587 - RNA, 22 nt, Human
agcagcuguggaaaaguaacua

SEQ ID NO: 313588 - RNA, 22 nt, Human
ucagagugggagaaugugccaa

SEQ ID NO: 313589 - RNA, 22 nt, Human
ucacaauuuggauacagcuaug

SEQ ID NO: 313590 - RNA, 22 nt, Human
ugaaaugagauagauaaucagg

SEQ ID NO: 313591 - RNA, 22 nt, Human
ggagcugcuccuucagccaagu

SEQ ID NO: 313592 - RNA, 22 nt, Human
agagaaggucacuaaggaccca

SEQ ID NO: 313593 - RNA, 22 nt, Human
gggauggggagcuggaaagggg

SEQ ID NO: 313594 - RNA, 22 nt, Human
acaugcauacacguacauaccu

SEQ ID NO: 313595 - RNA, 22 nt, Human
uucaaacaguguagaauauaug

SEQ ID NO: 313596 - RNA, 22 nt, Human
cagaaauggagcccaggaaucu

SEQ ID NO: 313597 - RNA, 22 nt, Human
aaauaauguuaggccuuugcuc

SEQ ID NO: 313598 - RNA, 22 nt, Human
cccugcagaaccacagacaaac

SEQ ID NO: 313599 - RNA, 22 nt, Human
ugaaacuucuaauaugaauagu

SEQ ID NO: 313600 - RNA, 22 nt, Human
gccucaguaaccuuaggggaua

SEQ ID NO: 313601 - RNA, 22 nt, Human
uagcugccauugcuccaggaag

SEQ ID NO: 313602 - RNA, 22 nt, Human
agcagcagauccaaaaaaugug

SEQ ID NO: 313603 - RNA, 22 nt, Human
ggcucuggagacauguggagag

SEQ ID NO: 313604 - RNA, 22 nt, Human
augaaauaucuugaagaaauuc

SEQ ID NO: 313605 - RNA, 22 nt, Human
aacagcuuugcuucuggagaca

SEQ ID NO: 313606 - RNA, 22 nt, Human
acacagccaggguaguaaggcu

SEQ ID NO: 313607 - RNA, 22 nt, Human
ucaguuuucucaucuguaauuu

SEQ ID NO: 313608 - RNA, 22 nt, Human
agccucuggcccuagacugcuu

SEQ ID NO: 313609 - RNA, 23 nt, Human
aguuuguaaagaaauauuugcac

SEQ ID NO: 313610 - RNA, 20 nt, Human
aagaaacuugaaaguacaag

SEQ ID NO: 313611 - RNA, 22 nt, Human
ugggcaccuagcaacccuucuc

SEQ ID NO: 313612 - RNA, 22 nt, Human
ugugcccauuacacagaggcau

SEQ ID NO: 313613 - RNA, 22 nt, Human
cucugcagaggcccaaggcuga

SEQ ID NO: 313614 - RNA, 22 nt, Human
aggagucauugagagggguccu

SEQ ID NO: 313615 - RNA, 22 nt, Human
aauacaguagguaauaguucau

SEQ ID NO: 313616 - RNA, 23 nt, Human
caugccaguuugugcaggcagau

SEQ ID NO: 313617 - RNA, 22 nt, Human
ucuuugaauccuuuacaucuga

SEQ ID NO: 313618 - RNA, 22 nt, Human
gcugucaggccaugugggccuu

SEQ ID NO: 313619 - RNA, 22 nt, Human
uccucuggggucagggcacuac

SEQ ID NO: 313620 - RNA, 22 nt, Human
cugugcuucgcaacuccaaggu

SEQ ID NO: 313621 - RNA, 22 nt, Human
cuggccugggagcugcuagcgu

SEQ ID NO: 313622 - RNA, 22 nt, Human
agguggggaggagugucucuuu

SEQ ID NO: 313623 - RNA, 22 nt, Human
cuggccuguccugacccagccu

SEQ ID NO: 313624 - RNA, 22 nt, Human
agagauguucauucagcauguu

SEQ ID NO: 313625 - RNA, 22 nt, Human
uugaagcaaauucugugcagua

SEQ ID NO: 313626 - RNA, 22 nt, Human
gcccagcccugaggucacagcu

SEQ ID NO: 313627 - RNA, 22 nt, Human
cagcagaggaaagcaaaucuaa

SEQ ID NO: 313628 - RNA, 22 nt, Human
ggcauccugggacuggcuucuu

SEQ ID NO: 313629 - RNA, 22 nt, Human
ugcaaacaggagaguaaguaua

SEQ ID NO: 313630 - RNA, 22 nt, Human
cugcuguggugucaagcaucuc

SEQ ID NO: 313631 - RNA, 22 nt, Human
ucagagugugagacauauugga

SEQ ID NO: 313632 - RNA, 22 nt, Human
caggccugaguguggaagucuu

SEQ ID NO: 313633 - RNA, 22 nt, Human
gacccagcuuaagucacauguu

SEQ ID NO: 313634 - RNA, 22 nt, Human
uuuagaaauucaucuauggccu

SEQ ID NO: 313635 - RNA, 22 nt, Human
auucuuggagcagucaaagaag

SEQ ID NO: 313636 - RNA, 20 nt, Human
uguugauuggugucaucuca

SEQ ID NO: 313637 - RNA, 22 nt, Human
cagagcugcucaugguggccag

SEQ ID NO: 313638 - RNA, 21 nt, Human
uguguucuucuaggucagcua

SEQ ID NO: 313639 - RNA, 22 nt, Human
uggcugcugcuuggucuucuuc

SEQ ID NO: 313640 - RNA, 22 nt, Human
accacccccuuggguguggaag

SEQ ID NO: 313641 - RNA, 22 nt, Human
agaugcugccucuccucacaag

SEQ ID NO: 313642 - RNA, 22 nt, Human
caggggcugugggcggagccuc

SEQ ID NO: 313643 - RNA, 22 nt, Human
ggagccaggcaaucuguacuuu

SEQ ID NO: 313644 - RNA, 22 nt, Human
ccaaaguccauaguuuacauua

SEQ ID NO: 313645 - RNA, 22 nt, Human
uuaagaauggaaugaggaauuu

SEQ ID NO: 313646 - RNA, 22 nt, Human
ucucugguggcuccaucaguag

SEQ ID NO: 313647 - RNA, 22 nt, Human
gccuuccuuacaccugcucagc

SEQ ID NO: 313648 - RNA, 21 nt, Human
ggugucaguuuuggucauuag

SEQ ID NO: 313649 - RNA, 22 nt, Human
uuaaauuagucaagcuucucug

SEQ ID NO: 313650 - RNA, 22 nt, Human
ucucuucucuagugagcaacug

SEQ ID NO: 313651 - RNA, 22 nt, Human
gaugugggguugagggaccagc

SEQ ID NO: 313652 - RNA, 22 nt, Human
agagaagauucuuauaugucuu

SEQ ID NO: 313653 - RNA, 22 nt, Human
uguggcuuuugcuagcuuugca

SEQ ID NO: 313654 - RNA, 22 nt, Human
gccagcagccacagaagucacu

SEQ ID NO: 313655 - RNA, 22 nt, Human
cucagaagccuucagucuuggc

SEQ ID NO: 313656 - RNA, 18 nt, Human
aaugcacacauuuacucc

SEQ ID NO: 313657 - RNA, 22 nt, Human
ggagcuguugcgcaugcgcucg

SEQ ID NO: 313658 - RNA, 22 nt, Human
aggucacacuuggaucauagaa

SEQ ID NO: 313659 - RNA, 22 nt, Human
cuggaaggucuguccccacugc

SEQ ID NO: 313660 - RNA, 22 nt, Human
cccugccucugaagcugcucag

SEQ ID NO: 313661 - RNA, 22 nt, Human
uccuccaggucuaggguggcuu

SEQ ID NO: 313662 - RNA, 21 nt, Human
agcugagcccagaagacuggu

SEQ ID NO: 313663 - RNA, 22 nt, Human
ggucagggggaucugugaggua

SEQ ID NO: 313664 - RNA, 22 nt, Human
aaaugcuguguuuuaacauaga

SEQ ID NO: 313665 - RNA, 17 nt, Human
acagggcagaaacagcu

SEQ ID NO: 313666 - RNA, 20 nt, Human
gccugcagguuggaugggau

SEQ ID NO: 313667 - RNA, 22 nt, Human
uaaucacaucaggguaaauggg

SEQ ID NO: 313668 - RNA, 22 nt, Human
guauuugauacaugaaauggug

SEQ ID NO: 313669 - RNA, 22 nt, Human
uagacauuauguauuaaguucu

SEQ ID NO: 313670 - RNA, 22 nt, Human
caggcaggugcagauuccucuu

SEQ ID NO: 313671 - RNA, 22 nt, Human
acaguaauaaguguuggugagg

SEQ ID NO: 313672 - RNA, 22 nt, Human
agccuccuggaguuucugggau

SEQ ID NO: 313673 - RNA, 18 nt, Human
cccucuugcacaaagcaa

SEQ ID NO: 313674 - RNA, 22 nt, Human
uuuccuaggagauugaucacau

SEQ ID NO: 313675 - RNA, 22 nt, Human
aaaauuauucauggcuuuugga

SEQ ID NO: 313676 - RNA, 22 nt, Human
agucccuguacuuuccacugcc

SEQ ID NO: 313677 - RNA, 22 nt, Human
agugaaauggaugcugcuacug

SEQ ID NO: 313678 - RNA, 22 nt, Human
uucucagaugauucagauaaac

SEQ ID NO: 313679 - RNA, 22 nt, Human
gagggagugccagagggccagc

SEQ ID NO: 313680 - RNA, 22 nt, Human
acaaauguggacauggauaaug

SEQ ID NO: 313681 - RNA, 22 nt, Human
cacugcuuaguugguaaaugug

SEQ ID NO: 313682 - RNA, 19 nt, Human
ggcagaagguguaggggga

SEQ ID NO: 313683 - RNA, 22 nt, Human
agguggggcugggaaagauucc

SEQ ID NO: 313684 - RNA, 22 nt, Human
cugcccugaccugccucagagu

SEQ ID NO: 313685 - RNA, 22 nt, Human
caggcagcugggucaccguccc

SEQ ID NO: 313686 - RNA, 22 nt, Human
agguccagcuguugcagccucc

SEQ ID NO: 313687 - RNA, 22 nt, Human
accaguccgcggagcuccgggg

SEQ ID NO: 313688 - RNA, 22 nt, Human
cuuguccuuuacuugagacuca

SEQ ID NO: 313689 - RNA, 22 nt, Human
caggcacugugcugagcucugc

SEQ ID NO: 313690 - RNA, 22 nt, Human
aaaaccaggcguuuccuauuau

SEQ ID NO: 313691 - RNA, 22 nt, Human
gcugccuugaacuuggccuggg

SEQ ID NO: 313692 - RNA, 22 nt, Human
acaggcugcugagccauuugcu

SEQ ID NO: 313693 - RNA, 22 nt, Human
ucaggcaggcagagggcaaaug

SEQ ID NO: 313694 - RNA, 22 nt, Human
ggcaggagcucuccaguuugcc

SEQ ID NO: 313695 - RNA, 22 nt, Human
gcagccaggaaagcuggacccu

SEQ ID NO: 313696 - RNA, 22 nt, Human
cagcagagcauuugguaggagg

SEQ ID NO: 313697 - RNA, 22 nt, Human
gugcauguuaaugguguacaaa

SEQ ID NO: 313698 - RNA, 22 nt, Human
ucagggcagaauccaaagaauu

SEQ ID NO: 313699 - RNA, 22 nt, Human
gguggccugcccugaucccugg

SEQ ID NO: 313700 - RNA, 22 nt, Human
gcaggcaggagcccaacugccu

SEQ ID NO: 313701 - RNA, 18 nt, Human
uccagucccaaggccagc

SEQ ID NO: 313702 - RNA, 22 nt, Human
cugcugggcagaggcugcauga

SEQ ID NO: 313703 - RNA, 22 nt, Human
ugucccaguucccaggguugcu

SEQ ID NO: 313704 - RNA, 22 nt, Human
uuccaggagacuuccagaaaua

SEQ ID NO: 313705 - RNA, 21 nt, Human
gagugcagcaagguagagucu

SEQ ID NO: 313706 - RNA, 22 nt, Human
guuuaagaggguuucauuccca

SEQ ID NO: 313707 - RNA, 22 nt, Human
uuaacagagaacauagaaguag

SEQ ID NO: 313708 - RNA, 22 nt, Human
uuuuccuucuagagcagauuuc

SEQ ID NO: 313709 - RNA, 22 nt, Human
cauguguuaaucuuucugcaaa

SEQ ID NO: 313710 - RNA, 22 nt, Human
aauaguauuuauuuggaaaaag

SEQ ID NO: 313711 - RNA, 22 nt, Human
acaguguucacuaagguuagcu

SEQ ID NO: 313712 - RNA, 22 nt, Human
agcaggugaauuccuggaugug

SEQ ID NO: 313713 - RNA, 22 nt, Human
ccacacugaaccucagugucuu

SEQ ID NO: 313714 - RNA, 22 nt, Human
gccugguguccagaggcgagug

SEQ ID NO: 313715 - RNA, 22 nt, Human
uggccuggugucugcgaggccu

SEQ ID NO: 313716 - RNA, 22 nt, Human
agcaggugcauggcgagcgcgg

SEQ ID NO: 313717 - RNA, 22 nt, Human
acacagccgugaaucugcuucu

SEQ ID NO: 313718 - RNA, 22 nt, Human
auugacaauuagcccuuaggug

SEQ ID NO: 313719 - RNA, 22 nt, Human
ugcugccaccugguggcugaag

SEQ ID NO: 313720 - RNA, 22 nt, Human
gucucagggacugcuucugggg

SEQ ID NO: 313721 - RNA, 22 nt, Human
ggcaggaggaagaguuagcacc

SEQ ID NO: 313722 - RNA, 23 nt, Human
uuguuuuuagagguggcaugaga

SEQ ID NO: 313723 - RNA, 22 nt, Human
cuggcugcaggaaggagugggc

SEQ ID NO: 313724 - RNA, 22 nt, Human
cugcugugacagcugccguguu

SEQ ID NO: 313725 - RNA, 21 nt, Human
cagaggccucaugcucugugc

SEQ ID NO: 313726 - RNA, 22 nt, Human
ggcaggcugcuugggucauguc

SEQ ID NO: 313727 - RNA, 18 nt, Human
acauuucuaugcuucugg

SEQ ID NO: 313728 - RNA, 18 nt, Human
ggagcugggccccacucc

SEQ ID NO: 313729 - RNA, 20 nt, Human
accucugcaucaauccuuug

SEQ ID NO: 313730 - RNA, 22 nt, Human
gagcugagccuggguggaccgc

SEQ ID NO: 313731 - RNA, 22 nt, Human
aaugcuuuuugcgaaaugugca

SEQ ID NO: 313732 - RNA, 22 nt, Human
ugggcacuguagcuggugcugg

SEQ ID NO: 313733 - RNA, 22 nt, Human
aaaguuuguugcuuacaaagaa

SEQ ID NO: 313734 - RNA, 22 nt, Human
caccagcuuugcccacugccca

SEQ ID NO: 313735 - RNA, 22 nt, Human
caggaggaaaugugacccugcu

SEQ ID NO: 313736 - RNA, 22 nt, Human
agggcugagacuaaggccagau

SEQ ID NO: 313737 - RNA, 22 nt, Human
cagagaaacucagauagcugau

SEQ ID NO: 313738 - RNA, 22 nt, Human
uaugagaaauugcugauauuug

SEQ ID NO: 313739 - RNA, 22 nt, Human
cagaauuuuucgaauguacugu

SEQ ID NO: 313740 - RNA, 22 nt, Human
uuguaugaauguauccuaauuu

SEQ ID NO: 313741 - RNA, 22 nt, Human
uaaauuauggcuggcagagcag

SEQ ID NO: 313742 - RNA, 22 nt, Human
agugauggugagugagaagcuc

SEQ ID NO: 313743 - RNA, 22 nt, Human
accaucagagcacaguccgugc

SEQ ID NO: 313744 - RNA, 22 nt, Human
ugggcagacuaaggucaaagcu

SEQ ID NO: 313745 - RNA, 22 nt, Human
uuacuuuggauggucaagaaag

SEQ ID NO: 313746 - RNA, 22 nt, Human
ugcagcugauuaaagggcagac

SEQ ID NO: 313747 - RNA, 22 nt, Human
ucuguucauguugggcuuuucc

SEQ ID NO: 313748 - RNA, 22 nt, Human
ucaggauaaaauguaauggcaa

SEQ ID NO: 313749 - RNA, 22 nt, Human
cuuugaaaacuuaaauaacagc

SEQ ID NO: 313750 - RNA, 22 nt, Human
ugaagccuuguguggccucucu

SEQ ID NO: 313751 - RNA, 22 nt, Human
agggggcccuugcaggugagcg

SEQ ID NO: 313752 - RNA, 22 nt, Human
cagaagccugccucagaugcac

SEQ ID NO: 313753 - RNA, 22 nt, Human
uccuguggcucuguggaaccuu

SEQ ID NO: 313754 - RNA, 22 nt, Human
agaagccacuggagguugagau

SEQ ID NO: 313755 - RNA, 22 nt, Human
uguauuagagcaguagaauuau

SEQ ID NO: 313756 - RNA, 22 nt, Human
cucugugcccuacugcucagcu

SEQ ID NO: 313757 - RNA, 20 nt, Human
uccuucaggcagggccuagu

SEQ ID NO: 313758 - RNA, 22 nt, Human
gggggugaggacaggagcacug

SEQ ID NO: 313759 - RNA, 22 nt, Human
ucugggaaugaauaagaccugu

SEQ ID NO: 313760 - RNA, 22 nt, Human
agaugcugcuccacaggccagg

SEQ ID NO: 313761 - RNA, 22 nt, Human
uauuccagaugaaaucauucag

SEQ ID NO: 313762 - RNA, 22 nt, Human
aggugcagcaugaguccaacgg

SEQ ID NO: 313763 - RNA, 22 nt, Human
cucugucacuucuccagcugag

SEQ ID NO: 313764 - RNA, 22 nt, Human
uguuaaucaaucaacaguauua

SEQ ID NO: 313765 - RNA, 18 nt, Human
gggcaucauucacaaagu

SEQ ID NO: 313766 - RNA, 22 nt, Human
cuggcagcucugagucccuucu

SEQ ID NO: 313767 - RNA, 22 nt, Human
acagcagcuaaaggugucuccu

SEQ ID NO: 313768 - RNA, 22 nt, Human
cagaaauguucuaaugauucag

SEQ ID NO: 313769 - RNA, 22 nt, Human
ucaugucaguuucuucuauaaa

SEQ ID NO: 313770 - RNA, 22 nt, Human
ugcacauuaguguuugagaugc

SEQ ID NO: 313771 - RNA, 22 nt, Human
aggagccaggaaaccugcucug

SEQ ID NO: 313772 - RNA, 22 nt, Human
caaugauucugcaacugugugc

SEQ ID NO: 313773 - RNA, 22 nt, Human
ccuggcugucguuuugugaaau

SEQ ID NO: 313774 - RNA, 22 nt, Human
aagaaauauugggccuuauaaa

SEQ ID NO: 313775 - RNA, 22 nt, Human
cccuggcaaaacacucucuuga

SEQ ID NO: 313776 - RNA, 22 nt, Human
gaaaugugugacaaguuucaau

SEQ ID NO: 313777 - RNA, 22 nt, Human
gaugauuuuaugucuugucauu

SEQ ID NO: 313778 - RNA, 22 nt, Human
gaggaguguauuccacaccacu

SEQ ID NO: 313779 - RNA, 22 nt, Human
cugggagcuagcucugagcuga

SEQ ID NO: 313780 - RNA, 22 nt, Human
cccagcagaccgcugugauggc

SEQ ID NO: 313781 - RNA, 22 nt, Human
cagaacauucacucauaugugg

SEQ ID NO: 313782 - RNA, 22 nt, Human
ucccuggcuguguucaggugcg

SEQ ID NO: 313783 - RNA, 22 nt, Human
uaaaaggagguugaagcuguca

SEQ ID NO: 313784 - RNA, 22 nt, Human
caaauguguuuuuucuucuaca

SEQ ID NO: 313785 - RNA, 22 nt, Human
uuuccucuucuggcaggcaggg

SEQ ID NO: 313786 - RNA, 22 nt, Human
ucccagcagcauagcucagaau

SEQ ID NO: 313787 - RNA, 22 nt, Human
aggacucaucccugcuugucag

SEQ ID NO: 313788 - RNA, 21 nt, Human
aagggagauaggaaucaggcc

SEQ ID NO: 313789 - RNA, 22 nt, Human
ggcugcagauagccagccacca

SEQ ID NO: 313790 - RNA, 19 nt, Human
uggcugggcgugccuccgu

SEQ ID NO: 313791 - RNA, 22 nt, Human
gcugaaggaggcucugguacua

SEQ ID NO: 313792 - RNA, 22 nt, Human
ccauuguaaauucuguggaagu

SEQ ID NO: 313793 - RNA, 22 nt, Human
ugugggcucccccucacucugu

SEQ ID NO: 313794 - RNA, 22 nt, Human
cagagguacaagcuaaguuggg

SEQ ID NO: 313795 - RNA, 19 nt, Human
ucaaaugccaaugucacag

SEQ ID NO: 313796 - RNA, 22 nt, Human
auccagucaaaauuaguaaggu

SEQ ID NO: 313797 - RNA, 22 nt, Human
gcaggagucacugacuuggucc

SEQ ID NO: 313798 - RNA, 22 nt, Human
gcucuuccauuucucuugaacu

SEQ ID NO: 313799 - RNA, 22 nt, Human
auaaggcagaaauagggaaagu

SEQ ID NO: 313800 - RNA, 22 nt, Human
ggccccugcggacugccuagag

SEQ ID NO: 313801 - RNA, 22 nt, Human
gcagcugcagguggucccaugc

SEQ ID NO: 313802 - RNA, 22 nt, Human
uggccucugcaauggauucacc

SEQ ID NO: 313803 - RNA, 22 nt, Human
ugagagggcccagagcacacca

SEQ ID NO: 313804 - RNA, 22 nt, Human
uaaugagaucauaucuucugag

SEQ ID NO: 313805 - RNA, 22 nt, Human
ugucagaugcgauaaacuagug

SEQ ID NO: 313806 - RNA, 22 nt, Human
gccucaguuuauacaccuguaa

SEQ ID NO: 313807 - RNA, 22 nt, Human
cccaagggagugccuggucaac

SEQ ID NO: 313808 - RNA, 22 nt, Human
ggcugagcacuuuaggcaggag

SEQ ID NO: 313809 - RNA, 22 nt, Human
cuuauguauaauguuccacaua

SEQ ID NO: 313810 - RNA, 22 nt, Human
ggcucagguuuaaagugcuuua

SEQ ID NO: 313811 - RNA, 22 nt, Human
cacugaaggcugcagcucagcc

SEQ ID NO: 313812 - RNA, 22 nt, Human
uucuucaaagaugucuguugga

SEQ ID NO: 313813 - RNA, 22 nt, Human
ucaggacagccagggugcagac

SEQ ID NO: 313814 - RNA, 22 nt, Human
cuugaaagcacuccuuugacug

SEQ ID NO: 313815 - RNA, 22 nt, Human
uuccaugaaggagacugagaag

SEQ ID NO: 313816 - RNA, 22 nt, Human
ucaggccacggcucacugagac

SEQ ID NO: 313817 - RNA, 22 nt, Human
aauauaaugcuguuuuaugcca

SEQ ID NO: 313818 - RNA, 22 nt, Human
gcaucuucacacaaagccagug

SEQ ID NO: 313819 - RNA, 22 nt, Human
gcuggaggauggacuggaagaa

SEQ ID NO: 313820 - RNA, 22 nt, Human
uuaacaauagaguuucuucagg

SEQ ID NO: 313821 - RNA, 22 nt, Human
uacacacagaggccaugggauu

SEQ ID NO: 313822 - RNA, 22 nt, Human
agccugagccccauccagcuga

SEQ ID NO: 313823 - RNA, 22 nt, Human
agggcccucuggcaggccaggc

SEQ ID NO: 313824 - RNA, 22 nt, Human
ccugucuguauugguuugcuau

SEQ ID NO: 313825 - RNA, 22 nt, Human
uauacacaaggugugcauuugu

SEQ ID NO: 313826 - RNA, 20 nt, Human
cagaccugcacccacuucga

SEQ ID NO: 313827 - RNA, 22 nt, Human
aacuucuugguccugagcuguu

SEQ ID NO: 313828 - RNA, 22 nt, Human
cuggccuuuuguuucuggagaa

SEQ ID NO: 313829 - RNA, 22 nt, Human
cauuaucucuucuauaugcuag

SEQ ID NO: 313830 - RNA, 22 nt, Human
aggcacugugcuucuuauaugu

SEQ ID NO: 313831 - RNA, 21 nt, Human
aggccucuucauggccaugau

SEQ ID NO: 313832 - RNA, 22 nt, Human
cacagcugaaguagccaugugg

SEQ ID NO: 313833 - RNA, 22 nt, Human
ugcauuauuugcaugugccugu

SEQ ID NO: 313834 - RNA, 22 nt, Human
uugauuucuauucagauguaga

SEQ ID NO: 313835 - RNA, 22 nt, Human
uagcugccuaugugauaagaga

SEQ ID NO: 313836 - RNA, 21 nt, Human
uagcacuucgcuguaauuggg

SEQ ID NO: 313837 - RNA, 22 nt, Human
cagggccaagcugcagcaucug

SEQ ID NO: 313838 - RNA, 19 nt, Human
guaagggcuaauggacuau

SEQ ID NO: 313839 - RNA, 18 nt, Human
ccugccagucuggagcag

SEQ ID NO: 313840 - RNA, 22 nt, Human
cagucccaggguugguucagcu

SEQ ID NO: 313841 - RNA, 22 nt, Human
ggcagcaggagccaucugguag

SEQ ID NO: 313842 - RNA, 22 nt, Human
ugaggggagaagcagcagccug

SEQ ID NO: 313843 - RNA, 22 nt, Human
augguacaaaauguauaaaguc

SEQ ID NO: 313844 - RNA, 22 nt, Human
gcucugcugagauaucugggag

SEQ ID NO: 313845 - RNA, 22 nt, Human
uuugcauuguuucaaaagugaa

SEQ ID NO: 313846 - RNA, 22 nt, Human
cacacagaugguaagggaggga

SEQ ID NO: 313847 - RNA, 22 nt, Human
uucauacacgaaaaugcaugca

SEQ ID NO: 313848 - RNA, 22 nt, Human
ggcugggcaaacaagacucuuc

SEQ ID NO: 313849 - RNA, 22 nt, Human
cuuccuugcugucugcuccagg

SEQ ID NO: 313850 - RNA, 22 nt, Human
gaagcagcgaaguggaagggac

SEQ ID NO: 313851 - RNA, 22 nt, Human
cagcauuuagaauuugaagugu

SEQ ID NO: 313852 - RNA, 22 nt, Human
uaguuucagcuccuucauccug

SEQ ID NO: 313853 - RNA, 22 nt, Human
cacaggcuccggccuugcagcc

SEQ ID NO: 313854 - RNA, 22 nt, Human
aucuucaaagggauguccaugg

SEQ ID NO: 313855 - RNA, 22 nt, Human
cagggccacuguagaugaggag

SEQ ID NO: 313856 - RNA, 19 nt, Human
cccucuugcacaaagcaaa

SEQ ID NO: 313857 - RNA, 22 nt, Human
ugccucugaggaagauuguguu

SEQ ID NO: 313858 - RNA, 22 nt, Human
ggcugccugcucaggugcggcg

SEQ ID NO: 313859 - RNA, 22 nt, Human
caaaguuaucaacugcaacauu

SEQ ID NO: 313860 - RNA, 22 nt, Human
guccucagggaauguggcgggu

SEQ ID NO: 313861 - RNA, 22 nt, Human
uauaucauggagauuaacauuc

SEQ ID NO: 313862 - RNA, 19 nt, Human
uugcauuguaguuggacug

SEQ ID NO: 313863 - RNA, 22 nt, Human
cccagggauuauaaaggugaaa

SEQ ID NO: 313864 - RNA, 22 nt, Human
ucagaguguggugagaugugca

SEQ ID NO: 313865 - RNA, 22 nt, Human
gagugcaucguggccauuuuaa

SEQ ID NO: 313866 - RNA, 22 nt, Human
ccaggccucuggcugcuuaguc

SEQ ID NO: 313867 - RNA, 22 nt, Human
ggucccaggaaucuguguucua

SEQ ID NO: 313868 - RNA, 22 nt, Human
cccagccuuugcuuccugguuc

SEQ ID NO: 313869 - RNA, 22 nt, Human
acuuccuggcguagcugacauu

SEQ ID NO: 313870 - RNA, 22 nt, Human
auguaacuguuauauuuuguug

SEQ ID NO: 313871 - RNA, 22 nt, Human
agcugcugagccaggcugaugu

SEQ ID NO: 313872 - RNA, 22 nt, Human
gugucacaugguuuacugcagc

SEQ ID NO: 313873 - RNA, 22 nt, Human
caguggcuguuucuggaaggca

SEQ ID NO: 313874 - RNA, 23 nt, Human
gccugggacucaggaggagcuca

SEQ ID NO: 313875 - RNA, 20 nt, Human
cuuugccuauucucugccug

SEQ ID NO: 313876 - RNA, 22 nt, Human
aaaguuuccugcuaagugcuau

SEQ ID NO: 313877 - RNA, 22 nt, Human
ccugcugggccugagcaaugag

SEQ ID NO: 313878 - RNA, 22 nt, Human
cuagaaaugcucaagagaaagu

SEQ ID NO: 313879 - RNA, 22 nt, Human
ucucagugacacucuucauaca

SEQ ID NO: 313880 - RNA, 22 nt, Human
cagcugccacaccucuuucucu

SEQ ID NO: 313881 - RNA, 21 nt, Human
uucaaaguuugccuaaagauu

SEQ ID NO: 313882 - RNA, 22 nt, Human
cauaauuucacugucguauggc

SEQ ID NO: 313883 - RNA, 22 nt, Human
ugcccuuggguaacuugcugau

SEQ ID NO: 313884 - RNA, 22 nt, Human
uuucaguuacugcuauaucauu

SEQ ID NO: 313885 - RNA, 22 nt, Human
uuagagaaauucugguaaugua

SEQ ID NO: 313886 - RNA, 22 nt, Human
uccucagucucuaaggccucag

SEQ ID NO: 313887 - RNA, 22 nt, Human
ggcagcuggguuggccagaaac

SEQ ID NO: 313888 - RNA, 22 nt, Human
cuccuuccugccccagugauaa

SEQ ID NO: 313889 - RNA, 22 nt, Human
cagccaucccagccugugguuc

SEQ ID NO: 313890 - RNA, 22 nt, Human
uccaggcuagguuuacaggaca

SEQ ID NO: 313891 - RNA, 21 nt, Human
ggagucauuagucauuuccuu

SEQ ID NO: 313892 - RNA, 17 nt, Human
agaacuguaguagcucc

SEQ ID NO: 313893 - RNA, 22 nt, Human
uuaugcuaagugcaacaagcca

SEQ ID NO: 313894 - RNA, 22 nt, Human
ucuucagauugcacugagcaag

SEQ ID NO: 313895 - RNA, 18 nt, Human
caugggugacagguggau

SEQ ID NO: 313896 - RNA, 22 nt, Human
ccaguguuuacaguugaacaaa

SEQ ID NO: 313897 - RNA, 21 nt, Human
gcaugccugcaucuuaguguu

SEQ ID NO: 313898 - RNA, 22 nt, Human
gaguggggcccacugcugggug

SEQ ID NO: 313899 - RNA, 18 nt, Human
ggaaaaggagugucuagc

SEQ ID NO: 313900 - RNA, 22 nt, Human
ccuggcugcuuucacuauggag

SEQ ID NO: 313901 - RNA, 22 nt, Human
ccuuucucuggcagcaggacag

SEQ ID NO: 313902 - RNA, 22 nt, Human
uacaguaucuucuggcaagcau

SEQ ID NO: 313903 - RNA, 22 nt, Human
aagggcagccugacucacgguc

SEQ ID NO: 313904 - RNA, 22 nt, Human
uccuguggggaaaagccuaucu

SEQ ID NO: 313905 - RNA, 22 nt, Human
ucaagagagugcugcuuggggu

SEQ ID NO: 313906 - RNA, 22 nt, Human
cccagcauccucagggagcggg

SEQ ID NO: 313907 - RNA, 22 nt, Human
cauuuucagcacccaucugaaa

SEQ ID NO: 313908 - RNA, 22 nt, Human
acaguguucacuuaacaaugga

SEQ ID NO: 313909 - RNA, 22 nt, Human
ccuguucaagggaugauugacc

SEQ ID NO: 313910 - RNA, 19 nt, Human
ggaagagaggaaaggugga

SEQ ID NO: 313911 - RNA, 23 nt, Human
auguauuuaaauuucagugauga

SEQ ID NO: 313912 - RNA, 22 nt, Human
uguuuguucccucucuuuccug

SEQ ID NO: 313913 - RNA, 22 nt, Human
aucuccaggcauuucaagagac

SEQ ID NO: 313914 - RNA, 22 nt, Human
accagagcgcucaagccuuccc

SEQ ID NO: 313915 - RNA, 22 nt, Human
gugaccaucagagaauaacaaa

SEQ ID NO: 313916 - RNA, 23 nt, Human
uggagaugccccacucccugucu

SEQ ID NO: 313917 - RNA, 22 nt, Human
caggaaugaggucguaaguguc

SEQ ID NO: 313918 - RNA, 22 nt, Human
guccuggaauccuagaacagug

SEQ ID NO: 313919 - RNA, 22 nt, Human
ggcugccacgucgaggguccaa

SEQ ID NO: 313920 - RNA, 22 nt, Human
gagcagugggaaggaacagggu

SEQ ID NO: 313921 - RNA, 22 nt, Human
gugcuuccucugccaacacucu

SEQ ID NO: 313922 - RNA, 22 nt, Human
agcugccauccgaggugucaga

SEQ ID NO: 313923 - RNA, 22 nt, Human
ucacaaauagcuauauuaagga

SEQ ID NO: 313924 - RNA, 22 nt, Human
uuugcauaggauggacauuuua

SEQ ID NO: 313925 - RNA, 22 nt, Human
cacaugcaucugucauguuugg

SEQ ID NO: 313926 - RNA, 19 nt, Human
caggaaugagguaauggcu

SEQ ID NO: 313927 - RNA, 22 nt, Human
acagugcuggcuacaacccugg

SEQ ID NO: 313928 - RNA, 22 nt, Human
ucugcugucacucauuugcuuc

SEQ ID NO: 313929 - RNA, 22 nt, Human
cuacauaaauuuaucacagacu

SEQ ID NO: 313930 - RNA, 23 nt, Human
aucaaacuggugagaaugucagu

SEQ ID NO: 313931 - RNA, 22 nt, Human
ugucaugcagguuuguuauaga

SEQ ID NO: 313932 - RNA, 22 nt, Human
ccaguguugaacaguauuugga

SEQ ID NO: 313933 - RNA, 22 nt, Human
cagaaauucccauuucagauuc

SEQ ID NO: 313934 - RNA, 22 nt, Human
cugccagcucaaagcgcagcua

SEQ ID NO: 313935 - RNA, 22 nt, Human
cauugcacucuggcuggaacgg

SEQ ID NO: 313936 - RNA, 22 nt, Human
cugucccagauguucucagcac

SEQ ID NO: 313937 - RNA, 22 nt, Human
uucucagagugaccaagucuuu

SEQ ID NO: 313938 - RNA, 22 nt, Human
acagaugaggaauuuauuuggu

SEQ ID NO: 313939 - RNA, 22 nt, Human
agaauucuccuucagggcagga

SEQ ID NO: 313940 - RNA, 22 nt, Human
uggccugccugggagcagcagg

SEQ ID NO: 313941 - RNA, 22 nt, Human
aagcccagcaucccugcaccag

SEQ ID NO: 313942 - RNA, 22 nt, Human
acauuucucuuagaguuggacu

SEQ ID NO: 313943 - RNA, 22 nt, Human
cauuagaagaacaguuauauua

SEQ ID NO: 313944 - RNA, 22 nt, Human
aacaguaaagacagaauuuauc

SEQ ID NO: 313945 - RNA, 22 nt, Human
cauauguauuucucauaauuag

SEQ ID NO: 313946 - RNA, 22 nt, Human
gccagccccuuagggcucuccc

SEQ ID NO: 313947 - RNA, 21 nt, Human
gcucuuggaaggggcucagcu

SEQ ID NO: 313948 - RNA, 22 nt, Human
cuggccuggcaggggaccucua

SEQ ID NO: 313949 - RNA, 22 nt, Human
gcuggcuguuggagguaccugc

SEQ ID NO: 313950 - RNA, 19 nt, Human
gcucagugaugccagacca

SEQ ID NO: 313951 - RNA, 23 nt, Human
uugaaggagaaagcuuucuuggu

SEQ ID NO: 313952 - RNA, 21 nt, Human
aagagcugucaggaaggcugc

SEQ ID NO: 313953 - RNA, 22 nt, Human
agcacaggaccaaggaagcugu

SEQ ID NO: 313954 - RNA, 22 nt, Human
ucauugcagugauguuguaugu

SEQ ID NO: 313955 - RNA, 22 nt, Human
caagagcugcaaauagcgugac

SEQ ID NO: 313956 - RNA, 22 nt, Human
gguaugaaaugauuccauguua

SEQ ID NO: 313957 - RNA, 22 nt, Human
cagggcuggcuguggcaaucuc

SEQ ID NO: 313958 - RNA, 22 nt, Human
gcugcagcaagcccuccagggg

SEQ ID NO: 313959 - RNA, 22 nt, Human
cacagcugccauggcugcacuu

SEQ ID NO: 313960 - RNA, 22 nt, Human
augggguggaguccgggcagcg

SEQ ID NO: 313961 - RNA, 22 nt, Human
uauagagguggaaacugagguu

SEQ ID NO: 313962 - RNA, 19 nt, Human
auuucaagagguuuauugg

SEQ ID NO: 313963 - RNA, 22 nt, Human
acagucuugcuguauggucagg

SEQ ID NO: 313964 - RNA, 22 nt, Human
gaaggcagguuuuucaaaacug

SEQ ID NO: 313965 - RNA, 22 nt, Human
ugguauaaaacuuuuuauugaa

SEQ ID NO: 313966 - RNA, 22 nt, Human
gagcagcucugggugacccagu

SEQ ID NO: 313967 - RNA, 22 nt, Human
cucauaaugugacuguauuuga

SEQ ID NO: 313968 - RNA, 22 nt, Human
ucaguuuuuacggucacaggga

SEQ ID NO: 313969 - RNA, 22 nt, Human
gcaugguggccuuaggguagcc

SEQ ID NO: 313970 - RNA, 22 nt, Human
aucagcaaucaaauugcagagu

SEQ ID NO: 313971 - RNA, 22 nt, Human
ccagccuggacugggucuugug

SEQ ID NO: 313972 - RNA, 22 nt, Human
agcaguggagcgagauguuuaa

SEQ ID NO: 313973 - RNA, 22 nt, Human
auaccuuuuagacauguaguug

SEQ ID NO: 313974 - RNA, 22 nt, Human
uucagucagugacuaagcaguu

SEQ ID NO: 313975 - RNA, 22 nt, Human
uagaauaugugguaggaucugg

SEQ ID NO: 313976 - RNA, 18 nt, Human
ggcugagguugacuagaa

SEQ ID NO: 313977 - RNA, 22 nt, Human
cugcuuugggcagcuuuguggc

SEQ ID NO: 313978 - RNA, 22 nt, Human
ccaaggagcugcaggcacuugu

SEQ ID NO: 313979 - RNA, 22 nt, Human
augucacagcucccauuccucc

SEQ ID NO: 313980 - RNA, 22 nt, Human
uagacauuucugguuauugaca

SEQ ID NO: 313981 - RNA, 22 nt, Human
gaagcagcagcuggggacaguu

SEQ ID NO: 313982 - RNA, 22 nt, Human
aggcagggcugggauuagacuc

SEQ ID NO: 313983 - RNA, 22 nt, Human
uggggguguccuggugcacaca

SEQ ID NO: 313984 - RNA, 22 nt, Human
uuugcuauuuuucugugcagcu

SEQ ID NO: 313985 - RNA, 22 nt, Human
uggcagagucaucacaucugga

SEQ ID NO: 313986 - RNA, 22 nt, Human
acauaucuuucccucuccugaa

SEQ ID NO: 313987 - RNA, 22 nt, Human
ucauauaacuggauauuuucaa

SEQ ID NO: 313988 - RNA, 22 nt, Human
cuagcaucagaugagaagcugu

SEQ ID NO: 313989 - RNA, 22 nt, Human
ccugagacaugaaccaggcucc

SEQ ID NO: 313990 - RNA, 22 nt, Human
uugcauugaaugcacauuuuua

SEQ ID NO: 313991 - RNA, 22 nt, Human
agaggagugggaagcagugcaa

SEQ ID NO: 313992 - RNA, 22 nt, Human
aggcagggucuugcuauguugc

SEQ ID NO: 313993 - RNA, 22 nt, Human
ucagaguggugguuuugccuuc

SEQ ID NO: 313994 - RNA, 22 nt, Human
gaggccugggagccuguccucc

SEQ ID NO: 313995 - RNA, 22 nt, Human
cacagcuuaugccacugauugg

SEQ ID NO: 313996 - RNA, 22 nt, Human
cccuggaagguucucuggcuca

SEQ ID NO: 313997 - RNA, 22 nt, Human
guucuucagcauuagaagucau

SEQ ID NO: 313998 - RNA, 22 nt, Human
uaaaaguuuuaguuguacauaa

SEQ ID NO: 313999 - RNA, 22 nt, Human
cacagggcagguacucucagag

SEQ ID NO: 314000 - RNA, 22 nt, Human
ucuuagaaaugaaguucuuucu

SEQ ID NO: 314001 - RNA, 22 nt, Human
gcugauuauuacaugucugugg

SEQ ID NO: 314002 - RNA, 22 nt, Human
aaguaugaaucaaagacuaucu

SEQ ID NO: 314003 - RNA, 22 nt, Human
agaggagcugggaggcccucgu

SEQ ID NO: 314004 - RNA, 22 nt, Human
aagggcugaaugaaggguugaa

SEQ ID NO: 314005 - RNA, 23 nt, Human
cuguggcugaguccuguuggagu

SEQ ID NO: 314006 - RNA, 22 nt, Human
gcagagccuugcgucaugugcc

SEQ ID NO: 314007 - RNA, 22 nt, Human
cagacacaccaggcccauucug

SEQ ID NO: 314008 - RNA, 21 nt, Human
gugcuuuuccuuaauguucuu

SEQ ID NO: 314009 - RNA, 22 nt, Human
aaaaugaggucaauauccuuuu

SEQ ID NO: 314010 - RNA, 22 nt, Human
gagcaccucaauuugcuauuug

SEQ ID NO: 314011 - RNA, 22 nt, Human
gccuggagacaaggacaaaggg

SEQ ID NO: 314012 - RNA, 22 nt, Human
ugccugggagugaccaagacuc

SEQ ID NO: 314013 - RNA, 22 nt, Human
ggcugggcucgcugauuggcug

SEQ ID NO: 314014 - RNA, 22 nt, Human
cagcucccgccaucgggaggca

SEQ ID NO: 314015 - RNA, 22 nt, Human
gguauaaaugaucagaucgcug

SEQ ID NO: 314016 - RNA, 22 nt, Human
uguuuuaaagccauugccuuuc

SEQ ID NO: 314017 - RNA, 22 nt, Human
guuucaaauagguuucagcaaa

SEQ ID NO: 314018 - RNA, 22 nt, Human
uucauucccuuauauuagcauu

SEQ ID NO: 314019 - RNA, 22 nt, Human
gccaggcuggugucacaacucu

SEQ ID NO: 314020 - RNA, 22 nt, Human
ucuggcucucauacucgccagu

SEQ ID NO: 314021 - RNA, 19 nt, Human
ucacaggcaucuccccaga

SEQ ID NO: 314022 - RNA, 22 nt, Human
ucucaguggaucucagaauuuu

SEQ ID NO: 314023 - RNA, 22 nt, Human
uggcccugcuguaucaucugcu

SEQ ID NO: 314024 - RNA, 22 nt, Human
ugucagugaguuaguugcaagu

SEQ ID NO: 314025 - RNA, 22 nt, Human
uuucacauaaauauuaugccua

SEQ ID NO: 314026 - RNA, 22 nt, Human
ucauuuauaaggaugcaauuaa

SEQ ID NO: 314027 - RNA, 22 nt, Human
gagggcaguagccucguacccu

SEQ ID NO: 314028 - RNA, 22 nt, Human
gccugagagacccauggggcaa

SEQ ID NO: 314029 - RNA, 22 nt, Human
ugcccaggaucuggcgaugcuc

SEQ ID NO: 314030 - RNA, 22 nt, Human
caguacuuauuucuauuuaggg

SEQ ID NO: 314031 - RNA, 22 nt, Human
uacuuuaaaaacugauaauuca

SEQ ID NO: 314032 - RNA, 21 nt, Human
gcucucugcaugguggcucag

SEQ ID NO: 314033 - RNA, 22 nt, Human
ucagaccauccugcuguuagug

SEQ ID NO: 314034 - RNA, 22 nt, Human
uuucaugauuaacuuagugaau

SEQ ID NO: 314035 - RNA, 22 nt, Human
ucuuacauauagcaugaguaca

SEQ ID NO: 314036 - RNA, 22 nt, Human
uggcagggccuaccccaauauc

SEQ ID NO: 314037 - RNA, 22 nt, Human
uggaggugagugugguacagca

SEQ ID NO: 314038 - RNA, 22 nt, Human
uagacacaagagaaggguauaa

SEQ ID NO: 314039 - RNA, 22 nt, Human
gucccagggagguucagggcuu

SEQ ID NO: 314040 - RNA, 22 nt, Human
cuguggcuaugguguacauacu

SEQ ID NO: 314041 - RNA, 20 nt, Human
agagccuugaggaagaugau

SEQ ID NO: 314042 - RNA, 22 nt, Human
ugugaaaagcaggcuacuuucu

SEQ ID NO: 314043 - RNA, 22 nt, Human
cccugaggggaguggugaggug

SEQ ID NO: 314044 - RNA, 22 nt, Human
uuucaguggguuuauuucaugu

SEQ ID NO: 314045 - RNA, 22 nt, Human
gcagcuuggauuucuguaguuu

SEQ ID NO: 314046 - RNA, 19 nt, Human
gugaggauacugcucagag

SEQ ID NO: 314047 - RNA, 22 nt, Human
uucuagauugccuguaaguaaa

SEQ ID NO: 314048 - RNA, 22 nt, Human
aagggcagaaagggacgcuuug

SEQ ID NO: 314049 - RNA, 22 nt, Human
gucacaggccuggaugaggggc

SEQ ID NO: 314050 - RNA, 22 nt, Human
gaggcccaguccugcaagcacg

SEQ ID NO: 314051 - RNA, 22 nt, Human
cccagacugcagagcgggcaga

SEQ ID NO: 314052 - RNA, 22 nt, Human
uuugcauaagucauguccagug

SEQ ID NO: 314053 - RNA, 22 nt, Human
cccagcaggucggugcugccug

SEQ ID NO: 314054 - RNA, 17 nt, Human
ucaugcccaacuauuac

SEQ ID NO: 314055 - RNA, 22 nt, Human
ccagcuccaaguuugggcauca

SEQ ID NO: 314056 - RNA, 22 nt, Human
gccuuugccugcgacguggcug

SEQ ID NO: 314057 - RNA, 22 nt, Human
gcuggagccaagcugcucuugg

SEQ ID NO: 314058 - RNA, 22 nt, Human
agacagaacagaauaauuguug

SEQ ID NO: 314059 - RNA, 22 nt, Human
cagcauggggcuuggagucagc

SEQ ID NO: 314060 - RNA, 22 nt, Human
ugucucaucucuuaaccccacu

SEQ ID NO: 314061 - RNA, 22 nt, Human
cagcugccuucugcgggaaguc

SEQ ID NO: 314062 - RNA, 22 nt, Human
gaaaagcuaggccaguucagcu

SEQ ID NO: 314063 - RNA, 22 nt, Human
aaaggucagcugccaucguucu

SEQ ID NO: 314064 - RNA, 22 nt, Human
gcagggugugucucauacaguu

SEQ ID NO: 314065 - RNA, 22 nt, Human
ugcugggcuaggguggagcucu

SEQ ID NO: 314066 - RNA, 18 nt, Human
ucuggaacaacuucaugu

SEQ ID NO: 314067 - RNA, 22 nt, Human
accugaggcuguuagucuaggu

SEQ ID NO: 314068 - RNA, 22 nt, Human
gagccuggagcuggaacgaagc

SEQ ID NO: 314069 - RNA, 19 nt, Human
acucaagucuaaugaaauc

SEQ ID NO: 314070 - RNA, 22 nt, Human
uaaaauguagcuucuaggcugg

SEQ ID NO: 314071 - RNA, 23 nt, Human
uccugagaugagacagugcugcc

SEQ ID NO: 314072 - RNA, 22 nt, Human
ccaggaggcagagguuacagug

SEQ ID NO: 314073 - RNA, 22 nt, Human
agggggugggaagucuagaauc

SEQ ID NO: 314074 - RNA, 23 nt, Human
ucccagggaaggugagcgaggcu

SEQ ID NO: 314075 - RNA, 22 nt, Human
uggggccugagguggagcugca

SEQ ID NO: 314076 - RNA, 22 nt, Human
auaguuugugaaacacagcagu

SEQ ID NO: 314077 - RNA, 22 nt, Human
ucacaugcucaccuaagccaca

SEQ ID NO: 314078 - RNA, 22 nt, Human
gaaggaagacugguuuaaaugu

SEQ ID NO: 314079 - RNA, 22 nt, Human
ugucugugaccucuuuggagcc

SEQ ID NO: 314080 - RNA, 22 nt, Human
auaaggcagucccuuaacaagg

SEQ ID NO: 314081 - RNA, 22 nt, Human
cuggccugagaaugcuacccuu

SEQ ID NO: 314082 - RNA, 22 nt, Human
gcuccuggucuggagcuucaag

SEQ ID NO: 314083 - RNA, 22 nt, Human
ucacuuauugcucaucucaugc

SEQ ID NO: 314084 - RNA, 22 nt, Human
cacacaggagagugcuggaggu

SEQ ID NO: 314085 - RNA, 22 nt, Human
auugcuguacacuucuagaucu

SEQ ID NO: 314086 - RNA, 22 nt, Human
acaaauauuuacugaauccacu

SEQ ID NO: 314087 - RNA, 22 nt, Human
cccagguggcagaagcugcagu

SEQ ID NO: 314088 - RNA, 22 nt, Human
ggcuggaaaagacaaagcuauu

SEQ ID NO: 314089 - RNA, 22 nt, Human
cccuggggcugagggauggccg

SEQ ID NO: 314090 - RNA, 22 nt, Human
ccuguucauuuuuugacucugc

SEQ ID NO: 314091 - RNA, 22 nt, Human
agauauauuuaagguaauaagu

SEQ ID NO: 314092 - RNA, 17 nt, Human
gggcagggacuccuggg

SEQ ID NO: 314093 - RNA, 22 nt, Human
gggcagcugccaagugcaucgc

SEQ ID NO: 314094 - RNA, 23 nt, Human
aaguucuuuuagaugucuucgug

SEQ ID NO: 314095 - RNA, 22 nt, Human
cuggcucaggaaaguugcugcu

SEQ ID NO: 314096 - RNA, 22 nt, Human
aggccagguggucaugcuugcu

SEQ ID NO: 314097 - RNA, 22 nt, Human
ugagcuguagcagaugcuguug

SEQ ID NO: 314098 - RNA, 22 nt, Human
gcaggcuggaggcuguucuggg

SEQ ID NO: 314099 - RNA, 22 nt, Human
cagaaguaagauuacugugaga

SEQ ID NO: 314100 - RNA, 22 nt, Human
uuccagaagccuccauauuacu

SEQ ID NO: 314101 - RNA, 22 nt, Human
gcaccugauugauuucacugcu

SEQ ID NO: 314102 - RNA, 19 nt, Human
gcauaaaaugucaaugugu

SEQ ID NO: 314103 - RNA, 22 nt, Human
uuugaaagcaccauuugaguag

SEQ ID NO: 314104 - RNA, 22 nt, Human
aguuugaaaguauugacagaag

SEQ ID NO: 314105 - RNA, 22 nt, Human
uugcacagaugagggugaugcu

SEQ ID NO: 314106 - RNA, 22 nt, Human
gccagguggcugagugacugag

SEQ ID NO: 314107 - RNA, 22 nt, Human
cauuucuguucucuuccuguac

SEQ ID NO: 314108 - RNA, 22 nt, Human
uccagugguacauggagacacu

SEQ ID NO: 314109 - RNA, 22 nt, Human
gccugucaauuuuguguacaau

SEQ ID NO: 314110 - RNA, 22 nt, Human
agucucuuuguggacucugccu

SEQ ID NO: 314111 - RNA, 21 nt, Human
acagccugucaucucaugguc

SEQ ID NO: 314112 - RNA, 22 nt, Human
agagggaucacccuguuucugg

SEQ ID NO: 314113 - RNA, 22 nt, Human
cugaggaagacagcagcugugu

SEQ ID NO: 314114 - RNA, 22 nt, Human
gcugcugguccucagagcucau

SEQ ID NO: 314115 - RNA, 22 nt, Human
uacaaaguagaaauucaguaaa

SEQ ID NO: 314116 - RNA, 22 nt, Human
gcuggccugaccagccacaggc

SEQ ID NO: 314117 - RNA, 22 nt, Human
gagccugggacugggggucaug

SEQ ID NO: 314118 - RNA, 22 nt, Human
gggcagcagcaggaggucucug

SEQ ID NO: 314119 - RNA, 22 nt, Human
gcaaggagacuguagggccaag

SEQ ID NO: 314120 - RNA, 22 nt, Human
aauguaugacaguucuaguggu

SEQ ID NO: 314121 - RNA, 20 nt, Human
accauaauguuaauuacaaa

SEQ ID NO: 314122 - RNA, 22 nt, Human
caggccugauacacugaacucu

SEQ ID NO: 314123 - RNA, 22 nt, Human
aagacuguacauuuuccagucu

SEQ ID NO: 314124 - RNA, 22 nt, Human
gauuucuugaccccugucucag

SEQ ID NO: 314125 - RNA, 22 nt, Human
gucuucuuuaaccuacuaaagc

SEQ ID NO: 314126 - RNA, 22 nt, Human
uugaagcagagaaauacuugaa

SEQ ID NO: 314127 - RNA, 22 nt, Human
ugaguucuaguggcugcagauu

SEQ ID NO: 314128 - RNA, 22 nt, Human
uagggcagccacccaggcugcu

SEQ ID NO: 314129 - RNA, 22 nt, Human
agcugcaguaaagcucuccagg

SEQ ID NO: 314130 - RNA, 22 nt, Human
agucccagcucagaaccacuag

SEQ ID NO: 314131 - RNA, 22 nt, Human
agcugggagcagagccacagcc

SEQ ID NO: 314132 - RNA, 22 nt, Human
acucugcuuauugcugcaggca

SEQ ID NO: 314133 - RNA, 22 nt, Human
aggggccuggacauggacgcgc

SEQ ID NO: 314134 - RNA, 22 nt, Human
uggcccaggaggccagagggca

SEQ ID NO: 314135 - RNA, 22 nt, Human
gugaaaauaaggcugguucuug

SEQ ID NO: 314136 - RNA, 22 nt, Human
cuggcuuccucaggagcagugg

SEQ ID NO: 314137 - RNA, 22 nt, Human
accagccugucugagucguggg

SEQ ID NO: 314138 - RNA, 22 nt, Human
ucaugaacaucucaaauaacca

SEQ ID NO: 314139 - RNA, 22 nt, Human
aggccuggguguucaccagaag

SEQ ID NO: 314140 - RNA, 22 nt, Human
aaguaaaauucaaucuucacug

SEQ ID NO: 314141 - RNA, 22 nt, Human
acauauauuacuaguaaagaca

SEQ ID NO: 314142 - RNA, 22 nt, Human
cucuuccuacagucugcuaugc

SEQ ID NO: 314143 - RNA, 21 nt, Human
agcagaggggacauguuugau

SEQ ID NO: 314144 - RNA, 22 nt, Human
aauucuauguucuugaguaaga

SEQ ID NO: 314145 - RNA, 22 nt, Human
guuaacacaggacucucugccu

SEQ ID NO: 314146 - RNA, 22 nt, Human
acucugggccccagguggagcu

SEQ ID NO: 314147 - RNA, 22 nt, Human
auucuucaguauguguggauug

SEQ ID NO: 314148 - RNA, 22 nt, Human
ugugugaaggaauauauacuca

SEQ ID NO: 314149 - RNA, 22 nt, Human
cagggcagggccacacccccug

SEQ ID NO: 314150 - RNA, 22 nt, Human
gccaggugcauggcugagucuc

SEQ ID NO: 314151 - RNA, 22 nt, Human
gugucauguagaaauugaugaa

SEQ ID NO: 314152 - RNA, 20 nt, Human
caggaugauuggacacgaug

SEQ ID NO: 314153 - RNA, 22 nt, Human
agggcuggaggguacuaguuua

SEQ ID NO: 314154 - RNA, 20 nt, Human
uccuugaaagugggguauau

SEQ ID NO: 314155 - RNA, 22 nt, Human
caugagaaguggccuucaaaaa

SEQ ID NO: 314156 - RNA, 22 nt, Human
ucuggagcgaggucccugucug

SEQ ID NO: 314157 - RNA, 22 nt, Human
auauuuaaacaggguaccaaua

SEQ ID NO: 314158 - RNA, 22 nt, Human
cagaaauguuuauauguggugu

SEQ ID NO: 314159 - RNA, 21 nt, Human
gaauaguucuguggcagcagu

SEQ ID NO: 314160 - RNA, 20 nt, Human
gcugaggucauuaugccuca

SEQ ID NO: 314161 - RNA, 22 nt, Human
aaguuguauauaccgcuuuaag

SEQ ID NO: 314162 - RNA, 22 nt, Human
cucaggccagguuucucccaca

SEQ ID NO: 314163 - RNA, 22 nt, Human
agucauaauuauaaacaucagu

SEQ ID NO: 314164 - RNA, 22 nt, Human
auccaaagcccuaaguuaacug

SEQ ID NO: 314165 - RNA, 19 nt, Human
uggccagguacugucugcu

SEQ ID NO: 314166 - RNA, 22 nt, Human
ccaggagucaauaaaggaagcu

SEQ ID NO: 314167 - RNA, 22 nt, Human
caaaugcauagaaagaugaaac

SEQ ID NO: 314168 - RNA, 22 nt, Human
ucugucacccagagugcagugg

SEQ ID NO: 314169 - RNA, 22 nt, Human
aaugaaauguagcuuauccaua

SEQ ID NO: 314170 - RNA, 22 nt, Human
ugcacacaguucucaggaaaga

SEQ ID NO: 314171 - RNA, 22 nt, Human
uggaagggagugacagucagag

SEQ ID NO: 314172 - RNA, 20 nt, Human
aagauucauuguaauuaggg

SEQ ID NO: 314173 - RNA, 22 nt, Human
uggcucuggcgugaagcccaga

SEQ ID NO: 314174 - RNA, 22 nt, Human
agauuuccugcacugccuuuga

SEQ ID NO: 314175 - RNA, 22 nt, Human
uccuucagcuuauuucuuagga

SEQ ID NO: 314176 - RNA, 22 nt, Human
gcacugaaugccaaaguguagg

SEQ ID NO: 314177 - RNA, 22 nt, Human
ggcucugcagugacuugagggg

SEQ ID NO: 314178 - RNA, 21 nt, Human
ugggaugggucugggaccagc

SEQ ID NO: 314179 - RNA, 21 nt, Human
gccauuguuuucuaccuggag

SEQ ID NO: 314180 - RNA, 23 nt, Human
auguaucucauccaaggaagcuc

SEQ ID NO: 314181 - RNA, 22 nt, Human
uggcuucagacuucugcuacgu

SEQ ID NO: 314182 - RNA, 22 nt, Human
auuguggugucaguuauaggca

SEQ ID NO: 314183 - RNA, 18 nt, Human
ggccugaggauuucagca

SEQ ID NO: 314184 - RNA, 22 nt, Human
aucuacagugcacaggacagcc

SEQ ID NO: 314185 - RNA, 22 nt, Human
uguacaugugucuguauaucuu

SEQ ID NO: 314186 - RNA, 19 nt, Human
ccuuccuccccagggccau

SEQ ID NO: 314187 - RNA, 22 nt, Human
cuggggggcuacugacagagga

SEQ ID NO: 314188 - RNA, 22 nt, Human
gagcagcuggacaggccucccu

SEQ ID NO: 314189 - RNA, 22 nt, Human
aaguaaaagcuuuaccaugcgc

SEQ ID NO: 314190 - RNA, 22 nt, Human
cucagaguccccacaucugggu

SEQ ID NO: 314191 - RNA, 22 nt, Human
cagugcuggagauggguggaac

SEQ ID NO: 314192 - RNA, 19 nt, Human
cagagcagugguuccugaa

SEQ ID NO: 314193 - RNA, 18 nt, Human
uccagcgugcuccagggc

SEQ ID NO: 314194 - RNA, 22 nt, Human
auuuucagagacaucuggacuu

SEQ ID NO: 314195 - RNA, 22 nt, Human
aggccagcacgacagccgcagg

SEQ ID NO: 314196 - RNA, 22 nt, Human
uugaaaguuuauggagucugca

SEQ ID NO: 314197 - RNA, 22 nt, Human
agucucuuccuucaaggcuggu

SEQ ID NO: 314198 - RNA, 20 nt, Human
gaguuccccauuucuccugg

SEQ ID NO: 314199 - RNA, 22 nt, Human
aagcugccaaugguaagcugcu

SEQ ID NO: 314200 - RNA, 22 nt, Human
caaaaugugagucccaccucaa

SEQ ID NO: 314201 - RNA, 22 nt, Human
ucagugcucaggggagccgagg

SEQ ID NO: 314202 - RNA, 22 nt, Human
accaaggagaaggugcaagcuu

SEQ ID NO: 314203 - RNA, 22 nt, Human
ggcucuggugugaagcagccuc

SEQ ID NO: 314204 - RNA, 22 nt, Human
ucucagaguuuuuuuccaggac

SEQ ID NO: 314205 - RNA, 22 nt, Human
acacagggucuagaguuaggcc

SEQ ID NO: 314206 - RNA, 22 nt, Human
ugguaucagagccaucuguauu

SEQ ID NO: 314207 - RNA, 22 nt, Human
cugcccuggucccauggcugau

SEQ ID NO: 314208 - RNA, 22 nt, Human
ggcaguggaggacccugugucu

SEQ ID NO: 314209 - RNA, 22 nt, Human
cuccagaagacccauccucaug

SEQ ID NO: 314210 - RNA, 22 nt, Human
ucugaaagaagggcagucuuuu

SEQ ID NO: 314211 - RNA, 22 nt, Human
uucuagaugauaaaccagcagc

SEQ ID NO: 314212 - RNA, 22 nt, Human
auguagcaugaggcacugugcc

SEQ ID NO: 314213 - RNA, 22 nt, Human
cugccucugguuuuggucccug

SEQ ID NO: 314214 - RNA, 22 nt, Human
cagcagcuacuuggagcagcag

SEQ ID NO: 314215 - RNA, 22 nt, Human
acagagauggcacagagaaggu

SEQ ID NO: 314216 - RNA, 22 nt, Human
cagagccaggccugcccucuuu

SEQ ID NO: 314217 - RNA, 22 nt, Human
cacagcuucuccuugauaucgc

SEQ ID NO: 314218 - RNA, 22 nt, Human
cccuggagucagguuggccugg

SEQ ID NO: 314219 - RNA, 22 nt, Human
cauggcugcgagaagagugggu

SEQ ID NO: 314220 - RNA, 22 nt, Human
uucaacuaauguuuauuuuaug

SEQ ID NO: 314221 - RNA, 22 nt, Human
gcagaagcccggucagcgcacg

SEQ ID NO: 314222 - RNA, 22 nt, Human
ggagaaaauugaugaaguuggc

SEQ ID NO: 314223 - RNA, 22 nt, Human
uccuugaaugaagagaggugac

SEQ ID NO: 314224 - RNA, 22 nt, Human
uggcagagaauaaaucuugacu

SEQ ID NO: 314225 - RNA, 23 nt, Human
aggcacugaaugugucagugagu

SEQ ID NO: 314226 - RNA, 22 nt, Human
uggagcugguaaacagugacau

SEQ ID NO: 314227 - RNA, 22 nt, Human
gcugccuguccugaggaguccg

SEQ ID NO: 314228 - RNA, 22 nt, Human
agccagagagccccagguucua

SEQ ID NO: 314229 - RNA, 22 nt, Human
uggcagucuggguuggcaguua

SEQ ID NO: 314230 - RNA, 22 nt, Human
accucugcucaagaccccuccg

SEQ ID NO: 314231 - RNA, 22 nt, Human
aguguccccuacagaggcauuc

SEQ ID NO: 314232 - RNA, 23 nt, Human
uugauacagaagaaucaguuugu

SEQ ID NO: 314233 - RNA, 22 nt, Human
cuggugggaagauggaaaacau

SEQ ID NO: 314234 - RNA, 22 nt, Human
uuagcuaaacuguaacuagaau

SEQ ID NO: 314235 - RNA, 22 nt, Human
cuggcagcagcuucuggaucga

SEQ ID NO: 314236 - RNA, 22 nt, Human
cacaggcuuccaguccccagcu

SEQ ID NO: 314237 - RNA, 22 nt, Human
ggcuccagggaguggagagaag

SEQ ID NO: 314238 - RNA, 22 nt, Human
auaagagcuagucuuuuccuug

SEQ ID NO: 314239 - RNA, 22 nt, Human
gccuuggccuuccuaggccuga

SEQ ID NO: 314240 - RNA, 22 nt, Human
ugacagaaagaauaugucaauc

SEQ ID NO: 314241 - RNA, 21 nt, Human
ucuggagcccuaagcugagaa

SEQ ID NO: 314242 - RNA, 22 nt, Human
gcagagcuccccaagacaccaa

SEQ ID NO: 314243 - RNA, 22 nt, Human
gacagguggggaaacuaaggua

SEQ ID NO: 314244 - RNA, 22 nt, Human
ugacagcauaacacuggucuug

SEQ ID NO: 314245 - RNA, 22 nt, Human
uuuaguaaguucacugcaaagc

SEQ ID NO: 314246 - RNA, 22 nt, Human
ugguccaggguguaguacagag

SEQ ID NO: 314247 - RNA, 22 nt, Human
uagcugccagaccauucuuacu

SEQ ID NO: 314248 - RNA, 22 nt, Human
gcagggugccgacuucagggau

SEQ ID NO: 314249 - RNA, 21 nt, Human
ggauggauagggaagagauuu

SEQ ID NO: 314250 - RNA, 22 nt, Human
uguacaaugccagggaacacca

SEQ ID NO: 314251 - RNA, 22 nt, Human
cagguggggcgcccucaggcag

SEQ ID NO: 314252 - RNA, 22 nt, Human
caguccugaauacuggacggug

SEQ ID NO: 314253 - RNA, 22 nt, Human
uucauucuugucuuuguauagu

SEQ ID NO: 314254 - RNA, 22 nt, Human
uucauagugauuguucagauag

SEQ ID NO: 314255 - RNA, 22 nt, Human
gucaaacaaauuaacauaucca

SEQ ID NO: 314256 - RNA, 22 nt, Human
ggcaucccuagaauagccaggu

SEQ ID NO: 314257 - RNA, 22 nt, Human
acaguaaugauucugagucucu

SEQ ID NO: 314258 - RNA, 20 nt, Human
ccagcauguacacaugugga

SEQ ID NO: 314259 - RNA, 22 nt, Human
ggagcuguaacgagccauugcu

SEQ ID NO: 314260 - RNA, 22 nt, Human
gcagggcagcuuagucccuguc

SEQ ID NO: 314261 - RNA, 22 nt, Human
aaggccaugcacauccuaggca

SEQ ID NO: 314262 - RNA, 22 nt, Human
agggaggagaauggacuccuuc

SEQ ID NO: 314263 - RNA, 23 nt, Human
aaauaugucugagggcaaagaau

SEQ ID NO: 314264 - RNA, 22 nt, Human
uuauguacaauguuaauguaaa

SEQ ID NO: 314265 - RNA, 22 nt, Human
caccaggcugaaccagagggga

SEQ ID NO: 314266 - RNA, 22 nt, Human
ucagcucucacagaucucaacc

SEQ ID NO: 314267 - RNA, 22 nt, Human
auccuugagccaaugacugauu

SEQ ID NO: 314268 - RNA, 23 nt, Human
ucuuuacauacugaugaguucuc

SEQ ID NO: 314269 - RNA, 22 nt, Human
gagucuuugguaaagucugcug

SEQ ID NO: 314270 - RNA, 22 nt, Human
auucacaaaaugauauagauac

SEQ ID NO: 314271 - RNA, 22 nt, Human
agggaaggaaaagcugucgcuu

SEQ ID NO: 314272 - RNA, 22 nt, Human
gcaguguuaaugcgaguguuca

SEQ ID NO: 314273 - RNA, 22 nt, Human
cgggcagauugggaagguucau

SEQ ID NO: 314274 - RNA, 22 nt, Human
ucauuuguaccauuuuuuaaga

SEQ ID NO: 314275 - RNA, 22 nt, Human
uuuauuauguacaggcacuaua

SEQ ID NO: 314276 - RNA, 22 nt, Human
uucucagaauugacugggagca

SEQ ID NO: 314277 - RNA, 22 nt, Human
uccuuucaccaaaaaguguugu

SEQ ID NO: 314278 - RNA, 22 nt, Human
gccagagcaugcacugccugca

SEQ ID NO: 314279 - RNA, 19 nt, Human
guugaaaguaggugagggu

SEQ ID NO: 314280 - RNA, 20 nt, Human
ugcagagcugacauuaccug

SEQ ID NO: 314281 - RNA, 22 nt, Human
gcauuuguguucuuccuagagc

SEQ ID NO: 314282 - RNA, 22 nt, Human
cauuggaaugcauuugaagaga

SEQ ID NO: 314283 - RNA, 22 nt, Human
gcuguucagggcacucaugggc

SEQ ID NO: 314284 - RNA, 18 nt, Human
agggaucaucacugcagc

SEQ ID NO: 314285 - RNA, 22 nt, Human
gugccagggggcacugaacaga

SEQ ID NO: 314286 - RNA, 22 nt, Human
aauguugaggauaucagaaaau

SEQ ID NO: 314287 - RNA, 22 nt, Human
gcucagagaugucugcugccuu

SEQ ID NO: 314288 - RNA, 22 nt, Human
uccuugaagaaugauucuugga

SEQ ID NO: 314289 - RNA, 22 nt, Human
aguaugaagaauacauagauga

SEQ ID NO: 314290 - RNA, 22 nt, Human
aaaacacugcaaagcugauugg

SEQ ID NO: 314291 - RNA, 22 nt, Human
guucuucaucuuaaccaucugu

SEQ ID NO: 314292 - RNA, 22 nt, Human
ccugaagagcacucuagaguug

SEQ ID NO: 314293 - RNA, 22 nt, Human
gccccuuccaucaugugaggac

SEQ ID NO: 314294 - RNA, 22 nt, Human
agguaaagacugcaaggagaau

SEQ ID NO: 314295 - RNA, 22 nt, Human
ggcaggaggugaguggcgggug

SEQ ID NO: 314296 - RNA, 22 nt, Human
cauugcuguuaauugucucuag

SEQ ID NO: 314297 - RNA, 22 nt, Human
ggcaccugcucaucuggacuca

SEQ ID NO: 314298 - RNA, 22 nt, Human
uggcagggccugcucaucaucc

SEQ ID NO: 314299 - RNA, 22 nt, Human
uaacacauuaguucuccuagau

SEQ ID NO: 314300 - RNA, 22 nt, Human
ccaguccagugccaugcauggc

SEQ ID NO: 314301 - RNA, 22 nt, Human
uauuucuaagagauaucuguac

SEQ ID NO: 314302 - RNA, 22 nt, Human
cuggcucaauaaauauuagcug

SEQ ID NO: 314303 - RNA, 22 nt, Human
ucugcuguucauucuuuuagcu

SEQ ID NO: 314304 - RNA, 21 nt, Human
gccucugcugucuuauuguga

SEQ ID NO: 314305 - RNA, 22 nt, Human
uucugucaaaugccaguagaga

SEQ ID NO: 314306 - RNA, 22 nt, Human
uauguaaaaauucaucaggcug

SEQ ID NO: 314307 - RNA, 22 nt, Human
ugcucacagcccagaacauaau

SEQ ID NO: 314308 - RNA, 22 nt, Human
agacaaaggauuaaugaugaug

SEQ ID NO: 314309 - RNA, 20 nt, Human
agcccuguuuccuggagaga

SEQ ID NO: 314310 - RNA, 22 nt, Human
gcuggccuccugcuagauggaa

SEQ ID NO: 314311 - RNA, 22 nt, Human
uccugccuuagagcaaggaaaa

SEQ ID NO: 314312 - RNA, 22 nt, Human
auagucuuagaucagauaaagu

SEQ ID NO: 314313 - RNA, 22 nt, Human
ccccuuccgucucuugaguguc

SEQ ID NO: 314314 - RNA, 22 nt, Human
caggcagcugacugucagauau

SEQ ID NO: 314315 - RNA, 22 nt, Human
ucccagccuuccuuguggugaa

SEQ ID NO: 314316 - RNA, 22 nt, Human
aagcagaucugauagggcccug

SEQ ID NO: 314317 - RNA, 23 nt, Human
gccagccuugcucuccugcagcc

SEQ ID NO: 314318 - RNA, 22 nt, Human
ccaggagcuggagggugcagug

SEQ ID NO: 314319 - RNA, 22 nt, Human
uuuggaauuggaaagugcugug

SEQ ID NO: 314320 - RNA, 22 nt, Human
uuugcacuagcauuuguccaug

SEQ ID NO: 314321 - RNA, 22 nt, Human
aaugucauugguaaagauuagg

SEQ ID NO: 314322 - RNA, 22 nt, Human
agcuuuauucaugauuucaggg

SEQ ID NO: 314323 - RNA, 22 nt, Human
gaucuguuucauucacagucug

SEQ ID NO: 314324 - RNA, 22 nt, Human
ucucaguguggugcuuaggaua

SEQ ID NO: 314325 - RNA, 22 nt, Human
gcucugggauuaccagccuuag

SEQ ID NO: 314326 - RNA, 22 nt, Human
aggucauuguuaagucaccaua

SEQ ID NO: 314327 - RNA, 22 nt, Human
cccuuagcucaauuucuugccc

SEQ ID NO: 314328 - RNA, 22 nt, Human
aguggacucuucccagugcuug

SEQ ID NO: 314329 - RNA, 22 nt, Human
uuuuuaagcuccuuugauguca

SEQ ID NO: 314330 - RNA, 22 nt, Human
ucuuuccuguaacugcuguuca

SEQ ID NO: 314331 - RNA, 19 nt, Human
uacauuuguguacacuugu

SEQ ID NO: 314332 - RNA, 22 nt, Human
ucuccucaccaccagcagcaga

SEQ ID NO: 314333 - RNA, 22 nt, Human
uggcagucggacuucuaucuca

SEQ ID NO: 314334 - RNA, 22 nt, Human
ccucacucuuguccuggcaggu

SEQ ID NO: 314335 - RNA, 22 nt, Human
agcaauaugacauugcuacauc

SEQ ID NO: 314336 - RNA, 22 nt, Human
ccugggagcuguggaaaggcug

SEQ ID NO: 314337 - RNA, 22 nt, Human
uguaggaaaaacaaugaucugc

SEQ ID NO: 314338 - RNA, 22 nt, Human
gggcagagagcuggaacuccuu

SEQ ID NO: 314339 - RNA, 22 nt, Human
gcucugaggcugugaggugcug

SEQ ID NO: 314340 - RNA, 22 nt, Human
agcagcuucuuucacuccugga

SEQ ID NO: 314341 - RNA, 22 nt, Human
auuccuugcacaucagauaguu

SEQ ID NO: 314342 - RNA, 22 nt, Human
acugccuuauaugcugugugug

SEQ ID NO: 314343 - RNA, 21 nt, Human
uggaaagauucaaagaccagg

SEQ ID NO: 314344 - RNA, 22 nt, Human
uacuuucuagcucuccccaguu

SEQ ID NO: 314345 - RNA, 22 nt, Human
cagucacacaaguggacuuggg

SEQ ID NO: 314346 - RNA, 22 nt, Human
gcugccacauuuucaggacuaa

SEQ ID NO: 314347 - RNA, 22 nt, Human
agaggccuaaccaagauguccu

SEQ ID NO: 314348 - RNA, 20 nt, Human
cugcugugugugccucagcc

SEQ ID NO: 314349 - RNA, 22 nt, Human
agagcuggaaucagaccucagg

SEQ ID NO: 314350 - RNA, 22 nt, Human
aaaaugagccaugaaccaacca

SEQ ID NO: 314351 - RNA, 22 nt, Human
accaaggagccacauacaaccu

SEQ ID NO: 314352 - RNA, 22 nt, Human
cagagccaggucuaggagucuc

SEQ ID NO: 314353 - RNA, 22 nt, Human
uucucagagcucacuguaguaa

SEQ ID NO: 314354 - RNA, 20 nt, Human
ggcugcugugggcagagagg

SEQ ID NO: 314355 - RNA, 22 nt, Human
cagaagcaaaugccuugcugag

SEQ ID NO: 314356 - RNA, 22 nt, Human
ccagcagcagcguccaaggaga

SEQ ID NO: 314357 - RNA, 19 nt, Human
aggucauugauagugcagg

SEQ ID NO: 314358 - RNA, 22 nt, Human
gucccugggaugcccuucuggg

SEQ ID NO: 314359 - RNA, 22 nt, Human
ugaaagguagcuggccucauag

SEQ ID NO: 314360 - RNA, 22 nt, Human
auuuccagugcacugaauagaa

SEQ ID NO: 314361 - RNA, 22 nt, Human
cucaggaugcaggucacaggac

SEQ ID NO: 314362 - RNA, 22 nt, Human
ccagcccucgguagucccauag

SEQ ID NO: 314363 - RNA, 23 nt, Human
ugugaaauuugaggucagugcuu

SEQ ID NO: 314364 - RNA, 22 nt, Human
aacucaguguguuucuuaguau

SEQ ID NO: 314365 - RNA, 22 nt, Human
aagauuauuuaagacaggaacc

SEQ ID NO: 314366 - RNA, 22 nt, Human
gcagcccaaaaaagagguagau

SEQ ID NO: 314367 - RNA, 22 nt, Human
gccuucugcgcucgugucuccg

SEQ ID NO: 314368 - RNA, 22 nt, Human
gcugagaggcacuaucuccgga

SEQ ID NO: 314369 - RNA, 22 nt, Human
caggcugccgugaagcaggccu

SEQ ID NO: 314370 - RNA, 22 nt, Human
agguggaacguucaggugcuag

SEQ ID NO: 314371 - RNA, 22 nt, Human
agugugcugcuuaaacaguugu

SEQ ID NO: 314372 - RNA, 22 nt, Human
gaggagaaugcgcaccacauau

SEQ ID NO: 314373 - RNA, 22 nt, Human
aaaagguuuugaguacaaauau

SEQ ID NO: 314374 - RNA, 20 nt, Human
auguaaaauuauaaggcuga

SEQ ID NO: 314375 - RNA, 22 nt, Human
agaaaucugacugcugugcaca

SEQ ID NO: 314376 - RNA, 17 nt, Human
agugaaauuuacauugc

SEQ ID NO: 314377 - RNA, 19 nt, Human
uuggaaggagccagagugg

SEQ ID NO: 314378 - RNA, 22 nt, Human
uggcucaguuugggggauugaa

SEQ ID NO: 314379 - RNA, 22 nt, Human
cuggggcugcgguggaggagcc

SEQ ID NO: 314380 - RNA, 21 nt, Human
cucaggauggcggccuggugg

SEQ ID NO: 314381 - RNA, 22 nt, Human
ccucccacuucuugcugagguc

SEQ ID NO: 314382 - RNA, 22 nt, Human
ucaggcugguggucagauggcu

SEQ ID NO: 314383 - RNA, 22 nt, Human
ccugagggaaggaugcuaccca

SEQ ID NO: 314384 - RNA, 22 nt, Human
ucucucagucagaugcuaaaga

SEQ ID NO: 314385 - RNA, 22 nt, Human
gagggaaagguuaauacaugau

SEQ ID NO: 314386 - RNA, 22 nt, Human
accccagcucugagccacacca

SEQ ID NO: 314387 - RNA, 22 nt, Human
uuucuauaugaggagcuaaagu

SEQ ID NO: 314388 - RNA, 22 nt, Human
caagauggacauaaggagagaa

SEQ ID NO: 314389 - RNA, 22 nt, Human
aaguguuaaaagauuaaaugcu

SEQ ID NO: 314390 - RNA, 22 nt, Human
agcccugggcuguagauaagca

SEQ ID NO: 314391 - RNA, 20 nt, Human
uugauucaagggcugaugga

SEQ ID NO: 314392 - RNA, 22 nt, Human
agagcuggagcagccccacugg

SEQ ID NO: 314393 - RNA, 19 nt, Human
acccucucagugccugagg

SEQ ID NO: 314394 - RNA, 21 nt, Human
ugggggagaauugguugcuuu

SEQ ID NO: 314395 - RNA, 22 nt, Human
aggguauguuuuuaucuacugu

SEQ ID NO: 314396 - RNA, 22 nt, Human
ggcgcacaaugugcagguuugu

SEQ ID NO: 314397 - RNA, 17 nt, Human
acagagcacaucaagau

SEQ ID NO: 314398 - RNA, 22 nt, Human
uggcuuccuccagagcaggagg

SEQ ID NO: 314399 - RNA, 22 nt, Human
agucccagccuguaggauuggg

SEQ ID NO: 314400 - RNA, 22 nt, Human
uucaggccuaauuucuagcccc

SEQ ID NO: 314401 - RNA, 22 nt, Human
auggggugagacuaggauuaaa

SEQ ID NO: 314402 - RNA, 22 nt, Human
augugugccccuuuuacucuuu

SEQ ID NO: 314403 - RNA, 22 nt, Human
gaugcagaaaguagacaccauc

SEQ ID NO: 314404 - RNA, 22 nt, Human
ccagggcuccauugcucauccu

SEQ ID NO: 314405 - RNA, 22 nt, Human
guuuggggucugcagagcggcg

SEQ ID NO: 314406 - RNA, 22 nt, Human
aucagcaagauguaauuucuau

SEQ ID NO: 314407 - RNA, 22 nt, Human
accuuuuuucagaacucuaaag

SEQ ID NO: 314408 - RNA, 22 nt, Human
cccucaguuuuccagugugggc

SEQ ID NO: 314409 - RNA, 22 nt, Human
agcagccacacgccuccuucuc

SEQ ID NO: 314410 - RNA, 22 nt, Human
aggccuggcuuugguuugcuga

SEQ ID NO: 314411 - RNA, 22 nt, Human
agucucuggacugggagauggc

SEQ ID NO: 314412 - RNA, 22 nt, Human
aggagguggccugagcgugccc

SEQ ID NO: 314413 - RNA, 22 nt, Human
cccaggcugaugggaugggcca

SEQ ID NO: 314414 - RNA, 22 nt, Human
uuugaaguggaaaaggauuuaa

SEQ ID NO: 314415 - RNA, 22 nt, Human
uuccuauuuccaugaaacacaa

SEQ ID NO: 314416 - RNA, 20 nt, Human
acaggggcagcacaauaaug

SEQ ID NO: 314417 - RNA, 22 nt, Human
uuguccuuggaugaagcuggga

SEQ ID NO: 314418 - RNA, 22 nt, Human
cugggcacauuuugacuagugu

SEQ ID NO: 314419 - RNA, 22 nt, Human
gaacacauuagucugaguuggc

SEQ ID NO: 314420 - RNA, 23 nt, Human
ggaguuggauuguacuugcugcu

SEQ ID NO: 314421 - RNA, 22 nt, Human
aaaaaucacuuuuauaggcagc

SEQ ID NO: 314422 - RNA, 22 nt, Human
agcagacaacccagaugaccca

SEQ ID NO: 314423 - RNA, 22 nt, Human
cauacaagcguucaauagaugu

SEQ ID NO: 314424 - RNA, 22 nt, Human
ggccagaggugguacauagcuu

SEQ ID NO: 314425 - RNA, 22 nt, Human
cagggcagagccaggauuucaa

SEQ ID NO: 314426 - RNA, 22 nt, Human
gccagccugugggggcucugug

SEQ ID NO: 314427 - RNA, 22 nt, Human
ccugggugucaugggcagcugg

SEQ ID NO: 314428 - RNA, 22 nt, Human
uuuucuaacaucuaguaauuug

SEQ ID NO: 314429 - RNA, 22 nt, Human
agcacauucugccuugcuuugc

SEQ ID NO: 314430 - RNA, 22 nt, Human
ugcauuaugcuacccagaagcu

SEQ ID NO: 314431 - RNA, 22 nt, Human
gagauuggauuuaauggccaaa

SEQ ID NO: 314432 - RNA, 22 nt, Human
ugccuuggugcuucuucaugug

SEQ ID NO: 314433 - RNA, 22 nt, Human
ccacaggggcccacgagccgcu

SEQ ID NO: 314434 - RNA, 22 nt, Human
cacaguguuugauuuaggggcc

SEQ ID NO: 314435 - RNA, 22 nt, Human
augaugcuguuuaucauauacu

SEQ ID NO: 314436 - RNA, 22 nt, Human
ggguggcacaggugcagagggu

SEQ ID NO: 314437 - RNA, 20 nt, Human
gcugccagugccugaugcuu

SEQ ID NO: 314438 - RNA, 22 nt, Human
ucucagugcagcaaggaauuua

SEQ ID NO: 314439 - RNA, 22 nt, Human
caguggguaggaaaggcucuuc

SEQ ID NO: 314440 - RNA, 21 nt, Human
ugcagagauaucugaagcaga

SEQ ID NO: 314441 - RNA, 22 nt, Human
uaauacagaaguguauuaaaau

SEQ ID NO: 314442 - RNA, 22 nt, Human
cuggcugguuacuauuucuggu

SEQ ID NO: 314443 - RNA, 22 nt, Human
ccagcgcuucccaucagggagg

SEQ ID NO: 314444 - RNA, 21 nt, Human
aaugugugcuauuuaucuuuu

SEQ ID NO: 314445 - RNA, 22 nt, Human
aaggagucucagcugggccuga

SEQ ID NO: 314446 - RNA, 22 nt, Human
ccuuucagaugggcauggaccg

SEQ ID NO: 314447 - RNA, 22 nt, Human
uggcuuccgccgcgggccucgg

SEQ ID NO: 314448 - RNA, 19 nt, Human
agggcugcucuggccuggg

SEQ ID NO: 314449 - RNA, 22 nt, Human
gaggcugcggggaggagccugc

SEQ ID NO: 314450 - RNA, 22 nt, Human
cugaggcugcccagggccaggu

SEQ ID NO: 314451 - RNA, 22 nt, Human
uugcauuuaaguagauguuaca

SEQ ID NO: 314452 - RNA, 22 nt, Human
ccuggagguggagguugcagug

SEQ ID NO: 314453 - RNA, 19 nt, Human
uggcauugguccagauaaa

SEQ ID NO: 314454 - RNA, 22 nt, Human
ccugcaggcugcaggccaguuc

SEQ ID NO: 314455 - RNA, 22 nt, Human
ugaacgcagguccacauggcuc

SEQ ID NO: 314456 - RNA, 22 nt, Human
gcccagcugcacccuggugggu

SEQ ID NO: 314457 - RNA, 22 nt, Human
uauacaauggcugaaucaucca

SEQ ID NO: 314458 - RNA, 22 nt, Human
caaugugguggcagaugucagu

SEQ ID NO: 314459 - RNA, 22 nt, Human
acaggcagcacuaaucucuggu

SEQ ID NO: 314460 - RNA, 22 nt, Human
cacagcagaaaguguaggagga

SEQ ID NO: 314461 - RNA, 22 nt, Human
aacaguaaugugguguuggguu

SEQ ID NO: 314462 - RNA, 22 nt, Human
uucucuuuucaccaguugcuaa

SEQ ID NO: 314463 - RNA, 22 nt, Human
ugcaagggcuuagggggcugug

SEQ ID NO: 314464 - RNA, 22 nt, Human
gagcugggacuuggaauccaca

SEQ ID NO: 314465 - RNA, 22 nt, Human
ucuggucaguaauaagaagugg

SEQ ID NO: 314466 - RNA, 22 nt, Human
gagcugggauuugaaccuggga

SEQ ID NO: 314467 - RNA, 22 nt, Human
uagcugggaauuaucugguugc

SEQ ID NO: 314468 - RNA, 22 nt, Human
ugguuuugcuccaguauaaaua

SEQ ID NO: 314469 - RNA, 22 nt, Human
ggagcagagcucuucaucugca

SEQ ID NO: 314470 - RNA, 22 nt, Human
gccucugcaggugcgguuaucc

SEQ ID NO: 314471 - RNA, 22 nt, Human
gccaggcacaguucuaggugcu

SEQ ID NO: 314472 - RNA, 22 nt, Human
uguugagacugagggagucagc

SEQ ID NO: 314473 - RNA, 22 nt, Human
uuucugcugugcuuucuugcgu

SEQ ID NO: 314474 - RNA, 22 nt, Human
uccacagcacaaagccagugug

SEQ ID NO: 314475 - RNA, 22 nt, Human
aauuuagauugauaaacaugga

SEQ ID NO: 314476 - RNA, 22 nt, Human
accgaaggaaacuggaaccguu

SEQ ID NO: 314477 - RNA, 22 nt, Human
uccaagaucuacagcaguuuag

SEQ ID NO: 314478 - RNA, 22 nt, Human
ccaaggagcucauauucuuguu

SEQ ID NO: 314479 - RNA, 22 nt, Human
acaggggcuccgaaggugaggg

SEQ ID NO: 314480 - RNA, 22 nt, Human
agagccuugaagaucuggaaaa

SEQ ID NO: 314481 - RNA, 22 nt, Human
uguaugaauauguuggggaggu

SEQ ID NO: 314482 - RNA, 22 nt, Human
aggggagagaacauaaggaagu

SEQ ID NO: 314483 - RNA, 22 nt, Human
ucucugagcccaauguagcaau

SEQ ID NO: 314484 - RNA, 22 nt, Human
gcagcuuuuuggaugucaguua

SEQ ID NO: 314485 - RNA, 22 nt, Human
agaauuuuugauuaucuacucg

SEQ ID NO: 314486 - RNA, 22 nt, Human
cugcugcaggaugggcacucug

SEQ ID NO: 314487 - RNA, 22 nt, Human
caggcacagaguuauucauuua

SEQ ID NO: 314488 - RNA, 22 nt, Human
gagccuguguuuccuguagcca

SEQ ID NO: 314489 - RNA, 22 nt, Human
ugaggccaggaucccaggcucu

SEQ ID NO: 314490 - RNA, 22 nt, Human
augaaaacggaccagagcuauu

SEQ ID NO: 314491 - RNA, 22 nt, Human
aaagauuucagaagccugugcc

SEQ ID NO: 314492 - RNA, 22 nt, Human
agugucauuccagggacccucg

SEQ ID NO: 314493 - RNA, 21 nt, Human
uggagcugccacuuguccucc

SEQ ID NO: 314494 - RNA, 22 nt, Human
ucagagguaagggcugagagga

SEQ ID NO: 314495 - RNA, 22 nt, Human
ucauuguuauguuuugcugucu

SEQ ID NO: 314496 - RNA, 22 nt, Human
uaucaucuuguugucaugcagc

SEQ ID NO: 314497 - RNA, 22 nt, Human
gggcucagccccauugaaccag

SEQ ID NO: 314498 - RNA, 22 nt, Human
guccucugcccaggucaagguu

SEQ ID NO: 314499 - RNA, 23 nt, Human
gcaggugguucgaacagaaguuu

SEQ ID NO: 314500 - RNA, 22 nt, Human
gggcccuggacguggcggcaga

SEQ ID NO: 314501 - RNA, 22 nt, Human
ggagugggcagcacugcccugu

SEQ ID NO: 314502 - RNA, 22 nt, Human
cucugugggggagaggcagcug

SEQ ID NO: 314503 - RNA, 22 nt, Human
aaagccuugagauccuauaguu

SEQ ID NO: 314504 - RNA, 22 nt, Human
gagagugaugaaugguuaaaca

SEQ ID NO: 314505 - RNA, 22 nt, Human
agucaauuaucucuaggucauc

SEQ ID NO: 314506 - RNA, 22 nt, Human
uccaggagaggccugaccaggu

SEQ ID NO: 314507 - RNA, 22 nt, Human
uaaggcacccuucugaguagag

SEQ ID NO: 314508 - RNA, 22 nt, Human
agaaaucaugacuaagagcagu

SEQ ID NO: 314509 - RNA, 19 nt, Human
ggucacagggguuacaagg

SEQ ID NO: 314510 - RNA, 22 nt, Human
cugaucuuaaguaacauuauuu

SEQ ID NO: 314511 - RNA, 22 nt, Human
agcugccacagagccuggccag

SEQ ID NO: 314512 - RNA, 17 nt, Human
uggcacagaggugcuau

SEQ ID NO: 314513 - RNA, 22 nt, Human
gacaggguacgggcuaggcaca

SEQ ID NO: 314514 - RNA, 18 nt, Human
ugugguggagcugccuuc

SEQ ID NO: 314515 - RNA, 22 nt, Human
ccagguggaaggucugugcucu

SEQ ID NO: 314516 - RNA, 22 nt, Human
cagauggaacacagaaaggaga

SEQ ID NO: 314517 - RNA, 22 nt, Human
uguguccauucaggcacugacc

SEQ ID NO: 314518 - RNA, 17 nt, Human
aauagcugcucagagag

SEQ ID NO: 314519 - RNA, 22 nt, Human
uggcuccuaucaaggagugggu

SEQ ID NO: 314520 - RNA, 19 nt, Human
ucccaggaagcaaauguca

SEQ ID NO: 314521 - RNA, 23 nt, Human
gcucagagguuuuucucuggaug

SEQ ID NO: 314522 - RNA, 22 nt, Human
ggagccugugggaugagaugug

SEQ ID NO: 314523 - RNA, 22 nt, Human
ggccagagaauaugccuuacgu

SEQ ID NO: 314524 - RNA, 22 nt, Human
ucagcagggaggcucugugccc

SEQ ID NO: 314525 - RNA, 22 nt, Human
cugugucccaguaccuugggua

SEQ ID NO: 314526 - RNA, 22 nt, Human
aggccaggcaacauucugaagu

SEQ ID NO: 314527 - RNA, 22 nt, Human
ggaggccaaggcagguggaucg

SEQ ID NO: 314528 - RNA, 19 nt, Human
cugcugggugcugagggag

SEQ ID NO: 314529 - RNA, 22 nt, Human
ggcaccuggagguuuacuggau

SEQ ID NO: 314530 - RNA, 22 nt, Human
uugaagcaaggcgaaucuugug

SEQ ID NO: 314531 - RNA, 22 nt, Human
ucagugcagggugggagagaga

SEQ ID NO: 314532 - RNA, 22 nt, Human
ccuucauugcaucuuuaagaga

SEQ ID NO: 314533 - RNA, 22 nt, Human
agucucagccacacagaccuau

SEQ ID NO: 314534 - RNA, 22 nt, Human
uuuaaagaaauuccucaucuuu

SEQ ID NO: 314535 - RNA, 22 nt, Human
uuaagucauuucugauuauaga

SEQ ID NO: 314536 - RNA, 22 nt, Human
agucccagagaggucggggcca

SEQ ID NO: 314537 - RNA, 17 nt, Human
ggcagcugccacuuuuu

SEQ ID NO: 314538 - RNA, 19 nt, Human
cucugccucccuccugggu

SEQ ID NO: 314539 - RNA, 22 nt, Human
agggaggauaguagucaguuua

SEQ ID NO: 314540 - RNA, 22 nt, Human
uagcuagaaugcuucgugauau

SEQ ID NO: 314541 - RNA, 22 nt, Human
cacugagaggucucauuuccaa

SEQ ID NO: 314542 - RNA, 22 nt, Human
cccagcccagcguucgaggggu

SEQ ID NO: 314543 - RNA, 22 nt, Human
agccaaggacacggagccuccu

SEQ ID NO: 314544 - RNA, 22 nt, Human
ggaggggauuuaguagaugcua

SEQ ID NO: 314545 - RNA, 19 nt, Human
ucuguucacauuguuucgc

SEQ ID NO: 314546 - RNA, 22 nt, Human
gagccuggauagccuuguucca

SEQ ID NO: 314547 - RNA, 22 nt, Human
ccugugucagccccugccucca

SEQ ID NO: 314548 - RNA, 22 nt, Human
gcaaagcugggugugaaugcac

SEQ ID NO: 314549 - RNA, 22 nt, Human
ugacaauacagagagagcaaaa

SEQ ID NO: 314550 - RNA, 22 nt, Human
guuuauaaggcccaauauuucu

SEQ ID NO: 314551 - RNA, 22 nt, Human
ccucagugcguacugaacagug

SEQ ID NO: 314552 - RNA, 22 nt, Human
ucuucacaccgggcagcaggaa

SEQ ID NO: 314553 - RNA, 20 nt, Human
aagcuggguaggagaggagc

SEQ ID NO: 314554 - RNA, 22 nt, Human
gaggguuggugcaaaugggaug

SEQ ID NO: 314555 - RNA, 22 nt, Human
gagcucagcccaaagagcagug

SEQ ID NO: 314556 - RNA, 22 nt, Human
ucaguuuugaaaacauugaaug

SEQ ID NO: 314557 - RNA, 22 nt, Human
gaaggccacaagagaaguuaag

SEQ ID NO: 314558 - RNA, 22 nt, Human
cucaggauuaaggaaucuaaau

SEQ ID NO: 314559 - RNA, 22 nt, Human
agaguguuucagucuuccuaga

SEQ ID NO: 314560 - RNA, 22 nt, Human
ggugacuggagggacccaggcc

SEQ ID NO: 314561 - RNA, 22 nt, Human
cagaagcauugacuccuugcuc

SEQ ID NO: 314562 - RNA, 22 nt, Human
ccaggaggcagaaguugcagug

SEQ ID NO: 314563 - RNA, 19 nt, Human
uggcagggagugauauuag

SEQ ID NO: 314564 - RNA, 23 nt, Human
ucuggcuccauccuuggggaucc

SEQ ID NO: 314565 - RNA, 22 nt, Human
gccugccuguuggcugaggugc

SEQ ID NO: 314566 - RNA, 22 nt, Human
agaugguagguggcaggacuga

SEQ ID NO: 314567 - RNA, 22 nt, Human
cugggcucagaugagaggaagg

SEQ ID NO: 314568 - RNA, 22 nt, Human
uggagugaaguaaagaggacaa

SEQ ID NO: 314569 - RNA, 22 nt, Human
accugaggccuccccagcagac

SEQ ID NO: 314570 - RNA, 22 nt, Human
uucucuuagcuguaaagucaau

SEQ ID NO: 314571 - RNA, 22 nt, Human
cucaggaaaggccaugcaaggg

SEQ ID NO: 314572 - RNA, 21 nt, Human
ucugggcccaugcugccucac

SEQ ID NO: 314573 - RNA, 22 nt, Human
gcaguguuuguguucucacaug

SEQ ID NO: 314574 - RNA, 22 nt, Human
caaaugcuggcccugcuacuua

SEQ ID NO: 314575 - RNA, 19 nt, Human
acagggcagcaauaggaua

SEQ ID NO: 314576 - RNA, 22 nt, Human
gccuccuggauuuuagugccau

SEQ ID NO: 314577 - RNA, 22 nt, Human
caugagcugcugggagccuguc

SEQ ID NO: 314578 - RNA, 22 nt, Human
guuuuccugaaacugauggugu

SEQ ID NO: 314579 - RNA, 22 nt, Human
cuuuaagacucugcucuuggug

SEQ ID NO: 314580 - RNA, 22 nt, Human
cuggcugggagcgagcugcuca

SEQ ID NO: 314581 - RNA, 22 nt, Human
cagcuuccaucuccacugcccu

SEQ ID NO: 314582 - RNA, 22 nt, Human
aaucucacucaaagaauucucu

SEQ ID NO: 314583 - RNA, 22 nt, Human
uccaggacuagcauuucugaua

SEQ ID NO: 314584 - RNA, 21 nt, Human
ggccucugccuugccccacuc

SEQ ID NO: 314585 - RNA, 22 nt, Human
augcugugccuucucugugcca

SEQ ID NO: 314586 - RNA, 22 nt, Human
ccugggcauaaaucacuccaag

SEQ ID NO: 314587 - RNA, 22 nt, Human
gccagcagguggagagaucaag

SEQ ID NO: 314588 - RNA, 22 nt, Human
cugcccuguuuggacagcccgg

SEQ ID NO: 314589 - RNA, 22 nt, Human
auacaucuuccuuuuaaaaugc

SEQ ID NO: 314590 - RNA, 22 nt, Human
gcccugagacugagcauggguu

SEQ ID NO: 314591 - RNA, 22 nt, Human
aagggaggccagagguuuugca

SEQ ID NO: 314592 - RNA, 22 nt, Human
uggccuugggcagguggccugc

SEQ ID NO: 314593 - RNA, 19 nt, Human
ugcagcucagggcaggggc

SEQ ID NO: 314594 - RNA, 22 nt, Human
cugcucuaacugcauuaguuuu

SEQ ID NO: 314595 - RNA, 22 nt, Human
aaauacacguacauguguaaaa

SEQ ID NO: 314596 - RNA, 18 nt, Human
cugcuugggagacgucag

SEQ ID NO: 314597 - RNA, 22 nt, Human
gauauguauugaaugaucauuu

SEQ ID NO: 314598 - RNA, 22 nt, Human
ggaggccacgguuuagcaccga

SEQ ID NO: 314599 - RNA, 22 nt, Human
ggcagccauacucagaccuggg

SEQ ID NO: 314600 - RNA, 22 nt, Human
uggcucugcaccucaguguacc

SEQ ID NO: 314601 - RNA, 22 nt, Human
auucaaguucuucugucuuugc

SEQ ID NO: 314602 - RNA, 21 nt, Human
gcccagcaaggugagaaggcc

SEQ ID NO: 314603 - RNA, 22 nt, Human
acugaguguaggacuuugaguu

SEQ ID NO: 314604 - RNA, 22 nt, Human
gcagagccaggcuggggcaggu

SEQ ID NO: 314605 - RNA, 22 nt, Human
ugcugucccuaagucucuucaa

SEQ ID NO: 314606 - RNA, 22 nt, Human
aaucucuuuggcucaaggaucc

SEQ ID NO: 314607 - RNA, 22 nt, Human
gcucagagcacucagacucagc

SEQ ID NO: 314608 - RNA, 22 nt, Human
agucuucccugugccagagugu

SEQ ID NO: 314609 - RNA, 22 nt, Human
auucauuugcuauuguguaugg

SEQ ID NO: 314610 - RNA, 22 nt, Human
auuguacaaugccuggaacauu

SEQ ID NO: 314611 - RNA, 22 nt, Human
uggaggagggcuggugucugua

SEQ ID NO: 314612 - RNA, 22 nt, Human
gucuuucuaugaugaacuguug

SEQ ID NO: 314613 - RNA, 22 nt, Human
uacagugucuggauaucaaagg

SEQ ID NO: 314614 - RNA, 22 nt, Human
aauguguagggugccuguuuuu

SEQ ID NO: 314615 - RNA, 21 nt, Human
ugguuugcggccaaaguuaaa

SEQ ID NO: 314616 - RNA, 22 nt, Human
aacauuucagcaaauaagaaca

SEQ ID NO: 314617 - RNA, 22 nt, Human
ggccaggcuggucucagacuuc

SEQ ID NO: 314618 - RNA, 22 nt, Human
cccaggucuaugccagcucuga

SEQ ID NO: 314619 - RNA, 22 nt, Human
ugagcuucuuuauuuggccaga

SEQ ID NO: 314620 - RNA, 22 nt, Human
ccugggcaaaugccagagacaa

SEQ ID NO: 314621 - RNA, 22 nt, Human
ugcuuccuucccguucuucucc

SEQ ID NO: 314622 - RNA, 23 nt, Human
aaugauuucaugaugauagcagc

SEQ ID NO: 314623 - RNA, 22 nt, Human
gagcuuccacucuagaaggagu

SEQ ID NO: 314624 - RNA, 22 nt, Human
agcucagcuuccucuccaugcu

SEQ ID NO: 314625 - RNA, 22 nt, Human
cucagcagcagggaagagguca

SEQ ID NO: 314626 - RNA, 22 nt, Human
auggggcugggauucuccucgg

SEQ ID NO: 314627 - RNA, 22 nt, Human
cagggcccaagacacaaugagg

SEQ ID NO: 314628 - RNA, 20 nt, Human
ucucuucuggggagauaaaa

SEQ ID NO: 314629 - RNA, 22 nt, Human
ucugggaauuuauuggcacuuu

SEQ ID NO: 314630 - RNA, 22 nt, Human
aacauacauauuucagugucca

SEQ ID NO: 314631 - RNA, 20 nt, Human
cucuggcuccgcgugaccgc

SEQ ID NO: 314632 - RNA, 22 nt, Human
ucgcugugguuucuguacaugg

SEQ ID NO: 314633 - RNA, 22 nt, Human
agauuguagaaacuguagcauu

SEQ ID NO: 314634 - RNA, 22 nt, Human
aguuuaugaaacacagauuuga

SEQ ID NO: 314635 - RNA, 22 nt, Human
cguguacagucuaucuuuuuuc

SEQ ID NO: 314636 - RNA, 22 nt, Human
gcugggcaccggagagacccca

SEQ ID NO: 314637 - RNA, 22 nt, Human
gaugccucuuuuggcugaauua

SEQ ID NO: 314638 - RNA, 22 nt, Human
ccagccugaaaugccucauccu

SEQ ID NO: 314639 - RNA, 22 nt, Human
uuccauaauaaccugagagaaa

SEQ ID NO: 314640 - RNA, 22 nt, Human
gcagggugaaggucacauagaa

SEQ ID NO: 314641 - RNA, 22 nt, Human
uuagacauagaauauugucuag

SEQ ID NO: 314642 - RNA, 22 nt, Human
uuggcuuccaggaucucagcag

SEQ ID NO: 314643 - RNA, 20 nt, Human
aggaaaaggguggugguaga

SEQ ID NO: 314644 - RNA, 21 nt, Human
guauucuuuaugaagugaaaa

SEQ ID NO: 314645 - RNA, 22 nt, Human
acauuucaguaaguguuaauuu

SEQ ID NO: 314646 - RNA, 22 nt, Human
ugggcugcggauaggccucgga

SEQ ID NO: 314647 - RNA, 22 nt, Human
uuguuacaucuuauguaagugg

SEQ ID NO: 314648 - RNA, 22 nt, Human
aauaacaggcucaucagaugcu

SEQ ID NO: 314649 - RNA, 22 nt, Human
agccagcaugaagacagaggcc

SEQ ID NO: 314650 - RNA, 21 nt, Human
uuucuucacuuugccccaugu

SEQ ID NO: 314651 - RNA, 22 nt, Human
uaagaacaagcuggggguucca

SEQ ID NO: 314652 - RNA, 22 nt, Human
gagccaggcccguacuugcugu

SEQ ID NO: 314653 - RNA, 22 nt, Human
uggcuuccaaaggaaugggccu

SEQ ID NO: 314654 - RNA, 22 nt, Human
uaaauucagugaguaauuucug

SEQ ID NO: 314655 - RNA, 22 nt, Human
uugacagcaaagauugugccua

SEQ ID NO: 314656 - RNA, 21 nt, Human
aggggacagaguagcuccagg

SEQ ID NO: 314657 - RNA, 22 nt, Human
aaaauuauagaucuagugccug

SEQ ID NO: 314658 - RNA, 22 nt, Human
guccucuggaagaugaguucuu

SEQ ID NO: 314659 - RNA, 22 nt, Human
aggccucagccugccaggccug

SEQ ID NO: 314660 - RNA, 22 nt, Human
cagagcugcuucccaguuugug

SEQ ID NO: 314661 - RNA, 22 nt, Human
ugaaggagaaauggaaaguggg

SEQ ID NO: 314662 - RNA, 22 nt, Human
uggaggcauuuuagguugucac

SEQ ID NO: 314663 - RNA, 22 nt, Human
gcagcaaucuucacagugucau

SEQ ID NO: 314664 - RNA, 18 nt, Human
cacaggcucccagugagg

SEQ ID NO: 314665 - RNA, 22 nt, Human
uuuaacagguaaaguaaaugug

SEQ ID NO: 314666 - RNA, 18 nt, Human
gaagggagcuggaaugca

SEQ ID NO: 314667 - RNA, 22 nt, Human
ucagcagaggggaaggcaucug

SEQ ID NO: 314668 - RNA, 22 nt, Human
gcugcaggggggucuggacuug

SEQ ID NO: 314669 - RNA, 22 nt, Human
uccagcucagaugcagggauca

SEQ ID NO: 314670 - RNA, 20 nt, Human
ugugcccaauguccagguuc

SEQ ID NO: 314671 - RNA, 22 nt, Human
aauuucagagguagagauucua

SEQ ID NO: 314672 - RNA, 22 nt, Human
acagagcucccagccaucuccu

SEQ ID NO: 314673 - RNA, 22 nt, Human
aggcagagagcaguggccgucu

SEQ ID NO: 314674 - RNA, 22 nt, Human
ugcucuguaacaaauugacaug

SEQ ID NO: 314675 - RNA, 22 nt, Human
acugucuccucaucaugccugg

SEQ ID NO: 314676 - RNA, 22 nt, Human
uuuauauuguaaaaaugguucu

SEQ ID NO: 314677 - RNA, 22 nt, Human
aggcucagcccaagguggagag

SEQ ID NO: 314678 - RNA, 21 nt, Human
uagagaaaagaagcuguuccu

SEQ ID NO: 314679 - RNA, 22 nt, Human
ugggcuacucugggagccuaac

SEQ ID NO: 314680 - RNA, 22 nt, Human
cucuggagcauuucaccuacau

SEQ ID NO: 314681 - RNA, 22 nt, Human
gaggccugguuugcaugagaau

SEQ ID NO: 314682 - RNA, 23 nt, Human
cagggcugggcuugguguuaggc

SEQ ID NO: 314683 - RNA, 22 nt, Human
ugcagggccagacuggguugga

SEQ ID NO: 314684 - RNA, 22 nt, Human
gggcagugguccaggcuacagc

SEQ ID NO: 314685 - RNA, 23 nt, Human
ucucuuucaagagcuuaaugugc

SEQ ID NO: 314686 - RNA, 22 nt, Human
agcagggcucuguggagggugg

SEQ ID NO: 314687 - RNA, 22 nt, Human
uaagaacaucuguccccagauu

SEQ ID NO: 314688 - RNA, 22 nt, Human
agggagaagagaacaaagcccu

SEQ ID NO: 314689 - RNA, 22 nt, Human
aaucaguuaggguguuaaugag

SEQ ID NO: 314690 - RNA, 22 nt, Human
cccagccaaggugcugguguug

SEQ ID NO: 314691 - RNA, 22 nt, Human
ggcagccaugcacgcugccugg

SEQ ID NO: 314692 - RNA, 22 nt, Human
aggcaggggagcuggaagggua

SEQ ID NO: 314693 - RNA, 22 nt, Human
uggcucagccuggcccuuucau

SEQ ID NO: 314694 - RNA, 22 nt, Human
uuauuuuuaaaaguucacacag

SEQ ID NO: 314695 - RNA, 19 nt, Human
agcagccauagacaauaug

SEQ ID NO: 314696 - RNA, 22 nt, Human
ugcucuggguccugggccuccu

SEQ ID NO: 314697 - RNA, 22 nt, Human
aguuggagaagaggucgggaau

SEQ ID NO: 314698 - RNA, 22 nt, Human
agcccagguugaggcugcagug

SEQ ID NO: 314699 - RNA, 22 nt, Human
uagaaguuaaaggaauacagaa

SEQ ID NO: 314700 - RNA, 21 nt, Human
ucuguggcggacucuaggccc

SEQ ID NO: 314701 - RNA, 22 nt, Human
caauguguguguuuuucucaac

SEQ ID NO: 314702 - RNA, 21 nt, Human
cugaggcagcacagcuaguca

SEQ ID NO: 314703 - RNA, 22 nt, Human
ucccagaaaaaggaggcuauga

SEQ ID NO: 314704 - RNA, 22 nt, Human
agccacagcaacaagugcaauu

SEQ ID NO: 314705 - RNA, 22 nt, Human
gcccagcuggcuuccagcacau

SEQ ID NO: 314706 - RNA, 22 nt, Human
uccucacagucaacacuuugag

SEQ ID NO: 314707 - RNA, 22 nt, Human
cacugccuggaaggagagacau

SEQ ID NO: 314708 - RNA, 22 nt, Human
uaguuuuuucaacaaauggugc

SEQ ID NO: 314709 - RNA, 22 nt, Human
gguggcagucuuaagagaucuu

SEQ ID NO: 314710 - RNA, 22 nt, Human
gcacagcaauuucuauaagcuc

SEQ ID NO: 314711 - RNA, 22 nt, Human
ccacagagacaggguccuugcu

SEQ ID NO: 314712 - RNA, 22 nt, Human
ggucucaggagacuggagagca

SEQ ID NO: 314713 - RNA, 22 nt, Human
gcagccacagaggagggaugca

SEQ ID NO: 314714 - RNA, 22 nt, Human
aacauucugguucuaaaaaccu

SEQ ID NO: 314715 - RNA, 22 nt, Human
aaggaguuuggguagucauaca

SEQ ID NO: 314716 - RNA, 22 nt, Human
gggacuucauagcuaggcacuu

SEQ ID NO: 314717 - RNA, 23 nt, Human
acugagccagggccugggucagc

SEQ ID NO: 314718 - RNA, 22 nt, Human
cuccaugaauuugagcuuugug

SEQ ID NO: 314719 - RNA, 22 nt, Human
auguacacaugcaugcaugugc

SEQ ID NO: 314720 - RNA, 22 nt, Human
uuugaagucaggcuuucuaccc

SEQ ID NO: 314721 - RNA, 22 nt, Human
cugcauccuaaccuccaugcag

SEQ ID NO: 314722 - RNA, 22 nt, Human
uaaauguguaaaccuccauuac

SEQ ID NO: 314723 - RNA, 22 nt, Human
aaugagaacugggaguuggugg

SEQ ID NO: 314724 - RNA, 23 nt, Human
uggcucucucagugcugcagagg

SEQ ID NO: 314725 - RNA, 22 nt, Human
gcauccagucuuggcuccugga

SEQ ID NO: 314726 - RNA, 22 nt, Human
gagccaggguuugaaacuagac

SEQ ID NO: 314727 - RNA, 22 nt, Human
uucuucaugcuguugcugcuug

SEQ ID NO: 314728 - RNA, 20 nt, Human
agugccagggcaggugagag

SEQ ID NO: 314729 - RNA, 22 nt, Human
gaggaaugucagcacaggccuc

SEQ ID NO: 314730 - RNA, 19 nt, Human
uggggccuccugucccugg

SEQ ID NO: 314731 - RNA, 22 nt, Human
gccugccugcugucaucugccu

SEQ ID NO: 314732 - RNA, 22 nt, Human
uuauuuucagcuaggaaagcca

SEQ ID NO: 314733 - RNA, 22 nt, Human
cuggcuggccggaggcaucccu

SEQ ID NO: 314734 - RNA, 22 nt, Human
uauagaagagacaugugcauag

SEQ ID NO: 314735 - RNA, 21 nt, Human
agucuguuaggaugacucuga

SEQ ID NO: 314736 - RNA, 22 nt, Human
cagcuucugagcaagccagggg

SEQ ID NO: 314737 - RNA, 22 nt, Human
cagcucugaggaacacuccuuu

SEQ ID NO: 314738 - RNA, 21 nt, Human
ucuuugcaucaguuguuuucu

SEQ ID NO: 314739 - RNA, 22 nt, Human
ugaagcagagugaaggugaauu

SEQ ID NO: 314740 - RNA, 18 nt, Human
auccaaaaagauggaagu

SEQ ID NO: 314741 - RNA, 22 nt, Human
auaaacaguagagaaagguggu

SEQ ID NO: 314742 - RNA, 22 nt, Human
aaaugucuaucuggcauauucc

SEQ ID NO: 314743 - RNA, 22 nt, Human
auucugucauuucaagaaaaac

SEQ ID NO: 314744 - RNA, 22 nt, Human
agccacagcauguguguaugua

SEQ ID NO: 314745 - RNA, 22 nt, Human
cugguccuccuugccuucagau

SEQ ID NO: 314746 - RNA, 22 nt, Human
ucagaggagccaaaguucugag

SEQ ID NO: 314747 - RNA, 22 nt, Human
gugugcaugcauagacaccaca

SEQ ID NO: 314748 - RNA, 22 nt, Human
aggaggcuguggagcacuccau

SEQ ID NO: 314749 - RNA, 22 nt, Human
ucaggccucaagcugcuuuaag

SEQ ID NO: 314750 - RNA, 22 nt, Human
accagguggccccagcgugguu

SEQ ID NO: 314751 - RNA, 22 nt, Human
guguuuccuaguuuaaugaaug

SEQ ID NO: 314752 - RNA, 22 nt, Human
agagcugggaccgucuggaagu

SEQ ID NO: 314753 - RNA, 22 nt, Human
uggcaguggcucagagugcaga

SEQ ID NO: 314754 - RNA, 22 nt, Human
cccucaggagaugucagcugga

SEQ ID NO: 314755 - RNA, 22 nt, Human
auuuuucucucacacuuaccag

SEQ ID NO: 314756 - RNA, 22 nt, Human
aaagaacagauguguggugcau

SEQ ID NO: 314757 - RNA, 23 nt, Human
ucuccagugucucuucauugagu

SEQ ID NO: 314758 - RNA, 21 nt, Human
aggugcagagccagggaccag

SEQ ID NO: 314759 - RNA, 22 nt, Human
uucaggaagguccuauagcaga

SEQ ID NO: 314760 - RNA, 22 nt, Human
agagcuggaagcugcucuuaga

SEQ ID NO: 314761 - RNA, 18 nt, Human
ccuggcuuccaucuuggu

SEQ ID NO: 314762 - RNA, 22 nt, Human
aaggccugaacaugaggagaug

SEQ ID NO: 314763 - RNA, 22 nt, Human
aaaugcacagagccuuagagau

SEQ ID NO: 314764 - RNA, 22 nt, Human
cugggggcaagcagacagcugu

SEQ ID NO: 314765 - RNA, 22 nt, Human
ugucaugcuuauguuacauacu

SEQ ID NO: 314766 - RNA, 22 nt, Human
cagccugcagggcugccuguug

SEQ ID NO: 314767 - RNA, 22 nt, Human
ggagcugucuguagggcacagg

SEQ ID NO: 314768 - RNA, 22 nt, Human
acucaggaaauugagauaaugg

SEQ ID NO: 314769 - RNA, 22 nt, Human
guucugucugagcaccacagga

SEQ ID NO: 314770 - RNA, 22 nt, Human
uguggccuggaaggggcugcuc

SEQ ID NO: 314771 - RNA, 22 nt, Human
uuugcauuauauuuauagaaga

SEQ ID NO: 314772 - RNA, 19 nt, Human
auagaaaggguuaaagaca

SEQ ID NO: 314773 - RNA, 22 nt, Human
ucucagaguuugaaucuggagu

SEQ ID NO: 314774 - RNA, 22 nt, Human
agagccuggacuuuucugagcc

SEQ ID NO: 314775 - RNA, 23 nt, Human
cccauuuucauguuaacuccugg

SEQ ID NO: 314776 - RNA, 22 nt, Human
gugacaguggucacuuguaguu

SEQ ID NO: 314777 - RNA, 22 nt, Human
auagaaauggcagcuggugcua

SEQ ID NO: 314778 - RNA, 22 nt, Human
cccagcacuuugaauaugucac

SEQ ID NO: 314779 - RNA, 22 nt, Human
gccuggggucucugacucacag

SEQ ID NO: 314780 - RNA, 22 nt, Human
cugggcagccucacacaauguu

SEQ ID NO: 314781 - RNA, 22 nt, Human
ucaguuuuuaagaguuaugcga

SEQ ID NO: 314782 - RNA, 18 nt, Human
agaaggagcuaugggcag

SEQ ID NO: 314783 - RNA, 22 nt, Human
uuuguaaauagcaguacucaug

SEQ ID NO: 314784 - RNA, 22 nt, Human
auuauuauauagggaaaguccc

SEQ ID NO: 314785 - RNA, 17 nt, Human
uuccccugaccaagccu

SEQ ID NO: 314786 - RNA, 22 nt, Human
agggacuggcucucugagcagg

SEQ ID NO: 314787 - RNA, 20 nt, Human
ugcguguguauuuauuuucu

SEQ ID NO: 314788 - RNA, 22 nt, Human
guguccagagaaacucacagcu

SEQ ID NO: 314789 - RNA, 19 nt, Human
ucauucaggaccaguggau

SEQ ID NO: 314790 - RNA, 22 nt, Human
uggacaggugagugacucaggg

SEQ ID NO: 314791 - RNA, 22 nt, Human
ucuguucaagacugaggugaca

SEQ ID NO: 314792 - RNA, 22 nt, Human
aagaggaaaugauugacuauau

SEQ ID NO: 314793 - RNA, 22 nt, Human
guuauguauugggaaauccaag

SEQ ID NO: 314794 - RNA, 22 nt, Human
ucagagccccuccgcuguccca

SEQ ID NO: 314795 - RNA, 22 nt, Human
auguccuuccauuuugaucugu

SEQ ID NO: 314796 - RNA, 22 nt, Human
uauuggugggggcagagagaga

SEQ ID NO: 314797 - RNA, 21 nt, Human
acagggcaugcagcuggcugu

SEQ ID NO: 314798 - RNA, 22 nt, Human
gcccugagggguggugucugua

SEQ ID NO: 314799 - RNA, 22 nt, Human
ggcaggugcucugugggccugg

SEQ ID NO: 314800 - RNA, 22 nt, Human
agcagaagaaagccacaugacu

SEQ ID NO: 314801 - RNA, 22 nt, Human
agaagccauucccuguaggcuc

SEQ ID NO: 314802 - RNA, 22 nt, Human
ugcuccagugagcuggccaucc

SEQ ID NO: 314803 - RNA, 22 nt, Human
caggguuucaccauguuagcag

SEQ ID NO: 314804 - RNA, 22 nt, Human
gucccugcccuccugggacuca

SEQ ID NO: 314805 - RNA, 22 nt, Human
uuccaaagaaauugaccaagac

SEQ ID NO: 314806 - RNA, 18 nt, Human
gagguccugcucuagccc

SEQ ID NO: 314807 - RNA, 22 nt, Human
gaugcacagugacccugccagu

SEQ ID NO: 314808 - RNA, 22 nt, Human
auucuucauacagacaaguccu

SEQ ID NO: 314809 - RNA, 21 nt, Human
cugugcuucuuccuaagccag

SEQ ID NO: 314810 - RNA, 22 nt, Human
uccacuggcccaccuccucagu

SEQ ID NO: 314811 - RNA, 22 nt, Human
aauuauguagccauaugaaaca

SEQ ID NO: 314812 - RNA, 22 nt, Human
ugccauauugcaaagugucugc

SEQ ID NO: 314813 - RNA, 22 nt, Human
aaaguguggucguucauuuugu

SEQ ID NO: 314814 - RNA, 22 nt, Human
gucuccugagacugcagucacc

SEQ ID NO: 314815 - RNA, 22 nt, Human
cugggagggguagccaauccua

SEQ ID NO: 314816 - RNA, 22 nt, Human
uugcugugucauuuguuuaauc

SEQ ID NO: 314817 - RNA, 22 nt, Human
uuucaugaggggcaaaaucuca

SEQ ID NO: 314818 - RNA, 22 nt, Human
auagugucagaaaaucauaaga

SEQ ID NO: 314819 - RNA, 22 nt, Human
uccuuugacuucuugcagucca

SEQ ID NO: 314820 - RNA, 22 nt, Human
ggggauggaggcgugugguccu

SEQ ID NO: 314821 - RNA, 20 nt, Human
uuaucugucaaucugucuca

SEQ ID NO: 314822 - RNA, 22 nt, Human
ucagaggaaaggucagauggcu

SEQ ID NO: 314823 - RNA, 22 nt, Human
caggggcucugggugaugugag

SEQ ID NO: 314824 - RNA, 22 nt, Human
gcuggcaggagccuuucccuuu

SEQ ID NO: 314825 - RNA, 22 nt, Human
ucaagaaagggcuucaccagga

SEQ ID NO: 314826 - RNA, 22 nt, Human
uuucugaagauacagcuuugcu

SEQ ID NO: 314827 - RNA, 23 nt, Human
agccacuucuaucuugcuccugg

SEQ ID NO: 314828 - RNA, 22 nt, Human
gccuucagcggccgcucgcugc

SEQ ID NO: 314829 - RNA, 22 nt, Human
cacagaggaaaggcaguuggua

SEQ ID NO: 314830 - RNA, 22 nt, Human
aaauaauugaguuggucaauau

SEQ ID NO: 314831 - RNA, 23 nt, Human
aggagccaggugcagcccuugug

SEQ ID NO: 314832 - RNA, 22 nt, Human
guauucauauuaaacauaucaa

SEQ ID NO: 314833 - RNA, 22 nt, Human
uacauguaauuuucauaguaag

SEQ ID NO: 314834 - RNA, 22 nt, Human
agagcacaggcucuggagucua

SEQ ID NO: 314835 - RNA, 22 nt, Human
cugugcauugucuugucuguag

SEQ ID NO: 314836 - RNA, 22 nt, Human
cugagccaaggggacagugaca

SEQ ID NO: 314837 - RNA, 22 nt, Human
agccuccaaaugucaggucccg

SEQ ID NO: 314838 - RNA, 22 nt, Human
ucuuccucuagaucugaggccc

SEQ ID NO: 314839 - RNA, 22 nt, Human
agagccacugggagacagagca

SEQ ID NO: 314840 - RNA, 22 nt, Human
gugucacaagagcccaggaaac

SEQ ID NO: 314841 - RNA, 22 nt, Human
gcugccugcucggcuccuggga

SEQ ID NO: 314842 - RNA, 19 nt, Human
cucuggccucuggaugcug

SEQ ID NO: 314843 - RNA, 22 nt, Human
cccagcagaaucugaugagggc

SEQ ID NO: 314844 - RNA, 18 nt, Human
ccagagcuggcuccucgc

SEQ ID NO: 314845 - RNA, 22 nt, Human
uuucuagaggcuccaggggagu

SEQ ID NO: 314846 - RNA, 22 nt, Human
aggcccuguccauggugcugaa

SEQ ID NO: 314847 - RNA, 22 nt, Human
uucuucuucuggcugcaccugg

SEQ ID NO: 314848 - RNA, 22 nt, Human
uuauuccaauuucuccuacaaa

SEQ ID NO: 314849 - RNA, 22 nt, Human
auucauuuagguauucacuuac

SEQ ID NO: 314850 - RNA, 22 nt, Human
guggcagagguuccucagugug

SEQ ID NO: 314851 - RNA, 22 nt, Human
ccugccuguacuagagacccag

SEQ ID NO: 314852 - RNA, 22 nt, Human
acugccuugaaagauuguugag

SEQ ID NO: 314853 - RNA, 22 nt, Human
gcucagugaagggugccaagua

SEQ ID NO: 314854 - RNA, 22 nt, Human
gauuucaaaaguagauccauca

SEQ ID NO: 314855 - RNA, 22 nt, Human
gccugcaguucugugcuaggca

SEQ ID NO: 314856 - RNA, 22 nt, Human
ugugccugucacccucagagag

SEQ ID NO: 314857 - RNA, 22 nt, Human
guacaguuuucaguguucacug

SEQ ID NO: 314858 - RNA, 22 nt, Human
auucacagaauaguuuuaccag

SEQ ID NO: 314859 - RNA, 22 nt, Human
uuaauacagucuccagaaguaa

SEQ ID NO: 314860 - RNA, 22 nt, Human
acuuuucaaaugggaaacucag

SEQ ID NO: 314861 - RNA, 22 nt, Human
ggccuggaagaggacagagaaa

SEQ ID NO: 314862 - RNA, 22 nt, Human
gugaaacagaagcuccuggaau

SEQ ID NO: 314863 - RNA, 22 nt, Human
gagcuuugcuggaagccugggg

SEQ ID NO: 314864 - RNA, 20 nt, Human
agggcagagggauuacaggc

SEQ ID NO: 314865 - RNA, 22 nt, Human
augacaguucuacacuuaaucu

SEQ ID NO: 314866 - RNA, 22 nt, Human
ugguaauuuacgcauuucugua

SEQ ID NO: 314867 - RNA, 22 nt, Human
uuucaguuuaugucuugaauua

SEQ ID NO: 314868 - RNA, 20 nt, Human
gcugaccccugcugucaugc

SEQ ID NO: 314869 - RNA, 22 nt, Human
ucaguguucagggaccaggucc

SEQ ID NO: 314870 - RNA, 22 nt, Human
ugcugcauuuaucuucucaaac

SEQ ID NO: 314871 - RNA, 22 nt, Human
ugcagaaggaggaggaaaucca

SEQ ID NO: 314872 - RNA, 22 nt, Human
gaccauuugcuaguaaauugca

SEQ ID NO: 314873 - RNA, 22 nt, Human
gagagcugggaaagccguggag

SEQ ID NO: 314874 - RNA, 22 nt, Human
gugcuggggagauaggaagaga

SEQ ID NO: 314875 - RNA, 22 nt, Human
caggugggccaugaaaaaugac

SEQ ID NO: 314876 - RNA, 22 nt, Human
ggaaggucgagcugcaucuggc

SEQ ID NO: 314877 - RNA, 22 nt, Human
guugaaagagcauggacuugaa

SEQ ID NO: 314878 - RNA, 22 nt, Human
ggcucuggagcacagacgucug

SEQ ID NO: 314879 - RNA, 22 nt, Human
ccuggagcucacugggagccgg

SEQ ID NO: 314880 - RNA, 23 nt, Human
cugcugugaaacaugguuuuggu

SEQ ID NO: 314881 - RNA, 22 nt, Human
uggcucagcuuacuuuugaggg

SEQ ID NO: 314882 - RNA, 22 nt, Human
uggccugggccugccggugcaa

SEQ ID NO: 314883 - RNA, 22 nt, Human
guccucaggaaagcagauaaca

SEQ ID NO: 314884 - RNA, 22 nt, Human
aagcagauauugugggaguggg

SEQ ID NO: 314885 - RNA, 22 nt, Human
gcuguguuggugaagcuguagc

SEQ ID NO: 314886 - RNA, 22 nt, Human
ugguuccuacgcacauugaauu

SEQ ID NO: 314887 - RNA, 22 nt, Human
gaggacagugugaucugccagc

SEQ ID NO: 314888 - RNA, 22 nt, Human
uaugaagacaaugauagcauga

SEQ ID NO: 314889 - RNA, 22 nt, Human
aggcugcuggcaggcguggacg

SEQ ID NO: 314890 - RNA, 22 nt, Human
gcucuggcuacuguggcuaccg

SEQ ID NO: 314891 - RNA, 22 nt, Human
aaaggucaaaaucgugacauug

SEQ ID NO: 314892 - RNA, 22 nt, Human
uauuuucuggacagucuugcuu

SEQ ID NO: 314893 - RNA, 22 nt, Human
cauaauuuuuuuaagucagaac

SEQ ID NO: 314894 - RNA, 22 nt, Human
gcguggugcugcccugcacaca

SEQ ID NO: 314895 - RNA, 22 nt, Human
auauuguacuaggguuacaugu

SEQ ID NO: 314896 - RNA, 22 nt, Human
cuggagcaggcuugucccagcu

SEQ ID NO: 314897 - RNA, 22 nt, Human
ugccacagaggugaagcccacu

SEQ ID NO: 314898 - RNA, 22 nt, Human
acagcaggauuuggcgauguug

SEQ ID NO: 314899 - RNA, 22 nt, Human
gcagggcucaacaggacacccc

SEQ ID NO: 314900 - RNA, 22 nt, Human
ugucauaaaacacaagcuguug

SEQ ID NO: 314901 - RNA, 22 nt, Human
guuauguaugagggaaugauua

SEQ ID NO: 314902 - RNA, 20 nt, Human
gggugagauguaggagaggg

SEQ ID NO: 314903 - RNA, 22 nt, Human
gagauguacaauguguauuaau

SEQ ID NO: 314904 - RNA, 22 nt, Human
acaggcucucagccaguuggca

SEQ ID NO: 314905 - RNA, 18 nt, Human
ugagagugugugcucuug

SEQ ID NO: 314906 - RNA, 22 nt, Human
agaccaagugcaggugccacua

SEQ ID NO: 314907 - RNA, 22 nt, Human
cucugucagaguguugucccca

SEQ ID NO: 314908 - RNA, 22 nt, Human
ggcccagucuggggcccuguga

SEQ ID NO: 314909 - RNA, 22 nt, Human
acucaggaauggggcugggacu

SEQ ID NO: 314910 - RNA, 22 nt, Human
ugcccaggguggagugcagcgg

SEQ ID NO: 314911 - RNA, 23 nt, Human
gcugcagcuguggauguucucag

SEQ ID NO: 314912 - RNA, 22 nt, Human
acauucaugucccacuucuagc

SEQ ID NO: 314913 - RNA, 22 nt, Human
aauguguacuuuuucaugcuca

SEQ ID NO: 314914 - RNA, 19 nt, Human
uggcuuccaucucucucau

SEQ ID NO: 314915 - RNA, 21 nt, Human
agcugggccucagccugcagu

SEQ ID NO: 314916 - RNA, 22 nt, Human
caguggccugagccaggcuucc

SEQ ID NO: 314917 - RNA, 22 nt, Human
caggccuggggcuggcuuccag

SEQ ID NO: 314918 - RNA, 22 nt, Human
cagucccagaagagccugggag

SEQ ID NO: 314919 - RNA, 23 nt, Human
agaugagccaacaccuccaugcc

SEQ ID NO: 314920 - RNA, 22 nt, Human
cucaggauauugggcuggagca

SEQ ID NO: 314921 - RNA, 22 nt, Human
aaguuuuccuguguccaagaug

SEQ ID NO: 314922 - RNA, 22 nt, Human
agaggcccucucucuccugaug

SEQ ID NO: 314923 - RNA, 22 nt, Human
gguuugcauucugaaaggcuca

SEQ ID NO: 314924 - RNA, 22 nt, Human
cucagagaggcaguggaaguca

SEQ ID NO: 314925 - RNA, 22 nt, Human
aauuacuuaagagaaacuuuga

SEQ ID NO: 314926 - RNA, 22 nt, Human
uaaaucaguuucucuuauuggu

SEQ ID NO: 314927 - RNA, 21 nt, Human
agcuuguguguaucacagugu

SEQ ID NO: 314928 - RNA, 22 nt, Human
agcaagcuaccuagauagucua

SEQ ID NO: 314929 - RNA, 22 nt, Human
acacaggggcucggcugggugc

SEQ ID NO: 314930 - RNA, 22 nt, Human
gcaggagccaggccgagcuggu

SEQ ID NO: 314931 - RNA, 22 nt, Human
cagguggcuucucccuaggcca

SEQ ID NO: 314932 - RNA, 22 nt, Human
aaaucugguucaguaaguccuc

SEQ ID NO: 314933 - RNA, 22 nt, Human
aaaggccacuugaaggauuuuu

SEQ ID NO: 314934 - RNA, 22 nt, Human
augcacuugcguguuugcaaau

SEQ ID NO: 314935 - RNA, 23 nt, Human
uuugcaaauuggacacaaccaca

SEQ ID NO: 314936 - RNA, 22 nt, Human
uaguaucuuucuauauuuccca

SEQ ID NO: 314937 - RNA, 22 nt, Human
ugauuuccccagucuugcugcu

SEQ ID NO: 314938 - RNA, 22 nt, Human
agcaccuugcucuuggccuucc

SEQ ID NO: 314939 - RNA, 22 nt, Human
gaugagggccugguggcugugc

SEQ ID NO: 314940 - RNA, 22 nt, Human
ucuggagagucacagugccaga

SEQ ID NO: 314941 - RNA, 22 nt, Human
uucuacaugguugcucagaggg

SEQ ID NO: 314942 - RNA, 22 nt, Human
aagcagccucauuugugguaag

SEQ ID NO: 314943 - RNA, 22 nt, Human
uggccugggugcugcugacauc

SEQ ID NO: 314944 - RNA, 22 nt, Human
agcuggccuucggugucacugg

SEQ ID NO: 314945 - RNA, 22 nt, Human
ugauuuccuggcuuuggaguuc

SEQ ID NO: 314946 - RNA, 22 nt, Human
ugcugcucaaugagaugccauc

SEQ ID NO: 314947 - RNA, 22 nt, Human
cagggcugaaaucaagguguag

SEQ ID NO: 314948 - RNA, 22 nt, Human
uguucucacuggaugcuucaca

SEQ ID NO: 314949 - RNA, 22 nt, Human
gaaguucuuuauagcaguguga

SEQ ID NO: 314950 - RNA, 22 nt, Human
acaucucaugaaugauaaauca

SEQ ID NO: 314951 - RNA, 22 nt, Human
aaacucuguugagauaauauuu

SEQ ID NO: 314952 - RNA, 22 nt, Human
ugggcagauuaaugcaguggcu

SEQ ID NO: 314953 - RNA, 22 nt, Human
cauuucugauuacagaauacua

SEQ ID NO: 314954 - RNA, 21 nt, Human
guggcucugccaggacugaaa

SEQ ID NO: 314955 - RNA, 17 nt, Human
gcuguaguuugauaaga

SEQ ID NO: 314956 - RNA, 22 nt, Human
cacucugcagcugaagggcugg

SEQ ID NO: 314957 - RNA, 22 nt, Human
ugucccagacacaguaugcgcu

SEQ ID NO: 314958 - RNA, 22 nt, Human
ccaggagcauuaagagaacaua

SEQ ID NO: 314959 - RNA, 22 nt, Human
cagggccugcuuccuucuuguu

SEQ ID NO: 314960 - RNA, 22 nt, Human
gagccuggauugucaccgacuu

SEQ ID NO: 314961 - RNA, 22 nt, Human
cuuaagaugaggucaugcuaua

SEQ ID NO: 314962 - RNA, 22 nt, Human
agugcugucccgacaacugagg

SEQ ID NO: 314963 - RNA, 22 nt, Human
acaguguuucacuuaaccguuu

SEQ ID NO: 314964 - RNA, 22 nt, Human
cagaccugggucccuggccugu

SEQ ID NO: 314965 - RNA, 22 nt, Human
gccucaguggcuuuaggaguuc

SEQ ID NO: 314966 - RNA, 20 nt, Human
auguagaugaaagcaaaggc

SEQ ID NO: 314967 - RNA, 22 nt, Human
gggcuucucccuaaggacucug

SEQ ID NO: 314968 - RNA, 22 nt, Human
ggcccaguguaccccaggcagu

SEQ ID NO: 314969 - RNA, 22 nt, Human
ccagaggugcugggagaggucu

SEQ ID NO: 314970 - RNA, 22 nt, Human
gggcugugagaguggggcugcu

SEQ ID NO: 314971 - RNA, 22 nt, Human
cagacagacagccguggccacc

SEQ ID NO: 314972 - RNA, 22 nt, Human
gagagaaaugugcaguuugggc

SEQ ID NO: 314973 - RNA, 22 nt, Human
gugguaauagagcuccaaacua

SEQ ID NO: 314974 - RNA, 22 nt, Human
uuauguaauuuguuugcucuuc

SEQ ID NO: 314975 - RNA, 22 nt, Human
ugcagaccucccauggcugccu

SEQ ID NO: 314976 - RNA, 22 nt, Human
uucaagaugcacaguggcauuc

SEQ ID NO: 314977 - RNA, 22 nt, Human
uuucaauguaacauuuccaggc

SEQ ID NO: 314978 - RNA, 22 nt, Human
gcuguucacggaggaggauggg

SEQ ID NO: 314979 - RNA, 22 nt, Human
cagagcaguaaaucuggggcac

SEQ ID NO: 314980 - RNA, 22 nt, Human
guccugggccugcugaggcuga

SEQ ID NO: 314981 - RNA, 23 nt, Human
cagcccugaaaucgaggugacac

SEQ ID NO: 314982 - RNA, 22 nt, Human
cccaagcagggugcagaggcau

SEQ ID NO: 314983 - RNA, 22 nt, Human
gccagcccagcuccaggggaaa

SEQ ID NO: 314984 - RNA, 22 nt, Human
ucaggggcugugcauuucccag

SEQ ID NO: 314985 - RNA, 22 nt, Human
cugggcugcaggaguggggcaa

SEQ ID NO: 314986 - RNA, 22 nt, Human
guuuucuuugaaugcuucuaga

SEQ ID NO: 314987 - RNA, 22 nt, Human
ugcucccaggcauucucuguug

SEQ ID NO: 314988 - RNA, 22 nt, Human
acugaaggcuuaacucuuucau

SEQ ID NO: 314989 - RNA, 22 nt, Human
uaaggccaccguuauagaacca

SEQ ID NO: 314990 - RNA, 22 nt, Human
ugcaccauuaauuuaugugaga

SEQ ID NO: 314991 - RNA, 22 nt, Human
uugcauugcuuggucuucaaga

SEQ ID NO: 314992 - RNA, 22 nt, Human
gccaucacauccaggcuaccuc

SEQ ID NO: 314993 - RNA, 22 nt, Human
gcuggcagaagagcugguucaa

SEQ ID NO: 314994 - RNA, 22 nt, Human
auguaugauauuuccaguauca

SEQ ID NO: 314995 - RNA, 20 nt, Human
cucuccuugccgacuuggca

SEQ ID NO: 314996 - RNA, 22 nt, Human
gcaaggcugugcacuuugcauu

SEQ ID NO: 314997 - RNA, 23 nt, Human
aagcugccagucugaagccuggg

SEQ ID NO: 314998 - RNA, 22 nt, Human
aauguaugcugugguaucuucu

SEQ ID NO: 314999 - RNA, 22 nt, Human
ggaaggaggaugcucuggccuu

SEQ ID NO: 315000 - RNA, 22 nt, Human
ugcacagugaccccuggugacu

SEQ ID NO: 315001 - RNA, 22 nt, Human
cagcagcuggugagacacagcc

SEQ ID NO: 315002 - RNA, 22 nt, Human
ucucacugggucacagcagagg

SEQ ID NO: 315003 - RNA, 22 nt, Human
augcuguggccagaguucaacu

SEQ ID NO: 315004 - RNA, 22 nt, Human
ucucagggcagcaaggaagcau

SEQ ID NO: 315005 - RNA, 22 nt, Human
ccucaguguuaggauaagagaa

SEQ ID NO: 315006 - RNA, 22 nt, Human
uccagggacagcgcuggagcua

SEQ ID NO: 315007 - RNA, 22 nt, Human
cgggcuggcugcagcugcugga

SEQ ID NO: 315008 - RNA, 22 nt, Human
gaggccugguuuccagcauccu

SEQ ID NO: 315009 - RNA, 17 nt, Human
uguuccauuugaccacc

SEQ ID NO: 315010 - RNA, 22 nt, Human
cagugcagaacacauggaaaau

SEQ ID NO: 315011 - RNA, 22 nt, Human
ucauggcacuuagcacaguccu

SEQ ID NO: 315012 - RNA, 22 nt, Human
aauaaauguuaagauugucuca

SEQ ID NO: 315013 - RNA, 22 nt, Human
aacauauaaacucuuaaguuca

SEQ ID NO: 315014 - RNA, 22 nt, Human
uccugccucuugccuucuucac

SEQ ID NO: 315015 - RNA, 20 nt, Human
cuguccccgaggucaccagg

SEQ ID NO: 315016 - RNA, 22 nt, Human
acagcagcuugcgugucugguc

SEQ ID NO: 315017 - RNA, 22 nt, Human
cucugcaugccuugcucagaca

SEQ ID NO: 315018 - RNA, 22 nt, Human
ccaggcucugucuggucagaag

SEQ ID NO: 315019 - RNA, 22 nt, Human
cagacaggcuagccagacucac

SEQ ID NO: 315020 - RNA, 22 nt, Human
gaggaguggaguugcuggguug

SEQ ID NO: 315021 - RNA, 22 nt, Human
cagccagggucaggcagcuucu

SEQ ID NO: 315022 - RNA, 22 nt, Human
aucuauuaugcugagaaacugu

SEQ ID NO: 315023 - RNA, 23 nt, Human
aucagucuugguagcugugccca

SEQ ID NO: 315024 - RNA, 22 nt, Human
acauuucuuccacaugcugcug

SEQ ID NO: 315025 - RNA, 20 nt, Human
uauuucugggcaaccauuua

SEQ ID NO: 315026 - RNA, 22 nt, Human
ggaccagagcucgggcuucuca

SEQ ID NO: 315027 - RNA, 22 nt, Human
agcccucauggaacagcuccua

SEQ ID NO: 315028 - RNA, 22 nt, Human
ccugggaggcagagguugcagu

SEQ ID NO: 315029 - RNA, 22 nt, Human
uuagaaauacaagugagguuga

SEQ ID NO: 315030 - RNA, 19 nt, Human
agccuggcuuugcucugcu

SEQ ID NO: 315031 - RNA, 22 nt, Human
uggagggcgcuuagauggaggg

SEQ ID NO: 315032 - RNA, 23 nt, Human
auaauaacgucugucuugucucu

SEQ ID NO: 315033 - RNA, 22 nt, Human
ggaaaaggccauuguuucucug

SEQ ID NO: 315034 - RNA, 22 nt, Human
cccagcaucuccaggcauggcc

SEQ ID NO: 315035 - RNA, 22 nt, Human
acuuugcacuaaguuacucauu

SEQ ID NO: 315036 - RNA, 22 nt, Human
uucucacuauguauguagauug

SEQ ID NO: 315037 - RNA, 22 nt, Human
gccuaggaguggggauggcggu

SEQ ID NO: 315038 - RNA, 22 nt, Human
auauucuuccaaaacaucauuu

SEQ ID NO: 315039 - RNA, 22 nt, Human
uccagcccgacugggccugccg

SEQ ID NO: 315040 - RNA, 22 nt, Human
cgugucaucugagccuugggcg

SEQ ID NO: 315041 - RNA, 22 nt, Human
uagucuuuuuaauaaauaaugc

SEQ ID NO: 315042 - RNA, 21 nt, Human
ggagcuggggagcuggcccca

SEQ ID NO: 315043 - RNA, 22 nt, Human
gaggagaggccaucguuguuau

SEQ ID NO: 315044 - RNA, 22 nt, Human
uucaaagugcauguuccucaga

SEQ ID NO: 315045 - RNA, 22 nt, Human
ccugucugcaugaucccugcca

SEQ ID NO: 315046 - RNA, 22 nt, Human
ugcugcuccccagcacacagca

SEQ ID NO: 315047 - RNA, 22 nt, Human
cagggccucuccuccaggaacu

SEQ ID NO: 315048 - RNA, 22 nt, Human
aaaguucugggggagaagaacg

SEQ ID NO: 315049 - RNA, 22 nt, Human
aaugaugguuucaucacuugaa

SEQ ID NO: 315050 - RNA, 22 nt, Human
ucacaggcuccagggccuggau

SEQ ID NO: 315051 - RNA, 22 nt, Human
aaaggucauugaaaaggaggaa

SEQ ID NO: 315052 - RNA, 22 nt, Human
acagguggaggcuuuaggaggu

SEQ ID NO: 315053 - RNA, 22 nt, Human
augcugggacguacuuguucau

SEQ ID NO: 315054 - RNA, 22 nt, Human
gccccuucguggaagugcauuc

SEQ ID NO: 315055 - RNA, 22 nt, Human
auugaaagcauggauuuggauu

SEQ ID NO: 315056 - RNA, 22 nt, Human
acagaauauugguuacuguugc

SEQ ID NO: 315057 - RNA, 22 nt, Human
ggucucuguugccuccaucaag

SEQ ID NO: 315058 - RNA, 22 nt, Human
acaaaguuauucuuucagagga

SEQ ID NO: 315059 - RNA, 22 nt, Human
ccucagugagaugcucagcgaa

SEQ ID NO: 315060 - RNA, 22 nt, Human
cugccuggaccggcagcccucc

SEQ ID NO: 315061 - RNA, 22 nt, Human
ugccugucuccucugcagggug

SEQ ID NO: 315062 - RNA, 22 nt, Human
aagcagccaccucaucuccacu

SEQ ID NO: 315063 - RNA, 18 nt, Human
cuccagggaacucaguca

SEQ ID NO: 315064 - RNA, 22 nt, Human
uggagccuguguuucugcccag

SEQ ID NO: 315065 - RNA, 17 nt, Human
uggcuucccugggccac

SEQ ID NO: 315066 - RNA, 22 nt, Human
cagggccuccccggcagucuuu

SEQ ID NO: 315067 - RNA, 22 nt, Human
cagugcuccugauguacccuug

SEQ ID NO: 315068 - RNA, 19 nt, Human
auguaugaggucuucugcu

SEQ ID NO: 315069 - RNA, 22 nt, Human
acagauauuuggggaaagacgu

SEQ ID NO: 315070 - RNA, 22 nt, Human
ucuguucaugaaauaucuuuuu

SEQ ID NO: 315071 - RNA, 22 nt, Human
agaccaagaaaggaugaggauc

SEQ ID NO: 315072 - RNA, 22 nt, Human
ucucagagagcuguguuuuccu

SEQ ID NO: 315073 - RNA, 22 nt, Human
gggucucucucggcuccacgcg

SEQ ID NO: 315074 - RNA, 22 nt, Human
cuguagcagugugcucuuuuuc

SEQ ID NO: 315075 - RNA, 22 nt, Human
gagagguccauuccccugucag

SEQ ID NO: 315076 - RNA, 22 nt, Human
ucuggcccagccccugagguca

SEQ ID NO: 315077 - RNA, 22 nt, Human
gagggcagagucuaaugaugca

SEQ ID NO: 315078 - RNA, 22 nt, Human
ugcugccucagcuuccugggcu

SEQ ID NO: 315079 - RNA, 22 nt, Human
acauacauaugacaacuuuccu

SEQ ID NO: 315080 - RNA, 22 nt, Human
cagccugcccuggaagcccagc

SEQ ID NO: 315081 - RNA, 22 nt, Human
agccuggagaggcgccauacac

SEQ ID NO: 315082 - RNA, 22 nt, Human
cccuggaggaccccaauguggc

SEQ ID NO: 315083 - RNA, 20 nt, Human
cucucccagcacagcuuccu

SEQ ID NO: 315084 - RNA, 22 nt, Human
cuguuuauuacacuggauagca

SEQ ID NO: 315085 - RNA, 21 nt, Human
gcacagcaugaguguuggcau

SEQ ID NO: 315086 - RNA, 21 nt, Human
aagaagcaauuuauuggaagg

SEQ ID NO: 315087 - RNA, 22 nt, Human
uggagcaggugccaggugugug

SEQ ID NO: 315088 - RNA, 22 nt, Human
guccuggggauuauagaguguu

SEQ ID NO: 315089 - RNA, 22 nt, Human
ucaaauaugugauagaagcuaa

SEQ ID NO: 315090 - RNA, 22 nt, Human
agccuggcccugcugaacucug

SEQ ID NO: 315091 - RNA, 22 nt, Human
cagcuugggucaggugccugcu

SEQ ID NO: 315092 - RNA, 22 nt, Human
ugcccugcagugagugcgucug

SEQ ID NO: 315093 - RNA, 22 nt, Human
gccauccucugagcacuaggca

SEQ ID NO: 315094 - RNA, 22 nt, Human
ucaggggagguugaaucgucuc

SEQ ID NO: 315095 - RNA, 22 nt, Human
cucagagucugcauuucuguca

SEQ ID NO: 315096 - RNA, 22 nt, Human
augucuaaaagauaaaguuuaa

SEQ ID NO: 315097 - RNA, 21 nt, Human
uguucacauggagcagaaugu

SEQ ID NO: 315098 - RNA, 22 nt, Human
aggccugucuggggcucagcca

SEQ ID NO: 315099 - RNA, 22 nt, Human
ggcucaggggccaggccugucc

SEQ ID NO: 315100 - RNA, 22 nt, Human
aggccuggccuuuauguucaag

SEQ ID NO: 315101 - RNA, 22 nt, Human
gggccaugagagguucaucaac

SEQ ID NO: 315102 - RNA, 22 nt, Human
cugcagccuccugggguacaug

SEQ ID NO: 315103 - RNA, 22 nt, Human
ggagccuggccuggcucugugu

SEQ ID NO: 315104 - RNA, 22 nt, Human
ucccuggggauguuggccugcc

SEQ ID NO: 315105 - RNA, 22 nt, Human
uuucagaucacuuucaggaaag

SEQ ID NO: 315106 - RNA, 22 nt, Human
gggcucugcgcucagcuccagc

SEQ ID NO: 315107 - RNA, 22 nt, Human
ugggguggauagaaagugaugu

SEQ ID NO: 315108 - RNA, 22 nt, Human
gagccagguuugaaucucaguc

SEQ ID NO: 315109 - RNA, 22 nt, Human
aagcuuucagagcagaauguga

SEQ ID NO: 315110 - RNA, 22 nt, Human
cugcuguggaugcaggaccuca

SEQ ID NO: 315111 - RNA, 22 nt, Human
gcagccagaagacucagaacaa

SEQ ID NO: 315112 - RNA, 22 nt, Human
agcuggggcugcagagaacagg

SEQ ID NO: 315113 - RNA, 22 nt, Human
uucuuuuccuacacagcgauuu

SEQ ID NO: 315114 - RNA, 22 nt, Human
uguaugaauauguauuuucaua

SEQ ID NO: 315115 - RNA, 22 nt, Human
aaaagcucuuucugcuguagau

SEQ ID NO: 315116 - RNA, 22 nt, Human
acuuggcaaguaucuauaaagu

SEQ ID NO: 315117 - RNA, 22 nt, Human
agcuggccuuagugagcaccug

SEQ ID NO: 315118 - RNA, 22 nt, Human
ccagcuccgggaguugcugcug

SEQ ID NO: 315119 - RNA, 22 nt, Human
uuuuaucugcuucauuaguuga

SEQ ID NO: 315120 - RNA, 22 nt, Human
ccuggcagcuaagugcuuugag

SEQ ID NO: 315121 - RNA, 22 nt, Human
uccagcagcccgaaggcccauc

SEQ ID NO: 315122 - RNA, 22 nt, Human
gggggcuggacuuucccacaca

SEQ ID NO: 315123 - RNA, 22 nt, Human
guaaaauucuagcaucugaaag

SEQ ID NO: 315124 - RNA, 22 nt, Human
ggaaggggagcuggaaagggua

SEQ ID NO: 315125 - RNA, 22 nt, Human
cugagccauccauaccagcuua

SEQ ID NO: 315126 - RNA, 22 nt, Human
gcugccugucccaggaugagga

SEQ ID NO: 315127 - RNA, 22 nt, Human
ggucaggguuccagguaucuuc

SEQ ID NO: 315128 - RNA, 22 nt, Human
uucagcagugcagacacccagu

SEQ ID NO: 315129 - RNA, 22 nt, Human
gccaggcagccacccucugcga

SEQ ID NO: 315130 - RNA, 22 nt, Human
uuucacagcuggguggcagagu

SEQ ID NO: 315131 - RNA, 22 nt, Human
ccaggguggggcaggcccacug

SEQ ID NO: 315132 - RNA, 22 nt, Human
aggcagagcuggguuuugaaau

SEQ ID NO: 315133 - RNA, 22 nt, Human
uguggcugucuguucuccuagg

SEQ ID NO: 315134 - RNA, 18 nt, Human
gcagagcugggauuccca

SEQ ID NO: 315135 - RNA, 22 nt, Human
uacaguaaccagucuacuuaga

SEQ ID NO: 315136 - RNA, 22 nt, Human
aguggcagagguugacugcagu

SEQ ID NO: 315137 - RNA, 22 nt, Human
uucaaauacauucuuugccacu

SEQ ID NO: 315138 - RNA, 22 nt, Human
uucauugugauucuuggcuagc

SEQ ID NO: 315139 - RNA, 22 nt, Human
aguguguguuugggcgguuuau

SEQ ID NO: 315140 - RNA, 22 nt, Human
gcuuuggaugugugccugaggu

SEQ ID NO: 315141 - RNA, 22 nt, Human
aauggccagcugggagaguuga

SEQ ID NO: 315142 - RNA, 22 nt, Human
aaaucaguucacguucugaggu

SEQ ID NO: 315143 - RNA, 22 nt, Human
cucagggcuugaguguccagga

SEQ ID NO: 315144 - RNA, 22 nt, Human
caggcacugugcuagauccuug

SEQ ID NO: 315145 - RNA, 19 nt, Human
cugucaggggcuggauguu

SEQ ID NO: 315146 - RNA, 21 nt, Human
cucaaagaccaaaaguguaga

SEQ ID NO: 315147 - RNA, 22 nt, Human
uugaaaggaauacagaggccua

SEQ ID NO: 315148 - RNA, 22 nt, Human
ucacccuugauaauguucuucu

SEQ ID NO: 315149 - RNA, 22 nt, Human
agagcccugaagcagagcuaaa

SEQ ID NO: 315150 - RNA, 22 nt, Human
ggcagaggagcuggaaacaugg

SEQ ID NO: 315151 - RNA, 22 nt, Human
ccauuguaguaucuguuuuagu

SEQ ID NO: 315152 - RNA, 22 nt, Human
uggccugguaccacauagauuu

SEQ ID NO: 315153 - RNA, 22 nt, Human
gcucccaggaugaggagccagg

SEQ ID NO: 315154 - RNA, 22 nt, Human
gggccuggggugacguaccccu

SEQ ID NO: 315155 - RNA, 22 nt, Human
uggucuuuaagguagcugucau

SEQ ID NO: 315156 - RNA, 22 nt, Human
ggcagcucacugauuagcaauu

SEQ ID NO: 315157 - RNA, 22 nt, Human
guuuccaaccccaccaaagugc

SEQ ID NO: 315158 - RNA, 22 nt, Human
uaaagguagugugacauauugu

SEQ ID NO: 315159 - RNA, 22 nt, Human
ggcucuggugggaagguuagau

SEQ ID NO: 315160 - RNA, 22 nt, Human
ugcagaagauggucugagcacc

SEQ ID NO: 315161 - RNA, 22 nt, Human
gccaggccugcaagugcuggug

SEQ ID NO: 315162 - RNA, 22 nt, Human
gccuggcuccuaagagcacaac

SEQ ID NO: 315163 - RNA, 22 nt, Human
aggcacuguucccaguuauccu

SEQ ID NO: 315164 - RNA, 22 nt, Human
ucuuggaaucuccauagaguga

SEQ ID NO: 315165 - RNA, 22 nt, Human
cagccagaaccuaggaugagcu

SEQ ID NO: 315166 - RNA, 22 nt, Human
uagcacauaacuuagaauaguu

SEQ ID NO: 315167 - RNA, 22 nt, Human
ccuggcuuccuggagcucacaa

SEQ ID NO: 315168 - RNA, 22 nt, Human
agggggaggcugugcugcgucu

SEQ ID NO: 315169 - RNA, 22 nt, Human
uaagacauuugaaaugugaucc

SEQ ID NO: 315170 - RNA, 20 nt, Human
gcccacucuaauccacuguc

SEQ ID NO: 315171 - RNA, 22 nt, Human
augcauaauguauguauugacu

SEQ ID NO: 315172 - RNA, 23 nt, Human
cacugcagcguggucuggcagga

SEQ ID NO: 315173 - RNA, 22 nt, Human
cccagcuccgagcuccgagccg

SEQ ID NO: 315174 - RNA, 22 nt, Human
aaguauauuuuuugaagcauau

SEQ ID NO: 315175 - RNA, 22 nt, Human
augauugaccaucugcugggcu

SEQ ID NO: 315176 - RNA, 22 nt, Human
ugggaggaucgcuugagcccag

SEQ ID NO: 315177 - RNA, 22 nt, Human
ucaccuuagcuagaggaagaga

SEQ ID NO: 315178 - RNA, 22 nt, Human
cagcuggggcagccacgugcgg

SEQ ID NO: 315179 - RNA, 22 nt, Human
uuaacacauauuuaucaauugc

SEQ ID NO: 315180 - RNA, 22 nt, Human
aaacucuggauuggaguccagc

SEQ ID NO: 315181 - RNA, 22 nt, Human
cacuguguaagaagaugggcuu

SEQ ID NO: 315182 - RNA, 22 nt, Human
ggcagcucugaugaugcucugg

SEQ ID NO: 315183 - RNA, 22 nt, Human
ugggcagaucuuugguggcuag

SEQ ID NO: 315184 - RNA, 21 nt, Human
ccucuggcuugugcugugccc

SEQ ID NO: 315185 - RNA, 20 nt, Human
gucagugucuucaguaguga

SEQ ID NO: 315186 - RNA, 22 nt, Human
uguggccaccagagcugcuauu

SEQ ID NO: 315187 - RNA, 22 nt, Human
uauaacacucagaaagaaucau

SEQ ID NO: 315188 - RNA, 22 nt, Human
uagcaguggaaucuuuugucca

SEQ ID NO: 315189 - RNA, 20 nt, Human
cccugagaccagagagcagc

SEQ ID NO: 315190 - RNA, 22 nt, Human
uccagagguauguagagaguau

SEQ ID NO: 315191 - RNA, 22 nt, Human
ugacaguuaagguauacauuca

SEQ ID NO: 315192 - RNA, 22 nt, Human
uucacagucacccuucuccaug

SEQ ID NO: 315193 - RNA, 22 nt, Human
ccacagggcacaagggagguug

SEQ ID NO: 315194 - RNA, 22 nt, Human
agacaugucaccaauucuuacu

SEQ ID NO: 315195 - RNA, 22 nt, Human
aggcucugcagugcuggaggac

SEQ ID NO: 315196 - RNA, 22 nt, Human
agcuggaggauaacucacuucu

SEQ ID NO: 315197 - RNA, 22 nt, Human
guucuccauucagcuuccugug

SEQ ID NO: 315198 - RNA, 20 nt, Human
cccagggaccugagcuccau

SEQ ID NO: 315199 - RNA, 22 nt, Human
uggcuuccugcauggauccucu

SEQ ID NO: 315200 - RNA, 22 nt, Human
cuuauguauauuuggaacguac

SEQ ID NO: 315201 - RNA, 22 nt, Human
cugcagagcaaguaacauccuc

SEQ ID NO: 315202 - RNA, 22 nt, Human
cacagugucugugcuucagugu

SEQ ID NO: 315203 - RNA, 22 nt, Human
ugggcucugcaucagugcccau

SEQ ID NO: 315204 - RNA, 22 nt, Human
ugaaacaaugugaaguugcuga

SEQ ID NO: 315205 - RNA, 22 nt, Human
ccugccugaaggucagccaccc

SEQ ID NO: 315206 - RNA, 22 nt, Human
uucuucaguuugguaaauguaa

SEQ ID NO: 315207 - RNA, 22 nt, Human
ggugggcaacauuuggccugag

SEQ ID NO: 315208 - RNA, 20 nt, Human
gcagagcuguucugugggga

SEQ ID NO: 315209 - RNA, 22 nt, Human
ugcccacauucaaaaggugaug

SEQ ID NO: 315210 - RNA, 22 nt, Human
gcugucuucacuuccugguuuc

SEQ ID NO: 315211 - RNA, 22 nt, Human
gaaguucuuagucucauuugca

SEQ ID NO: 315212 - RNA, 22 nt, Human
cagucucuaaaucaaucugaau

SEQ ID NO: 315213 - RNA, 22 nt, Human
gcagagccccauugcuggcggg

SEQ ID NO: 315214 - RNA, 22 nt, Human
ggcacugacacuagcauggcac

SEQ ID NO: 315215 - RNA, 22 nt, Human
ugaccuauuagauuuccuugcc

SEQ ID NO: 315216 - RNA, 19 nt, Human
aaacacagauuucuuacca

SEQ ID NO: 315217 - RNA, 22 nt, Human
cuuccucccccacacacucacu

SEQ ID NO: 315218 - RNA, 17 nt, Human
agcuccugcccauggcu

SEQ ID NO: 315219 - RNA, 20 nt, Human
aggcagacaaggagucuguu

SEQ ID NO: 315220 - RNA, 22 nt, Human
uguccacaucacucacuuguca

SEQ ID NO: 315221 - RNA, 22 nt, Human
ugaaaugauguacaagaaggca

SEQ ID NO: 315222 - RNA, 22 nt, Human
ugggggagauugugcaucucua

SEQ ID NO: 315223 - RNA, 22 nt, Human
ccuugcauauauuauaucuuug

SEQ ID NO: 315224 - RNA, 22 nt, Human
auucugucuaagcuggcuacgu

SEQ ID NO: 315225 - RNA, 22 nt, Human
gcugcccugugguccagcaggu

SEQ ID NO: 315226 - RNA, 22 nt, Human
gcaggggcuaaggacacagaga

SEQ ID NO: 315227 - RNA, 23 nt, Human
agaaaagcuuggacacauggccu

SEQ ID NO: 315228 - RNA, 22 nt, Human
ugaaacacugcgauaaaauccu

SEQ ID NO: 315229 - RNA, 22 nt, Human
agucagugaaaacuagaauguu

SEQ ID NO: 315230 - RNA, 22 nt, Human
uacauucuacuuuuucacuccc

SEQ ID NO: 315231 - RNA, 23 nt, Human
ccaggcaguagcuauugaaguga

SEQ ID NO: 315232 - RNA, 22 nt, Human
cccuggguucuggcugggcugc

SEQ ID NO: 315233 - RNA, 22 nt, Human
gcccagcaggacagagugguuu

SEQ ID NO: 315234 - RNA, 19 nt, Human
ggccccucucacaggaguu

SEQ ID NO: 315235 - RNA, 22 nt, Human
aaugagcuagaccugcuuccuc

SEQ ID NO: 315236 - RNA, 22 nt, Human
auggacaggaacucccuuggca

SEQ ID NO: 315237 - RNA, 22 nt, Human
cacaggagguuaggaagugguc

SEQ ID NO: 315238 - RNA, 22 nt, Human
cuggagcagguuuaggaguccc

SEQ ID NO: 315239 - RNA, 22 nt, Human
aaucagaaaauucaguggaauu

SEQ ID NO: 315240 - RNA, 22 nt, Human
acagcagagugugagauagcca

SEQ ID NO: 315241 - RNA, 22 nt, Human
acucucagaggguggcagcaau

SEQ ID NO: 315242 - RNA, 19 nt, Human
ccagcagcuuugauucucu

SEQ ID NO: 315243 - RNA, 22 nt, Human
ucccagaguauuagcaauugcu

SEQ ID NO: 315244 - RNA, 22 nt, Human
uggagcuggaauuugagcugga

SEQ ID NO: 315245 - RNA, 23 nt, Human
agcagggccagaauacuugcugu

SEQ ID NO: 315246 - RNA, 22 nt, Human
caggauccuggcugcauggacg

SEQ ID NO: 315247 - RNA, 22 nt, Human
gggccuggcaugcagccccguu

SEQ ID NO: 315248 - RNA, 22 nt, Human
cuugauguauaaguugauaugu

SEQ ID NO: 315249 - RNA, 22 nt, Human
ggcagcuguaagaugagugaau

SEQ ID NO: 315250 - RNA, 22 nt, Human
acugaaagauaaaucaguuagc

SEQ ID NO: 315251 - RNA, 22 nt, Human
augcugugucuagcaggaacac

SEQ ID NO: 315252 - RNA, 22 nt, Human
agccccacacucucucugagaa

SEQ ID NO: 315253 - RNA, 20 nt, Human
agccagaagaaggcuggaga

SEQ ID NO: 315254 - RNA, 22 nt, Human
uuucaucuuccuuggcauaggu

SEQ ID NO: 315255 - RNA, 22 nt, Human
ucacauuuuaucuauuuuaagu

SEQ ID NO: 315256 - RNA, 22 nt, Human
ccucagugugcagcagcaucug

SEQ ID NO: 315257 - RNA, 22 nt, Human
ucuguucagguuucagagaacu

SEQ ID NO: 315258 - RNA, 22 nt, Human
cuuccugcauugugccagaguu

SEQ ID NO: 315259 - RNA, 22 nt, Human
cauuugaauuguucugugggaa

SEQ ID NO: 315260 - RNA, 22 nt, Human
cugacucagcagcugaugaucc

SEQ ID NO: 315261 - RNA, 22 nt, Human
ugccucugguuaucugguaccu

SEQ ID NO: 315262 - RNA, 23 nt, Human
augcaguauaugucaguaguuua

SEQ ID NO: 315263 - RNA, 22 nt, Human
uagcugugagcacccaggcugu

SEQ ID NO: 315264 - RNA, 22 nt, Human
uuacaaagagaaguuguagaau

SEQ ID NO: 315265 - RNA, 22 nt, Human
gcugucacauuuggagcacugg

SEQ ID NO: 315266 - RNA, 22 nt, Human
acagguggagugguuagcaggc

SEQ ID NO: 315267 - RNA, 22 nt, Human
ccacagggcacagacaggaagc

SEQ ID NO: 315268 - RNA, 22 nt, Human
ugcauauuauguguaucugucu

SEQ ID NO: 315269 - RNA, 22 nt, Human
cauuuguuuagaagucuuuaua

SEQ ID NO: 315270 - RNA, 22 nt, Human
uaugagaauuugcuaauuggcu

SEQ ID NO: 315271 - RNA, 22 nt, Human
cagagcugauuggauccagaga

SEQ ID NO: 315272 - RNA, 22 nt, Human
aggcacugcuucuaaguaggaa

SEQ ID NO: 315273 - RNA, 22 nt, Human
ucagaagcauguggggagccug

SEQ ID NO: 315274 - RNA, 21 nt, Human
agaaaaaccagcauguuuuca

SEQ ID NO: 315275 - RNA, 22 nt, Human
ccagagcccagggucaugcagg

SEQ ID NO: 315276 - RNA, 22 nt, Human
ucucagagcaucauuuucuuag

SEQ ID NO: 315277 - RNA, 19 nt, Human
cuugguuaugguaugaugc

SEQ ID NO: 315278 - RNA, 22 nt, Human
uggaaggcaacggagugagcug

SEQ ID NO: 315279 - RNA, 22 nt, Human
ugcugccuuagcagccaggcaa

SEQ ID NO: 315280 - RNA, 22 nt, Human
uccagagggcgauggcuggggg

SEQ ID NO: 315281 - RNA, 22 nt, Human
auucaguaggucuagaauaaga

SEQ ID NO: 315282 - RNA, 22 nt, Human
auuucaaggcuauuaauauaaa

SEQ ID NO: 315283 - RNA, 22 nt, Human
acuguucaucucuuagaaagua

SEQ ID NO: 315284 - RNA, 22 nt, Human
ucucuguacaguacaugccgug

SEQ ID NO: 315285 - RNA, 22 nt, Human
uuugaaaggguuaugagacuga

SEQ ID NO: 315286 - RNA, 22 nt, Human
ggagggcaucaaucaggccugg

SEQ ID NO: 315287 - RNA, 22 nt, Human
cuggcuccuccaaggccuggag

SEQ ID NO: 315288 - RNA, 22 nt, Human
aaugcacacauuugguacugaa

SEQ ID NO: 315289 - RNA, 22 nt, Human
aauucuagcauugugaaaauau

SEQ ID NO: 315290 - RNA, 22 nt, Human
agcuccuggcaaggucauggug

SEQ ID NO: 315291 - RNA, 22 nt, Human
ggguccagcgacagcaggcuca

SEQ ID NO: 315292 - RNA, 22 nt, Human
ggacuggacucucaggcucaca

SEQ ID NO: 315293 - RNA, 22 nt, Human
cccugcagcuuuugcauaguca

SEQ ID NO: 315294 - RNA, 22 nt, Human
uucauacaguggcugcacucca

SEQ ID NO: 315295 - RNA, 20 nt, Human
ccugucuccucuuaccuggc

SEQ ID NO: 315296 - RNA, 22 nt, Human
acauuuuuauucaucaaagcag

SEQ ID NO: 315297 - RNA, 22 nt, Human
uaggacauguguuuuauauaug

SEQ ID NO: 315298 - RNA, 22 nt, Human
aaaggccagguuggcugguauu

SEQ ID NO: 315299 - RNA, 22 nt, Human
cagcuggcgggcagagccgcca

SEQ ID NO: 315300 - RNA, 22 nt, Human
aucucccagccacagcauucuu

SEQ ID NO: 315301 - RNA, 21 nt, Human
acagcagggcuggcaugacag

SEQ ID NO: 315302 - RNA, 22 nt, Human
ccagccuggagggcaguggugg

SEQ ID NO: 315303 - RNA, 19 nt, Human
accaggcuuauggucagug

SEQ ID NO: 315304 - RNA, 22 nt, Human
aucuuugugcuaauguaguucu

SEQ ID NO: 315305 - RNA, 22 nt, Human
ucagaggaauaaugcugcauuu

SEQ ID NO: 315306 - RNA, 22 nt, Human
caguuucuauggcugggcucug

SEQ ID NO: 315307 - RNA, 22 nt, Human
guuauguaaucuaacacucagu

SEQ ID NO: 315308 - RNA, 22 nt, Human
uaugagaaauuauaccuagguu

SEQ ID NO: 315309 - RNA, 22 nt, Human
ccaaggaguagagcaggaagcu

SEQ ID NO: 315310 - RNA, 22 nt, Human
gagagugagauaauuucacaua

SEQ ID NO: 315311 - RNA, 22 nt, Human
ccaaagugcugggguuacaggc

SEQ ID NO: 315312 - RNA, 22 nt, Human
auguaugaagcuuuguuuggga

SEQ ID NO: 315313 - RNA, 22 nt, Human
acagugcuaaacacuucuugaa

SEQ ID NO: 315314 - RNA, 22 nt, Human
agcuuccuguugagagagggag

SEQ ID NO: 315315 - RNA, 22 nt, Human
cugcugggaaggucugcucagu

SEQ ID NO: 315316 - RNA, 22 nt, Human
uccugaggcuaaagugcagugg

SEQ ID NO: 315317 - RNA, 22 nt, Human
agcuggagaugcccagcaccgg

SEQ ID NO: 315318 - RNA, 22 nt, Human
ugaagcaggaaacuucuuguuu

SEQ ID NO: 315319 - RNA, 22 nt, Human
ugcugcacucaccaacagauaa

SEQ ID NO: 315320 - RNA, 22 nt, Human
ccagacuguggaguuccuggug

SEQ ID NO: 315321 - RNA, 22 nt, Human
gccuccugaaaggaagagcucc

SEQ ID NO: 315322 - RNA, 20 nt, Human
gugcauuucaccuguacugu

SEQ ID NO: 315323 - RNA, 22 nt, Human
ucagaggacaagcucccuggug

SEQ ID NO: 315324 - RNA, 22 nt, Human
ugccuaggaaaccucaugcuuc

SEQ ID NO: 315325 - RNA, 22 nt, Human
cacagagagcuacgugcagcgu

SEQ ID NO: 315326 - RNA, 22 nt, Human
uugggcugaacccugcagcuga

SEQ ID NO: 315327 - RNA, 22 nt, Human
cagcaggcccaggugcugguga

SEQ ID NO: 315328 - RNA, 21 nt, Human
acagaacuguauagugauaaa

SEQ ID NO: 315329 - RNA, 22 nt, Human
cacagguggcuccaaguuagag

SEQ ID NO: 315330 - RNA, 22 nt, Human
ugcuucagaggaaaggcaaaag

SEQ ID NO: 315331 - RNA, 22 nt, Human
gugcagguguuuuggcugccag

SEQ ID NO: 315332 - RNA, 22 nt, Human
uacagaaaucacaucgcuuuga

SEQ ID NO: 315333 - RNA, 22 nt, Human
uuccaaaggaauggggagcuau

SEQ ID NO: 315334 - RNA, 18 nt, Human
uaugagaagauuagcaau

SEQ ID NO: 315335 - RNA, 22 nt, Human
uccaugagcuagcuuuccaaag

SEQ ID NO: 315336 - RNA, 19 nt, Human
uguagcaguuuaaaacaac

SEQ ID NO: 315337 - RNA, 23 nt, Human
ucagagaacucgggcagaugacc

SEQ ID NO: 315338 - RNA, 22 nt, Human
gucaggaugacaagugcuuuca

SEQ ID NO: 315339 - RNA, 22 nt, Human
aggggcucaaagugugcaggga

SEQ ID NO: 315340 - RNA, 21 nt, Human
uccucugcucucauaccacaa

SEQ ID NO: 315341 - RNA, 22 nt, Human
gccuggagaggaagccggugga

SEQ ID NO: 315342 - RNA, 22 nt, Human
gucccagggaagaaggcagcac

SEQ ID NO: 315343 - RNA, 22 nt, Human
ucuucauuccguagauauuuau

SEQ ID NO: 315344 - RNA, 22 nt, Human
ugugaaaggggucacagggaaa

SEQ ID NO: 315345 - RNA, 22 nt, Human
auggcagcaaaugucuggcugg

SEQ ID NO: 315346 - RNA, 22 nt, Human
augcuguguggccaccuccaug

SEQ ID NO: 315347 - RNA, 21 nt, Human
auucagaguaauucaucuuua

SEQ ID NO: 315348 - RNA, 22 nt, Human
uggagacucugcaucugugaca

SEQ ID NO: 315349 - RNA, 22 nt, Human
uugaggagcaggaugggaggcu

SEQ ID NO: 315350 - RNA, 22 nt, Human
ucugggaagcugcgugccuguu

SEQ ID NO: 315351 - RNA, 22 nt, Human
ccacagggauaggaauggggcu

SEQ ID NO: 315352 - RNA, 22 nt, Human
acucagugggcuugaugucgaa

SEQ ID NO: 315353 - RNA, 22 nt, Human
uaugaacauguucauugacuua

SEQ ID NO: 315354 - RNA, 22 nt, Human
ucagucuucccuccagugcaac

SEQ ID NO: 315355 - RNA, 22 nt, Human
ugcuuccuauccacacaaugcc

SEQ ID NO: 315356 - RNA, 22 nt, Human
cugccuuggcccuaguucaugg

SEQ ID NO: 315357 - RNA, 22 nt, Human
caguggccaugguggcaggggu

SEQ ID NO: 315358 - RNA, 21 nt, Human
agcaggaggcagucacagcuc

SEQ ID NO: 315359 - RNA, 22 nt, Human
gauggcacacagacauccccgc

SEQ ID NO: 315360 - RNA, 22 nt, Human
ucaagagauugaauaauaacug

SEQ ID NO: 315361 - RNA, 22 nt, Human
cuuuaagagaucaccaaucaca

SEQ ID NO: 315362 - RNA, 22 nt, Human
ggccugcucugcagccucuaca

SEQ ID NO: 315363 - RNA, 22 nt, Human
ucaggaugguguggaggaaaua

SEQ ID NO: 315364 - RNA, 22 nt, Human
agguauaagaagauuauuuaua

SEQ ID NO: 315365 - RNA, 22 nt, Human
auuuccauagagcgucucacag

SEQ ID NO: 315366 - RNA, 22 nt, Human
uggcucagcgguggcagcagac

SEQ ID NO: 315367 - RNA, 22 nt, Human
aacagcaugcuggguaacauug

SEQ ID NO: 315368 - RNA, 22 nt, Human
cuuaaauuuucaucuacaagaa

SEQ ID NO: 315369 - RNA, 22 nt, Human
ggguccagacacuccagaggaa

SEQ ID NO: 315370 - RNA, 22 nt, Human
uuuuuggguccaggcuguaucu

SEQ ID NO: 315371 - RNA, 19 nt, Human
agcagccaucgaccaugga

SEQ ID NO: 315372 - RNA, 20 nt, Human
caagcccucuuuagccugcc

SEQ ID NO: 315373 - RNA, 20 nt, Human
ugaaggccauuuguuccaga

SEQ ID NO: 315374 - RNA, 22 nt, Human
gggugggguguaucggauccua

SEQ ID NO: 315375 - RNA, 22 nt, Human
gugaaaucugaggcccaugaug

SEQ ID NO: 315376 - RNA, 23 nt, Human
uucuucucaauuaguugauucag

SEQ ID NO: 315377 - RNA, 22 nt, Human
gcuggggucugugaggagggcu

SEQ ID NO: 315378 - RNA, 22 nt, Human
guguaucaaagcacagacuuca

SEQ ID NO: 315379 - RNA, 22 nt, Human
uuauucuucuucucuugccagg

SEQ ID NO: 315380 - RNA, 22 nt, Human
agguggagaucagggacuaagg

SEQ ID NO: 315381 - RNA, 22 nt, Human
cugcucuggcuguguacuucag

SEQ ID NO: 315382 - RNA, 22 nt, Human
uugcaccaaaugaguuaaaauu

SEQ ID NO: 315383 - RNA, 22 nt, Human
caggcccugggcaggaucagcc

SEQ ID NO: 315384 - RNA, 22 nt, Human
acagcagcgucaacuuaaaauu

SEQ ID NO: 315385 - RNA, 22 nt, Human
uacuguauuugauaagugaagu

SEQ ID NO: 315386 - RNA, 22 nt, Human
uuuuccucugagcuuugaauaa

SEQ ID NO: 315387 - RNA, 22 nt, Human
ucagucuuugcuuaugacaaua

SEQ ID NO: 315388 - RNA, 22 nt, Human
cuggugcacauucgcucucaua

SEQ ID NO: 315389 - RNA, 22 nt, Human
ccucucaucauuaucgcuuugu

SEQ ID NO: 315390 - RNA, 22 nt, Human
ugguacuuggaggcagaaaaau

SEQ ID NO: 315391 - RNA, 22 nt, Human
gccuccccugcaauuguccuug

SEQ ID NO: 315392 - RNA, 22 nt, Human
auccuucaaggggcugacagcu

SEQ ID NO: 315393 - RNA, 22 nt, Human
acuggcaguagagggagcgcau

SEQ ID NO: 315394 - RNA, 22 nt, Human
cccucugcucaggugcauaggc

SEQ ID NO: 315395 - RNA, 22 nt, Human
uacauggugguggcacuugacu

SEQ ID NO: 315396 - RNA, 22 nt, Human
agcaguggccuggggcucugug

SEQ ID NO: 315397 - RNA, 22 nt, Human
uggaaggggagcuggaaagggg

SEQ ID NO: 315398 - RNA, 22 nt, Human
uugcauuguaggauguuagaag

SEQ ID NO: 315399 - RNA, 22 nt, Human
ucugagggcuugaggggaagua

SEQ ID NO: 315400 - RNA, 22 nt, Human
cggcagagacggcgcuuugaac

SEQ ID NO: 315401 - RNA, 22 nt, Human
cuggccacaacuagcccaggac

SEQ ID NO: 315402 - RNA, 22 nt, Human
ucuagaaacaugacauugaucu

SEQ ID NO: 315403 - RNA, 22 nt, Human
cuugcuuuguccagaaauucag

SEQ ID NO: 315404 - RNA, 22 nt, Human
uagauaaauuagaaaguuuacu

SEQ ID NO: 315405 - RNA, 22 nt, Human
auuugcuuuuacuauguuaaaa

SEQ ID NO: 315406 - RNA, 22 nt, Human
augaagcugaccuugucuugcu

SEQ ID NO: 315407 - RNA, 22 nt, Human
ucucucagcuuugagaccugcu

SEQ ID NO: 315408 - RNA, 18 nt, Human
gucaccuggaucagauua

SEQ ID NO: 315409 - RNA, 22 nt, Human
agcucccagagcucgagaguaa

SEQ ID NO: 315410 - RNA, 20 nt, Human
agguggcuccugcugggggu

SEQ ID NO: 315411 - RNA, 22 nt, Human
guugaaagcuuuucauuuaguu

SEQ ID NO: 315412 - RNA, 22 nt, Human
ucacuuaaaaauucuaguuaug

SEQ ID NO: 315413 - RNA, 22 nt, Human
agccacagucaaccuguccaua

SEQ ID NO: 315414 - RNA, 22 nt, Human
ugauuuccacagucaggggugc

SEQ ID NO: 315415 - RNA, 22 nt, Human
ggccagagagccgcuguuagga

SEQ ID NO: 315416 - RNA, 22 nt, Human
agcaucuggucaugagugagaa

SEQ ID NO: 315417 - RNA, 22 nt, Human
guccuggcccacuggcaggcug

SEQ ID NO: 315418 - RNA, 22 nt, Human
cuggggcucucuggaaugcuug

SEQ ID NO: 315419 - RNA, 22 nt, Human
uugaaaggguuaaagugguaaa

SEQ ID NO: 315420 - RNA, 22 nt, Human
ugccauccaacaguuccaucuu

SEQ ID NO: 315421 - RNA, 22 nt, Human
uggcucagaagaaaagguaaac

SEQ ID NO: 315422 - RNA, 22 nt, Human
aaggggaguuagugauaaaacc

SEQ ID NO: 315423 - RNA, 22 nt, Human
acagcuggcaggggggcaugaa

SEQ ID NO: 315424 - RNA, 20 nt, Human
ucauccaggacaggaguggc

SEQ ID NO: 315425 - RNA, 20 nt, Human
agagcugggaagcucccuau

SEQ ID NO: 315426 - RNA, 22 nt, Human
cuccccagguucaggagguggg

SEQ ID NO: 315427 - RNA, 22 nt, Human
caucaaauaggaauauuuggca

SEQ ID NO: 315428 - RNA, 22 nt, Human
uuccagauuucuacacaagacc

SEQ ID NO: 315429 - RNA, 22 nt, Human
agaugagaauuuuuagagugcu

SEQ ID NO: 315430 - RNA, 22 nt, Human
uaacuuucuucauaugugaacc

SEQ ID NO: 315431 - RNA, 22 nt, Human
cuguguggccucaagccagccu

SEQ ID NO: 315432 - RNA, 22 nt, Human
auucugauaucuuauucuagcu

SEQ ID NO: 315433 - RNA, 22 nt, Human
cagaguggcagucccaggccca

SEQ ID NO: 315434 - RNA, 22 nt, Human
gcugcucugcuguguaagcagg

SEQ ID NO: 315435 - RNA, 20 nt, Human
cccugagacaaaggaggggc

SEQ ID NO: 315436 - RNA, 22 nt, Human
acagggccagccugggaccugg

SEQ ID NO: 315437 - RNA, 22 nt, Human
gccaggcuguggggaacuugaa

SEQ ID NO: 315438 - RNA, 22 nt, Human
uccuugaagcuuguaucuaaua

SEQ ID NO: 315439 - RNA, 22 nt, Human
acagagcaauaacagggagagg

SEQ ID NO: 315440 - RNA, 22 nt, Human
cucuugaagcaggggccaguuc

SEQ ID NO: 315441 - RNA, 22 nt, Human
uaauuuaauuucaugccagccu

SEQ ID NO: 315442 - RNA, 22 nt, Human
ugugcagggaagggcaugcuau

SEQ ID NO: 315443 - RNA, 22 nt, Human
ugugcuucugcagagacuauuu

SEQ ID NO: 315444 - RNA, 22 nt, Human
agggccucugacgcccccagcc

SEQ ID NO: 315445 - RNA, 22 nt, Human
ggucaggggcugcucuacagag

SEQ ID NO: 315446 - RNA, 22 nt, Human
acaagauagcuuagaagauuca

SEQ ID NO: 315447 - RNA, 22 nt, Human
acagcagcuggguucccaccau

SEQ ID NO: 315448 - RNA, 22 nt, Human
aagugagauuauauguacggga

SEQ ID NO: 315449 - RNA, 22 nt, Human
acauuuacagugcuagacaauc

SEQ ID NO: 315450 - RNA, 22 nt, Human
agaggcagcagucauacuacag

SEQ ID NO: 315451 - RNA, 22 nt, Human
cacagggcaccaguuggccauc

SEQ ID NO: 315452 - RNA, 23 nt, Human
aaaguugauuugcaguuuaagag

SEQ ID NO: 315453 - RNA, 22 nt, Human
ggccugaggcaauagucagaca

SEQ ID NO: 315454 - RNA, 19 nt, Human
cuggugcuugagugaguca

SEQ ID NO: 315455 - RNA, 22 nt, Human
uugcaggggaaggagcagagcu

SEQ ID NO: 315456 - RNA, 20 nt, Human
ugcagggcucugcuucucuc

SEQ ID NO: 315457 - RNA, 22 nt, Human
ccagaaagaaugaacugaaccc

SEQ ID NO: 315458 - RNA, 22 nt, Human
uugugucugggggagugacauc

SEQ ID NO: 315459 - RNA, 22 nt, Human
ugagcugggcugggcugagcug

SEQ ID NO: 315460 - RNA, 22 nt, Human
uaaggccaauuaacaaccaggg

SEQ ID NO: 315461 - RNA, 20 nt, Human
agggucaguagcacagagcu

SEQ ID NO: 315462 - RNA, 22 nt, Human
cacauguaguaagcaggcaaug

SEQ ID NO: 315463 - RNA, 22 nt, Human
aaaagaggagugguuuaugaca

SEQ ID NO: 315464 - RNA, 22 nt, Human
ucauugcaguagggagagaccc

SEQ ID NO: 315465 - RNA, 22 nt, Human
ccuggcagcuccuccccggcgg

SEQ ID NO: 315466 - RNA, 22 nt, Human
guggccugccgugugguauggg

SEQ ID NO: 315467 - RNA, 22 nt, Human
gccucugcugcaagccugguug

SEQ ID NO: 315468 - RNA, 22 nt, Human
ucaaaguagccggauggaauuu

SEQ ID NO: 315469 - RNA, 22 nt, Human
ccaggcagagggauccccaucc

SEQ ID NO: 315470 - RNA, 22 nt, Human
auaaggcagaaaugauucuagu

SEQ ID NO: 315471 - RNA, 22 nt, Human
agggccagcacuccuggcagga

SEQ ID NO: 315472 - RNA, 22 nt, Human
ugcagggccgcuggaggucaug

SEQ ID NO: 315473 - RNA, 22 nt, Human
aguguuucucagaagggccuau

SEQ ID NO: 315474 - RNA, 22 nt, Human
ggcucagguugggucacaugac

SEQ ID NO: 315475 - RNA, 22 nt, Human
uuaagucacuuaucuaaagaca

SEQ ID NO: 315476 - RNA, 22 nt, Human
gggccucugugcagaggggccu

SEQ ID NO: 315477 - RNA, 22 nt, Human
aguuacuuucugaucagugugu

SEQ ID NO: 315478 - RNA, 22 nt, Human
ccucaggauccgcaggugcagu

SEQ ID NO: 315479 - RNA, 22 nt, Human
uggggcuguccuuagucugaga

SEQ ID NO: 315480 - RNA, 22 nt, Human
aaguucuugcugugugucagau

SEQ ID NO: 315481 - RNA, 22 nt, Human
gucaggauuuuaaaaucccagu

SEQ ID NO: 315482 - RNA, 22 nt, Human
ggagauagacuuggugagccac

SEQ ID NO: 315483 - RNA, 22 nt, Human
aguaugaauugcuuugccugua

SEQ ID NO: 315484 - RNA, 22 nt, Human
ucaguguucgcucagggacucc

SEQ ID NO: 315485 - RNA, 17 nt, Human
ucuguucaugcauaccu

SEQ ID NO: 315486 - RNA, 22 nt, Human
aggcucagauucacauuugguu

SEQ ID NO: 315487 - RNA, 21 nt, Human
ugcugccauagaccugaggga

SEQ ID NO: 315488 - RNA, 22 nt, Human
cugaaggaagcagaagcgaggu

SEQ ID NO: 315489 - RNA, 22 nt, Human
cuccucccugcgauugcucugc

SEQ ID NO: 315490 - RNA, 22 nt, Human
aaauacuagaauucagaguuga

SEQ ID NO: 315491 - RNA, 19 nt, Human
caggagagcaugcacuuug

SEQ ID NO: 315492 - RNA, 22 nt, Human
gugcuuuccauccucccugcug

SEQ ID NO: 315493 - RNA, 22 nt, Human
uggagcugggaguccugggcug

SEQ ID NO: 315494 - RNA, 22 nt, Human
auaagguaugaaaaguaaaugg

SEQ ID NO: 315495 - RNA, 21 nt, Human
aggcacuguuugugguuuggg

SEQ ID NO: 315496 - RNA, 21 nt, Human
uuugcauuuuacaugugggga

SEQ ID NO: 315497 - RNA, 22 nt, Human
cuccugagcucugaggaagcuu

SEQ ID NO: 315498 - RNA, 22 nt, Human
uaacaauaguguuugcuaguca

SEQ ID NO: 315499 - RNA, 22 nt, Human
cagcaagauuuuuaaagcaagg

SEQ ID NO: 315500 - RNA, 22 nt, Human
cugcucuguauaugagcaggaa

SEQ ID NO: 315501 - RNA, 22 nt, Human
agugcuuuagagaaauggugcu

SEQ ID NO: 315502 - RNA, 22 nt, Human
agguggguccuggcucugccau

SEQ ID NO: 315503 - RNA, 22 nt, Human
gucacacuagggccaaguggag

SEQ ID NO: 315504 - RNA, 22 nt, Human
aguuuuucugggaggcacugcu

SEQ ID NO: 315505 - RNA, 22 nt, Human
acaccagggccuagccagggcg

SEQ ID NO: 315506 - RNA, 22 nt, Human
agcccagcagaaaguccagccu

SEQ ID NO: 315507 - RNA, 22 nt, Human
auguaucaacaaauuguacagu

SEQ ID NO: 315508 - RNA, 22 nt, Human
uaaacauuuguuauucuuguuu

SEQ ID NO: 315509 - RNA, 22 nt, Human
gcagagcaguacucucuugacu

SEQ ID NO: 315510 - RNA, 22 nt, Human
agacagcugcucgcagagcuau

SEQ ID NO: 315511 - RNA, 22 nt, Human
gcccauggacacccaagugcca

SEQ ID NO: 315512 - RNA, 22 nt, Human
cacugaagccacuggaagagga

SEQ ID NO: 315513 - RNA, 22 nt, Human
uuggaugaagucuagcuuuagu

SEQ ID NO: 315514 - RNA, 22 nt, Human
ugcugccagccaggccauggag

SEQ ID NO: 315515 - RNA, 22 nt, Human
ugggcucugcugcguaccaguu

SEQ ID NO: 315516 - RNA, 22 nt, Human
agucaguguagaaagcccaggc

SEQ ID NO: 315517 - RNA, 21 nt, Human
cucuggagucaagagcuucca

SEQ ID NO: 315518 - RNA, 22 nt, Human
agugaccaacaaugcugagaag

SEQ ID NO: 315519 - RNA, 22 nt, Human
cuggcugccacuucagggucuu

SEQ ID NO: 315520 - RNA, 21 nt, Human
gagacagcccagugccagggc

SEQ ID NO: 315521 - RNA, 22 nt, Human
uaaucuguguaccuucaucgga

SEQ ID NO: 315522 - RNA, 22 nt, Human
cucuuuccucagccacagucua

SEQ ID NO: 315523 - RNA, 22 nt, Human
uccucaguggggcauucauuau

SEQ ID NO: 315524 - RNA, 22 nt, Human
acagaguagcucaagaagauug

SEQ ID NO: 315525 - RNA, 22 nt, Human
gccuuggccaacaccuugcaaa

SEQ ID NO: 315526 - RNA, 20 nt, Human
ucagccagcuaacaugggga

SEQ ID NO: 315527 - RNA, 23 nt, Human
acaagauagggauaaaaagauaa

SEQ ID NO: 315528 - RNA, 22 nt, Human
uuacaaagagugccagagugug

SEQ ID NO: 315529 - RNA, 22 nt, Human
gaaaaugugucaucccuacugu

SEQ ID NO: 315530 - RNA, 22 nt, Human
agggacaguuacaucaucagac

SEQ ID NO: 315531 - RNA, 22 nt, Human
ggugcagcugcagccugggagc

SEQ ID NO: 315532 - RNA, 22 nt, Human
gcagccacugggagugcuuaua

SEQ ID NO: 315533 - RNA, 22 nt, Human
auuguacuuuuauuacauguag

SEQ ID NO: 315534 - RNA, 22 nt, Human
cuggcagcugugugaagaacug

SEQ ID NO: 315535 - RNA, 22 nt, Human
cagaagaauggugucugagcuc

SEQ ID NO: 315536 - RNA, 22 nt, Human
uaccuuggguugaguucauucu

SEQ ID NO: 315537 - RNA, 22 nt, Human
cugggccugguagggcuugaaa

SEQ ID NO: 315538 - RNA, 22 nt, Human
gcagacaggcccaguggaggga

SEQ ID NO: 315539 - RNA, 20 nt, Human
aguuauaguaucuagccaug

SEQ ID NO: 315540 - RNA, 22 nt, Human
aauaaaauggucaguuuucuca

SEQ ID NO: 315541 - RNA, 22 nt, Human
gcugugcacuaccuauacaucc

SEQ ID NO: 315542 - RNA, 22 nt, Human
auucuucagcaggggacacuau

SEQ ID NO: 315543 - RNA, 22 nt, Human
ccaaaguccacaguuuacauua

SEQ ID NO: 315544 - RNA, 22 nt, Human
ucacaaauauuuuaacaguagg

SEQ ID NO: 315545 - RNA, 19 nt, Human
cuguccuuggcugcacugu

SEQ ID NO: 315546 - RNA, 22 nt, Human
ccacagggucagccacucugca

SEQ ID NO: 315547 - RNA, 22 nt, Human
ggagcacuauaauagagauuuu

SEQ ID NO: 315548 - RNA, 22 nt, Human
ccagggugugagaaggaaguag

SEQ ID NO: 315549 - RNA, 21 nt, Human
ucugucucuccacugcccugc

SEQ ID NO: 315550 - RNA, 22 nt, Human
uccagggaccucccugagagcu

SEQ ID NO: 315551 - RNA, 17 nt, Human
ucuuuccugccaugcuc

SEQ ID NO: 315552 - RNA, 22 nt, Human
gcugugcagccaagugccucug

SEQ ID NO: 315553 - RNA, 22 nt, Human
cagccugcuagggcaaugccuu

SEQ ID NO: 315554 - RNA, 22 nt, Human
ccugagagcauuccacacugaa

SEQ ID NO: 315555 - RNA, 22 nt, Human
acagccagaggugguccugggu

SEQ ID NO: 315556 - RNA, 17 nt, Human
agguauaaaaugguagc

SEQ ID NO: 315557 - RNA, 22 nt, Human
cugcuguggguuaagacacugu

SEQ ID NO: 315558 - RNA, 21 nt, Human
acaggcuuuagaaaaugacuc

SEQ ID NO: 315559 - RNA, 22 nt, Human
agagccuguuuugugggagaug

SEQ ID NO: 315560 - RNA, 22 nt, Human
ucuggcucaggucagacaggga

SEQ ID NO: 315561 - RNA, 22 nt, Human
cugagacuuucaugugcuuuua

SEQ ID NO: 315562 - RNA, 22 nt, Human
ccacugucagaggggcugugcc

SEQ ID NO: 315563 - RNA, 20 nt, Human
ugcucugucuaaaacuuccc

SEQ ID NO: 315564 - RNA, 22 nt, Human
gggcccagcgugguuccaucug

SEQ ID NO: 315565 - RNA, 22 nt, Human
uuagauauguuuuugcuaaugc

SEQ ID NO: 315566 - RNA, 22 nt, Human
gaguuauuucagaaggaaagau

SEQ ID NO: 315567 - RNA, 22 nt, Human
ggccacagugggaaauccuggg

SEQ ID NO: 315568 - RNA, 19 nt, Human
cccaaggcccugggcaggc

SEQ ID NO: 315569 - RNA, 19 nt, Human
ucaggacugacuugaaguc

SEQ ID NO: 315570 - RNA, 19 nt, Human
ccuggcccugcugcgcggg

SEQ ID NO: 315571 - RNA, 22 nt, Human
ggaccagagaagugagcaccug

SEQ ID NO: 315572 - RNA, 22 nt, Human
uaaagguagcaugaaacugcaa

SEQ ID NO: 315573 - RNA, 22 nt, Human
cagggagcuggugccagccgac

SEQ ID NO: 315574 - RNA, 22 nt, Human
ucuguucaucaucuggacacau

SEQ ID NO: 315575 - RNA, 20 nt, Human
auuauucauacaugugugac

SEQ ID NO: 315576 - RNA, 22 nt, Human
auuucaguguuuuaagaguuca

SEQ ID NO: 315577 - RNA, 22 nt, Human
ucugauuagagcauucuugagu

SEQ ID NO: 315578 - RNA, 22 nt, Human
gccuucugauugcuggacugac

SEQ ID NO: 315579 - RNA, 22 nt, Human
agcugccagaugacagugcuau

SEQ ID NO: 315580 - RNA, 22 nt, Human
cuggcuccaucacugggugaug

SEQ ID NO: 315581 - RNA, 22 nt, Human
uucauguguauggaacauuuuu

SEQ ID NO: 315582 - RNA, 22 nt, Human
agcuccugcacccagccuugag

SEQ ID NO: 315583 - RNA, 19 nt, Human
cagagcugcuggccucguc

SEQ ID NO: 315584 - RNA, 23 nt, Human
uuacuuuugcaccaaccuaauau

SEQ ID NO: 315585 - RNA, 22 nt, Human
aggaccugacuggcuccugcuu

SEQ ID NO: 315586 - RNA, 22 nt, Human
uacaaaguuuucuuggauugag

SEQ ID NO: 315587 - RNA, 22 nt, Human
cugcaggggccucgagcacagg

SEQ ID NO: 315588 - RNA, 22 nt, Human
ucaucucaaaacccaaggggca

SEQ ID NO: 315589 - RNA, 23 nt, Human
acugucugauauguuuuccauca

SEQ ID NO: 315590 - RNA, 22 nt, Human
gaucauuuugaugcccuuuuag

SEQ ID NO: 315591 - RNA, 22 nt, Human
uggucucugacucugaagaccc

SEQ ID NO: 315592 - RNA, 22 nt, Human
ccagggagcggggcugggucuc

SEQ ID NO: 315593 - RNA, 21 nt, Human
uucucagaucgaguagugaga

SEQ ID NO: 315594 - RNA, 22 nt, Human
ugugcucuggaguugccuucac

SEQ ID NO: 315595 - RNA, 19 nt, Human
uccugggcugggccagguc

SEQ ID NO: 315596 - RNA, 22 nt, Human
ugggccuccaauuccagcggga

SEQ ID NO: 315597 - RNA, 18 nt, Human
gggaagaggaucuggccc

SEQ ID NO: 315598 - RNA, 22 nt, Human
uaaauguauaggcacuaaaccu

SEQ ID NO: 315599 - RNA, 22 nt, Human
auguggaggaaaugaguguaca

SEQ ID NO: 315600 - RNA, 22 nt, Human
aggucacacaacugucagaggc

SEQ ID NO: 315601 - RNA, 22 nt, Human
uccacauccauugcuugacuuu

SEQ ID NO: 315602 - RNA, 22 nt, Human
aaucacaauuacuuuugcacca

SEQ ID NO: 315603 - RNA, 22 nt, Human
gccuggucucuuucaugucagu

SEQ ID NO: 315604 - RNA, 22 nt, Human
cucaggauccaucuccugcccu

SEQ ID NO: 315605 - RNA, 22 nt, Human
cugggcacuuuggggagccuac

SEQ ID NO: 315606 - RNA, 22 nt, Human
cuggcucauuuuagcaucaggu

SEQ ID NO: 315607 - RNA, 22 nt, Human
ugcugccuugaccuccugggcu

SEQ ID NO: 315608 - RNA, 17 nt, Human
uucucugagcuguauug

SEQ ID NO: 315609 - RNA, 22 nt, Human
cccaggaggcagaaguugcagu

SEQ ID NO: 315610 - RNA, 22 nt, Human
agggagugguuaagaaggugca

SEQ ID NO: 315611 - RNA, 22 nt, Human
uucugucauuuagcauugucau

SEQ ID NO: 315612 - RNA, 23 nt, Human
auuuccuacuauaaaagagguaa

SEQ ID NO: 315613 - RNA, 22 nt, Human
cugaggugcuauggaggauacg

SEQ ID NO: 315614 - RNA, 17 nt, Human
gccuggcccagccuggc

SEQ ID NO: 315615 - RNA, 22 nt, Human
acaaaagugagugugucucaga

SEQ ID NO: 315616 - RNA, 22 nt, Human
aagcaauauacugauaugauua

SEQ ID NO: 315617 - RNA, 22 nt, Human
uccuugaauggacauuacacug

SEQ ID NO: 315618 - RNA, 22 nt, Human
augcugaggacaaagagaucaa

SEQ ID NO: 315619 - RNA, 22 nt, Human
acagagguaggacaugagauau

SEQ ID NO: 315620 - RNA, 22 nt, Human
gccucugcacuguggcacacca

SEQ ID NO: 315621 - RNA, 22 nt, Human
ccuggugaauguucauggacug

SEQ ID NO: 315622 - RNA, 22 nt, Human
ccagccuccauguagauagcug

SEQ ID NO: 315623 - RNA, 22 nt, Human
guaacugaggcagcuuuuaaga

SEQ ID NO: 315624 - RNA, 22 nt, Human
uugcaccauuucacuuccauua

SEQ ID NO: 315625 - RNA, 22 nt, Human
accaggcugugaagugagacua

SEQ ID NO: 315626 - RNA, 22 nt, Human
ggagucagccugucagagugua

SEQ ID NO: 315627 - RNA, 22 nt, Human
gagcucagauucuggugucaga

SEQ ID NO: 315628 - RNA, 22 nt, Human
cggcuggguagaggugccgggu

SEQ ID NO: 315629 - RNA, 22 nt, Human
cuuccucacggugcaacaggaa

SEQ ID NO: 315630 - RNA, 22 nt, Human
acagccuguguaccagcuggga

SEQ ID NO: 315631 - RNA, 22 nt, Human
aucacugucgucaucugagauu

SEQ ID NO: 315632 - RNA, 22 nt, Human
ugcauggacucaucagacaaga

SEQ ID NO: 315633 - RNA, 22 nt, Human
cagggugcgccacucagaugua

SEQ ID NO: 315634 - RNA, 15 nt, Human
aggcacugugggacc

SEQ ID NO: 315635 - RNA, 22 nt, Human
auaugagaguaaaugccgaucu

SEQ ID NO: 315636 - RNA, 22 nt, Human
uggcagugccccuugaccagug

SEQ ID NO: 315637 - RNA, 22 nt, Human
uuucaacaccagagaccaugcg

SEQ ID NO: 315638 - RNA, 22 nt, Human
gggagggacacaaagaguuccc

SEQ ID NO: 315639 - RNA, 22 nt, Human
augggaguuuucucugaugcuc

SEQ ID NO: 315640 - RNA, 22 nt, Human
aggcugcuucagcugcagggag

SEQ ID NO: 315641 - RNA, 22 nt, Human
uccugcagccacugcaggcaga

SEQ ID NO: 315642 - RNA, 22 nt, Human
gagauggggaauaggagcaagc

SEQ ID NO: 315643 - RNA, 22 nt, Human
uucucugaaggccaugcucacu

SEQ ID NO: 315644 - RNA, 22 nt, Human
uccucaggauguggaguagaau

SEQ ID NO: 315645 - RNA, 22 nt, Human
cuugcaggcagggccuccugga

SEQ ID NO: 315646 - RNA, 22 nt, Human
ggagcugcuuugaucugaagaa

SEQ ID NO: 315647 - RNA, 22 nt, Human
ucagaaauagucuuuaaaauga

SEQ ID NO: 315648 - RNA, 22 nt, Human
cauuuugugcuagacacuaugg

SEQ ID NO: 315649 - RNA, 22 nt, Human
ucacugucugaaagaaauggcc

SEQ ID NO: 315650 - RNA, 20 nt, Human
ugaaaggugggaauuguggg

SEQ ID NO: 315651 - RNA, 22 nt, Human
ggaggccaaggcgggcggauca

SEQ ID NO: 315652 - RNA, 22 nt, Human
cuucugggcauucagcugcaca

SEQ ID NO: 315653 - RNA, 22 nt, Human
uaacaguguggacuugagaucu

SEQ ID NO: 315654 - RNA, 23 nt, Human
uaaugagaagcuuuguuuccuga

SEQ ID NO: 315655 - RNA, 22 nt, Human
gcugucucggggcuuucuccug

SEQ ID NO: 315656 - RNA, 22 nt, Human
gagguacaugaggauacacagg

SEQ ID NO: 315657 - RNA, 22 nt, Human
ccucacuuuccuuucuccuggg

SEQ ID NO: 315658 - RNA, 22 nt, Human
uucaaugauuuuuagggaucau

SEQ ID NO: 315659 - RNA, 22 nt, Human
gggcugcacagaucuucaaggg

SEQ ID NO: 315660 - RNA, 22 nt, Human
ugcagagggacagccacagcuc

SEQ ID NO: 315661 - RNA, 22 nt, Human
gaugccugcauuucaggagagu

SEQ ID NO: 315662 - RNA, 22 nt, Human
cagggccugccugguuccugga

SEQ ID NO: 315663 - RNA, 22 nt, Human
uggggugccgacagggagggca

SEQ ID NO: 315664 - RNA, 22 nt, Human
agagccaggcggcugggcaccu

SEQ ID NO: 315665 - RNA, 22 nt, Human
ccuggcugugcauugccggccc

SEQ ID NO: 315666 - RNA, 22 nt, Human
accuuuuuguucuguucucagc

SEQ ID NO: 315667 - RNA, 22 nt, Human
cagugcugacagggaggaaccu

SEQ ID NO: 315668 - RNA, 22 nt, Human
aggccuguuccuuccugggcac

SEQ ID NO: 315669 - RNA, 22 nt, Human
caggcugagcucuggccugggc

SEQ ID NO: 315670 - RNA, 23 nt, Human
ucucagaggauuccugggccuug

SEQ ID NO: 315671 - RNA, 15 nt, Human
ugggcagaucacuug

SEQ ID NO: 315672 - RNA, 23 nt, Human
uggcccugugcaugcugcuuccc

SEQ ID NO: 315673 - RNA, 22 nt, Human
ugaaaucugcaugcaaaguccu

SEQ ID NO: 315674 - RNA, 22 nt, Human
acugugcaugaaccgaaacaaa

SEQ ID NO: 315675 - RNA, 22 nt, Human
gcacccagggacuuggcuggcc

SEQ ID NO: 315676 - RNA, 20 nt, Human
ucugaggcugagcucuacuu

SEQ ID NO: 315677 - RNA, 19 nt, Human
cccagcuugaccaccugcu

SEQ ID NO: 315678 - RNA, 22 nt, Human
ucuucauuuuacaggcagaccu

SEQ ID NO: 315679 - RNA, 22 nt, Human
cccagcauggagugaggacuca

SEQ ID NO: 315680 - RNA, 22 nt, Human
ugaagaugucagcagggguggu

SEQ ID NO: 315681 - RNA, 22 nt, Human
uagaaacacagaucugguguca

SEQ ID NO: 315682 - RNA, 22 nt, Human
ggucaggguauaaucaagugag

SEQ ID NO: 315683 - RNA, 22 nt, Human
uaaugaauaaacuugagaguca

SEQ ID NO: 315684 - RNA, 22 nt, Human
cacaccuguaauaccagcuacu

SEQ ID NO: 315685 - RNA, 22 nt, Human
guaguucugcagugucaccuga

SEQ ID NO: 315686 - RNA, 22 nt, Human
aacauuuaugguagucauugca

SEQ ID NO: 315687 - RNA, 22 nt, Human
aaaucaguucucccuuucuuca

SEQ ID NO: 315688 - RNA, 22 nt, Human
agcaccuguugcacuucauaau

SEQ ID NO: 315689 - RNA, 22 nt, Human
auuccuugcucucaucaaccuu

SEQ ID NO: 315690 - RNA, 22 nt, Human
ucagugaucuaaggguauggcc

SEQ ID NO: 315691 - RNA, 22 nt, Human
uggggagcacgguagggaaaug

SEQ ID NO: 315692 - RNA, 22 nt, Human
cccagaaggucgaggcugcagu

SEQ ID NO: 315693 - RNA, 22 nt, Human
cccaggaggucgaagcugcagu

SEQ ID NO: 315694 - RNA, 22 nt, Human
gaaaugcauggaucuuggcaga

SEQ ID NO: 315695 - RNA, 22 nt, Human
cuggagggagauucaaaggagg

SEQ ID NO: 315696 - RNA, 22 nt, Human
agcccuucaaccugccuacucc

SEQ ID NO: 315697 - RNA, 22 nt, Human
gagggagagugauggaccauug

SEQ ID NO: 315698 - RNA, 22 nt, Human
uuuccuuccuugcuagccugag

SEQ ID NO: 315699 - RNA, 19 nt, Human
ugggccugcaucugggucu

SEQ ID NO: 315700 - RNA, 22 nt, Human
gcucucugguuccagucaggaa

SEQ ID NO: 315701 - RNA, 22 nt, Human
uuaugggagcaauuggggaggu

SEQ ID NO: 315702 - RNA, 22 nt, Human
aagccagguguuuaggccagcg

SEQ ID NO: 315703 - RNA, 20 nt, Human
gaggccucagccucagcucc

SEQ ID NO: 315704 - RNA, 22 nt, Human
guggcugcuaagucuccuuccu

SEQ ID NO: 315705 - RNA, 22 nt, Human
caugggagcuaucuccaucacu

SEQ ID NO: 315706 - RNA, 22 nt, Human
cccugagcccauaguugacauu

SEQ ID NO: 315707 - RNA, 22 nt, Human
gaacaguaaauuuaugcagcac

SEQ ID NO: 315708 - RNA, 22 nt, Human
ccuggccugugaaucugagagc

SEQ ID NO: 315709 - RNA, 22 nt, Human
cugagaaggaagccuccacucu

SEQ ID NO: 315710 - RNA, 22 nt, Human
uaugacuuauuucaucaguucu

SEQ ID NO: 315711 - RNA, 22 nt, Human
gccacagggcagaugcgcagag

SEQ ID NO: 315712 - RNA, 22 nt, Human
ccuguucagagcuaagcaucau

SEQ ID NO: 315713 - RNA, 22 nt, Human
ggucccagcuggucacugucag

SEQ ID NO: 315714 - RNA, 22 nt, Human
agauggguaacuggagucugcu

SEQ ID NO: 315715 - RNA, 22 nt, Human
ugggcagaggcucugaagucca

SEQ ID NO: 315716 - RNA, 22 nt, Human
gacccaggguuucugcacaggg

SEQ ID NO: 315717 - RNA, 22 nt, Human
cacaggaggaggccagagcgua

SEQ ID NO: 315718 - RNA, 22 nt, Human
ugcuggggucauggggcgcccg

SEQ ID NO: 315719 - RNA, 22 nt, Human
agccacagugcaagagagaaaa

SEQ ID NO: 315720 - RNA, 23 nt, Human
uaugagaauuaagugcgagugcc

SEQ ID NO: 315721 - RNA, 22 nt, Human
caggguccggcugccuggcugu

SEQ ID NO: 315722 - RNA, 22 nt, Human
caaggcugcugcgggucgcacc

SEQ ID NO: 315723 - RNA, 22 nt, Human
ggcuucccuuuccgagaggaga

SEQ ID NO: 315724 - RNA, 22 nt, Human
ugugcugguacaugugaggaug

SEQ ID NO: 315725 - RNA, 20 nt, Human
agccugccagcuggcccaga

SEQ ID NO: 315726 - RNA, 23 nt, Human
ugucacauuuaguuggcauuguu

SEQ ID NO: 315727 - RNA, 22 nt, Human
uagaaaucuacuuagacuuucu

SEQ ID NO: 315728 - RNA, 22 nt, Human
uuuccaagacuccaguucuccc

SEQ ID NO: 315729 - RNA, 20 nt, Human
uggcaccaggugguggcccc

SEQ ID NO: 315730 - RNA, 22 nt, Human
ugcuggguuaccuaagccuaaa

SEQ ID NO: 315731 - RNA, 22 nt, Human
ggagagagaugccgccuugcuc

SEQ ID NO: 315732 - RNA, 22 nt, Human
acagcuguggccacuugcaucc

SEQ ID NO: 315733 - RNA, 22 nt, Human
uuuucuuacugucugugauccu

SEQ ID NO: 315734 - RNA, 20 nt, Human
ugugugcacacaugacauuc

SEQ ID NO: 315735 - RNA, 22 nt, Human
guacuucccugggaggcaagca

SEQ ID NO: 315736 - RNA, 22 nt, Human
cucaggauagauuguccucuca

SEQ ID NO: 315737 - RNA, 22 nt, Human
ccugcucugguuuagucagucu

SEQ ID NO: 315738 - RNA, 22 nt, Human
ugucccagucaaggcugucauc

SEQ ID NO: 315739 - RNA, 22 nt, Human
agucuucagagaaauuaacucu

SEQ ID NO: 315740 - RNA, 22 nt, Human
agagcuggggccagagucaagg

SEQ ID NO: 315741 - RNA, 22 nt, Human
agcagcauuaugauauaucuua

SEQ ID NO: 315742 - RNA, 22 nt, Human
ucugggcuugguuagggcuguu

SEQ ID NO: 315743 - RNA, 22 nt, Human
acuuccuggcugggugaccugg

SEQ ID NO: 315744 - RNA, 22 nt, Human
auauauuugagaauauucauga

SEQ ID NO: 315745 - RNA, 22 nt, Human
gcugccuuugugagccaagggg

SEQ ID NO: 315746 - RNA, 22 nt, Human
gugcauuggugcgccacuucac

SEQ ID NO: 315747 - RNA, 22 nt, Human
gguagcagggcugugagucaga

SEQ ID NO: 315748 - RNA, 22 nt, Human
ggaaggagucuuuaacacccau

SEQ ID NO: 315749 - RNA, 22 nt, Human
cagucuucuaaccuagcagccu

SEQ ID NO: 315750 - RNA, 22 nt, Human
aggcacugaagaacucuuuuug

SEQ ID NO: 315751 - RNA, 22 nt, Human
agcaggaaguagucuguaagca

SEQ ID NO: 315752 - RNA, 22 nt, Human
caggggacauuaaagcuccaua

SEQ ID NO: 315753 - RNA, 19 nt, Human
auaaggcaauuggauuugg

SEQ ID NO: 315754 - RNA, 22 nt, Human
ggagggcuguagaggagaccug

SEQ ID NO: 315755 - RNA, 22 nt, Human
cagaugcuuggaggacacuugg

SEQ ID NO: 315756 - RNA, 22 nt, Human
cccuccagccauggacccaggu

SEQ ID NO: 315757 - RNA, 22 nt, Human
aaaguuuguuauaugauaagga

SEQ ID NO: 315758 - RNA, 22 nt, Human
cugugcuugacagugggaagca

SEQ ID NO: 315759 - RNA, 22 nt, Human
aguaggaggcgggagcaugaag

SEQ ID NO: 315760 - RNA, 22 nt, Human
ggccaugguuggggaagacaug

SEQ ID NO: 315761 - RNA, 22 nt, Human
auguaguauuuggaaauguaaa

SEQ ID NO: 315762 - RNA, 22 nt, Human
ccagguggcuucugcccgaugu

SEQ ID NO: 315763 - RNA, 22 nt, Human
uagaaaugaauguuuaaaaguc

SEQ ID NO: 315764 - RNA, 22 nt, Human
aagucacacuagacaacugagg

SEQ ID NO: 315765 - RNA, 22 nt, Human
aacaugaaaguugcuaagugca

SEQ ID NO: 315766 - RNA, 22 nt, Human
ucuguucaugucuuuuuaagug

SEQ ID NO: 315767 - RNA, 22 nt, Human
ugaaagggguugaguuacagcu

SEQ ID NO: 315768 - RNA, 20 nt, Human
cuccucaguuccaugggagg

SEQ ID NO: 315769 - RNA, 22 nt, Human
ucccagaggcaguugguaacuu

SEQ ID NO: 315770 - RNA, 22 nt, Human
uucaagaugucuucacaauagu

SEQ ID NO: 315771 - RNA, 22 nt, Human
gagggcugauaaaugcgcaugg

SEQ ID NO: 315772 - RNA, 19 nt, Human
ucucacaucagcuccuagc

SEQ ID NO: 315773 - RNA, 22 nt, Human
ugccauuucuuucaauauucuu

SEQ ID NO: 315774 - RNA, 22 nt, Human
ucauccaguucacauggugagu

SEQ ID NO: 315775 - RNA, 22 nt, Human
gcccugugagucaugcggcaga

SEQ ID NO: 315776 - RNA, 22 nt, Human
aguaucaaggaucuccagcacc

SEQ ID NO: 315777 - RNA, 22 nt, Human
agaugaaaagauaagcagcaau

SEQ ID NO: 315778 - RNA, 22 nt, Human
ugggcugcuuccucagcugaga

SEQ ID NO: 315779 - RNA, 22 nt, Human
ucugucaucucuaaaauagaaa

SEQ ID NO: 315780 - RNA, 22 nt, Human
ccugcccuagagaugacacaau

SEQ ID NO: 315781 - RNA, 22 nt, Human
ggcaggguggcccuccagugag

SEQ ID NO: 315782 - RNA, 21 nt, Human
gcagagccggggcgagaaggc

SEQ ID NO: 315783 - RNA, 22 nt, Human
uggccuguggcuuaaggucugu

SEQ ID NO: 315784 - RNA, 22 nt, Human
guuuuauaggcuguugcuauau

SEQ ID NO: 315785 - RNA, 20 nt, Human
gagauggcuaagugcugaac

SEQ ID NO: 315786 - RNA, 22 nt, Human
uaagaaauuuaguuauagaaug

SEQ ID NO: 315787 - RNA, 22 nt, Human
auuucuguaacuuaugaaaguu

SEQ ID NO: 315788 - RNA, 17 nt, Human
ggagagugggaauggcc

SEQ ID NO: 315789 - RNA, 22 nt, Human
ucuucaaaugcuaguaauauca

SEQ ID NO: 315790 - RNA, 22 nt, Human
cugccuggaaggagcaagggga

SEQ ID NO: 315791 - RNA, 22 nt, Human
ucauugcacuccagccugggca

SEQ ID NO: 315792 - RNA, 22 nt, Human
uuauuccagcuaagaguccugg

SEQ ID NO: 315793 - RNA, 22 nt, Human
cagggagaggcaucauagggaa

SEQ ID NO: 315794 - RNA, 22 nt, Human
gcuggagcugcagccugggccu

SEQ ID NO: 315795 - RNA, 22 nt, Human
uucugucauccuuucuagaugu

SEQ ID NO: 315796 - RNA, 22 nt, Human
gggaggcuggcucuggccacag

SEQ ID NO: 315797 - RNA, 22 nt, Human
uaaauucuacaacuucaaagau

SEQ ID NO: 315798 - RNA, 22 nt, Human
agagcugcaccuaugcagaccu

SEQ ID NO: 315799 - RNA, 22 nt, Human
uugcuuuguuacugcaguuucc

SEQ ID NO: 315800 - RNA, 22 nt, Human
ggcagccaugucccagggcuuc

SEQ ID NO: 315801 - RNA, 22 nt, Human
uauaucuuauaugugcagguac

SEQ ID NO: 315802 - RNA, 22 nt, Human
gagcuggugugugcccgagcac

SEQ ID NO: 315803 - RNA, 22 nt, Human
ucucagugaagaguauaacaaa

SEQ ID NO: 315804 - RNA, 22 nt, Human
ucagggcaagucucagaagguu

SEQ ID NO: 315805 - RNA, 22 nt, Human
ccaggcaggcgauggugcagug

SEQ ID NO: 315806 - RNA, 21 nt, Human
ugcucacagaugugcucagug

SEQ ID NO: 315807 - RNA, 22 nt, Human
ugaguagcggcuauguguaacu

SEQ ID NO: 315808 - RNA, 22 nt, Human
guccagcuccagggaggcaggc

SEQ ID NO: 315809 - RNA, 22 nt, Human
caggccuccacuccacgcagac

SEQ ID NO: 315810 - RNA, 22 nt, Human
ggagcugaaggggugggcucag

SEQ ID NO: 315811 - RNA, 22 nt, Human
ggcugccugccuccaagccggg

SEQ ID NO: 315812 - RNA, 16 nt, Human
gccuggaguggcaggg

SEQ ID NO: 315813 - RNA, 22 nt, Human
cagcuggcagcccuggcccugc

SEQ ID NO: 315814 - RNA, 22 nt, Human
aucuggcuugacuuugcgacuu

SEQ ID NO: 315815 - RNA, 22 nt, Human
cucacagguaccagcacccucc

SEQ ID NO: 315816 - RNA, 22 nt, Human
uguaugaaaaggaauagauuga

SEQ ID NO: 315817 - RNA, 22 nt, Human
ccugucagcugauggcuaugua

SEQ ID NO: 315818 - RNA, 22 nt, Human
uggcuggacagugggcagugga

SEQ ID NO: 315819 - RNA, 22 nt, Human
uuuucauuguaaaucaggaaac

SEQ ID NO: 315820 - RNA, 19 nt, Human
agaaaucucgagauuuguu

SEQ ID NO: 315821 - RNA, 22 nt, Human
cccuuagcuccaagggguuugg

SEQ ID NO: 315822 - RNA, 22 nt, Human
uguacaaugccgagacuaacuc

SEQ ID NO: 315823 - RNA, 20 nt, Human
ucagagucaucaaagauggu

SEQ ID NO: 315824 - RNA, 22 nt, Human
uccuucagcucucuauuuagau

SEQ ID NO: 315825 - RNA, 22 nt, Human
gcugccucccccauggcuggaa

SEQ ID NO: 315826 - RNA, 22 nt, Human
cagcauggagacaaagugggca

SEQ ID NO: 315827 - RNA, 22 nt, Human
gagcucaggagcaucagaagaa

SEQ ID NO: 315828 - RNA, 22 nt, Human
aaugcaguuucauuuguagaau

SEQ ID NO: 315829 - RNA, 22 nt, Human
ugccuggauucgguuguuguca

SEQ ID NO: 315830 - RNA, 22 nt, Human
ucucagaguaauucuuuaaggu

SEQ ID NO: 315831 - RNA, 21 nt, Human
ccagcuccaggaccuuggauc

SEQ ID NO: 315832 - RNA, 22 nt, Human
cagcccugggaguuggggccga

SEQ ID NO: 315833 - RNA, 22 nt, Human
aaacugaauucccaagggcaug

SEQ ID NO: 315834 - RNA, 23 nt, Human
ggcuggcccggggcugcuccuga

SEQ ID NO: 315835 - RNA, 22 nt, Human
aaugugaaaccgcacagaauaa

SEQ ID NO: 315836 - RNA, 22 nt, Human
uugaaaggcacaggcaccuggg

SEQ ID NO: 315837 - RNA, 22 nt, Human
cugucuguucagauucauuacu

SEQ ID NO: 315838 - RNA, 19 nt, Human
cuggcagccugucuguguc

SEQ ID NO: 315839 - RNA, 22 nt, Human
uuuacagaaugucaauuucuau

SEQ ID NO: 315840 - RNA, 23 nt, Human
agaaaguuugugccuugugacac

SEQ ID NO: 315841 - RNA, 22 nt, Human
cugcccugucugcagccuggcu

SEQ ID NO: 315842 - RNA, 22 nt, Human
agcagccuuugaucaucuggga

SEQ ID NO: 315843 - RNA, 22 nt, Human
uccucuggauauaagccucacc

SEQ ID NO: 315844 - RNA, 22 nt, Human
ucauugcaagcucauuuaucug

SEQ ID NO: 315845 - RNA, 22 nt, Human
cagcaauaacucaaagccauuu

SEQ ID NO: 315846 - RNA, 22 nt, Human
uuuggaauuggcauucuauucu

SEQ ID NO: 315847 - RNA, 22 nt, Human
cagcuggcuggucagugcacaa

SEQ ID NO: 315848 - RNA, 22 nt, Human
ccugugugcacacgaggccaug

SEQ ID NO: 315849 - RNA, 22 nt, Human
uuucaaaguugggaauuguaau

SEQ ID NO: 315850 - RNA, 22 nt, Human
uauuuccagcaguaagaagaca

SEQ ID NO: 315851 - RNA, 22 nt, Human
aggcugccucgugagcucgcug

SEQ ID NO: 315852 - RNA, 22 nt, Human
cuggccugaucucaugcugucc

SEQ ID NO: 315853 - RNA, 22 nt, Human
ccuggagcaggagcugcagagg

SEQ ID NO: 315854 - RNA, 22 nt, Human
uguguacaagaguguuuacugu

SEQ ID NO: 315855 - RNA, 22 nt, Human
cucagagaaaaggagcaagggu

SEQ ID NO: 315856 - RNA, 20 nt, Human
caguccugucccugcugccc

SEQ ID NO: 315857 - RNA, 22 nt, Human
ucuccuggauggaccuucucuu

SEQ ID NO: 315858 - RNA, 22 nt, Human
ucacaucucccuggaggacaca

SEQ ID NO: 315859 - RNA, 19 nt, Human
gucacauuugucucccagg

SEQ ID NO: 315860 - RNA, 22 nt, Human
gccuggagagcacugugcgcuu

SEQ ID NO: 315861 - RNA, 22 nt, Human
uccugccuguuuaccuguacuu

SEQ ID NO: 315862 - RNA, 22 nt, Human
ccuuccuggagcccaugcagau

SEQ ID NO: 315863 - RNA, 22 nt, Human
uauuuguauuucaugcaguaaa

SEQ ID NO: 315864 - RNA, 22 nt, Human
gccucugggcucugccccuggc

SEQ ID NO: 315865 - RNA, 22 nt, Human
ugauugaacugagcuucaagau

SEQ ID NO: 315866 - RNA, 20 nt, Human
ccagguggugccuggagagg

SEQ ID NO: 315867 - RNA, 22 nt, Human
ugaugaaauguugaggcaguga

SEQ ID NO: 315868 - RNA, 22 nt, Human
aaugagaaccuugaaaggaacu

SEQ ID NO: 315869 - RNA, 22 nt, Human
cuuccuugcggccccugccuag

SEQ ID NO: 315870 - RNA, 22 nt, Human
caguccagcucaucaguggcac

SEQ ID NO: 315871 - RNA, 22 nt, Human
cugagagucagcuucuccuccu

SEQ ID NO: 315872 - RNA, 22 nt, Human
uaugcacaccuggguccuuguc

SEQ ID NO: 315873 - RNA, 22 nt, Human
ugugcaguuucuauguugucca

SEQ ID NO: 315874 - RNA, 22 nt, Human
gcagggcuaauggggcaaguag

SEQ ID NO: 315875 - RNA, 22 nt, Human
gccaggaaugcauaaaugaccu

SEQ ID NO: 315876 - RNA, 22 nt, Human
cuugaaagucacaugcagcccu

SEQ ID NO: 315877 - RNA, 22 nt, Human
ugcugccaggucuugcugucca

SEQ ID NO: 315878 - RNA, 22 nt, Human
uuuagaaauugcagagugggug

SEQ ID NO: 315879 - RNA, 22 nt, Human
uauucugugugauauguaaaug

SEQ ID NO: 315880 - RNA, 19 nt, Human
aauacaguguuauagaauu

SEQ ID NO: 315881 - RNA, 18 nt, Human
gugagcagagagcaucac

SEQ ID NO: 315882 - RNA, 22 nt, Human
aauuaugagguagauaucacau

SEQ ID NO: 315883 - RNA, 22 nt, Human
uuuuccucuguuauuaguguga

SEQ ID NO: 315884 - RNA, 22 nt, Human
ggaaggggagcuaaaucuacug

SEQ ID NO: 315885 - RNA, 22 nt, Human
gcagguggcagaggugggaucu

SEQ ID NO: 315886 - RNA, 22 nt, Human
aggccuggcaugagaccugaga

SEQ ID NO: 315887 - RNA, 22 nt, Human
ccagggcagccaacccagaugc

SEQ ID NO: 315888 - RNA, 22 nt, Human
ugucccuggaacuauggcucca

SEQ ID NO: 315889 - RNA, 22 nt, Human
aaaugucuuuaucucauguaac

SEQ ID NO: 315890 - RNA, 22 nt, Human
ugcugccacaaauucagcugcc

SEQ ID NO: 315891 - RNA, 23 nt, Human
ugcugguguuuuugggaccaggg

SEQ ID NO: 315892 - RNA, 22 nt, Human
gcagguguggaguggggugagc

SEQ ID NO: 315893 - RNA, 22 nt, Human
ggauccuucuuugaccucacag

SEQ ID NO: 315894 - RNA, 22 nt, Human
agaagcagacucugaggcaagg

SEQ ID NO: 315895 - RNA, 22 nt, Human
ugcugucuguuuacuggcuaua

SEQ ID NO: 315896 - RNA, 22 nt, Human
uggaaagaugaagauguuuaag

SEQ ID NO: 315897 - RNA, 22 nt, Human
uaugaaauugccauuuuuaugg

SEQ ID NO: 315898 - RNA, 22 nt, Human
aagccaggggcugcuuaggaga

SEQ ID NO: 315899 - RNA, 22 nt, Human
gccugcagaggugcugcuagcu

SEQ ID NO: 315900 - RNA, 22 nt, Human
auucuucauaccuacugagguu

SEQ ID NO: 315901 - RNA, 22 nt, Human
cuuaacauccugcauuuuucuu

SEQ ID NO: 315902 - RNA, 22 nt, Human
cuggcuccacucccugccugac

SEQ ID NO: 315903 - RNA, 22 nt, Human
uucucuuauucuggauaugcag

SEQ ID NO: 315904 - RNA, 22 nt, Human
uggcagcuugaaugcagucuuu

SEQ ID NO: 315905 - RNA, 22 nt, Human
caggguggggcuggcuaucaaa

SEQ ID NO: 315906 - RNA, 22 nt, Human
uugaaaacuuucuagaccaaga

SEQ ID NO: 315907 - RNA, 22 nt, Human
guacaaaguggaccugauagua

SEQ ID NO: 315908 - RNA, 23 nt, Human
ugguggggucuuggagacagcac

SEQ ID NO: 315909 - RNA, 22 nt, Human
cuguucucuggcgguggcuguu

SEQ ID NO: 315910 - RNA, 22 nt, Human
uggagaaagcugcauauggaaa

SEQ ID NO: 315911 - RNA, 22 nt, Human
uccagucauuuccauuguuccc

SEQ ID NO: 315912 - RNA, 22 nt, Human
acuguguccucauguggcagaa

SEQ ID NO: 315913 - RNA, 21 nt, Human
acccuggguucuccauacccu

SEQ ID NO: 315914 - RNA, 22 nt, Human
gcugagcugggacaguccuggg

SEQ ID NO: 315915 - RNA, 22 nt, Human
guuauguaugggggccuuauga

SEQ ID NO: 315916 - RNA, 22 nt, Human
guuaucaugcuucaucaucacu

SEQ ID NO: 315917 - RNA, 22 nt, Human
agcagcuggugagcaagcucag

SEQ ID NO: 315918 - RNA, 22 nt, Human
uagcagcucacagccucccauu

SEQ ID NO: 315919 - RNA, 22 nt, Human
cauuaagauuuuuuucuacugg

SEQ ID NO: 315920 - RNA, 22 nt, Human
agauuucagaugcucggcaguu

SEQ ID NO: 315921 - RNA, 22 nt, Human
aacagaacccgagugugaaucu

SEQ ID NO: 315922 - RNA, 22 nt, Human
ucccaggauguuggcggcaggu

SEQ ID NO: 315923 - RNA, 19 nt, Human
aaaagucuauucaauuaca

SEQ ID NO: 315924 - RNA, 22 nt, Human
agggucuguggaugcaucuggg

SEQ ID NO: 315925 - RNA, 22 nt, Human
uuaaauuauuucuagugaggug

SEQ ID NO: 315926 - RNA, 22 nt, Human
aggugaaguugaggaggcagaa

SEQ ID NO: 315927 - RNA, 22 nt, Human
acuuccugcuaugagcuucugu

SEQ ID NO: 315928 - RNA, 22 nt, Human
gaggggcuugaggcccugaugg

SEQ ID NO: 315929 - RNA, 22 nt, Human
aaaugugcuugugaucagcugu

SEQ ID NO: 315930 - RNA, 22 nt, Human
uagagcuauuuagagcauuuua

SEQ ID NO: 315931 - RNA, 18 nt, Human
cucaggccuuucccugug

SEQ ID NO: 315932 - RNA, 22 nt, Human
uggccuggaagagaggucgagg

SEQ ID NO: 315933 - RNA, 22 nt, Human
ucagagaugcagugccaccuac

SEQ ID NO: 315934 - RNA, 22 nt, Human
ggagucccagcaaagccuuccc

SEQ ID NO: 315935 - RNA, 22 nt, Human
agcagaaccacagcacuguuga

SEQ ID NO: 315936 - RNA, 22 nt, Human
gucccaggcuuauguggagcuu

SEQ ID NO: 315937 - RNA, 22 nt, Human
cucuggagguugagcccagcaa

SEQ ID NO: 315938 - RNA, 22 nt, Human
gcaguucuacuuauccauagac

SEQ ID NO: 315939 - RNA, 22 nt, Human
caaaugugguuucucagcauuc

SEQ ID NO: 315940 - RNA, 19 nt, Human
aggcccagcgcugggggcu

SEQ ID NO: 315941 - RNA, 22 nt, Human
gaaggccaguuuugagauaggu

SEQ ID NO: 315942 - RNA, 22 nt, Human
acucaggagggaucagcuauca

SEQ ID NO: 315943 - RNA, 22 nt, Human
gggagagcgcgcuagggccgag

SEQ ID NO: 315944 - RNA, 22 nt, Human
aucaaaaugcuccagugauggu

SEQ ID NO: 315945 - RNA, 22 nt, Human
ggccucuggcaggcaggcccuc

SEQ ID NO: 315946 - RNA, 22 nt, Human
aucaggauggguuuggcuuagg

SEQ ID NO: 315947 - RNA, 22 nt, Human
uggcagcagggccccuggagga

SEQ ID NO: 315948 - RNA, 22 nt, Human
uuuuccuacugauaaacaguua

SEQ ID NO: 315949 - RNA, 22 nt, Human
acacugaauaauugagaguuga

SEQ ID NO: 315950 - RNA, 20 nt, Human
gucucagaauggauuugcau

SEQ ID NO: 315951 - RNA, 22 nt, Human
ugucucaguucccuucucugga

SEQ ID NO: 315952 - RNA, 22 nt, Human
ccagcugcugugcagggaggcu

SEQ ID NO: 315953 - RNA, 22 nt, Human
uggcccugacugauguggaggg

SEQ ID NO: 315954 - RNA, 22 nt, Human
gccuccugguugcuucuccaac

SEQ ID NO: 315955 - RNA, 22 nt, Human
uggcucaguggcagccgcagcu

SEQ ID NO: 315956 - RNA, 22 nt, Human
aaaguucagugccuucuauaca

SEQ ID NO: 315957 - RNA, 22 nt, Human
cucuggacacuggcaugggguc

SEQ ID NO: 315958 - RNA, 20 nt, Human
uccugcaguuccuaggaggg

SEQ ID NO: 315959 - RNA, 22 nt, Human
cuggcagcuuagcacucugguu

SEQ ID NO: 315960 - RNA, 22 nt, Human
agcugcagauucuaucuagaag

SEQ ID NO: 315961 - RNA, 21 nt, Human
aggcucagcagguguauaaag

SEQ ID NO: 315962 - RNA, 22 nt, Human
uggagcaggacugcugcccuca

SEQ ID NO: 315963 - RNA, 21 nt, Human
ggcccugguuacgccuccucu

SEQ ID NO: 315964 - RNA, 22 nt, Human
aguucacauaucuguuuuauuu

SEQ ID NO: 315965 - RNA, 22 nt, Human
caggggccaggcugucugcugu

SEQ ID NO: 315966 - RNA, 22 nt, Human
guugggaagcagauggaugagc

SEQ ID NO: 315967 - RNA, 22 nt, Human
gggcaggaugcaguuucagaga

SEQ ID NO: 315968 - RNA, 23 nt, Human
ccagcuccgugagccucgggcuc

SEQ ID NO: 315969 - RNA, 22 nt, Human
caaagaugcugauguuggauca

SEQ ID NO: 315970 - RNA, 22 nt, Human
ggcgaggccgggacaggcugga

SEQ ID NO: 315971 - RNA, 22 nt, Human
agcuggguggagggcccacggu

SEQ ID NO: 315972 - RNA, 22 nt, Human
aagacauuuauuugaaucaauu

SEQ ID NO: 315973 - RNA, 22 nt, Human
uugaaauaucaaguuauuagug

SEQ ID NO: 315974 - RNA, 22 nt, Human
uuuucauuguuccucgagcauu

SEQ ID NO: 315975 - RNA, 22 nt, Human
uguuccuaaauaugaauggaga

SEQ ID NO: 315976 - RNA, 22 nt, Human
aaaacucugcaguuaguuucua

SEQ ID NO: 315977 - RNA, 22 nt, Human
uggggagugaugccucggauaa

SEQ ID NO: 315978 - RNA, 22 nt, Human
guggggggacguuggucacuuu

SEQ ID NO: 315979 - RNA, 22 nt, Human
uggagggaacccaggcugcucu

SEQ ID NO: 315980 - RNA, 22 nt, Human
ucagcuucagaucagcuagaga

SEQ ID NO: 315981 - RNA, 22 nt, Human
uuucacauaugguuguugauug

SEQ ID NO: 315982 - RNA, 22 nt, Human
agggcagaggcggacacggaag

SEQ ID NO: 315983 - RNA, 22 nt, Human
ugcaagagguaaaaugaaagga

SEQ ID NO: 315984 - RNA, 22 nt, Human
caugauuuugucuuguguuaau

SEQ ID NO: 315985 - RNA, 22 nt, Human
gccugguggugugcucaagugg

SEQ ID NO: 315986 - RNA, 19 nt, Human
ugaaauggcaguugcuaaa

SEQ ID NO: 315987 - RNA, 22 nt, Human
cccccaggcucugacacaggag

SEQ ID NO: 315988 - RNA, 22 nt, Human
agaggcuccuagccacuggcuu

SEQ ID NO: 315989 - RNA, 22 nt, Human
agugugaccuuauuuggaaaca

SEQ ID NO: 315990 - RNA, 22 nt, Human
cugguccuugacgcgugggagg

SEQ ID NO: 315991 - RNA, 22 nt, Human
cacagcugcccuacuccaugug

SEQ ID NO: 315992 - RNA, 22 nt, Human
ucugggaacagccuggcugugu

SEQ ID NO: 315993 - RNA, 18 nt, Human
gucauugcaacauacugu

SEQ ID NO: 315994 - RNA, 22 nt, Human
aucacauuguuagcauagacug

SEQ ID NO: 315995 - RNA, 22 nt, Human
caggugggaccaugauagggca

SEQ ID NO: 315996 - RNA, 22 nt, Human
ucaaaguuacuugugguuuucu

SEQ ID NO: 315997 - RNA, 22 nt, Human
augccuggucccaccucuaggu

SEQ ID NO: 315998 - RNA, 22 nt, Human
gcauuucugugcauacacauga

SEQ ID NO: 315999 - RNA, 22 nt, Human
agaggccaguggcugugcuguc

SEQ ID NO: 316000 - RNA, 22 nt, Human
ucuuuguaaaugccuagcauaa

SEQ ID NO: 316001 - RNA, 22 nt, Human
caggcacuagcagaaugaggcu

SEQ ID NO: 316002 - RNA, 22 nt, Human
augcuuuuccuaaaaugaugcc

SEQ ID NO: 316003 - RNA, 22 nt, Human
uuuuauuggagugauaccaagc

SEQ ID NO: 316004 - RNA, 22 nt, Human
gagaaagacguaggcugggagg

SEQ ID NO: 316005 - RNA, 22 nt, Human
cugccaucugagccaaaagugc

SEQ ID NO: 316006 - RNA, 22 nt, Human
cagcccugcacgcugccuccgc

SEQ ID NO: 316007 - RNA, 22 nt, Human
caggagacaauggcuguggggc

SEQ ID NO: 316008 - RNA, 22 nt, Human
acagggcagagugaaaugcuau

SEQ ID NO: 316009 - RNA, 19 nt, Human
aggaaagguggccuuagca

SEQ ID NO: 316010 - RNA, 21 nt, Human
gcagcaguguucuagaauacu

SEQ ID NO: 316011 - RNA, 22 nt, Human
uucuucaaaauccagcaugauu

SEQ ID NO: 316012 - RNA, 22 nt, Human
cuggagccauguauagccuaug

SEQ ID NO: 316013 - RNA, 22 nt, Human
uuacaaagaguguucuuuucca

SEQ ID NO: 316014 - RNA, 22 nt, Human
cugcuuugcauagcugccagag

SEQ ID NO: 316015 - RNA, 22 nt, Human
uuagccauauagaaaaagagcu

SEQ ID NO: 316016 - RNA, 22 nt, Human
gaggccuggagccgccuaggcg

SEQ ID NO: 316017 - RNA, 22 nt, Human
uagccucucuccuccacaaccu

SEQ ID NO: 316018 - RNA, 22 nt, Human
cuuucauucuuagauauuagug

SEQ ID NO: 316019 - RNA, 22 nt, Human
aggcacuggguaauuaguagcu

SEQ ID NO: 316020 - RNA, 22 nt, Human
gcuuccucgcugggcagaggca

SEQ ID NO: 316021 - RNA, 22 nt, Human
accagagaaaacacagcaggcu

SEQ ID NO: 316022 - RNA, 22 nt, Human
cugagcucuaaugucagccuug

SEQ ID NO: 316023 - RNA, 22 nt, Human
uacaguaaagcugcuaugaauu

SEQ ID NO: 316024 - RNA, 22 nt, Human
aguuuauguagaauuggcaaua

SEQ ID NO: 316025 - RNA, 22 nt, Human
guaaaguucuacuagaaucaac

SEQ ID NO: 316026 - RNA, 22 nt, Human
aaacuguaaacacagcaguaca

SEQ ID NO: 316027 - RNA, 22 nt, Human
caaaagauacuugcaucuaacu

SEQ ID NO: 316028 - RNA, 21 nt, Human
uacugagaccucacagugugc

SEQ ID NO: 316029 - RNA, 22 nt, Human
ggcaggugcaccugagccaucu

SEQ ID NO: 316030 - RNA, 22 nt, Human
ucccagaggaaauggcagcuga

SEQ ID NO: 316031 - RNA, 22 nt, Human
aggccaaguagcuagcauugaa

SEQ ID NO: 316032 - RNA, 22 nt, Human
ugcacagagagaugagacacgu

SEQ ID NO: 316033 - RNA, 22 nt, Human
agugaaauagcauuuaugaagc

SEQ ID NO: 316034 - RNA, 22 nt, Human
agucucagaaaagaagcaugga

SEQ ID NO: 316035 - RNA, 22 nt, Human
acacauauauacauauuugugc

SEQ ID NO: 316036 - RNA, 22 nt, Human
uguauuuucuucuggaagcuua

SEQ ID NO: 316037 - RNA, 20 nt, Human
uaagaacaagacuaggaagc

SEQ ID NO: 316038 - RNA, 22 nt, Human
ggcugcagcagagggacucacg

SEQ ID NO: 316039 - RNA, 19 nt, Human
cugaagucuuuucagcugg

SEQ ID NO: 316040 - RNA, 22 nt, Human
aaggcagccgugugacugcaug

SEQ ID NO: 316041 - RNA, 22 nt, Human
acacaugcugauaagaauauaa

SEQ ID NO: 316042 - RNA, 22 nt, Human
auuuucagaacauucauucacu

SEQ ID NO: 316043 - RNA, 22 nt, Human
cagcuggcccuuugguagccuu

SEQ ID NO: 316044 - RNA, 19 nt, Human
aucuuacagagcagaguac

SEQ ID NO: 316045 - RNA, 18 nt, Human
cucugucauaagugucau

SEQ ID NO: 316046 - RNA, 22 nt, Human
guggccuggaugagcuucgaca

SEQ ID NO: 316047 - RNA, 22 nt, Human
uccugagagcagcugcuuugga

SEQ ID NO: 316048 - RNA, 22 nt, Human
aauauugagaaccagcauguuu

SEQ ID NO: 316049 - RNA, 22 nt, Human
agcuccugcaccaggggccccu

SEQ ID NO: 316050 - RNA, 22 nt, Human
agcagaugagccucaugacugg

SEQ ID NO: 316051 - RNA, 22 nt, Human
uuucauguuuucuuaaauggca

SEQ ID NO: 316052 - RNA, 22 nt, Human
aaauguaguauguugcauguau

SEQ ID NO: 316053 - RNA, 23 nt, Human
agggaaaguaguaauggccuuug

SEQ ID NO: 316054 - RNA, 22 nt, Human
aaggcaguaggaucuuccacag

SEQ ID NO: 316055 - RNA, 22 nt, Human
gaguggggucugggcaucaguc

SEQ ID NO: 316056 - RNA, 22 nt, Human
ggcuggcuuucucuccgcaccu

SEQ ID NO: 316057 - RNA, 22 nt, Human
caggcacugugcaagggucucg

SEQ ID NO: 316058 - RNA, 19 nt, Human
auuugaaagcugugcuugc

SEQ ID NO: 316059 - RNA, 22 nt, Human
augcucugggcaggagcccugg

SEQ ID NO: 316060 - RNA, 22 nt, Human
uagaaauguugguauuaacauu

SEQ ID NO: 316061 - RNA, 22 nt, Human
guuauaaaggugauaaugguca

SEQ ID NO: 316062 - RNA, 22 nt, Human
aggucauuuccuuagaggcaga

SEQ ID NO: 316063 - RNA, 22 nt, Human
gcacagggcccugugcguaggu

SEQ ID NO: 316064 - RNA, 22 nt, Human
auuaaauuaaguggcuaauuua

SEQ ID NO: 316065 - RNA, 20 nt, Human
agucccagaucaaauuucug

SEQ ID NO: 316066 - RNA, 22 nt, Human
cagcugcccaagccccagaugu

SEQ ID NO: 316067 - RNA, 22 nt, Human
aaauuauuacaagcuaguuggc

SEQ ID NO: 316068 - RNA, 22 nt, Human
aagcuccccgaaacccaccucu

SEQ ID NO: 316069 - RNA, 22 nt, Human
ucagguggcuuggagggggacg

SEQ ID NO: 316070 - RNA, 22 nt, Human
gccaggcauucuagaaguagug

SEQ ID NO: 316071 - RNA, 22 nt, Human
augaaaugcugagaggugcuuc

SEQ ID NO: 316072 - RNA, 22 nt, Human
uuugaaagagcugauacaugaa

SEQ ID NO: 316073 - RNA, 20 nt, Human
aaagucuuaugguuaauuuu

SEQ ID NO: 316074 - RNA, 22 nt, Human
ccuggcugguggcagcgacaag

SEQ ID NO: 316075 - RNA, 22 nt, Human
gagcagcugguaggugaaccca

SEQ ID NO: 316076 - RNA, 22 nt, Human
uccagucaucucccuucacauu

SEQ ID NO: 316077 - RNA, 22 nt, Human
aauguacaauaagacaaagagg

SEQ ID NO: 316078 - RNA, 22 nt, Human
agaagccaacagggcaggagag

SEQ ID NO: 316079 - RNA, 22 nt, Human
gucugagaaucuugcauaucau

SEQ ID NO: 316080 - RNA, 22 nt, Human
augugaaagagguguucagugg

SEQ ID NO: 316081 - RNA, 23 nt, Human
uggaccugaaccagugccucugu

SEQ ID NO: 316082 - RNA, 22 nt, Human
auggccuggccagagcucugcu

SEQ ID NO: 316083 - RNA, 22 nt, Human
uucacauugguucuugauagcu

SEQ ID NO: 316084 - RNA, 22 nt, Human
ugcugcucuguaaagugaugag

SEQ ID NO: 316085 - RNA, 22 nt, Human
cucuuaaagaauguuccagcug

SEQ ID NO: 316086 - RNA, 22 nt, Human
aauaucaguauauuguaucagu

SEQ ID NO: 316087 - RNA, 20 nt, Human
uaggcagagcugugcagccu

SEQ ID NO: 316088 - RNA, 22 nt, Human
ucugccuuggcaaccacagcuu

SEQ ID NO: 316089 - RNA, 20 nt, Human
ugcugcuuugccacuaguug

SEQ ID NO: 316090 - RNA, 22 nt, Human
aaggaugaacauuaauacauca

SEQ ID NO: 316091 - RNA, 22 nt, Human
ccuggagggcgccgcacagucc

SEQ ID NO: 316092 - RNA, 22 nt, Human
acauuuaaauaccuauguuucu

SEQ ID NO: 316093 - RNA, 22 nt, Human
gcccagcuccucugcagacccu

SEQ ID NO: 316094 - RNA, 22 nt, Human
ccuuaaaagaacuaucucuucu

SEQ ID NO: 316095 - RNA, 22 nt, Human
uuugacauggaauaacucauuu

SEQ ID NO: 316096 - RNA, 22 nt, Human
caguacuuguccucagguguua

SEQ ID NO: 316097 - RNA, 22 nt, Human
ugggagagugcucaaugugcaa

SEQ ID NO: 316098 - RNA, 22 nt, Human
auacauacauguaugcacauac

SEQ ID NO: 316099 - RNA, 18 nt, Human
cccacggugcuguagggc

SEQ ID NO: 316100 - RNA, 22 nt, Human
uccugccuugccugggacauca

SEQ ID NO: 316101 - RNA, 22 nt, Human
aaagaucuccccuucaaagagu

SEQ ID NO: 316102 - RNA, 22 nt, Human
ugugugccagccuacgaggagc

SEQ ID NO: 316103 - RNA, 22 nt, Human
ucuaggagaaccaucagggagg

SEQ ID NO: 316104 - RNA, 20 nt, Human
aguaggggaaugcaagagca

SEQ ID NO: 316105 - RNA, 22 nt, Human
cagggcuguaaauuagugcuga

SEQ ID NO: 316106 - RNA, 22 nt, Human
aggagccaagauggggcaagua

SEQ ID NO: 316107 - RNA, 22 nt, Human
caaacugagcaucagaaaguuu

SEQ ID NO: 316108 - RNA, 22 nt, Human
gcugucugggaugucacugcug

SEQ ID NO: 316109 - RNA, 22 nt, Human
uggugaagucagcggagcccgg

SEQ ID NO: 316110 - RNA, 19 nt, Human
uguggccaugguucagcug

SEQ ID NO: 316111 - RNA, 22 nt, Human
aaaguuugaaugauauauuagu

SEQ ID NO: 316112 - RNA, 22 nt, Human
guggcccucugauagggucagg

SEQ ID NO: 316113 - RNA, 23 nt, Human
agcacacuuguacaaugcccuag

SEQ ID NO: 316114 - RNA, 22 nt, Human
uguguauuaccauuuuacagcu

SEQ ID NO: 316115 - RNA, 22 nt, Human
uccucaguuuucuaguauggca

SEQ ID NO: 316116 - RNA, 22 nt, Human
ugucucagaguaucccugaacu

SEQ ID NO: 316117 - RNA, 22 nt, Human
ggagagaacugaccugaaagga

SEQ ID NO: 316118 - RNA, 22 nt, Human
ucagcugccucucccuggaaga

SEQ ID NO: 316119 - RNA, 22 nt, Human
gucucagauucagacaucuaca

SEQ ID NO: 316120 - RNA, 22 nt, Human
acugcuuuucuaagauucugug

SEQ ID NO: 316121 - RNA, 18 nt, Human
uucaccagugugaugggu

SEQ ID NO: 316122 - RNA, 22 nt, Human
cagugccucuuaagugucaccc

SEQ ID NO: 316123 - RNA, 20 nt, Human
ggccugagcauggcuggcag

SEQ ID NO: 316124 - RNA, 22 nt, Human
cauggccucaaaggacugcaga

SEQ ID NO: 316125 - RNA, 22 nt, Human
gcucaggaucagccaccucuuu

SEQ ID NO: 316126 - RNA, 22 nt, Human
aggcuccuaucgcuuucagcaa

SEQ ID NO: 316127 - RNA, 22 nt, Human
agggagacacaugaggaaguca

SEQ ID NO: 316128 - RNA, 22 nt, Human
ucagcagcagcucagcauguuu

SEQ ID NO: 316129 - RNA, 22 nt, Human
cugcccugucuuuuucugauga

SEQ ID NO: 316130 - RNA, 21 nt, Human
accaggcuugugggagggagc

SEQ ID NO: 316131 - RNA, 22 nt, Human
uucacaggaggguggaugcaug

SEQ ID NO: 316132 - RNA, 22 nt, Human
ccaaagagcuagaauuauaggc

SEQ ID NO: 316133 - RNA, 22 nt, Human
aauauguucaaaauagaucacu

SEQ ID NO: 316134 - RNA, 22 nt, Human
auuuuacuacuccaauuaauga

SEQ ID NO: 316135 - RNA, 22 nt, Human
caucacuguccucagcauucca

SEQ ID NO: 316136 - RNA, 22 nt, Human
uuucagcugguaaaggaguagc

SEQ ID NO: 316137 - RNA, 22 nt, Human
ccagagcuccagggcuacagaa

SEQ ID NO: 316138 - RNA, 22 nt, Human
ucacaucuuauuagaguaucuc

SEQ ID NO: 316139 - RNA, 22 nt, Human
uccaugagggacacuggaugcu

SEQ ID NO: 316140 - RNA, 22 nt, Human
ggccucugggguccugagccca

SEQ ID NO: 316141 - RNA, 22 nt, Human
aagcugccacacggugaguacu

SEQ ID NO: 316142 - RNA, 22 nt, Human
uaacagaauagcagaaacagaa

SEQ ID NO: 316143 - RNA, 20 nt, Human
ggccuuggguuucgccuguu

SEQ ID NO: 316144 - RNA, 22 nt, Human
gcugggagucgcgucuguggcc

SEQ ID NO: 316145 - RNA, 22 nt, Human
ggccaccuuccaguugccugca

SEQ ID NO: 316146 - RNA, 22 nt, Human
cucauuaaaggaaaucaccugc

SEQ ID NO: 316147 - RNA, 20 nt, Human
aguagcagugugacauugac

SEQ ID NO: 316148 - RNA, 22 nt, Human
caggagugaaaugaggcccagg

SEQ ID NO: 316149 - RNA, 22 nt, Human
ugcaggagcugugcggugaggg

SEQ ID NO: 316150 - RNA, 22 nt, Human
gcauugucaaaagugguaugac

SEQ ID NO: 316151 - RNA, 23 nt, Human
uugcuucugugcaauucaguacu

SEQ ID NO: 316152 - RNA, 22 nt, Human
augugaggaagaaagagguaag

SEQ ID NO: 316153 - RNA, 22 nt, Human
ccagggugggguccaggaacca

SEQ ID NO: 316154 - RNA, 18 nt, Human
ucagcuggggcugcagcc

SEQ ID NO: 316155 - RNA, 22 nt, Human
ccaggcaggcagcguucucagg

SEQ ID NO: 316156 - RNA, 23 nt, Human
uacauuguggauggaguccuggg

SEQ ID NO: 316157 - RNA, 18 nt, Human
guucaaggucaagagaga

SEQ ID NO: 316158 - RNA, 22 nt, Human
caaagugcugagauuacaggua

SEQ ID NO: 316159 - RNA, 22 nt, Human
caggagcaaggagcagugggau

SEQ ID NO: 316160 - RNA, 22 nt, Human
cuggcucauagagcagcuccaa

SEQ ID NO: 316161 - RNA, 22 nt, Human
gcagggaggaagagaugcuucc

SEQ ID NO: 316162 - RNA, 22 nt, Human
agcugagcacauucaaacaggu

SEQ ID NO: 316163 - RNA, 22 nt, Human
ggcuagaacuuuacacuuugca

SEQ ID NO: 316164 - RNA, 22 nt, Human
ucucagugguggcauuccagac

SEQ ID NO: 316165 - RNA, 22 nt, Human
uucuuaaagaggcaaaacacag

SEQ ID NO: 316166 - RNA, 22 nt, Human
gggcugcugccaccagguggau

SEQ ID NO: 316167 - RNA, 22 nt, Human
gcugugcuggaaggggaccugc

SEQ ID NO: 316168 - RNA, 22 nt, Human
aggcagaggagaaugaucuucc

SEQ ID NO: 316169 - RNA, 20 nt, Human
ucauuucuugggguuccaag

SEQ ID NO: 316170 - RNA, 22 nt, Human
ggagccaggggaccuucacaga

SEQ ID NO: 316171 - RNA, 22 nt, Human
ugcagugguugagagcccagac

SEQ ID NO: 316172 - RNA, 22 nt, Human
aauaacuuaagaaauuucccca

SEQ ID NO: 316173 - RNA, 22 nt, Human
ggugugccuggggcuuagcugc

SEQ ID NO: 316174 - RNA, 22 nt, Human
gcuggggaggcagcagagaaca

SEQ ID NO: 316175 - RNA, 22 nt, Human
uuuauauuaccuggaauagcuu

SEQ ID NO: 316176 - RNA, 22 nt, Human
cacagggcaggccccaggccuc

SEQ ID NO: 316177 - RNA, 22 nt, Human
cugccagguuggcgcucgcucu

SEQ ID NO: 316178 - RNA, 22 nt, Human
cuugcacacauguacaugugua

SEQ ID NO: 316179 - RNA, 20 nt, Human
acugcuucuuucucugaccu

SEQ ID NO: 316180 - RNA, 22 nt, Human
ggugaaggaggaagcugaugga

SEQ ID NO: 316181 - RNA, 22 nt, Human
auuaaauuuucacuaggcuccc

SEQ ID NO: 316182 - RNA, 20 nt, Human
ugcagagcuggcuggcuccu

SEQ ID NO: 316183 - RNA, 22 nt, Human
caaaugaagaaccuucucaccu

SEQ ID NO: 316184 - RNA, 23 nt, Human
ugggcaucuccucugugccaggc

SEQ ID NO: 316185 - RNA, 22 nt, Human
gcugccucuguagcuuuggacc

SEQ ID NO: 316186 - RNA, 22 nt, Human
cacaaauggccguguucaaaga

SEQ ID NO: 316187 - RNA, 22 nt, Human
acacauauucauauguacuuac

SEQ ID NO: 316188 - RNA, 22 nt, Human
agcaugcacaugacuggcuuaa

SEQ ID NO: 316189 - RNA, 22 nt, Human
gacacauagaucuaucucacuc

SEQ ID NO: 316190 - RNA, 22 nt, Human
ugaaggcauugaugaaggaauc

SEQ ID NO: 316191 - RNA, 19 nt, Human
uguguaaagucugugguca

SEQ ID NO: 316192 - RNA, 20 nt, Human
gaaaugugaccucuucugug

SEQ ID NO: 316193 - RNA, 21 nt, Human
gccuggcagguggaagggcuc

SEQ ID NO: 316194 - RNA, 22 nt, Human
augucuuuggcuuugacauggc

SEQ ID NO: 316195 - RNA, 22 nt, Human
ucccagagcucugacaccagcu

SEQ ID NO: 316196 - RNA, 22 nt, Human
aaugcagugagccauuaaaugg

SEQ ID NO: 316197 - RNA, 22 nt, Human
agcuccugauacaugcaggaau

SEQ ID NO: 316198 - RNA, 18 nt, Human
aagcugggaaggagacag

SEQ ID NO: 316199 - RNA, 22 nt, Human
gcccugucccuuggcuucuagg

SEQ ID NO: 316200 - RNA, 18 nt, Human
ggccucagccuggccgga

SEQ ID NO: 316201 - RNA, 22 nt, Human
gagcugggacauggguccucuc

SEQ ID NO: 316202 - RNA, 22 nt, Human
aaggucauuuaacaauuuauga

SEQ ID NO: 316203 - RNA, 22 nt, Human
auacacauauguguguauaugu

SEQ ID NO: 316204 - RNA, 22 nt, Human
ccagccuggguguuagaagaca

SEQ ID NO: 316205 - RNA, 22 nt, Human
uccagcagguuggucaggugca

SEQ ID NO: 316206 - RNA, 22 nt, Human
acauuucugcauguaggguaau

SEQ ID NO: 316207 - RNA, 22 nt, Human
gcuguucacaucuggaccauuu

SEQ ID NO: 316208 - RNA, 22 nt, Human
uuuucauuuuuguagaugcaag

SEQ ID NO: 316209 - RNA, 22 nt, Human
aaggccagcuuguagggcuggu

SEQ ID NO: 316210 - RNA, 22 nt, Human
agccccucuguggcucugccuc

SEQ ID NO: 316211 - RNA, 22 nt, Human
uucuucuucauuucugacgaug

SEQ ID NO: 316212 - RNA, 22 nt, Human
caggcagcagccacucugguau

SEQ ID NO: 316213 - RNA, 22 nt, Human
aguuauaaucugcuacugauau

SEQ ID NO: 316214 - RNA, 22 nt, Human
ggggcagauggaacagagcaca

SEQ ID NO: 316215 - RNA, 22 nt, Human
ccccaggacacauggaccaagu

SEQ ID NO: 316216 - RNA, 22 nt, Human
ugucugucugcaagccagaaag

SEQ ID NO: 316217 - RNA, 22 nt, Human
agcccagaggcugggcgugcau

SEQ ID NO: 316218 - RNA, 22 nt, Human
ggcugccuccugcugggcugga

SEQ ID NO: 316219 - RNA, 22 nt, Human
uuggcugaagguuaagugcugg

SEQ ID NO: 316220 - RNA, 22 nt, Human
gcucagagauggggaaugaaaa

SEQ ID NO: 316221 - RNA, 22 nt, Human
ccaggagcagggcuggcugcac

SEQ ID NO: 316222 - RNA, 22 nt, Human
gaggagaggggcucccaagagc

SEQ ID NO: 316223 - RNA, 22 nt, Human
agaaauguauucuguauguuuu

SEQ ID NO: 316224 - RNA, 22 nt, Human
uuccauaauuaaguggagagaa

SEQ ID NO: 316225 - RNA, 22 nt, Human
agaauaugaugguuggagaauu

SEQ ID NO: 316226 - RNA, 22 nt, Human
cagguggagcugacugagggca

SEQ ID NO: 316227 - RNA, 22 nt, Human
uucuggagagaaaccuuacaaa

SEQ ID NO: 316228 - RNA, 22 nt, Human
ccucccuuggccauagccagcc

SEQ ID NO: 316229 - RNA, 22 nt, Human
ucacacagauugguagagcuga

SEQ ID NO: 316230 - RNA, 22 nt, Human
ucugaggcuucagacuguacug

SEQ ID NO: 316231 - RNA, 22 nt, Human
cuacacaguucugccuaauggc

SEQ ID NO: 316232 - RNA, 22 nt, Human
ggggcagcucccgagggcagga

SEQ ID NO: 316233 - RNA, 22 nt, Human
ugggggucaggaugaggccuug

SEQ ID NO: 316234 - RNA, 22 nt, Human
cagcugaguuuccaagucugcc

SEQ ID NO: 316235 - RNA, 22 nt, Human
ucucacuggguauaaaugagua

SEQ ID NO: 316236 - RNA, 22 nt, Human
ccuaguccccaggaggucagug

SEQ ID NO: 316237 - RNA, 22 nt, Human
cucucaguaaauuucugcccca

SEQ ID NO: 316238 - RNA, 22 nt, Human
cuuuggaauauuuuauugagaa

SEQ ID NO: 316239 - RNA, 22 nt, Human
aaacagcuggucucaaauguuc

SEQ ID NO: 316240 - RNA, 22 nt, Human
gccaugcuugguaugcugugag

SEQ ID NO: 316241 - RNA, 22 nt, Human
agcaugcugguguucauggcag

SEQ ID NO: 316242 - RNA, 22 nt, Human
agucucugugagcucccaaugg

SEQ ID NO: 316243 - RNA, 22 nt, Human
uuggcauucaugggacaacaaa

SEQ ID NO: 316244 - RNA, 22 nt, Human
uccaugagacagauacuguaag

SEQ ID NO: 316245 - RNA, 20 nt, Human
acugagcugcauggagagga

SEQ ID NO: 316246 - RNA, 22 nt, Human
guuuuguugcugcagagcucaa

SEQ ID NO: 316247 - RNA, 22 nt, Human
uacauuguucaugcaugagaaa

SEQ ID NO: 316248 - RNA, 22 nt, Human
agcagaacugaugagacuugag

SEQ ID NO: 316249 - RNA, 22 nt, Human
uaccaggcagcugcacagaggc

SEQ ID NO: 316250 - RNA, 22 nt, Human
gaagcagccacggggagacaga

SEQ ID NO: 316251 - RNA, 22 nt, Human
auccagcuuugucuggucuucg

SEQ ID NO: 316252 - RNA, 22 nt, Human
caggaaauaucuccuggcagag

SEQ ID NO: 316253 - RNA, 22 nt, Human
uauuuugagguauuuuugagcu

SEQ ID NO: 316254 - RNA, 22 nt, Human
gccucacugcagccccaggaag

SEQ ID NO: 316255 - RNA, 18 nt, Human
gugggguguugugaggau

SEQ ID NO: 316256 - RNA, 17 nt, Human
ccaggugggaggugggg

SEQ ID NO: 316257 - RNA, 22 nt, Human
cucugggcuuguugaccugcac

SEQ ID NO: 316258 - RNA, 22 nt, Human
cuuccuuggcuucuggggugug

SEQ ID NO: 316259 - RNA, 22 nt, Human
cagugcauagauccugaggccu

SEQ ID NO: 316260 - RNA, 22 nt, Human
uguagcauguaaauugguuauu

SEQ ID NO: 316261 - RNA, 22 nt, Human
ucaccacugaacagaccuuugg

SEQ ID NO: 316262 - RNA, 22 nt, Human
augucacagucugacucaguga

SEQ ID NO: 316263 - RNA, 22 nt, Human
uuccucuccucccaccagguga

SEQ ID NO: 316264 - RNA, 22 nt, Human
ggcuagaauaauugacuucauu

SEQ ID NO: 316265 - RNA, 22 nt, Human
aaaugugucaguuucauucucu

SEQ ID NO: 316266 - RNA, 22 nt, Human
uaugagaaaggagaaugacuuu

SEQ ID NO: 316267 - RNA, 22 nt, Human
uggcucugcugaaccuagugca

SEQ ID NO: 316268 - RNA, 22 nt, Human
gcucagaaaagugaggcucagu

SEQ ID NO: 316269 - RNA, 22 nt, Human
caguccaggccuggaggagcca

SEQ ID NO: 316270 - RNA, 22 nt, Human
caaagcucaugcucuuagccau

SEQ ID NO: 316271 - RNA, 19 nt, Human
acauauguggauauacaug

SEQ ID NO: 316272 - RNA, 22 nt, Human
cugcagagguugguucuaagau

SEQ ID NO: 316273 - RNA, 22 nt, Human
cuggcagguuuggugucuggug

SEQ ID NO: 316274 - RNA, 22 nt, Human
cuucaguucuaaaguagaaugu

SEQ ID NO: 316275 - RNA, 22 nt, Human
ugcagccauuuucugccaaugc

SEQ ID NO: 316276 - RNA, 22 nt, Human
agcagcauagaagcugggagga

SEQ ID NO: 316277 - RNA, 19 nt, Human
cucucacucgccacauccu

SEQ ID NO: 316278 - RNA, 22 nt, Human
ugagccugggagauggaggcug

SEQ ID NO: 316279 - RNA, 22 nt, Human
ccuugcaggggaacaggcagug

SEQ ID NO: 316280 - RNA, 22 nt, Human
uaaguucaguuggucgaaguag

SEQ ID NO: 316281 - RNA, 22 nt, Human
aaguuucauguggagguagacu

SEQ ID NO: 316282 - RNA, 22 nt, Human
uuggcugagagaggaaaagggc

SEQ ID NO: 316283 - RNA, 22 nt, Human
aaauacauaaagguuguaccag

SEQ ID NO: 316284 - RNA, 21 nt, Human
accagcaggagaucagaagga

SEQ ID NO: 316285 - RNA, 20 nt, Human
agugcaagaaagcacagcug

SEQ ID NO: 316286 - RNA, 22 nt, Human
guaagagcacugucuccugcug

SEQ ID NO: 316287 - RNA, 22 nt, Human
gcugucacaucaaggcacuaaa

SEQ ID NO: 316288 - RNA, 22 nt, Human
ucugggaagcugguccuguucu

SEQ ID NO: 316289 - RNA, 22 nt, Human
uaguccaguaaaacagcuaacg

SEQ ID NO: 316290 - RNA, 22 nt, Human
aagagcugcaucuaagccauga

SEQ ID NO: 316291 - RNA, 22 nt, Human
cacagugugacugaccuucagc

SEQ ID NO: 316292 - RNA, 22 nt, Human
uuuaagaugguauuuuauaaag

SEQ ID NO: 316293 - RNA, 22 nt, Human
ggguuggggcccagcagucugc

SEQ ID NO: 316294 - RNA, 22 nt, Human
uuuaacagaugugaaauuuuca

SEQ ID NO: 316295 - RNA, 22 nt, Human
uggccugccucccggcuucuuu

SEQ ID NO: 316296 - RNA, 22 nt, Human
caguuucuuaucuucaaaauug

SEQ ID NO: 316297 - RNA, 22 nt, Human
agauuucccucuuguauuugca

SEQ ID NO: 316298 - RNA, 22 nt, Human
agcugccaaguuggaguagcaa

SEQ ID NO: 316299 - RNA, 22 nt, Human
cuuuccuagauggccaucuuuc

SEQ ID NO: 316300 - RNA, 22 nt, Human
aaggcugccucugccagaggag

SEQ ID NO: 316301 - RNA, 22 nt, Human
ucacagggcauuauggcuccag

SEQ ID NO: 316302 - RNA, 22 nt, Human
accagcucagaagccagaaaga

SEQ ID NO: 316303 - RNA, 20 nt, Human
aggcuccuguaccugaggaa

SEQ ID NO: 316304 - RNA, 22 nt, Human
ugagaaagacagacauuccuaa

SEQ ID NO: 316305 - RNA, 19 nt, Human
ucgagucaagacacuaggc

SEQ ID NO: 316306 - RNA, 22 nt, Human
aauacugucuuucacagauauu

SEQ ID NO: 316307 - RNA, 19 nt, Human
ucugccucuggucaggcuc

SEQ ID NO: 316308 - RNA, 22 nt, Human
ggcugccuacuuucccagaguu

SEQ ID NO: 316309 - RNA, 22 nt, Human
cucaggccugaguggcaguccc

SEQ ID NO: 316310 - RNA, 22 nt, Human
gcaggaugggagcuucacucug

SEQ ID NO: 316311 - RNA, 22 nt, Human
caggagugcagguggugaggca

SEQ ID NO: 316312 - RNA, 18 nt, Human
agcugcagaccaggaggu

SEQ ID NO: 316313 - RNA, 22 nt, Human
ucugcagcuucuugccagagag

SEQ ID NO: 316314 - RNA, 22 nt, Human
cugacucugacaggacuugugg

SEQ ID NO: 316315 - RNA, 22 nt, Human
ugcagagcuucauugcauaggc

SEQ ID NO: 316316 - RNA, 22 nt, Human
agagggagcccagucauagcug

SEQ ID NO: 316317 - RNA, 22 nt, Human
uuguuuguaaggcucuuagaau

SEQ ID NO: 316318 - RNA, 22 nt, Human
gaggcaugucuggccuguccca

SEQ ID NO: 316319 - RNA, 22 nt, Human
aucuuguuaaaaugcagaaacu

SEQ ID NO: 316320 - RNA, 22 nt, Human
uccuucuuucccccuagucauu

SEQ ID NO: 316321 - RNA, 22 nt, Human
ugaagcagaggggucuugagcu

SEQ ID NO: 316322 - RNA, 22 nt, Human
aucugccuggcuccaggugagc

SEQ ID NO: 316323 - RNA, 22 nt, Human
uccaggcuggacaugaggcggg

SEQ ID NO: 316324 - RNA, 22 nt, Human
uguuuuaagagcgcacuuuaua

SEQ ID NO: 316325 - RNA, 22 nt, Human
ucagcagucacauguuguccca

SEQ ID NO: 316326 - RNA, 21 nt, Human
gagugcaggucugaugccauc

SEQ ID NO: 316327 - RNA, 22 nt, Human
cccagggcccuggacagcuaca

SEQ ID NO: 316328 - RNA, 22 nt, Human
cauacauuuugcauauuuacca

SEQ ID NO: 316329 - RNA, 22 nt, Human
cugcuguguggugaaacucagu

SEQ ID NO: 316330 - RNA, 18 nt, Human
gggcuguguucaugccca

SEQ ID NO: 316331 - RNA, 22 nt, Human
gcaggggaguccacucuaugca

SEQ ID NO: 316332 - RNA, 22 nt, Human
ggggcagagaauaaaaaccuaa

SEQ ID NO: 316333 - RNA, 19 nt, Human
acacugaauguagaauugg

SEQ ID NO: 316334 - RNA, 22 nt, Human
gugacagaguuuuagaucucau

SEQ ID NO: 316335 - RNA, 22 nt, Human
ugaaggagggaagaaggcucug

SEQ ID NO: 316336 - RNA, 22 nt, Human
gcaguguugagugguggcugaa

SEQ ID NO: 316337 - RNA, 22 nt, Human
cagacaugauguaagcagaggc

SEQ ID NO: 316338 - RNA, 22 nt, Human
caggggacaguaugguggauga

SEQ ID NO: 316339 - RNA, 22 nt, Human
agcugaugccauguggaacagu

SEQ ID NO: 316340 - RNA, 18 nt, Human
gcagcugacacuggaguu

SEQ ID NO: 316341 - RNA, 22 nt, Human
uauuuagaaugcguguacgugu

SEQ ID NO: 316342 - RNA, 22 nt, Human
gcaaggcuuugugaauuuuaaa

SEQ ID NO: 316343 - RNA, 22 nt, Human
uaucaauacauguuaucagugu

SEQ ID NO: 316344 - RNA, 22 nt, Human
uauuccaguccuauccucuuuu

SEQ ID NO: 316345 - RNA, 22 nt, Human
aagcagccuggacuugggcugg

SEQ ID NO: 316346 - RNA, 22 nt, Human
cugagguguugaugaccuaugc

SEQ ID NO: 316347 - RNA, 22 nt, Human
uagcagggaaggugugcugagc

SEQ ID NO: 316348 - RNA, 22 nt, Human
caggcagcaggagcccugcucg

SEQ ID NO: 316349 - RNA, 22 nt, Human
aggcacugagaggcuguguugc

SEQ ID NO: 316350 - RNA, 22 nt, Human
ucaggcuggaaugcaguggggc

SEQ ID NO: 316351 - RNA, 22 nt, Human
ugucagugguagacccagaggu

SEQ ID NO: 316352 - RNA, 22 nt, Human
agaauccuguuuuacuucauca

SEQ ID NO: 316353 - RNA, 22 nt, Human
ggccgggcaggucucagccagc

SEQ ID NO: 316354 - RNA, 22 nt, Human
ucacagacauggugagguaaca

SEQ ID NO: 316355 - RNA, 22 nt, Human
gaaugugucacccugucccaug

SEQ ID NO: 316356 - RNA, 22 nt, Human
agggaauguagcaagaugccaa

SEQ ID NO: 316357 - RNA, 22 nt, Human
acacuagcuaaaugcugauuaa

SEQ ID NO: 316358 - RNA, 22 nt, Human
cuuuggcaaugucauuuucaau

SEQ ID NO: 316359 - RNA, 22 nt, Human
ccucaggaaaugaauaaauggc

SEQ ID NO: 316360 - RNA, 22 nt, Human
uuuauguuugacaaugaucugg

SEQ ID NO: 316361 - RNA, 22 nt, Human
cuggugcuggagccuagucccu

SEQ ID NO: 316362 - RNA, 22 nt, Human
gcagaacauuucacaguaucuu

SEQ ID NO: 316363 - RNA, 22 nt, Human
ucugggaacugagcuccccuag

SEQ ID NO: 316364 - RNA, 22 nt, Human
uucuuacagcccuauuacuaaa

SEQ ID NO: 316365 - RNA, 22 nt, Human
gcaagcugcuuaagcucauugu

SEQ ID NO: 316366 - RNA, 22 nt, Human
ucaugaaucguggaaugauuua

SEQ ID NO: 316367 - RNA, 19 nt, Human
gcuccugggccucacucau

SEQ ID NO: 316368 - RNA, 22 nt, Human
ccugagagcagcuuccugcuua

SEQ ID NO: 316369 - RNA, 22 nt, Human
aagaauguuaguuucugauaca

SEQ ID NO: 316370 - RNA, 22 nt, Human
ggcagagcuuguuccuucuguu

SEQ ID NO: 316371 - RNA, 22 nt, Human
gaggccuggugugucucccgcu

SEQ ID NO: 316372 - RNA, 22 nt, Human
gcaguguugugauccaggucuu

SEQ ID NO: 316373 - RNA, 22 nt, Human
uguacacaauucuuaacauaca

SEQ ID NO: 316374 - RNA, 22 nt, Human
acagaugaauuuuaauuguguu

SEQ ID NO: 316375 - RNA, 22 nt, Human
ucacaggacccugaggguggcg

SEQ ID NO: 316376 - RNA, 22 nt, Human
ugggccugggcuccuguccucu

SEQ ID NO: 316377 - RNA, 22 nt, Human
agaacagaugugggcagaccug

SEQ ID NO: 316378 - RNA, 22 nt, Human
cccugguguccacuggaggaag

SEQ ID NO: 316379 - RNA, 22 nt, Human
agugucugccaacugcaugguc

SEQ ID NO: 316380 - RNA, 22 nt, Human
guuauaaaaugcacaguuguuu

SEQ ID NO: 316381 - RNA, 22 nt, Human
aagcugaggcccauggcaaggu

SEQ ID NO: 316382 - RNA, 22 nt, Human
cccuggaggaaaaucugaggcu

SEQ ID NO: 316383 - RNA, 22 nt, Human
uagucucuggagacucuagggg

SEQ ID NO: 316384 - RNA, 22 nt, Human
uugaaucucuugaaucucuguu

SEQ ID NO: 316385 - RNA, 22 nt, Human
ucagcaaugagaacuggcauuu

SEQ ID NO: 316386 - RNA, 22 nt, Human
aggucaaaccacagcucuaggc

SEQ ID NO: 316387 - RNA, 22 nt, Human
gaaagaagcuuuagauggcuau

SEQ ID NO: 316388 - RNA, 22 nt, Human
agcagcugggcucagagcuggg

SEQ ID NO: 316389 - RNA, 22 nt, Human
uuaggaaauuaugguuucagau

SEQ ID NO: 316390 - RNA, 22 nt, Human
aaaaugugcaguuuuuaagcug

SEQ ID NO: 316391 - RNA, 22 nt, Human
auuuucugguugagguuuaaca

SEQ ID NO: 316392 - RNA, 22 nt, Human
gcucuggguagccacugccugg

SEQ ID NO: 316393 - RNA, 22 nt, Human
ggagcugcucagagccaguccc

SEQ ID NO: 316394 - RNA, 20 nt, Human
gcccaagguccagaaggggg

SEQ ID NO: 316395 - RNA, 22 nt, Human
uuucagaugcaauuaauuuuca

SEQ ID NO: 316396 - RNA, 22 nt, Human
ucaggaucaggggccuuuccuu

SEQ ID NO: 316397 - RNA, 22 nt, Human
accucaggauguggacacagaa

SEQ ID NO: 316398 - RNA, 22 nt, Human
ggugccaggcucccagcucagg

SEQ ID NO: 316399 - RNA, 22 nt, Human
uuagccauuaauguccugugca

SEQ ID NO: 316400 - RNA, 17 nt, Human
uagagcugguucaggag

SEQ ID NO: 316401 - RNA, 22 nt, Human
gcccuggccuucaucucagaca

SEQ ID NO: 316402 - RNA, 22 nt, Human
ugggcagacgggagcuugccuu

SEQ ID NO: 316403 - RNA, 22 nt, Human
ccagagugacgugaagugugaa

SEQ ID NO: 316404 - RNA, 22 nt, Human
gcuguucauagaaauggucuca

SEQ ID NO: 316405 - RNA, 22 nt, Human
uccaguccuaucugcccuugga

SEQ ID NO: 316406 - RNA, 22 nt, Human
aauaauuagugggacagagaac

SEQ ID NO: 316407 - RNA, 22 nt, Human
cugagcauggccgguccauggu

SEQ ID NO: 316408 - RNA, 22 nt, Human
cucuucuugcuagacugagugc

SEQ ID NO: 316409 - RNA, 20 nt, Human
cagucccaauccagggccag

SEQ ID NO: 316410 - RNA, 22 nt, Human
agcaccugcuaugugucaggga

SEQ ID NO: 316411 - RNA, 22 nt, Human
gaaucucaguggaagcaggaag

SEQ ID NO: 316412 - RNA, 22 nt, Human
agggggaguuucaguuagaaag

SEQ ID NO: 316413 - RNA, 22 nt, Human
uaaagaugcccacauugcaggu

SEQ ID NO: 316414 - RNA, 22 nt, Human
uugacacagaucaauauucaac

SEQ ID NO: 316415 - RNA, 20 nt, Human
ugcuugucaugcacucaggc

SEQ ID NO: 316416 - RNA, 19 nt, Human
uccccagcaccucugaguc

SEQ ID NO: 316417 - RNA, 22 nt, Human
aacagcaauagcacuauucauu

SEQ ID NO: 316418 - RNA, 21 nt, Human
cagagcuguccaaacccugac

SEQ ID NO: 316419 - RNA, 22 nt, Human
cccuggagugccggaaucaaga

SEQ ID NO: 316420 - RNA, 22 nt, Human
agcugcugcggaaagaugccac

SEQ ID NO: 316421 - RNA, 22 nt, Human
uugaaagaggcaaaguuugauc

SEQ ID NO: 316422 - RNA, 20 nt, Human
uucuuucaucuacacguugu

SEQ ID NO: 316423 - RNA, 19 nt, Human
cccuggcaggcaagccugg

SEQ ID NO: 316424 - RNA, 17 nt, Human
gcuggcugacccaugcc

SEQ ID NO: 316425 - RNA, 22 nt, Human
ugaaggccacuuccugugagcu

SEQ ID NO: 316426 - RNA, 22 nt, Human
cugcuguguuagcagguuuagu

SEQ ID NO: 316427 - RNA, 22 nt, Human
aaggcacugacugugcagggga

SEQ ID NO: 316428 - RNA, 22 nt, Human
uaugcacagaaguuugcugaau

SEQ ID NO: 316429 - RNA, 22 nt, Human
uucuucuuuccuauaauuaauu

SEQ ID NO: 316430 - RNA, 22 nt, Human
ccagucacagguguguuuauau

SEQ ID NO: 316431 - RNA, 22 nt, Human
ggcucugcccagaugaagagga

SEQ ID NO: 316432 - RNA, 20 nt, Human
ugggccugagccugugggcu

SEQ ID NO: 316433 - RNA, 22 nt, Human
cuggccugugggcugucuccgg

SEQ ID NO: 316434 - RNA, 22 nt, Human
uugaaauacugcauuguucagu

SEQ ID NO: 316435 - RNA, 22 nt, Human
aucaggauagucuguaaauugu

SEQ ID NO: 316436 - RNA, 22 nt, Human
gcagggccagugcagagaggaa

SEQ ID NO: 316437 - RNA, 22 nt, Human
gggcagcagaggaucccuuaau

SEQ ID NO: 316438 - RNA, 22 nt, Human
aauccagcacauggacacaguc

SEQ ID NO: 316439 - RNA, 22 nt, Human
ucucagaggcccgacguucucc

SEQ ID NO: 316440 - RNA, 23 nt, Human
auucuucauuaucuucuagaaaa

SEQ ID NO: 316441 - RNA, 22 nt, Human
agauuucccaaauacuuguuau

SEQ ID NO: 316442 - RNA, 22 nt, Human
uggcuucuuagaccaguggccu

SEQ ID NO: 316443 - RNA, 22 nt, Human
gaagaacaagcagugcuuuccu

SEQ ID NO: 316444 - RNA, 21 nt, Human
agaaaaguagaguuuucagag

SEQ ID NO: 316445 - RNA, 22 nt, Human
gauuucaaccuaacaguaugac

SEQ ID NO: 316446 - RNA, 22 nt, Human
agugucuuugacacauucaaag

SEQ ID NO: 316447 - RNA, 22 nt, Human
cuuugaaaggaagccacacagc

SEQ ID NO: 316448 - RNA, 22 nt, Human
gcugcugucagugguggcaguu

SEQ ID NO: 316449 - RNA, 22 nt, Human
ugcucugguaacucacuuccau

SEQ ID NO: 316450 - RNA, 22 nt, Human
ugcugaggucaccuugcugcua

SEQ ID NO: 316451 - RNA, 22 nt, Human
gagggggcgugcaaggcuccgc

SEQ ID NO: 316452 - RNA, 22 nt, Human
ucugggcccuaaaccagcucua

SEQ ID NO: 316453 - RNA, 22 nt, Human
aggacuucaucaccuguauaaa

SEQ ID NO: 316454 - RNA, 22 nt, Human
ccuguucaaugcccuggcuuca

SEQ ID NO: 316455 - RNA, 22 nt, Human
cugcagcuauauuuucccacag

SEQ ID NO: 316456 - RNA, 22 nt, Human
ugcagggcuacaggacuacaac

SEQ ID NO: 316457 - RNA, 22 nt, Human
aaaggccaugguuggaguguuu

SEQ ID NO: 316458 - RNA, 22 nt, Human
gcauuauuaauagcugcaugag

SEQ ID NO: 316459 - RNA, 22 nt, Human
ugcccaaguguuuggcugaguc

SEQ ID NO: 316460 - RNA, 22 nt, Human
ccucagcucuucccugugcaca

SEQ ID NO: 316461 - RNA, 20 nt, Human
ccuccaggcacacccaugug

SEQ ID NO: 316462 - RNA, 21 nt, Human
ucaggcaggcgcagagggaag

SEQ ID NO: 316463 - RNA, 22 nt, Human
ccucuggggugagugggccacu

SEQ ID NO: 316464 - RNA, 22 nt, Human
agaccgagaaguucuccaggcc

SEQ ID NO: 316465 - RNA, 22 nt, Human
aagcugccagcugagcugaggc

SEQ ID NO: 316466 - RNA, 22 nt, Human
agagaagggccuguauguaauc

SEQ ID NO: 316467 - RNA, 22 nt, Human
ggcuggucacaccacugcaggg

SEQ ID NO: 316468 - RNA, 22 nt, Human
ucuucagagugaaagucuguga

SEQ ID NO: 316469 - RNA, 22 nt, Human
gaggccuggguuggaggugcau

SEQ ID NO: 316470 - RNA, 22 nt, Human
uggcagaguuauggguauuuau

SEQ ID NO: 316471 - RNA, 22 nt, Human
cucagaauuuagggcucugagg

SEQ ID NO: 316472 - RNA, 22 nt, Human
ucuucuccagugcuucugcaca

SEQ ID NO: 316473 - RNA, 22 nt, Human
uuuucuuauggugaagcacaaa

SEQ ID NO: 316474 - RNA, 22 nt, Human
aaagaauagccuuuguccaaau

SEQ ID NO: 316475 - RNA, 21 nt, Human
agcaccuuacagcuauaaugg

SEQ ID NO: 316476 - RNA, 22 nt, Human
ggcagugaaaaaguauguuucc

SEQ ID NO: 316477 - RNA, 22 nt, Human
ccagcagacacacaggcguggg

SEQ ID NO: 316478 - RNA, 22 nt, Human
acagagcaugcucaguguguga

SEQ ID NO: 316479 - RNA, 22 nt, Human
agcauuuaugacuaauguaaaa

SEQ ID NO: 316480 - RNA, 22 nt, Human
agaugaaaauacgugacuuuaa

SEQ ID NO: 316481 - RNA, 22 nt, Human
ggcuucugguaaagaccacacc

SEQ ID NO: 316482 - RNA, 22 nt, Human
gauuucuucauucauuagaugg

SEQ ID NO: 316483 - RNA, 22 nt, Human
uggcagcuccggguaggggcug

SEQ ID NO: 316484 - RNA, 22 nt, Human
ugcauuguugaccaguugugca

SEQ ID NO: 316485 - RNA, 22 nt, Human
uacaguaacauguuguacaagc

SEQ ID NO: 316486 - RNA, 22 nt, Human
uucuuuccaaccagauauuggu

SEQ ID NO: 316487 - RNA, 22 nt, Human
aaaguggucaccuucucauuuc

SEQ ID NO: 316488 - RNA, 19 nt, Human
aucugccuguuaucacaua

SEQ ID NO: 316489 - RNA, 22 nt, Human
augaaacaugagaaauggagag

SEQ ID NO: 316490 - RNA, 22 nt, Human
gccagagcacaggcugguagua

SEQ ID NO: 316491 - RNA, 22 nt, Human
cagagccugcucacgucucugu

SEQ ID NO: 316492 - RNA, 22 nt, Human
gucucaguaagaaaggcuccug

SEQ ID NO: 316493 - RNA, 22 nt, Human
ccaggcagcaaauuuucugaau

SEQ ID NO: 316494 - RNA, 22 nt, Human
ugucauuuaguccucugugugu

SEQ ID NO: 316495 - RNA, 22 nt, Human
guuccuuguaauuuguuaagga

SEQ ID NO: 316496 - RNA, 22 nt, Human
uauguacauaacaugaaaugca

SEQ ID NO: 316497 - RNA, 21 nt, Human
aucauucuggaaaauucaagc

SEQ ID NO: 316498 - RNA, 22 nt, Human
ugucaaaaugacuuuacuacag

SEQ ID NO: 316499 - RNA, 22 nt, Human
auuguaaguagaaauguuaugg

SEQ ID NO: 316500 - RNA, 22 nt, Human
gggugaggcccauuugaggcca

SEQ ID NO: 316501 - RNA, 22 nt, Human
uagggcuauaagagaauaagac

SEQ ID NO: 316502 - RNA, 22 nt, Human
cauaagaaauaaugaugaugac

SEQ ID NO: 316503 - RNA, 22 nt, Human
ggugucccaggccagcugugug

SEQ ID NO: 316504 - RNA, 19 nt, Human
cauuuuaagcauccccagu

SEQ ID NO: 316505 - RNA, 22 nt, Human
caccaggcacauaguaggcacu

SEQ ID NO: 316506 - RNA, 22 nt, Human
uucuugaaucacuuuagagaua

SEQ ID NO: 316507 - RNA, 22 nt, Human
ugucaugccauuuaaaauguuu

SEQ ID NO: 316508 - RNA, 22 nt, Human
gagugcagaugaacagaagauu

SEQ ID NO: 316509 - RNA, 22 nt, Human
guccucagucaguuuggugggg

SEQ ID NO: 316510 - RNA, 22 nt, Human
ucaaauguucccuguacuggcc

SEQ ID NO: 316511 - RNA, 22 nt, Human
aguuuuucugcuggucucacua

SEQ ID NO: 316512 - RNA, 22 nt, Human
aguuuuuccugauuuuacagaa

SEQ ID NO: 316513 - RNA, 21 nt, Human
cagcaaaucauugggcagacu

SEQ ID NO: 316514 - RNA, 18 nt, Human
gucuggaggucaggagcu

SEQ ID NO: 316515 - RNA, 22 nt, Human
gggcuggcaucgguugcugaga

SEQ ID NO: 316516 - RNA, 22 nt, Human
ugaugguugauuauaaaucagu

SEQ ID NO: 316517 - RNA, 22 nt, Human
ggcagcucugugucugggaagc

SEQ ID NO: 316518 - RNA, 15 nt, Human
ugauuuccuacuaac

SEQ ID NO: 316519 - RNA, 22 nt, Human
gugcugcucacaucuggaggua

SEQ ID NO: 316520 - RNA, 22 nt, Human
aggggcucaguuacuuuggcag

SEQ ID NO: 316521 - RNA, 22 nt, Human
uagcugccuuugggcuccugcu

SEQ ID NO: 316522 - RNA, 22 nt, Human
aagguacaaaguauuauuuaaa

SEQ ID NO: 316523 - RNA, 22 nt, Human
guccucugcuucaugcccugau

SEQ ID NO: 316524 - RNA, 22 nt, Human
aacaucuuuuuguuugcugaaa

SEQ ID NO: 316525 - RNA, 22 nt, Human
caaagggcucuagacucagcag

SEQ ID NO: 316526 - RNA, 22 nt, Human
cggagcugccugccaagccugc

SEQ ID NO: 316527 - RNA, 22 nt, Human
cagccuggauugcagaaugcua

SEQ ID NO: 316528 - RNA, 22 nt, Human
gaagccaagugcaaaugccuua

SEQ ID NO: 316529 - RNA, 22 nt, Human
gagcugggagcugggauuugga

SEQ ID NO: 316530 - RNA, 22 nt, Human
acugugcaaugaguaauaaacu

SEQ ID NO: 316531 - RNA, 22 nt, Human
guuuuauaggugaaauauuacu

SEQ ID NO: 316532 - RNA, 22 nt, Human
guaucuuucccaccaaucacaa

SEQ ID NO: 316533 - RNA, 22 nt, Human
uaaauguguuguggaugaaguu

SEQ ID NO: 316534 - RNA, 22 nt, Human
aagcagugcgcucaucuaaggg

SEQ ID NO: 316535 - RNA, 17 nt, Human
ugaaggccaugaccacg

SEQ ID NO: 316536 - RNA, 22 nt, Human
cauugacaucaggcuuggccaa

SEQ ID NO: 316537 - RNA, 22 nt, Human
caggccuggagugcaauggcac

SEQ ID NO: 316538 - RNA, 22 nt, Human
gcuguucccauguggggcucag

SEQ ID NO: 316539 - RNA, 22 nt, Human
auguuucaccagcaaauuaccu

SEQ ID NO: 316540 - RNA, 22 nt, Human
cuggacuuuggcccaucugcca

SEQ ID NO: 316541 - RNA, 22 nt, Human
uauguccugcuacucucucaug

SEQ ID NO: 316542 - RNA, 22 nt, Human
ugcugcugaucauuuauagucu

SEQ ID NO: 316543 - RNA, 22 nt, Human
acauuuaggauguuuugagaga

SEQ ID NO: 316544 - RNA, 22 nt, Human
gagugagggcagcaggggcugc

SEQ ID NO: 316545 - RNA, 22 nt, Human
gcugcucuuuucagagaugaga

SEQ ID NO: 316546 - RNA, 22 nt, Human
agagcuggcagcagcuucuccu

SEQ ID NO: 316547 - RNA, 22 nt, Human
aacuacauuguccuuucugaag

SEQ ID NO: 316548 - RNA, 22 nt, Human
uuaaugcagaaaucaaacugac

SEQ ID NO: 316549 - RNA, 20 nt, Human
uacaaaccuccacacuggug

SEQ ID NO: 316550 - RNA, 23 nt, Human
gcugucaguuguuuuugucucua

SEQ ID NO: 316551 - RNA, 22 nt, Human
cuggggcuggugaggcaggcuc

SEQ ID NO: 316552 - RNA, 22 nt, Human
agaaacugaauuauuucugagg

SEQ ID NO: 316553 - RNA, 22 nt, Human
gauuuauuggucuuucauuggu

SEQ ID NO: 316554 - RNA, 22 nt, Human
gugcugggcccugagaccaggg

SEQ ID NO: 316555 - RNA, 22 nt, Human
ggagccuggucagguuggcucc

SEQ ID NO: 316556 - RNA, 22 nt, Human
agggggugcauuugugaaugaa

SEQ ID NO: 316557 - RNA, 19 nt, Human
acagaagcauagaaaagga

SEQ ID NO: 316558 - RNA, 22 nt, Human
aauguucagaggacaauauaaa

SEQ ID NO: 316559 - RNA, 22 nt, Human
uugaagagugccuuccagacau

SEQ ID NO: 316560 - RNA, 22 nt, Human
uggcucagcugucacagccugg

SEQ ID NO: 316561 - RNA, 22 nt, Human
gcagggacaaggcagguguucu

SEQ ID NO: 316562 - RNA, 22 nt, Human
uucaagauggcugcaaauacuu

SEQ ID NO: 316563 - RNA, 22 nt, Human
caggucagagucccccuguccu

SEQ ID NO: 316564 - RNA, 22 nt, Human
caauacuuccuuguuagaggca

SEQ ID NO: 316565 - RNA, 22 nt, Human
caggccugacccugagcuucac

SEQ ID NO: 316566 - RNA, 22 nt, Human
uggccugguuauauugcuauca

SEQ ID NO: 316567 - RNA, 22 nt, Human
acaguguuuucuuaaggagaaa

SEQ ID NO: 316568 - RNA, 22 nt, Human
agggugggcuagacucuucccc

SEQ ID NO: 316569 - RNA, 22 nt, Human
aauucuauaggcaagcuauuuu

SEQ ID NO: 316570 - RNA, 22 nt, Human
acauugaucagccucccaugca

SEQ ID NO: 316571 - RNA, 22 nt, Human
ugcuggcccaguauggacugca

SEQ ID NO: 316572 - RNA, 18 nt, Human
acaaauguagugucuuaa

SEQ ID NO: 316573 - RNA, 22 nt, Human
ccucccagugccuccagagcag

SEQ ID NO: 316574 - RNA, 22 nt, Human
ucugggugaugaaaugcacugu

SEQ ID NO: 316575 - RNA, 22 nt, Human
uccaggagguuuggaggaagca

SEQ ID NO: 316576 - RNA, 22 nt, Human
caggugcugcguggcggagcug

SEQ ID NO: 316577 - RNA, 22 nt, Human
aaguuugacagaaguuucuaau

SEQ ID NO: 316578 - RNA, 22 nt, Human
ggagccuuccagacugcccaca

SEQ ID NO: 316579 - RNA, 22 nt, Human
aucuggcucacuuagucuagga

SEQ ID NO: 316580 - RNA, 22 nt, Human
gcagcuuggugaaaggugaugg

SEQ ID NO: 316581 - RNA, 22 nt, Human
cucucugagugagggacaagcu

SEQ ID NO: 316582 - RNA, 22 nt, Human
uacccagcuucaagucaggacu

SEQ ID NO: 316583 - RNA, 22 nt, Human
cugcagaggguuugagcauccu

SEQ ID NO: 316584 - RNA, 22 nt, Human
uuccuugaaugagucauggaaa

SEQ ID NO: 316585 - RNA, 22 nt, Human
uggcucuguuuguuaacuagac

SEQ ID NO: 316586 - RNA, 22 nt, Human
ugcagucuuccagcugcacaaa

SEQ ID NO: 316587 - RNA, 22 nt, Human
uuucugugguggguaguucaga

SEQ ID NO: 316588 - RNA, 22 nt, Human
aauguuguuuuucugcaugucu

SEQ ID NO: 316589 - RNA, 22 nt, Human
cccuccagagcuugaccugcug

SEQ ID NO: 316590 - RNA, 22 nt, Human
uuuuuccuuagggguuacucac

SEQ ID NO: 316591 - RNA, 22 nt, Human
aagaugcuuauugcuccugcag

SEQ ID NO: 316592 - RNA, 20 nt, Human
uggagccacagucagguucc

SEQ ID NO: 316593 - RNA, 22 nt, Human
ggggaagaggcgugauggaucc

SEQ ID NO: 316594 - RNA, 22 nt, Human
acauaugugcuuauauccauga

SEQ ID NO: 316595 - RNA, 22 nt, Human
agaggcaguauacaauccgagc

SEQ ID NO: 316596 - RNA, 22 nt, Human
cuggagcccaggccuggugucu

SEQ ID NO: 316597 - RNA, 22 nt, Human
caguauguacucuuaucaugua

SEQ ID NO: 316598 - RNA, 22 nt, Human
caaaucuauauguugauauucu

SEQ ID NO: 316599 - RNA, 22 nt, Human
agauacauagcugugagcacac

SEQ ID NO: 316600 - RNA, 22 nt, Human
ccuggcucuguccucgcgcaaa

SEQ ID NO: 316601 - RNA, 22 nt, Human
caguccugagcuccugggcuga

SEQ ID NO: 316602 - RNA, 22 nt, Human
agagcugaauuuggguggugga

SEQ ID NO: 316603 - RNA, 22 nt, Human
ugcuggccaacaaggcuccaag

SEQ ID NO: 316604 - RNA, 22 nt, Human
cauuguauugaggauacuuaag

SEQ ID NO: 316605 - RNA, 22 nt, Human
agaggggcucauauccugucau

SEQ ID NO: 316606 - RNA, 22 nt, Human
cagcagcuucuguugaucagaa

SEQ ID NO: 316607 - RNA, 22 nt, Human
caagugucuauaucagugcuug

SEQ ID NO: 316608 - RNA, 22 nt, Human
ggaggaugccaagcugugcaca

SEQ ID NO: 316609 - RNA, 22 nt, Human
ggaggcucccacgcagcucaca

SEQ ID NO: 316610 - RNA, 22 nt, Human
gcauaugaucacgugugucggu

SEQ ID NO: 316611 - RNA, 22 nt, Human
uggggcuggggaucuugagccu

SEQ ID NO: 316612 - RNA, 22 nt, Human
ccucacucugcacccugcagca

SEQ ID NO: 316613 - RNA, 22 nt, Human
cuggccuuuaaaaugaccuuau

SEQ ID NO: 316614 - RNA, 19 nt, Human
cagaguccuugaccagucc

SEQ ID NO: 316615 - RNA, 21 nt, Human
ucccugcuuucuggcccaguc

SEQ ID NO: 316616 - RNA, 22 nt, Human
uaaaugaagaaauggagauugu

SEQ ID NO: 316617 - RNA, 22 nt, Human
gccaggcuccaggcccuccuga

SEQ ID NO: 316618 - RNA, 22 nt, Human
uucucuggaacugaaacaagau

SEQ ID NO: 316619 - RNA, 22 nt, Human
aucaaaguggaaguuuacuagg

SEQ ID NO: 316620 - RNA, 22 nt, Human
aaaggagaguagguuacuccau

SEQ ID NO: 316621 - RNA, 22 nt, Human
ugcaggcaggggaugagcagcc

SEQ ID NO: 316622 - RNA, 23 nt, Human
cugcuguuuucuguaccugaagc

SEQ ID NO: 316623 - RNA, 22 nt, Human
uuccaggaggcacugacagagg

SEQ ID NO: 316624 - RNA, 22 nt, Human
augauucagcaauuuuauaucu

SEQ ID NO: 316625 - RNA, 17 nt, Human
ugagacagggcaggccc

SEQ ID NO: 316626 - RNA, 22 nt, Human
aagggcagcugacagaugcuua

SEQ ID NO: 316627 - RNA, 22 nt, Human
cugcagcuccccugagaucaag

SEQ ID NO: 316628 - RNA, 22 nt, Human
uagcauuaucugucuuaucauu

SEQ ID NO: 316629 - RNA, 22 nt, Human
gaugaggggucauuggcuggga

SEQ ID NO: 316630 - RNA, 22 nt, Human
ggcugccuucagacuccagcuu

SEQ ID NO: 316631 - RNA, 22 nt, Human
uuauuuacaacucuucucuucc

SEQ ID NO: 316632 - RNA, 23 nt, Human
cuggcuccgaagacuccaggauc

SEQ ID NO: 316633 - RNA, 22 nt, Human
cucuuaguaaugccaugaagca

SEQ ID NO: 316634 - RNA, 22 nt, Human
gagagcugugguuugaccaggc

SEQ ID NO: 316635 - RNA, 22 nt, Human
aggcagcuggcagcacccaggg

SEQ ID NO: 316636 - RNA, 22 nt, Human
uggacaggaucugagacugaga

SEQ ID NO: 316637 - RNA, 22 nt, Human
ggaggccaugaggcucuaggug

SEQ ID NO: 316638 - RNA, 22 nt, Human
aauaacuucauguaacauuuaa

SEQ ID NO: 316639 - RNA, 22 nt, Human
cacagaauuaagggagaaauau

SEQ ID NO: 316640 - RNA, 23 nt, Human
ucacaggggccagcgcucugugg

SEQ ID NO: 316641 - RNA, 22 nt, Human
ugccaggcgugguggugcgcac

SEQ ID NO: 316642 - RNA, 22 nt, Human
uuuauguaaguggaaugaugcc

SEQ ID NO: 316643 - RNA, 22 nt, Human
uuucaugagauuccuccacauc

SEQ ID NO: 316644 - RNA, 22 nt, Human
caccugagugucaguauucuca

SEQ ID NO: 316645 - RNA, 19 nt, Human
ggggagaacuagagacagc

SEQ ID NO: 316646 - RNA, 22 nt, Human
ugacagcugagccccaggcaag

SEQ ID NO: 316647 - RNA, 22 nt, Human
ugaaggaaaugacggcagaaga

SEQ ID NO: 316648 - RNA, 22 nt, Human
gaggcaggcagauugcuugagg

SEQ ID NO: 316649 - RNA, 22 nt, Human
cacugucuuuugugaagacaau

SEQ ID NO: 316650 - RNA, 22 nt, Human
uaacacauuuuaagccauuuua

SEQ ID NO: 316651 - RNA, 22 nt, Human
aguguguccagaaaucuguauu

SEQ ID NO: 316652 - RNA, 22 nt, Human
aucauccuagaaggaagcuagg

SEQ ID NO: 316653 - RNA, 22 nt, Human
uaguccauuuucacacugcuga

SEQ ID NO: 316654 - RNA, 22 nt, Human
agcagauguuucagagcaggcu

SEQ ID NO: 316655 - RNA, 22 nt, Human
gagagggccgggggccagcucc

SEQ ID NO: 316656 - RNA, 22 nt, Human
uaguauuuaaucacuuuugucu

SEQ ID NO: 316657 - RNA, 22 nt, Human
agcagggcuuugcagacuuggg

SEQ ID NO: 316658 - RNA, 22 nt, Human
gacuuucucuccucccaggugu

SEQ ID NO: 316659 - RNA, 22 nt, Human
uccaugaggcagggaggcuggc

SEQ ID NO: 316660 - RNA, 22 nt, Human
aguccaugguucugacucaucu

SEQ ID NO: 316661 - RNA, 22 nt, Human
ucuggccugaaaguccaugcuu

SEQ ID NO: 316662 - RNA, 22 nt, Human
cccuguggaggcagcauccugc

SEQ ID NO: 316663 - RNA, 20 nt, Human
ggucccugcccucugucauc

SEQ ID NO: 316664 - RNA, 20 nt, Human
ucauuguguugccaauuccc

SEQ ID NO: 316665 - RNA, 22 nt, Human
gcucagugugguccucagaugu

SEQ ID NO: 316666 - RNA, 21 nt, Human
gcagccagccgagaccaugcc

SEQ ID NO: 316667 - RNA, 22 nt, Human
gcugagagcaaagcaugucuag

SEQ ID NO: 316668 - RNA, 23 nt, Human
acagacaacacugaugagagaaa

SEQ ID NO: 316669 - RNA, 22 nt, Human
agcagagcggggccuccggaag

SEQ ID NO: 316670 - RNA, 22 nt, Human
gggcuggugaggcugcccugca

SEQ ID NO: 316671 - RNA, 22 nt, Human
cccuccagcucaaagcaaccgg

SEQ ID NO: 316672 - RNA, 22 nt, Human
cucagacccccagagcugcuaa

SEQ ID NO: 316673 - RNA, 22 nt, Human
ucuggcucuaacuaggcaucag

SEQ ID NO: 316674 - RNA, 22 nt, Human
uauaacaguuuaggugguguca

SEQ ID NO: 316675 - RNA, 22 nt, Human
agagaaggcauagaacuugagu

SEQ ID NO: 316676 - RNA, 22 nt, Human
uggagggcuaagcugagggaua

SEQ ID NO: 316677 - RNA, 22 nt, Human
caugggagguuggcuuggcaug

SEQ ID NO: 316678 - RNA, 22 nt, Human
gcagggcugcugaaacuuguuu

SEQ ID NO: 316679 - RNA, 22 nt, Human
gaugguuugguaaaaguauguu

SEQ ID NO: 316680 - RNA, 22 nt, Human
uuaaaauagccagugccccucu

SEQ ID NO: 316681 - RNA, 23 nt, Human
acacaaggguaacugccagccau

SEQ ID NO: 316682 - RNA, 22 nt, Human
ugucaugccaggaaauaguccc

SEQ ID NO: 316683 - RNA, 22 nt, Human
ggaggaccccagcagcucccca

SEQ ID NO: 316684 - RNA, 22 nt, Human
cugcuggagguuggagcaugca

SEQ ID NO: 316685 - RNA, 22 nt, Human
aggcacagcacaccuggccccc

SEQ ID NO: 316686 - RNA, 22 nt, Human
gccugccugaaggcuguaccag

SEQ ID NO: 316687 - RNA, 22 nt, Human
acugccauuggucaaaugagug

SEQ ID NO: 316688 - RNA, 22 nt, Human
gguggagcuguggacaggaagg

SEQ ID NO: 316689 - RNA, 22 nt, Human
aagucauuaucucuucuaaucu

SEQ ID NO: 316690 - RNA, 19 nt, Human
ucccuggcgccucucgggc

SEQ ID NO: 316691 - RNA, 22 nt, Human
ucucuggaagcgcagaucuguu

SEQ ID NO: 316692 - RNA, 21 nt, Human
ugaaugaggaggauggcauuu

SEQ ID NO: 316693 - RNA, 19 nt, Human
ugggcuuccccagggcaga

SEQ ID NO: 316694 - RNA, 21 nt, Human
guggccugauuaugaaugggu

SEQ ID NO: 316695 - RNA, 22 nt, Human
cacagggcagaggguccguggc

SEQ ID NO: 316696 - RNA, 22 nt, Human
ugugaaaggagccauagacagu

SEQ ID NO: 316697 - RNA, 22 nt, Human
ucuucucuacaccagcagcccc

SEQ ID NO: 316698 - RNA, 22 nt, Human
uuucuucauagaccuugucuug

SEQ ID NO: 316699 - RNA, 22 nt, Human
cugucagguuggucucagagcu

SEQ ID NO: 316700 - RNA, 22 nt, Human
uguugaagauaaaguucucauu

SEQ ID NO: 316701 - RNA, 22 nt, Human
agagcagaggcauggccguggg

SEQ ID NO: 316702 - RNA, 22 nt, Human
augugcauuaaaugucaauguu

SEQ ID NO: 316703 - RNA, 22 nt, Human
agcccugggcagccaaggaagc

SEQ ID NO: 316704 - RNA, 22 nt, Human
cuucuucaaccugaaaguuuca

SEQ ID NO: 316705 - RNA, 19 nt, Human
uguagcuagugucuaucca

SEQ ID NO: 316706 - RNA, 22 nt, Human
ucugccugcaguguggcagggc

SEQ ID NO: 316707 - RNA, 22 nt, Human
uauguacaaucagcaguucaua

SEQ ID NO: 316708 - RNA, 18 nt, Human
ggaaggaguggaccccag

SEQ ID NO: 316709 - RNA, 22 nt, Human
uguacacugcaggaugcauugc

SEQ ID NO: 316710 - RNA, 22 nt, Human
gcccaggccggagagcagugcu

SEQ ID NO: 316711 - RNA, 22 nt, Human
ugcugccaagcccgugcuccug

SEQ ID NO: 316712 - RNA, 22 nt, Human
cugcucuagagagcauuaguca

SEQ ID NO: 316713 - RNA, 22 nt, Human
ucacaggguaucugggauggau

SEQ ID NO: 316714 - RNA, 22 nt, Human
gcucaagggaugggagugggug

SEQ ID NO: 316715 - RNA, 22 nt, Human
gggagagguuacccgagcaacu

SEQ ID NO: 316716 - RNA, 22 nt, Human
aaccauuugccauuaucuuaag

SEQ ID NO: 316717 - RNA, 22 nt, Human
uggcuccuaggauggugccugg

SEQ ID NO: 316718 - RNA, 22 nt, Human
cauugcugugggcauuugcugc

SEQ ID NO: 316719 - RNA, 22 nt, Human
ucugggcuuuacacugugcuua

SEQ ID NO: 316720 - RNA, 22 nt, Human
uaauuuauuucaacugccaagg

SEQ ID NO: 316721 - RNA, 20 nt, Human
cccuggagagaagcuccacg

SEQ ID NO: 316722 - RNA, 21 nt, Human
agagcugggacuugccugaga

SEQ ID NO: 316723 - RNA, 20 nt, Human
aagagcugacucacaguggu

SEQ ID NO: 316724 - RNA, 22 nt, Human
uaugaacuguaacccucaccgc

SEQ ID NO: 316725 - RNA, 22 nt, Human
agaaaagggcaggagggauaca

SEQ ID NO: 316726 - RNA, 20 nt, Human
guucucacugaucugcaggg

SEQ ID NO: 316727 - RNA, 22 nt, Human
gcaggagcucguuuccaggcug

SEQ ID NO: 316728 - RNA, 22 nt, Human
gcaucuaaauaaacgugggagu

SEQ ID NO: 316729 - RNA, 22 nt, Human
cuuccuugugguccuucucauu

SEQ ID NO: 316730 - RNA, 21 nt, Human
gcaggguccuuuccauuccua

SEQ ID NO: 316731 - RNA, 22 nt, Human
uccucagacuucccuuugugua

SEQ ID NO: 316732 - RNA, 22 nt, Human
ugggagcaagcuggugcuggag

SEQ ID NO: 316733 - RNA, 22 nt, Human
guggcucuccauugacauggaa

SEQ ID NO: 316734 - RNA, 22 nt, Human
cugcuuuggacaacuauucuug

SEQ ID NO: 316735 - RNA, 22 nt, Human
aucucagggcuggagcccugga

SEQ ID NO: 316736 - RNA, 22 nt, Human
agcugcugcgccucacccuggc

SEQ ID NO: 316737 - RNA, 22 nt, Human
cucugaaagaguuuaguauuau

SEQ ID NO: 316738 - RNA, 22 nt, Human
gaagcccacguuuggugaugua

SEQ ID NO: 316739 - RNA, 23 nt, Human
uggcccugaaucuguccuggagg

SEQ ID NO: 316740 - RNA, 22 nt, Human
uagaggugucacuuugggaagu

SEQ ID NO: 316741 - RNA, 22 nt, Human
auuuguugcuagcagcacugau

SEQ ID NO: 316742 - RNA, 22 nt, Human
cugggugagcuggccagagggu

SEQ ID NO: 316743 - RNA, 22 nt, Human
gccugugcauagcagcggacuc

SEQ ID NO: 316744 - RNA, 22 nt, Human
auuuagaacuuuguuugccaau

SEQ ID NO: 316745 - RNA, 22 nt, Human
aucaggaugacuauaaggcugc

SEQ ID NO: 316746 - RNA, 22 nt, Human
ucugucugacaggguaugaacu

SEQ ID NO: 316747 - RNA, 22 nt, Human
uuuuuauaugaaggauagugcg

SEQ ID NO: 316748 - RNA, 22 nt, Human
uuuuauguaauccuuacugucg

SEQ ID NO: 316749 - RNA, 22 nt, Human
gggcacagaagucuaagacauc

SEQ ID NO: 316750 - RNA, 22 nt, Human
gggaguggauuauguggaccca

SEQ ID NO: 316751 - RNA, 22 nt, Human
acagccugcugccugcuucuug

SEQ ID NO: 316752 - RNA, 22 nt, Human
agcagcucuggcacuguagcau

SEQ ID NO: 316753 - RNA, 22 nt, Human
agcucccaggcagucaugagga

SEQ ID NO: 316754 - RNA, 22 nt, Human
aggugccagugcuguggucccc

SEQ ID NO: 316755 - RNA, 22 nt, Human
uggcucuguugugcugagccag

SEQ ID NO: 316756 - RNA, 22 nt, Human
aggcugccuguuccaaucuccu

SEQ ID NO: 316757 - RNA, 22 nt, Human
gagggcugauaacaggaauaca

SEQ ID NO: 316758 - RNA, 22 nt, Human
uuacauuuuaguuaaccuguga

SEQ ID NO: 316759 - RNA, 22 nt, Human
agagcuggcugguagcccugau

SEQ ID NO: 316760 - RNA, 22 nt, Human
agaaagaacguugguuaucuua

SEQ ID NO: 316761 - RNA, 22 nt, Human
gaaacauaguugagacacugcu

SEQ ID NO: 316762 - RNA, 22 nt, Human
uccugcaggccuguucccagua

SEQ ID NO: 316763 - RNA, 22 nt, Human
gcucccugccuacacggaccuu

SEQ ID NO: 316764 - RNA, 22 nt, Human
caacagaaggaagcagggucag

SEQ ID NO: 316765 - RNA, 22 nt, Human
gcuggccucuacaggccggcca

SEQ ID NO: 316766 - RNA, 22 nt, Human
ggcagcagcaagguuggagcug

SEQ ID NO: 316767 - RNA, 22 nt, Human
ccaggcugcagucaaggggcau

SEQ ID NO: 316768 - RNA, 20 nt, Human
gugccuggagaagaggcugu

SEQ ID NO: 316769 - RNA, 22 nt, Human
gagcugccaguguaugaauucu

SEQ ID NO: 316770 - RNA, 22 nt, Human
ccagcagccaccuucucgaaau

SEQ ID NO: 316771 - RNA, 22 nt, Human
acugcagccuagggaccacagu

SEQ ID NO: 316772 - RNA, 21 nt, Human
ucacaucuauguuaagcaaac

SEQ ID NO: 316773 - RNA, 22 nt, Human
auuaaaagcuucccaagaguua

SEQ ID NO: 316774 - RNA, 22 nt, Human
ccaaagucugcauuuuaacaug

SEQ ID NO: 316775 - RNA, 22 nt, Human
cagagacaccccagaaaauaag

SEQ ID NO: 316776 - RNA, 22 nt, Human
augcaguaaauguucuaguuug

SEQ ID NO: 316777 - RNA, 22 nt, Human
gacagaguuguugauguaugcu

SEQ ID NO: 316778 - RNA, 22 nt, Human
cugcccugggaguaccuguccu

SEQ ID NO: 316779 - RNA, 22 nt, Human
uuguuucugaguuuucauguau

SEQ ID NO: 316780 - RNA, 22 nt, Human
ucuagaaauuuugccuuguauu

SEQ ID NO: 316781 - RNA, 20 nt, Human
gcaggcagggaaugggggug

SEQ ID NO: 316782 - RNA, 22 nt, Human
augaaggcuguguagauggaug

SEQ ID NO: 316783 - RNA, 22 nt, Human
auacauguuguaccauauguuu

SEQ ID NO: 316784 - RNA, 22 nt, Human
uccauuuucuaaguaucacuua

SEQ ID NO: 316785 - RNA, 22 nt, Human
uuauagaaggagcauucacuua

SEQ ID NO: 316786 - RNA, 18 nt, Human
uggcagcaggaagccauu

SEQ ID NO: 316787 - RNA, 22 nt, Human
aaugcacaugccacauguggua

SEQ ID NO: 316788 - RNA, 22 nt, Human
gauggguggucucagacuugcc

SEQ ID NO: 316789 - RNA, 18 nt, Human
gagcugggagaaggaagg

SEQ ID NO: 316790 - RNA, 23 nt, Human
ggccuccuggucuaggcuagacu

SEQ ID NO: 316791 - RNA, 19 nt, Human
agugaaauggaguauucaa

SEQ ID NO: 316792 - RNA, 23 nt, Human
gugugccaagcacugugccagga

SEQ ID NO: 316793 - RNA, 22 nt, Human
cuguagccagaagcagaaggcc

SEQ ID NO: 316794 - RNA, 22 nt, Human
gcucacugccauucucuagaug

SEQ ID NO: 316795 - RNA, 22 nt, Human
ggaggcugcugccucacguggg

SEQ ID NO: 316796 - RNA, 22 nt, Human
acaggagaaaucuggucaaaag

SEQ ID NO: 316797 - RNA, 22 nt, Human
cauuugaaccuggauguucuua

SEQ ID NO: 316798 - RNA, 22 nt, Human
ugaaggcuguuggauggggaag

SEQ ID NO: 316799 - RNA, 22 nt, Human
guguaauuauauaaagaucuac

SEQ ID NO: 316800 - RNA, 22 nt, Human
guuaauaaagguauagaaucag

SEQ ID NO: 316801 - RNA, 22 nt, Human
gccucagugauaugugggacaa

SEQ ID NO: 316802 - RNA, 22 nt, Human
uacagaguggugagaucuuuug

SEQ ID NO: 316803 - RNA, 22 nt, Human
guauacauagaugaugaacaag

SEQ ID NO: 316804 - RNA, 22 nt, Human
aucaguuuugggggacauacug

SEQ ID NO: 316805 - RNA, 22 nt, Human
cugccagcacugccuccugagg

SEQ ID NO: 316806 - RNA, 23 nt, Human
cagagcuggcucagagcugccug

SEQ ID NO: 316807 - RNA, 22 nt, Human
gcuccugggcucuaccuugcua

SEQ ID NO: 316808 - RNA, 22 nt, Human
ccugccugacagagaagguuca

SEQ ID NO: 316809 - RNA, 22 nt, Human
uccugggcuugcuccuccagcu

SEQ ID NO: 316810 - RNA, 22 nt, Human
cucuccucagaacaggcccucu

SEQ ID NO: 316811 - RNA, 22 nt, Human
ugugccaugaggcucugauaug

SEQ ID NO: 316812 - RNA, 22 nt, Human
ucuggcuccacaccucacugca

SEQ ID NO: 316813 - RNA, 22 nt, Human
gcugcagcuguaggacacaauu

SEQ ID NO: 316814 - RNA, 22 nt, Human
gaguggagcaaaagagguagau

SEQ ID NO: 316815 - RNA, 22 nt, Human
ccugaagaugcuguggccuggu

SEQ ID NO: 316816 - RNA, 22 nt, Human
aacagaaaagguagguggcuuu

SEQ ID NO: 316817 - RNA, 23 nt, Human
gaggagggucugacaaguguagc

SEQ ID NO: 316818 - RNA, 22 nt, Human
aagaaugucguugguauuuuaa

SEQ ID NO: 316819 - RNA, 22 nt, Human
cugguacaaaaugcugauauca

SEQ ID NO: 316820 - RNA, 22 nt, Human
ugcuggccgugagcucucggga

SEQ ID NO: 316821 - RNA, 22 nt, Human
uccuuuccaugcuucuagaggc

SEQ ID NO: 316822 - RNA, 22 nt, Human
gucccuggucuaccguggcuuc

SEQ ID NO: 316823 - RNA, 22 nt, Human
ucugucugcaccuaagcacagu

SEQ ID NO: 316824 - RNA, 23 nt, Human
cauggcagcaagagcucauggcc

SEQ ID NO: 316825 - RNA, 22 nt, Human
gccuucugugcuccuggccuuu

SEQ ID NO: 316826 - RNA, 22 nt, Human
caggcugaucagggcugggaug

SEQ ID NO: 316827 - RNA, 22 nt, Human
augugaaauagcuggauaugaa

SEQ ID NO: 316828 - RNA, 22 nt, Human
cuucagaggggacucaaaguca

SEQ ID NO: 316829 - RNA, 20 nt, Human
ugggagcuggugaggucuca

SEQ ID NO: 316830 - RNA, 22 nt, Human
ugaaagcacucacuucugcucu

SEQ ID NO: 316831 - RNA, 22 nt, Human
ugagcaguaggucugaauagug

SEQ ID NO: 316832 - RNA, 22 nt, Human
cgcuggggcuuuuugcuugaga

SEQ ID NO: 316833 - RNA, 20 nt, Human
ccuaggcaugcugagucucc

SEQ ID NO: 316834 - RNA, 22 nt, Human
cucccuggcuuuguccugaggc

SEQ ID NO: 316835 - RNA, 22 nt, Human
cagcucucacacccuccuccca

SEQ ID NO: 316836 - RNA, 22 nt, Human
ccuggccuccuggccuucucau

SEQ ID NO: 316837 - RNA, 22 nt, Human
cuccucaguugucccauggaga

SEQ ID NO: 316838 - RNA, 22 nt, Human
cagcccugagagaaccaucuau

SEQ ID NO: 316839 - RNA, 22 nt, Human
gagccagguuggaggcugcagu

SEQ ID NO: 316840 - RNA, 22 nt, Human
ggcuccucucuggccgcucccg

SEQ ID NO: 316841 - RNA, 22 nt, Human
agaaaucuuggagucuguggua

SEQ ID NO: 316842 - RNA, 22 nt, Human
uuugggaagaggaaucucugga

SEQ ID NO: 316843 - RNA, 22 nt, Human
cucugggcaggaccaguggacc

SEQ ID NO: 316844 - RNA, 22 nt, Human
uacaaaguauauuucuagcugu

SEQ ID NO: 316845 - RNA, 22 nt, Human
aacaugcucuguuucuuggaug

SEQ ID NO: 316846 - RNA, 22 nt, Human
caucacuguccaaaguucaguu

SEQ ID NO: 316847 - RNA, 22 nt, Human
ucaggggacagccagcuggagg

SEQ ID NO: 316848 - RNA, 22 nt, Human
ccccagccagcaggaccucuga

SEQ ID NO: 316849 - RNA, 22 nt, Human
ggagccagagggaugcaguuga

SEQ ID NO: 316850 - RNA, 22 nt, Human
aggauccuuuuucugcuguuug

SEQ ID NO: 316851 - RNA, 22 nt, Human
ggcaggcuggcuuuguuccagg

SEQ ID NO: 316852 - RNA, 22 nt, Human
uucacauuaucaggauuguuuc

SEQ ID NO: 316853 - RNA, 22 nt, Human
aagggaggggauguaagccugg

SEQ ID NO: 316854 - RNA, 20 nt, Human
ugcugucguguuuucugcuu

SEQ ID NO: 316855 - RNA, 22 nt, Human
auaucuuuguuuuugccaagau

SEQ ID NO: 316856 - RNA, 22 nt, Human
aauguguacaugacagauagaa

SEQ ID NO: 316857 - RNA, 22 nt, Human
ugaagcaggguggccagauugu

SEQ ID NO: 316858 - RNA, 23 nt, Human
ccagcgcucacucagagcauguu

SEQ ID NO: 316859 - RNA, 18 nt, Human
acagacaaaauggaaaug

SEQ ID NO: 316860 - RNA, 23 nt, Human
ugaguucucaucuuggcuucuau

SEQ ID NO: 316861 - RNA, 22 nt, Human
ucaucugucccaggcuuuuuuc

SEQ ID NO: 316862 - RNA, 22 nt, Human
aggaaaggccucagcagaaacc

SEQ ID NO: 316863 - RNA, 22 nt, Human
aagucuguuugagugucacacu

SEQ ID NO: 316864 - RNA, 22 nt, Human
ggcucugcgcgguaaagugacu

SEQ ID NO: 316865 - RNA, 22 nt, Human
caaaggcaacauauacuuguuu

SEQ ID NO: 316866 - RNA, 22 nt, Human
augcugcacaagccacauguag

SEQ ID NO: 316867 - RNA, 22 nt, Human
uuggccuuguuaaggaggcccu

SEQ ID NO: 316868 - RNA, 22 nt, Human
guuauaaaugacugcaaaaguu

SEQ ID NO: 316869 - RNA, 22 nt, Human
auguuaaaugguuuauuauuaa

SEQ ID NO: 316870 - RNA, 22 nt, Human
acaggcuuuuuuagaaugacau

SEQ ID NO: 316871 - RNA, 22 nt, Human
gcucccagcauugcugcugaau

SEQ ID NO: 316872 - RNA, 22 nt, Human
gaggcugggaaguccaagacca

SEQ ID NO: 316873 - RNA, 22 nt, Human
gaggaaccaaucugugauauuc

SEQ ID NO: 316874 - RNA, 22 nt, Human
acuuugcagggcuugauaucca

SEQ ID NO: 316875 - RNA, 22 nt, Human
ugccugggccuucccaccucug

SEQ ID NO: 316876 - RNA, 22 nt, Human
cucaccaggaacagcugcggag

SEQ ID NO: 316877 - RNA, 22 nt, Human
acccagcucuuugauggucuug

SEQ ID NO: 316878 - RNA, 22 nt, Human
gcagcuggagccagccagacac

SEQ ID NO: 316879 - RNA, 22 nt, Human
ccaguggguaggccauggugag

SEQ ID NO: 316880 - RNA, 22 nt, Human
aagaaagguguguuugcagaug

SEQ ID NO: 316881 - RNA, 22 nt, Human
uccugcaggccagaggggugag

SEQ ID NO: 316882 - RNA, 22 nt, Human
ccaggguggaggcuggauggag

SEQ ID NO: 316883 - RNA, 22 nt, Human
gcugccugauuuacauagugaa

SEQ ID NO: 316884 - RNA, 22 nt, Human
gugcugugcgcuuuuucuguau

SEQ ID NO: 316885 - RNA, 22 nt, Human
ugcauaaagugccauaguauua

SEQ ID NO: 316886 - RNA, 22 nt, Human
cagucccaugagcccagaacau

SEQ ID NO: 316887 - RNA, 22 nt, Human
acagagccacuuuggugccuac

SEQ ID NO: 316888 - RNA, 22 nt, Human
ccucccucuguuagagcugucu

SEQ ID NO: 316889 - RNA, 22 nt, Human
gggaguguugagcgcccugcca

SEQ ID NO: 316890 - RNA, 22 nt, Human
aucucugguuguuuugcuccca

SEQ ID NO: 316891 - RNA, 17 nt, Human
guccuacccauggucua

SEQ ID NO: 316892 - RNA, 22 nt, Human
gccacguugccacccgggugac

SEQ ID NO: 316893 - RNA, 22 nt, Human
uguuccaucaguuuuugguuga

SEQ ID NO: 316894 - RNA, 22 nt, Human
uggacagguugaguaggaggag

SEQ ID NO: 316895 - RNA, 22 nt, Human
ggcucagaccucccagcuccag

SEQ ID NO: 316896 - RNA, 22 nt, Human
ggagccagugcccucuggugga

SEQ ID NO: 316897 - RNA, 22 nt, Human
ggugcagaggagccagcugggg

SEQ ID NO: 316898 - RNA, 22 nt, Human
aggugcuggagucugggcagga

SEQ ID NO: 316899 - RNA, 22 nt, Human
aguaaaaucuuaagcacagugg

SEQ ID NO: 316900 - RNA, 22 nt, Human
cacagccugcugcacucaagaa

SEQ ID NO: 316901 - RNA, 22 nt, Human
acagaaauauagaagguaggaa

SEQ ID NO: 316902 - RNA, 22 nt, Human
agcagggggaguuagacuagau

SEQ ID NO: 316903 - RNA, 22 nt, Human
agucugcacucagguggagguc

SEQ ID NO: 316904 - RNA, 22 nt, Human
gcaggcugauagaggauuccau

SEQ ID NO: 316905 - RNA, 22 nt, Human
guuuagaauucuaacuuuaagg

SEQ ID NO: 316906 - RNA, 22 nt, Human
ccugccugggcucacuugccag

SEQ ID NO: 316907 - RNA, 22 nt, Human
ccuggcagcgugccgagcugcg

SEQ ID NO: 316908 - RNA, 22 nt, Human
acuucuugggacccuggcaccg

SEQ ID NO: 316909 - RNA, 22 nt, Human
ugccaaggguaugggcaagaua

SEQ ID NO: 316910 - RNA, 22 nt, Human
uccugggaagagaccugagcau

SEQ ID NO: 316911 - RNA, 22 nt, Human
augucccaagauacagcuagag

SEQ ID NO: 316912 - RNA, 22 nt, Human
ggaugcugggagacagcaggca

SEQ ID NO: 316913 - RNA, 22 nt, Human
cuuaaauucuuaaugcccucau

SEQ ID NO: 316914 - RNA, 22 nt, Human
ugaagccagcuuuggaagacac

SEQ ID NO: 316915 - RNA, 22 nt, Human
cugugcaguaggucagggcugg

SEQ ID NO: 316916 - RNA, 22 nt, Human
ucccacugcuuugcucugcuca

SEQ ID NO: 316917 - RNA, 22 nt, Human
gcagacagccagacugcacugg

SEQ ID NO: 316918 - RNA, 22 nt, Human
uacauguaagacaugagacucu

SEQ ID NO: 316919 - RNA, 22 nt, Human
gcaggccucuguugagggccuu

SEQ ID NO: 316920 - RNA, 22 nt, Human
ugcagcagcagggaggaggcuc

SEQ ID NO: 316921 - RNA, 22 nt, Human
gaaaaaugagcugaugucaggg

SEQ ID NO: 316922 - RNA, 22 nt, Human
cccugcagccggccagcucauu

SEQ ID NO: 316923 - RNA, 22 nt, Human
uaugaaacauucauacaaauaa

SEQ ID NO: 316924 - RNA, 18 nt, Human
agcagagcccaugcauuc

SEQ ID NO: 316925 - RNA, 22 nt, Human
aaaucuguaagcaauugcucag

SEQ ID NO: 316926 - RNA, 22 nt, Human
uauccuuguacuauaguauuua

SEQ ID NO: 316927 - RNA, 20 nt, Human
uccagcugggaacagcugau

SEQ ID NO: 316928 - RNA, 22 nt, Human
aucaggaugacaacugcugggu

SEQ ID NO: 316929 - RNA, 20 nt, Human
gacauucauaguuauuacca

SEQ ID NO: 316930 - RNA, 22 nt, Human
ggaaggggccuugagcaaacug

SEQ ID NO: 316931 - RNA, 22 nt, Human
guggcuucacauggcauuuggc

SEQ ID NO: 316932 - RNA, 22 nt, Human
guggcaggucccauuggagcag

SEQ ID NO: 316933 - RNA, 22 nt, Human
agcuccugcgcacggugcacac

SEQ ID NO: 316934 - RNA, 22 nt, Human
gggagccaaggagagaggccuu

SEQ ID NO: 316935 - RNA, 22 nt, Human
gaggagcacaugaggcugaggg

SEQ ID NO: 316936 - RNA, 22 nt, Human
uguucuucuagauugccuuuua

SEQ ID NO: 316937 - RNA, 22 nt, Human
ccuaugccugucacucugcgcu

SEQ ID NO: 316938 - RNA, 22 nt, Human
uuauacuaaaacgcauugaauu

SEQ ID NO: 316939 - RNA, 22 nt, Human
uuccgcuggggccgccuggcgg

SEQ ID NO: 316940 - RNA, 22 nt, Human
gccagcucagaugcaggaagga

SEQ ID NO: 316941 - RNA, 22 nt, Human
gcagcagagaacacaaugaugg

SEQ ID NO: 316942 - RNA, 22 nt, Human
caagacaagaucuaagcaugcu

SEQ ID NO: 316943 - RNA, 22 nt, Human
cacccagcagcacuuaagacua

SEQ ID NO: 316944 - RNA, 22 nt, Human
augcuuuuaugucacaugguca

SEQ ID NO: 316945 - RNA, 22 nt, Human
ucauauaaguuuaaaacuaucu

SEQ ID NO: 316946 - RNA, 22 nt, Human
ccucugcagcagagagccagag

SEQ ID NO: 316947 - RNA, 22 nt, Human
gacccugaggaugcaccagcag

SEQ ID NO: 316948 - RNA, 22 nt, Human
uggggcucaccuaggcuggaag

SEQ ID NO: 316949 - RNA, 22 nt, Human
cuguccuccggccaccuacagu

SEQ ID NO: 316950 - RNA, 22 nt, Human
ccagcagcuuuauuggcucucc

SEQ ID NO: 316951 - RNA, 22 nt, Human
cagaguggcgacccccucagcu

SEQ ID NO: 316952 - RNA, 22 nt, Human
ucuccucucuuaccugguacaa

SEQ ID NO: 316953 - RNA, 22 nt, Human
cagggagaucuuggcuccuggu

SEQ ID NO: 316954 - RNA, 22 nt, Human
ccaguugguuucaaugggacag

SEQ ID NO: 316955 - RNA, 22 nt, Human
cagcauuuggaggagaggcuuu

SEQ ID NO: 316956 - RNA, 22 nt, Human
ugccuggcaagaggggcuggcu

SEQ ID NO: 316957 - RNA, 22 nt, Human
gagcugccuacauugccaagag

SEQ ID NO: 316958 - RNA, 22 nt, Human
cagcuuggaggaggaucuaaga

SEQ ID NO: 316959 - RNA, 22 nt, Human
ugagugccugaacauagaguag

SEQ ID NO: 316960 - RNA, 18 nt, Human
cuucagugacagucuggc

SEQ ID NO: 316961 - RNA, 17 nt, Human
uuuagaauacaauguuu

SEQ ID NO: 316962 - RNA, 22 nt, Human
cuccagggaaaggggcguccgc

SEQ ID NO: 316963 - RNA, 22 nt, Human
uuccuguauucuaaagggaaag

SEQ ID NO: 316964 - RNA, 22 nt, Human
ccugacagcgugucccuggccc

SEQ ID NO: 316965 - RNA, 22 nt, Human
uucccucucacuuaaagcuugg

SEQ ID NO: 316966 - RNA, 22 nt, Human
gccuggaguggacuuggccccu

SEQ ID NO: 316967 - RNA, 22 nt, Human
acagagagaaacaaucagcagc

SEQ ID NO: 316968 - RNA, 22 nt, Human
cucacuguccaacaggcuuuac

SEQ ID NO: 316969 - RNA, 22 nt, Human
cauuugaaauucuuagaacaaa

SEQ ID NO: 316970 - RNA, 22 nt, Human
uuuugcuugagugcacaaaaug

SEQ ID NO: 316971 - RNA, 22 nt, Human
caguccugcuggccuucccugg

SEQ ID NO: 316972 - RNA, 22 nt, Human
uugcuuugccaccagaagucua

SEQ ID NO: 316973 - RNA, 22 nt, Human
cagagcugcacauucuaugaug

SEQ ID NO: 316974 - RNA, 23 nt, Human
ucucagugcacgcaccaugccug

SEQ ID NO: 316975 - RNA, 22 nt, Human
cacaauuuccuugcuucacuuu

SEQ ID NO: 316976 - RNA, 22 nt, Human
ucagggacugcagagggaagcu

SEQ ID NO: 316977 - RNA, 22 nt, Human
ggagcaagagguggugaaaaau

SEQ ID NO: 316978 - RNA, 22 nt, Human
ccaggugguucaggucaccaua

SEQ ID NO: 316979 - RNA, 22 nt, Human
cugcugggcuccucaugugacu

SEQ ID NO: 316980 - RNA, 22 nt, Human
cagucccagcugcucagaaggc

SEQ ID NO: 316981 - RNA, 23 nt, Human
uuccagaguccacaucugccacc

SEQ ID NO: 316982 - RNA, 22 nt, Human
ugccugggguuggcaaacugcu

SEQ ID NO: 316983 - RNA, 22 nt, Human
uuuuagaaauacugauuuagug

SEQ ID NO: 316984 - RNA, 22 nt, Human
ugcugccuggagccuuuuguuu

SEQ ID NO: 316985 - RNA, 22 nt, Human
cucuggccugcuuccucaggua

SEQ ID NO: 316986 - RNA, 22 nt, Human
cacucccuucaggagccuagga

SEQ ID NO: 316987 - RNA, 21 nt, Human
uucaaagagugggcauuguca

SEQ ID NO: 316988 - RNA, 22 nt, Human
cagaguacugggagaacagaag

SEQ ID NO: 316989 - RNA, 22 nt, Human
uccuugaaaaucuugguuuaga

SEQ ID NO: 316990 - RNA, 22 nt, Human
ucuggcucucucaucacccaau

SEQ ID NO: 316991 - RNA, 22 nt, Human
uugcauguuauuuaaucuguau

SEQ ID NO: 316992 - RNA, 20 nt, Human
caaugcacacagcugcuucu

SEQ ID NO: 316993 - RNA, 22 nt, Human
uggugcuguggaggggcagaag

SEQ ID NO: 316994 - RNA, 22 nt, Human
agcaggagcccuuaucaccagg

SEQ ID NO: 316995 - RNA, 22 nt, Human
caggcuggagugcaguugugca

SEQ ID NO: 316996 - RNA, 17 nt, Human
ugauaguucauuuuaag

SEQ ID NO: 316997 - RNA, 22 nt, Human
ugcugccaccccucaccagagc

SEQ ID NO: 316998 - RNA, 22 nt, Human
gcccagcaccucucucaggguu

SEQ ID NO: 316999 - RNA, 22 nt, Human
cagcugaguguuggcauguuca

SEQ ID NO: 317000 - RNA, 22 nt, Human
agccagacauggcuccugcucc

SEQ ID NO: 317001 - RNA, 17 nt, Human
gccucugcuugugucau

SEQ ID NO: 317002 - RNA, 22 nt, Human
agcuagaaguacagccauauga

SEQ ID NO: 317003 - RNA, 22 nt, Human
ugucccaggccucauguugcca

SEQ ID NO: 317004 - RNA, 22 nt, Human
cccuguccugcuaggcccuggu

SEQ ID NO: 317005 - RNA, 22 nt, Human
cccuggugguacggcacuggca

SEQ ID NO: 317006 - RNA, 22 nt, Human
aaaauguaaagcuugaguguag

SEQ ID NO: 317007 - RNA, 23 nt, Human
ggcagagagcauggcuggggccc

SEQ ID NO: 317008 - RNA, 22 nt, Human
agccaacuaggagauuaaggua

SEQ ID NO: 317009 - RNA, 22 nt, Human
guccugggcccaggggcugccu

SEQ ID NO: 317010 - RNA, 22 nt, Human
acagagcuguacaugugccaug

SEQ ID NO: 317011 - RNA, 22 nt, Human
ccaggguguagggauuccagau

SEQ ID NO: 317012 - RNA, 22 nt, Human
ccagggucuuggagaggagugc

SEQ ID NO: 317013 - RNA, 22 nt, Human
cucugagagagcuggugagcac

SEQ ID NO: 317014 - RNA, 22 nt, Human
gagccuucaucgcagccuuguu

SEQ ID NO: 317015 - RNA, 22 nt, Human
aucaguuucacuugcuugcaaa

SEQ ID NO: 317016 - RNA, 22 nt, Human
auugucuucuggucuuaucuuu

SEQ ID NO: 317017 - RNA, 22 nt, Human
cagcucaaguuucccaggucag

SEQ ID NO: 317018 - RNA, 22 nt, Human
ugcauuguugaugaguugaaua

SEQ ID NO: 317019 - RNA, 22 nt, Human
ccagggcaggagaaagacucac

SEQ ID NO: 317020 - RNA, 22 nt, Human
ugugaaagucaaauuaauugaa

SEQ ID NO: 317021 - RNA, 22 nt, Human
cauucacucagcgaugccagua

SEQ ID NO: 317022 - RNA, 22 nt, Human
aacaaauggaacacaaaucuuu

SEQ ID NO: 317023 - RNA, 23 nt, Human
gccugccugaccugugcaaaguc

SEQ ID NO: 317024 - RNA, 23 nt, Human
auaaggcauaaagguacauugga

SEQ ID NO: 317025 - RNA, 22 nt, Human
caggaccccauauucacugaac

SEQ ID NO: 317026 - RNA, 22 nt, Human
aaggcacugcuuugcugcgccc

SEQ ID NO: 317027 - RNA, 22 nt, Human
accugagcaugccaggagagug

SEQ ID NO: 317028 - RNA, 22 nt, Human
guggcccugucccaggccuccu

SEQ ID NO: 317029 - RNA, 22 nt, Human
uggcucuggugcgggcuccugc

SEQ ID NO: 317030 - RNA, 22 nt, Human
ugccuucaaucaggauggucuc

SEQ ID NO: 317031 - RNA, 22 nt, Human
acuuugcaauacuuaauacaaa

SEQ ID NO: 317032 - RNA, 22 nt, Human
uuuaaaaaacuagucugagucu

SEQ ID NO: 317033 - RNA, 22 nt, Human
uucaggaucauuuguuuuaucu

SEQ ID NO: 317034 - RNA, 22 nt, Human
ucuggcucuguguccccaccca

SEQ ID NO: 317035 - RNA, 22 nt, Human
caaggccacugcucagguuucc

SEQ ID NO: 317036 - RNA, 22 nt, Human
uauguuaaauguuugauguuua

SEQ ID NO: 317037 - RNA, 22 nt, Human
agguggcagagugacaggcuga

SEQ ID NO: 317038 - RNA, 22 nt, Human
guccagggcuaaaucagguucc

SEQ ID NO: 317039 - RNA, 22 nt, Human
uauucacaggcuggagugaugu

SEQ ID NO: 317040 - RNA, 19 nt, Human
cagugcuguucauucagug

SEQ ID NO: 317041 - RNA, 22 nt, Human
agguggccggugccagccgggc

SEQ ID NO: 317042 - RNA, 22 nt, Human
uagagcaguuggcagcuguauu

SEQ ID NO: 317043 - RNA, 22 nt, Human
uucucaguuucauagcugagca

SEQ ID NO: 317044 - RNA, 22 nt, Human
aagggcugccagggggugccag

SEQ ID NO: 317045 - RNA, 22 nt, Human
agcugccaucagccuuuggaug

SEQ ID NO: 317046 - RNA, 22 nt, Human
acugugcuuucucuggaggcau

SEQ ID NO: 317047 - RNA, 22 nt, Human
agcauuuaauuacaguuuaauu

SEQ ID NO: 317048 - RNA, 22 nt, Human
gaucucuggguccuguuggccu

SEQ ID NO: 317049 - RNA, 23 nt, Human
ggccuguguuuugucugaaguac

SEQ ID NO: 317050 - RNA, 22 nt, Human
acagaugaguuaaagcagagug

SEQ ID NO: 317051 - RNA, 22 nt, Human
uggggcugucccgguuuggcga

SEQ ID NO: 317052 - RNA, 22 nt, Human
agcucccagcuccuuugagaga

SEQ ID NO: 317053 - RNA, 22 nt, Human
aggcagagcuaggaagaauugu

SEQ ID NO: 317054 - RNA, 22 nt, Human
uauuuccugcauggugauguaa

SEQ ID NO: 317055 - RNA, 21 nt, Human
uccaggaguggcugggcaggg

SEQ ID NO: 317056 - RNA, 22 nt, Human
aaagccuuggucaucugguucc

SEQ ID NO: 317057 - RNA, 22 nt, Human
uuuccaauaaagugucauuguu

SEQ ID NO: 317058 - RNA, 22 nt, Human
gcugggcuucacagagccuuua

SEQ ID NO: 317059 - RNA, 22 nt, Human
uucaugugaucacagauuguaa

SEQ ID NO: 317060 - RNA, 22 nt, Human
ggcuucucucuucacauggcuu

SEQ ID NO: 317061 - RNA, 22 nt, Human
ugcaugcauaaauguacacaca

SEQ ID NO: 317062 - RNA, 22 nt, Human
gccugucucuuggaacuuggua

SEQ ID NO: 317063 - RNA, 22 nt, Human
cagcccaaagccccaggcuaga

SEQ ID NO: 317064 - RNA, 22 nt, Human
ggcccucccugagccagguggg

SEQ ID NO: 317065 - RNA, 22 nt, Human
acacuuuguuguggcauauacg

SEQ ID NO: 317066 - RNA, 22 nt, Human
gaggccagaaugagcugaaugc

SEQ ID NO: 317067 - RNA, 22 nt, Human
ggcgugggaaguggggcuucug

SEQ ID NO: 317068 - RNA, 22 nt, Human
cccauucauccucgcuuccuuc

SEQ ID NO: 317069 - RNA, 22 nt, Human
uguaugcagggcuuguaugcag

SEQ ID NO: 317070 - RNA, 22 nt, Human
aaucucuugggaggaaugaauu

SEQ ID NO: 317071 - RNA, 22 nt, Human
acauuuagaguucuuuacucca

SEQ ID NO: 317072 - RNA, 21 nt, Human
ccaccaggucuucugcucggg

SEQ ID NO: 317073 - RNA, 22 nt, Human
guggccugaugccagcccugug

SEQ ID NO: 317074 - RNA, 22 nt, Human
guguacauagaauugugcuuug

SEQ ID NO: 317075 - RNA, 19 nt, Human
agcuggggcgguguguguu

SEQ ID NO: 317076 - RNA, 22 nt, Human
cugccucuauucacugaggcag

SEQ ID NO: 317077 - RNA, 20 nt, Human
agaaucugacccagagagac

SEQ ID NO: 317078 - RNA, 22 nt, Human
uccagagccuauauguucaacu

SEQ ID NO: 317079 - RNA, 21 nt, Human
auccuugaucagaagagugcu

SEQ ID NO: 317080 - RNA, 22 nt, Human
cuuuggcaaggguuuuaauugu

SEQ ID NO: 317081 - RNA, 22 nt, Human
aagcaucucuauguggagagug

SEQ ID NO: 317082 - RNA, 22 nt, Human
uuauuuaaaauguagguuggga

SEQ ID NO: 317083 - RNA, 22 nt, Human
ucagcaggcgguuccuuguggg

SEQ ID NO: 317084 - RNA, 22 nt, Human
cugcagagaauuguggggcuuc

SEQ ID NO: 317085 - RNA, 22 nt, Human
cccagcaucccagugggcagca

SEQ ID NO: 317086 - RNA, 22 nt, Human
ugcugggggugucucaccaggc

SEQ ID NO: 317087 - RNA, 22 nt, Human
ucugccuggauuccauucucca

SEQ ID NO: 317088 - RNA, 22 nt, Human
ugggccuguugccugaguccau

SEQ ID NO: 317089 - RNA, 22 nt, Human
aagauuuaccacuuuauucaag

SEQ ID NO: 317090 - RNA, 22 nt, Human
caggugggcuugggagaacacu

SEQ ID NO: 317091 - RNA, 22 nt, Human
ccugggcuuucaaaaccagccu

SEQ ID NO: 317092 - RNA, 22 nt, Human
aacaaauguaaaaugcagaugc

SEQ ID NO: 317093 - RNA, 22 nt, Human
uuacauuuggcuauguccucua

SEQ ID NO: 317094 - RNA, 22 nt, Human
uuuugugagcccauaaaugcca

SEQ ID NO: 317095 - RNA, 19 nt, Human
caggaugaucccaugacac

SEQ ID NO: 317096 - RNA, 22 nt, Human
ucagggcagguuaacuugggug

SEQ ID NO: 317097 - RNA, 22 nt, Human
ggaugcuggggaccaaucucug

SEQ ID NO: 317098 - RNA, 22 nt, Human
uauaaaguuucgaaagauguau

SEQ ID NO: 317099 - RNA, 17 nt, Human
agcccugugcucuuuuu

SEQ ID NO: 317100 - RNA, 22 nt, Human
auuguaucuugucauuaugcau

SEQ ID NO: 317101 - RNA, 22 nt, Human
gaaguagaaagccucguaaaua

SEQ ID NO: 317102 - RNA, 22 nt, Human
uuuuucuuaaauguggguuggc

SEQ ID NO: 317103 - RNA, 22 nt, Human
ggaggccuugaggccaggagcu

SEQ ID NO: 317104 - RNA, 22 nt, Human
cacugcuucuggaggaauuugg

SEQ ID NO: 317105 - RNA, 22 nt, Human
aaaugcacacaccaggaaacua

SEQ ID NO: 317106 - RNA, 22 nt, Human
uaugaacugugagugugauggg

SEQ ID NO: 317107 - RNA, 21 nt, Human
uggagcugaauuuuuggcauc

SEQ ID NO: 317108 - RNA, 22 nt, Human
auugaaagcacaaagaacaagu

SEQ ID NO: 317109 - RNA, 20 nt, Human
uguuucuuuuaaugagcggc

SEQ ID NO: 317110 - RNA, 23 nt, Human
ggcacugaagcuacaauggugag

SEQ ID NO: 317111 - RNA, 22 nt, Human
ugcaggcuguaaucugaggcua

SEQ ID NO: 317112 - RNA, 19 nt, Human
gccugagccagccaugcaa

SEQ ID NO: 317113 - RNA, 22 nt, Human
gcagcuguggguuccaagucua

SEQ ID NO: 317114 - RNA, 22 nt, Human
acuguugucaggcugcuuugga

SEQ ID NO: 317115 - RNA, 22 nt, Human
uuagaaaacauaagugguaaag

SEQ ID NO: 317116 - RNA, 22 nt, Human
gcaccaggcagcugagcaggcc

SEQ ID NO: 317117 - RNA, 22 nt, Human
cagaaggcuuuguggaguagac

SEQ ID NO: 317118 - RNA, 22 nt, Human
uucaacacaggaacaugauaua

SEQ ID NO: 317119 - RNA, 22 nt, Human
ccagcuggugggucuuucucug

SEQ ID NO: 317120 - RNA, 23 nt, Human
uuugaaguugacugccuuccaga

SEQ ID NO: 317121 - RNA, 22 nt, Human
aaaaaugugaccacaggguguu

SEQ ID NO: 317122 - RNA, 22 nt, Human
uuugggcugguuugccaugccc

SEQ ID NO: 317123 - RNA, 22 nt, Human
uggcagagguauauugggagga

SEQ ID NO: 317124 - RNA, 22 nt, Human
aacaaauggggccuuguaugaa

SEQ ID NO: 317125 - RNA, 22 nt, Human
ucucagugagcuuuucuauguu

SEQ ID NO: 317126 - RNA, 22 nt, Human
uguucauaucauuuugaaagcu

SEQ ID NO: 317127 - RNA, 22 nt, Human
auggauaagucaaagaguaucc

SEQ ID NO: 317128 - RNA, 22 nt, Human
cugggagcugucaggagcgugu

SEQ ID NO: 317129 - RNA, 22 nt, Human
gcugucccgcugacuuccagcu

SEQ ID NO: 317130 - RNA, 22 nt, Human
gucucagaccacccucuuuggc

SEQ ID NO: 317131 - RNA, 20 nt, Human
cauuugaaucuccauucugc

SEQ ID NO: 317132 - RNA, 22 nt, Human
ggcagcaugagccuggugaauu

SEQ ID NO: 317133 - RNA, 22 nt, Human
ccugcuucagggaugauggcac

SEQ ID NO: 317134 - RNA, 22 nt, Human
cuagguauucauguuucguggc

SEQ ID NO: 317135 - RNA, 22 nt, Human
ugaugaaaauaugauucugagg

SEQ ID NO: 317136 - RNA, 22 nt, Human
caaaguuaugaaugauaagauu

SEQ ID NO: 317137 - RNA, 22 nt, Human
auguagaagugggcauuauaga

SEQ ID NO: 317138 - RNA, 22 nt, Human
cagccagggagggcaaaugaga

SEQ ID NO: 317139 - RNA, 22 nt, Human
cacagggccuggggcagcugcu

SEQ ID NO: 317140 - RNA, 22 nt, Human
gccucugcaucaucacuccagc

SEQ ID NO: 317141 - RNA, 22 nt, Human
acugauuacacgaguucugacu

SEQ ID NO: 317142 - RNA, 20 nt, Human
agauggugaaggccagggag

SEQ ID NO: 317143 - RNA, 22 nt, Human
ggggccuguagagcuucaggga

SEQ ID NO: 317144 - RNA, 22 nt, Human
agggcagcucucaccucuggcc

SEQ ID NO: 317145 - RNA, 22 nt, Human
uguaugaagccagaaucuguuu

SEQ ID NO: 317146 - RNA, 20 nt, Human
agaggcuuccuugggaggag

SEQ ID NO: 317147 - RNA, 22 nt, Human
uucauucugcaguucucagcuc

SEQ ID NO: 317148 - RNA, 20 nt, Human
ggcagcucacuacuuucugu

SEQ ID NO: 317149 - RNA, 22 nt, Human
gaaaagagaacaucugaggauc

SEQ ID NO: 317150 - RNA, 22 nt, Human
gaccagagaaaggcacuggaag

SEQ ID NO: 317151 - RNA, 22 nt, Human
ccagagucuuuauauuccugaa

SEQ ID NO: 317152 - RNA, 22 nt, Human
ggcagggaaacagcugauccca

SEQ ID NO: 317153 - RNA, 22 nt, Human
ugcaauaaagugcuauaaaucc

SEQ ID NO: 317154 - RNA, 21 nt, Human
uucaaaaugguguguuugucu

SEQ ID NO: 317155 - RNA, 22 nt, Human
gggcugggaauggcuaaguaug

SEQ ID NO: 317156 - RNA, 22 nt, Human
aguauguagugcaaucagucag

SEQ ID NO: 317157 - RNA, 22 nt, Human
aggcucagauccuuguguccug

SEQ ID NO: 317158 - RNA, 22 nt, Human
uaaagcaggccacauaugugau

SEQ ID NO: 317159 - RNA, 22 nt, Human
guguggcugccagccaagaggc

SEQ ID NO: 317160 - RNA, 21 nt, Human
cagaaguaaggguaacuucuc

SEQ ID NO: 317161 - RNA, 17 nt, Human
ucagcaaagacaaagga

SEQ ID NO: 317162 - RNA, 19 nt, Human
gcagccaccgcggcggccg

SEQ ID NO: 317163 - RNA, 22 nt, Human
gugugaaagcuuguccucugua

SEQ ID NO: 317164 - RNA, 20 nt, Human
ugagugauggaggcggguca

SEQ ID NO: 317165 - RNA, 22 nt, Human
cagggcccauggcucagguagg

SEQ ID NO: 317166 - RNA, 22 nt, Human
uggccaggcagguagaacggcc

SEQ ID NO: 317167 - RNA, 22 nt, Human
acagggccucagcugauucugg

SEQ ID NO: 317168 - RNA, 22 nt, Human
ucaaugauuagaguuuagugug

SEQ ID NO: 317169 - RNA, 20 nt, Human
uaguauuugcauaaggauag

SEQ ID NO: 317170 - RNA, 23 nt, Human
auacauacagucuuacugacuuu

SEQ ID NO: 317171 - RNA, 22 nt, Human
uagaggugacacugagaccaua

SEQ ID NO: 317172 - RNA, 21 nt, Human
cuguuucuugugaagugacac

SEQ ID NO: 317173 - RNA, 22 nt, Human
uggcucaguuuagcagcucagu

SEQ ID NO: 317174 - RNA, 22 nt, Human
ugcauuguugaauauuucauag

SEQ ID NO: 317175 - RNA, 22 nt, Human
ccacccuggacaggccucugag

SEQ ID NO: 317176 - RNA, 22 nt, Human
guguauaaugcuguuuguacau

SEQ ID NO: 317177 - RNA, 22 nt, Human
uaacagaagagcaggcagcccu

SEQ ID NO: 317178 - RNA, 22 nt, Human
cacugcaguuccccagugcgca

SEQ ID NO: 317179 - RNA, 22 nt, Human
cagagagagucaaaucuuugcu

SEQ ID NO: 317180 - RNA, 22 nt, Human
gcuggccucaucacugacuucu

SEQ ID NO: 317181 - RNA, 22 nt, Human
gcucugcugaagccccuugcau

SEQ ID NO: 317182 - RNA, 22 nt, Human
cagggccaccguguuugcugcu

SEQ ID NO: 317183 - RNA, 20 nt, Human
cuguggcucaugcaucugcc

SEQ ID NO: 317184 - RNA, 22 nt, Human
ucuggcucugacacuacuguua

SEQ ID NO: 317185 - RNA, 22 nt, Human
cugggccauggaagucucugcc

SEQ ID NO: 317186 - RNA, 22 nt, Human
agagugaaguaauuguuaggau

SEQ ID NO: 317187 - RNA, 22 nt, Human
gcuggccugcgagggcaggcug

SEQ ID NO: 317188 - RNA, 22 nt, Human
agccaggauggucucgaucggc

SEQ ID NO: 317189 - RNA, 18 nt, Human
accugccuguucuucucu

SEQ ID NO: 317190 - RNA, 19 nt, Human
augucuggguaacagcugc

SEQ ID NO: 317191 - RNA, 22 nt, Human
caggcagcagaggaguguggga

SEQ ID NO: 317192 - RNA, 22 nt, Human
uggcucagugcauucacaguaa

SEQ ID NO: 317193 - RNA, 22 nt, Human
ucaagagaagugcuccacagua

SEQ ID NO: 317194 - RNA, 22 nt, Human
ugaaaucugucccacuuuagcu

SEQ ID NO: 317195 - RNA, 22 nt, Human
uauguacauguuaaagggcaaa

SEQ ID NO: 317196 - RNA, 22 nt, Human
cugggaggcagucucucuagaa

SEQ ID NO: 317197 - RNA, 22 nt, Human
gcccucugcacagcucugagca

SEQ ID NO: 317198 - RNA, 22 nt, Human
agagcccucuucacugccccuu

SEQ ID NO: 317199 - RNA, 19 nt, Human
ucucagugccgcugaccgc

SEQ ID NO: 317200 - RNA, 22 nt, Human
acguuuucuagagaauaugcag

SEQ ID NO: 317201 - RNA, 20 nt, Human
ucugugcaccugcuacaagg

SEQ ID NO: 317202 - RNA, 22 nt, Human
caagggaccugagauggucucu

SEQ ID NO: 317203 - RNA, 22 nt, Human
gagcccagguucugcuuccagc

SEQ ID NO: 317204 - RNA, 22 nt, Human
aaaggagauaaagggcccuuca

SEQ ID NO: 317205 - RNA, 22 nt, Human
acuguacacgugucauuuacag

SEQ ID NO: 317206 - RNA, 22 nt, Human
gccuggaggaauguagcugagg

SEQ ID NO: 317207 - RNA, 22 nt, Human
gccuguguggaugcgccggugc

SEQ ID NO: 317208 - RNA, 22 nt, Human
uacaaaguuugggguccucaaa

SEQ ID NO: 317209 - RNA, 22 nt, Human
agaugacagcuacgggaugaaa

SEQ ID NO: 317210 - RNA, 18 nt, Human
agaguguucucagugaaa

SEQ ID NO: 317211 - RNA, 22 nt, Human
aauaauuuuagcucagaguugu

SEQ ID NO: 317212 - RNA, 22 nt, Human
aaacagcagcuguuuaauuugc

SEQ ID NO: 317213 - RNA, 22 nt, Human
uuagaaaauuugcuucuuugga

SEQ ID NO: 317214 - RNA, 22 nt, Human
ccugcagacacuuguccagcaa

SEQ ID NO: 317215 - RNA, 22 nt, Human
acugggaguucuccaugucccu

SEQ ID NO: 317216 - RNA, 22 nt, Human
aguguacauguuuacagcaucu

SEQ ID NO: 317217 - RNA, 22 nt, Human
uuuccucugcugccauugcccc

SEQ ID NO: 317218 - RNA, 19 nt, Human
uuagccauccacagugaaa

SEQ ID NO: 317219 - RNA, 22 nt, Human
gagagucuaggaaccucauaua

SEQ ID NO: 317220 - RNA, 22 nt, Human
cugccugugccaccgccucauu

SEQ ID NO: 317221 - RNA, 22 nt, Human
uaaugucagcauaguuuauuuu

SEQ ID NO: 317222 - RNA, 22 nt, Human
gagauuucuuuugaugccuguc

SEQ ID NO: 317223 - RNA, 22 nt, Human
uccaugucuucaugugucuaac

SEQ ID NO: 317224 - RNA, 22 nt, Human
cauuuucaugaguuucuguuca

SEQ ID NO: 317225 - RNA, 19 nt, Human
cccucaggucugagcaguc

SEQ ID NO: 317226 - RNA, 22 nt, Human
uuccucagagggcgcuggggaa

SEQ ID NO: 317227 - RNA, 22 nt, Human
cugcugcucgaccagucccagg

SEQ ID NO: 317228 - RNA, 21 nt, Human
auggagggaccagggaagcag

SEQ ID NO: 317229 - RNA, 20 nt, Human
uuuuccagaaaguaucauug

SEQ ID NO: 317230 - RNA, 22 nt, Human
uagaaaucagguuuuuagaaag

SEQ ID NO: 317231 - RNA, 22 nt, Human
agaaauguacgauguuaugcag

SEQ ID NO: 317232 - RNA, 22 nt, Human
gaaaugcaggcuuggauucagc

SEQ ID NO: 317233 - RNA, 22 nt, Human
ucuccuggucaccucagaaguc

SEQ ID NO: 317234 - RNA, 22 nt, Human
ugaaauguugccaugaggucuc

SEQ ID NO: 317235 - RNA, 22 nt, Human
uugcagcugcaguaaauguuca

SEQ ID NO: 317236 - RNA, 22 nt, Human
agagccuggucugagauaggac

SEQ ID NO: 317237 - RNA, 22 nt, Human
agauacaucauuuauaccuuca

SEQ ID NO: 317238 - RNA, 22 nt, Human
cauuucugucacguucuuuuau

SEQ ID NO: 317239 - RNA, 22 nt, Human
cugucugucaaguucaucucca

SEQ ID NO: 317240 - RNA, 22 nt, Human
uacaguaagaugaaauagcaau

SEQ ID NO: 317241 - RNA, 19 nt, Human
ggcuggcaagugacagugu

SEQ ID NO: 317242 - RNA, 23 nt, Human
aacaccaaggcucagagagauaa

SEQ ID NO: 317243 - RNA, 22 nt, Human
ggaguuggugagcaccaggcuu

SEQ ID NO: 317244 - RNA, 22 nt, Human
uaaguggaagguuauaugcuaa

SEQ ID NO: 317245 - RNA, 22 nt, Human
gcagggacugugaucucacaga

SEQ ID NO: 317246 - RNA, 22 nt, Human
auugacaauguauuuguaucug

SEQ ID NO: 317247 - RNA, 22 nt, Human
uguuacuuaucucacgugaugc

SEQ ID NO: 317248 - RNA, 22 nt, Human
cugggccugggaggccaggucu

SEQ ID NO: 317249 - RNA, 22 nt, Human
gcauggcagugaggauggugcu

SEQ ID NO: 317250 - RNA, 20 nt, Human
gugggcagaugugugcaugg

SEQ ID NO: 317251 - RNA, 22 nt, Human
gcccucagcuccuggacacaug

SEQ ID NO: 317252 - RNA, 22 nt, Human
ccuggggagaagagcuuccccc

SEQ ID NO: 317253 - RNA, 22 nt, Human
gagcacagcuggagguagcauu

SEQ ID NO: 317254 - RNA, 22 nt, Human
gcuggccuucugcagaguucug

SEQ ID NO: 317255 - RNA, 22 nt, Human
ucugcagcuuuuugguggggug

SEQ ID NO: 317256 - RNA, 19 nt, Human
gcacacccugcaccaccau

SEQ ID NO: 317257 - RNA, 18 nt, Human
ugcucuggucucacuugg

SEQ ID NO: 317258 - RNA, 22 nt, Human
uggacucaaguccaaguucacg

SEQ ID NO: 317259 - RNA, 22 nt, Human
aauauuuguuaguguuuuaaug

SEQ ID NO: 317260 - RNA, 20 nt, Human
ggcacuggaagcacacagga

SEQ ID NO: 317261 - RNA, 22 nt, Human
cauugcaccacauugcaucccu

SEQ ID NO: 317262 - RNA, 22 nt, Human
uguucuugagccuuuagaccua

SEQ ID NO: 317263 - RNA, 22 nt, Human
cauuccuuaacguggggagucu

SEQ ID NO: 317264 - RNA, 22 nt, Human
uaguacuuaucucugucauugu

SEQ ID NO: 317265 - RNA, 22 nt, Human
ugauuuccaauaaggagaaugu

SEQ ID NO: 317266 - RNA, 22 nt, Human
accagagcuggcagaguaucaa

SEQ ID NO: 317267 - RNA, 22 nt, Human
ugcauuguuuagaacucuuugg

SEQ ID NO: 317268 - RNA, 22 nt, Human
cagaagcauuccagcaaauagu

SEQ ID NO: 317269 - RNA, 22 nt, Human
uggcagaaguacacaagcaugc

SEQ ID NO: 317270 - RNA, 22 nt, Human
aaucuguuuaguucugcguaug

SEQ ID NO: 317271 - RNA, 21 nt, Human
acagaguaguugaaacagaga

SEQ ID NO: 317272 - RNA, 22 nt, Human
cuggccuggucuggccucucca

SEQ ID NO: 317273 - RNA, 22 nt, Human
acaggcagggaccuuggcuaag

SEQ ID NO: 317274 - RNA, 22 nt, Human
ggccugagaaccauggggccaa

SEQ ID NO: 317275 - RNA, 22 nt, Human
aguacuucagaggcugcccagg

SEQ ID NO: 317276 - RNA, 22 nt, Human
gucccuggaauggacucugcgc

SEQ ID NO: 317277 - RNA, 22 nt, Human
auacaguguacuauuuagcagu

SEQ ID NO: 317278 - RNA, 22 nt, Human
uccauguggccagacacuggca

SEQ ID NO: 317279 - RNA, 22 nt, Human
cccuggagcuagucugagcaga

SEQ ID NO: 317280 - RNA, 20 nt, Human
cacaggcuauaugagagcca

SEQ ID NO: 317281 - RNA, 22 nt, Human
ugagcuuacuucuguacacaga

SEQ ID NO: 317282 - RNA, 22 nt, Human
uuuucucuuguuaauguacuga

SEQ ID NO: 317283 - RNA, 22 nt, Human
auccugggaagcugacauugaa

SEQ ID NO: 317284 - RNA, 22 nt, Human
cacugcagaucagaggcugaga

SEQ ID NO: 317285 - RNA, 22 nt, Human
agugaaauuuguuuagauaggu

SEQ ID NO: 317286 - RNA, 22 nt, Human
gccuggcugagguggggaggca

SEQ ID NO: 317287 - RNA, 22 nt, Human
cugugcuuaccugcccagguga

SEQ ID NO: 317288 - RNA, 23 nt, Human
uuucuguuggguauauauccaag

SEQ ID NO: 317289 - RNA, 22 nt, Human
agggagaaugaccaagguauau

SEQ ID NO: 317290 - RNA, 22 nt, Human
ucaggaugguccuuuaugagaa

SEQ ID NO: 317291 - RNA, 22 nt, Human
ccaguguuuuccaguuugccca

SEQ ID NO: 317292 - RNA, 22 nt, Human
agucuacaaucuuaaaugaacu

SEQ ID NO: 317293 - RNA, 22 nt, Human
ugaggcuguucuaccagggcca

SEQ ID NO: 317294 - RNA, 22 nt, Human
uaugagaacgggggcguguggg

SEQ ID NO: 317295 - RNA, 22 nt, Human
cuggcagcaguuaugaaacaau

SEQ ID NO: 317296 - RNA, 22 nt, Human
cagggcucaucugugugaccag

SEQ ID NO: 317297 - RNA, 22 nt, Human
aaguaugugauacauguuaauu

SEQ ID NO: 317298 - RNA, 22 nt, Human
uguggugagaaacugguagauu

SEQ ID NO: 317299 - RNA, 22 nt, Human
aaacagcugucauuguuuuaaa

SEQ ID NO: 317300 - RNA, 22 nt, Human
gauaaugaugacaaugacaacc

SEQ ID NO: 317301 - RNA, 22 nt, Human
uuucaugcacaaaugagcaagg

SEQ ID NO: 317302 - RNA, 22 nt, Human
ccagugggugcugggcucugcc

SEQ ID NO: 317303 - RNA, 22 nt, Human
acugcuuacaaaaggaaagaau

SEQ ID NO: 317304 - RNA, 22 nt, Human
ccuggagcuuggucacgcugcg

SEQ ID NO: 317305 - RNA, 22 nt, Human
cagcugcuguuacugcuuauua

SEQ ID NO: 317306 - RNA, 22 nt, Human
ugaaaugaagggcuuguucugg

SEQ ID NO: 317307 - RNA, 22 nt, Human
ggucucagaucuuuauuaaggc

SEQ ID NO: 317308 - RNA, 22 nt, Human
uagccucuggaauccuuucucu

SEQ ID NO: 317309 - RNA, 22 nt, Human
auuauguaacugugguucagca

SEQ ID NO: 317310 - RNA, 22 nt, Human
cagccccucccucaggcaggug

SEQ ID NO: 317311 - RNA, 22 nt, Human
ucacaugcuugaggaaagaaaa

SEQ ID NO: 317312 - RNA, 22 nt, Human
acuuccugggcaugcagagucc

SEQ ID NO: 317313 - RNA, 22 nt, Human
cugugagcuggguggccaggac

SEQ ID NO: 317314 - RNA, 22 nt, Human
uggcagaggagaauuaagauua

SEQ ID NO: 317315 - RNA, 22 nt, Human
aaucuggcucagaagaagauga

SEQ ID NO: 317316 - RNA, 22 nt, Human
aaguucuugauaaguccacugu

SEQ ID NO: 317317 - RNA, 22 nt, Human
aucuggcuauugacauguuaua

SEQ ID NO: 317318 - RNA, 22 nt, Human
cagcucuguugccaaagugggc

SEQ ID NO: 317319 - RNA, 22 nt, Human
auuucuucaggucagaaauaga

SEQ ID NO: 317320 - RNA, 22 nt, Human
agcagcucuguuuaccuggagg

SEQ ID NO: 317321 - RNA, 22 nt, Human
gaugcacuuucuuuucaacagu

SEQ ID NO: 317322 - RNA, 22 nt, Human
ucuguucagcugccucagggua

SEQ ID NO: 317323 - RNA, 22 nt, Human
auaugaaaagaagucaccauug

SEQ ID NO: 317324 - RNA, 22 nt, Human
cagggacugagauccagacugu

SEQ ID NO: 317325 - RNA, 22 nt, Human
ucagugcagaauagugaugcau

SEQ ID NO: 317326 - RNA, 22 nt, Human
uagaaacauauaggauggcagg

SEQ ID NO: 317327 - RNA, 22 nt, Human
ggcaaaguuuucaucucauaac

SEQ ID NO: 317328 - RNA, 22 nt, Human
cugcaggcucgaagacacggau

SEQ ID NO: 317329 - RNA, 20 nt, Human
aucagcaacugccacucagu

SEQ ID NO: 317330 - RNA, 22 nt, Human
caccccagucuaaaaccagccu

SEQ ID NO: 317331 - RNA, 22 nt, Human
guaucacuuuugagagugagaa

SEQ ID NO: 317332 - RNA, 22 nt, Human
cuccucagcugggaggaguccc

SEQ ID NO: 317333 - RNA, 21 nt, Human
ugccaggccugagcugggguc

SEQ ID NO: 317334 - RNA, 22 nt, Human
gucccuaguggaaagacaugau

SEQ ID NO: 317335 - RNA, 22 nt, Human
uggcucagucuggguugacuga

SEQ ID NO: 317336 - RNA, 22 nt, Human
ucuguucuauuggucuaugugu

SEQ ID NO: 317337 - RNA, 22 nt, Human
aauuugcaugaugagaacaaua

SEQ ID NO: 317338 - RNA, 22 nt, Human
uagaaauguuagauguauugag

SEQ ID NO: 317339 - RNA, 22 nt, Human
acuugauuuugaaccuuucuac

SEQ ID NO: 317340 - RNA, 22 nt, Human
cagucacauggaugauggauag

SEQ ID NO: 317341 - RNA, 22 nt, Human
cuucaucaacucuaacaaaugu

SEQ ID NO: 317342 - RNA, 22 nt, Human
ugaagcaguuacuggguguuaa

SEQ ID NO: 317343 - RNA, 22 nt, Human
gggaaggagguggcuugaagug

SEQ ID NO: 317344 - RNA, 23 nt, Human
ccugcagcugcuggggcuccacc

SEQ ID NO: 317345 - RNA, 22 nt, Human
agcugucugucuccugaggaga

SEQ ID NO: 317346 - RNA, 22 nt, Human
cagcaauaagguaagcuucucc

SEQ ID NO: 317347 - RNA, 23 nt, Human
aaauuauugcucuucaauugccu

SEQ ID NO: 317348 - RNA, 20 nt, Human
ccuggcuuugcaucugugau

SEQ ID NO: 317349 - RNA, 22 nt, Human
uugagaagaauguguugaguuu

SEQ ID NO: 317350 - RNA, 22 nt, Human
uauuccagguauucuucaagag

SEQ ID NO: 317351 - RNA, 22 nt, Human
aagggcagggaguuugugucua

SEQ ID NO: 317352 - RNA, 22 nt, Human
agugaggggcagcugagugggc

SEQ ID NO: 317353 - RNA, 23 nt, Human
cccuguagcccaggacaggcuuu

SEQ ID NO: 317354 - RNA, 22 nt, Human
accugggagucacaccugagaa

SEQ ID NO: 317355 - RNA, 22 nt, Human
caaauaucuuuggcaaagagaa

SEQ ID NO: 317356 - RNA, 20 nt, Human
agugucugggccucaggccc

SEQ ID NO: 317357 - RNA, 22 nt, Human
cauuuguauguuccuccuuagg

SEQ ID NO: 317358 - RNA, 22 nt, Human
uuucacaauuuuaaggagcaaa

SEQ ID NO: 317359 - RNA, 18 nt, Human
ugcuggguaacuguaugg

SEQ ID NO: 317360 - RNA, 22 nt, Human
ucuacuauguuucuuaaauaga

SEQ ID NO: 317361 - RNA, 22 nt, Human
aucuguuccccuaugcucucua

SEQ ID NO: 317362 - RNA, 22 nt, Human
uaugcacacauguaugcaugug

SEQ ID NO: 317363 - RNA, 22 nt, Human
ggggcugggauuugaacccagg

SEQ ID NO: 317364 - RNA, 22 nt, Human
ggcugcuguacugaugucaguu

SEQ ID NO: 317365 - RNA, 20 nt, Human
uggaggcaccuguggagauc

SEQ ID NO: 317366 - RNA, 22 nt, Human
guuaugaaauaaauauagauca

SEQ ID NO: 317367 - RNA, 23 nt, Human
ccugaagggucaggguccucagc

SEQ ID NO: 317368 - RNA, 22 nt, Human
uuucuucucacccaggacagag

SEQ ID NO: 317369 - RNA, 22 nt, Human
gggcuggaucuccugcaggcag

SEQ ID NO: 317370 - RNA, 22 nt, Human
ugaggccacuuccccacagccc

SEQ ID NO: 317371 - RNA, 22 nt, Human
agcaccugucacaagcagaagg

SEQ ID NO: 317372 - RNA, 22 nt, Human
caggacaguauaggcuuuagga

SEQ ID NO: 317373 - RNA, 22 nt, Human
ugaggccagucucaucacaggc

SEQ ID NO: 317374 - RNA, 22 nt, Human
cccccagccagcagugcucagc

SEQ ID NO: 317375 - RNA, 22 nt, Human
uacuuacagagcuuauaaguua

SEQ ID NO: 317376 - RNA, 22 nt, Human
uccauguguuuuccuguccaca

SEQ ID NO: 317377 - RNA, 22 nt, Human
ucauuuuucacacagggucacc

SEQ ID NO: 317378 - RNA, 22 nt, Human
gccuucaguagugucagcugua

SEQ ID NO: 317379 - RNA, 22 nt, Human
ucaucaaagcgcuuggaguagg

SEQ ID NO: 317380 - RNA, 21 nt, Human
uccuuccuugagguccuuucc

SEQ ID NO: 317381 - RNA, 22 nt, Human
ggcuuugccuggaauuuccuug

SEQ ID NO: 317382 - RNA, 22 nt, Human
aagauuuccuucaguagagcua

SEQ ID NO: 317383 - RNA, 22 nt, Human
ugaaagaacuagcaucuucaag

SEQ ID NO: 317384 - RNA, 22 nt, Human
gagguggccucaagcagucuuc

SEQ ID NO: 317385 - RNA, 18 nt, Human
aggccugggaagcugagg

SEQ ID NO: 317386 - RNA, 19 nt, Human
ccagagcccgccagauggg

SEQ ID NO: 317387 - RNA, 22 nt, Human
uguauguaaaguuuguaauaga

SEQ ID NO: 317388 - RNA, 22 nt, Human
cagagcugggaucccaugggcg

SEQ ID NO: 317389 - RNA, 22 nt, Human
ccugggaagagcugacaggagg

SEQ ID NO: 317390 - RNA, 18 nt, Human
gcucugcccaggcugccc

SEQ ID NO: 317391 - RNA, 22 nt, Human
cauguacauucuguagauggag

SEQ ID NO: 317392 - RNA, 22 nt, Human
cccugagagugagugccaccuu

SEQ ID NO: 317393 - RNA, 22 nt, Human
acuuucuccagaaaaccaagga

SEQ ID NO: 317394 - RNA, 22 nt, Human
gcuuagucaauuauaaauaggc

SEQ ID NO: 317395 - RNA, 20 nt, Human
ggggcccaagcccucuugcc

SEQ ID NO: 317396 - RNA, 22 nt, Human
augcaguauaaaucauuucugg

SEQ ID NO: 317397 - RNA, 22 nt, Human
aggccagcucacccuggcuccu

SEQ ID NO: 317398 - RNA, 22 nt, Human
uggucaguugcaucagagaagu

SEQ ID NO: 317399 - RNA, 22 nt, Human
gcucuguguccacagcuggaaa

SEQ ID NO: 317400 - RNA, 22 nt, Human
ccuggcugcauuuugcuggaug

SEQ ID NO: 317401 - RNA, 16 nt, Human
ugggcagaugagaaga

SEQ ID NO: 317402 - RNA, 22 nt, Human
ggcucugcaugugagugggugg

SEQ ID NO: 317403 - RNA, 22 nt, Human
agaugcugugucuguucccuug

SEQ ID NO: 317404 - RNA, 22 nt, Human
ugggggagcgacagacauaauu

SEQ ID NO: 317405 - RNA, 22 nt, Human
ugaaucauggauaaauagcuua

SEQ ID NO: 317406 - RNA, 22 nt, Human
cuguaauucacuagggucagcg

SEQ ID NO: 317407 - RNA, 22 nt, Human
uuucuguuaggcaucauuuuaa

SEQ ID NO: 317408 - RNA, 22 nt, Human
ugagccuggcggaagcagcgug

SEQ ID NO: 317409 - RNA, 22 nt, Human
uucaugaauguuccaugugagu

SEQ ID NO: 317410 - RNA, 22 nt, Human
gcccagcacauugcugaggacc

SEQ ID NO: 317411 - RNA, 23 nt, Human
uagagcagggaaaucugucagag

SEQ ID NO: 317412 - RNA, 22 nt, Human
ggcagcuccucucagcaaaaga

SEQ ID NO: 317413 - RNA, 22 nt, Human
auuagcugaccucuaaggagcc

SEQ ID NO: 317414 - RNA, 22 nt, Human
ucucaguguuuaaaaagauuuc

SEQ ID NO: 317415 - RNA, 22 nt, Human
ugugcuucaucacuucucaguu

SEQ ID NO: 317416 - RNA, 16 nt, Human
gggcugggggauucug

SEQ ID NO: 317417 - RNA, 22 nt, Human
ugggacagagugagcuuuggcc

SEQ ID NO: 317418 - RNA, 22 nt, Human
gcccauccauggggucauggcc

SEQ ID NO: 317419 - RNA, 22 nt, Human
gcagagccccucaagccagccu

SEQ ID NO: 317420 - RNA, 22 nt, Human
agcuggagcuucaagcagguaa

SEQ ID NO: 317421 - RNA, 22 nt, Human
ugcucugcaagcaggagcaaga

SEQ ID NO: 317422 - RNA, 22 nt, Human
uaauuauuugaagacauuagag

SEQ ID NO: 317423 - RNA, 22 nt, Human
gagcuuggugaugccuccuggu

SEQ ID NO: 317424 - RNA, 22 nt, Human
uccugccucaggcucuggagua

SEQ ID NO: 317425 - RNA, 22 nt, Human
aacaaaugauuguugguuggag

SEQ ID NO: 317426 - RNA, 22 nt, Human
ccucuucuagguuucagccugc

SEQ ID NO: 317427 - RNA, 22 nt, Human
ucugugcauuguaacaacuaaa

SEQ ID NO: 317428 - RNA, 22 nt, Human
guuucacagucugcagaauuuu

SEQ ID NO: 317429 - RNA, 20 nt, Human
cagcucugggaaagaggcca

SEQ ID NO: 317430 - RNA, 22 nt, Human
ggcccuguccuggcugucuccg

SEQ ID NO: 317431 - RNA, 22 nt, Human
uuagaacugaagaagauuaagg

SEQ ID NO: 317432 - RNA, 22 nt, Human
gugcugugucuaucaggaauaa

SEQ ID NO: 317433 - RNA, 22 nt, Human
uauuucagucacuucuucucug

SEQ ID NO: 317434 - RNA, 22 nt, Human
ggcuggagugggcuccagaguu

SEQ ID NO: 317435 - RNA, 22 nt, Human
guucuucaccaaggucagaggc

SEQ ID NO: 317436 - RNA, 22 nt, Human
gucucaguuugaagugaugcca

SEQ ID NO: 317437 - RNA, 22 nt, Human
acucugaggcaggucagggcag

SEQ ID NO: 317438 - RNA, 22 nt, Human
cagcauggggaucacuguaggc

SEQ ID NO: 317439 - RNA, 22 nt, Human
ucagugugaggggcuggguccu

SEQ ID NO: 317440 - RNA, 22 nt, Human
agggaugauggaaagaagcagg

SEQ ID NO: 317441 - RNA, 22 nt, Human
ggcaaaaacagcaaugacuuuu

SEQ ID NO: 317442 - RNA, 21 nt, Human
aguucauacugaguaacaaaa

SEQ ID NO: 317443 - RNA, 22 nt, Human
cagucccuaguggagcucacag

SEQ ID NO: 317444 - RNA, 22 nt, Human
agucucuuauucccuauugcug

SEQ ID NO: 317445 - RNA, 22 nt, Human
aaaugcaccuugcugugagacu

SEQ ID NO: 317446 - RNA, 22 nt, Human
auguagagcaguguuguccaau

SEQ ID NO: 317447 - RNA, 22 nt, Human
ugggugagugggaaaagcccag

SEQ ID NO: 317448 - RNA, 22 nt, Human
cacaggggcaaacuguagggga

SEQ ID NO: 317449 - RNA, 22 nt, Human
aggggugauuugggacaggaca

SEQ ID NO: 317450 - RNA, 21 nt, Human
ucucuggaguuagcagagaga

SEQ ID NO: 317451 - RNA, 22 nt, Human
ccugggggccaggaagguguga

SEQ ID NO: 317452 - RNA, 22 nt, Human
ggcuucaccaggugcaugcaug

SEQ ID NO: 317453 - RNA, 22 nt, Human
gggcugggauugcuugcuguga

SEQ ID NO: 317454 - RNA, 22 nt, Human
uccagcccugcuuccugccuca

SEQ ID NO: 317455 - RNA, 22 nt, Human
cugcugugcacccaggaaggcu

SEQ ID NO: 317456 - RNA, 19 nt, Human
guggccugcgcugggugcg

SEQ ID NO: 317457 - RNA, 23 nt, Human
ucagaaugcacugaauuuacccu

SEQ ID NO: 317458 - RNA, 22 nt, Human
guugcacaguuccucaagcagg

SEQ ID NO: 317459 - RNA, 22 nt, Human
agucaauucuuuucaacucaag

SEQ ID NO: 317460 - RNA, 22 nt, Human
cagguccccuccccuaccaggc

SEQ ID NO: 317461 - RNA, 22 nt, Human
acuuugcagagccagaagagaa

SEQ ID NO: 317462 - RNA, 22 nt, Human
gccugagcaggcguggaccaug

SEQ ID NO: 317463 - RNA, 22 nt, Human
agcucugggccaggaacccuaa

SEQ ID NO: 317464 - RNA, 22 nt, Human
ggggaugguagaccggugacgu

SEQ ID NO: 317465 - RNA, 22 nt, Human
ucugaaaguaucuggaucuuuu

SEQ ID NO: 317466 - RNA, 22 nt, Human
ucugucaccgagggcauccaaa

SEQ ID NO: 317467 - RNA, 22 nt, Human
uuccauauguauauagcuguua

SEQ ID NO: 317468 - RNA, 22 nt, Human
augggaggaugcucgggugcuc

SEQ ID NO: 317469 - RNA, 22 nt, Human
gugcugucaauugcuuucagua

SEQ ID NO: 317470 - RNA, 22 nt, Human
gguggcaggcccugagcauccc

SEQ ID NO: 317471 - RNA, 22 nt, Human
gagaggucaucucccaucagca

SEQ ID NO: 317472 - RNA, 22 nt, Human
cagcuguucggggcuggcaugu

SEQ ID NO: 317473 - RNA, 22 nt, Human
gucacuguauccagguuccagc

SEQ ID NO: 317474 - RNA, 22 nt, Human
agguuuucagcuguauccugag

SEQ ID NO: 317475 - RNA, 22 nt, Human
gcaguguuggcaggauggggcu

SEQ ID NO: 317476 - RNA, 21 nt, Human
aagaaguuuggauuuuguccu

SEQ ID NO: 317477 - RNA, 22 nt, Human
ugagacaguucugcagcugggu

SEQ ID NO: 317478 - RNA, 22 nt, Human
uuagcucagaaaauuuaaacuu

SEQ ID NO: 317479 - RNA, 22 nt, Human
ggagccuggcaaugcugcgucc

SEQ ID NO: 317480 - RNA, 22 nt, Human
ugcucuggggagcuccucugcg

SEQ ID NO: 317481 - RNA, 22 nt, Human
uuuuaucuucauuccuaucuac

SEQ ID NO: 317482 - RNA, 22 nt, Human
gggcagagaaauggacaguugg

SEQ ID NO: 317483 - RNA, 22 nt, Human
gaguggggcguggauccagcgu

SEQ ID NO: 317484 - RNA, 22 nt, Human
agggcugcaucugccuggugaa

SEQ ID NO: 317485 - RNA, 22 nt, Human
uccuuagagacaagaccaguuu

SEQ ID NO: 317486 - RNA, 22 nt, Human
ccagccccuauccucgcuccac

SEQ ID NO: 317487 - RNA, 22 nt, Human
ucagugcuucggcgagcaccua

SEQ ID NO: 317488 - RNA, 22 nt, Human
ucacauuuuccuugguaucugu

SEQ ID NO: 317489 - RNA, 18 nt, Human
gggcaagcggcugucacc

SEQ ID NO: 317490 - RNA, 22 nt, Human
caagcuccuuacauccacaggg

SEQ ID NO: 317491 - RNA, 22 nt, Human
uugcucaggcuggugugcagug

SEQ ID NO: 317492 - RNA, 22 nt, Human
cccagcugcaccucuauggccu

SEQ ID NO: 317493 - RNA, 19 nt, Human
aauguaguguuaugucaac

SEQ ID NO: 317494 - RNA, 22 nt, Human
cagagcuguuacuauucaugaa

SEQ ID NO: 317495 - RNA, 22 nt, Human
uugaaucauuacaauagauaag

SEQ ID NO: 317496 - RNA, 22 nt, Human
cagcccaggccgacaguuccuc

SEQ ID NO: 317497 - RNA, 22 nt, Human
ucucuucuaacacuagaaauuc

SEQ ID NO: 317498 - RNA, 21 nt, Human
gggccacaccuucugcagacc

SEQ ID NO: 317499 - RNA, 22 nt, Human
gauguagacacuuggaggcuua

SEQ ID NO: 317500 - RNA, 22 nt, Human
aggucaaguuuagauagaguua

SEQ ID NO: 317501 - RNA, 22 nt, Human
ucugccagaaguucugagagua

SEQ ID NO: 317502 - RNA, 22 nt, Human
auauacuuggagacuaucauug

SEQ ID NO: 317503 - RNA, 23 nt, Human
ccagcccuccaccagcucuaggc

SEQ ID NO: 317504 - RNA, 22 nt, Human
aggcagcagccacaaggccuga

SEQ ID NO: 317505 - RNA, 22 nt, Human
ccacagggcucuaggcgcuucc

SEQ ID NO: 317506 - RNA, 22 nt, Human
aggucauugaaguuauuuucuu

SEQ ID NO: 317507 - RNA, 22 nt, Human
cugccuggccugaucuccacgc

SEQ ID NO: 317508 - RNA, 22 nt, Human
caggagcucucaucgucagggc

SEQ ID NO: 317509 - RNA, 22 nt, Human
uccugagggcgauucagcaggu

SEQ ID NO: 317510 - RNA, 22 nt, Human
ggagagugggagcaacuguugc

SEQ ID NO: 317511 - RNA, 22 nt, Human
cugcugugcagacagacucucu

SEQ ID NO: 317512 - RNA, 22 nt, Human
ucccaggcuaggccucugcguu

SEQ ID NO: 317513 - RNA, 22 nt, Human
ccacccagccagaugcaggaag

SEQ ID NO: 317514 - RNA, 21 nt, Human
agagucugcauuucugacaag

SEQ ID NO: 317515 - RNA, 22 nt, Human
cugggaguguucuaggucacau

SEQ ID NO: 317516 - RNA, 20 nt, Human
auuccauaguuggcacuuuu

SEQ ID NO: 317517 - RNA, 22 nt, Human
ucuccucugcgcggcagugccc

SEQ ID NO: 317518 - RNA, 23 nt, Human
aggagccaggaaccagcuucccc

SEQ ID NO: 317519 - RNA, 22 nt, Human
uuuguagaggguaauugacaga

SEQ ID NO: 317520 - RNA, 21 nt, Human
aaagagguuaauauuguaagu

SEQ ID NO: 317521 - RNA, 22 nt, Human
acaaagugcacaagaugagaac

SEQ ID NO: 317522 - RNA, 22 nt, Human
uuaaaaauauguagggcccgau

SEQ ID NO: 317523 - RNA, 22 nt, Human
aauguaugugauuauuccucua

SEQ ID NO: 317524 - RNA, 22 nt, Human
aggcacugacaauucuggacug

SEQ ID NO: 317525 - RNA, 20 nt, Human
uucuggaggcuacaagucug

SEQ ID NO: 317526 - RNA, 22 nt, Human
acugccaggauggcacuagagg

SEQ ID NO: 317527 - RNA, 22 nt, Human
ucgagcucuggagccaaggaug

SEQ ID NO: 317528 - RNA, 22 nt, Human
auuucacucauucauguuacuu

SEQ ID NO: 317529 - RNA, 23 nt, Human
gugauuucagggaacagaaucag

SEQ ID NO: 317530 - RNA, 22 nt, Human
agggcagaccacgugcaaggau

SEQ ID NO: 317531 - RNA, 22 nt, Human
ucagaggagaaguugggaaaau

SEQ ID NO: 317532 - RNA, 22 nt, Human
gauaccagacagggagggagaa

SEQ ID NO: 317533 - RNA, 22 nt, Human
cagcugcccaggccaccuggag

SEQ ID NO: 317534 - RNA, 22 nt, Human
gcagggacgccagggacagcaa

SEQ ID NO: 317535 - RNA, 22 nt, Human
agcugguucagaaauuagaugg

SEQ ID NO: 317536 - RNA, 22 nt, Human
gcagagccagaauggccaggac

SEQ ID NO: 317537 - RNA, 22 nt, Human
gaaggagggugcggaucugagc

SEQ ID NO: 317538 - RNA, 22 nt, Human
gucucagauaacauguauucua

SEQ ID NO: 317539 - RNA, 22 nt, Human
ugaugcugcugggaguggugcu

SEQ ID NO: 317540 - RNA, 22 nt, Human
acauucuuaacaguuaaaaacu

SEQ ID NO: 317541 - RNA, 22 nt, Human
gcugcugucacggugcuaaggg

SEQ ID NO: 317542 - RNA, 22 nt, Human
agugaaauaaagcugccuaugg

SEQ ID NO: 317543 - RNA, 22 nt, Human
ccccaccugugcgucugccgca

SEQ ID NO: 317544 - RNA, 22 nt, Human
agcugagccagcagcaacagga

SEQ ID NO: 317545 - RNA, 22 nt, Human
aauguauguguauaucaaauca

SEQ ID NO: 317546 - RNA, 22 nt, Human
aaaucaguuguuauauuaaaga

SEQ ID NO: 317547 - RNA, 22 nt, Human
cuggguggcagagccugcagug

SEQ ID NO: 317548 - RNA, 22 nt, Human
aggcacugcagauuacaggcgc

SEQ ID NO: 317549 - RNA, 22 nt, Human
cuugggaaugcuaacagaugac

SEQ ID NO: 317550 - RNA, 22 nt, Human
acacaguaugaaaagucuaguu

SEQ ID NO: 317551 - RNA, 22 nt, Human
gaggguccccaugcagagcuca

SEQ ID NO: 317552 - RNA, 22 nt, Human
agcugccaucugaagaacugca

SEQ ID NO: 317553 - RNA, 22 nt, Human
ucuuugcaaauguuauuaucuu

SEQ ID NO: 317554 - RNA, 22 nt, Human
guggcagcaaaauccugcauuc

SEQ ID NO: 317555 - RNA, 22 nt, Human
ugcagcagucagucaggccugg

SEQ ID NO: 317556 - RNA, 22 nt, Human
acccaggguagagugcaguggc

SEQ ID NO: 317557 - RNA, 22 nt, Human
uaagugcaauguuuuacuuaaa

SEQ ID NO: 317558 - RNA, 21 nt, Human
aucuuuauuacgcagagaaga

SEQ ID NO: 317559 - RNA, 22 nt, Human
gacaguuuuuaauccuuucaug

SEQ ID NO: 317560 - RNA, 22 nt, Human
gcugugugacugagagccuggc

SEQ ID NO: 317561 - RNA, 22 nt, Human
ggccacagucucuggaaggaug

SEQ ID NO: 317562 - RNA, 17 nt, Human
aaaauucuguaaagagg

SEQ ID NO: 317563 - RNA, 22 nt, Human
uuagccauggacugaauugacu

SEQ ID NO: 317564 - RNA, 22 nt, Human
ggcuccuggggaggugagcuug

SEQ ID NO: 317565 - RNA, 22 nt, Human
uggcugcuuguuuuagugaggc

SEQ ID NO: 317566 - RNA, 22 nt, Human
agcagcugagaugguaagauuc

SEQ ID NO: 317567 - RNA, 22 nt, Human
agggcuggcaagggauugaaau

SEQ ID NO: 317568 - RNA, 22 nt, Human
cuguauuuaguuaaaaugcuaa

SEQ ID NO: 317569 - RNA, 20 nt, Human
ucucugcuguccacauuugc

SEQ ID NO: 317570 - RNA, 22 nt, Human
ucaguguuugaacccaggguua

SEQ ID NO: 317571 - RNA, 22 nt, Human
ucugagagucucugaggcagau

SEQ ID NO: 317572 - RNA, 22 nt, Human
uggccuggcucacagugagauu

SEQ ID NO: 317573 - RNA, 18 nt, Human
cagucccaaaccuuagga

SEQ ID NO: 317574 - RNA, 20 nt, Human
uugauaggcagcuugucagg

SEQ ID NO: 317575 - RNA, 22 nt, Human
uauuuagaacagacaauagaaa

SEQ ID NO: 317576 - RNA, 19 nt, Human
ucucugcuucucuuggcau

SEQ ID NO: 317577 - RNA, 22 nt, Human
accuggccauccagcuggcauc

SEQ ID NO: 317578 - RNA, 20 nt, Human
uggagcugugguaaggagca

SEQ ID NO: 317579 - RNA, 22 nt, Human
uucuuucccaguagaugugaaa

SEQ ID NO: 317580 - RNA, 22 nt, Human
aggggugaaagagggcccucaa

SEQ ID NO: 317581 - RNA, 22 nt, Human
ugcagcauugcaaagcagucuu

SEQ ID NO: 317582 - RNA, 22 nt, Human
aauguguagcauuuaaugcagu

SEQ ID NO: 317583 - RNA, 22 nt, Human
gcucccacgcaauucuuuucag

SEQ ID NO: 317584 - RNA, 22 nt, Human
auauaucaugaguaaaacuuga

SEQ ID NO: 317585 - RNA, 22 nt, Human
uauuugaaaguguacaaaaacu

SEQ ID NO: 317586 - RNA, 22 nt, Human
uaaauguggagacucaggaguc

SEQ ID NO: 317587 - RNA, 22 nt, Human
uaaagucaucuuuacaucuuug

SEQ ID NO: 317588 - RNA, 22 nt, Human
uugaaauggaagugaaaauucu

SEQ ID NO: 317589 - RNA, 22 nt, Human
ccaguguuuucauccucccuug

SEQ ID NO: 317590 - RNA, 22 nt, Human
cuuucaaugugccugccuuggg

SEQ ID NO: 317591 - RNA, 22 nt, Human
uugacaauguccuuugaauuuc

SEQ ID NO: 317592 - RNA, 22 nt, Human
gacccuguuucuacaaauaauu

SEQ ID NO: 317593 - RNA, 22 nt, Human
cuucuucaguugcauguauugg

SEQ ID NO: 317594 - RNA, 22 nt, Human
ucucccacugcaagcccaggcu

SEQ ID NO: 317595 - RNA, 22 nt, Human
aggaccagccuccaggucucuu

SEQ ID NO: 317596 - RNA, 22 nt, Human
ucacugcagagaccucuaguca

SEQ ID NO: 317597 - RNA, 22 nt, Human
gagagaagaauguuccgaggcc

SEQ ID NO: 317598 - RNA, 22 nt, Human
ugccaggggaccuagggauguc

SEQ ID NO: 317599 - RNA, 22 nt, Human
ccugauggagcccugcugcaug

SEQ ID NO: 317600 - RNA, 22 nt, Human
uaauuucaccguugcuagaaau

SEQ ID NO: 317601 - RNA, 22 nt, Human
ucagcucuguuuugaguggaac

SEQ ID NO: 317602 - RNA, 18 nt, Human
ugacagaaccuggagccu

SEQ ID NO: 317603 - RNA, 22 nt, Human
aaaggcuccuucucccaugacc

SEQ ID NO: 317604 - RNA, 22 nt, Human
gccaccccauagguguuaggug

SEQ ID NO: 317605 - RNA, 19 nt, Human
aagaagcaauaagcuguga

SEQ ID NO: 317606 - RNA, 22 nt, Human
uagaaaagaauuuuauuugaua

SEQ ID NO: 317607 - RNA, 21 nt, Human
cagcuuugucugucuucgggg

SEQ ID NO: 317608 - RNA, 22 nt, Human
gaauagcuuccuuuuuuccaaa

SEQ ID NO: 317609 - RNA, 22 nt, Human
gcucccaccuccagccugaguu

SEQ ID NO: 317610 - RNA, 16 nt, Human
ccuuucucugccuucc

SEQ ID NO: 317611 - RNA, 17 nt, Human
uuccaguuuaguauugu

SEQ ID NO: 317612 - RNA, 22 nt, Human
caucugccuaaguggcccuguu

SEQ ID NO: 317613 - RNA, 22 nt, Human
gugcuuccaucuagagggucac

SEQ ID NO: 317614 - RNA, 22 nt, Human
ugucccagcacuuugggagucu

SEQ ID NO: 317615 - RNA, 22 nt, Human
aaguguagauuauggagugucu

SEQ ID NO: 317616 - RNA, 22 nt, Human
uuucacaagacagcuacuguug

SEQ ID NO: 317617 - RNA, 21 nt, Human
uuugaaagugggugauucuuu

SEQ ID NO: 317618 - RNA, 22 nt, Human
ugagcccaggaguuggaggcug

SEQ ID NO: 317619 - RNA, 22 nt, Human
ccccugccagcuaucccugaac

SEQ ID NO: 317620 - RNA, 21 nt, Human
acagcaagccuuccuuucagg

SEQ ID NO: 317621 - RNA, 22 nt, Human
cagaguguggcaucuuccaacu

SEQ ID NO: 317622 - RNA, 22 nt, Human
uaaggccaauuacauauguuca

SEQ ID NO: 317623 - RNA, 22 nt, Human
caaaccuugcagaacugggcag

SEQ ID NO: 317624 - RNA, 22 nt, Human
uacauucaacaugucacuaugu

SEQ ID NO: 317625 - RNA, 22 nt, Human
uggccagguguggguucucaga

SEQ ID NO: 317626 - RNA, 22 nt, Human
uggcaggguuggccaccuuacc

SEQ ID NO: 317627 - RNA, 18 nt, Human
uguuccaaggaaggaauc

SEQ ID NO: 317628 - RNA, 22 nt, Human
agaaaucuuugaaguguaaugu

SEQ ID NO: 317629 - RNA, 22 nt, Human
cccugccuuguuggagccuaug

SEQ ID NO: 317630 - RNA, 22 nt, Human
ucagggcugccgggcagaccgu

SEQ ID NO: 317631 - RNA, 22 nt, Human
gaaauuuauuaucuacaucauu

SEQ ID NO: 317632 - RNA, 22 nt, Human
aagggcugcuguagaagcagag

SEQ ID NO: 317633 - RNA, 22 nt, Human
ugggaugggaucucgcuguguc

SEQ ID NO: 317634 - RNA, 22 nt, Human
ugaugggaggugcugcaggacc

SEQ ID NO: 317635 - RNA, 22 nt, Human
aaaugcacugaacacauguugu

SEQ ID NO: 317636 - RNA, 19 nt, Human
ggcugucuggcguguggau

SEQ ID NO: 317637 - RNA, 22 nt, Human
uugcuagcugguguaugcauug

SEQ ID NO: 317638 - RNA, 22 nt, Human
agguggagacccagagaaggcg

SEQ ID NO: 317639 - RNA, 22 nt, Human
agauuuagacugccuuaaucau

SEQ ID NO: 317640 - RNA, 21 nt, Human
ccugcagcaccagaaggagau

SEQ ID NO: 317641 - RNA, 22 nt, Human
uccugcaguuacaucccagcca

SEQ ID NO: 317642 - RNA, 22 nt, Human
cccugcagaccaaugccauaga

SEQ ID NO: 317643 - RNA, 22 nt, Human
aggccugagcagaggaguggac

SEQ ID NO: 317644 - RNA, 22 nt, Human
ucucuucuuguguuuuccugcc

SEQ ID NO: 317645 - RNA, 22 nt, Human
cugugauuguuaguuccuauac

SEQ ID NO: 317646 - RNA, 22 nt, Human
gaggcagcagggcugguuccuu

SEQ ID NO: 317647 - RNA, 22 nt, Human
uggcacuggaaucguagccuug

SEQ ID NO: 317648 - RNA, 22 nt, Human
ccugagcuggaagagcuugugc

SEQ ID NO: 317649 - RNA, 22 nt, Human
accuugaugccuuuccaagaug

SEQ ID NO: 317650 - RNA, 22 nt, Human
cauguaaaacacucagaacagu

SEQ ID NO: 317651 - RNA, 22 nt, Human
aagggaaaucauauggugcagu

SEQ ID NO: 317652 - RNA, 19 nt, Human
augagcuggcauuucaggu

SEQ ID NO: 317653 - RNA, 22 nt, Human
ggcagcuccucaaaaaauuaaa

SEQ ID NO: 317654 - RNA, 22 nt, Human
caguagcacuagauaugugugg

SEQ ID NO: 317655 - RNA, 22 nt, Human
auucuaggcuugaaacaugaag

SEQ ID NO: 317656 - RNA, 18 nt, Human
cugccuguugcugagagg

SEQ ID NO: 317657 - RNA, 22 nt, Human
agugucugaaccaccggggcau

SEQ ID NO: 317658 - RNA, 22 nt, Human
agcugccagggacugggcaugg

SEQ ID NO: 317659 - RNA, 22 nt, Human
cuucaagagaaugcagggaugu

SEQ ID NO: 317660 - RNA, 22 nt, Human
agccucugcacgggcacgggug

SEQ ID NO: 317661 - RNA, 22 nt, Human
acugggccuggauuggcguguc

SEQ ID NO: 317662 - RNA, 16 nt, Human
gggggugagagagagu

SEQ ID NO: 317663 - RNA, 22 nt, Human
ugaagcagcaaaugaugggaga

SEQ ID NO: 317664 - RNA, 22 nt, Human
cugaggagagaucacguggugu

SEQ ID NO: 317665 - RNA, 22 nt, Human
gagcagaacuacucacauaucg

SEQ ID NO: 317666 - RNA, 22 nt, Human
aucagcaagcauuuauugagug

SEQ ID NO: 317667 - RNA, 22 nt, Human
ugggcagaaugugggauccaga

SEQ ID NO: 317668 - RNA, 22 nt, Human
aguuauauuccauagauucaga

SEQ ID NO: 317669 - RNA, 22 nt, Human
auaauaaaccaggaugggucug

SEQ ID NO: 317670 - RNA, 22 nt, Human
gaaaugaacugauuaucauugc

SEQ ID NO: 317671 - RNA, 22 nt, Human
uaugcacauuaucuaauccauu

SEQ ID NO: 317672 - RNA, 22 nt, Human
agucccagcccaguccuguaag

SEQ ID NO: 317673 - RNA, 22 nt, Human
caucugcuguuccuuggacuca

SEQ ID NO: 317674 - RNA, 22 nt, Human
ggcauggcucggagucagaaca

SEQ ID NO: 317675 - RNA, 22 nt, Human
uaaggcacccgugagcugccag

SEQ ID NO: 317676 - RNA, 22 nt, Human
uggccugggccggcagauauac

SEQ ID NO: 317677 - RNA, 22 nt, Human
aggguagggcccggagacagac

SEQ ID NO: 317678 - RNA, 19 nt, Human
acagaaauuaguuauuuuc

SEQ ID NO: 317679 - RNA, 22 nt, Human
uuuuaacuuaaaauacauagau

SEQ ID NO: 317680 - RNA, 22 nt, Human
uugaaucuauguauucagugua

SEQ ID NO: 317681 - RNA, 22 nt, Human
ugccucagagugggcuugcuau

SEQ ID NO: 317682 - RNA, 22 nt, Human
uaaagcacauaucuuacaauaa

SEQ ID NO: 317683 - RNA, 22 nt, Human
acaggcuucucacagaaaaggg

SEQ ID NO: 317684 - RNA, 20 nt, Human
uugcagcagugaggugaagg

SEQ ID NO: 317685 - RNA, 22 nt, Human
cuggguggaucgcagccccagg

SEQ ID NO: 317686 - RNA, 21 nt, Human
uccauaagagaccaucuccua

SEQ ID NO: 317687 - RNA, 22 nt, Human
guuuuucuuugugugaagacaa

SEQ ID NO: 317688 - RNA, 22 nt, Human
gggcuucucuuuagugagcuga

SEQ ID NO: 317689 - RNA, 22 nt, Human
ccacaggaccagaggagaucac

SEQ ID NO: 317690 - RNA, 22 nt, Human
caaugguggugucagaagagau

SEQ ID NO: 317691 - RNA, 22 nt, Human
aagccucaccuuuuagaagcua

SEQ ID NO: 317692 - RNA, 22 nt, Human
guaucuuuccacaucuucagua

SEQ ID NO: 317693 - RNA, 22 nt, Human
ccaucuccacugucccugucaa

SEQ ID NO: 317694 - RNA, 22 nt, Human
gauuuuaauuauaggagguccu

SEQ ID NO: 317695 - RNA, 22 nt, Human
guuuuuccugcugacuuggguc

SEQ ID NO: 317696 - RNA, 22 nt, Human
gcagcuggcucagagagguggg

SEQ ID NO: 317697 - RNA, 22 nt, Human
ccuggcaggccccuccuggauu

SEQ ID NO: 317698 - RNA, 22 nt, Human
acccaggagcaggcugggcagu

SEQ ID NO: 317699 - RNA, 22 nt, Human
ugcaggggcuugucugggccug

SEQ ID NO: 317700 - RNA, 19 nt, Human
gcccuccucacugagcucu

SEQ ID NO: 317701 - RNA, 22 nt, Human
ucauuuguucaucugcucuucu

SEQ ID NO: 317702 - RNA, 22 nt, Human
uuaacagagugccuggcaugua

SEQ ID NO: 317703 - RNA, 22 nt, Human
agauuucaauggauauugcaag

SEQ ID NO: 317704 - RNA, 22 nt, Human
aaugugguuaacccauuuaaga

SEQ ID NO: 317705 - RNA, 22 nt, Human
cagaaggcuggcagauugagau

SEQ ID NO: 317706 - RNA, 22 nt, Human
gccaccagccccaugcgcugug

SEQ ID NO: 317707 - RNA, 22 nt, Human
agaaaucagaacccugaaguuc

SEQ ID NO: 317708 - RNA, 22 nt, Human
acuuucuaggucucaguccuuu

SEQ ID NO: 317709 - RNA, 22 nt, Human
accagagcagacuacuggaggu

SEQ ID NO: 317710 - RNA, 22 nt, Human
aggcucuguuauucuagagggc

SEQ ID NO: 317711 - RNA, 22 nt, Human
ucucucagggggaaggcugaag

SEQ ID NO: 317712 - RNA, 22 nt, Human
caaauucucaagguuuauccca

SEQ ID NO: 317713 - RNA, 22 nt, Human
aaugucugccagaacugaucau

SEQ ID NO: 317714 - RNA, 22 nt, Human
uucacagacauugcagacugaa

SEQ ID NO: 317715 - RNA, 22 nt, Human
ugcugccacugguagucucauu

SEQ ID NO: 317716 - RNA, 22 nt, Human
uauuuucuguggaggaccagau

SEQ ID NO: 317717 - RNA, 22 nt, Human
aagaggaagucuccauggagag

SEQ ID NO: 317718 - RNA, 22 nt, Human
ucagagagugcaaaauauagcu

SEQ ID NO: 317719 - RNA, 22 nt, Human
cgagaguggacagggcgcagcu

SEQ ID NO: 317720 - RNA, 22 nt, Human
uaaggcaccauaauauauuuaa

SEQ ID NO: 317721 - RNA, 22 nt, Human
ccugggcuucugucuagauguu

SEQ ID NO: 317722 - RNA, 22 nt, Human
gcagggccuuagcagcggcugc

SEQ ID NO: 317723 - RNA, 22 nt, Human
gcagagcagugcuugcccagcg

SEQ ID NO: 317724 - RNA, 22 nt, Human
acagcuggaggccccauugucc

SEQ ID NO: 317725 - RNA, 22 nt, Human
aaaccuuuaccagacuagcaag

SEQ ID NO: 317726 - RNA, 22 nt, Human
cuggagccacuuuuuauccuuu

SEQ ID NO: 317727 - RNA, 22 nt, Human
cuuaagaauauugaaguugugg

SEQ ID NO: 317728 - RNA, 22 nt, Human
ggggagugacgcagggccauag

SEQ ID NO: 317729 - RNA, 22 nt, Human
uccagggguaccggccaggcag

SEQ ID NO: 317730 - RNA, 23 nt, Human
agaugaggcuucuccauguuggu

SEQ ID NO: 317731 - RNA, 22 nt, Human
gaaaggucuuccggucuuccag

SEQ ID NO: 317732 - RNA, 22 nt, Human
ucauaauacaaagaguucugca

SEQ ID NO: 317733 - RNA, 22 nt, Human
gcucugcugucuucuugcaggc

SEQ ID NO: 317734 - RNA, 22 nt, Human
gccugccuuuuggaggcacauu

SEQ ID NO: 317735 - RNA, 22 nt, Human
gccugcagccucaagggcugag

SEQ ID NO: 317736 - RNA, 22 nt, Human
uacauauagacaguuacucuag

SEQ ID NO: 317737 - RNA, 20 nt, Human
ugggcagcacugcuggcugg

SEQ ID NO: 317738 - RNA, 22 nt, Human
cuuguucaguugccucuccugc

SEQ ID NO: 317739 - RNA, 22 nt, Human
uuugacagacauuuacuacauu

SEQ ID NO: 317740 - RNA, 18 nt, Human
ccugcagcccaggaggcc

SEQ ID NO: 317741 - RNA, 22 nt, Human
cagacuugacggcagcugcuuu

SEQ ID NO: 317742 - RNA, 22 nt, Human
augcugugauuguagaaauauu

SEQ ID NO: 317743 - RNA, 22 nt, Human
uucugucaaacucacaggccga

SEQ ID NO: 317744 - RNA, 22 nt, Human
gcagggagguuugcugaccugg

SEQ ID NO: 317745 - RNA, 22 nt, Human
ugucacagggauaccauggggc

SEQ ID NO: 317746 - RNA, 23 nt, Human
agccagggcacugguggagauug

SEQ ID NO: 317747 - RNA, 22 nt, Human
ccuggccuggcacucccucugc

SEQ ID NO: 317748 - RNA, 22 nt, Human
ucucugcucugugccucaguuu

SEQ ID NO: 317749 - RNA, 22 nt, Human
guggccuuuccugaagaaauga

SEQ ID NO: 317750 - RNA, 22 nt, Human
cccaggcuggagugcaauggca

SEQ ID NO: 317751 - RNA, 22 nt, Human
ccucugggugggaggccgggcg

SEQ ID NO: 317752 - RNA, 22 nt, Human
uacauuguuuuuucuugccauc

SEQ ID NO: 317753 - RNA, 22 nt, Human
ugugccagaaaauaugcugagg

SEQ ID NO: 317754 - RNA, 22 nt, Human
uacaaagcuguauagccugguc

SEQ ID NO: 317755 - RNA, 22 nt, Human
gugcugggauuacaggugugag

SEQ ID NO: 317756 - RNA, 22 nt, Human
gcucaggacccaggugugaccu

SEQ ID NO: 317757 - RNA, 22 nt, Human
aaugucugccugaacuuuauau

SEQ ID NO: 317758 - RNA, 22 nt, Human
uuauugccugauugaggucauu

SEQ ID NO: 317759 - RNA, 22 nt, Human
aauggagacuucaaaauggauu

SEQ ID NO: 317760 - RNA, 22 nt, Human
ucugcugcugagcacacuccua

SEQ ID NO: 317761 - RNA, 22 nt, Human
ggugcccaccugucuuccugga

SEQ ID NO: 317762 - RNA, 22 nt, Human
uuccaggauagcuuucaggaau

SEQ ID NO: 317763 - RNA, 22 nt, Human
acauuucuccuugcaggaguca

SEQ ID NO: 317764 - RNA, 22 nt, Human
cuggagccaugucuugacugcu

SEQ ID NO: 317765 - RNA, 22 nt, Human
gccuggagcucuccacuugggg

SEQ ID NO: 317766 - RNA, 23 nt, Human
gcugucugucaucucugcgggag

SEQ ID NO: 317767 - RNA, 22 nt, Human
cagcucugagacugaggcuaug

SEQ ID NO: 317768 - RNA, 22 nt, Human
cagagcagcagagcuuccaugg

SEQ ID NO: 317769 - RNA, 22 nt, Human
gaugugagugguagcugggauu

SEQ ID NO: 317770 - RNA, 20 nt, Human
agaagcugauacugauggaa

SEQ ID NO: 317771 - RNA, 22 nt, Human
gucauuguguggacauggagaa

SEQ ID NO: 317772 - RNA, 20 nt, Human
gugugaagcccucaggagga

SEQ ID NO: 317773 - RNA, 22 nt, Human
aaagauuugaguucugcuuaua

SEQ ID NO: 317774 - RNA, 22 nt, Human
uucuucaaccaucuacauaaac

SEQ ID NO: 317775 - RNA, 22 nt, Human
gcagcugguuaaugggagaauu

SEQ ID NO: 317776 - RNA, 22 nt, Human
gagugaaaaaggaagggccaua

SEQ ID NO: 317777 - RNA, 22 nt, Human
aggaaagguucagugauugaaa

SEQ ID NO: 317778 - RNA, 22 nt, Human
aaggccuggauuuagguuguga

SEQ ID NO: 317779 - RNA, 22 nt, Human
ugucugguggguugacaggcag

SEQ ID NO: 317780 - RNA, 23 nt, Human
uggcaccaggcauucuaggggua

SEQ ID NO: 317781 - RNA, 22 nt, Human
aggagacauacuauaggaauau

SEQ ID NO: 317782 - RNA, 22 nt, Human
ccugguguugugaaguagccgu

SEQ ID NO: 317783 - RNA, 22 nt, Human
uggccucuuaggacauccucua

SEQ ID NO: 317784 - RNA, 22 nt, Human
uuugcauuugcaaauaaugaaa

SEQ ID NO: 317785 - RNA, 22 nt, Human
cagugcagguuuagggcugggg

SEQ ID NO: 317786 - RNA, 22 nt, Human
aauauccacacugugucccugc

SEQ ID NO: 317787 - RNA, 22 nt, Human
gaggagggagcuggaagcucuu

SEQ ID NO: 317788 - RNA, 21 nt, Human
acagcaagccuucacaugagu

SEQ ID NO: 317789 - RNA, 22 nt, Human
auggacaggcugagcuuccuca

SEQ ID NO: 317790 - RNA, 22 nt, Human
guaaacauuacugugcuguaua

SEQ ID NO: 317791 - RNA, 22 nt, Human
gaagagaugacaaaggagcaug

SEQ ID NO: 317792 - RNA, 22 nt, Human
uuucauugcagagucugugugc

SEQ ID NO: 317793 - RNA, 22 nt, Human
ugggaggaaugucacugagcca

SEQ ID NO: 317794 - RNA, 22 nt, Human
uccucagugcuagccaacugcc

SEQ ID NO: 317795 - RNA, 22 nt, Human
cuguccuguggaccugaggacg

SEQ ID NO: 317796 - RNA, 17 nt, Human
uccagagcacagagcuc

SEQ ID NO: 317797 - RNA, 20 nt, Human
gaggcugcggacugcuggac

SEQ ID NO: 317798 - RNA, 22 nt, Human
uuucacauuagauaugucauuu

SEQ ID NO: 317799 - RNA, 20 nt, Human
gcaaaauaggcucuguuggu

SEQ ID NO: 317800 - RNA, 23 nt, Human
agccucuuuucuccugcccugca

SEQ ID NO: 317801 - RNA, 22 nt, Human
uugagucaguaauuccauuucu

SEQ ID NO: 317802 - RNA, 22 nt, Human
ugaugauguuuaucuugguauu

SEQ ID NO: 317803 - RNA, 20 nt, Human
agaguaacuggcacauaggg

SEQ ID NO: 317804 - RNA, 22 nt, Human
ugaguuauaaugaauauuugaa

SEQ ID NO: 317805 - RNA, 22 nt, Human
aagaaaacaugaucuaauuuaa

SEQ ID NO: 317806 - RNA, 22 nt, Human
cugagauggaguuuugcucuug

SEQ ID NO: 317807 - RNA, 22 nt, Human
agugcuguuagguuaauauagu

SEQ ID NO: 317808 - RNA, 22 nt, Human
ucgaacucauagucguagcugu

SEQ ID NO: 317809 - RNA, 22 nt, Human
augcugugccuggaaagcggcu

SEQ ID NO: 317810 - RNA, 22 nt, Human
ccugagcugaacuaagcaguuu

SEQ ID NO: 317811 - RNA, 21 nt, Human
aaggccugcuuacugcuaguu

SEQ ID NO: 317812 - RNA, 22 nt, Human
cuugaaagaagggucuuuuaau

SEQ ID NO: 317813 - RNA, 22 nt, Human
gaaucucaaauuaagaauuuua

SEQ ID NO: 317814 - RNA, 23 nt, Human
gggugggccaaauuagguagccu

SEQ ID NO: 317815 - RNA, 22 nt, Human
uucucuuuugugaugugagaug

SEQ ID NO: 317816 - RNA, 22 nt, Human
uuucaaagguggaagagugaau

SEQ ID NO: 317817 - RNA, 22 nt, Human
augcacagcagugaguucagug

SEQ ID NO: 317818 - RNA, 22 nt, Human
ugggcagagucauacaggagac

SEQ ID NO: 317819 - RNA, 22 nt, Human
uuguuuuaucuuucuacagacu

SEQ ID NO: 317820 - RNA, 20 nt, Human
agugacagagacuguguggc

SEQ ID NO: 317821 - RNA, 22 nt, Human
ccucuguccuggggaguggagc

SEQ ID NO: 317822 - RNA, 22 nt, Human
ugugccuucucaguccugcuca

SEQ ID NO: 317823 - RNA, 22 nt, Human
ggaucauuaacacauccaucac

SEQ ID NO: 317824 - RNA, 22 nt, Human
gugaggugggcuggccagagac

SEQ ID NO: 317825 - RNA, 22 nt, Human
ugagaaucauccagaggcuucu

SEQ ID NO: 317826 - RNA, 22 nt, Human
uggcagaggaaaaagucacugg

SEQ ID NO: 317827 - RNA, 22 nt, Human
gcuguccugggaacaggcacua

SEQ ID NO: 317828 - RNA, 22 nt, Human
cuggcagggugggcuuugcuuu

SEQ ID NO: 317829 - RNA, 22 nt, Human
agggcucugggguggcagagau

SEQ ID NO: 317830 - RNA, 22 nt, Human
gacauucacaguuuccgauggu

SEQ ID NO: 317831 - RNA, 22 nt, Human
gccccuggcuggccagcuccuc

SEQ ID NO: 317832 - RNA, 22 nt, Human
acagauauaugauuguguaaau

SEQ ID NO: 317833 - RNA, 22 nt, Human
cuugcugucuugcauuuagagc

SEQ ID NO: 317834 - RNA, 22 nt, Human
agggcagagauuaauuaagaca

SEQ ID NO: 317835 - RNA, 22 nt, Human
uaguccagccuuggguguagcc

SEQ ID NO: 317836 - RNA, 22 nt, Human
ggccugggcccacugucaagag

SEQ ID NO: 317837 - RNA, 22 nt, Human
ccuggggagagaaagcccagcc

SEQ ID NO: 317838 - RNA, 22 nt, Human
uggcucaggaucuaagcagaau

SEQ ID NO: 317839 - RNA, 22 nt, Human
cugcaggcaucuaacugugggc

SEQ ID NO: 317840 - RNA, 22 nt, Human
uuucauugaugggugauagaaa

SEQ ID NO: 317841 - RNA, 22 nt, Human
uucaagaucuuccaaaggauac

SEQ ID NO: 317842 - RNA, 22 nt, Human
uccagugguaguaaagaggucu

SEQ ID NO: 317843 - RNA, 22 nt, Human
uuuucaugucauguccuugagg

SEQ ID NO: 317844 - RNA, 22 nt, Human
uccagucaggcugaauucaagg

SEQ ID NO: 317845 - RNA, 22 nt, Human
cacagaggcaaccuucuggggu

SEQ ID NO: 317846 - RNA, 22 nt, Human
gcugccugggcaggaggcgcug

SEQ ID NO: 317847 - RNA, 22 nt, Human
ucaguagcagaaagcaaugagu

SEQ ID NO: 317848 - RNA, 21 nt, Human
uuaagagcuuagcaguaggcc

SEQ ID NO: 317849 - RNA, 22 nt, Human
auuuugauaaucauguuagaga

SEQ ID NO: 317850 - RNA, 22 nt, Human
guuugauucaagaacaaagagu

SEQ ID NO: 317851 - RNA, 22 nt, Human
gcagacagacugcagugauuuu

SEQ ID NO: 317852 - RNA, 22 nt, Human
gaauacaugauacaugaacugc

SEQ ID NO: 317853 - RNA, 22 nt, Human
uucacagaugccugaugugugg

SEQ ID NO: 317854 - RNA, 22 nt, Human
ugcuggggcucugaccacucca

SEQ ID NO: 317855 - RNA, 22 nt, Human
aggcagccagauggcagccugc

SEQ ID NO: 317856 - RNA, 22 nt, Human
ggccucucuccagucagugcag

SEQ ID NO: 317857 - RNA, 22 nt, Human
caguaugucuacuggacaaagu

SEQ ID NO: 317858 - RNA, 22 nt, Human
aguccugggucuggagaaugga

SEQ ID NO: 317859 - RNA, 22 nt, Human
uaacuuucacaucacacugacu

SEQ ID NO: 317860 - RNA, 22 nt, Human
uuaauuaaauucaugagcauug

SEQ ID NO: 317861 - RNA, 21 nt, Human
cauuucuauugaugagaaaag

SEQ ID NO: 317862 - RNA, 19 nt, Human
gccugcagaaaaggcaggg

SEQ ID NO: 317863 - RNA, 22 nt, Human
ccugggugaaaucucuccugca

SEQ ID NO: 317864 - RNA, 22 nt, Human
ccagcagagcauggggaggaag

SEQ ID NO: 317865 - RNA, 22 nt, Human
acauuucugcuagaauagguga

SEQ ID NO: 317866 - RNA, 22 nt, Human
gcugaagggagugcugagucug

SEQ ID NO: 317867 - RNA, 22 nt, Human
auuuagaaauuccaaaaguauu

SEQ ID NO: 317868 - RNA, 22 nt, Human
uggagcucaaaggccuguggga

SEQ ID NO: 317869 - RNA, 22 nt, Human
ccuccucugggaagauucagag

SEQ ID NO: 317870 - RNA, 22 nt, Human
agccuucaguaaauccacugug

SEQ ID NO: 317871 - RNA, 22 nt, Human
uggaggaugccuggggaggccu

SEQ ID NO: 317872 - RNA, 22 nt, Human
ucaggagagaaagaauacaauu

SEQ ID NO: 317873 - RNA, 22 nt, Human
guggugaguucaggcuggggug

SEQ ID NO: 317874 - RNA, 22 nt, Human
auacaucuaugccuuucugaca

SEQ ID NO: 317875 - RNA, 22 nt, Human
ucucauguauugcccuggugug

SEQ ID NO: 317876 - RNA, 22 nt, Human
cagaggugcauacaggucauua

SEQ ID NO: 317877 - RNA, 22 nt, Human
agcagggcagugcuucagcucu

SEQ ID NO: 317878 - RNA, 18 nt, Human
gggcauggaugcagcauc

SEQ ID NO: 317879 - RNA, 22 nt, Human
ucauugcaggcauuccccugcc

SEQ ID NO: 317880 - RNA, 22 nt, Human
caggaguggugugagggacucc

SEQ ID NO: 317881 - RNA, 22 nt, Human
uagcagaaccagcagucaauuu

SEQ ID NO: 317882 - RNA, 22 nt, Human
uauucacagcugccgcacucag

SEQ ID NO: 317883 - RNA, 22 nt, Human
cacugcauggaugauggcugua

SEQ ID NO: 317884 - RNA, 22 nt, Human
cagcugcaggaacaaaaaugug

SEQ ID NO: 317885 - RNA, 22 nt, Human
acaguguuuggcaaugcaugca

SEQ ID NO: 317886 - RNA, 22 nt, Human
ggcucaggagaggggcuaaaag

SEQ ID NO: 317887 - RNA, 22 nt, Human
agaguguuuuucugucaaggac

SEQ ID NO: 317888 - RNA, 22 nt, Human
ggagugacucucggggccacua

SEQ ID NO: 317889 - RNA, 22 nt, Human
cagaggcucuuccucacugccc

SEQ ID NO: 317890 - RNA, 22 nt, Human
gcagcugaauguccauugcugc

SEQ ID NO: 317891 - RNA, 18 nt, Human
ggagagugacagagucgu

SEQ ID NO: 317892 - RNA, 22 nt, Human
gaaaucugaaucuucuguuggu

SEQ ID NO: 317893 - RNA, 22 nt, Human
auaaguaggaaaauuugaauau

SEQ ID NO: 317894 - RNA, 22 nt, Human
uugagucucugccaaaacacaa

SEQ ID NO: 317895 - RNA, 22 nt, Human
uucuucuuuaucucaguauccu

SEQ ID NO: 317896 - RNA, 21 nt, Human
augucaaaugcuuuauuuuau

SEQ ID NO: 317897 - RNA, 22 nt, Human
gcccagaaguugaggcugcagu

SEQ ID NO: 317898 - RNA, 22 nt, Human
caugaaaucugaguauguuucc

SEQ ID NO: 317899 - RNA, 22 nt, Human
agccacagagguugaugugguu

SEQ ID NO: 317900 - RNA, 22 nt, Human
uggccugguuguugcugccguu

SEQ ID NO: 317901 - RNA, 22 nt, Human
caggaaaaaugccaggagucag

SEQ ID NO: 317902 - RNA, 22 nt, Human
uuacaggggacauuggggacau

SEQ ID NO: 317903 - RNA, 22 nt, Human
gcaguguuaccucuucaguggg

SEQ ID NO: 317904 - RNA, 22 nt, Human
auucuuauuauaguaaaacagu

SEQ ID NO: 317905 - RNA, 22 nt, Human
gcugcagcagcugcaggguugu

SEQ ID NO: 317906 - RNA, 22 nt, Human
aggagcugcuuaaaugguuggu

SEQ ID NO: 317907 - RNA, 22 nt, Human
ucuggcucagggcucugaggga

SEQ ID NO: 317908 - RNA, 22 nt, Human
uucuguauauuguaaagacuca

SEQ ID NO: 317909 - RNA, 22 nt, Human
ugcugcuccugccuggcuccca

SEQ ID NO: 317910 - RNA, 22 nt, Human
guggcugcagagggcacagcau

SEQ ID NO: 317911 - RNA, 22 nt, Human
ugguauucuuucuguagaucau

SEQ ID NO: 317912 - RNA, 22 nt, Human
aggcuggaguacaguggcuauu

SEQ ID NO: 317913 - RNA, 19 nt, Human
cacagggcaggucucaugu

SEQ ID NO: 317914 - RNA, 22 nt, Human
auaugcacauacauacauaggu

SEQ ID NO: 317915 - RNA, 22 nt, Human
acccagaggugucuagcaagcu

SEQ ID NO: 317916 - RNA, 22 nt, Human
guggcagcugguaugcagacag

SEQ ID NO: 317917 - RNA, 22 nt, Human
ucucagagcuucaguuauuuuc

SEQ ID NO: 317918 - RNA, 22 nt, Human
gcugcagcccggcgcgccugag

SEQ ID NO: 317919 - RNA, 22 nt, Human
ugaaccaggaggcagccagcac

SEQ ID NO: 317920 - RNA, 22 nt, Human
aagauaaacucuugauuucuga

SEQ ID NO: 317921 - RNA, 22 nt, Human
gugccugcagcaauccauggca

SEQ ID NO: 317922 - RNA, 21 nt, Human
agaaaauggcguuuuagauuu

SEQ ID NO: 317923 - RNA, 22 nt, Human
ugcagcauucuuggccacuacu

SEQ ID NO: 317924 - RNA, 22 nt, Human
gcucugugggugaguagaaucu

SEQ ID NO: 317925 - RNA, 22 nt, Human
cuguggaaaauuuguauguaau

SEQ ID NO: 317926 - RNA, 22 nt, Human
ccuggcaguuuugcccaggauu

SEQ ID NO: 317927 - RNA, 22 nt, Human
ccacagaguuacaaaacaguca

SEQ ID NO: 317928 - RNA, 17 nt, Human
ucucagugacugauagc

SEQ ID NO: 317929 - RNA, 18 nt, Human
gagucuuuguuacugcug

SEQ ID NO: 317930 - RNA, 22 nt, Human
cacauuuaaagguugaagcuga

SEQ ID NO: 317931 - RNA, 22 nt, Human
gguggguauugaauacaggugu

SEQ ID NO: 317932 - RNA, 22 nt, Human
gcaggcagaucaccugucagga

SEQ ID NO: 317933 - RNA, 19 nt, Human
uucacauuggaagaaguag

SEQ ID NO: 317934 - RNA, 21 nt, Human
uccucugcagugagguggccu

SEQ ID NO: 317935 - RNA, 22 nt, Human
aagcugcagacccccugucuca

SEQ ID NO: 317936 - RNA, 22 nt, Human
cugccuggaaugccagcuucuc

SEQ ID NO: 317937 - RNA, 22 nt, Human
ggucccaguugcccaggucagg

SEQ ID NO: 317938 - RNA, 22 nt, Human
uaaaugcaguuaguacuugcca

SEQ ID NO: 317939 - RNA, 22 nt, Human
aucacaggugguaggaaaagaa

SEQ ID NO: 317940 - RNA, 22 nt, Human
ggugaguugggguucacagguc

SEQ ID NO: 317941 - RNA, 23 nt, Human
uucuuucaagaaguucacagugc

SEQ ID NO: 317942 - RNA, 23 nt, Human
aauuuaguuugagacauuagccu

SEQ ID NO: 317943 - RNA, 22 nt, Human
uggcuggcaguaggcuaguggc

SEQ ID NO: 317944 - RNA, 22 nt, Human
uccugcagagccgcccucaggu

SEQ ID NO: 317945 - RNA, 20 nt, Human
uguuccaugacuauuuggau

SEQ ID NO: 317946 - RNA, 22 nt, Human
ccuggcugggccugauuucuca

SEQ ID NO: 317947 - RNA, 22 nt, Human
ugucccaguuuaucugggacug

SEQ ID NO: 317948 - RNA, 22 nt, Human
ccugagggaggguauaggcugu

SEQ ID NO: 317949 - RNA, 22 nt, Human
acagaauucucucugcagaggc

SEQ ID NO: 317950 - RNA, 22 nt, Human
ugaaaguuacaggaaaacagau

SEQ ID NO: 317951 - RNA, 22 nt, Human
cagggcaggaauuugacauugc

SEQ ID NO: 317952 - RNA, 22 nt, Human
aggaccagaggccagagucagc

SEQ ID NO: 317953 - RNA, 22 nt, Human
gggcuggaggugagcaggacag

SEQ ID NO: 317954 - RNA, 22 nt, Human
ccagggugagugucauggguua

SEQ ID NO: 317955 - RNA, 22 nt, Human
ugggaauggaugcuaagugcua

SEQ ID NO: 317956 - RNA, 21 nt, Human
ucagcagcuuuugcagucccu

SEQ ID NO: 317957 - RNA, 22 nt, Human
auguuauuuuggaaaauacaaa

SEQ ID NO: 317958 - RNA, 22 nt, Human
uacaguauuaugagugauugaa

SEQ ID NO: 317959 - RNA, 22 nt, Human
uuugaaaguguuuacuugggaa

SEQ ID NO: 317960 - RNA, 23 nt, Human
gggcugcuccaggccaaggcugg

SEQ ID NO: 317961 - RNA, 17 nt, Human
uagcuguguuucagcua

SEQ ID NO: 317962 - RNA, 22 nt, Human
ccugcagggaaucgaggcagaa

SEQ ID NO: 317963 - RNA, 22 nt, Human
cccuguccuggaugggagcacu

SEQ ID NO: 317964 - RNA, 22 nt, Human
aauuucaaacuaauaggaacca

SEQ ID NO: 317965 - RNA, 22 nt, Human
gugccugccccacuccucagca

SEQ ID NO: 317966 - RNA, 22 nt, Human
gaggggaaagugugaggcugcg

SEQ ID NO: 317967 - RNA, 22 nt, Human
ccucucucuccugcacacacac

SEQ ID NO: 317968 - RNA, 22 nt, Human
ccugucaguugcugucagggau

SEQ ID NO: 317969 - RNA, 22 nt, Human
agugucauaugccacugcaucc

SEQ ID NO: 317970 - RNA, 22 nt, Human
gggagagaugcugauugccaau

SEQ ID NO: 317971 - RNA, 22 nt, Human
aggugcugccccgagaaggaug

SEQ ID NO: 317972 - RNA, 22 nt, Human
cuggggcugcagcgaucuucau

SEQ ID NO: 317973 - RNA, 22 nt, Human
ucccagccuuucuuuucugcug

SEQ ID NO: 317974 - RNA, 19 nt, Human
ugcagccacgugagagacu

SEQ ID NO: 317975 - RNA, 22 nt, Human
gccucucucuacccaguaugau

SEQ ID NO: 317976 - RNA, 22 nt, Human
uugaaguuguaguucagugaag

SEQ ID NO: 317977 - RNA, 22 nt, Human
agagcaggcauaaagcuuugaa

SEQ ID NO: 317978 - RNA, 22 nt, Human
ugcaagaggaauucuagaagca

SEQ ID NO: 317979 - RNA, 22 nt, Human
auuuuuccaugauacuuaucug

SEQ ID NO: 317980 - RNA, 22 nt, Human
uuuacagagaauguacauaaag

SEQ ID NO: 317981 - RNA, 22 nt, Human
ugugaaggagaugaagggagug

SEQ ID NO: 317982 - RNA, 22 nt, Human
ucauacaucuguccuggagcuc

SEQ ID NO: 317983 - RNA, 22 nt, Human
cagagcugguguuacaagucca

SEQ ID NO: 317984 - RNA, 22 nt, Human
ggcagcugauuagcaucaagga

SEQ ID NO: 317985 - RNA, 22 nt, Human
ucucuccuuaucauuguguuua

SEQ ID NO: 317986 - RNA, 22 nt, Human
acaauguaggauauguacuugu

SEQ ID NO: 317987 - RNA, 22 nt, Human
caagauggagaagcagcaaggg

SEQ ID NO: 317988 - RNA, 22 nt, Human
cagagcugacccaaggauugaa

SEQ ID NO: 317989 - RNA, 20 nt, Human
ggaccagguggggcgguggc

SEQ ID NO: 317990 - RNA, 22 nt, Human
cccaggccccagggcuugucag

SEQ ID NO: 317991 - RNA, 22 nt, Human
ccucaugguacuuacuguagcu

SEQ ID NO: 317992 - RNA, 22 nt, Human
agcuuccugaugcaagagggcu

SEQ ID NO: 317993 - RNA, 22 nt, Human
uaacacauauuugcaguaagca

SEQ ID NO: 317994 - RNA, 22 nt, Human
acaguguuguggcucuuaauag

SEQ ID NO: 317995 - RNA, 22 nt, Human
aggugcagcugguggagucugg

SEQ ID NO: 317996 - RNA, 22 nt, Human
uuagaaagaacuuuagauauca

SEQ ID NO: 317997 - RNA, 23 nt, Human
agacccagagacuggcucugcuc

SEQ ID NO: 317998 - RNA, 22 nt, Human
caggugggagcggagacugauu

SEQ ID NO: 317999 - RNA, 22 nt, Human
ggccacagagggcgggaugcug

SEQ ID NO: 318000 - RNA, 22 nt, Human
gagacugauggggcucccagaa

SEQ ID NO: 318001 - RNA, 22 nt, Human
cacauccuucagcugagcccag

SEQ ID NO: 318002 - RNA, 22 nt, Human
acagaauugaaaguauaaucug

SEQ ID NO: 318003 - RNA, 22 nt, Human
ugcagaguaaaagcagaugcua

SEQ ID NO: 318004 - RNA, 22 nt, Human
gggcuucuagaccagcagugag

SEQ ID NO: 318005 - RNA, 22 nt, Human
uggccugaggcucggcaugggu

SEQ ID NO: 318006 - RNA, 22 nt, Human
gggccugugcacaguucuguua

SEQ ID NO: 318007 - RNA, 22 nt, Human
guggccaggacauugccaggca

SEQ ID NO: 318008 - RNA, 22 nt, Human
gcuuccuagcauuagccauugc

SEQ ID NO: 318009 - RNA, 22 nt, Human
ucaacacuauccaggcaaucuu

SEQ ID NO: 318010 - RNA, 22 nt, Human
cauuucuguacauguuuuggug

SEQ ID NO: 318011 - RNA, 22 nt, Human
cuggcagcuuccuuugcaucug

SEQ ID NO: 318012 - RNA, 22 nt, Human
ucugcagauuuaucagcagcug

SEQ ID NO: 318013 - RNA, 22 nt, Human
ucagaggauugccucagcgagc

SEQ ID NO: 318014 - RNA, 22 nt, Human
aaaagguagauucuccuucuau

SEQ ID NO: 318015 - RNA, 22 nt, Human
ucagugcuccuaaagugaaugc

SEQ ID NO: 318016 - RNA, 22 nt, Human
ucacacagguuugcaaugauuu

SEQ ID NO: 318017 - RNA, 22 nt, Human
ucagagcuuuggagaccaggaa

SEQ ID NO: 318018 - RNA, 22 nt, Human
gcuggccucuggagaagggcuu

SEQ ID NO: 318019 - RNA, 22 nt, Human
ucuggccuacuggaguccauga

SEQ ID NO: 318020 - RNA, 22 nt, Human
uacauucagaagaauggacacg

SEQ ID NO: 318021 - RNA, 22 nt, Human
ucuggcuccguguccgcuccca

SEQ ID NO: 318022 - RNA, 22 nt, Human
cuauaauuaugcucaaaaugua

SEQ ID NO: 318023 - RNA, 22 nt, Human
aagagcuggaagugaagauaac

SEQ ID NO: 318024 - RNA, 22 nt, Human
gggagagagaaaacguggcgca

SEQ ID NO: 318025 - RNA, 22 nt, Human
uauguuuuucaagugcacacua

SEQ ID NO: 318026 - RNA, 22 nt, Human
uggggacacagagccaaacuau

SEQ ID NO: 318027 - RNA, 22 nt, Human
ugaucaaaacauuacuccacca

SEQ ID NO: 318028 - RNA, 22 nt, Human
aguuagaaaguaaaucauuuga

SEQ ID NO: 318029 - RNA, 22 nt, Human
cagugcugggcagaggagagcg

SEQ ID NO: 318030 - RNA, 21 nt, Human
uggagacucugguucuuugug

SEQ ID NO: 318031 - RNA, 21 nt, Human
gcugccaccgcgugcuccagg

SEQ ID NO: 318032 - RNA, 22 nt, Human
gagccuggccuccugccucagc

SEQ ID NO: 318033 - RNA, 22 nt, Human
uggggugguaauacaccguucu

SEQ ID NO: 318034 - RNA, 22 nt, Human
augaggcaaucaugguccaguu

SEQ ID NO: 318035 - RNA, 22 nt, Human
uuauuucauguaaaauuuaugu

SEQ ID NO: 318036 - RNA, 22 nt, Human
auucagagcacuggguagaauu

SEQ ID NO: 318037 - RNA, 22 nt, Human
aaggcaggaugggaaaagauuu

SEQ ID NO: 318038 - RNA, 22 nt, Human
acaguguuacuugauaguguau

SEQ ID NO: 318039 - RNA, 22 nt, Human
agucucagaguaccugagggac

SEQ ID NO: 318040 - RNA, 22 nt, Human
ugugugcauucacaugcaugcc

SEQ ID NO: 318041 - RNA, 22 nt, Human
aucagaagcuuguagucucucu

SEQ ID NO: 318042 - RNA, 22 nt, Human
uguauuuuuaggaaugcgcuau

SEQ ID NO: 318043 - RNA, 22 nt, Human
gagaaugggaaugaaaguagca

SEQ ID NO: 318044 - RNA, 22 nt, Human
aggaggcacucacucucagggu

SEQ ID NO: 318045 - RNA, 21 nt, Human
aacauuucugggagaacucac

SEQ ID NO: 318046 - RNA, 20 nt, Human
uccagcccagcagccugaca

SEQ ID NO: 318047 - RNA, 22 nt, Human
ucugcugugauuugcuaccugu

SEQ ID NO: 318048 - RNA, 22 nt, Human
agagagcauugaggaaaucuuc

SEQ ID NO: 318049 - RNA, 22 nt, Human
auugacaaggaaacuauaccag

SEQ ID NO: 318050 - RNA, 22 nt, Human
agagaacaaauuaaaggugguu

SEQ ID NO: 318051 - RNA, 22 nt, Human
ccugagccugaguggugcaggg

SEQ ID NO: 318052 - RNA, 18 nt, Human
cuuguucuucucuuggcg

SEQ ID NO: 318053 - RNA, 22 nt, Human
uuacuuuguucucaagauaugu

SEQ ID NO: 318054 - RNA, 22 nt, Human
cugcaggaauucaaagugagcu

SEQ ID NO: 318055 - RNA, 21 nt, Human
agcagcugggcaacauggagg

SEQ ID NO: 318056 - RNA, 19 nt, Human
ugucucagugucccuuccu

SEQ ID NO: 318057 - RNA, 19 nt, Human
aggguccagggagcggcuc

SEQ ID NO: 318058 - RNA, 22 nt, Human
ucuggcucuauaacuccuagcu

SEQ ID NO: 318059 - RNA, 22 nt, Human
auggaaagggaagcaaggaaca

SEQ ID NO: 318060 - RNA, 22 nt, Human
aaguucaagucugcaucuuuuu

SEQ ID NO: 318061 - RNA, 22 nt, Human
gccugcuggauguggccaggcc

SEQ ID NO: 318062 - RNA, 22 nt, Human
aauagcucacugauuucucuuu

SEQ ID NO: 318063 - RNA, 22 nt, Human
uggcucugaucagauguccagu

SEQ ID NO: 318064 - RNA, 22 nt, Human
agccaggaauuggacaacacau

SEQ ID NO: 318065 - RNA, 22 nt, Human
aucuagauuagguauaagagcu

SEQ ID NO: 318066 - RNA, 22 nt, Human
aguuucauauuaccaugucacc

SEQ ID NO: 318067 - RNA, 22 nt, Human
agggagcuuccgaacuacagcu

SEQ ID NO: 318068 - RNA, 21 nt, Human
cagagcagcguucugcugugg

SEQ ID NO: 318069 - RNA, 22 nt, Human
cuggaagaggaagccagcugga

SEQ ID NO: 318070 - RNA, 22 nt, Human
cucuggcuuugcucaugcaucc

SEQ ID NO: 318071 - RNA, 22 nt, Human
ugccuggcaaugccagaagcca

SEQ ID NO: 318072 - RNA, 22 nt, Human
uucagaaguagcuaagcaguca

SEQ ID NO: 318073 - RNA, 22 nt, Human
uagaaaggcaagcgugaaauau

SEQ ID NO: 318074 - RNA, 22 nt, Human
agcagccauuuaaaaugaauug

SEQ ID NO: 318075 - RNA, 22 nt, Human
ucagggcaaugucccucagaag

SEQ ID NO: 318076 - RNA, 22 nt, Human
ucugagagccucuagccuaagu

SEQ ID NO: 318077 - RNA, 22 nt, Human
ucuucaaguuccaaagugcagg

SEQ ID NO: 318078 - RNA, 20 nt, Human
gcacugaagguuccagggga

SEQ ID NO: 318079 - RNA, 22 nt, Human
cuguauuucccacauucucuau

SEQ ID NO: 318080 - RNA, 17 nt, Human
agcugagcuggccaggg

SEQ ID NO: 318081 - RNA, 22 nt, Human
cagaccucaguccucaguagga

SEQ ID NO: 318082 - RNA, 22 nt, Human
gggcugcuguagagaacauguu

SEQ ID NO: 318083 - RNA, 22 nt, Human
aauguaugagcgugaaagcacu

SEQ ID NO: 318084 - RNA, 22 nt, Human
gcugcugugaauuuuuuaaaug

SEQ ID NO: 318085 - RNA, 22 nt, Human
ugauuuccaaaaggcuucuaag

SEQ ID NO: 318086 - RNA, 22 nt, Human
uuggaggcaaugggaaggaggc

SEQ ID NO: 318087 - RNA, 22 nt, Human
gcucuucucagauuguacacuc

SEQ ID NO: 318088 - RNA, 22 nt, Human
uauggaaagcucuuuuugauug

SEQ ID NO: 318089 - RNA, 22 nt, Human
gaaggagaggauugugaggcug

SEQ ID NO: 318090 - RNA, 22 nt, Human
ucuaaaaaagucuguucacuug

SEQ ID NO: 318091 - RNA, 22 nt, Human
uuguuucaugaguguaaaggga

SEQ ID NO: 318092 - RNA, 22 nt, Human
aaagaugucacaagaugugaug

SEQ ID NO: 318093 - RNA, 20 nt, Human
acaaaugcauucugugacau

SEQ ID NO: 318094 - RNA, 22 nt, Human
agcaaggggcagugaaagugug

SEQ ID NO: 318095 - RNA, 22 nt, Human
ucuggcuccugaguccaugcuc

SEQ ID NO: 318096 - RNA, 22 nt, Human
ccugccugguguaagucuaagg

SEQ ID NO: 318097 - RNA, 20 nt, Human
aggcacuguugucuguaucc

SEQ ID NO: 318098 - RNA, 22 nt, Human
agucuccuuggccucaaugccu

SEQ ID NO: 318099 - RNA, 22 nt, Human
gccuggugugcgccgcgcagcu

SEQ ID NO: 318100 - RNA, 22 nt, Human
ggagauuuauagcacacuucag

SEQ ID NO: 318101 - RNA, 22 nt, Human
uucaauucugcucugaucuuag

SEQ ID NO: 318102 - RNA, 22 nt, Human
uuugaaauaugaggcauuauga

SEQ ID NO: 318103 - RNA, 22 nt, Human
cugcugcauuccucuuuaugag

SEQ ID NO: 318104 - RNA, 22 nt, Human
ggucagccuuggauuugguagc

SEQ ID NO: 318105 - RNA, 22 nt, Human
gugucauuaaccaccaugcaaa

SEQ ID NO: 318106 - RNA, 19 nt, Human
cuucuucuuggcagccaag

SEQ ID NO: 318107 - RNA, 22 nt, Human
gcugagagcaguguggccuuaa

SEQ ID NO: 318108 - RNA, 22 nt, Human
ucccagacaaucauuggccacc

SEQ ID NO: 318109 - RNA, 22 nt, Human
guguaaggccccagguucuuua

SEQ ID NO: 318110 - RNA, 22 nt, Human
ucugcugugggucuauauuuua

SEQ ID NO: 318111 - RNA, 22 nt, Human
gagcuguccuaccaggaguccu

SEQ ID NO: 318112 - RNA, 22 nt, Human
gacagggccgcagauggagacu

SEQ ID NO: 318113 - RNA, 22 nt, Human
ggugcagaaggaagggagcugg

SEQ ID NO: 318114 - RNA, 22 nt, Human
aaaugcacagaaaggaugugga

SEQ ID NO: 318115 - RNA, 22 nt, Human
accaucagucauugucaguggg

SEQ ID NO: 318116 - RNA, 20 nt, Human
ugcagcuucaccugugucau

SEQ ID NO: 318117 - RNA, 22 nt, Human
uaaggcacccauguucauacag

SEQ ID NO: 318118 - RNA, 22 nt, Human
uccuauugguagacauuucugu

SEQ ID NO: 318119 - RNA, 19 nt, Human
ugaagcagcaaacucucag

SEQ ID NO: 318120 - RNA, 22 nt, Human
ucaaagucauggcuaguaauga

SEQ ID NO: 318121 - RNA, 22 nt, Human
ggugaagggccuuaggagacag

SEQ ID NO: 318122 - RNA, 22 nt, Human
uagcacauuguugaccagaagg

SEQ ID NO: 318123 - RNA, 22 nt, Human
gcuggccauggccugcgccauc

SEQ ID NO: 318124 - RNA, 22 nt, Human
gggcauggaggucugucugcag

SEQ ID NO: 318125 - RNA, 22 nt, Human
gcucugagucucagcuaccaca

SEQ ID NO: 318126 - RNA, 22 nt, Human
gggcaguggcucacgccuguaa

SEQ ID NO: 318127 - RNA, 22 nt, Human
uaaugcaguacugauauaaaca

SEQ ID NO: 318128 - RNA, 22 nt, Human
gguccccagcaguggcugcuuc

SEQ ID NO: 318129 - RNA, 22 nt, Human
accauccugaaaccuucaugcu

SEQ ID NO: 318130 - RNA, 22 nt, Human
gucaccagugcuaagaggugga

SEQ ID NO: 318131 - RNA, 22 nt, Human
uccuucaggguugaggccgacu

SEQ ID NO: 318132 - RNA, 22 nt, Human
gagcuccucccaggguagcacu

SEQ ID NO: 318133 - RNA, 22 nt, Human
gcagggacaccuuugugaagcu

SEQ ID NO: 318134 - RNA, 22 nt, Human
agcuccuggacgaacagggagu

SEQ ID NO: 318135 - RNA, 22 nt, Human
gucugaggaagaugcaggggga

SEQ ID NO: 318136 - RNA, 22 nt, Human
ggcaguggguuccccaaggcac

SEQ ID NO: 318137 - RNA, 22 nt, Human
ggugggcagcucuuggcaggca

SEQ ID NO: 318138 - RNA, 23 nt, Human
gacagagugagaccuugucuuac

SEQ ID NO: 318139 - RNA, 22 nt, Human
cugcuucugggaugauggagua

SEQ ID NO: 318140 - RNA, 22 nt, Human
agagacaggguuuugucguguu

SEQ ID NO: 318141 - RNA, 22 nt, Human
ucaggaaagaagaugcucagug

SEQ ID NO: 318142 - RNA, 22 nt, Human
gccuggcccagggcucuuguug

SEQ ID NO: 318143 - RNA, 22 nt, Human
ugcaggugaaaauuaugaggau

SEQ ID NO: 318144 - RNA, 22 nt, Human
ucagggcagccuaaggcaccuc

SEQ ID NO: 318145 - RNA, 22 nt, Human
aggcugcucugcgaagucagcu

SEQ ID NO: 318146 - RNA, 22 nt, Human
ucucccaggugggugccuggag

SEQ ID NO: 318147 - RNA, 22 nt, Human
uccagccaagccuugguagcug

SEQ ID NO: 318148 - RNA, 22 nt, Human
uaacagaaguuguucauugugg

SEQ ID NO: 318149 - RNA, 18 nt, Human
agagcagcggcaucacac

SEQ ID NO: 318150 - RNA, 22 nt, Human
caguccuggggaccaggcugag

SEQ ID NO: 318151 - RNA, 22 nt, Human
guaucuuuugguggaaaaauaa

SEQ ID NO: 318152 - RNA, 22 nt, Human
cuuggcagauccaaaaaugaca

SEQ ID NO: 318153 - RNA, 22 nt, Human
agcagcaggcuguguggacuga

SEQ ID NO: 318154 - RNA, 22 nt, Human
uuagauaauguuauuguaauuu

SEQ ID NO: 318155 - RNA, 22 nt, Human
gaggccuggcugggaggaggug

SEQ ID NO: 318156 - RNA, 22 nt, Human
auggauaauggugauaguugca

SEQ ID NO: 318157 - RNA, 22 nt, Human
cuggagaggccccaagauauuu

SEQ ID NO: 318158 - RNA, 22 nt, Human
ggauggcaggacaaggacccag

SEQ ID NO: 318159 - RNA, 22 nt, Human
gccaggaguucagaugcauguu

SEQ ID NO: 318160 - RNA, 22 nt, Human
gcagacuguaucaaugucagua

SEQ ID NO: 318161 - RNA, 22 nt, Human
gagcagugacuggagcaugaga

SEQ ID NO: 318162 - RNA, 22 nt, Human
uuauuuauggcacuguuggugg

SEQ ID NO: 318163 - RNA, 22 nt, Human
ugcucuccggcuuccguggccu

SEQ ID NO: 318164 - RNA, 22 nt, Human
caggugaccuuuguccuaaguu

SEQ ID NO: 318165 - RNA, 22 nt, Human
uccuggaggcaaaugagcacau

SEQ ID NO: 318166 - RNA, 22 nt, Human
uccaugagagguaacuuuacaa

SEQ ID NO: 318167 - RNA, 22 nt, Human
agagaagagucuugucaaauua

SEQ ID NO: 318168 - RNA, 22 nt, Human
aauuucaagucuugaagaagua

SEQ ID NO: 318169 - RNA, 20 nt, Human
cacguuuuuccacuagcaaa

SEQ ID NO: 318170 - RNA, 22 nt, Human
caggauggagaguuguugguug

SEQ ID NO: 318171 - RNA, 22 nt, Human
cccuuucccuucuggcucaggg

SEQ ID NO: 318172 - RNA, 23 nt, Human
uggcuggcagaaacugaagcaug

SEQ ID NO: 318173 - RNA, 22 nt, Human
ucccaggaucugagggcagaga

SEQ ID NO: 318174 - RNA, 22 nt, Human
auccccagaaaauaggugccua

SEQ ID NO: 318175 - RNA, 22 nt, Human
gguuggggcgagcuggaggccc

SEQ ID NO: 318176 - RNA, 23 nt, Human
uugucugugcuuuuccaguugcu

SEQ ID NO: 318177 - RNA, 22 nt, Human
aguguguacucauauacuucca

SEQ ID NO: 318178 - RNA, 22 nt, Human
cugugcccaggccccuggggau

SEQ ID NO: 318179 - RNA, 22 nt, Human
uauucaaaguaccuucauugcc

SEQ ID NO: 318180 - RNA, 22 nt, Human
agguacagggugaaaguuuaug

SEQ ID NO: 318181 - RNA, 22 nt, Human
uuugaaaauuuaagugcuacac

SEQ ID NO: 318182 - RNA, 22 nt, Human
uuugcauuacuugacuuuaguu

SEQ ID NO: 318183 - RNA, 22 nt, Human
cagacacagauaugcauauggc

SEQ ID NO: 318184 - RNA, 22 nt, Human
guacauuuugagguuaaaacaa

SEQ ID NO: 318185 - RNA, 21 nt, Human
gcacagugccaggcacacagu

SEQ ID NO: 318186 - RNA, 22 nt, Human
cugagcugcucccgcugcagcg

SEQ ID NO: 318187 - RNA, 22 nt, Human
auucacaguuuccucauauucu

SEQ ID NO: 318188 - RNA, 22 nt, Human
cuucucagcaugguuacuguga

SEQ ID NO: 318189 - RNA, 22 nt, Human
cuguggcugcagccuugguccu

SEQ ID NO: 318190 - RNA, 22 nt, Human
cagguggggcagcugugggagc

SEQ ID NO: 318191 - RNA, 22 nt, Human
ggguccaggucuucaggcagag

SEQ ID NO: 318192 - RNA, 21 nt, Human
ccugagggugguugugaagau

SEQ ID NO: 318193 - RNA, 22 nt, Human
caaauucucuuacuguuugaca

SEQ ID NO: 318194 - RNA, 20 nt, Human
cucucuggaaggugggagcc

SEQ ID NO: 318195 - RNA, 22 nt, Human
cagccugggcuccagagucccu

SEQ ID NO: 318196 - RNA, 22 nt, Human
aaaugcacagaggccagagagg

SEQ ID NO: 318197 - RNA, 22 nt, Human
acagggcaaccucugggagacu

SEQ ID NO: 318198 - RNA, 22 nt, Human
aguuuuaugcaguguucugaua

SEQ ID NO: 318199 - RNA, 22 nt, Human
uuccuugguagagagaauauuu

SEQ ID NO: 318200 - RNA, 22 nt, Human
ggagcugggaauuggaucaucu

SEQ ID NO: 318201 - RNA, 18 nt, Human
gcaggugccacugcuguu

SEQ ID NO: 318202 - RNA, 22 nt, Human
gcucugcugcuuacuagauggu

SEQ ID NO: 318203 - RNA, 22 nt, Human
agaaaauaauuucuuggcuggu

SEQ ID NO: 318204 - RNA, 20 nt, Human
gaggaaaagcugccaggccu

SEQ ID NO: 318205 - RNA, 18 nt, Human
gagcugccauauuuaguu

SEQ ID NO: 318206 - RNA, 22 nt, Human
uuucaaugacacaaaagagaaa

SEQ ID NO: 318207 - RNA, 22 nt, Human
aucaaaguuucccagaaguugu

SEQ ID NO: 318208 - RNA, 22 nt, Human
cugagccaugagccugcgccca

SEQ ID NO: 318209 - RNA, 22 nt, Human
ucccagagcagaugugcuaaag

SEQ ID NO: 318210 - RNA, 21 nt, Human
aggugggagaccauguagguc

SEQ ID NO: 318211 - RNA, 22 nt, Human
cagucucucagcuuucagcugu

SEQ ID NO: 318212 - RNA, 22 nt, Human
uucauuaguucugaagaugucu

SEQ ID NO: 318213 - RNA, 22 nt, Human
gcuggaccaggugugcacaggc

SEQ ID NO: 318214 - RNA, 23 nt, Human
agcuggguggccugcgugaagcu

SEQ ID NO: 318215 - RNA, 22 nt, Human
uugcauuugagaaaguucuccu

SEQ ID NO: 318216 - RNA, 23 nt, Human
auugaugacuugauuacacuuuu

SEQ ID NO: 318217 - RNA, 22 nt, Human
cagggagcagcgcuggggccuc

SEQ ID NO: 318218 - RNA, 22 nt, Human
uccugugccuccaccugcuccg

SEQ ID NO: 318219 - RNA, 22 nt, Human
ugccugucuucaggagugucac

SEQ ID NO: 318220 - RNA, 22 nt, Human
aagagcauauuaauaguggaga

SEQ ID NO: 318221 - RNA, 22 nt, Human
acagaggucauggagaguucuc

SEQ ID NO: 318222 - RNA, 22 nt, Human
ugggugcuucgucagcucugag

SEQ ID NO: 318223 - RNA, 22 nt, Human
acuucacagaaauuuuaugagg

SEQ ID NO: 318224 - RNA, 22 nt, Human
cugagguggaacagaggugaag

SEQ ID NO: 318225 - RNA, 22 nt, Human
uggcccugccacucacugcuga

SEQ ID NO: 318226 - RNA, 19 nt, Human
gcucugagaggggcauggg

SEQ ID NO: 318227 - RNA, 21 nt, Human
ugauuuccaucuuaaaauaaa

SEQ ID NO: 318228 - RNA, 22 nt, Human
augggaggaaggaggcccuuga

SEQ ID NO: 318229 - RNA, 22 nt, Human
ucugucacuauuggccagaaca

SEQ ID NO: 318230 - RNA, 22 nt, Human
cccaggagguggagguugcagu

SEQ ID NO: 318231 - RNA, 22 nt, Human
aggagcagauugguaagaucau

SEQ ID NO: 318232 - RNA, 22 nt, Human
ugauuuccacgugcacccaggu

SEQ ID NO: 318233 - RNA, 22 nt, Human
gccugggaacucugaucuccug

SEQ ID NO: 318234 - RNA, 22 nt, Human
ucccugggcaucacguugcuuc

SEQ ID NO: 318235 - RNA, 22 nt, Human
uacugccuggagcauuggugcu

SEQ ID NO: 318236 - RNA, 20 nt, Human
gcugccuuguccugcuuggu

SEQ ID NO: 318237 - RNA, 22 nt, Human
ugcagugguguccagguguacu

SEQ ID NO: 318238 - RNA, 22 nt, Human
cuucaagaagacagcagagcau

SEQ ID NO: 318239 - RNA, 22 nt, Human
cagaaugcaaauuuuauaauau

SEQ ID NO: 318240 - RNA, 22 nt, Human
uccauggguagcccugguugag

SEQ ID NO: 318241 - RNA, 22 nt, Human
caucagcacuaugauuaaagua

SEQ ID NO: 318242 - RNA, 21 nt, Human
uuagcaaagcaaacacaugcu

SEQ ID NO: 318243 - RNA, 22 nt, Human
ucugugaacaucacauugacag

SEQ ID NO: 318244 - RNA, 22 nt, Human
uccuucuuugacaaguggcaga

SEQ ID NO: 318245 - RNA, 22 nt, Human
augcaucauggaaaacucaguu

SEQ ID NO: 318246 - RNA, 22 nt, Human
ccagggcagcgccccuccacgc

SEQ ID NO: 318247 - RNA, 22 nt, Human
ccaggcugggcuacaaguugag

SEQ ID NO: 318248 - RNA, 22 nt, Human
gucaugccuggcuucuuagaca

SEQ ID NO: 318249 - RNA, 22 nt, Human
ggcugccucuggaagcuggaga

SEQ ID NO: 318250 - RNA, 22 nt, Human
uugaagcaggaaaauuucuauu

SEQ ID NO: 318251 - RNA, 22 nt, Human
ccugccugcagaaaguaucucc

SEQ ID NO: 318252 - RNA, 22 nt, Human
ggagagcugguagcuggcucca

SEQ ID NO: 318253 - RNA, 22 nt, Human
aagcucugcucagcagacuagg

SEQ ID NO: 318254 - RNA, 22 nt, Human
cagugcaguuucccagaugcug

SEQ ID NO: 318255 - RNA, 22 nt, Human
cucuucuuuaguccagaccauc

SEQ ID NO: 318256 - RNA, 22 nt, Human
uagggcuauucugaguaauaau

SEQ ID NO: 318257 - RNA, 22 nt, Human
ugcuuagacgucaaguacagcc

SEQ ID NO: 318258 - RNA, 22 nt, Human
uguucuuuggcuucacagcucu

SEQ ID NO: 318259 - RNA, 22 nt, Human
agagcuggggcccguaaagcca

SEQ ID NO: 318260 - RNA, 22 nt, Human
aacagugucaggauuacagaua

SEQ ID NO: 318261 - RNA, 22 nt, Human
agcuucuugaccaagccuguaa

SEQ ID NO: 318262 - RNA, 22 nt, Human
ugaaggagcucaggagauaguc

SEQ ID NO: 318263 - RNA, 22 nt, Human
cccaccccuggacaggugagug

SEQ ID NO: 318264 - RNA, 22 nt, Human
uucauugucucuguuugccuuc

SEQ ID NO: 318265 - RNA, 22 nt, Human
caggaaaggugugucaugaugg

SEQ ID NO: 318266 - RNA, 22 nt, Human
auuauauaggacuugcccuucc

SEQ ID NO: 318267 - RNA, 22 nt, Human
aaacacaauguuucuuuguucu

SEQ ID NO: 318268 - RNA, 21 nt, Human
uugaagcaaggguggcucuga

SEQ ID NO: 318269 - RNA, 22 nt, Human
caguagcaggcaggugcuuuug

SEQ ID NO: 318270 - RNA, 22 nt, Human
aguucucagcuuaguaugcugu

SEQ ID NO: 318271 - RNA, 22 nt, Human
uaaggcauucucaugcugugaa

SEQ ID NO: 318272 - RNA, 22 nt, Human
ggcuagaagucagaggucaaga

SEQ ID NO: 318273 - RNA, 22 nt, Human
gaggccuggaauuccagccugg

SEQ ID NO: 318274 - RNA, 21 nt, Human
gggcuggacaugguggcucau

SEQ ID NO: 318275 - RNA, 23 nt, Human
ucuccuccuagauacagucaugg

SEQ ID NO: 318276 - RNA, 22 nt, Human
gccaggcaaauuaaggaaugca

SEQ ID NO: 318277 - RNA, 22 nt, Human
ugucucuggcccaugagcagag

SEQ ID NO: 318278 - RNA, 22 nt, Human
aucuggcucuuccuggaguucc

SEQ ID NO: 318279 - RNA, 17 nt, Human
agcagcugaagcagcca

SEQ ID NO: 318280 - RNA, 22 nt, Human
ggcccaguguugccagaccuga

SEQ ID NO: 318281 - RNA, 22 nt, Human
ucagugucuugaccugggugug

SEQ ID NO: 318282 - RNA, 22 nt, Human
cacauaaguggguuccauugca

SEQ ID NO: 318283 - RNA, 22 nt, Human
uugaccauaccuccaggcaguu

SEQ ID NO: 318284 - RNA, 22 nt, Human
uaggagcuaaaauauuuuauau

SEQ ID NO: 318285 - RNA, 22 nt, Human
aaaaauagcuucucuugucccu

SEQ ID NO: 318286 - RNA, 22 nt, Human
ucaugacaucuguuuaucucaa

SEQ ID NO: 318287 - RNA, 22 nt, Human
aaauaugaaugauaagaguuau

SEQ ID NO: 318288 - RNA, 22 nt, Human
ucuguccucuuugaagcugcuc

SEQ ID NO: 318289 - RNA, 22 nt, Human
ccuuuuucaauauagaauugca

SEQ ID NO: 318290 - RNA, 22 nt, Human
ccugggcuuucggcggcuuccu

SEQ ID NO: 318291 - RNA, 22 nt, Human
gcaguggggcgcugggaguugg

SEQ ID NO: 318292 - RNA, 22 nt, Human
caggauggugugagugugagga

SEQ ID NO: 318293 - RNA, 19 nt, Human
ugccuggcaccagcuccac

SEQ ID NO: 318294 - RNA, 22 nt, Human
cuuaacagcaagaucuguguca

SEQ ID NO: 318295 - RNA, 22 nt, Human
gcugucagugaggugagacaug

SEQ ID NO: 318296 - RNA, 22 nt, Human
gcugucugacuccaaguuggag

SEQ ID NO: 318297 - RNA, 22 nt, Human
ugaaggccagcagagugaaggc

SEQ ID NO: 318298 - RNA, 22 nt, Human
auuccuuguuucacugaaaagg

SEQ ID NO: 318299 - RNA, 22 nt, Human
gauuuucauuugcacucuagaa

SEQ ID NO: 318300 - RNA, 22 nt, Human
augcuuuagugucaaguuuggg

SEQ ID NO: 318301 - RNA, 21 nt, Human
uggcucaguugcugggcacag

SEQ ID NO: 318302 - RNA, 22 nt, Human
gcauuccugagaaugcagagug

SEQ ID NO: 318303 - RNA, 22 nt, Human
uguggaaaauuggaacguuccu

SEQ ID NO: 318304 - RNA, 22 nt, Human
cuuguagaauugaaauggucuc

SEQ ID NO: 318305 - RNA, 22 nt, Human
gcugcucuccauggccgugagu

SEQ ID NO: 318306 - RNA, 21 nt, Human
gcuccuggugcugcguggcgc

SEQ ID NO: 318307 - RNA, 22 nt, Human
uggagccauaacccuuucguac

SEQ ID NO: 318308 - RNA, 22 nt, Human
ggggcuggcucacuaagagacu

SEQ ID NO: 318309 - RNA, 17 nt, Human
cagggcugucugccuag

SEQ ID NO: 318310 - RNA, 22 nt, Human
cccaggaguuugaguucagcau

SEQ ID NO: 318311 - RNA, 22 nt, Human
aaaucagugcucauuugaaagg

SEQ ID NO: 318312 - RNA, 22 nt, Human
gcugccugaagugucuacacug

SEQ ID NO: 318313 - RNA, 22 nt, Human
cugccucuggccucaggcccag

SEQ ID NO: 318314 - RNA, 22 nt, Human
augggaggcagcagagcccagc

SEQ ID NO: 318315 - RNA, 22 nt, Human
gcccuguguguuugcacugauu

SEQ ID NO: 318316 - RNA, 22 nt, Human
ccuguggcucucuuuggagguc

SEQ ID NO: 318317 - RNA, 22 nt, Human
cagggagcuggcuggcgugagu

SEQ ID NO: 318318 - RNA, 22 nt, Human
uguaugcuuguguauaauauaa

SEQ ID NO: 318319 - RNA, 22 nt, Human
auuucagcccaguaugagcccc

SEQ ID NO: 318320 - RNA, 22 nt, Human
cagcccugcagccauggccugu

SEQ ID NO: 318321 - RNA, 22 nt, Human
uucuuucacucaagaaggaucu

SEQ ID NO: 318322 - RNA, 22 nt, Human
ugcucccaaacgaccuacugug

SEQ ID NO: 318323 - RNA, 22 nt, Human
ugcagcagguuccaaaggguua

SEQ ID NO: 318324 - RNA, 22 nt, Human
uggguggaauaaaucaguucug

SEQ ID NO: 318325 - RNA, 22 nt, Human
cuccuuccugguuagcaccuua

SEQ ID NO: 318326 - RNA, 19 nt, Human
cuggcucuuggguggagga

SEQ ID NO: 318327 - RNA, 22 nt, Human
ggcacugagaacaggcugacuu

SEQ ID NO: 318328 - RNA, 22 nt, Human
gcugggagcaaguacucaucuu

SEQ ID NO: 318329 - RNA, 22 nt, Human
ugggcacaaacaucugccuguu

SEQ ID NO: 318330 - RNA, 22 nt, Human
aaaugcaggaaauuaugcuuuu

SEQ ID NO: 318331 - RNA, 22 nt, Human
ugaggcagaaauuccuguuuuc

SEQ ID NO: 318332 - RNA, 22 nt, Human
ccaaaccauccaucuccaggcu

SEQ ID NO: 318333 - RNA, 22 nt, Human
gccugaaguuucaugccucuau

SEQ ID NO: 318334 - RNA, 22 nt, Human
ucuucccuaaucaccaucuuca

SEQ ID NO: 318335 - RNA, 22 nt, Human
auccaaaucaugucagaagaac

SEQ ID NO: 318336 - RNA, 20 nt, Human
uuucaguugguuaauggcau

SEQ ID NO: 318337 - RNA, 22 nt, Human
ucugucuucaucagcaugugau

SEQ ID NO: 318338 - RNA, 22 nt, Human
cuuucacaguccugacugagcg

SEQ ID NO: 318339 - RNA, 19 nt, Human
uaucuguuuccugcuuguc

SEQ ID NO: 318340 - RNA, 22 nt, Human
ucagguggcuucggggaguggc

SEQ ID NO: 318341 - RNA, 22 nt, Human
ugaagcagcuucuuucugucaa

SEQ ID NO: 318342 - RNA, 22 nt, Human
uugcuuuguggugguucuucca

SEQ ID NO: 318343 - RNA, 22 nt, Human
ugccuggguucccaccccaaag

SEQ ID NO: 318344 - RNA, 22 nt, Human
ggcagaggaaggaugaauucac

SEQ ID NO: 318345 - RNA, 22 nt, Human
ccugugccauccugagcauccc

SEQ ID NO: 318346 - RNA, 22 nt, Human
ccagcugggauuaagggaaaau

SEQ ID NO: 318347 - RNA, 20 nt, Human
uggggccuguuucugugguu

SEQ ID NO: 318348 - RNA, 22 nt, Human
aguccuuugggaaaaaugacua

SEQ ID NO: 318349 - RNA, 22 nt, Human
cagagcucagagcagggcacuc

SEQ ID NO: 318350 - RNA, 22 nt, Human
agcagggcuugccgcuuguccu

SEQ ID NO: 318351 - RNA, 22 nt, Human
caggcacucauucagagaggug

SEQ ID NO: 318352 - RNA, 21 nt, Human
cuacuuaaguaggggauuagg

SEQ ID NO: 318353 - RNA, 22 nt, Human
uguggcuuaagaaugccuuuaa

SEQ ID NO: 318354 - RNA, 22 nt, Human
ugcagaaguauuccaggcccca

SEQ ID NO: 318355 - RNA, 22 nt, Human
auaaauuuauaauuguuuccug

SEQ ID NO: 318356 - RNA, 22 nt, Human
uccacugcagcuucugauggaa

SEQ ID NO: 318357 - RNA, 22 nt, Human
cuccucuggaaauuccucugcc

SEQ ID NO: 318358 - RNA, 22 nt, Human
cauuguuaauugguaucuuaca

SEQ ID NO: 318359 - RNA, 22 nt, Human
caaaguccauaguuuacaauag

SEQ ID NO: 318360 - RNA, 22 nt, Human
uuugaagucagacacugcuuug

SEQ ID NO: 318361 - RNA, 22 nt, Human
uuugcauuuugauaagaucacu

SEQ ID NO: 318362 - RNA, 22 nt, Human
uuauuccaguaaucucuguaau

SEQ ID NO: 318363 - RNA, 22 nt, Human
uggcucaggggucuggcucugu

SEQ ID NO: 318364 - RNA, 22 nt, Human
uuucccagagguaugaauaagu

SEQ ID NO: 318365 - RNA, 20 nt, Human
aauaaaagaagccuucaccc

SEQ ID NO: 318366 - RNA, 22 nt, Human
ucauucuccucuggaaaaggca

SEQ ID NO: 318367 - RNA, 22 nt, Human
gggaucagaaacauagcccuga

SEQ ID NO: 318368 - RNA, 18 nt, Human
uaaaugcauguuaauaac

SEQ ID NO: 318369 - RNA, 22 nt, Human
ugaaaucuuuaguuucuguccc

SEQ ID NO: 318370 - RNA, 19 nt, Human
uggaaaauggauugaauca

SEQ ID NO: 318371 - RNA, 22 nt, Human
uucuuugaguuaguacagucca

SEQ ID NO: 318372 - RNA, 22 nt, Human
uggcucagucauggaugaguaa

SEQ ID NO: 318373 - RNA, 22 nt, Human
ggcaggagaaaggucucuucuu

SEQ ID NO: 318374 - RNA, 20 nt, Human
uccaggagaacugggagccg

SEQ ID NO: 318375 - RNA, 22 nt, Human
uggcugccuuucaccucaucuc

SEQ ID NO: 318376 - RNA, 22 nt, Human
uucacacacagcuuccuauugu

SEQ ID NO: 318377 - RNA, 22 nt, Human
auguuucaaugcacuuuagccu

SEQ ID NO: 318378 - RNA, 22 nt, Human
accucugcuucccggguucaag

SEQ ID NO: 318379 - RNA, 19 nt, Human
ccucuccgcccaccagccc

SEQ ID NO: 318380 - RNA, 22 nt, Human
gacauuucaaucucauuauggg

SEQ ID NO: 318381 - RNA, 22 nt, Human
ggagccuugggcgcucucccau

SEQ ID NO: 318382 - RNA, 22 nt, Human
agagccaggaugucuucugggg

SEQ ID NO: 318383 - RNA, 22 nt, Human
aaauguagaccuauagggaccu

SEQ ID NO: 318384 - RNA, 22 nt, Human
ucacgagaggcacagaauagag

SEQ ID NO: 318385 - RNA, 22 nt, Human
gugcaguggcagauccuagcuc

SEQ ID NO: 318386 - RNA, 22 nt, Human
uauucaugagauaggcaguuuu

SEQ ID NO: 318387 - RNA, 22 nt, Human
uggggcuggcacagucucuauu

SEQ ID NO: 318388 - RNA, 22 nt, Human
ggcccaaggcccaggucgagcu

SEQ ID NO: 318389 - RNA, 22 nt, Human
ccucucuguguggccucuccau

SEQ ID NO: 318390 - RNA, 18 nt, Human
agcagcugucagaaugcc

SEQ ID NO: 318391 - RNA, 22 nt, Human
uuaagacaguguauuuguuuuc

SEQ ID NO: 318392 - RNA, 22 nt, Human
ugcagcuucuuguccugugauu

SEQ ID NO: 318393 - RNA, 22 nt, Human
cucugagcuccuggaagcgugc

SEQ ID NO: 318394 - RNA, 22 nt, Human
uagcuggguugaggucaucuac

SEQ ID NO: 318395 - RNA, 21 nt, Human
ccaggcuccugaggcugguca

SEQ ID NO: 318396 - RNA, 22 nt, Human
auuuguaauuucuuaucugugu

SEQ ID NO: 318397 - RNA, 22 nt, Human
gacacagagauaggccuguguu

SEQ ID NO: 318398 - RNA, 19 nt, Human
cccaguccuuguccugggc

SEQ ID NO: 318399 - RNA, 20 nt, Human
acuuuacugagcuguaauuc

SEQ ID NO: 318400 - RNA, 22 nt, Human
gaugauggacaaagcauuggug

SEQ ID NO: 318401 - RNA, 20 nt, Human
gugggcagcaggcauacugg

SEQ ID NO: 318402 - RNA, 22 nt, Human
agcauuuaguuaguaaauguuu

SEQ ID NO: 318403 - RNA, 22 nt, Human
uccucucagugugguuguggga

SEQ ID NO: 318404 - RNA, 22 nt, Human
uggcucagcagguuagaaacua

SEQ ID NO: 318405 - RNA, 22 nt, Human
uccagaaacuuuuccagucuca

SEQ ID NO: 318406 - RNA, 22 nt, Human
acauuguagacuuuucauaugu

SEQ ID NO: 318407 - RNA, 22 nt, Human
gggggcucugacucccucagcu

SEQ ID NO: 318408 - RNA, 23 nt, Human
uggcucagggucucuuaugaagu

SEQ ID NO: 318409 - RNA, 22 nt, Human
caagagcugugaccucauucac

SEQ ID NO: 318410 - RNA, 22 nt, Human
uguccugcaacugaaggagaag

SEQ ID NO: 318411 - RNA, 22 nt, Human
uggagggauacaaagaugaaaa

SEQ ID NO: 318412 - RNA, 22 nt, Human
cacugcuuuuuuggcuauguac

SEQ ID NO: 318413 - RNA, 22 nt, Human
aggggcugccuggcuuggcacu

SEQ ID NO: 318414 - RNA, 22 nt, Human
gcaggagugacauggaugugga

SEQ ID NO: 318415 - RNA, 22 nt, Human
agaggccaggcugcagagggau

SEQ ID NO: 318416 - RNA, 22 nt, Human
gcuggcagggacagcugcgugu

SEQ ID NO: 318417 - RNA, 22 nt, Human
ugcccuguuccugccuccagcu

SEQ ID NO: 318418 - RNA, 22 nt, Human
uguggccagcagguggcugugu

SEQ ID NO: 318419 - RNA, 22 nt, Human
uggccugcccagagcagcucug

SEQ ID NO: 318420 - RNA, 22 nt, Human
aggacuuagaacauuauguacu

SEQ ID NO: 318421 - RNA, 22 nt, Human
ucucagagauuuuguuucccuu

SEQ ID NO: 318422 - RNA, 22 nt, Human
cucaggaggaggaaguucauug

SEQ ID NO: 318423 - RNA, 22 nt, Human
uuugcaaauaccaugaaacuug

SEQ ID NO: 318424 - RNA, 22 nt, Human
gagauauguuagaaagcuauug

SEQ ID NO: 318425 - RNA, 22 nt, Human
aucaggaucaugcuggguggga

SEQ ID NO: 318426 - RNA, 22 nt, Human
uccauuuuagagaugaagaaac

SEQ ID NO: 318427 - RNA, 22 nt, Human
ucuuuacaaucuaagcauaguu

SEQ ID NO: 318428 - RNA, 21 nt, Human
caugaagccgguucccuguuu

SEQ ID NO: 318429 - RNA, 22 nt, Human
ccucugcucccuggugucugag

SEQ ID NO: 318430 - RNA, 22 nt, Human
aaagaugaucuacaaguucauu

SEQ ID NO: 318431 - RNA, 22 nt, Human
ugcuuccugaggccgucuucuc

SEQ ID NO: 318432 - RNA, 22 nt, Human
cuggcugugcagucuuccagaa

SEQ ID NO: 318433 - RNA, 22 nt, Human
ggccuugguaaagggaugcaug

SEQ ID NO: 318434 - RNA, 22 nt, Human
ugaaggaggaauguggccucca

SEQ ID NO: 318435 - RNA, 22 nt, Human
gccaggcuggcaaaaggaaacc

SEQ ID NO: 318436 - RNA, 22 nt, Human
cagagcagugaggaguugugua

SEQ ID NO: 318437 - RNA, 22 nt, Human
gccugcagauauauaggauggu

SEQ ID NO: 318438 - RNA, 22 nt, Human
ucccagggucaguggugaggcc

SEQ ID NO: 318439 - RNA, 22 nt, Human
uagggcaguuucauguuaucuu

SEQ ID NO: 318440 - RNA, 22 nt, Human
agcagaaccugcagaccugucu

SEQ ID NO: 318441 - RNA, 22 nt, Human
aaucagucauuagcucugaccu

SEQ ID NO: 318442 - RNA, 21 nt, Human
cugcucuggggaccggcugug

SEQ ID NO: 318443 - RNA, 22 nt, Human
gcaguguuaaacaacugcugcu

SEQ ID NO: 318444 - RNA, 22 nt, Human
cacaguccagacuccuggaguu

SEQ ID NO: 318445 - RNA, 22 nt, Human
aggagacagaauuuaaauuugg

SEQ ID NO: 318446 - RNA, 22 nt, Human
cauaaucagauguguacauaag

SEQ ID NO: 318447 - RNA, 22 nt, Human
cccuggaguccuggcaguugau

SEQ ID NO: 318448 - RNA, 22 nt, Human
uuugacauugccaauuugcuca

SEQ ID NO: 318449 - RNA, 21 nt, Human
uacagaaugcgcuucagucug

SEQ ID NO: 318450 - RNA, 22 nt, Human
cccagcuccuuggaugggcagg

SEQ ID NO: 318451 - RNA, 22 nt, Human
cuucuaggcuucucagggggca

SEQ ID NO: 318452 - RNA, 22 nt, Human
gaacagaagaggcuggugccac

SEQ ID NO: 318453 - RNA, 22 nt, Human
uguggcucucagauccuccaau

SEQ ID NO: 318454 - RNA, 22 nt, Human
ccacaucucgguccccucuuug

SEQ ID NO: 318455 - RNA, 22 nt, Human
ccuguucaagguauuaauuauc

SEQ ID NO: 318456 - RNA, 22 nt, Human
cacucugagaaguacaagcucc

SEQ ID NO: 318457 - RNA, 22 nt, Human
gcaggggcugagcaccagcggg

SEQ ID NO: 318458 - RNA, 22 nt, Human
cugcugagcaucagggcugccc

SEQ ID NO: 318459 - RNA, 22 nt, Human
agggaggaucugcuccuugucu

SEQ ID NO: 318460 - RNA, 22 nt, Human
cuuauguacacacauauauugu

SEQ ID NO: 318461 - RNA, 22 nt, Human
uagggcaggugaagaaaagcua

SEQ ID NO: 318462 - RNA, 22 nt, Human
cagcugccccuccagggcuggg

SEQ ID NO: 318463 - RNA, 22 nt, Human
cauuuguaguaucuguuuauau

SEQ ID NO: 318464 - RNA, 22 nt, Human
aguaugaacggaaggccuggga

SEQ ID NO: 318465 - RNA, 22 nt, Human
aaggcaguacuuuauguccaua

SEQ ID NO: 318466 - RNA, 22 nt, Human
agucucagcaagcauggcuagu

SEQ ID NO: 318467 - RNA, 22 nt, Human
ucugucacuuuuauuuacugaa

SEQ ID NO: 318468 - RNA, 22 nt, Human
uuagucaauagugaauauagag

SEQ ID NO: 318469 - RNA, 22 nt, Human
aaaggccacacugcucuuucuc

SEQ ID NO: 318470 - RNA, 22 nt, Human
cugucauuuaagacauucugga

SEQ ID NO: 318471 - RNA, 22 nt, Human
aguguuugagacacauuucacu

SEQ ID NO: 318472 - RNA, 22 nt, Human
ugggagcccaagggagcugccg

SEQ ID NO: 318473 - RNA, 22 nt, Human
gaaauauuacaguggaggggau

SEQ ID NO: 318474 - RNA, 22 nt, Human
ggagacagugacuuagagacug

SEQ ID NO: 318475 - RNA, 21 nt, Human
ucacuagugccuucugucauu

SEQ ID NO: 318476 - RNA, 21 nt, Human
ucuagaauccuguauaagacu

SEQ ID NO: 318477 - RNA, 23 nt, Human
aggcuuccuaucuuagagcuggg

SEQ ID NO: 318478 - RNA, 22 nt, Human
ggcuucugaaaucucugugcgu

SEQ ID NO: 318479 - RNA, 22 nt, Human
cuccugggaauuuaguugugag

SEQ ID NO: 318480 - RNA, 22 nt, Human
acaaagucuuuuacaacaguca

SEQ ID NO: 318481 - RNA, 22 nt, Human
cagcuggcaaguggagcagggu

SEQ ID NO: 318482 - RNA, 22 nt, Human
ugaguuuugucuugcuagaagu

SEQ ID NO: 318483 - RNA, 22 nt, Human
ccuccuuuccuguuuuccugag

SEQ ID NO: 318484 - RNA, 22 nt, Human
ugccagcccaccuuggggccuc

SEQ ID NO: 318485 - RNA, 22 nt, Human
uuccagcuaacucacaucccuu

SEQ ID NO: 318486 - RNA, 22 nt, Human
aggcuccaugcaaaggcuguuu

SEQ ID NO: 318487 - RNA, 22 nt, Human
aucaguuuauacuuauaaaucu

SEQ ID NO: 318488 - RNA, 22 nt, Human
ucaggcagaugcagggauggau

SEQ ID NO: 318489 - RNA, 22 nt, Human
ccugcaggggagagacuucuag

SEQ ID NO: 318490 - RNA, 22 nt, Human
ggcuucucucccccagcuccac

SEQ ID NO: 318491 - RNA, 22 nt, Human
ccagugcuucuuugcuagcugg

SEQ ID NO: 318492 - RNA, 22 nt, Human
cugcucuguuucuuagcugggu

SEQ ID NO: 318493 - RNA, 22 nt, Human
gucccauaaguagugcaacuug

SEQ ID NO: 318494 - RNA, 22 nt, Human
gagggcacgaaacaaccacuuc

SEQ ID NO: 318495 - RNA, 22 nt, Human
gccuggccugaacuaggaggug

SEQ ID NO: 318496 - RNA, 22 nt, Human
gaggaggaaacccuguuccucu

SEQ ID NO: 318497 - RNA, 22 nt, Human
uauucacaguugauuuacaguu

SEQ ID NO: 318498 - RNA, 22 nt, Human
aaagacuuggcuuaugauuugc

SEQ ID NO: 318499 - RNA, 22 nt, Human
cucacugcccugaaguuggguu

SEQ ID NO: 318500 - RNA, 22 nt, Human
aggcuuccgaguagcugggacu

SEQ ID NO: 318501 - RNA, 22 nt, Human
caagcagacaguaggccuagaa

SEQ ID NO: 318502 - RNA, 18 nt, Human
aaauguacuguccauggc

SEQ ID NO: 318503 - RNA, 22 nt, Human
ugccugucuuggaguccuggcc

SEQ ID NO: 318504 - RNA, 22 nt, Human
uucuucuuucccccugugguac

SEQ ID NO: 318505 - RNA, 22 nt, Human
ggcuggaagguagaagaugagg

SEQ ID NO: 318506 - RNA, 22 nt, Human
gcugccacgaucucugcuguag

SEQ ID NO: 318507 - RNA, 22 nt, Human
accuuucaaaguggcuaucacu

SEQ ID NO: 318508 - RNA, 22 nt, Human
ugcaggcuuuagccccauggcu

SEQ ID NO: 318509 - RNA, 22 nt, Human
gccggggcuggggagagacaug

SEQ ID NO: 318510 - RNA, 22 nt, Human
uagcaggguaaauguagaugga

SEQ ID NO: 318511 - RNA, 20 nt, Human
cagggccacgcuccaaggca

SEQ ID NO: 318512 - RNA, 22 nt, Human
ucugagcauugaauuuucuucc

SEQ ID NO: 318513 - RNA, 22 nt, Human
uaugaaauuucuaguucugcuu

SEQ ID NO: 318514 - RNA, 22 nt, Human
ucuggccaggauggcaagacca

SEQ ID NO: 318515 - RNA, 22 nt, Human
uuccuguaguugugcaauguac

SEQ ID NO: 318516 - RNA, 21 nt, Human
uaaggccaagucuauuucugu

SEQ ID NO: 318517 - RNA, 22 nt, Human
ccuggcagucaggggaguccuu

SEQ ID NO: 318518 - RNA, 22 nt, Human
agaaagggaacuggcaaagcca

SEQ ID NO: 318519 - RNA, 19 nt, Human
ugucucugaaagaugagcu

SEQ ID NO: 318520 - RNA, 22 nt, Human
uagggcagagcuuguacacgau

SEQ ID NO: 318521 - RNA, 22 nt, Human
agugucauuuuguccaucuucu

SEQ ID NO: 318522 - RNA, 22 nt, Human
cauggggagacaccuagggaaa

SEQ ID NO: 318523 - RNA, 22 nt, Human
uagcccagagucccaauuccag

SEQ ID NO: 318524 - RNA, 22 nt, Human
guguguccaggcgggagucaag

SEQ ID NO: 318525 - RNA, 22 nt, Human
agcagcucuuaacaaagcaugg

SEQ ID NO: 318526 - RNA, 21 nt, Human
ccuggcugcacaguugcuggu

SEQ ID NO: 318527 - RNA, 20 nt, Human
cuccagggaacagacuggag

SEQ ID NO: 318528 - RNA, 22 nt, Human
accugccucuaagcagcaggug

SEQ ID NO: 318529 - RNA, 23 nt, Human
uggcucugagcuuccugguggcc

SEQ ID NO: 318530 - RNA, 22 nt, Human
uggaggaaguggcuggccagaa

SEQ ID NO: 318531 - RNA, 22 nt, Human
uuaacaugucuugacuucaucu

SEQ ID NO: 318532 - RNA, 19 nt, Human
acagaaauguaagugagac

SEQ ID NO: 318533 - RNA, 22 nt, Human
aguuucuaccgguacauucagg

SEQ ID NO: 318534 - RNA, 22 nt, Human
cugucuguuuuaccuucuccag

SEQ ID NO: 318535 - RNA, 22 nt, Human
uuugcauaaaggagcauuucuc

SEQ ID NO: 318536 - RNA, 22 nt, Human
acaauucugaugguuucccagu

SEQ ID NO: 318537 - RNA, 22 nt, Human
gguaaaaugcagauucuuagcc

SEQ ID NO: 318538 - RNA, 22 nt, Human
augcaguaaauguuaagaaaaa

SEQ ID NO: 318539 - RNA, 22 nt, Human
acaugcauaggagaagucuuua

SEQ ID NO: 318540 - RNA, 21 nt, Human
ggccucugucauccugggaag

SEQ ID NO: 318541 - RNA, 22 nt, Human
uggcagggucuugcuguguugc

SEQ ID NO: 318542 - RNA, 22 nt, Human
ggcuggccucaggguccucgcu

SEQ ID NO: 318543 - RNA, 23 nt, Human
uuuauauuccuaaugucuugagc

SEQ ID NO: 318544 - RNA, 22 nt, Human
uccuugaauauaauaacaguag

SEQ ID NO: 318545 - RNA, 22 nt, Human
cauguacacucauguaacuaua

SEQ ID NO: 318546 - RNA, 22 nt, Human
aguggccagugcugcucugggg

SEQ ID NO: 318547 - RNA, 22 nt, Human
auuuaaugucgagcuauuguag

SEQ ID NO: 318548 - RNA, 22 nt, Human
ugcaauaaggaguaauaguaaa

SEQ ID NO: 318549 - RNA, 22 nt, Human
ccugcccccgucagaggugaug

SEQ ID NO: 318550 - RNA, 22 nt, Human
ccaggcagcucugauuuauguc

SEQ ID NO: 318551 - RNA, 22 nt, Human
agcagggggccacagucacagc

SEQ ID NO: 318552 - RNA, 22 nt, Human
aaggaggccuggcagaugaaga

SEQ ID NO: 318553 - RNA, 22 nt, Human
aguggcagccgagcaggagaug

SEQ ID NO: 318554 - RNA, 22 nt, Human
acaguuaucuuugaaauagaga

SEQ ID NO: 318555 - RNA, 22 nt, Human
auuauguagguuaggugguugu

SEQ ID NO: 318556 - RNA, 22 nt, Human
agccuggagguaaugaggaaac

SEQ ID NO: 318557 - RNA, 22 nt, Human
aguugaauaauuagacauaucu

SEQ ID NO: 318558 - RNA, 22 nt, Human
uuuccuuccagguuccuaaggc

SEQ ID NO: 318559 - RNA, 22 nt, Human
uggcaccugaacuuagaggugu

SEQ ID NO: 318560 - RNA, 22 nt, Human
acucaggaaaugaagacugguu

SEQ ID NO: 318561 - RNA, 22 nt, Human
uuucccaguucccugcucuaua

SEQ ID NO: 318562 - RNA, 22 nt, Human
uuuuaagaugcuaguauuucag

SEQ ID NO: 318563 - RNA, 19 nt, Human
ucaucucacagggccuggc

SEQ ID NO: 318564 - RNA, 22 nt, Human
cugaggugagcuucccugggcu

SEQ ID NO: 318565 - RNA, 22 nt, Human
ucuggagcuggagggcaaggca

SEQ ID NO: 318566 - RNA, 22 nt, Human
ccuuaaauucuccauuugaaag

SEQ ID NO: 318567 - RNA, 22 nt, Human
caggccugugacaccgugucug

SEQ ID NO: 318568 - RNA, 20 nt, Human
uaucaaucagaaagaagacu

SEQ ID NO: 318569 - RNA, 22 nt, Human
gguugccggggcaggacuggaa

SEQ ID NO: 318570 - RNA, 22 nt, Human
gagcauuugguuauaguaauuu

SEQ ID NO: 318571 - RNA, 22 nt, Human
cagcucuggcgucagggagcga

SEQ ID NO: 318572 - RNA, 22 nt, Human
agcagugggugacagagcugag

SEQ ID NO: 318573 - RNA, 22 nt, Human
ucucuuucuauugcaccaugcu

SEQ ID NO: 318574 - RNA, 22 nt, Human
uauuuuaaagacugccagccua

SEQ ID NO: 318575 - RNA, 22 nt, Human
agccucucuccagcuuggcaga

SEQ ID NO: 318576 - RNA, 22 nt, Human
ggagugaaucacuagaugcaga

SEQ ID NO: 318577 - RNA, 19 nt, Human
uggaggagaggaaaaguca

SEQ ID NO: 318578 - RNA, 22 nt, Human
ccuggcagaauauuaaagugca

SEQ ID NO: 318579 - RNA, 22 nt, Human
cucagcagugacaagagaguau

SEQ ID NO: 318580 - RNA, 22 nt, Human
gcagcugagagaagaacagggc

SEQ ID NO: 318581 - RNA, 22 nt, Human
cuccagugucucagagcagaug

SEQ ID NO: 318582 - RNA, 22 nt, Human
gugauuucuaaucaucugaaug

SEQ ID NO: 318583 - RNA, 22 nt, Human
augguuuguguggcccagauga

SEQ ID NO: 318584 - RNA, 20 nt, Human
agcaggaaugaugcuuucau

SEQ ID NO: 318585 - RNA, 22 nt, Human
caaggaaaaagcgagcucgggg

SEQ ID NO: 318586 - RNA, 22 nt, Human
uccuucagauuccugcuucugg

SEQ ID NO: 318587 - RNA, 22 nt, Human
gggcuccaacggugagcaugga

SEQ ID NO: 318588 - RNA, 22 nt, Human
cccccuggcaggcuggccucuc

SEQ ID NO: 318589 - RNA, 22 nt, Human
aaagccagagcaagcugucaca

SEQ ID NO: 318590 - RNA, 19 nt, Human
agcagagcagggccguggg

SEQ ID NO: 318591 - RNA, 22 nt, Human
ggcugcugggaauaugccagcu

SEQ ID NO: 318592 - RNA, 22 nt, Human
agagcugugaaaaugagguuug

SEQ ID NO: 318593 - RNA, 22 nt, Human
ggauggagguucucagaugcuc

SEQ ID NO: 318594 - RNA, 17 nt, Human
aggagucucagaugagc

SEQ ID NO: 318595 - RNA, 22 nt, Human
ggcacagggggcugaggacuag

SEQ ID NO: 318596 - RNA, 22 nt, Human
aggagucaggaccaaauggaaa

SEQ ID NO: 318597 - RNA, 22 nt, Human
ucugccagugguuuggcccuga

SEQ ID NO: 318598 - RNA, 22 nt, Human
uccucaguaaggaucgucagcu

SEQ ID NO: 318599 - RNA, 22 nt, Human
caggaggcuccuagggcucugu

SEQ ID NO: 318600 - RNA, 22 nt, Human
auuaaauuggacgcugggggaa

SEQ ID NO: 318601 - RNA, 22 nt, Human
uuugcauuuguucaaguauuga

SEQ ID NO: 318602 - RNA, 22 nt, Human
cccagcacaggcaauuccauac

SEQ ID NO: 318603 - RNA, 22 nt, Human
uacuacauuaauaaaacauuca

SEQ ID NO: 318604 - RNA, 22 nt, Human
uccuuccucggggacccagauc

SEQ ID NO: 318605 - RNA, 22 nt, Human
uuaguuuucccaucuuuauggu

SEQ ID NO: 318606 - RNA, 22 nt, Human
aaguauuucuggccugugaaag

SEQ ID NO: 318607 - RNA, 22 nt, Human
caggaccuggaaugcuugugaa

SEQ ID NO: 318608 - RNA, 22 nt, Human
ugcuggaauaauuucauguuaa

SEQ ID NO: 318609 - RNA, 22 nt, Human
caaaguuuggcucucaugacau

SEQ ID NO: 318610 - RNA, 20 nt, Human
ccucaagcagacugacagcu

SEQ ID NO: 318611 - RNA, 22 nt, Human
ggggggugcugaucaguggagc

SEQ ID NO: 318612 - RNA, 22 nt, Human
gcugccuggaauaacggcuggc

SEQ ID NO: 318613 - RNA, 22 nt, Human
gaaaucugcuucuugcauagua

SEQ ID NO: 318614 - RNA, 22 nt, Human
ccugcuguucuguuuagugaac

SEQ ID NO: 318615 - RNA, 22 nt, Human
ucugccuuccccauaaucugau

SEQ ID NO: 318616 - RNA, 22 nt, Human
gaggcagaggaagguggucucu

SEQ ID NO: 318617 - RNA, 22 nt, Human
gcuggagccauuggcuuggccu

SEQ ID NO: 318618 - RNA, 22 nt, Human
uucuuuccucccagccuuugga

SEQ ID NO: 318619 - RNA, 22 nt, Human
gggauggggggaagcguccaug

SEQ ID NO: 318620 - RNA, 22 nt, Human
gcaggcagagagggguuuccag

SEQ ID NO: 318621 - RNA, 22 nt, Human
agggagcucaguuggaagcggu

SEQ ID NO: 318622 - RNA, 22 nt, Human
ugggccacggggguggagagcu

SEQ ID NO: 318623 - RNA, 22 nt, Human
gcugagagugagcacuggauau

SEQ ID NO: 318624 - RNA, 20 nt, Human
cucaguguggccugaguguu

SEQ ID NO: 318625 - RNA, 22 nt, Human
aagacagagggaagcaaugaug

SEQ ID NO: 318626 - RNA, 22 nt, Human
agcugucuccagauacaggauu

SEQ ID NO: 318627 - RNA, 22 nt, Human
ucauggagacuuugagccuguu

SEQ ID NO: 318628 - RNA, 22 nt, Human
gaaguucucaaggaucacagaa

SEQ ID NO: 318629 - RNA, 22 nt, Human
acaagguauccacauuaaaugu

SEQ ID NO: 318630 - RNA, 22 nt, Human
ugggcagauguccucugaagug

SEQ ID NO: 318631 - RNA, 22 nt, Human
uggcagaguuggagguggaaga

SEQ ID NO: 318632 - RNA, 22 nt, Human
ugcccaaguccuccaccgaggu

SEQ ID NO: 318633 - RNA, 22 nt, Human
ugacucuguaccugucugccuu

SEQ ID NO: 318634 - RNA, 22 nt, Human
uaccauuucauucuuuccucau

SEQ ID NO: 318635 - RNA, 22 nt, Human
acgcagaagggccuggcgugcc

SEQ ID NO: 318636 - RNA, 22 nt, Human
gaagcagcuuucuggugaggag

SEQ ID NO: 318637 - RNA, 22 nt, Human
agccaggacguugcucagcucc

SEQ ID NO: 318638 - RNA, 22 nt, Human
acauaugauauugaggaucuca

SEQ ID NO: 318639 - RNA, 22 nt, Human
cuucugcaauaaguuuuggucc

SEQ ID NO: 318640 - RNA, 22 nt, Human
ccuggagcacucucccuggcug

SEQ ID NO: 318641 - RNA, 22 nt, Human
gucagcagugucagcucugggg

SEQ ID NO: 318642 - RNA, 22 nt, Human
agagccugggaauuugcauguu

SEQ ID NO: 318643 - RNA, 22 nt, Human
aaguucaaucagaugaaaaagc

SEQ ID NO: 318644 - RNA, 22 nt, Human
gggaccaggugggugcauuccg

SEQ ID NO: 318645 - RNA, 22 nt, Human
aagggaggaggauuuauuguac

SEQ ID NO: 318646 - RNA, 22 nt, Human
uuuauguaguuacggacuauca

SEQ ID NO: 318647 - RNA, 22 nt, Human
gggccuggugcuucugacuccu

SEQ ID NO: 318648 - RNA, 22 nt, Human
cagacuuucaaggagugaaggc

SEQ ID NO: 318649 - RNA, 22 nt, Human
cucuucuuauggccguggcuga

SEQ ID NO: 318650 - RNA, 22 nt, Human
cucugcauuuuaacagaugauu

SEQ ID NO: 318651 - RNA, 22 nt, Human
uuuauuuauaagccacuugcug

SEQ ID NO: 318652 - RNA, 22 nt, Human
ggagagaauuccauggacaugu

SEQ ID NO: 318653 - RNA, 22 nt, Human
ucagcugaaguggagaagcaga

SEQ ID NO: 318654 - RNA, 17 nt, Human
acaagcaguggccaugg

SEQ ID NO: 318655 - RNA, 22 nt, Human
gcugcaggagcuggagcugugg

SEQ ID NO: 318656 - RNA, 22 nt, Human
aacaguguuuuucuucagcacu

SEQ ID NO: 318657 - RNA, 22 nt, Human
uccugagauguggagcuccaug

SEQ ID NO: 318658 - RNA, 22 nt, Human
gagucacaaagccuuucuuauu

SEQ ID NO: 318659 - RNA, 22 nt, Human
aaacugcuuuccacaguggcua

SEQ ID NO: 318660 - RNA, 22 nt, Human
ggaggacaggggcugcagcaca

SEQ ID NO: 318661 - RNA, 22 nt, Human
ugggcagaaggaagagccaccu

SEQ ID NO: 318662 - RNA, 22 nt, Human
cugagccuuauucaccagcccu

SEQ ID NO: 318663 - RNA, 22 nt, Human
cugucccucaucaccucugggu

SEQ ID NO: 318664 - RNA, 22 nt, Human
cagcuugcuaauuuugacuuca

SEQ ID NO: 318665 - RNA, 22 nt, Human
ugcaggugguuuggacacugcu

SEQ ID NO: 318666 - RNA, 22 nt, Human
auugucuuuggugcuuccagga

SEQ ID NO: 318667 - RNA, 22 nt, Human
ucucugggaaugggccugggua

SEQ ID NO: 318668 - RNA, 22 nt, Human
uuuuuguagucauuagaagagg

SEQ ID NO: 318669 - RNA, 21 nt, Human
uguaugcacgcacaugcacac

SEQ ID NO: 318670 - RNA, 18 nt, Human
acccucuggcuucugagc

SEQ ID NO: 318671 - RNA, 22 nt, Human
aagugaagaaauacaugagaau

SEQ ID NO: 318672 - RNA, 23 nt, Human
uuuuccagaaucgacucuguaga

SEQ ID NO: 318673 - RNA, 22 nt, Human
acacaugagaaacaucaguugu

SEQ ID NO: 318674 - RNA, 22 nt, Human
ggccuggcucuugcccagccug

SEQ ID NO: 318675 - RNA, 22 nt, Human
ggcccaucucuugcucuggguu

SEQ ID NO: 318676 - RNA, 22 nt, Human
agcaggugacccaagcaggcug

SEQ ID NO: 318677 - RNA, 19 nt, Human
uugaaauuguuugauaugg

SEQ ID NO: 318678 - RNA, 22 nt, Human
ccuguucaugaaacugcuuucc

SEQ ID NO: 318679 - RNA, 22 nt, Human
ucaggagucugugcaguuccac

SEQ ID NO: 318680 - RNA, 22 nt, Human
gaggcugcuuugaugacaggag

SEQ ID NO: 318681 - RNA, 22 nt, Human
agacccugucaguguuaggaaa

SEQ ID NO: 318682 - RNA, 22 nt, Human
ggcuucugccacgagagggaag

SEQ ID NO: 318683 - RNA, 22 nt, Human
agaauccucuucaguaaauucu

SEQ ID NO: 318684 - RNA, 22 nt, Human
uggcaggggaggugcuugcuua

SEQ ID NO: 318685 - RNA, 22 nt, Human
ccuuccaggugcaggcaagccu

SEQ ID NO: 318686 - RNA, 22 nt, Human
cagcuccugcagcugcugccgu

SEQ ID NO: 318687 - RNA, 22 nt, Human
ccuggggucagggacgcugugc

SEQ ID NO: 318688 - RNA, 22 nt, Human
ucuuugcacugugcaagcagaa

SEQ ID NO: 318689 - RNA, 22 nt, Human
ugggccaggauuucaagacccu

SEQ ID NO: 318690 - RNA, 22 nt, Human
ggcuccugaaagacuaugggaa

SEQ ID NO: 318691 - RNA, 22 nt, Human
gcuggccugggcucaagaccag

SEQ ID NO: 318692 - RNA, 22 nt, Human
aagcagaugcguuggagcaguu

SEQ ID NO: 318693 - RNA, 22 nt, Human
uccuuggagguguucaucugcc

SEQ ID NO: 318694 - RNA, 22 nt, Human
uugcucuguaauaaucuggggu

SEQ ID NO: 318695 - RNA, 22 nt, Human
gugcugucguggaacugggcug

SEQ ID NO: 318696 - RNA, 22 nt, Human
cugugggcugaaagugcucccg

SEQ ID NO: 318697 - RNA, 22 nt, Human
gaagguagcugcugagaugaca

SEQ ID NO: 318698 - RNA, 22 nt, Human
ugggugaggaugaugaggcagc

SEQ ID NO: 318699 - RNA, 21 nt, Human
cccuucuugggucaaaguaua

SEQ ID NO: 318700 - RNA, 22 nt, Human
ugucaaaaauaagagagauugu

SEQ ID NO: 318701 - RNA, 22 nt, Human
cuuggcugucuauaggaaagag

SEQ ID NO: 318702 - RNA, 19 nt, Human
ggcugucucggcccagcca

SEQ ID NO: 318703 - RNA, 22 nt, Human
ugagagacacacugugcaugua

SEQ ID NO: 318704 - RNA, 22 nt, Human
uugacagcuauuuugcuuugau

SEQ ID NO: 318705 - RNA, 22 nt, Human
gcagcugccgugagcucacgcc

SEQ ID NO: 318706 - RNA, 22 nt, Human
aaaugcagguucuugagccaag

SEQ ID NO: 318707 - RNA, 22 nt, Human
agcaggaguguccccuggcugu

SEQ ID NO: 318708 - RNA, 22 nt, Human
ucaguggagcuaagcaugagau

SEQ ID NO: 318709 - RNA, 23 nt, Human
gcaguguuugcuucaucuuaucc

SEQ ID NO: 318710 - RNA, 22 nt, Human
ucccuucacagaugcgauguuu

SEQ ID NO: 318711 - RNA, 22 nt, Human
gcuuccuucuaccacaucaugc

SEQ ID NO: 318712 - RNA, 22 nt, Human
uugauaaaaugauaucuucuuu

SEQ ID NO: 318713 - RNA, 22 nt, Human
uaagcauaacuaaaaaugauuu

SEQ ID NO: 318714 - RNA, 22 nt, Human
ggagccuguggccgucacgacu

SEQ ID NO: 318715 - RNA, 22 nt, Human
ucagugcuuuugagaagcuccu

SEQ ID NO: 318716 - RNA, 22 nt, Human
gaaggccaagaggcuccaagau

SEQ ID NO: 318717 - RNA, 21 nt, Human
gucagcagauccagcacuugu

SEQ ID NO: 318718 - RNA, 22 nt, Human
gaguaaggcugcugauggagug

SEQ ID NO: 318719 - RNA, 23 nt, Human
cauaaaauauuaguaugguagca

SEQ ID NO: 318720 - RNA, 22 nt, Human
ggccagaggccauccuccugcu

SEQ ID NO: 318721 - RNA, 22 nt, Human
uugaaaggugcugugugcugau

SEQ ID NO: 318722 - RNA, 22 nt, Human
gagccagcgccuugccucuggg

SEQ ID NO: 318723 - RNA, 22 nt, Human
aauacaguaauuuugaugaguu

SEQ ID NO: 318724 - RNA, 22 nt, Human
ccagcagcgauagggugagugc

SEQ ID NO: 318725 - RNA, 22 nt, Human
aggucauuuuugccuucuauuu

SEQ ID NO: 318726 - RNA, 22 nt, Human
uauagaaguaagcauugugaug

SEQ ID NO: 318727 - RNA, 22 nt, Human
aagcugcccucauucccagugc

SEQ ID NO: 318728 - RNA, 22 nt, Human
uaauguguccugaaagcuucug

SEQ ID NO: 318729 - RNA, 22 nt, Human
cugccacuuucacccagugcuc

SEQ ID NO: 318730 - RNA, 21 nt, Human
ugggcagauggcaguguggcu

SEQ ID NO: 318731 - RNA, 22 nt, Human
cuuugcaaacugucacacuuuc

SEQ ID NO: 318732 - RNA, 22 nt, Human
gccuggccgcuccgagcuccgc

SEQ ID NO: 318733 - RNA, 22 nt, Human
ggcuccuguccuccuggagcuc

SEQ ID NO: 318734 - RNA, 22 nt, Human
cagacagaaggcuccuugaggu

SEQ ID NO: 318735 - RNA, 22 nt, Human
augggggccugaacaggcaaaa

SEQ ID NO: 318736 - RNA, 22 nt, Human
ugguuuugcuaaaauagaaaga

SEQ ID NO: 318737 - RNA, 22 nt, Human
uuuucucuacaaaauaaccagc

SEQ ID NO: 318738 - RNA, 20 nt, Human
cucugcagcaaggccugggu

SEQ ID NO: 318739 - RNA, 22 nt, Human
aggcccugcccagugccacaag

SEQ ID NO: 318740 - RNA, 22 nt, Human
agcccugugggccuuguggcac

SEQ ID NO: 318741 - RNA, 22 nt, Human
ccaugcccuaaaggacuggcag

SEQ ID NO: 318742 - RNA, 22 nt, Human
agcuggccuccgggugccuggg

SEQ ID NO: 318743 - RNA, 22 nt, Human
uaccucaaguuccaggaaagcg

SEQ ID NO: 318744 - RNA, 22 nt, Human
ugagugaggaagcgguggagga

SEQ ID NO: 318745 - RNA, 22 nt, Human
gcagacuggucuucagccuugg

SEQ ID NO: 318746 - RNA, 22 nt, Human
gacccugagcaaaagcaguucu

SEQ ID NO: 318747 - RNA, 20 nt, Human
aucuuugucucuguaguugu

SEQ ID NO: 318748 - RNA, 22 nt, Human
gaaaaaugcuccaaaucugugg

SEQ ID NO: 318749 - RNA, 22 nt, Human
agagucuuccaggcagccugag

SEQ ID NO: 318750 - RNA, 22 nt, Human
agugcacaccuuaguacaaagu

SEQ ID NO: 318751 - RNA, 22 nt, Human
gcaggaagaugagcucagguaa

SEQ ID NO: 318752 - RNA, 22 nt, Human
cacugaaucucaaggggagggu

SEQ ID NO: 318753 - RNA, 22 nt, Human
guccugucccccaaggcugugg

SEQ ID NO: 318754 - RNA, 22 nt, Human
gccaggcuggugcaaggauauu

SEQ ID NO: 318755 - RNA, 22 nt, Human
aagggacuuugucagcuuucca

SEQ ID NO: 318756 - RNA, 22 nt, Human
gaggggcugggguugacuccaa

SEQ ID NO: 318757 - RNA, 22 nt, Human
gcugcucugaaaaugacuguug

SEQ ID NO: 318758 - RNA, 22 nt, Human
cugcucugagaggcucuuccua

SEQ ID NO: 318759 - RNA, 22 nt, Human
ggcugagccuggagcaucuggu

SEQ ID NO: 318760 - RNA, 22 nt, Human
acaaagucucuaauaaucuucu

SEQ ID NO: 318761 - RNA, 22 nt, Human
caugggcuuuggaggcuggagg

SEQ ID NO: 318762 - RNA, 22 nt, Human
cuggcucccucgcugaggugcu

SEQ ID NO: 318763 - RNA, 22 nt, Human
cuguacaucccgagagccagua

SEQ ID NO: 318764 - RNA, 22 nt, Human
uguuguuuucucauggagaaua

SEQ ID NO: 318765 - RNA, 19 nt, Human
uccucagugacaaccucag

SEQ ID NO: 318766 - RNA, 22 nt, Human
aaaugugugcacaaagacagcu

SEQ ID NO: 318767 - RNA, 23 nt, Human
gugagcagcccacuaggaaugcc

SEQ ID NO: 318768 - RNA, 21 nt, Human
auuauuauuucuguguccagc

SEQ ID NO: 318769 - RNA, 22 nt, Human
cagggcaguaccgcccucuggc

SEQ ID NO: 318770 - RNA, 18 nt, Human
uucagcagcagacacacu

SEQ ID NO: 318771 - RNA, 22 nt, Human
agcagccaaccuuacauucauc

SEQ ID NO: 318772 - RNA, 22 nt, Human
ucaggggaaaucucucagcgaa

SEQ ID NO: 318773 - RNA, 22 nt, Human
uagauuucaggcuggcuugcgg

SEQ ID NO: 318774 - RNA, 22 nt, Human
aauguaugggugagaaaguuga

SEQ ID NO: 318775 - RNA, 22 nt, Human
ucuuuucuggacucugcaugga

SEQ ID NO: 318776 - RNA, 22 nt, Human
agcuggcagucauccuagugag

SEQ ID NO: 318777 - RNA, 22 nt, Human
uggcagaguggaccauacucaa

SEQ ID NO: 318778 - RNA, 22 nt, Human
ugaaugcuuggagucauaaaau

SEQ ID NO: 318779 - RNA, 22 nt, Human
auacuaaaguauagaacuuagu

SEQ ID NO: 318780 - RNA, 22 nt, Human
aggcuggcgacaucuggcgggc

SEQ ID NO: 318781 - RNA, 22 nt, Human
acugcuuuaucugagaaguccu

SEQ ID NO: 318782 - RNA, 22 nt, Human
uggcagaguucgcugugccuuu

SEQ ID NO: 318783 - RNA, 19 nt, Human
aggcucugagcuccuggag

SEQ ID NO: 318784 - RNA, 22 nt, Human
uuagggcuuuucugaauaggcc

SEQ ID NO: 318785 - RNA, 22 nt, Human
gaaggaggcuccccaaagucug

SEQ ID NO: 318786 - RNA, 22 nt, Human
ggcagaguggagugcggccucc

SEQ ID NO: 318787 - RNA, 22 nt, Human
gccuucugaucgcuggacugac

SEQ ID NO: 318788 - RNA, 21 nt, Human
ugaaaugagaaugcugagcac

SEQ ID NO: 318789 - RNA, 22 nt, Human
auguagcagaagauguuuuccu

SEQ ID NO: 318790 - RNA, 20 nt, Human
cugcugugauucccuccucc

SEQ ID NO: 318791 - RNA, 22 nt, Human
guccucagagugggcagguccu

SEQ ID NO: 318792 - RNA, 22 nt, Human
uaggccaggacagagcuuccag

SEQ ID NO: 318793 - RNA, 20 nt, Human
uccaagcccuccuuccauuc

SEQ ID NO: 318794 - RNA, 22 nt, Human
uucuuucucaacaugaauguuu

SEQ ID NO: 318795 - RNA, 22 nt, Human
aggcacuguggaagacaugguu

SEQ ID NO: 318796 - RNA, 22 nt, Human
cuuccaaagcacuuuauggacc

SEQ ID NO: 318797 - RNA, 22 nt, Human
cugggaggcaccgcgucgugcu

SEQ ID NO: 318798 - RNA, 22 nt, Human
cugggaggauucauugagguga

SEQ ID NO: 318799 - RNA, 22 nt, Human
cccugcagccuugcaugccuuc

SEQ ID NO: 318800 - RNA, 22 nt, Human
uaggacauaaguauucuaacuu

SEQ ID NO: 318801 - RNA, 22 nt, Human
agccucugauggcucccaagga

SEQ ID NO: 318802 - RNA, 19 nt, Human
aguagcagaaagugcagug

SEQ ID NO: 318803 - RNA, 22 nt, Human
ugccucagucuaaagucucuca

SEQ ID NO: 318804 - RNA, 22 nt, Human
uucucagauccaucagaagucc

SEQ ID NO: 318805 - RNA, 22 nt, Human
uauguacacauacacuuguaau

SEQ ID NO: 318806 - RNA, 22 nt, Human
ucagggacuaggugcugccuga

SEQ ID NO: 318807 - RNA, 22 nt, Human
ucuggagcuggcagggcccugg

SEQ ID NO: 318808 - RNA, 22 nt, Human
gagguggcgcgccaucccugcc

SEQ ID NO: 318809 - RNA, 22 nt, Human
uagcagggccaggcugggaacc

SEQ ID NO: 318810 - RNA, 21 nt, Human
uuucacaaaaguaugugacaa

SEQ ID NO: 318811 - RNA, 22 nt, Human
cugcugagguccuugcucagac

SEQ ID NO: 318812 - RNA, 22 nt, Human
acaaaauuguguuaaacuuuau

SEQ ID NO: 318813 - RNA, 22 nt, Human
cugugcuuccaggauggcagcu

SEQ ID NO: 318814 - RNA, 22 nt, Human
uuugaauaucacaaacuuucaa

SEQ ID NO: 318815 - RNA, 22 nt, Human
ugucaugcccaggagcaaggua

SEQ ID NO: 318816 - RNA, 22 nt, Human
cccacagguccccaugaacucg

SEQ ID NO: 318817 - RNA, 22 nt, Human
cugucacccacccagccuguca

SEQ ID NO: 318818 - RNA, 22 nt, Human
agcacuuuccuggcaaaugugg

SEQ ID NO: 318819 - RNA, 22 nt, Human
uaucuguuaggaucagagcugg

SEQ ID NO: 318820 - RNA, 22 nt, Human
auucaagagcccauguuuccug

SEQ ID NO: 318821 - RNA, 22 nt, Human
ccugccagucacuaugucaccu

SEQ ID NO: 318822 - RNA, 19 nt, Human
uuacaucugcaacacuggu

SEQ ID NO: 318823 - RNA, 20 nt, Human
cugggcugcccagcuauggg

SEQ ID NO: 318824 - RNA, 22 nt, Human
gcacagggaggcuggccuggcc

SEQ ID NO: 318825 - RNA, 23 nt, Human
ugucccagagggagggauaggcu

SEQ ID NO: 318826 - RNA, 22 nt, Human
cugucucucuaggacacugggg

SEQ ID NO: 318827 - RNA, 22 nt, Human
agagauaugaguaguugugaca

SEQ ID NO: 318828 - RNA, 22 nt, Human
cugcccugagucaugccagaug

SEQ ID NO: 318829 - RNA, 22 nt, Human
gugcugugugauccaugcuggc

SEQ ID NO: 318830 - RNA, 22 nt, Human
aagggcaggugggcauuucugg

SEQ ID NO: 318831 - RNA, 22 nt, Human
cuugugcaauugacauugaauc

SEQ ID NO: 318832 - RNA, 22 nt, Human
uuauuauuuuguguacagcaaa

SEQ ID NO: 318833 - RNA, 22 nt, Human
uggagggcaugcuguccauggg

SEQ ID NO: 318834 - RNA, 22 nt, Human
gucaaaugcacagaaccauuaa

SEQ ID NO: 318835 - RNA, 22 nt, Human
ccugucauacuaacguaguggg

SEQ ID NO: 318836 - RNA, 22 nt, Human
aauacauauggaauuccauguu

SEQ ID NO: 318837 - RNA, 22 nt, Human
acaaucauuccguucacaacag

SEQ ID NO: 318838 - RNA, 21 nt, Human
uucugccuuccccuagcuggg

SEQ ID NO: 318839 - RNA, 22 nt, Human
cuggccaggcuugggacagaca

SEQ ID NO: 318840 - RNA, 22 nt, Human
ccagccuggggaggcagcuucu

SEQ ID NO: 318841 - RNA, 22 nt, Human
auaaggcagucacuggaauguu

SEQ ID NO: 318842 - RNA, 22 nt, Human
ggcagggcuugucucugugaug

SEQ ID NO: 318843 - RNA, 22 nt, Human
ccagagccuggcaucugcauaa

SEQ ID NO: 318844 - RNA, 22 nt, Human
gaaucauuuauuuuugacagca

SEQ ID NO: 318845 - RNA, 22 nt, Human
aggaccuguaccucagcaucua

SEQ ID NO: 318846 - RNA, 22 nt, Human
acauuguuugagaauacagaug

SEQ ID NO: 318847 - RNA, 22 nt, Human
cugaaagaauaagauguuuaca

SEQ ID NO: 318848 - RNA, 21 nt, Human
agauuguauggaggugagagg

SEQ ID NO: 318849 - RNA, 22 nt, Human
gggaggagcuuggagauucacu

SEQ ID NO: 318850 - RNA, 20 nt, Human
agauuauuccuaagauuucu

SEQ ID NO: 318851 - RNA, 20 nt, Human
accccagccccucuaucuga

SEQ ID NO: 318852 - RNA, 18 nt, Human
ucagagguacagaaaagu

SEQ ID NO: 318853 - RNA, 22 nt, Human
cuccugaguaguagcauuguca

SEQ ID NO: 318854 - RNA, 22 nt, Human
gccugcuggcuguccauugcag

SEQ ID NO: 318855 - RNA, 22 nt, Human
uggcuguguuaccacuucaugu

SEQ ID NO: 318856 - RNA, 22 nt, Human
caucaucaaaacaaauggaguc

SEQ ID NO: 318857 - RNA, 22 nt, Human
gcucagagauguucaguagcuu

SEQ ID NO: 318858 - RNA, 18 nt, Human
ccagcaugccagaggcug

SEQ ID NO: 318859 - RNA, 22 nt, Human
ucuggcuuucauuuguuuaaag

SEQ ID NO: 318860 - RNA, 22 nt, Human
ugugccugaguuggcugaguac

SEQ ID NO: 318861 - RNA, 22 nt, Human
acauuaacaccgugaguuuggu

SEQ ID NO: 318862 - RNA, 22 nt, Human
ggucccugguucccucugagcu

SEQ ID NO: 318863 - RNA, 22 nt, Human
gcagugaaacaauaggaucaaa

SEQ ID NO: 318864 - RNA, 22 nt, Human
gccuggcaggccugggccagca

SEQ ID NO: 318865 - RNA, 22 nt, Human
ucucuguaguugggcagcugcu

SEQ ID NO: 318866 - RNA, 22 nt, Human
aguauuucuaguugguucuacu

SEQ ID NO: 318867 - RNA, 19 nt, Human
aguguguacugaaagcacu

SEQ ID NO: 318868 - RNA, 22 nt, Human
auuucagaugaccaaauggaaa

SEQ ID NO: 318869 - RNA, 22 nt, Human
uuauuauaaugagggauaaaaa

SEQ ID NO: 318870 - RNA, 22 nt, Human
uuugcauuaguuuagauuucaa

SEQ ID NO: 318871 - RNA, 22 nt, Human
cacaguggauugggugaugccc

SEQ ID NO: 318872 - RNA, 22 nt, Human
acauauuuccaugcagcauguc

SEQ ID NO: 318873 - RNA, 22 nt, Human
uaguuaaagcccuaaauugaua

SEQ ID NO: 318874 - RNA, 22 nt, Human
ucccugggccuccugcuaugca

SEQ ID NO: 318875 - RNA, 22 nt, Human
cccugagaugccucacccuagu

SEQ ID NO: 318876 - RNA, 23 nt, Human
acagcugcaccuggccgccuggc

SEQ ID NO: 318877 - RNA, 22 nt, Human
ucucgacagccuggcacagugg

SEQ ID NO: 318878 - RNA, 22 nt, Human
ccuccaggauaagucagggccu

SEQ ID NO: 318879 - RNA, 22 nt, Human
uguaccuuuuucugugcaugcu

SEQ ID NO: 318880 - RNA, 22 nt, Human
uugaagauggaucgccacucuc

SEQ ID NO: 318881 - RNA, 22 nt, Human
agaacagaggccuuauguuuca

SEQ ID NO: 318882 - RNA, 22 nt, Human
uauugaguuacagaaaauacuu

SEQ ID NO: 318883 - RNA, 22 nt, Human
ucauuuaauaauuuuugaguag

SEQ ID NO: 318884 - RNA, 22 nt, Human
agccacaccuguccugccagcu

SEQ ID NO: 318885 - RNA, 22 nt, Human
ugcauuguuugauaggugaauu

SEQ ID NO: 318886 - RNA, 22 nt, Human
guuccuuguauuucagacauga

SEQ ID NO: 318887 - RNA, 22 nt, Human
guaugaaaauuguaaaguucuu

SEQ ID NO: 318888 - RNA, 22 nt, Human
uuagucuucuuccuuauauguu

SEQ ID NO: 318889 - RNA, 22 nt, Human
ucaggauguuaauauagcauua

SEQ ID NO: 318890 - RNA, 22 nt, Human
gcucucuggguggugggcaaca

SEQ ID NO: 318891 - RNA, 22 nt, Human
cucaaguaagaaacagaauugg

SEQ ID NO: 318892 - RNA, 22 nt, Human
gccaggcucagcagucaaccug

SEQ ID NO: 318893 - RNA, 22 nt, Human
agaaaugaauauguagugguua

SEQ ID NO: 318894 - RNA, 22 nt, Human
cagcauugaucccaggcugugg

SEQ ID NO: 318895 - RNA, 22 nt, Human
aaaugcagauuuugaugcagca

SEQ ID NO: 318896 - RNA, 22 nt, Human
uauuuccaccuauuauuuucug

SEQ ID NO: 318897 - RNA, 22 nt, Human
ccuggcugccgagugugcagcg

SEQ ID NO: 318898 - RNA, 22 nt, Human
acaugauuuuaguaucauaaua

SEQ ID NO: 318899 - RNA, 22 nt, Human
cuggggacuugcagacacaauu

SEQ ID NO: 318900 - RNA, 17 nt, Human
guuugcaugguguuaac

SEQ ID NO: 318901 - RNA, 18 nt, Human
ccagguggugacagagau

SEQ ID NO: 318902 - RNA, 22 nt, Human
gugcagugagcagugcagcacc

SEQ ID NO: 318903 - RNA, 22 nt, Human
uagaaaugcccagauucugcua

SEQ ID NO: 318904 - RNA, 22 nt, Human
gagagcugucagcguagcaccg

SEQ ID NO: 318905 - RNA, 22 nt, Human
ucacuugccuagcccaguucag

SEQ ID NO: 318906 - RNA, 21 nt, Human
ucuuuccugcccaguugcccu

SEQ ID NO: 318907 - RNA, 22 nt, Human
uuuaucuuuaggacuuugcaga

SEQ ID NO: 318908 - RNA, 22 nt, Human
cagcugccacuugcucucggcu

SEQ ID NO: 318909 - RNA, 22 nt, Human
cccucugcaggcuggaccugcc

SEQ ID NO: 318910 - RNA, 22 nt, Human
ugucacauaauuuaucuguagg

SEQ ID NO: 318911 - RNA, 22 nt, Human
uuagauaaauuaagacuuuaca

SEQ ID NO: 318912 - RNA, 21 nt, Human
gcaggaugcaucuuggugucu

SEQ ID NO: 318913 - RNA, 22 nt, Human
uccauuuucuugcucuagguaa

SEQ ID NO: 318914 - RNA, 22 nt, Human
cuggcucauccagguguugcuc

SEQ ID NO: 318915 - RNA, 22 nt, Human
gcucacagccggcuggcagggg

SEQ ID NO: 318916 - RNA, 23 nt, Human
ggggccugcaccggucugcgcgg

SEQ ID NO: 318917 - RNA, 21 nt, Human
uggcucuguucaauauaugga

SEQ ID NO: 318918 - RNA, 22 nt, Human
uccauuuuagaagaaaauccac

SEQ ID NO: 318919 - RNA, 22 nt, Human
gagcugaaucagagauauuauu

SEQ ID NO: 318920 - RNA, 21 nt, Human
ugcaggagucugugagucagg

SEQ ID NO: 318921 - RNA, 22 nt, Human
aaaucaguuaagaugaggccau

SEQ ID NO: 318922 - RNA, 22 nt, Human
acuuaaaaagaaucuuuucacg

SEQ ID NO: 318923 - RNA, 22 nt, Human
gggcacagcugcuacccagugc

SEQ ID NO: 318924 - RNA, 22 nt, Human
ugccuggaaggcccaugggaag

SEQ ID NO: 318925 - RNA, 22 nt, Human
uuuauuccaugugucuaugacc

SEQ ID NO: 318926 - RNA, 22 nt, Human
cuguacauauacauuuuuuucc

SEQ ID NO: 318927 - RNA, 22 nt, Human
cuccagggggcauccacacagc

SEQ ID NO: 318928 - RNA, 22 nt, Human
aggcuggggaauugaauuugcu

SEQ ID NO: 318929 - RNA, 22 nt, Human
aguugacauccagagacauucu

SEQ ID NO: 318930 - RNA, 22 nt, Human
gaacaguaucaguagugccagu

SEQ ID NO: 318931 - RNA, 22 nt, Human
uguauauucugccuaaaagcuu

SEQ ID NO: 318932 - RNA, 22 nt, Human
gguggagagcuggaugagaggu

SEQ ID NO: 318933 - RNA, 22 nt, Human
agaaaugaagcaggaguuauua

SEQ ID NO: 318934 - RNA, 22 nt, Human
ucaguguuuauucaauguuauu

SEQ ID NO: 318935 - RNA, 22 nt, Human
gcccugugcucaugggaacauc

SEQ ID NO: 318936 - RNA, 22 nt, Human
aacucaguuacauauuagaaua

SEQ ID NO: 318937 - RNA, 22 nt, Human
aggggagaaaaaugccuucugu

SEQ ID NO: 318938 - RNA, 22 nt, Human
aggcacugaagugguaaaugua

SEQ ID NO: 318939 - RNA, 22 nt, Human
aaggucauggcaaauuacuuuu

SEQ ID NO: 318940 - RNA, 22 nt, Human
ucacauuuucuacuacuguacg

SEQ ID NO: 318941 - RNA, 22 nt, Human
ccagcuccuucugucuguggag

SEQ ID NO: 318942 - RNA, 22 nt, Human
ccacagcaugcaggccugacac

SEQ ID NO: 318943 - RNA, 22 nt, Human
gccacugcacuccagcccaggc

SEQ ID NO: 318944 - RNA, 22 nt, Human
agggcagagcacugaauuggga

SEQ ID NO: 318945 - RNA, 22 nt, Human
acagaaauugggcaaauggaag

SEQ ID NO: 318946 - RNA, 23 nt, Human
agacagaggcugaggcuggccgc

SEQ ID NO: 318947 - RNA, 22 nt, Human
gcuggccaggugcuuugguucu

SEQ ID NO: 318948 - RNA, 22 nt, Human
cacagggcagugcugcccacuc

SEQ ID NO: 318949 - RNA, 22 nt, Human
aaaaguauuggccaccauuucu

SEQ ID NO: 318950 - RNA, 22 nt, Human
caugcacaaagguaagaugcgu

SEQ ID NO: 318951 - RNA, 22 nt, Human
uccucaggucaaagcaggagaa

SEQ ID NO: 318952 - RNA, 22 nt, Human
ccugugcauccgguggucauug

SEQ ID NO: 318953 - RNA, 22 nt, Human
ugcugccaugcagagcaacaga

SEQ ID NO: 318954 - RNA, 22 nt, Human
ucucaagagggaggcaaucaug

SEQ ID NO: 318955 - RNA, 23 nt, Human
ggacagggcccugcccuauggcc

SEQ ID NO: 318956 - RNA, 22 nt, Human
uaaaugcagcaguuucuguucu

SEQ ID NO: 318957 - RNA, 22 nt, Human
cugggagauugcuagagaugca

SEQ ID NO: 318958 - RNA, 22 nt, Human
agggacagaugaaugacugagu

SEQ ID NO: 318959 - RNA, 19 nt, Human
uucuccaggcugcagaggg

SEQ ID NO: 318960 - RNA, 22 nt, Human
uucuggaggccccuuccuucuc

SEQ ID NO: 318961 - RNA, 22 nt, Human
ccagcucuggcuucuugcuggg

SEQ ID NO: 318962 - RNA, 22 nt, Human
gggacagcuguagugcuuggcu

SEQ ID NO: 318963 - RNA, 21 nt, Human
ugggcacugagggugcugcuc

SEQ ID NO: 318964 - RNA, 22 nt, Human
ugcuuucaaaggcuuucuagau

SEQ ID NO: 318965 - RNA, 22 nt, Human
cagacagaccugcaagggcaca

SEQ ID NO: 318966 - RNA, 22 nt, Human
aaguuacuggcaagggcugcag

SEQ ID NO: 318967 - RNA, 22 nt, Human
gagagcuggauucuggauaggu

SEQ ID NO: 318968 - RNA, 22 nt, Human
cuggcagcauuaacagagagca

SEQ ID NO: 318969 - RNA, 22 nt, Human
ggcagagcugcaugagcacuca

SEQ ID NO: 318970 - RNA, 19 nt, Human
ggacacagaaagcugcauu

SEQ ID NO: 318971 - RNA, 22 nt, Human
gagggguguggagccaucaguu

SEQ ID NO: 318972 - RNA, 22 nt, Human
gcagggcuguggacacuuuggu

SEQ ID NO: 318973 - RNA, 22 nt, Human
agaaaaggauugauggaucaga

SEQ ID NO: 318974 - RNA, 22 nt, Human
ggagggguggaaggagugccug

SEQ ID NO: 318975 - RNA, 22 nt, Human
uaaaaguggauaagcuguagga

SEQ ID NO: 318976 - RNA, 22 nt, Human
ucugagcuuuuauuaucaaccu

SEQ ID NO: 318977 - RNA, 22 nt, Human
uuuagaguugaguauucauugg

SEQ ID NO: 318978 - RNA, 20 nt, Human
ucacuaguaaccaucugcuu

SEQ ID NO: 318979 - RNA, 22 nt, Human
acagucucuccacacugcaggg

SEQ ID NO: 318980 - RNA, 20 nt, Human
uucuucucuaguuaucuuca

SEQ ID NO: 318981 - RNA, 22 nt, Human
gugugccaccagucaaggugaa

SEQ ID NO: 318982 - RNA, 22 nt, Human
agcagccaauuggaggaugaag

SEQ ID NO: 318983 - RNA, 22 nt, Human
gggcuggcaggaccugggcuga

SEQ ID NO: 318984 - RNA, 22 nt, Human
cugggggcagcaagaagccaug

SEQ ID NO: 318985 - RNA, 22 nt, Human
auuacaauaagguuuauuugua

SEQ ID NO: 318986 - RNA, 22 nt, Human
gauacauuuuaucuccuaacag

SEQ ID NO: 318987 - RNA, 22 nt, Human
aaaguucagauuagacucaaga

SEQ ID NO: 318988 - RNA, 22 nt, Human
ggucuuccgagaggccugugcu

SEQ ID NO: 318989 - RNA, 22 nt, Human
gacacaaaguuugucagaaauu

SEQ ID NO: 318990 - RNA, 22 nt, Human
caaaugauaccuauuacuaggc

SEQ ID NO: 318991 - RNA, 22 nt, Human
gccagguggcugagcagcugca

SEQ ID NO: 318992 - RNA, 22 nt, Human
ugcauuccuccaccuccugcac

SEQ ID NO: 318993 - RNA, 22 nt, Human
acaaagauaagucagaaaguca

SEQ ID NO: 318994 - RNA, 22 nt, Human
uuuacuuugugucaagucaaga

SEQ ID NO: 318995 - RNA, 22 nt, Human
auucaaguccagcuucucuaca

SEQ ID NO: 318996 - RNA, 22 nt, Human
cuggcagcgcagcaugaagucg

SEQ ID NO: 318997 - RNA, 22 nt, Human
ggucauuguucuuuucugugau

SEQ ID NO: 318998 - RNA, 22 nt, Human
acugcccucccaucuauugcaa

SEQ ID NO: 318999 - RNA, 22 nt, Human
uggcuucugggacuugugagca

SEQ ID NO: 319000 - RNA, 22 nt, Human
ccagcucugauuuugaccucca

SEQ ID NO: 319001 - RNA, 22 nt, Human
cacauguacagaagcaggcugg

SEQ ID NO: 319002 - RNA, 22 nt, Human
ucugucaaaaguuuucaauaaa

SEQ ID NO: 319003 - RNA, 20 nt, Human
gcaaauggaucccacaagcc

SEQ ID NO: 319004 - RNA, 22 nt, Human
uaaggcagaaauaugagcaggg

SEQ ID NO: 319005 - RNA, 22 nt, Human
aaggagagguuguccguguugu

SEQ ID NO: 319006 - RNA, 22 nt, Human
cucuucuugaaagaggaauuca

SEQ ID NO: 319007 - RNA, 22 nt, Human
ucacagacaauuguuuuggugu

SEQ ID NO: 319008 - RNA, 22 nt, Human
aaucgguugaacccaggaagug

SEQ ID NO: 319009 - RNA, 22 nt, Human
ucugggagguaaccaugcugau

SEQ ID NO: 319010 - RNA, 22 nt, Human
gugugcagaagacacaagacau

SEQ ID NO: 319011 - RNA, 22 nt, Human
agccaggauuggcugagccuua

SEQ ID NO: 319012 - RNA, 22 nt, Human
ugcuucaggaagaaacgccagg

SEQ ID NO: 319013 - RNA, 22 nt, Human
uagcaauagaaacauauaaagu

SEQ ID NO: 319014 - RNA, 22 nt, Human
acauuuuuuagagucccacauu

SEQ ID NO: 319015 - RNA, 18 nt, Human
caggaugagugaugggga

SEQ ID NO: 319016 - RNA, 22 nt, Human
augcaagauguauagaagacuu

SEQ ID NO: 319017 - RNA, 18 nt, Human
gggcacuggggacuggag

SEQ ID NO: 319018 - RNA, 18 nt, Human
ucugucuguacaaguauc

SEQ ID NO: 319019 - RNA, 22 nt, Human
gagggcagagacagugauucac

SEQ ID NO: 319020 - RNA, 22 nt, Human
caggaggcaucauggagcggac

SEQ ID NO: 319021 - RNA, 22 nt, Human
auuagugucugugaauaauucu

SEQ ID NO: 319022 - RNA, 22 nt, Human
auccaugaagguacuucucagg

SEQ ID NO: 319023 - RNA, 22 nt, Human
auccaguucucagugcuuacag

SEQ ID NO: 319024 - RNA, 19 nt, Human
acuuucuccaggaccuguu

SEQ ID NO: 319025 - RNA, 22 nt, Human
uugcauugugauuacagaggug

SEQ ID NO: 319026 - RNA, 20 nt, Human
ugucauuguuucuaggaccu

SEQ ID NO: 319027 - RNA, 22 nt, Human
caggcagcguccugcuuccugu

SEQ ID NO: 319028 - RNA, 22 nt, Human
ggguggaggagaacaggcccca

SEQ ID NO: 319029 - RNA, 22 nt, Human
accucugcaguagggcugugcc

SEQ ID NO: 319030 - RNA, 22 nt, Human
augggcagcagcugccauucau

SEQ ID NO: 319031 - RNA, 22 nt, Human
aaagauuauggcauugaaauac

SEQ ID NO: 319032 - RNA, 22 nt, Human
gcagugccuugcuucucugucu

SEQ ID NO: 319033 - RNA, 22 nt, Human
aagcccagaugugagaacugag

SEQ ID NO: 319034 - RNA, 22 nt, Human
gauuucaccugaucuugucauc

SEQ ID NO: 319035 - RNA, 22 nt, Human
auaaggaaugauguaucaguuu

SEQ ID NO: 319036 - RNA, 22 nt, Human
uggcucugucacugugagcuau

SEQ ID NO: 319037 - RNA, 22 nt, Human
gagcaggcuugcagagaagggg

SEQ ID NO: 319038 - RNA, 22 nt, Human
agggcagcuaaggugcugacug

SEQ ID NO: 319039 - RNA, 22 nt, Human
aucauucuaguccuuauggucu

SEQ ID NO: 319040 - RNA, 22 nt, Human
ugcuagugcaggguuuucaguu

SEQ ID NO: 319041 - RNA, 22 nt, Human
aaaucaguaaauguucauuaac

SEQ ID NO: 319042 - RNA, 22 nt, Human
aucucagacauguuguccauga

SEQ ID NO: 319043 - RNA, 22 nt, Human
auuguggcuagacagucacaau

SEQ ID NO: 319044 - RNA, 22 nt, Human
agccuccaucccaugcacaaag

SEQ ID NO: 319045 - RNA, 22 nt, Human
ugugcccauuccacuugaguac

SEQ ID NO: 319046 - RNA, 22 nt, Human
acagaccaaguuuccagcaggu

SEQ ID NO: 319047 - RNA, 22 nt, Human
ugcuggaggccugacuguguuu

SEQ ID NO: 319048 - RNA, 22 nt, Human
auuucucuuagcaagacauuac

SEQ ID NO: 319049 - RNA, 22 nt, Human
uguaagauauucagcuuauuga

SEQ ID NO: 319050 - RNA, 22 nt, Human
ugagccaggcucaagugauccu

SEQ ID NO: 319051 - RNA, 18 nt, Human
uugagggaggggcagagu

SEQ ID NO: 319052 - RNA, 22 nt, Human
agcuggagaucaugcugauacu

SEQ ID NO: 319053 - RNA, 23 nt, Human
ugccucugccucccuagucugca

SEQ ID NO: 319054 - RNA, 22 nt, Human
cuggcagcgguuugcagccugg

SEQ ID NO: 319055 - RNA, 22 nt, Human
cagauaaaggcuuacuaguagu

SEQ ID NO: 319056 - RNA, 22 nt, Human
aaauuagucgguuuaggaauuu

SEQ ID NO: 319057 - RNA, 18 nt, Human
gcugagguggugucagag

SEQ ID NO: 319058 - RNA, 22 nt, Human
auggcagggcagccucucagag

SEQ ID NO: 319059 - RNA, 22 nt, Human
cagcccagcagggucuggcccu

SEQ ID NO: 319060 - RNA, 23 nt, Human
uggagcugacagucagagggagg

SEQ ID NO: 319061 - RNA, 22 nt, Human
ucuuagaaguucauguuccagc

SEQ ID NO: 319062 - RNA, 23 nt, Human
acacauuuuucccguucugaggu

SEQ ID NO: 319063 - RNA, 22 nt, Human
ccuuccagaguucagucugccc

SEQ ID NO: 319064 - RNA, 22 nt, Human
agcugcuaugacaacaccagcc

SEQ ID NO: 319065 - RNA, 22 nt, Human
caggugccucaggaugagacaa

SEQ ID NO: 319066 - RNA, 22 nt, Human
cgccucagccguggucaucuuc

SEQ ID NO: 319067 - RNA, 22 nt, Human
cauuucacaaauggccacauca

SEQ ID NO: 319068 - RNA, 22 nt, Human
ccuccaggcugaauaucuagaa

SEQ ID NO: 319069 - RNA, 22 nt, Human
cagaauggcuuuuauggcucag

SEQ ID NO: 319070 - RNA, 22 nt, Human
ccugccugcaccuucucugggg

SEQ ID NO: 319071 - RNA, 20 nt, Human
caguccugccccuuggggac

SEQ ID NO: 319072 - RNA, 22 nt, Human
cugagcugggaguagagacucu

SEQ ID NO: 319073 - RNA, 22 nt, Human
cucaaggaaagucuggagaaga

SEQ ID NO: 319074 - RNA, 22 nt, Human
aaucacaugugcucaauuuuaa

SEQ ID NO: 319075 - RNA, 20 nt, Human
agugugcauuuagagucugc

SEQ ID NO: 319076 - RNA, 22 nt, Human
gcaguguuuuacagaccagcau

SEQ ID NO: 319077 - RNA, 22 nt, Human
gaggaaaauggaguguaauuaa

SEQ ID NO: 319078 - RNA, 22 nt, Human
agugaguggacccugcaaggaa

SEQ ID NO: 319079 - RNA, 22 nt, Human
uggcacugccuggcagggcccc

SEQ ID NO: 319080 - RNA, 22 nt, Human
ucuuuccuagaggcugaugagu

SEQ ID NO: 319081 - RNA, 22 nt, Human
uuccuguaugucagugaagagc

SEQ ID NO: 319082 - RNA, 19 nt, Human
caguggccuggaggucucu

SEQ ID NO: 319083 - RNA, 21 nt, Human
agcuggcagauauggugucug

SEQ ID NO: 319084 - RNA, 22 nt, Human
ccucucauagucuguauccuuu

SEQ ID NO: 319085 - RNA, 22 nt, Human
ugggcuccggcggccucaggcu

SEQ ID NO: 319086 - RNA, 22 nt, Human
ugaccaaaggugguuuauuugg

SEQ ID NO: 319087 - RNA, 22 nt, Human
uagagaaaagcagggaucagga

SEQ ID NO: 319088 - RNA, 22 nt, Human
gaggccugaaaggggaccuaug

SEQ ID NO: 319089 - RNA, 18 nt, Human
acaaaggucugcaagacc

SEQ ID NO: 319090 - RNA, 22 nt, Human
augaagcuaaacccugcagcca

SEQ ID NO: 319091 - RNA, 20 nt, Human
uccaagggcagcagaaucag

SEQ ID NO: 319092 - RNA, 22 nt, Human
gcagauggaaagugcuugaggg

SEQ ID NO: 319093 - RNA, 22 nt, Human
caggcagcugaggacuuugcua

SEQ ID NO: 319094 - RNA, 22 nt, Human
ucuguggcacgauugcacugca

SEQ ID NO: 319095 - RNA, 22 nt, Human
ccaggcugggcggggaaccugg

SEQ ID NO: 319096 - RNA, 22 nt, Human
agugcagugguuaggagccagg

SEQ ID NO: 319097 - RNA, 22 nt, Human
ucuguucagaaauggaagugcc

SEQ ID NO: 319098 - RNA, 22 nt, Human
acugggccggugcagaguaguu

SEQ ID NO: 319099 - RNA, 22 nt, Human
aagaacagguucuagaaccauu

SEQ ID NO: 319100 - RNA, 22 nt, Human
caccagggacaaugcuaggggu

SEQ ID NO: 319101 - RNA, 22 nt, Human
ucagguguuagaagaaauuuca

SEQ ID NO: 319102 - RNA, 22 nt, Human
aucuuugaagaggacuugaagu

SEQ ID NO: 319103 - RNA, 22 nt, Human
uuuccuuccaaaugcccgggag

SEQ ID NO: 319104 - RNA, 21 nt, Human
ucucuggaauuagaccauguu

SEQ ID NO: 319105 - RNA, 22 nt, Human
uccugagaugagacagugcugc

SEQ ID NO: 319106 - RNA, 22 nt, Human
ggcuggagauaugucuggaaca

SEQ ID NO: 319107 - RNA, 22 nt, Human
agggcagcacagcugugcuccu

SEQ ID NO: 319108 - RNA, 22 nt, Human
cagugcuggcuguuaggacagu

SEQ ID NO: 319109 - RNA, 22 nt, Human
aggcccagcccguccucgugcu

SEQ ID NO: 319110 - RNA, 22 nt, Human
uaugagaacugacagagugcca

SEQ ID NO: 319111 - RNA, 22 nt, Human
accaaggagacaaagguguauu

SEQ ID NO: 319112 - RNA, 22 nt, Human
agggucccgaaggagacagcaa

SEQ ID NO: 319113 - RNA, 18 nt, Human
ucugucucuguccuugcu

SEQ ID NO: 319114 - RNA, 22 nt, Human
uuuccuguugccaucaagaaug

SEQ ID NO: 319115 - RNA, 22 nt, Human
aaaugcagauugucauucagga

SEQ ID NO: 319116 - RNA, 22 nt, Human
agacccagaaagcagcugcauu

SEQ ID NO: 319117 - RNA, 22 nt, Human
gggaggucagggugccugcugg

SEQ ID NO: 319118 - RNA, 22 nt, Human
aguaaaauuaauggaucagaag

SEQ ID NO: 319119 - RNA, 22 nt, Human
guguacauauugagucugcuga

SEQ ID NO: 319120 - RNA, 22 nt, Human
cagcugccaugacauguccugc

SEQ ID NO: 319121 - RNA, 22 nt, Human
augguuuguaacccaauacucc

SEQ ID NO: 319122 - RNA, 19 nt, Human
cagcaauaaugccagaugg

SEQ ID NO: 319123 - RNA, 22 nt, Human
agaggcugagaaacccucuucu

SEQ ID NO: 319124 - RNA, 22 nt, Human
gcagagugaggaagagcuucca

SEQ ID NO: 319125 - RNA, 23 nt, Human
uuuuccuguggagacaugacugg

SEQ ID NO: 319126 - RNA, 22 nt, Human
cggcagcuccgcgccguaggac

SEQ ID NO: 319127 - RNA, 22 nt, Human
uccuggguccauggcagccgaa

SEQ ID NO: 319128 - RNA, 22 nt, Human
cagggcuccccgcaccgcagcc

SEQ ID NO: 319129 - RNA, 22 nt, Human
caagaugggcaccccagcaccu

SEQ ID NO: 319130 - RNA, 22 nt, Human
gcugucugucucugugacuuaa

SEQ ID NO: 319131 - RNA, 22 nt, Human
acugcuuuagaccuagagcucu

SEQ ID NO: 319132 - RNA, 20 nt, Human
uuuacauuuugaaacaguga

SEQ ID NO: 319133 - RNA, 22 nt, Human
agggcugcugaggaagccuugc

SEQ ID NO: 319134 - RNA, 22 nt, Human
gcagugcuaaguagcuggccca

SEQ ID NO: 319135 - RNA, 22 nt, Human
ucucuucuagcuucuugugguu

SEQ ID NO: 319136 - RNA, 22 nt, Human
uuagaaaaauguucaguaguuu

SEQ ID NO: 319137 - RNA, 22 nt, Human
gguggguuuggaagagcaggcu

SEQ ID NO: 319138 - RNA, 22 nt, Human
ccugccugucaucgccugcgcc

SEQ ID NO: 319139 - RNA, 22 nt, Human
ucaggauggcuucugcaucaaa

SEQ ID NO: 319140 - RNA, 22 nt, Human
aaggagaaggguaaucaacaca

SEQ ID NO: 319141 - RNA, 22 nt, Human
acaagcaugggcuuugacauca

SEQ ID NO: 319142 - RNA, 22 nt, Human
gggcagagguucaacuucaaca

SEQ ID NO: 319143 - RNA, 22 nt, Human
uccagcagggaauuaguagucu

SEQ ID NO: 319144 - RNA, 22 nt, Human
gcuggucacucugggagcugcu

SEQ ID NO: 319145 - RNA, 22 nt, Human
uccugccuucauacugcuguau

SEQ ID NO: 319146 - RNA, 19 nt, Human
gagcagcugcacccauuga

SEQ ID NO: 319147 - RNA, 22 nt, Human
aaggcaguagguguuucaaacu

SEQ ID NO: 319148 - RNA, 22 nt, Human
auuugcuuucagguauaaaagg

SEQ ID NO: 319149 - RNA, 22 nt, Human
acacugaauguuuaagaacuug

SEQ ID NO: 319150 - RNA, 22 nt, Human
agcagaacauuuucagggcugu

SEQ ID NO: 319151 - RNA, 22 nt, Human
cagagccucccuccucugccau

SEQ ID NO: 319152 - RNA, 22 nt, Human
cuggccuagcucucugcuugaa

SEQ ID NO: 319153 - RNA, 22 nt, Human
uuauuucauugauuucuaagac

SEQ ID NO: 319154 - RNA, 22 nt, Human
gggccuguguguucaggagccu

SEQ ID NO: 319155 - RNA, 22 nt, Human
uccuuggcuuucuggagcuucu

SEQ ID NO: 319156 - RNA, 22 nt, Human
auuuugaugcuaucuaaugaau

SEQ ID NO: 319157 - RNA, 22 nt, Human
gagcugccggcccacaguacua

SEQ ID NO: 319158 - RNA, 22 nt, Human
uggagcugauacagcuggcuuu

SEQ ID NO: 319159 - RNA, 22 nt, Human
gggcugugcugaguaggaggug

SEQ ID NO: 319160 - RNA, 22 nt, Human
uagcaggguccaaugugaggca

SEQ ID NO: 319161 - RNA, 22 nt, Human
guaucuuuuacaccaggaaauu

SEQ ID NO: 319162 - RNA, 20 nt, Human
ugucaugcauuagaugaaga

SEQ ID NO: 319163 - RNA, 21 nt, Human
uuuuuucuugcgugaggccug

SEQ ID NO: 319164 - RNA, 22 nt, Human
aucacauucuuucaaagcaguc

SEQ ID NO: 319165 - RNA, 22 nt, Human
acuuugaaggggaacauuuuaa

SEQ ID NO: 319166 - RNA, 22 nt, Human
ucugaaauacugcagguucucu

SEQ ID NO: 319167 - RNA, 22 nt, Human
gguggggccugcuccagcggcc

SEQ ID NO: 319168 - RNA, 22 nt, Human
cuccagggcagcauggcagugg

SEQ ID NO: 319169 - RNA, 22 nt, Human
cguuggagacacuugaggacuu

SEQ ID NO: 319170 - RNA, 23 nt, Human
ucuguacaauugagaagagaaca

SEQ ID NO: 319171 - RNA, 22 nt, Human
aggcccagacucagcggggcgg

SEQ ID NO: 319172 - RNA, 22 nt, Human
uuaauacaagcauaugcacaca

SEQ ID NO: 319173 - RNA, 22 nt, Human
gggauggcuuuguggcugacuc

SEQ ID NO: 319174 - RNA, 19 nt, Human
uuuggcacucugaaguguu

SEQ ID NO: 319175 - RNA, 22 nt, Human
ucaugcaaggcugaaacauggu

SEQ ID NO: 319176 - RNA, 23 nt, Human
agagcuuucuaaaauguaaaucu

SEQ ID NO: 319177 - RNA, 22 nt, Human
cuuuggaagugaccacaauccu

SEQ ID NO: 319178 - RNA, 22 nt, Human
cucaggcccacagcagacccac

SEQ ID NO: 319179 - RNA, 22 nt, Human
aaauccuaaggagaauaugauu

SEQ ID NO: 319180 - RNA, 22 nt, Human
auucuucagaauaucuggcacu

SEQ ID NO: 319181 - RNA, 22 nt, Human
acagggcagguggcuacugguc

SEQ ID NO: 319182 - RNA, 22 nt, Human
cuguggagcuuguggcaguggg

SEQ ID NO: 319183 - RNA, 22 nt, Human
gugacucacacaggccugggcu

SEQ ID NO: 319184 - RNA, 22 nt, Human
uccuucagccaugggcucucca

SEQ ID NO: 319185 - RNA, 22 nt, Human
aaaacaguuuaggcaucacagu

SEQ ID NO: 319186 - RNA, 22 nt, Human
gccuggagacagcagaggcggc

SEQ ID NO: 319187 - RNA, 22 nt, Human
agacagagauacuauguuguca

SEQ ID NO: 319188 - RNA, 22 nt, Human
acauuugagaugccuuuuaggu

SEQ ID NO: 319189 - RNA, 22 nt, Human
ucucccaggcugcccuguggac

SEQ ID NO: 319190 - RNA, 22 nt, Human
ucauucuugaucacuaguuagu

SEQ ID NO: 319191 - RNA, 22 nt, Human
acaguguuuauguacagauugu

SEQ ID NO: 319192 - RNA, 22 nt, Human
cuucagaauccagaaucagaau

SEQ ID NO: 319193 - RNA, 22 nt, Human
cagggccugagggcugcucugc

SEQ ID NO: 319194 - RNA, 22 nt, Human
gcuguucaaaagccacaguuac

SEQ ID NO: 319195 - RNA, 22 nt, Human
uggccagguugggcuuugcagc

SEQ ID NO: 319196 - RNA, 22 nt, Human
agccaucauuucugucacuggc

SEQ ID NO: 319197 - RNA, 22 nt, Human
gagccagccuucuucugagguc

SEQ ID NO: 319198 - RNA, 22 nt, Human
cugcugagcccuggcacaggug

SEQ ID NO: 319199 - RNA, 22 nt, Human
aauucuguuacuaaugugaugu

SEQ ID NO: 319200 - RNA, 22 nt, Human
ucaagcaucuuggucuacgauc

SEQ ID NO: 319201 - RNA, 22 nt, Human
auaaugaggauuugcauauuag

SEQ ID NO: 319202 - RNA, 22 nt, Human
uccaggagagguguggggacug

SEQ ID NO: 319203 - RNA, 22 nt, Human
cugccuugaaaaugaagcuuua

SEQ ID NO: 319204 - RNA, 22 nt, Human
uucaugugauaaaugugugacu

SEQ ID NO: 319205 - RNA, 22 nt, Human
gccgaagcugccgucugguccu

SEQ ID NO: 319206 - RNA, 22 nt, Human
auuuggcaacauuaauugaauc

SEQ ID NO: 319207 - RNA, 22 nt, Human
agaguggggaagguguugagaa

SEQ ID NO: 319208 - RNA, 22 nt, Human
uacuuuagaaggaaauaaguuc

SEQ ID NO: 319209 - RNA, 22 nt, Human
cagccacguagcccuuggccgu

SEQ ID NO: 319210 - RNA, 21 nt, Human
cccuugccugcacuccucggc

SEQ ID NO: 319211 - RNA, 22 nt, Human
cagugcugagagccuggccagg

SEQ ID NO: 319212 - RNA, 22 nt, Human
ccaggugggaggaaagcagaga

SEQ ID NO: 319213 - RNA, 22 nt, Human
agugaggggauucaggcaaggu

SEQ ID NO: 319214 - RNA, 22 nt, Human
ucuucuuccucauuuauacaua

SEQ ID NO: 319215 - RNA, 22 nt, Human
aaguucaaggcucuagaguucc

SEQ ID NO: 319216 - RNA, 22 nt, Human
ggagcuggcuacagagaacucc

SEQ ID NO: 319217 - RNA, 22 nt, Human
gagaggccaaaaucccugcccc

SEQ ID NO: 319218 - RNA, 22 nt, Human
ucaaaagucugcauucuucaca

SEQ ID NO: 319219 - RNA, 22 nt, Human
gagcucauccccaugguccguc

SEQ ID NO: 319220 - RNA, 22 nt, Human
aagccagggauuccugagggag

SEQ ID NO: 319221 - RNA, 22 nt, Human
ucaaguguaguggugucagguc

SEQ ID NO: 319222 - RNA, 22 nt, Human
agcccagcaaagggagguucag

SEQ ID NO: 319223 - RNA, 22 nt, Human
aaagcaguauauugguaguugu

SEQ ID NO: 319224 - RNA, 22 nt, Human
gaggcugaggguuagagaguca

SEQ ID NO: 319225 - RNA, 22 nt, Human
ccagggcaaaugagaucauagc

SEQ ID NO: 319226 - RNA, 22 nt, Human
uucacauuagugguucuauaua

SEQ ID NO: 319227 - RNA, 22 nt, Human
caguggugaagagcaggggcuc

SEQ ID NO: 319228 - RNA, 22 nt, Human
gcugccuuuuaaagccucgcuu

SEQ ID NO: 319229 - RNA, 22 nt, Human
uuagauaaauugcaacuugauu

SEQ ID NO: 319230 - RNA, 22 nt, Human
ggcagcuggggcagugcccugu

SEQ ID NO: 319231 - RNA, 18 nt, Human
caggucugucugccuccc

SEQ ID NO: 319232 - RNA, 22 nt, Human
cagcugagcaucacuagucugg

SEQ ID NO: 319233 - RNA, 22 nt, Human
aacagaaaucauuuagggcucu

SEQ ID NO: 319234 - RNA, 20 nt, Human
cccucccagaugcuucccaa

SEQ ID NO: 319235 - RNA, 22 nt, Human
uuugacagauccuuaacucagc

SEQ ID NO: 319236 - RNA, 22 nt, Human
gccuggagaccugcuccucuac

SEQ ID NO: 319237 - RNA, 20 nt, Human
cuucuucauuaacccuacug

SEQ ID NO: 319238 - RNA, 22 nt, Human
ccaguguuuccccagaagagag

SEQ ID NO: 319239 - RNA, 22 nt, Human
agcugccaggccccugagaacc

SEQ ID NO: 319240 - RNA, 22 nt, Human
ccugggagggcaagugcugaug

SEQ ID NO: 319241 - RNA, 22 nt, Human
gggggcuggaauauccaucaac

SEQ ID NO: 319242 - RNA, 22 nt, Human
ccagguggaggugugagguccu

SEQ ID NO: 319243 - RNA, 22 nt, Human
ugcaucuuacguuuugaaaggg

SEQ ID NO: 319244 - RNA, 22 nt, Human
caagaugugccuaaucagaccu

SEQ ID NO: 319245 - RNA, 22 nt, Human
gccuggcaggccucaugagggg

SEQ ID NO: 319246 - RNA, 22 nt, Human
auaaauaucacuguugucccuc

SEQ ID NO: 319247 - RNA, 22 nt, Human
ugccugcuaggcccugcugggu

SEQ ID NO: 319248 - RNA, 18 nt, Human
acugugugaauuagcucc

SEQ ID NO: 319249 - RNA, 22 nt, Human
cagcuggcagaaccugcaucca

SEQ ID NO: 319250 - RNA, 22 nt, Human
cagggccagcgucucgggcuau

SEQ ID NO: 319251 - RNA, 22 nt, Human
cuuagaaauaaugguuucaguu

SEQ ID NO: 319252 - RNA, 22 nt, Human
gcagcaggcacggucucgacau

SEQ ID NO: 319253 - RNA, 23 nt, Human
uggcucuguggaucccucaggag

SEQ ID NO: 319254 - RNA, 22 nt, Human
gggagcugagcuggaagagaau

SEQ ID NO: 319255 - RNA, 19 nt, Human
agccuggagggcuggucac

SEQ ID NO: 319256 - RNA, 22 nt, Human
gcaccacaucaaugaggggagc

SEQ ID NO: 319257 - RNA, 22 nt, Human
cugucugcuagaacaucuauac

SEQ ID NO: 319258 - RNA, 22 nt, Human
gugcauuuaggucacaugaugu

SEQ ID NO: 319259 - RNA, 22 nt, Human
guuugcauuuauuagucuucug

SEQ ID NO: 319260 - RNA, 22 nt, Human
gaauguaauagucaguagaaca

SEQ ID NO: 319261 - RNA, 22 nt, Human
aguuacuugagacguuuaugaa

SEQ ID NO: 319262 - RNA, 22 nt, Human
aaaugcuugcucuugauuauuu

SEQ ID NO: 319263 - RNA, 22 nt, Human
uguaugaagacuucuucugugu

SEQ ID NO: 319264 - RNA, 21 nt, Human
ccugggccaaauucccuggac

SEQ ID NO: 319265 - RNA, 22 nt, Human
uccuucaguuaaagaucucaca

SEQ ID NO: 319266 - RNA, 22 nt, Human
aaacucugaugcuuauugggaa

SEQ ID NO: 319267 - RNA, 22 nt, Human
uuggaggacuaguuaagagacc

SEQ ID NO: 319268 - RNA, 22 nt, Human
ggauggagaugaccauggugac

SEQ ID NO: 319269 - RNA, 22 nt, Human
uuccaguugguagaauguaagg

SEQ ID NO: 319270 - RNA, 22 nt, Human
ggcagcugggucacaccgaucu

SEQ ID NO: 319271 - RNA, 22 nt, Human
aagagagagcauucuucuguua

SEQ ID NO: 319272 - RNA, 22 nt, Human
cacaugggugugccuggaggaa

SEQ ID NO: 319273 - RNA, 22 nt, Human
acccuggggguggccagugcca

SEQ ID NO: 319274 - RNA, 22 nt, Human
acauuucuaauuuaauguaaca

SEQ ID NO: 319275 - RNA, 22 nt, Human
gugcccugguccccagcauaua

SEQ ID NO: 319276 - RNA, 21 nt, Human
agagccugagaucuuccagca

SEQ ID NO: 319277 - RNA, 22 nt, Human
cagccaggccuggugaccaaag

SEQ ID NO: 319278 - RNA, 20 nt, Human
ucucaggccccaguuuucuu

SEQ ID NO: 319279 - RNA, 22 nt, Human
auagcuguuagauuggggucga

SEQ ID NO: 319280 - RNA, 22 nt, Human
ggcuuggaccagucacaguggu

SEQ ID NO: 319281 - RNA, 22 nt, Human
accaucaguacuggaugcugac

SEQ ID NO: 319282 - RNA, 22 nt, Human
agggcagagagaugaaugggau

SEQ ID NO: 319283 - RNA, 22 nt, Human
ccagccugguucagaauuggcu

SEQ ID NO: 319284 - RNA, 22 nt, Human
caggcagcucgaugccuuguug

SEQ ID NO: 319285 - RNA, 22 nt, Human
cagaggccuuucuacagugaua

SEQ ID NO: 319286 - RNA, 22 nt, Human
acauguaaaaggaacaugcaug

SEQ ID NO: 319287 - RNA, 22 nt, Human
aacaguaucuuuuaucagaaau

SEQ ID NO: 319288 - RNA, 22 nt, Human
ggaggcucugcuccguguguuc

SEQ ID NO: 319289 - RNA, 22 nt, Human
uuuugaaagaguccugcuacag

SEQ ID NO: 319290 - RNA, 20 nt, Human
gcuuuuucuaauagcagucc

SEQ ID NO: 319291 - RNA, 22 nt, Human
auugaaagauaggcuacugugg

SEQ ID NO: 319292 - RNA, 22 nt, Human
uucagugugugauaccugcugu

SEQ ID NO: 319293 - RNA, 22 nt, Human
gccuggagaagauggaacuagc

SEQ ID NO: 319294 - RNA, 22 nt, Human
cuauugaauagcccaaaucauu

SEQ ID NO: 319295 - RNA, 22 nt, Human
uugaagcauuugcuauagcauu

SEQ ID NO: 319296 - RNA, 22 nt, Human
gucaugccagcggagcucggga

SEQ ID NO: 319297 - RNA, 22 nt, Human
aaggcacucauucaaggagaua

SEQ ID NO: 319298 - RNA, 22 nt, Human
ugggaggcagguaggugaugau

SEQ ID NO: 319299 - RNA, 22 nt, Human
auuccuuggaacagaugcgaag

SEQ ID NO: 319300 - RNA, 17 nt, Human
aggcugcugggccaggg

SEQ ID NO: 319301 - RNA, 22 nt, Human
ucacugaauacuugucucaucc

SEQ ID NO: 319302 - RNA, 22 nt, Human
uggcagagagacucuccuugau

SEQ ID NO: 319303 - RNA, 21 nt, Human
gauuucacuuaccuucauuua

SEQ ID NO: 319304 - RNA, 22 nt, Human
agccuggauccuaggcucagcu

SEQ ID NO: 319305 - RNA, 22 nt, Human
cuggaaauuggagaugauguuu

SEQ ID NO: 319306 - RNA, 22 nt, Human
gcugcuccgucugagcucuggu

SEQ ID NO: 319307 - RNA, 22 nt, Human
ucauuucaaguucugacagcua

SEQ ID NO: 319308 - RNA, 22 nt, Human
caugaaaauaacauuguuguga

SEQ ID NO: 319309 - RNA, 20 nt, Human
acaaaauagguacuggguag

SEQ ID NO: 319310 - RNA, 22 nt, Human
agagauuacagcaggguccagc

SEQ ID NO: 319311 - RNA, 22 nt, Human
ucucagagaacaguuggugcuu

SEQ ID NO: 319312 - RNA, 22 nt, Human
uuucaaauagaaucuuuccaaa

SEQ ID NO: 319313 - RNA, 22 nt, Human
ccacacagucaguuuccaagaa

SEQ ID NO: 319314 - RNA, 22 nt, Human
ggccucuguuuggagccaggau

SEQ ID NO: 319315 - RNA, 22 nt, Human
cugagcuuccaguuccuccagg

SEQ ID NO: 319316 - RNA, 21 nt, Human
auacuuugaauuacagccuug

SEQ ID NO: 319317 - RNA, 22 nt, Human
guacuuccagccaagugagaca

SEQ ID NO: 319318 - RNA, 22 nt, Human
aguuuuucuccccuggcuucau

SEQ ID NO: 319319 - RNA, 22 nt, Human
ucucaggaguagugggauccau

SEQ ID NO: 319320 - RNA, 22 nt, Human
guccuggcuuaguucgcuguaa

SEQ ID NO: 319321 - RNA, 21 nt, Human
acagagccgggcacaaagcug

SEQ ID NO: 319322 - RNA, 22 nt, Human
gcccaggcuggagugcaguagc

SEQ ID NO: 319323 - RNA, 23 nt, Human
aaaguguagccagguuaagaacc

SEQ ID NO: 319324 - RNA, 22 nt, Human
auguagaauggugauuggcagg

SEQ ID NO: 319325 - RNA, 22 nt, Human
agcagcuggggccugugacgau

SEQ ID NO: 319326 - RNA, 22 nt, Human
guggcuucugcggugugcgcag

SEQ ID NO: 319327 - RNA, 22 nt, Human
uuucucuaaauagggaggcuua

SEQ ID NO: 319328 - RNA, 22 nt, Human
cucugcaacuucuagcaguguc

SEQ ID NO: 319329 - RNA, 22 nt, Human
auaacagaugugaagugcuaau

SEQ ID NO: 319330 - RNA, 22 nt, Human
cagcagugugcaggugugcugg

SEQ ID NO: 319331 - RNA, 22 nt, Human
cccagcauuucugggcugcacu

SEQ ID NO: 319332 - RNA, 22 nt, Human
uagcuuuccuuguugccugugc

SEQ ID NO: 319333 - RNA, 22 nt, Human
uuucucaguucucugcaaggag

SEQ ID NO: 319334 - RNA, 22 nt, Human
uguaggccuauguccagcaauu

SEQ ID NO: 319335 - RNA, 22 nt, Human
uacauacacaaauauacuguuu

SEQ ID NO: 319336 - RNA, 22 nt, Human
caauauucaguggaaaagccau

SEQ ID NO: 319337 - RNA, 22 nt, Human
gugagcaggauuucauggugua

SEQ ID NO: 319338 - RNA, 22 nt, Human
ccucuccaguuuuaacgugacc

SEQ ID NO: 319339 - RNA, 22 nt, Human
aacugcuguggccuaguacuua

SEQ ID NO: 319340 - RNA, 18 nt, Human
uacaugcauaaaugaagc

SEQ ID NO: 319341 - RNA, 22 nt, Human
ucccacucccaggcaggccucu

SEQ ID NO: 319342 - RNA, 20 nt, Human
uaacuuucuaugcuuucagc

SEQ ID NO: 319343 - RNA, 22 nt, Human
uggaagccaggcccgcuccuaa

SEQ ID NO: 319344 - RNA, 22 nt, Human
agguuauaugucauacugaagu

SEQ ID NO: 319345 - RNA, 22 nt, Human
aggccugggucucgugccuacc

SEQ ID NO: 319346 - RNA, 22 nt, Human
aaaugcauuuuuaauuagaccc

SEQ ID NO: 319347 - RNA, 22 nt, Human
gcugggagccccgagccagcgc

SEQ ID NO: 319348 - RNA, 22 nt, Human
aagauucucagagugaaagaau

SEQ ID NO: 319349 - RNA, 22 nt, Human
gaggccuggaccagccacagag

SEQ ID NO: 319350 - RNA, 22 nt, Human
cagugucuuauuuguagcucag

SEQ ID NO: 319351 - RNA, 22 nt, Human
agguggggccaaaugcuacagu

SEQ ID NO: 319352 - RNA, 22 nt, Human
uguaugaaguuacugagccucu

SEQ ID NO: 319353 - RNA, 22 nt, Human
auaaguucagguaaagaaauca

SEQ ID NO: 319354 - RNA, 22 nt, Human
augauauuugcaaugugcuugc

SEQ ID NO: 319355 - RNA, 18 nt, Human
aggagccuuugcacugga

SEQ ID NO: 319356 - RNA, 22 nt, Human
ucuggcucaggagcuguguuca

SEQ ID NO: 319357 - RNA, 22 nt, Human
ugcagggcccuugggguugaac

SEQ ID NO: 319358 - RNA, 18 nt, Human
ccugagcccugcuuacuu

SEQ ID NO: 319359 - RNA, 22 nt, Human
uaaguaaauuuauaaugugauu

SEQ ID NO: 319360 - RNA, 23 nt, Human
ugcuucucugcuugacaguucug

SEQ ID NO: 319361 - RNA, 22 nt, Human
uagcauuuauggucaugugucc

SEQ ID NO: 319362 - RNA, 22 nt, Human
caggcagccuucucgucucaca

SEQ ID NO: 319363 - RNA, 22 nt, Human
gcagcccagguguagcucuuug

SEQ ID NO: 319364 - RNA, 22 nt, Human
gcagcugauggaaguccuauug

SEQ ID NO: 319365 - RNA, 22 nt, Human
agagguagagguugcagugagc

SEQ ID NO: 319366 - RNA, 19 nt, Human
ucuaacagaagugucgucc

SEQ ID NO: 319367 - RNA, 22 nt, Human
gaaguucuuugcuccccaguac

SEQ ID NO: 319368 - RNA, 22 nt, Human
aucaguuuuguucacuacuaua

SEQ ID NO: 319369 - RNA, 22 nt, Human
cuuuccaaugcauuuccaaugu

SEQ ID NO: 319370 - RNA, 22 nt, Human
cgcugccaggauccccugccgg

SEQ ID NO: 319371 - RNA, 22 nt, Human
gcccuggaaucucuccauggga

SEQ ID NO: 319372 - RNA, 22 nt, Human
ccuucuucuguguggcccaaga

SEQ ID NO: 319373 - RNA, 22 nt, Human
gucuauauauugcuugaauaau

SEQ ID NO: 319374 - RNA, 22 nt, Human
guaaaucccauccuuucucugg

SEQ ID NO: 319375 - RNA, 20 nt, Human
gugcuucagaagccauugcu

SEQ ID NO: 319376 - RNA, 22 nt, Human
uugaauaguuuuggauagcaua

SEQ ID NO: 319377 - RNA, 22 nt, Human
aggagaaggaagugcaucacua

SEQ ID NO: 319378 - RNA, 22 nt, Human
agaaugcaagauaaacuuuauu

SEQ ID NO: 319379 - RNA, 22 nt, Human
uacaaagucacauugaaaugaa

SEQ ID NO: 319380 - RNA, 22 nt, Human
aggugccagaugcacagcugaa

SEQ ID NO: 319381 - RNA, 22 nt, Human
gggaagggagggaccucagucu

SEQ ID NO: 319382 - RNA, 22 nt, Human
aaagaucagucugaagcaacau

SEQ ID NO: 319383 - RNA, 22 nt, Human
gucucccacuuucuggccucuu

SEQ ID NO: 319384 - RNA, 22 nt, Human
agcagcugagccccagcuguga

SEQ ID NO: 319385 - RNA, 22 nt, Human
cuacauuuuaauaagcugcuua

SEQ ID NO: 319386 - RNA, 22 nt, Human
agugaaaugauaguguaaauac

SEQ ID NO: 319387 - RNA, 22 nt, Human
gcaaaugcucuccuuggucagg

SEQ ID NO: 319388 - RNA, 18 nt, Human
ucacagugcucuugccua

SEQ ID NO: 319389 - RNA, 22 nt, Human
agagcuggagaugcagguuucg

SEQ ID NO: 319390 - RNA, 22 nt, Human
aggccugaggaccagauaaaug

SEQ ID NO: 319391 - RNA, 22 nt, Human
uaaauucugaucaaguuccuuc

SEQ ID NO: 319392 - RNA, 22 nt, Human
cccugccuugggguccacaccg

SEQ ID NO: 319393 - RNA, 22 nt, Human
agcagccaaaugaagauuuuac

SEQ ID NO: 319394 - RNA, 22 nt, Human
gaggcaggguguugauuacaga

SEQ ID NO: 319395 - RNA, 22 nt, Human
aucuggcucgcuaggcucuggg

SEQ ID NO: 319396 - RNA, 22 nt, Human
uauuucaugugcaccauaauuc

SEQ ID NO: 319397 - RNA, 22 nt, Human
uccaguccagggaauggcugau

SEQ ID NO: 319398 - RNA, 22 nt, Human
aggcugagauagguggaucauu

SEQ ID NO: 319399 - RNA, 22 nt, Human
gagacagaguuucacucuuguu

SEQ ID NO: 319400 - RNA, 22 nt, Human
cacagcuucugagugaggauuu

SEQ ID NO: 319401 - RNA, 22 nt, Human
ccaguguuuaggaauaaaaugu

SEQ ID NO: 319402 - RNA, 19 nt, Human
agcuccuguucagcagcuc

SEQ ID NO: 319403 - RNA, 22 nt, Human
uuugcauugccucugacuuaug

SEQ ID NO: 319404 - RNA, 22 nt, Human
auauuguugacuauaagaguaa

SEQ ID NO: 319405 - RNA, 22 nt, Human
gugccugguuuggggaauguuc

SEQ ID NO: 319406 - RNA, 22 nt, Human
ccaucagcaugggagcaugggc

SEQ ID NO: 319407 - RNA, 22 nt, Human
auucucaaacaagugguuugau

SEQ ID NO: 319408 - RNA, 22 nt, Human
aggcccaguagucgacggcgcu

SEQ ID NO: 319409 - RNA, 22 nt, Human
aggaggccgcugaugggcuccc

SEQ ID NO: 319410 - RNA, 22 nt, Human
aaucaguuaaauauugaguaca

SEQ ID NO: 319411 - RNA, 22 nt, Human
agcccccaaaagugcuuaugau

SEQ ID NO: 319412 - RNA, 22 nt, Human
ggcccugugguuuugcaaaguc

SEQ ID NO: 319413 - RNA, 22 nt, Human
ccugggcaucucaugcaccugc

SEQ ID NO: 319414 - RNA, 22 nt, Human
ggccuggccuccagaugugggc

SEQ ID NO: 319415 - RNA, 22 nt, Human
aucuggcuauuucuggucgggg

SEQ ID NO: 319416 - RNA, 22 nt, Human
ugcugcucuucaccauggccuc

SEQ ID NO: 319417 - RNA, 22 nt, Human
uaauuccaaguugagacaugca

SEQ ID NO: 319418 - RNA, 22 nt, Human
gcagcaugagcuauacaaagua

SEQ ID NO: 319419 - RNA, 22 nt, Human
aaucuuagguuuggcuucaucu

SEQ ID NO: 319420 - RNA, 22 nt, Human
caggcucagcaggagccugacc

SEQ ID NO: 319421 - RNA, 22 nt, Human
aggcuuccuggaggaagaggua

SEQ ID NO: 319422 - RNA, 22 nt, Human
aaaaaguuucaacugccaacuc

SEQ ID NO: 319423 - RNA, 22 nt, Human
ccuggcagcuguuuggcuuggc

SEQ ID NO: 319424 - RNA, 22 nt, Human
uuucaagcauaacugggaagag

SEQ ID NO: 319425 - RNA, 22 nt, Human
aagcaaaagguuacacuucugg

SEQ ID NO: 319426 - RNA, 22 nt, Human
gagcagcuagauaaagcccuuc

SEQ ID NO: 319427 - RNA, 22 nt, Human
ugagggaguuggguguauagga

SEQ ID NO: 319428 - RNA, 18 nt, Human
uuccauaauguauguaac

SEQ ID NO: 319429 - RNA, 22 nt, Human
aaguuauaucaucucauugacg

SEQ ID NO: 319430 - RNA, 22 nt, Human
aaugagaagccuagguguacug

SEQ ID NO: 319431 - RNA, 22 nt, Human
ucccagcagagccagcaagccg

SEQ ID NO: 319432 - RNA, 22 nt, Human
agcagcugaccagugaguccug

SEQ ID NO: 319433 - RNA, 22 nt, Human
aaaagaugaaauggugucuugg

SEQ ID NO: 319434 - RNA, 22 nt, Human
ucauuugugugagugauuugac

SEQ ID NO: 319435 - RNA, 18 nt, Human
guccugagcucugcugua

SEQ ID NO: 319436 - RNA, 22 nt, Human
gaggagaaauuuggggaccuga

SEQ ID NO: 319437 - RNA, 22 nt, Human
gaaaucugucuuuguuugaaua

SEQ ID NO: 319438 - RNA, 22 nt, Human
aggcccaguagugcugccuuua

SEQ ID NO: 319439 - RNA, 22 nt, Human
ccaggcugugguuuagauagag

SEQ ID NO: 319440 - RNA, 22 nt, Human
gucaaguuuauccgcucauuca

SEQ ID NO: 319441 - RNA, 22 nt, Human
cagcccugcagagggcgcuccu

SEQ ID NO: 319442 - RNA, 22 nt, Human
uuggcagggccaggcucucucu

SEQ ID NO: 319443 - RNA, 22 nt, Human
cugaaggacuuggugauaguug

SEQ ID NO: 319444 - RNA, 22 nt, Human
aaugaugggaaggagaaaagca

SEQ ID NO: 319445 - RNA, 22 nt, Human
uaucuguuccaggcacucagcu

SEQ ID NO: 319446 - RNA, 22 nt, Human
gccagcuggagugagagugggc

SEQ ID NO: 319447 - RNA, 22 nt, Human
uggcucucaggccugcugcguu

SEQ ID NO: 319448 - RNA, 22 nt, Human
agugaaauuccuggucuuuguu

SEQ ID NO: 319449 - RNA, 17 nt, Human
agccccucagcgucacc

SEQ ID NO: 319450 - RNA, 22 nt, Human
uucccucuccuacucaggaaag

SEQ ID NO: 319451 - RNA, 22 nt, Human
guacauuucauuuaaaugaugu

SEQ ID NO: 319452 - RNA, 22 nt, Human
cagugcugugcuggaagcuguu

SEQ ID NO: 319453 - RNA, 22 nt, Human
ugcaguggaagagguggagauc

SEQ ID NO: 319454 - RNA, 22 nt, Human
ggcugccaggagggaggccagu

SEQ ID NO: 319455 - RNA, 22 nt, Human
ucacagaaauaagauaguuauu

SEQ ID NO: 319456 - RNA, 22 nt, Human
ugaugggaaaaugaggccuggg

SEQ ID NO: 319457 - RNA, 22 nt, Human
cacaauguauauguauaucaaa

SEQ ID NO: 319458 - RNA, 22 nt, Human
cucuuaguuuaucuuugacaaa

SEQ ID NO: 319459 - RNA, 21 nt, Human
ccagaggccucucuuggccac

SEQ ID NO: 319460 - RNA, 22 nt, Human
uugcuucaguagcucuuuaaag

SEQ ID NO: 319461 - RNA, 22 nt, Human
cauggcagaaaccugagcugcu

SEQ ID NO: 319462 - RNA, 22 nt, Human
aacagaaugcaggggaugcugc

SEQ ID NO: 319463 - RNA, 21 nt, Human
acacaaaccuccucagccugg

SEQ ID NO: 319464 - RNA, 22 nt, Human
aggccuggugugccggaugcag

SEQ ID NO: 319465 - RNA, 22 nt, Human
gaguuguucaacgugugugaaa

SEQ ID NO: 319466 - RNA, 20 nt, Human
ccugggcuccaggagccccg

SEQ ID NO: 319467 - RNA, 22 nt, Human
ggcacagagcccagcuuccuag

SEQ ID NO: 319468 - RNA, 22 nt, Human
uuugcauugcauacaaggaacu

SEQ ID NO: 319469 - RNA, 22 nt, Human
uuccugggguacuggagaaaau

SEQ ID NO: 319470 - RNA, 22 nt, Human
acacagggcaaugcuuugaccu

SEQ ID NO: 319471 - RNA, 22 nt, Human
uaacacauaagcugagaccaug

SEQ ID NO: 319472 - RNA, 22 nt, Human
aagauuuccauuucuagcucau

SEQ ID NO: 319473 - RNA, 22 nt, Human
agaugcuucaguguuuaauuua

SEQ ID NO: 319474 - RNA, 22 nt, Human
ucagcuuuugucagaaauugua

SEQ ID NO: 319475 - RNA, 22 nt, Human
auggauaagaacaaauaucuga

SEQ ID NO: 319476 - RNA, 22 nt, Human
ccuggccuuaagggcagggagc

SEQ ID NO: 319477 - RNA, 22 nt, Human
ugaagcaaacgcuucuguuccu

SEQ ID NO: 319478 - RNA, 22 nt, Human
gcuuccugagaaacaaucugau

SEQ ID NO: 319479 - RNA, 22 nt, Human
uugcauuccaguccccacugug

SEQ ID NO: 319480 - RNA, 22 nt, Human
uccucaguuauaaauaggaaac

SEQ ID NO: 319481 - RNA, 22 nt, Human
caaauacuggguaaguuaauuu

SEQ ID NO: 319482 - RNA, 22 nt, Human
aaugcaccuaccuugauucugc

SEQ ID NO: 319483 - RNA, 22 nt, Human
aaauguguuuagaugguuuauu

SEQ ID NO: 319484 - RNA, 22 nt, Human
gaaggggacuggcagcugcaga

SEQ ID NO: 319485 - RNA, 22 nt, Human
augaugguuguccuaggugcau

SEQ ID NO: 319486 - RNA, 22 nt, Human
ugcucugguccucccucggcgc

SEQ ID NO: 319487 - RNA, 22 nt, Human
cuguucacacacuuguacucuc

SEQ ID NO: 319488 - RNA, 21 nt, Human
uuucugucucugccacuaguu

SEQ ID NO: 319489 - RNA, 22 nt, Human
uggaggcauaggccugggcccu

SEQ ID NO: 319490 - RNA, 22 nt, Human
uggccugggucacaccaggguc

SEQ ID NO: 319491 - RNA, 23 nt, Human
aaguaacagggauaauagcaguu

SEQ ID NO: 319492 - RNA, 22 nt, Human
cugcaggagugaaagcaggccu

SEQ ID NO: 319493 - RNA, 22 nt, Human
acuuuugguucuguaacuguga

SEQ ID NO: 319494 - RNA, 22 nt, Human
ugggcaggaugcguugauucuu

SEQ ID NO: 319495 - RNA, 22 nt, Human
gcuggcucagggacuagaguuu

SEQ ID NO: 319496 - RNA, 21 nt, Human
gauuuuaaagagacugccaca

SEQ ID NO: 319497 - RNA, 22 nt, Human
auacagauguugaauguuauau

SEQ ID NO: 319498 - RNA, 22 nt, Human
uuugcaguagacaucuuauuuu

SEQ ID NO: 319499 - RNA, 22 nt, Human
cacuacuugaaagaauuacaga

SEQ ID NO: 319500 - RNA, 22 nt, Human
uaacagaaauuuuaguuagggg

SEQ ID NO: 319501 - RNA, 22 nt, Human
gcagggcugcagagggcacugu

SEQ ID NO: 319502 - RNA, 22 nt, Human
cuccuuccccuacucagcaucc

SEQ ID NO: 319503 - RNA, 22 nt, Human
uugucuaaugagcuccacuuca

SEQ ID NO: 319504 - RNA, 22 nt, Human
gcagcagagcuuuguccuggcu

SEQ ID NO: 319505 - RNA, 22 nt, Human
ugcuccauucucuagccagugc

SEQ ID NO: 319506 - RNA, 22 nt, Human
augauuuccaguuguugcuaag

SEQ ID NO: 319507 - RNA, 22 nt, Human
auugaaagauuuugggcucaug

SEQ ID NO: 319508 - RNA, 22 nt, Human
ucccagagugagccaggggcag

SEQ ID NO: 319509 - RNA, 22 nt, Human
aaaauaacuucuacuauuugca

SEQ ID NO: 319510 - RNA, 22 nt, Human
gcucagugcagccuuucuguau

SEQ ID NO: 319511 - RNA, 19 nt, Human
gaucuuugccaauuuaagc

SEQ ID NO: 319512 - RNA, 22 nt, Human
aagcgccacgagaagcuggacc

SEQ ID NO: 319513 - RNA, 22 nt, Human
gucuuuaugguaugaaaacuga

SEQ ID NO: 319514 - RNA, 22 nt, Human
ccugcugugaagccaggccugu

SEQ ID NO: 319515 - RNA, 22 nt, Human
uagcacauacauaauagauaga

SEQ ID NO: 319516 - RNA, 22 nt, Human
auguagaaaguucauagaugcg

SEQ ID NO: 319517 - RNA, 22 nt, Human
uuuuccucaggaaugcuaagcu

SEQ ID NO: 319518 - RNA, 22 nt, Human
cuugaaucuucugaguauuugc

SEQ ID NO: 319519 - RNA, 22 nt, Human
aaaaguauuuuggaucucagau

SEQ ID NO: 319520 - RNA, 22 nt, Human
gguggccucucaugcaagguag

SEQ ID NO: 319521 - RNA, 22 nt, Human
uucacauuggugauauguuucu

SEQ ID NO: 319522 - RNA, 22 nt, Human
ggcucuggaaaguguccuugau

SEQ ID NO: 319523 - RNA, 22 nt, Human
acugggaggcaucuggagcuga

SEQ ID NO: 319524 - RNA, 22 nt, Human
agaugguguuuccccaggugga

SEQ ID NO: 319525 - RNA, 22 nt, Human
guacauguugguuguuuccagu

SEQ ID NO: 319526 - RNA, 22 nt, Human
caaauguguaaggaaguguuag

SEQ ID NO: 319527 - RNA, 22 nt, Human
cugcccucccaguugguccgug

SEQ ID NO: 319528 - RNA, 17 nt, Human
agauggcaggaggcaga

SEQ ID NO: 319529 - RNA, 22 nt, Human
cacagaagaaucaugcuguguu

SEQ ID NO: 319530 - RNA, 22 nt, Human
auagaagauagcuuuuguuucu

SEQ ID NO: 319531 - RNA, 22 nt, Human
aacugcauucagaaagcucacu

SEQ ID NO: 319532 - RNA, 22 nt, Human
ugcuuaauauugugauguaaua

SEQ ID NO: 319533 - RNA, 22 nt, Human
cauguugaauggccuugauuuu

SEQ ID NO: 319534 - RNA, 22 nt, Human
cuucaagauccauagauauugc

SEQ ID NO: 319535 - RNA, 22 nt, Human
uuugaaagaaaccagugaguga

SEQ ID NO: 319536 - RNA, 22 nt, Human
aauuuccagaucagaugacuca

SEQ ID NO: 319537 - RNA, 22 nt, Human
cuacccaggcuggagugcagua

SEQ ID NO: 319538 - RNA, 20 nt, Human
caguccaaucagaggccacc

SEQ ID NO: 319539 - RNA, 22 nt, Human
uuaguaaauaaagucuacuuuc

SEQ ID NO: 319540 - RNA, 23 nt, Human
gccucugcucugcguuggggacu

SEQ ID NO: 319541 - RNA, 22 nt, Human
aaugcugcaagaggugaaaaga

SEQ ID NO: 319542 - RNA, 22 nt, Human
aaggcugcuuuuaacaugcaua

SEQ ID NO: 319543 - RNA, 22 nt, Human
cagcucuguaaauuccuucauc

SEQ ID NO: 319544 - RNA, 22 nt, Human
gagccuggauugaagugggugg

SEQ ID NO: 319545 - RNA, 22 nt, Human
uugcuauuuugagagucauagu

SEQ ID NO: 319546 - RNA, 17 nt, Human
aggccagaugaggcaag

SEQ ID NO: 319547 - RNA, 19 nt, Human
agacacacuugauaugugu

SEQ ID NO: 319548 - RNA, 22 nt, Human
ggccugcugacccaaguccugu

SEQ ID NO: 319549 - RNA, 22 nt, Human
aggcucauucuugccucugagc

SEQ ID NO: 319550 - RNA, 22 nt, Human
acaguguucugcuuuuuaaucc

SEQ ID NO: 319551 - RNA, 22 nt, Human
caugagaaccaggucuguguuu

SEQ ID NO: 319552 - RNA, 22 nt, Human
uccuccuucgggacugcuugac

SEQ ID NO: 319553 - RNA, 22 nt, Human
gaaacuuacuuacucacauuuc

SEQ ID NO: 319554 - RNA, 22 nt, Human
agaugcagauuuggauucagga

SEQ ID NO: 319555 - RNA, 22 nt, Human
uuugacaaauccuucagcaaug

SEQ ID NO: 319556 - RNA, 22 nt, Human
caggcagauuugcugcccucca

SEQ ID NO: 319557 - RNA, 22 nt, Human
ccagggccaagagaccucgagg

SEQ ID NO: 319558 - RNA, 22 nt, Human
uaugaacuuuugaugugacaug

SEQ ID NO: 319559 - RNA, 22 nt, Human
ucucaccaaagccuugaccaua

SEQ ID NO: 319560 - RNA, 22 nt, Human
agucucagcuacuugggaggcu

SEQ ID NO: 319561 - RNA, 22 nt, Human
gaaugcacuuccaacaucuauu

SEQ ID NO: 319562 - RNA, 22 nt, Human
gccuggagccucagcaaggagg

SEQ ID NO: 319563 - RNA, 22 nt, Human
cagcgcugugggaacagggcua

SEQ ID NO: 319564 - RNA, 22 nt, Human
cacugaaggacaguaggaaggg

SEQ ID NO: 319565 - RNA, 22 nt, Human
cagggcaggaugcugugauuau

SEQ ID NO: 319566 - RNA, 22 nt, Human
aaaucaguuggaacacaagcag

SEQ ID NO: 319567 - RNA, 20 nt, Human
ccuccuggucaggugugcag

SEQ ID NO: 319568 - RNA, 22 nt, Human
ugugcacaggaagcuauucucu

SEQ ID NO: 319569 - RNA, 22 nt, Human
ccaguguucaauacauauuugu

SEQ ID NO: 319570 - RNA, 22 nt, Human
ggaccuggcaauuugcaucucu

SEQ ID NO: 319571 - RNA, 22 nt, Human
aagcagaaaaacugagcuccaa

SEQ ID NO: 319572 - RNA, 22 nt, Human
ugagagagccugaaucucuuac

SEQ ID NO: 319573 - RNA, 22 nt, Human
gguuggaggugggaauagcuag

SEQ ID NO: 319574 - RNA, 22 nt, Human
caaaugcauaguuuauaagaag

SEQ ID NO: 319575 - RNA, 22 nt, Human
gaggcuggcagaaaagcacagg

SEQ ID NO: 319576 - RNA, 20 nt, Human
aaguuuucuccaaauacagu

SEQ ID NO: 319577 - RNA, 22 nt, Human
cauuuagaaacuguuuuuaaca

SEQ ID NO: 319578 - RNA, 22 nt, Human
caguccugggugcagcaggaaa

SEQ ID NO: 319579 - RNA, 19 nt, Human
agauggggaagagugugag

SEQ ID NO: 319580 - RNA, 23 nt, Human
acagaugaaaguguggcucagag

SEQ ID NO: 319581 - RNA, 16 nt, Human
uucugucacguacggc

SEQ ID NO: 319582 - RNA, 22 nt, Human
ccugggcucaagugauccuccu

SEQ ID NO: 319583 - RNA, 22 nt, Human
gcugagucuugagcacugagca

SEQ ID NO: 319584 - RNA, 22 nt, Human
cucuggagaacuccuugugucu

SEQ ID NO: 319585 - RNA, 22 nt, Human
gcucucugccuuucucaaugac

SEQ ID NO: 319586 - RNA, 22 nt, Human
ggcuggcacucuguccaguguc

SEQ ID NO: 319587 - RNA, 22 nt, Human
gagcugcugguugcuggugccu

SEQ ID NO: 319588 - RNA, 22 nt, Human
aggccagguuccucaaucuuga

SEQ ID NO: 319589 - RNA, 22 nt, Human
uuuaagauucaguaaggcaaac

SEQ ID NO: 319590 - RNA, 22 nt, Human
agggucugacaaugugacuuag

SEQ ID NO: 319591 - RNA, 22 nt, Human
auuucacucuuaauugcuuccu

SEQ ID NO: 319592 - RNA, 22 nt, Human
gugggacucuucuuuggcagug

SEQ ID NO: 319593 - RNA, 19 nt, Human
acaagggcaggcaagguga

SEQ ID NO: 319594 - RNA, 22 nt, Human
uauuacugagguuuuauggagu

SEQ ID NO: 319595 - RNA, 22 nt, Human
uuaaguccuugguaauuuucuu

SEQ ID NO: 319596 - RNA, 22 nt, Human
gcccuuccaacccagagggcaa

SEQ ID NO: 319597 - RNA, 22 nt, Human
ggcagagaugugggucagaauc

SEQ ID NO: 319598 - RNA, 22 nt, Human
ugcauuguaggauguuuagcag

SEQ ID NO: 319599 - RNA, 20 nt, Human
cucaggauugucuagccccu

SEQ ID NO: 319600 - RNA, 20 nt, Human
ggccuuggccucuuugcagc

SEQ ID NO: 319601 - RNA, 22 nt, Human
augauggugagguugagcacag

SEQ ID NO: 319602 - RNA, 22 nt, Human
cagagccauuauggagacuugc

SEQ ID NO: 319603 - RNA, 22 nt, Human
agugcauauaugaagaguauga

SEQ ID NO: 319604 - RNA, 22 nt, Human
uggcagcugaggggaggcuuug

SEQ ID NO: 319605 - RNA, 22 nt, Human
cucagagucccuucccucgugg

SEQ ID NO: 319606 - RNA, 20 nt, Human
auauguguacguguauacau

SEQ ID NO: 319607 - RNA, 22 nt, Human
aggagcugacuuguaaagcauu

SEQ ID NO: 319608 - RNA, 22 nt, Human
uccuucaaaaguugagagagcc

SEQ ID NO: 319609 - RNA, 22 nt, Human
cagcaauauacacagucuaugg

SEQ ID NO: 319610 - RNA, 22 nt, Human
uguuccaauaaggaguugaaau

SEQ ID NO: 319611 - RNA, 22 nt, Human
acagauauaaacuauaguagug

SEQ ID NO: 319612 - RNA, 22 nt, Human
auaacaugaccugugcuucaca

SEQ ID NO: 319613 - RNA, 22 nt, Human
ugaggcuggcaaggcugguauu

SEQ ID NO: 319614 - RNA, 22 nt, Human
ccaggccuguguuguguggagg

SEQ ID NO: 319615 - RNA, 19 nt, Human
uaaggccaaaaguaagugu

SEQ ID NO: 319616 - RNA, 22 nt, Human
acaaacuuccaucaugaauuuu

SEQ ID NO: 319617 - RNA, 22 nt, Human
cagcugaauucuucagacucca

SEQ ID NO: 319618 - RNA, 22 nt, Human
auguaaacaagguuauugucca

SEQ ID NO: 319619 - RNA, 22 nt, Human
caggagaagguuuggagugcag

SEQ ID NO: 319620 - RNA, 22 nt, Human
uauuucugggaguucagaaauu

SEQ ID NO: 319621 - RNA, 18 nt, Human
gguggcaggucagaugcc

SEQ ID NO: 319622 - RNA, 22 nt, Human
guucauauuacuuugagugcag

SEQ ID NO: 319623 - RNA, 22 nt, Human
uccugggcugcagggaagagca

SEQ ID NO: 319624 - RNA, 22 nt, Human
auaaggcacacauagauagggu

SEQ ID NO: 319625 - RNA, 22 nt, Human
uagcagcuuccagagagggcag

SEQ ID NO: 319626 - RNA, 22 nt, Human
uucagagaugacaccugguguu

SEQ ID NO: 319627 - RNA, 22 nt, Human
guggcauugacauguaaacagu

SEQ ID NO: 319628 - RNA, 22 nt, Human
gccuugcuuugcuucuggacag

SEQ ID NO: 319629 - RNA, 18 nt, Human
acauuucuccuucugacc

SEQ ID NO: 319630 - RNA, 22 nt, Human
agggcagcauugccuuucucca

SEQ ID NO: 319631 - RNA, 22 nt, Human
gcuguggcuguacagagaccau

SEQ ID NO: 319632 - RNA, 22 nt, Human
uuaaauauuauguugucugcaa

SEQ ID NO: 319633 - RNA, 22 nt, Human
uuauuugcccauguuuagcaga

SEQ ID NO: 319634 - RNA, 19 nt, Human
uccauaagcuuguguucau

SEQ ID NO: 319635 - RNA, 22 nt, Human
auacuguuuugugacuuaucuu

SEQ ID NO: 319636 - RNA, 22 nt, Human
ccucccacauccuagcucugcu

SEQ ID NO: 319637 - RNA, 19 nt, Human
agggagaauuccaagagga

SEQ ID NO: 319638 - RNA, 22 nt, Human
gcacccagcccagggcgugaug

SEQ ID NO: 319639 - RNA, 22 nt, Human
gcacacagauuaggaaacagaa

SEQ ID NO: 319640 - RNA, 22 nt, Human
caggaacacaaugagucucaaa

SEQ ID NO: 319641 - RNA, 22 nt, Human
ucugagagguuaagcaauuuga

SEQ ID NO: 319642 - RNA, 22 nt, Human
aaagaugucauacacauuaaga

SEQ ID NO: 319643 - RNA, 22 nt, Human
gcugugcagguccccacugccu

SEQ ID NO: 319644 - RNA, 22 nt, Human
auuccuuguauaucuacaugca

SEQ ID NO: 319645 - RNA, 22 nt, Human
gcuggggagggcgucaaggcca

SEQ ID NO: 319646 - RNA, 22 nt, Human
gaguuauuaauggcugaguuug

SEQ ID NO: 319647 - RNA, 22 nt, Human
aaggaaccauuugugugcaugg

SEQ ID NO: 319648 - RNA, 22 nt, Human
auaugugaaugauaucacuuug

SEQ ID NO: 319649 - RNA, 22 nt, Human
ucugcuggccuuagcaggucua

SEQ ID NO: 319650 - RNA, 22 nt, Human
ggggcagagucuggacuguugu

SEQ ID NO: 319651 - RNA, 22 nt, Human
gugauaaaauucaaauagcucu

SEQ ID NO: 319652 - RNA, 22 nt, Human
ucacuggggccuuuggucagga

SEQ ID NO: 319653 - RNA, 22 nt, Human
ucagagugaggcccagcaaucu

SEQ ID NO: 319654 - RNA, 22 nt, Human
uccuugaaaagaaugucuccau

SEQ ID NO: 319655 - RNA, 22 nt, Human
cacucugacuggcccugcagga

SEQ ID NO: 319656 - RNA, 22 nt, Human
uggacucagugcugccauuccc

SEQ ID NO: 319657 - RNA, 22 nt, Human
caugaaaaugucaaguucugcu

SEQ ID NO: 319658 - RNA, 22 nt, Human
gggcuccagcccgggaccaggu

SEQ ID NO: 319659 - RNA, 22 nt, Human
uuacaaaguucugaguucaaac

SEQ ID NO: 319660 - RNA, 22 nt, Human
cugagcccaggcgggagcugag

SEQ ID NO: 319661 - RNA, 21 nt, Human
aauguauguuuaucucacagu

SEQ ID NO: 319662 - RNA, 22 nt, Human
ccucccaccauuuagagagagc

SEQ ID NO: 319663 - RNA, 22 nt, Human
cuggcuggucaucagcaguacg

SEQ ID NO: 319664 - RNA, 22 nt, Human
ugcaauaacccaguaucuguga

SEQ ID NO: 319665 - RNA, 22 nt, Human
uuucuguaauuaaaagggcagg

SEQ ID NO: 319666 - RNA, 22 nt, Human
gaacacaugauuauaaaugcua

SEQ ID NO: 319667 - RNA, 22 nt, Human
agauaauuugaguaaauuaauu

SEQ ID NO: 319668 - RNA, 22 nt, Human
gcagauggugggggaggaguac

SEQ ID NO: 319669 - RNA, 19 nt, Human
ucugaggguccagaugcau

SEQ ID NO: 319670 - RNA, 22 nt, Human
aggggaggcagcgauaaaccug

SEQ ID NO: 319671 - RNA, 22 nt, Human
agaaaaggcuugaagagguuuu

SEQ ID NO: 319672 - RNA, 22 nt, Human
uaucuguuguccaugcagaaag

SEQ ID NO: 319673 - RNA, 17 nt, Human
agcagaagucagaggga

SEQ ID NO: 319674 - RNA, 22 nt, Human
ugggccuggacaaggccacuag

SEQ ID NO: 319675 - RNA, 22 nt, Human
ggguccagcuacaucagggugg

SEQ ID NO: 319676 - RNA, 22 nt, Human
cuucagggugacgcaggcugca

SEQ ID NO: 319677 - RNA, 22 nt, Human
ggcugcucuucuuggcgaccuc

SEQ ID NO: 319678 - RNA, 22 nt, Human
aauuaacagagggcuuauuacu

SEQ ID NO: 319679 - RNA, 21 nt, Human
aaggaaaagcuuggucucuga

SEQ ID NO: 319680 - RNA, 22 nt, Human
ggcugccugugcccaggcacac

SEQ ID NO: 319681 - RNA, 22 nt, Human
cagagcugcgcuuuuuccuggu

SEQ ID NO: 319682 - RNA, 23 nt, Human
aggaacugaggccuagggaggua

SEQ ID NO: 319683 - RNA, 21 nt, Human
uagaaaucagcuggugccucu

SEQ ID NO: 319684 - RNA, 22 nt, Human
uggagggcucuuucaccuggua

SEQ ID NO: 319685 - RNA, 22 nt, Human
cccaggagguggagcuugcagu

SEQ ID NO: 319686 - RNA, 22 nt, Human
gcucaggaaauaguuuaguguu

SEQ ID NO: 319687 - RNA, 23 nt, Human
aagaauaaaugacauuaaaggug

SEQ ID NO: 319688 - RNA, 22 nt, Human
uauuucagcccuacuacuuggc

SEQ ID NO: 319689 - RNA, 22 nt, Human
ccaggacuucgaggcuacagug

SEQ ID NO: 319690 - RNA, 22 nt, Human
uuguaacagguacuaaauaacu

SEQ ID NO: 319691 - RNA, 22 nt, Human
auauuccauugguuucccuucu

SEQ ID NO: 319692 - RNA, 22 nt, Human
uuaauaaacaggugcagcugaa

SEQ ID NO: 319693 - RNA, 22 nt, Human
ggccuugggcagacacgucaca

SEQ ID NO: 319694 - RNA, 22 nt, Human
gagcuggugaucagcuggagga

SEQ ID NO: 319695 - RNA, 22 nt, Human
ugcuggccaauggcagaggcgg

SEQ ID NO: 319696 - RNA, 22 nt, Human
cucagugcuuuggauccuggau

SEQ ID NO: 319697 - RNA, 22 nt, Human
uguucaauccccagguccugaa

SEQ ID NO: 319698 - RNA, 22 nt, Human
uguucuugggaaucuuacaguu

SEQ ID NO: 319699 - RNA, 22 nt, Human
aaauugcaaaaguacuuuuagg

SEQ ID NO: 319700 - RNA, 22 nt, Human
gaggaacccagcugggguugcc

SEQ ID NO: 319701 - RNA, 20 nt, Human
cuggguggcaagcaaggggg

SEQ ID NO: 319702 - RNA, 22 nt, Human
caaggccagagccagcgauaag

SEQ ID NO: 319703 - RNA, 18 nt, Human
uggcucugcagccagaug

SEQ ID NO: 319704 - RNA, 22 nt, Human
uugcauaaagauuuuauugcau

SEQ ID NO: 319705 - RNA, 22 nt, Human
ggacucuguuuuccugaucacu

SEQ ID NO: 319706 - RNA, 22 nt, Human
aggggcugacuggaaagugcca

SEQ ID NO: 319707 - RNA, 22 nt, Human
agccucucuguuagucacuggg

SEQ ID NO: 319708 - RNA, 22 nt, Human
aggaaacuccccuacaucucaa

SEQ ID NO: 319709 - RNA, 22 nt, Human
uugugaaacauucauggauuug

SEQ ID NO: 319710 - RNA, 22 nt, Human
aaucaguuguccaaaguucaca

SEQ ID NO: 319711 - RNA, 22 nt, Human
aaguguauauaugacuuauaaa

SEQ ID NO: 319712 - RNA, 22 nt, Human
agaagcaguuauuuuuugcaca

SEQ ID NO: 319713 - RNA, 23 nt, Human
acacaauagaguacuauucagcc

SEQ ID NO: 319714 - RNA, 22 nt, Human
uggagcaggcaucuuucucucu

SEQ ID NO: 319715 - RNA, 22 nt, Human
uuugugaagggaacagaagugu

SEQ ID NO: 319716 - RNA, 18 nt, Human
ggugagggagcuggaagc

SEQ ID NO: 319717 - RNA, 22 nt, Human
cagcccuguccaaugucugcuc

SEQ ID NO: 319718 - RNA, 22 nt, Human
ggugaggcuaagugacacaggg

SEQ ID NO: 319719 - RNA, 22 nt, Human
gaugggaggaaccugggucccu

SEQ ID NO: 319720 - RNA, 22 nt, Human
ccaggcugcuuagccuuaucuu

SEQ ID NO: 319721 - RNA, 22 nt, Human
ggccccacgggggaguccuagu

SEQ ID NO: 319722 - RNA, 22 nt, Human
caggccugagacaucugagaua

SEQ ID NO: 319723 - RNA, 21 nt, Human
ucauuugugaucugauuucca

SEQ ID NO: 319724 - RNA, 22 nt, Human
cagugcagguggcagaggacag

SEQ ID NO: 319725 - RNA, 22 nt, Human
uaggcagggauuaggguugauu

SEQ ID NO: 319726 - RNA, 22 nt, Human
aaguucaaguaguguuacaugg

SEQ ID NO: 319727 - RNA, 22 nt, Human
uucauucccaagaguaaacaua

SEQ ID NO: 319728 - RNA, 22 nt, Human
aggcugcagaacagucaggugc

SEQ ID NO: 319729 - RNA, 22 nt, Human
uuugcauuguaauauuuaguuc

SEQ ID NO: 319730 - RNA, 17 nt, Human
ucugggcuucagugguc

SEQ ID NO: 319731 - RNA, 22 nt, Human
gcagagugauggaaugugggug

SEQ ID NO: 319732 - RNA, 22 nt, Human
accagcagaguugaggaggaca

SEQ ID NO: 319733 - RNA, 22 nt, Human
caaauucacaugauugcuucug

SEQ ID NO: 319734 - RNA, 20 nt, Human
auacaaagagauugauguau

SEQ ID NO: 319735 - RNA, 22 nt, Human
uuaugacaggaaaaucacagaa

SEQ ID NO: 319736 - RNA, 22 nt, Human
guagaagugaugucauguuaua

SEQ ID NO: 319737 - RNA, 22 nt, Human
cugacccuugcucgggcccugu

SEQ ID NO: 319738 - RNA, 22 nt, Human
ucagauggcacacagagccugc

SEQ ID NO: 319739 - RNA, 22 nt, Human
aggaguggaauuacuggguucu

SEQ ID NO: 319740 - RNA, 22 nt, Human
acuuccugcagcuucucagccc

SEQ ID NO: 319741 - RNA, 22 nt, Human
ugucuuuggaauauuuagcuga

SEQ ID NO: 319742 - RNA, 22 nt, Human
ggccugagucccaccuggcugu

SEQ ID NO: 319743 - RNA, 22 nt, Human
uccucagggggccaacccagcc

SEQ ID NO: 319744 - RNA, 22 nt, Human
ccacugucuuuuccaggcugaa

SEQ ID NO: 319745 - RNA, 22 nt, Human
uuauccaagcagaagcugcaca

SEQ ID NO: 319746 - RNA, 22 nt, Human
auacagaaaaugaugcagaguu

SEQ ID NO: 319747 - RNA, 17 nt, Human
cccagagaugcugccuu

SEQ ID NO: 319748 - RNA, 22 nt, Human
uuuacacaaaagauagcacacc

SEQ ID NO: 319749 - RNA, 22 nt, Human
aaugagacacgugaagcagaug

SEQ ID NO: 319750 - RNA, 22 nt, Human
aaagaacaaaugauauaugguu

SEQ ID NO: 319751 - RNA, 22 nt, Human
caugagaagggguggaguuaga

SEQ ID NO: 319752 - RNA, 23 nt, Human
gaauaguuuuagaaauuggagaa

SEQ ID NO: 319753 - RNA, 22 nt, Human
ggguguccugugccaagcuggg

SEQ ID NO: 319754 - RNA, 22 nt, Human
uuuguuuagaugguaaaucagu

SEQ ID NO: 319755 - RNA, 23 nt, Human
cuggcucuguagguggcauccuu

SEQ ID NO: 319756 - RNA, 22 nt, Human
uccucugcuccaggcuggacuu

SEQ ID NO: 319757 - RNA, 22 nt, Human
uccugucugcucacagagcugg

SEQ ID NO: 319758 - RNA, 22 nt, Human
gcagagccaugggagguuuuug

SEQ ID NO: 319759 - RNA, 22 nt, Human
gagcccaggcagagguugcagu

SEQ ID NO: 319760 - RNA, 22 nt, Human
ucagaaauuuucucaguaguuc

SEQ ID NO: 319761 - RNA, 22 nt, Human
gcccaugcacuuucugugaugg

SEQ ID NO: 319762 - RNA, 22 nt, Human
cugagccauaagggaggcuggg

SEQ ID NO: 319763 - RNA, 22 nt, Human
aaguuaugaaauuuggacagcu

SEQ ID NO: 319764 - RNA, 22 nt, Human
ccagcuccucuucccaguguca

SEQ ID NO: 319765 - RNA, 22 nt, Human
ucaaggcuaaacuuucagagua

SEQ ID NO: 319766 - RNA, 20 nt, Human
cccucugcacauggcugugg

SEQ ID NO: 319767 - RNA, 22 nt, Human
caggaugagguagaggcagaua

SEQ ID NO: 319768 - RNA, 22 nt, Human
ucucagggagggcgagucagcg

SEQ ID NO: 319769 - RNA, 22 nt, Human
ccagucugugugccagccugcg

SEQ ID NO: 319770 - RNA, 22 nt, Human
gcugccugauguccagcaggac

SEQ ID NO: 319771 - RNA, 22 nt, Human
cugggccagcaacugcaaugga

SEQ ID NO: 319772 - RNA, 22 nt, Human
ggccucucucccuggcuugcag

SEQ ID NO: 319773 - RNA, 22 nt, Human
agaggcuccaccuucucugucc

SEQ ID NO: 319774 - RNA, 20 nt, Human
gcugggggugugcugaguga

SEQ ID NO: 319775 - RNA, 22 nt, Human
cugggagucaccaggagcaagg

SEQ ID NO: 319776 - RNA, 21 nt, Human
cccagggaagccgcagucacc

SEQ ID NO: 319777 - RNA, 22 nt, Human
cucugauuuccuuauucuguca

SEQ ID NO: 319778 - RNA, 22 nt, Human
agugacugacaccuguaauccc

SEQ ID NO: 319779 - RNA, 18 nt, Human
uggcucagauggcuuuaa

SEQ ID NO: 319780 - RNA, 22 nt, Human
ugaagacagaccaaggagaaug

SEQ ID NO: 319781 - RNA, 20 nt, Human
gcuuccuucccagcccccac

SEQ ID NO: 319782 - RNA, 22 nt, Human
uaaggcacuucaauguuuagaa

SEQ ID NO: 319783 - RNA, 22 nt, Human
augaguucaauuguuucaguca

SEQ ID NO: 319784 - RNA, 22 nt, Human
uggcugcuagccagagcuucag

SEQ ID NO: 319785 - RNA, 22 nt, Human
agucccagacuccaguuuucug

SEQ ID NO: 319786 - RNA, 18 nt, Human
gagcccugagucugcaca

SEQ ID NO: 319787 - RNA, 20 nt, Human
ccuguucacugcgcaguuuc

SEQ ID NO: 319788 - RNA, 22 nt, Human
uuaaacagguuuuugaauggcc

SEQ ID NO: 319789 - RNA, 22 nt, Human
uggugcugacaguucugagugc

SEQ ID NO: 319790 - RNA, 22 nt, Human
uaguuaaaauaauggagauguu

SEQ ID NO: 319791 - RNA, 22 nt, Human
ucucagggugaggaaagaauuu

SEQ ID NO: 319792 - RNA, 22 nt, Human
acaaaaauuagcugggcauggu

SEQ ID NO: 319793 - RNA, 22 nt, Human
cccagcuaccucugcuaggaga

SEQ ID NO: 319794 - RNA, 22 nt, Human
ggcugagcucaggggcagcagg

SEQ ID NO: 319795 - RNA, 22 nt, Human
ccagcugagaaguguaaaguga

SEQ ID NO: 319796 - RNA, 19 nt, Human
uuucaggagcuaugcaggg

SEQ ID NO: 319797 - RNA, 22 nt, Human
gagcacagaaucuucccaugca

SEQ ID NO: 319798 - RNA, 22 nt, Human
gcuccugucuuggggcacuggc

SEQ ID NO: 319799 - RNA, 23 nt, Human
gcauugucuccccacuucugggc

SEQ ID NO: 319800 - RNA, 22 nt, Human
gccucugcaauuacauugugcc

SEQ ID NO: 319801 - RNA, 19 nt, Human
ggcccaaguacugagugcc

SEQ ID NO: 319802 - RNA, 22 nt, Human
gcuggugagcaaaggagaagga

SEQ ID NO: 319803 - RNA, 22 nt, Human
gugcagugaaaaaagaaugucc

SEQ ID NO: 319804 - RNA, 22 nt, Human
gugcauccacuagggcucuccc

SEQ ID NO: 319805 - RNA, 22 nt, Human
uggccuuggcagugagaagagu

SEQ ID NO: 319806 - RNA, 22 nt, Human
uuucauaugggcauuggcaaua

SEQ ID NO: 319807 - RNA, 22 nt, Human
aaaaguucccugguuagaaaag

SEQ ID NO: 319808 - RNA, 18 nt, Human
gaaaugugauucuagggc

SEQ ID NO: 319809 - RNA, 22 nt, Human
ugcuagaauuagguuaaacaaa

SEQ ID NO: 319810 - RNA, 22 nt, Human
guucacaucacuucacugaacc

SEQ ID NO: 319811 - RNA, 18 nt, Human
auguacauuugcuaaagc

SEQ ID NO: 319812 - RNA, 22 nt, Human
ccugccugucccucaguccaca

SEQ ID NO: 319813 - RNA, 22 nt, Human
ggccaggagcaagccaggcucu

SEQ ID NO: 319814 - RNA, 22 nt, Human
uuuccucugacugcuccccugc

SEQ ID NO: 319815 - RNA, 22 nt, Human
cuaauguaucauggcucucagc

SEQ ID NO: 319816 - RNA, 22 nt, Human
gagcaggcauucuaguggcuga

SEQ ID NO: 319817 - RNA, 22 nt, Human
guguaauugaaauugagaacca

SEQ ID NO: 319818 - RNA, 22 nt, Human
uuggaauucaaguuguagcuua

SEQ ID NO: 319819 - RNA, 22 nt, Human
ccuuccuugagaagcaauuccu

SEQ ID NO: 319820 - RNA, 22 nt, Human
ucuguggccuguguccaagugc

SEQ ID NO: 319821 - RNA, 22 nt, Human
guccugggaacuggacagcuaa

SEQ ID NO: 319822 - RNA, 22 nt, Human
gccugccuucggugcgcagcgg

SEQ ID NO: 319823 - RNA, 22 nt, Human
ccagaggaaaaauaucucccua

SEQ ID NO: 319824 - RNA, 21 nt, Human
uaaagaagaugaaugugauca

SEQ ID NO: 319825 - RNA, 22 nt, Human
ucugggagagcugcugucagag

SEQ ID NO: 319826 - RNA, 22 nt, Human
uuggcauugaaguuucauuggu

SEQ ID NO: 319827 - RNA, 18 nt, Human
cagggccccagaauuauc

SEQ ID NO: 319828 - RNA, 20 nt, Human
ugcuguaagauuagagagcu

SEQ ID NO: 319829 - RNA, 22 nt, Human
ggcagcucugcuccacaugagu

SEQ ID NO: 319830 - RNA, 22 nt, Human
agcaggguuccaggaguugcag

SEQ ID NO: 319831 - RNA, 21 nt, Human
uucuucaaagaagaaggcaca

SEQ ID NO: 319832 - RNA, 22 nt, Human
gccugagcuacuagggagucug

SEQ ID NO: 319833 - RNA, 22 nt, Human
ucacugggagaugugggaaggg

SEQ ID NO: 319834 - RNA, 22 nt, Human
cagcccugcugacacugucuga

SEQ ID NO: 319835 - RNA, 20 nt, Human
gagccugggaagucuaaggu

SEQ ID NO: 319836 - RNA, 22 nt, Human
ugcuguguggaugugaagaauc

SEQ ID NO: 319837 - RNA, 22 nt, Human
gggcacagagggucuugaagaa

SEQ ID NO: 319838 - RNA, 22 nt, Human
ucuuucucucuaaucaagcaca

SEQ ID NO: 319839 - RNA, 22 nt, Human
gauuucaaggauguuagaggug

SEQ ID NO: 319840 - RNA, 22 nt, Human
ucaguguuuuuaaagcaauaua

SEQ ID NO: 319841 - RNA, 22 nt, Human
cucccuggcacagcgagagguu

SEQ ID NO: 319842 - RNA, 22 nt, Human
agucucugcaugccugcugugc

SEQ ID NO: 319843 - RNA, 22 nt, Human
gcugccuggcuuuaguccacuu

SEQ ID NO: 319844 - RNA, 22 nt, Human
gcuggccugucuagagccuuac

SEQ ID NO: 319845 - RNA, 22 nt, Human
gagcugaguuaccuccagauca

SEQ ID NO: 319846 - RNA, 22 nt, Human
ugugugcagccucugucuuugg

SEQ ID NO: 319847 - RNA, 22 nt, Human
guacaugucaaaaaaugcauaa

SEQ ID NO: 319848 - RNA, 20 nt, Human
aaggcacuaugucugcuagc

SEQ ID NO: 319849 - RNA, 22 nt, Human
gccagagcugagacacgagucc

SEQ ID NO: 319850 - RNA, 22 nt, Human
guccucuguguaggcugcagac

SEQ ID NO: 319851 - RNA, 22 nt, Human
uccagggaagagcagaggcuac

SEQ ID NO: 319852 - RNA, 22 nt, Human
gcagagcauguccucaggacag

SEQ ID NO: 319853 - RNA, 22 nt, Human
agcagcugaucaaagcacuuau

SEQ ID NO: 319854 - RNA, 22 nt, Human
uaaaugcaguacaaauuguucu

SEQ ID NO: 319855 - RNA, 22 nt, Human
gagacauggcaaaagcacuggu

SEQ ID NO: 319856 - RNA, 22 nt, Human
gcagacagcauguugggcuauu

SEQ ID NO: 319857 - RNA, 22 nt, Human
uccucuucugcccaucagaggc

SEQ ID NO: 319858 - RNA, 18 nt, Human
ucugggcuucccgaggcu

SEQ ID NO: 319859 - RNA, 22 nt, Human
gggcucugguacuuccuggcuc

SEQ ID NO: 319860 - RNA, 22 nt, Human
agggccugcucuaucacucuca

SEQ ID NO: 319861 - RNA, 22 nt, Human
cugugccuaagaugcaugucuc

SEQ ID NO: 319862 - RNA, 22 nt, Human
agcuggugcugaagcucuugag

SEQ ID NO: 319863 - RNA, 22 nt, Human
auugaagauuaaaugcuuccuu

SEQ ID NO: 319864 - RNA, 22 nt, Human
uccuggaguugugcagugcaca

SEQ ID NO: 319865 - RNA, 22 nt, Human
gugcagggcuggcaccggaggc

SEQ ID NO: 319866 - RNA, 22 nt, Human
ccacaaguuucagcacccagag

SEQ ID NO: 319867 - RNA, 22 nt, Human
auguucuuucagccagugcauc

SEQ ID NO: 319868 - RNA, 22 nt, Human
agcagagcuauucuugugcaau

SEQ ID NO: 319869 - RNA, 22 nt, Human
uagucuuuugagaaguauaucu

SEQ ID NO: 319870 - RNA, 22 nt, Human
agaugaaagauuuuuauagaga

SEQ ID NO: 319871 - RNA, 19 nt, Human
ucauaaggagagaggaaau

SEQ ID NO: 319872 - RNA, 22 nt, Human
gucagaggaauggaugagugau

SEQ ID NO: 319873 - RNA, 22 nt, Human
ugaagcaggcauugacugauga

SEQ ID NO: 319874 - RNA, 20 nt, Human
cuucuucagccuaugcuuca

SEQ ID NO: 319875 - RNA, 22 nt, Human
ucaaugauagacaagaucuaag

SEQ ID NO: 319876 - RNA, 22 nt, Human
acacauuucucuuuuuguaagu

SEQ ID NO: 319877 - RNA, 18 nt, Human
ugagaggcagguagagga

SEQ ID NO: 319878 - RNA, 22 nt, Human
acagagcuuaauucaggagcuu

SEQ ID NO: 319879 - RNA, 22 nt, Human
guuugcauaaaguggaugcagg

SEQ ID NO: 319880 - RNA, 22 nt, Human
cucuggaguggguggccgggag

SEQ ID NO: 319881 - RNA, 22 nt, Human
ggccauggaccccgagcugacc

SEQ ID NO: 319882 - RNA, 22 nt, Human
aguacauuuauuaaugguaaaa

SEQ ID NO: 319883 - RNA, 22 nt, Human
gguggccuuucaguggaucagg

SEQ ID NO: 319884 - RNA, 22 nt, Human
ucucaagcuuguugguauguuu

SEQ ID NO: 319885 - RNA, 22 nt, Human
gcugucacacaugggaucucag

SEQ ID NO: 319886 - RNA, 22 nt, Human
uacuuuuagccuauuugauucu

SEQ ID NO: 319887 - RNA, 22 nt, Human
gugcauugcgaugcagacgacc

SEQ ID NO: 319888 - RNA, 22 nt, Human
acagagcacugcccugugccgc

SEQ ID NO: 319889 - RNA, 22 nt, Human
ggcaccagggacaauccucuuc

SEQ ID NO: 319890 - RNA, 22 nt, Human
guggccugccagcagauggcgc

SEQ ID NO: 319891 - RNA, 22 nt, Human
gcugugugcucacguaguggaa

SEQ ID NO: 319892 - RNA, 22 nt, Human
uuucucaucuggaaacagugcu

SEQ ID NO: 319893 - RNA, 23 nt, Human
acagaaaguucugcuggacagag

SEQ ID NO: 319894 - RNA, 22 nt, Human
aucauuccacauguaccacuag

SEQ ID NO: 319895 - RNA, 22 nt, Human
auggaaaggcuguggaaacuua

SEQ ID NO: 319896 - RNA, 22 nt, Human
ucaaugauaucagcaggaugug

SEQ ID NO: 319897 - RNA, 22 nt, Human
acagaguaucuaucaggaguau

SEQ ID NO: 319898 - RNA, 22 nt, Human
cacucuccagcacaccccauuu

SEQ ID NO: 319899 - RNA, 22 nt, Human
caagggaguuacugagggcggg

SEQ ID NO: 319900 - RNA, 20 nt, Human
uaugcuuuuuauaagauuga

SEQ ID NO: 319901 - RNA, 19 nt, Human
gcccugcaggagguggggc

SEQ ID NO: 319902 - RNA, 22 nt, Human
caucacugacgcugagauucca

SEQ ID NO: 319903 - RNA, 22 nt, Human
aaaaugacauuccagugauauu

SEQ ID NO: 319904 - RNA, 22 nt, Human
uuagcaucugcuguaagcuuau

SEQ ID NO: 319905 - RNA, 22 nt, Human
uggcuucuugggaugggucauu

SEQ ID NO: 319906 - RNA, 22 nt, Human
auguaucaauuaucugucugca

SEQ ID NO: 319907 - RNA, 22 nt, Human
gaggccugaggcugccuggagc

SEQ ID NO: 319908 - RNA, 20 nt, Human
uggcccaguggggcagggug

SEQ ID NO: 319909 - RNA, 22 nt, Human
ggccuagggaguggccaugccu

SEQ ID NO: 319910 - RNA, 22 nt, Human
cuaaaugccuuuccuaccuaac

SEQ ID NO: 319911 - RNA, 22 nt, Human
aagcaccugcaguugacaaaaa

SEQ ID NO: 319912 - RNA, 22 nt, Human
cacuggggaaaacaggcuucuu

SEQ ID NO: 319913 - RNA, 22 nt, Human
ugaaguuguuaagguugccauu

SEQ ID NO: 319914 - RNA, 22 nt, Human
aauaucaacaguguccuucuaa

SEQ ID NO: 319915 - RNA, 21 nt, Human
ggcacugagccagauggacuc

SEQ ID NO: 319916 - RNA, 22 nt, Human
aaauuauaggugccaccuugga

SEQ ID NO: 319917 - RNA, 22 nt, Human
uugagggucuggaucugcugcu

SEQ ID NO: 319918 - RNA, 22 nt, Human
gaucauuugcaggaaacauuaa

SEQ ID NO: 319919 - RNA, 22 nt, Human
cauugcacuuuggguccaggac

SEQ ID NO: 319920 - RNA, 22 nt, Human
cagaggcuguguaggcagacug

SEQ ID NO: 319921 - RNA, 22 nt, Human
agccuguggaucccugcacugg

SEQ ID NO: 319922 - RNA, 22 nt, Human
agaagcugacagaugcagcagg

SEQ ID NO: 319923 - RNA, 22 nt, Human
uguguacauaucuauccuagau

SEQ ID NO: 319924 - RNA, 22 nt, Human
caggcagaagaaguggaaggac

SEQ ID NO: 319925 - RNA, 22 nt, Human
uccaggcugggcugaagggugc

SEQ ID NO: 319926 - RNA, 22 nt, Human
aggcuccuugcucacaggcuca

SEQ ID NO: 319927 - RNA, 22 nt, Human
auugaaagguuuugagcagaua

SEQ ID NO: 319928 - RNA, 22 nt, Human
cugccaggacugacgucuucag

SEQ ID NO: 319929 - RNA, 22 nt, Human
ugccagggcugcuacuggcuga

SEQ ID NO: 319930 - RNA, 22 nt, Human
ucuggcuccuggcuccacugcc

SEQ ID NO: 319931 - RNA, 22 nt, Human
uuaauuuuaaccuguuuguguc

SEQ ID NO: 319932 - RNA, 22 nt, Human
uucugucacuuuuuuggaaucu

SEQ ID NO: 319933 - RNA, 22 nt, Human
gguuugcaugugauguugggca

SEQ ID NO: 319934 - RNA, 22 nt, Human
auucacagggacaaugggagag

SEQ ID NO: 319935 - RNA, 22 nt, Human
ggcugcagcggauuggggauug

SEQ ID NO: 319936 - RNA, 20 nt, Human
ccugggguacacuggcaugu

SEQ ID NO: 319937 - RNA, 22 nt, Human
uguaugcagcaaaacaauuagu

SEQ ID NO: 319938 - RNA, 22 nt, Human
gccugcagugagugcagaaggu

SEQ ID NO: 319939 - RNA, 22 nt, Human
cuagaaauauuuuacagucaag

SEQ ID NO: 319940 - RNA, 22 nt, Human
cuacugaguccuucagcugcca

SEQ ID NO: 319941 - RNA, 22 nt, Human
uggcugaauaauauucuguugu

SEQ ID NO: 319942 - RNA, 22 nt, Human
ugcugccuccaacuccugggcu

SEQ ID NO: 319943 - RNA, 22 nt, Human
gcugucuguucgagcguguguu

SEQ ID NO: 319944 - RNA, 22 nt, Human
ugagaggcagaauggugccugc

SEQ ID NO: 319945 - RNA, 22 nt, Human
ucuuuccuacuuuauugugaac

SEQ ID NO: 319946 - RNA, 23 nt, Human
ccugggcauuggcugcagcuucu

SEQ ID NO: 319947 - RNA, 22 nt, Human
aagcagccacuggccaguuaua

SEQ ID NO: 319948 - RNA, 22 nt, Human
gagcagcugcagugcagacccu

SEQ ID NO: 319949 - RNA, 22 nt, Human
uccucaggaucuaggagugcuu

SEQ ID NO: 319950 - RNA, 20 nt, Human
gcugggcuaccacuggcccu

SEQ ID NO: 319951 - RNA, 22 nt, Human
auugaaaguccuaucuaaggga

SEQ ID NO: 319952 - RNA, 22 nt, Human
gcucucagaugcuccagcagcc

SEQ ID NO: 319953 - RNA, 22 nt, Human
uuauuauugugaccugagaaug

SEQ ID NO: 319954 - RNA, 22 nt, Human
guucuucaguaaaauuaaaugu

SEQ ID NO: 319955 - RNA, 22 nt, Human
uggcagcuguguccagguagaa

SEQ ID NO: 319956 - RNA, 22 nt, Human
gcaguguucuuguugcuuuuau

SEQ ID NO: 319957 - RNA, 22 nt, Human
gacucagugauuugacaugccu

SEQ ID NO: 319958 - RNA, 22 nt, Human
ugcucccagggacucuggcugg

SEQ ID NO: 319959 - RNA, 22 nt, Human
ucagcuggcaguucagaggcug

SEQ ID NO: 319960 - RNA, 22 nt, Human
uagugaaacaguuaucaaucug

SEQ ID NO: 319961 - RNA, 22 nt, Human
cagccaggcccccgagucguug

SEQ ID NO: 319962 - RNA, 22 nt, Human
gcugggcagccccuacagagag

SEQ ID NO: 319963 - RNA, 18 nt, Human
gaggauggaaggagaugc

SEQ ID NO: 319964 - RNA, 20 nt, Human
gggguuggcuggcacaggga

SEQ ID NO: 319965 - RNA, 22 nt, Human
auggaaagcuaagccauuuacc

SEQ ID NO: 319966 - RNA, 22 nt, Human
ucuccuucgaggcccagcuccc

SEQ ID NO: 319967 - RNA, 22 nt, Human
auacauguaacugcauuguaau

SEQ ID NO: 319968 - RNA, 22 nt, Human
uuccaagagcuuuaauuguuga

SEQ ID NO: 319969 - RNA, 22 nt, Human
cugggaggacaacuuggagcuc

SEQ ID NO: 319970 - RNA, 22 nt, Human
uuucauguuuauggaaaaugag

SEQ ID NO: 319971 - RNA, 22 nt, Human
cagagagagugggguguggauu

SEQ ID NO: 319972 - RNA, 22 nt, Human
ugcucuguugugcaugugggau

SEQ ID NO: 319973 - RNA, 21 nt, Human
aaagaacaggcagauguucuu

SEQ ID NO: 319974 - RNA, 22 nt, Human
ggguaauuggggccuugcagug

SEQ ID NO: 319975 - RNA, 22 nt, Human
aggagcugagucagcccgacag

SEQ ID NO: 319976 - RNA, 22 nt, Human
guccaugauucuguguaguaga

SEQ ID NO: 319977 - RNA, 22 nt, Human
acagccuguuugaucuggugcu

SEQ ID NO: 319978 - RNA, 22 nt, Human
auuuuuccaauuaggauaaaga

SEQ ID NO: 319979 - RNA, 22 nt, Human
cugggaguugacgaggcuugua

SEQ ID NO: 319980 - RNA, 22 nt, Human
agguacagaugaaagucuaguu

SEQ ID NO: 319981 - RNA, 22 nt, Human
uaacagaaauauuuccagguga

SEQ ID NO: 319982 - RNA, 22 nt, Human
cuacauuuugugauuaugaaau

SEQ ID NO: 319983 - RNA, 22 nt, Human
aauauucaaguuauucuuucuu

SEQ ID NO: 319984 - RNA, 22 nt, Human
uguauguguauguacauaugca

SEQ ID NO: 319985 - RNA, 22 nt, Human
ggcauggcuggguucuggugag

SEQ ID NO: 319986 - RNA, 22 nt, Human
ucuggcucggauuugucuagca

SEQ ID NO: 319987 - RNA, 22 nt, Human
acauuucucagguaagucauuu

SEQ ID NO: 319988 - RNA, 22 nt, Human
ccugcagguuucccccggacgg

SEQ ID NO: 319989 - RNA, 22 nt, Human
agaauucuguucuucgggugug

SEQ ID NO: 319990 - RNA, 22 nt, Human
ggaaagaccugagauaggaaua

SEQ ID NO: 319991 - RNA, 22 nt, Human
ucucagagaagugaugagcaau

SEQ ID NO: 319992 - RNA, 21 nt, Human
agucccaggggugagugaugu

SEQ ID NO: 319993 - RNA, 21 nt, Human
agaagggauugugguaaagau

SEQ ID NO: 319994 - RNA, 22 nt, Human
guuuagaacacggaaauacuga

SEQ ID NO: 319995 - RNA, 22 nt, Human
uccuuuccagccucaccucagc

SEQ ID NO: 319996 - RNA, 22 nt, Human
cugucucuguugccuguaggug

SEQ ID NO: 319997 - RNA, 22 nt, Human
uccaugagaacccuuggagaua

SEQ ID NO: 319998 - RNA, 22 nt, Human
gaagagcugcaguuuccugggc

SEQ ID NO: 319999 - RNA, 22 nt, Human
ucacuguugaccuggaaguggg

SEQ ID NO: 320000 - RNA, 22 nt, Human
gagggcaggggucuugcacggu

SEQ ID NO: 320001 - RNA, 22 nt, Human
ggcagaggaagcuggaaguggg

SEQ ID NO: 320002 - RNA, 22 nt, Human
uaaagguaugucuuaaucaaac

SEQ ID NO: 320003 - RNA, 22 nt, Human
uacuuagagcgauaauuuauac

SEQ ID NO: 320004 - RNA, 22 nt, Human
gggagccaugcuggucuucuuu

SEQ ID NO: 320005 - RNA, 22 nt, Human
guucauuuuacuguaaauagca

SEQ ID NO: 320006 - RNA, 22 nt, Human
agccagggauggcagugcccag

SEQ ID NO: 320007 - RNA, 22 nt, Human
acauacuuuuuaaaagauugcu

SEQ ID NO: 320008 - RNA, 22 nt, Human
cugggccuggcguuccaggcug

SEQ ID NO: 320009 - RNA, 22 nt, Human
uaaguucagaguucucauuugu

SEQ ID NO: 320010 - RNA, 22 nt, Human
gggcacuggaaggcucucaggc

SEQ ID NO: 320011 - RNA, 22 nt, Human
uaugcacaguuacaagaauauc

SEQ ID NO: 320012 - RNA, 22 nt, Human
gaaagauauuuauuggcaacag

SEQ ID NO: 320013 - RNA, 22 nt, Human
ugaaagguguccaauauuucuc

SEQ ID NO: 320014 - RNA, 22 nt, Human
agaggccuuucuguugagugaa

SEQ ID NO: 320015 - RNA, 22 nt, Human
cacugaaggcuaggauuagaug

SEQ ID NO: 320016 - RNA, 22 nt, Human
agcagcaacuuauuuuucuuau

SEQ ID NO: 320017 - RNA, 22 nt, Human
gucucagaguccuacuuauucc

SEQ ID NO: 320018 - RNA, 23 nt, Human
auuucuaggggauuuucuggugc

SEQ ID NO: 320019 - RNA, 22 nt, Human
aggucacauggauaaugaucag

SEQ ID NO: 320020 - RNA, 22 nt, Human
aaaguucuaaaacucuuuguga

SEQ ID NO: 320021 - RNA, 22 nt, Human
uagcagcugugaguaaaagcca

SEQ ID NO: 320022 - RNA, 22 nt, Human
ucugaaaugcaaauuugacuga

SEQ ID NO: 320023 - RNA, 22 nt, Human
cauuuucucaaugaacccucuu

SEQ ID NO: 320024 - RNA, 22 nt, Human
ugggcuggcguggagaguuuag

SEQ ID NO: 320025 - RNA, 22 nt, Human
ccugccuggcugucagcagagc

SEQ ID NO: 320026 - RNA, 22 nt, Human
gcucagugaaacaucaaauagu

SEQ ID NO: 320027 - RNA, 22 nt, Human
ucuucacagaugcauauacuuc

SEQ ID NO: 320028 - RNA, 22 nt, Human
cccaugagguggagguugcagu

SEQ ID NO: 320029 - RNA, 22 nt, Human
ggcucaggacugcagcguagag

SEQ ID NO: 320030 - RNA, 22 nt, Human
cucaggaggugguagaggcccu

SEQ ID NO: 320031 - RNA, 22 nt, Human
acagaaggcggggacaaggcgg

SEQ ID NO: 320032 - RNA, 22 nt, Human
aaaugcacucugcuucugugac

SEQ ID NO: 320033 - RNA, 22 nt, Human
cugggguggaggagcuccccug

SEQ ID NO: 320034 - RNA, 22 nt, Human
aaguucuaauuuugcauucagg

SEQ ID NO: 320035 - RNA, 22 nt, Human
uucaguaaaacacugcaauguc

SEQ ID NO: 320036 - RNA, 19 nt, Human
ucucagaggaaaaauugcu

SEQ ID NO: 320037 - RNA, 21 nt, Human
agagcugguagguagguaggu

SEQ ID NO: 320038 - RNA, 22 nt, Human
ucucagaguuccucuggagucc

SEQ ID NO: 320039 - RNA, 22 nt, Human
caagcccaggauuccccaguua

SEQ ID NO: 320040 - RNA, 22 nt, Human
auugacaaauggauguugacau

SEQ ID NO: 320041 - RNA, 22 nt, Human
uaugagaauaaucugguaaaua

SEQ ID NO: 320042 - RNA, 22 nt, Human
gcugccugcacagagcugcuuu

SEQ ID NO: 320043 - RNA, 22 nt, Human
gcugagggcuguaacagcagag

SEQ ID NO: 320044 - RNA, 22 nt, Human
cucccagagagcaggugggccg

SEQ ID NO: 320045 - RNA, 22 nt, Human
aagccgggccugagaaaugaca

SEQ ID NO: 320046 - RNA, 22 nt, Human
uccugaggcacaauccuagaau

SEQ ID NO: 320047 - RNA, 22 nt, Human
gaaagggagugaagaugguaua

SEQ ID NO: 320048 - RNA, 22 nt, Human
aagagcuggcccaaucugagca

SEQ ID NO: 320049 - RNA, 22 nt, Human
agagcuggauggucaagauggc

SEQ ID NO: 320050 - RNA, 22 nt, Human
ucugccuugagguccucagcuc

SEQ ID NO: 320051 - RNA, 22 nt, Human
uccucugcuguucugguucuuu

SEQ ID NO: 320052 - RNA, 22 nt, Human
ggucaugcugugaaucagugcu

SEQ ID NO: 320053 - RNA, 21 nt, Human
cugcuuuacuucagaggaucu

SEQ ID NO: 320054 - RNA, 22 nt, Human
ugcaguggaggccgugagacag

SEQ ID NO: 320055 - RNA, 22 nt, Human
agcacaugcacagugcuacacu

SEQ ID NO: 320056 - RNA, 22 nt, Human
cagaggccaccuguggccacug

SEQ ID NO: 320057 - RNA, 22 nt, Human
cagcucuguugcccuggaaacg

SEQ ID NO: 320058 - RNA, 22 nt, Human
ggcagauggaagaggcuggguc

SEQ ID NO: 320059 - RNA, 22 nt, Human
ucugccugcggcugcagguggc

SEQ ID NO: 320060 - RNA, 22 nt, Human
gaacuguaguuaauacuacaca

SEQ ID NO: 320061 - RNA, 22 nt, Human
aauacuauguugugacacauga

SEQ ID NO: 320062 - RNA, 23 nt, Human
gugcaugugucuuuacaguagca

SEQ ID NO: 320063 - RNA, 22 nt, Human
aggccagcuuccagaggggcag

SEQ ID NO: 320064 - RNA, 19 nt, Human
gcaggguguugacuguccc

SEQ ID NO: 320065 - RNA, 22 nt, Human
ccagaggucuccugcacgggau

SEQ ID NO: 320066 - RNA, 23 nt, Human
gccucugcagccuaguuaguguc

SEQ ID NO: 320067 - RNA, 22 nt, Human
acuuaguauuuuucagcuuuga

SEQ ID NO: 320068 - RNA, 22 nt, Human
acuuugaaacuaaaauucauua

SEQ ID NO: 320069 - RNA, 22 nt, Human
caggccucccggugcacacuga

SEQ ID NO: 320070 - RNA, 22 nt, Human
ugaggugaccgcagaugggaag

SEQ ID NO: 320071 - RNA, 20 nt, Human
augcuuucuugugugcugcu

SEQ ID NO: 320072 - RNA, 22 nt, Human
ugaaagcuguccacuaggcugu

SEQ ID NO: 320073 - RNA, 22 nt, Human
uggcaguguauagguggcuccu

SEQ ID NO: 320074 - RNA, 19 nt, Human
ucccagagucuagagguug

SEQ ID NO: 320075 - RNA, 22 nt, Human
gcucacuggccugaagaggacg

SEQ ID NO: 320076 - RNA, 22 nt, Human
agccuggccugggcaggcacau

SEQ ID NO: 320077 - RNA, 22 nt, Human
cucucuguuaugcuuucaugaa

SEQ ID NO: 320078 - RNA, 22 nt, Human
uaaaugugggggccacgggcuu

SEQ ID NO: 320079 - RNA, 22 nt, Human
agcugccauccuguucagcacc

SEQ ID NO: 320080 - RNA, 22 nt, Human
uuaaaugaggcugauguagauu

SEQ ID NO: 320081 - RNA, 22 nt, Human
uauuucugaauccaaaagguca

SEQ ID NO: 320082 - RNA, 22 nt, Human
cuccucuggcuuccuggaggca

SEQ ID NO: 320083 - RNA, 22 nt, Human
uucuggagcuaaaguccacucu

SEQ ID NO: 320084 - RNA, 20 nt, Human
ccacaggaguccagucgacc

SEQ ID NO: 320085 - RNA, 22 nt, Human
uccagccaacugccuagggagc

SEQ ID NO: 320086 - RNA, 22 nt, Human
aaggcugaguaaaacagagaac

SEQ ID NO: 320087 - RNA, 22 nt, Human
gaguguucccacaccccaguug

SEQ ID NO: 320088 - RNA, 22 nt, Human
agcugccagcaaguuucaaaca

SEQ ID NO: 320089 - RNA, 23 nt, Human
aucaaaguggaaaucaauuaucu

SEQ ID NO: 320090 - RNA, 22 nt, Human
caggccugcaggaaaggcuccc

SEQ ID NO: 320091 - RNA, 22 nt, Human
ucucuggaauuuugagagugac

SEQ ID NO: 320092 - RNA, 22 nt, Human
gucucaguuacucucccuggua

SEQ ID NO: 320093 - RNA, 22 nt, Human
cugggcucuaagggagcaccgu

SEQ ID NO: 320094 - RNA, 22 nt, Human
gaaaugcagauucugauucugu

SEQ ID NO: 320095 - RNA, 22 nt, Human
cuugaauccaaaugggagauga

SEQ ID NO: 320096 - RNA, 22 nt, Human
ugcucugugguccaagauggcu

SEQ ID NO: 320097 - RNA, 22 nt, Human
aaagagcuucauuuccauuuau

SEQ ID NO: 320098 - RNA, 22 nt, Human
ugcagcuguuacggacccuguc

SEQ ID NO: 320099 - RNA, 22 nt, Human
agggaguguaaauggugcucag

SEQ ID NO: 320100 - RNA, 22 nt, Human
cugcuguguuggcauuggauag

SEQ ID NO: 320101 - RNA, 22 nt, Human
ggaggggccggcugccugccac

SEQ ID NO: 320102 - RNA, 22 nt, Human
cugcucuguuaauuaaacuuug

SEQ ID NO: 320103 - RNA, 22 nt, Human
uucugucagaagcuagcuccug

SEQ ID NO: 320104 - RNA, 22 nt, Human
gcaaggcagcgcggaguagcua

SEQ ID NO: 320105 - RNA, 20 nt, Human
agcagcuguguuuucauccu

SEQ ID NO: 320106 - RNA, 18 nt, Human
gcuccuggaccaggucac

SEQ ID NO: 320107 - RNA, 20 nt, Human
cugagcccccagccugcagg

SEQ ID NO: 320108 - RNA, 22 nt, Human
agggccuggaacuggagaccac

SEQ ID NO: 320109 - RNA, 22 nt, Human
aggcuucuuagauuggcuggag

SEQ ID NO: 320110 - RNA, 20 nt, Human
aggaggcaauguagauaagc

SEQ ID NO: 320111 - RNA, 22 nt, Human
ucuuuccuaggugauaugcaau

SEQ ID NO: 320112 - RNA, 23 nt, Human
uugcuuucaucaugagaugcucc

SEQ ID NO: 320113 - RNA, 22 nt, Human
ucuucacauggaacaugaagcu

SEQ ID NO: 320114 - RNA, 22 nt, Human
gaauuguagagggaacagaagc

SEQ ID NO: 320115 - RNA, 22 nt, Human
uccuugaagagugggcggucga

SEQ ID NO: 320116 - RNA, 22 nt, Human
cuggagccuagguugaccuggg

SEQ ID NO: 320117 - RNA, 22 nt, Human
cagagccugccaccuuucuccc

SEQ ID NO: 320118 - RNA, 22 nt, Human
guucuucaggccauccucccag

SEQ ID NO: 320119 - RNA, 22 nt, Human
ucauugcaguugaguuguguua

SEQ ID NO: 320120 - RNA, 22 nt, Human
ggcugcaggcagaggcugucug

SEQ ID NO: 320121 - RNA, 22 nt, Human
ggaggggagucucccaaagccg

SEQ ID NO: 320122 - RNA, 22 nt, Human
auguacaguggaaacuaacaaa

SEQ ID NO: 320123 - RNA, 21 nt, Human
gcugcaucaaucuacccaggg

SEQ ID NO: 320124 - RNA, 22 nt, Human
gacagccucaugaggagcaaaa

SEQ ID NO: 320125 - RNA, 22 nt, Human
gaaguacaguuuuaucuagcca

SEQ ID NO: 320126 - RNA, 22 nt, Human
agaugggcgcccuggacugagg

SEQ ID NO: 320127 - RNA, 22 nt, Human
uguuagaaguuaaucacuaauu

SEQ ID NO: 320128 - RNA, 22 nt, Human
uguguguauaugcauuuaucua

SEQ ID NO: 320129 - RNA, 22 nt, Human
gcuccagaugaaaggccagagg

SEQ ID NO: 320130 - RNA, 23 nt, Human
uugauuucaaaugcagagaacac

SEQ ID NO: 320131 - RNA, 22 nt, Human
ggacccugggcuugcuccuggg

SEQ ID NO: 320132 - RNA, 22 nt, Human
aauugcuaaagauuauguuuuc

SEQ ID NO: 320133 - RNA, 22 nt, Human
ccugucugcagauaucucaggu

SEQ ID NO: 320134 - RNA, 17 nt, Human
ucauuuguugugacuag

SEQ ID NO: 320135 - RNA, 18 nt, Human
uggcagccagcugcuccu

SEQ ID NO: 320136 - RNA, 20 nt, Human
ugcagggcugccucccagcu

SEQ ID NO: 320137 - RNA, 22 nt, Human
cucauggagggagugcucuucc

SEQ ID NO: 320138 - RNA, 22 nt, Human
uuucaguguaucuuccaaaagc

SEQ ID NO: 320139 - RNA, 22 nt, Human
caguggcagagaacagagaccu

SEQ ID NO: 320140 - RNA, 22 nt, Human
uaguuauuauuguuacuaucag

SEQ ID NO: 320141 - RNA, 22 nt, Human
ucacaggguuuggaagccuccu

SEQ ID NO: 320142 - RNA, 22 nt, Human
ggccucugcccucacuccuguc

SEQ ID NO: 320143 - RNA, 20 nt, Human
agugucuggugcagggccuc

SEQ ID NO: 320144 - RNA, 22 nt, Human
aaguucaaguguaaucuuuauu

SEQ ID NO: 320145 - RNA, 22 nt, Human
ucacauuuucauauucucugag

SEQ ID NO: 320146 - RNA, 22 nt, Human
aacauucuauuuugcuaaaaca

SEQ ID NO: 320147 - RNA, 22 nt, Human
uugugaaauguuucaaaauagu

SEQ ID NO: 320148 - RNA, 22 nt, Human
cccagaggugcuucagaggugc

SEQ ID NO: 320149 - RNA, 21 nt, Human
auugaaagucaacaaucaguu

SEQ ID NO: 320150 - RNA, 22 nt, Human
cagagaccccgcugcccuucug

SEQ ID NO: 320151 - RNA, 22 nt, Human
ccauggaguuccucuggucuau

SEQ ID NO: 320152 - RNA, 22 nt, Human
agugcuuuaccuagauaauguu

SEQ ID NO: 320153 - RNA, 22 nt, Human
agcugcugaaugacacugcaag

SEQ ID NO: 320154 - RNA, 22 nt, Human
ugcucuguaaggucagaaaagg

SEQ ID NO: 320155 - RNA, 22 nt, Human
agcucauggugcuaucucaggg

SEQ ID NO: 320156 - RNA, 22 nt, Human
ugcauauuuuauaaagauggaa

SEQ ID NO: 320157 - RNA, 22 nt, Human
agcagcaugaugacagagucuc

SEQ ID NO: 320158 - RNA, 22 nt, Human
uguaaaaccaaaucaaucuagu

SEQ ID NO: 320159 - RNA, 21 nt, Human
ucagggcagugggagguuccu

SEQ ID NO: 320160 - RNA, 22 nt, Human
ucucagagggaaacaugaguga

SEQ ID NO: 320161 - RNA, 22 nt, Human
gcugucugcugggucgcucagg

SEQ ID NO: 320162 - RNA, 22 nt, Human
aggguauaaagagcaagcagaa

SEQ ID NO: 320163 - RNA, 21 nt, Human
uauuucuuugacucucucccu

SEQ ID NO: 320164 - RNA, 22 nt, Human
ccagagccggcucccucagcuu

SEQ ID NO: 320165 - RNA, 22 nt, Human
gaaauuauugcuagagacugca

SEQ ID NO: 320166 - RNA, 22 nt, Human
uuugaacuucuccauucugaug

SEQ ID NO: 320167 - RNA, 19 nt, Human
cuugcugggugguuucugc

SEQ ID NO: 320168 - RNA, 22 nt, Human
guccucugacucagccuuggga

SEQ ID NO: 320169 - RNA, 22 nt, Human
aguguuucuggcaaaugaaagu

SEQ ID NO: 320170 - RNA, 22 nt, Human
ggcugccagugagugcagaccg

SEQ ID NO: 320171 - RNA, 22 nt, Human
gaguguuccagaaacuggcccu

SEQ ID NO: 320172 - RNA, 22 nt, Human
uggcagggugccaguugcgagu

SEQ ID NO: 320173 - RNA, 22 nt, Human
agccuggaguucccaggagaag

SEQ ID NO: 320174 - RNA, 22 nt, Human
gcucucuggaggccauggacag

SEQ ID NO: 320175 - RNA, 22 nt, Human
ccugucucccuggcauggcuca

SEQ ID NO: 320176 - RNA, 22 nt, Human
uccucaggcggugaggaggggc

SEQ ID NO: 320177 - RNA, 22 nt, Human
guguaugaacgaaagaauggau

SEQ ID NO: 320178 - RNA, 22 nt, Human
aaaguucaugguguuauagaaa

SEQ ID NO: 320179 - RNA, 22 nt, Human
ugggcccaagagagucuccaac

SEQ ID NO: 320180 - RNA, 18 nt, Human
ugucauugccagggaagc

SEQ ID NO: 320181 - RNA, 22 nt, Human
ugagaacugaggauuugaauuc

SEQ ID NO: 320182 - RNA, 22 nt, Human
cuguguccugcgucaagccaau

SEQ ID NO: 320183 - RNA, 22 nt, Human
auuucuguauccugcugucaga

SEQ ID NO: 320184 - RNA, 22 nt, Human
gagcaacaguuuaugguuuuuc

SEQ ID NO: 320185 - RNA, 22 nt, Human
aagcagccuggcaugaugcuuu

SEQ ID NO: 320186 - RNA, 22 nt, Human
agaggaggccaggcccacaccu

SEQ ID NO: 320187 - RNA, 22 nt, Human
gcacacagccagcugagggcua

SEQ ID NO: 320188 - RNA, 22 nt, Human
caagaugccccugguagggauc

SEQ ID NO: 320189 - RNA, 22 nt, Human
uaaaugugucuuuuuaaggccu

SEQ ID NO: 320190 - RNA, 22 nt, Human
uugacaauugggagauauaaag

SEQ ID NO: 320191 - RNA, 20 nt, Human
ccaguccaccugagacaugu

SEQ ID NO: 320192 - RNA, 22 nt, Human
ugggcagaaaucaguaucagau

SEQ ID NO: 320193 - RNA, 21 nt, Human
aucagcaaaugccugucuccc

SEQ ID NO: 320194 - RNA, 20 nt, Human
acauguacuaaugaauacag

SEQ ID NO: 320195 - RNA, 22 nt, Human
uccuggggcucugagcgagaca

SEQ ID NO: 320196 - RNA, 22 nt, Human
gaggucaggggagaggcugaug

SEQ ID NO: 320197 - RNA, 22 nt, Human
acagaguaggugcugucgacug

SEQ ID NO: 320198 - RNA, 22 nt, Human
aaagcuaugaggcaugcauuuc

SEQ ID NO: 320199 - RNA, 22 nt, Human
cagucccacuagugccaauacc

SEQ ID NO: 320200 - RNA, 22 nt, Human
cacagcuuguuuagugacucac

SEQ ID NO: 320201 - RNA, 22 nt, Human
cuguaugaguugggaauagaau

SEQ ID NO: 320202 - RNA, 22 nt, Human
gucccaggugggcuccaccucu

SEQ ID NO: 320203 - RNA, 22 nt, Human
acugaaggcuuucccaagguca

SEQ ID NO: 320204 - RNA, 21 nt, Human
cucuggaggcaagggagagug

SEQ ID NO: 320205 - RNA, 22 nt, Human
aagcgccaugguuccugcgcag

SEQ ID NO: 320206 - RNA, 22 nt, Human
ggucccagaauugguuagcaca

SEQ ID NO: 320207 - RNA, 22 nt, Human
ugaaaugaaacagaacauauca

SEQ ID NO: 320208 - RNA, 22 nt, Human
ggccagaggccacagcuguguc

SEQ ID NO: 320209 - RNA, 22 nt, Human
ccuccaaguuugacucaggaca

SEQ ID NO: 320210 - RNA, 22 nt, Human
gccccagccaaggugacacgaa

SEQ ID NO: 320211 - RNA, 22 nt, Human
guggagccaggggcuguaggua

SEQ ID NO: 320212 - RNA, 22 nt, Human
gagggucccugcucagggccag

SEQ ID NO: 320213 - RNA, 22 nt, Human
agugcuuucuugcuccaucagu

SEQ ID NO: 320214 - RNA, 22 nt, Human
gcccucugcuggccucaccucg

SEQ ID NO: 320215 - RNA, 22 nt, Human
cuggcuguauuaguuugauccu

SEQ ID NO: 320216 - RNA, 22 nt, Human
uugaaaguagcagcugcauaug

SEQ ID NO: 320217 - RNA, 23 nt, Human
uccaagggcuacaaacacagacc

SEQ ID NO: 320218 - RNA, 22 nt, Human
uuguuucauggggauguuuauu

SEQ ID NO: 320219 - RNA, 22 nt, Human
cuguucauggaaaaauaguugg

SEQ ID NO: 320220 - RNA, 22 nt, Human
gcaggagcuggaaagugauguu

SEQ ID NO: 320221 - RNA, 22 nt, Human
auucccaucgucaacuucacug

SEQ ID NO: 320222 - RNA, 22 nt, Human
auguaagguucagaguauguga

SEQ ID NO: 320223 - RNA, 22 nt, Human
gugggggcaggcagugcuagga

SEQ ID NO: 320224 - RNA, 22 nt, Human
cuggucugagggcucuugaggc

SEQ ID NO: 320225 - RNA, 22 nt, Human
uuccauuguuucugucuucacu

SEQ ID NO: 320226 - RNA, 22 nt, Human
uuuuccucuguauuugaaaugc

SEQ ID NO: 320227 - RNA, 22 nt, Human
ugggcuggcccaccacaccucg

SEQ ID NO: 320228 - RNA, 22 nt, Human
auagaaauguauuuuggacuag

SEQ ID NO: 320229 - RNA, 22 nt, Human
aggggagaguuaaugugaaugu

SEQ ID NO: 320230 - RNA, 22 nt, Human
cucuccuggggagcacacacac

SEQ ID NO: 320231 - RNA, 22 nt, Human
ucuccaagcagggcugcaaggc

SEQ ID NO: 320232 - RNA, 19 nt, Human
guuuuucccagacgaggca

SEQ ID NO: 320233 - RNA, 22 nt, Human
uaacauuagguagacauaagcc

SEQ ID NO: 320234 - RNA, 22 nt, Human
caaaguuuaaaguagauuucag

SEQ ID NO: 320235 - RNA, 22 nt, Human
ugaggccaaugacccugggcag

SEQ ID NO: 320236 - RNA, 22 nt, Human
ugaaaugagauaauuuaagugc

SEQ ID NO: 320237 - RNA, 22 nt, Human
cauggcaggugcagauucugug

SEQ ID NO: 320238 - RNA, 22 nt, Human
aguccaaggagagacagcauuu

SEQ ID NO: 320239 - RNA, 20 nt, Human
ugaagcagccuugauucugu

SEQ ID NO: 320240 - RNA, 22 nt, Human
aggacugggugcagagggcauc

SEQ ID NO: 320241 - RNA, 22 nt, Human
gccuggugaaaggcagagagcg

SEQ ID NO: 320242 - RNA, 22 nt, Human
uaaggcaccuguccaggcuggg

SEQ ID NO: 320243 - RNA, 22 nt, Human
cuuagaaaugcagauucucagg

SEQ ID NO: 320244 - RNA, 22 nt, Human
uucaguaugauuccuccaguag

SEQ ID NO: 320245 - RNA, 17 nt, Human
auuuccucagggcugag

SEQ ID NO: 320246 - RNA, 22 nt, Human
uuuuuaguagagguggguuuca

SEQ ID NO: 320247 - RNA, 22 nt, Human
cugccugugccaaugcuccuuu

SEQ ID NO: 320248 - RNA, 22 nt, Human
cuuccaaacccaggguaugggc

SEQ ID NO: 320249 - RNA, 22 nt, Human
acaggcagcgucauugcugcuc

SEQ ID NO: 320250 - RNA, 22 nt, Human
ugggcuguggagcaccuuugca

SEQ ID NO: 320251 - RNA, 21 nt, Human
ugcuuuaugggaaaaauguca

SEQ ID NO: 320252 - RNA, 22 nt, Human
gaaauauuucucuugagccccu

SEQ ID NO: 320253 - RNA, 22 nt, Human
uauaucaccaaaaacaguucug

SEQ ID NO: 320254 - RNA, 22 nt, Human
agacaucagcuugugugcaggg

SEQ ID NO: 320255 - RNA, 22 nt, Human
aagggagacaguugugugagga

SEQ ID NO: 320256 - RNA, 22 nt, Human
aguguuccuugcuuucccagag

SEQ ID NO: 320257 - RNA, 22 nt, Human
gcccucucuucugcagccucca

SEQ ID NO: 320258 - RNA, 23 nt, Human
agaggcaggaguggcuugcccgg

SEQ ID NO: 320259 - RNA, 22 nt, Human
gcugccacucugagcuugcuuc

SEQ ID NO: 320260 - RNA, 22 nt, Human
ucacacguccuugcuacuccuc

SEQ ID NO: 320261 - RNA, 22 nt, Human
cugcuuugacuguuaagaacca

SEQ ID NO: 320262 - RNA, 22 nt, Human
uaugcauauagaugcacacaca

SEQ ID NO: 320263 - RNA, 22 nt, Human
ucaguguuggcauucagaaaug

SEQ ID NO: 320264 - RNA, 22 nt, Human
cagccagagaaagggcacugcc

SEQ ID NO: 320265 - RNA, 22 nt, Human
uucaggaugcagagguuguagu

SEQ ID NO: 320266 - RNA, 22 nt, Human
ucacaggagggagagacaccca

SEQ ID NO: 320267 - RNA, 22 nt, Human
uuuccucuucgauuaaguuugg

SEQ ID NO: 320268 - RNA, 22 nt, Human
ccaaggagaaugacaccaugga

SEQ ID NO: 320269 - RNA, 22 nt, Human
ggcuucuuccugugaacauguu

SEQ ID NO: 320270 - RNA, 22 nt, Human
gagggcugcuggaaaaaugcag

SEQ ID NO: 320271 - RNA, 22 nt, Human
uuucaaagaguuguaaauuacu

SEQ ID NO: 320272 - RNA, 22 nt, Human
augagagacuguguguugggag

SEQ ID NO: 320273 - RNA, 22 nt, Human
ugcugucccccgugucugggcu

SEQ ID NO: 320274 - RNA, 22 nt, Human
uaaggccaaacuauuauaguuc

SEQ ID NO: 320275 - RNA, 22 nt, Human
cacauuuaauccuuuauaagua

SEQ ID NO: 320276 - RNA, 22 nt, Human
caaaagucuuccuauucucuua

SEQ ID NO: 320277 - RNA, 22 nt, Human
gaggggcucuugggcaugaagg

SEQ ID NO: 320278 - RNA, 22 nt, Human
uucuugcaggucacucacugag

SEQ ID NO: 320279 - RNA, 22 nt, Human
ucccagaguucaaugggaaggu

SEQ ID NO: 320280 - RNA, 22 nt, Human
uuucacaaguaaaguccuaagu

SEQ ID NO: 320281 - RNA, 19 nt, Human
ccaggccuccugggagguc

SEQ ID NO: 320282 - RNA, 22 nt, Human
uucaggaugacaccauguccag

SEQ ID NO: 320283 - RNA, 22 nt, Human
ccagggcacuuaggcccagccc

SEQ ID NO: 320284 - RNA, 19 nt, Human
cccagagcauccugaacuu

SEQ ID NO: 320285 - RNA, 22 nt, Human
uggcucugaccagguagaggag

SEQ ID NO: 320286 - RNA, 17 nt, Human
uuccuggaagucauucc

SEQ ID NO: 320287 - RNA, 22 nt, Human
aguuauuacucuuuaacauauu

SEQ ID NO: 320288 - RNA, 22 nt, Human
agcugccauggccugaauuuac

SEQ ID NO: 320289 - RNA, 22 nt, Human
ucaggcagcuccaggaauggua

SEQ ID NO: 320290 - RNA, 21 nt, Human
ugcagccauucagcccuaugc

SEQ ID NO: 320291 - RNA, 22 nt, Human
uucuuuaaaauagugagaaaga

SEQ ID NO: 320292 - RNA, 22 nt, Human
aaggcacuuuuccugagaugau

SEQ ID NO: 320293 - RNA, 22 nt, Human
auucuucauuguugauucaugu

SEQ ID NO: 320294 - RNA, 20 nt, Human
agagccuggaaaaagacauc

SEQ ID NO: 320295 - RNA, 21 nt, Human
gagacagacuuucguccccug

SEQ ID NO: 320296 - RNA, 22 nt, Human
guuccauaucacagcagacgaa

SEQ ID NO: 320297 - RNA, 22 nt, Human
uucucugaucuugcuagacuga

SEQ ID NO: 320298 - RNA, 22 nt, Human
agagccugcagcugugaagaaa

SEQ ID NO: 320299 - RNA, 22 nt, Human
uggcuuccacugugugcccccu

SEQ ID NO: 320300 - RNA, 23 nt, Human
gcagagcugcccuauugccuugg

SEQ ID NO: 320301 - RNA, 22 nt, Human
ucucagagauuuauggaaaacu

SEQ ID NO: 320302 - RNA, 22 nt, Human
uaauacuguauacugcaaauuu

SEQ ID NO: 320303 - RNA, 22 nt, Human
agggcugguauguccaugaaag

SEQ ID NO: 320304 - RNA, 22 nt, Human
uuuccucauuuaucugcuggga

SEQ ID NO: 320305 - RNA, 22 nt, Human
gaaguucucagcuaggugaugu

SEQ ID NO: 320306 - RNA, 22 nt, Human
gaaggaaaggucucaugccuuu

SEQ ID NO: 320307 - RNA, 22 nt, Human
cuaggaggcgggggcugcagua

SEQ ID NO: 320308 - RNA, 22 nt, Human
aguuaaagucugaaauagagaa

SEQ ID NO: 320309 - RNA, 22 nt, Human
ucacuuagauggggaucaucac

SEQ ID NO: 320310 - RNA, 22 nt, Human
ugaauaguccuuggaauaacug

SEQ ID NO: 320311 - RNA, 22 nt, Human
cucugggcaaguaugauagaaa

SEQ ID NO: 320312 - RNA, 20 nt, Human
aggcugggguguuuugccca

SEQ ID NO: 320313 - RNA, 22 nt, Human
agagaagggguaaagaguccug

SEQ ID NO: 320314 - RNA, 22 nt, Human
agcaggcuaagggaccuguuua

SEQ ID NO: 320315 - RNA, 22 nt, Human
ggcagcuccuccuagucugccc

SEQ ID NO: 320316 - RNA, 22 nt, Human
aagaggccucaccucacugccc

SEQ ID NO: 320317 - RNA, 19 nt, Human
agcaaauauaauaguguuc

SEQ ID NO: 320318 - RNA, 22 nt, Human
aaacuguaagagaauaaacuac

SEQ ID NO: 320319 - RNA, 22 nt, Human
ccugggaggcugugggucugcu

SEQ ID NO: 320320 - RNA, 22 nt, Human
gagaaacuuggaguuauucugg

SEQ ID NO: 320321 - RNA, 22 nt, Human
ucggagcuguagaugaaacccu

SEQ ID NO: 320322 - RNA, 22 nt, Human
cagucccaaggaggaagcaguc

SEQ ID NO: 320323 - RNA, 22 nt, Human
uuucacauacaguguauaguag

SEQ ID NO: 320324 - RNA, 19 nt, Human
cuggggcuuugguacugcc

SEQ ID NO: 320325 - RNA, 22 nt, Human
agggcagagacaugcuuccuga

SEQ ID NO: 320326 - RNA, 22 nt, Human
acacaaguucuaaagauugcgc

SEQ ID NO: 320327 - RNA, 22 nt, Human
uuagaacuuaagaauacugucu

SEQ ID NO: 320328 - RNA, 22 nt, Human
uaaaguucagugcaugaaugug

SEQ ID NO: 320329 - RNA, 22 nt, Human
aggcacugauucucagaguuac

SEQ ID NO: 320330 - RNA, 22 nt, Human
uugaaaggugaacaugaugcac

SEQ ID NO: 320331 - RNA, 22 nt, Human
agcagccagaaauccagaggug

SEQ ID NO: 320332 - RNA, 22 nt, Human
gagcugccugaacaagcagcag

SEQ ID NO: 320333 - RNA, 21 nt, Human
aacaaagggaugcucaucuuu

SEQ ID NO: 320334 - RNA, 18 nt, Human
uugcuuuguaagcuugca

SEQ ID NO: 320335 - RNA, 22 nt, Human
ucuggccauggcaagccgagug

SEQ ID NO: 320336 - RNA, 20 nt, Human
ucaggcaguggggaaaggca

SEQ ID NO: 320337 - RNA, 22 nt, Human
cagcccuggccccagguggucu

SEQ ID NO: 320338 - RNA, 22 nt, Human
gaaguuuauuucaaucuauuca

SEQ ID NO: 320339 - RNA, 22 nt, Human
auggcagccuguggacagucaa

SEQ ID NO: 320340 - RNA, 22 nt, Human
gaaucucauucuaacuaguagg

SEQ ID NO: 320341 - RNA, 22 nt, Human
agugcuuugugcucucacugca

SEQ ID NO: 320342 - RNA, 22 nt, Human
aggcagaaaauagucauccaaa

SEQ ID NO: 320343 - RNA, 22 nt, Human
ugauuucauaguauauacauga

SEQ ID NO: 320344 - RNA, 22 nt, Human
caguccugcuagugugaaaagc

SEQ ID NO: 320345 - RNA, 22 nt, Human
agaaaagguugaaaguaggauu

SEQ ID NO: 320346 - RNA, 22 nt, Human
guguacaugagaaaucaacuuu

SEQ ID NO: 320347 - RNA, 22 nt, Human
uggccacagccucugccaguuc

SEQ ID NO: 320348 - RNA, 22 nt, Human
uugcagggcaggaccauggaca

SEQ ID NO: 320349 - RNA, 22 nt, Human
cccagccuggugcacugugggg

SEQ ID NO: 320350 - RNA, 22 nt, Human
cagcugccaagaaucuuuucua

SEQ ID NO: 320351 - RNA, 22 nt, Human
gagcugggaguuauagcauguu

SEQ ID NO: 320352 - RNA, 22 nt, Human
ucugccuggguguggagcagag

SEQ ID NO: 320353 - RNA, 22 nt, Human
cugcccugagggccuguguguu

SEQ ID NO: 320354 - RNA, 23 nt, Human
cagaaaacccagagcucaguccc

SEQ ID NO: 320355 - RNA, 19 nt, Human
agcagcuggagguggagug

SEQ ID NO: 320356 - RNA, 22 nt, Human
auggggcucugcggcugcuccc

SEQ ID NO: 320357 - RNA, 22 nt, Human
ggagugacucacagcugggaca

SEQ ID NO: 320358 - RNA, 22 nt, Human
gccaggcagcaggaagccagug

SEQ ID NO: 320359 - RNA, 22 nt, Human
cagcucucuaaggucuugcuuu

SEQ ID NO: 320360 - RNA, 18 nt, Human
ucuuccaacacugacacc

SEQ ID NO: 320361 - RNA, 22 nt, Human
guuuuccuucucagccauugcc

SEQ ID NO: 320362 - RNA, 22 nt, Human
cucuggaauguuuacaugcccu

SEQ ID NO: 320363 - RNA, 22 nt, Human
uaaugugugucaucaguagagu

SEQ ID NO: 320364 - RNA, 22 nt, Human
ggccugugucugugccuguccu

SEQ ID NO: 320365 - RNA, 22 nt, Human
uacugcaugguggaguggagcu

SEQ ID NO: 320366 - RNA, 22 nt, Human
ggccucuggucaagacaagcau

SEQ ID NO: 320367 - RNA, 22 nt, Human
uguggcccagaugagugugcua

SEQ ID NO: 320368 - RNA, 22 nt, Human
ccugggcaacauagugagaccc

SEQ ID NO: 320369 - RNA, 22 nt, Human
cacaggaggaggugcccgggcc

SEQ ID NO: 320370 - RNA, 22 nt, Human
cagcccuggaacagcugacuca

SEQ ID NO: 320371 - RNA, 22 nt, Human
gcugugcuauaucucugagugu

SEQ ID NO: 320372 - RNA, 22 nt, Human
aucuuccuucacuuucucccac

SEQ ID NO: 320373 - RNA, 23 nt, Human
ugcucccaggugacgcugcuguu

SEQ ID NO: 320374 - RNA, 22 nt, Human
ggagcugggaacuauguaguau

SEQ ID NO: 320375 - RNA, 22 nt, Human
uuguaugagcuccaggaacuca

SEQ ID NO: 320376 - RNA, 22 nt, Human
cucacaggagaaagucaugguc

SEQ ID NO: 320377 - RNA, 22 nt, Human
ucauugcagcuucagguguuca

SEQ ID NO: 320378 - RNA, 22 nt, Human
auugaauagaugcauuauacua

SEQ ID NO: 320379 - RNA, 21 nt, Human
gagcugggcgaggcuccgggg

SEQ ID NO: 320380 - RNA, 16 nt, Human
gggagggaguuggugg

SEQ ID NO: 320381 - RNA, 22 nt, Human
acagaguauuggaaaggcagug

SEQ ID NO: 320382 - RNA, 22 nt, Human
auggggagagaagggcugagcu

SEQ ID NO: 320383 - RNA, 22 nt, Human
gaggcaggcacuguuaucagca

SEQ ID NO: 320384 - RNA, 22 nt, Human
caaaugaauauuuccauggguu

SEQ ID NO: 320385 - RNA, 22 nt, Human
agugagaguauuaaugugaacu

SEQ ID NO: 320386 - RNA, 22 nt, Human
gcccucagaggacagcugacuu

SEQ ID NO: 320387 - RNA, 22 nt, Human
agccucugcuggcccuggcacu

SEQ ID NO: 320388 - RNA, 22 nt, Human
ucagagagccucaggcacugcc

SEQ ID NO: 320389 - RNA, 20 nt, Human
ccuguggagcugccuccucc

SEQ ID NO: 320390 - RNA, 22 nt, Human
cugggcaguuuauucaguucug

SEQ ID NO: 320391 - RNA, 22 nt, Human
gcucaggaaacagcagggcuug

SEQ ID NO: 320392 - RNA, 22 nt, Human
ucaguucugcuagaaaaacagu

SEQ ID NO: 320393 - RNA, 22 nt, Human
ccaggccuucugaggacacucu

SEQ ID NO: 320394 - RNA, 22 nt, Human
uuuguguuuguacaaugcacua

SEQ ID NO: 320395 - RNA, 22 nt, Human
ucucuggagggcuccaggcggg

SEQ ID NO: 320396 - RNA, 22 nt, Human
gaggaagcagggcuuggcugag

SEQ ID NO: 320397 - RNA, 22 nt, Human
ugggauggagccugaguauagu

SEQ ID NO: 320398 - RNA, 22 nt, Human
uggggcuguggauucucacgaa

SEQ ID NO: 320399 - RNA, 22 nt, Human
cugcaggggcaguccacuuccu

SEQ ID NO: 320400 - RNA, 22 nt, Human
caggagcugggucuggaagcag

SEQ ID NO: 320401 - RNA, 22 nt, Human
agagugaaguuuuugaaaguga

SEQ ID NO: 320402 - RNA, 22 nt, Human
ucugccuggaugauggcagggc

SEQ ID NO: 320403 - RNA, 22 nt, Human
ugggcaagucacuucugucuuu

SEQ ID NO: 320404 - RNA, 22 nt, Human
agagaacacgugcaucugcaau

SEQ ID NO: 320405 - RNA, 22 nt, Human
ggcugcuguuucagagacuguu

SEQ ID NO: 320406 - RNA, 22 nt, Human
ucccugggccacagcugugagc

SEQ ID NO: 320407 - RNA, 22 nt, Human
caggcugcagcagcaguggccc

SEQ ID NO: 320408 - RNA, 22 nt, Human
aacuuuauuguuaggggcuaaa

SEQ ID NO: 320409 - RNA, 22 nt, Human
gaggagagggcugcgggcccac

SEQ ID NO: 320410 - RNA, 22 nt, Human
ucugggagacguguguugucag

SEQ ID NO: 320411 - RNA, 22 nt, Human
ucauuucccuccuacaaagagg

SEQ ID NO: 320412 - RNA, 22 nt, Human
aaacacagauuucuuuguccca

SEQ ID NO: 320413 - RNA, 22 nt, Human
gaggcagagugcaccccaggag

SEQ ID NO: 320414 - RNA, 22 nt, Human
caggggcuuaagugacagaagg

SEQ ID NO: 320415 - RNA, 22 nt, Human
uaugagcuuccaguguugcaug

SEQ ID NO: 320416 - RNA, 22 nt, Human
ugcugggcuagaagcugaggcc

SEQ ID NO: 320417 - RNA, 22 nt, Human
ugucaagucucugaaugaaaug

SEQ ID NO: 320418 - RNA, 19 nt, Human
agaggccucagcagcuggc

SEQ ID NO: 320419 - RNA, 16 nt, Human
ccaccugcagcucuca

SEQ ID NO: 320420 - RNA, 22 nt, Human
gccucugcggggcccgagcccg

SEQ ID NO: 320421 - RNA, 22 nt, Human
uagcugggucucuguuuucuca

SEQ ID NO: 320422 - RNA, 22 nt, Human
gugauuucagguuuuucauacu

SEQ ID NO: 320423 - RNA, 22 nt, Human
uuugaaaggaaguuaauacuuu

SEQ ID NO: 320424 - RNA, 20 nt, Human
ggcugaaaguagaaaguauu

SEQ ID NO: 320425 - RNA, 22 nt, Human
gagccucguggcggccacugcg

SEQ ID NO: 320426 - RNA, 22 nt, Human
uuucuguauuuaaaagaucugg

SEQ ID NO: 320427 - RNA, 22 nt, Human
uagaaauccccagucucauagu

SEQ ID NO: 320428 - RNA, 22 nt, Human
uccuucagaggacggcagccag

SEQ ID NO: 320429 - RNA, 22 nt, Human
cugggcuguaauguggcacuga

SEQ ID NO: 320430 - RNA, 20 nt, Human
aagagcauaguacaggaaga

SEQ ID NO: 320431 - RNA, 22 nt, Human
guucccauacaguaucagugcu

SEQ ID NO: 320432 - RNA, 22 nt, Human
uucuucaauuauuggaaagaaa

SEQ ID NO: 320433 - RNA, 22 nt, Human
cauuuguaauacugacuugcag

SEQ ID NO: 320434 - RNA, 22 nt, Human
ggcugccucugaugugcagacg

SEQ ID NO: 320435 - RNA, 22 nt, Human
ugaagcagcaccauuuuagagc

SEQ ID NO: 320436 - RNA, 22 nt, Human
gcugccuccugaaagcgcucug

SEQ ID NO: 320437 - RNA, 22 nt, Human
uagcagggguagauagagugug

SEQ ID NO: 320438 - RNA, 22 nt, Human
ucuuccucucuaauugaucaga

SEQ ID NO: 320439 - RNA, 22 nt, Human
cuguaucuguguuggaugaguu

SEQ ID NO: 320440 - RNA, 22 nt, Human
agcagggccaacaguaaacacc

SEQ ID NO: 320441 - RNA, 22 nt, Human
gugaggggaguaaagccauguu

SEQ ID NO: 320442 - RNA, 23 nt, Human
ucagucuucccugucaguaauag

SEQ ID NO: 320443 - RNA, 22 nt, Human
cuuccaaguugcucugcugacc

SEQ ID NO: 320444 - RNA, 22 nt, Human
ccuggcugaaccaaugaagugg

SEQ ID NO: 320445 - RNA, 22 nt, Human
uccuugaaugaauguucucucc

SEQ ID NO: 320446 - RNA, 22 nt, Human
cucccaagggguaagggagcug

SEQ ID NO: 320447 - RNA, 22 nt, Human
ggccccaggaccuccacggucc

SEQ ID NO: 320448 - RNA, 22 nt, Human
ucuaaagaagaggguucugcgg

SEQ ID NO: 320449 - RNA, 18 nt, Human
acauacauucugucugca

SEQ ID NO: 320450 - RNA, 20 nt, Human
ucagggcaugggacagcccc

SEQ ID NO: 320451 - RNA, 22 nt, Human
cauucauuagaauagauaugua

SEQ ID NO: 320452 - RNA, 21 nt, Human
aacauuucaggauccaaauug

SEQ ID NO: 320453 - RNA, 22 nt, Human
uuacaaagcguugagacaagua

SEQ ID NO: 320454 - RNA, 22 nt, Human
agcccuagagcuggaggucagu

SEQ ID NO: 320455 - RNA, 22 nt, Human
uacuuuggauccuuacaauagc

SEQ ID NO: 320456 - RNA, 22 nt, Human
auacuuucugaccaauuaauug

SEQ ID NO: 320457 - RNA, 21 nt, Human
uucucagagucuauuacaguu

SEQ ID NO: 320458 - RNA, 22 nt, Human
gcugucuuccuugcuccaaggg

SEQ ID NO: 320459 - RNA, 22 nt, Human
cagggcagugaagaacacacgu

SEQ ID NO: 320460 - RNA, 22 nt, Human
aaauaguuuagcucucauuuca

SEQ ID NO: 320461 - RNA, 22 nt, Human
caguuuuucaaaauuacaugau

SEQ ID NO: 320462 - RNA, 18 nt, Human
ccuggaccugucuccuuu

SEQ ID NO: 320463 - RNA, 19 nt, Human
uugguggugguuuugguuc

SEQ ID NO: 320464 - RNA, 22 nt, Human
cagacccucgggugaguuggcc

SEQ ID NO: 320465 - RNA, 22 nt, Human
cagaguguauucugcaguugca

SEQ ID NO: 320466 - RNA, 22 nt, Human
agugcuggaaagggacggagga

SEQ ID NO: 320467 - RNA, 22 nt, Human
augaaaaguucgaucuagaagg

SEQ ID NO: 320468 - RNA, 22 nt, Human
ggaggugaggccguagggugug

SEQ ID NO: 320469 - RNA, 22 nt, Human
ucccuguccugggcaaucccag

SEQ ID NO: 320470 - RNA, 22 nt, Human
aggcaggugggucacuugaguc

SEQ ID NO: 320471 - RNA, 22 nt, Human
gaggaggcuaagugggcucugg

SEQ ID NO: 320472 - RNA, 22 nt, Human
auuuacagaugaugcuauuuga

SEQ ID NO: 320473 - RNA, 22 nt, Human
ggagcuggucagccuugagcau

SEQ ID NO: 320474 - RNA, 22 nt, Human
gccuucaggaggguuccagaca

SEQ ID NO: 320475 - RNA, 22 nt, Human
gaagaacacuucaugauucauu

SEQ ID NO: 320476 - RNA, 22 nt, Human
caggagugucuccacacagcaa

SEQ ID NO: 320477 - RNA, 22 nt, Human
gcugcuguugauuuaguccaau

SEQ ID NO: 320478 - RNA, 22 nt, Human
ugcccuguuaucuuggaagagu

SEQ ID NO: 320479 - RNA, 22 nt, Human
guggccucaugucuauaaagag

SEQ ID NO: 320480 - RNA, 22 nt, Human
ucuggccuuaucuguccaagcc

SEQ ID NO: 320481 - RNA, 22 nt, Human
cuguacaucucugaggacagua

SEQ ID NO: 320482 - RNA, 18 nt, Human
gcucaguguguuaacacu

SEQ ID NO: 320483 - RNA, 22 nt, Human
ugcuagaauuugcagaagcaua

SEQ ID NO: 320484 - RNA, 18 nt, Human
ucuggcucaggacugaac

SEQ ID NO: 320485 - RNA, 22 nt, Human
uggcaggguacaccuuaacacc

SEQ ID NO: 320486 - RNA, 19 nt, Human
gccagcagaaugaugaggc

SEQ ID NO: 320487 - RNA, 22 nt, Human
ucccuuaaaacucauguguugu

SEQ ID NO: 320488 - RNA, 21 nt, Human
ugcucaguaaaugcugaguga

SEQ ID NO: 320489 - RNA, 22 nt, Human
uaauuuaauccaaguguuacau

SEQ ID NO: 320490 - RNA, 22 nt, Human
caugaaauugcuccuuuggugc

SEQ ID NO: 320491 - RNA, 22 nt, Human
uggagucugugaugcucugggu

SEQ ID NO: 320492 - RNA, 22 nt, Human
aggaccaguaugagagcaucug

SEQ ID NO: 320493 - RNA, 22 nt, Human
auuucagauucagaaauguagg

SEQ ID NO: 320494 - RNA, 21 nt, Human
uuagaaagcucacuacaguua

SEQ ID NO: 320495 - RNA, 23 nt, Human
ugggccuggaaagccuuagagag

SEQ ID NO: 320496 - RNA, 22 nt, Human
aguuuauagcccagauucaugg

SEQ ID NO: 320497 - RNA, 22 nt, Human
cucugggcaaguuucuucauga

SEQ ID NO: 320498 - RNA, 22 nt, Human
acuuccuguguuggucuugcug

SEQ ID NO: 320499 - RNA, 22 nt, Human
agggaggaguccucaaagucau

SEQ ID NO: 320500 - RNA, 22 nt, Human
aaagucauguaaugauaugauu

SEQ ID NO: 320501 - RNA, 22 nt, Human
caaggccaugagcagcgagugu

SEQ ID NO: 320502 - RNA, 22 nt, Human
ccagucccaggcagaaauccag

SEQ ID NO: 320503 - RNA, 22 nt, Human
auuucauacuaaggcucaaaaa

SEQ ID NO: 320504 - RNA, 22 nt, Human
cugcucuguucccccaucaucu

SEQ ID NO: 320505 - RNA, 22 nt, Human
agcagagcccuuccauggccuu

SEQ ID NO: 320506 - RNA, 22 nt, Human
ggccugcuucucagugagcuug

SEQ ID NO: 320507 - RNA, 22 nt, Human
ugagccagauaagggcucacgc

SEQ ID NO: 320508 - RNA, 22 nt, Human
uggaaauacuugccauaaaacu

SEQ ID NO: 320509 - RNA, 20 nt, Human
caugagaagggcagugugag

SEQ ID NO: 320510 - RNA, 22 nt, Human
uugagaagaggcuuuguaggaa

SEQ ID NO: 320511 - RNA, 21 nt, Human
ccagccucagaucagggagcu

SEQ ID NO: 320512 - RNA, 22 nt, Human
gcagcuguguaaugagcccaca

SEQ ID NO: 320513 - RNA, 22 nt, Human
gagcaggccagcaauggaaggg

SEQ ID NO: 320514 - RNA, 22 nt, Human
uggacagguuugggugccuguu

SEQ ID NO: 320515 - RNA, 22 nt, Human
ugggagaagcauggggugcaga

SEQ ID NO: 320516 - RNA, 23 nt, Human
aaaguuugaagcaacaguaguug

SEQ ID NO: 320517 - RNA, 17 nt, Human
ugccagccugucccagg

SEQ ID NO: 320518 - RNA, 22 nt, Human
ccucauggccuugagcugaggg

SEQ ID NO: 320519 - RNA, 22 nt, Human
cauuugaaauaguucauucuug

SEQ ID NO: 320520 - RNA, 22 nt, Human
uaaggccaaguucauauacaac

SEQ ID NO: 320521 - RNA, 19 nt, Human
uuucuuaggccuuuggccu

SEQ ID NO: 320522 - RNA, 22 nt, Human
aggagggugauccgggcugguc

SEQ ID NO: 320523 - RNA, 22 nt, Human
uaaaugugagugaugcggugaa

SEQ ID NO: 320524 - RNA, 22 nt, Human
cauugaaaaacguugacugagu

SEQ ID NO: 320525 - RNA, 21 nt, Human
ggacuuacauagguaaggggu

SEQ ID NO: 320526 - RNA, 22 nt, Human
uucuacaauaugaauaaugaag

SEQ ID NO: 320527 - RNA, 22 nt, Human
cuccuugguguaguacugagca

SEQ ID NO: 320528 - RNA, 22 nt, Human
ccauggcaauggucagucuauu

SEQ ID NO: 320529 - RNA, 22 nt, Human
aagcuggcaugucaccugagaa

SEQ ID NO: 320530 - RNA, 22 nt, Human
uggaaagaaaguaaaggcguau

SEQ ID NO: 320531 - RNA, 22 nt, Human
ugcagaagaccuuccagggcug

SEQ ID NO: 320532 - RNA, 22 nt, Human
uucauacaaugggauauuauga

SEQ ID NO: 320533 - RNA, 22 nt, Human
ugggcuccagcaccugugcucu

SEQ ID NO: 320534 - RNA, 22 nt, Human
acccugggucauauacagugug

SEQ ID NO: 320535 - RNA, 22 nt, Human
ucacagugaugacgugggagca

SEQ ID NO: 320536 - RNA, 22 nt, Human
caggcugaggcaguaggguuug

SEQ ID NO: 320537 - RNA, 22 nt, Human
augcugugagugugccgcagag

SEQ ID NO: 320538 - RNA, 22 nt, Human
uuggcuucuggcagucuggacg

SEQ ID NO: 320539 - RNA, 22 nt, Human
cugccucuugacagaucguggc

SEQ ID NO: 320540 - RNA, 22 nt, Human
ugagcccagucugucugacaug

SEQ ID NO: 320541 - RNA, 22 nt, Human
cucugagaaagcugugagcuaa

SEQ ID NO: 320542 - RNA, 22 nt, Human
aaaggagagugagucagaugcc

SEQ ID NO: 320543 - RNA, 22 nt, Human
gccagagcugagugagguucuu

SEQ ID NO: 320544 - RNA, 22 nt, Human
aaacaugaauagauauuaaaca

SEQ ID NO: 320545 - RNA, 22 nt, Human
gugccagcucuccccacaucug

SEQ ID NO: 320546 - RNA, 22 nt, Human
gagaagguggaccugaaggagc

SEQ ID NO: 320547 - RNA, 23 nt, Human
uuacaguaggaguuggaaaacca

SEQ ID NO: 320548 - RNA, 22 nt, Human
agguauaagucucauuucuguu

SEQ ID NO: 320549 - RNA, 22 nt, Human
ggauggcauguugggcucuguu

SEQ ID NO: 320550 - RNA, 22 nt, Human
acagaaauaacuuuuuauguuu

SEQ ID NO: 320551 - RNA, 22 nt, Human
auauaguuggguuucauucuac

SEQ ID NO: 320552 - RNA, 22 nt, Human
auuucauugaaguuaauucuuc

SEQ ID NO: 320553 - RNA, 22 nt, Human
ggcaggcaggagcgugcuuggg

SEQ ID NO: 320554 - RNA, 22 nt, Human
cccaugccuucugacucacagg

SEQ ID NO: 320555 - RNA, 22 nt, Human
acugcaggagacacagcugcug

SEQ ID NO: 320556 - RNA, 22 nt, Human
cugcucugaagccaggauucug

SEQ ID NO: 320557 - RNA, 22 nt, Human
acucagcucaggagcuggcugg

SEQ ID NO: 320558 - RNA, 22 nt, Human
auguccuucuccucuuaccugc

SEQ ID NO: 320559 - RNA, 22 nt, Human
uuguuacagcagugauuucaga

SEQ ID NO: 320560 - RNA, 22 nt, Human
cgucccaguuccagccgcgcug

SEQ ID NO: 320561 - RNA, 22 nt, Human
caggcuugauuauucagacaau

SEQ ID NO: 320562 - RNA, 22 nt, Human
uuguuaaaaugcauauucuggu

SEQ ID NO: 320563 - RNA, 23 nt, Human
cuucucagaagucugugccagga

SEQ ID NO: 320564 - RNA, 22 nt, Human
gggcuggcgggaaaggcaauuc

SEQ ID NO: 320565 - RNA, 22 nt, Human
ugcugucugauucagggugauu

SEQ ID NO: 320566 - RNA, 22 nt, Human
uguucauuuggcccuuuuguau

SEQ ID NO: 320567 - RNA, 22 nt, Human
gucccugcaucaccacgggacu

SEQ ID NO: 320568 - RNA, 22 nt, Human
uuauuuucuccucagaaagugg

SEQ ID NO: 320569 - RNA, 22 nt, Human
ucucaguccaaaugagagguug

SEQ ID NO: 320570 - RNA, 22 nt, Human
caaggccauauugccuguaugu

SEQ ID NO: 320571 - RNA, 22 nt, Human
gcacagggagacagccguggcc

SEQ ID NO: 320572 - RNA, 22 nt, Human
auagacuugguuaguaaauuug

SEQ ID NO: 320573 - RNA, 22 nt, Human
auguacauuuuccuaauguuuu

SEQ ID NO: 320574 - RNA, 22 nt, Human
uuuccuaugauauucuaugugu

SEQ ID NO: 320575 - RNA, 22 nt, Human
ucaggaggccaccaggaccugu

SEQ ID NO: 320576 - RNA, 22 nt, Human
ugaugaauaaacuugagaguca

SEQ ID NO: 320577 - RNA, 22 nt, Human
aaggccugcucagcugucugug

SEQ ID NO: 320578 - RNA, 22 nt, Human
uuuguuuucaaugugucauuca

SEQ ID NO: 320579 - RNA, 22 nt, Human
gcuggcagaauuucuucuugcu

SEQ ID NO: 320580 - RNA, 22 nt, Human
uguuuaaucuauaaaauggaga

SEQ ID NO: 320581 - RNA, 22 nt, Human
cagcaauaguguguuuguuuca

SEQ ID NO: 320582 - RNA, 22 nt, Human
ugaucagucccaugaucuucca

SEQ ID NO: 320583 - RNA, 22 nt, Human
uucuucuuaauguccugggaac

SEQ ID NO: 320584 - RNA, 22 nt, Human
aucuuucaguuucauaccaauu

SEQ ID NO: 320585 - RNA, 22 nt, Human
ucuuuucaucauuuaauaggua

SEQ ID NO: 320586 - RNA, 22 nt, Human
ugcuugagacacauaugaauuu

SEQ ID NO: 320587 - RNA, 22 nt, Human
aggggcuggcuuaucugagagu

SEQ ID NO: 320588 - RNA, 22 nt, Human
guaaaauagaauaacguggcua

SEQ ID NO: 320589 - RNA, 22 nt, Human
gcugggcuucucaaugcugccu

SEQ ID NO: 320590 - RNA, 22 nt, Human
ccugccuguaagauggguacaa

SEQ ID NO: 320591 - RNA, 22 nt, Human
ggcaguagccagggacuggcag

SEQ ID NO: 320592 - RNA, 22 nt, Human
guacuuccguggacuaauuguu

SEQ ID NO: 320593 - RNA, 22 nt, Human
aauaugcauuaacuguguacau

SEQ ID NO: 320594 - RNA, 22 nt, Human
agcugcuguccuaggcacugua

SEQ ID NO: 320595 - RNA, 21 nt, Human
ugcccacagcaaaugcagagg

SEQ ID NO: 320596 - RNA, 22 nt, Human
uugaacauuggcaauuucauau

SEQ ID NO: 320597 - RNA, 22 nt, Human
aucuagaaaguguugaagauca

SEQ ID NO: 320598 - RNA, 22 nt, Human
auucuucaucagagaugcacua

SEQ ID NO: 320599 - RNA, 22 nt, Human
gugggccuugcagggugcaggg

SEQ ID NO: 320600 - RNA, 19 nt, Human
ccugucugucuucagcuag

SEQ ID NO: 320601 - RNA, 22 nt, Human
cugaugcuauaagccacagugg

SEQ ID NO: 320602 - RNA, 22 nt, Human
agcucccagcagagcuggccac

SEQ ID NO: 320603 - RNA, 22 nt, Human
aaugucugcucuacucaggagg

SEQ ID NO: 320604 - RNA, 22 nt, Human
agucuuuccugcuugacuguuc

SEQ ID NO: 320605 - RNA, 22 nt, Human
gcugcaggcucugcaggaauug

SEQ ID NO: 320606 - RNA, 22 nt, Human
gcaggguauaauacuuagguga

SEQ ID NO: 320607 - RNA, 22 nt, Human
aggggccugguuggccucuguu

SEQ ID NO: 320608 - RNA, 22 nt, Human
gaguuauucuagguccuuugua

SEQ ID NO: 320609 - RNA, 22 nt, Human
ggaugcugcuaucaggcuucga

SEQ ID NO: 320610 - RNA, 21 nt, Human
aggcagaaagagcccaggcug

SEQ ID NO: 320611 - RNA, 22 nt, Human
cugcuucuccaaaguaggacuu

SEQ ID NO: 320612 - RNA, 20 nt, Human
uugcauuggaugugcaggug

SEQ ID NO: 320613 - RNA, 22 nt, Human
uuguuuguaugcugagaagaau

SEQ ID NO: 320614 - RNA, 22 nt, Human
ggcugccuggaccuccucuuuc

SEQ ID NO: 320615 - RNA, 22 nt, Human
aagaauacguaucaacaauggu

SEQ ID NO: 320616 - RNA, 22 nt, Human
cuccagggagcuuggaaagacc

SEQ ID NO: 320617 - RNA, 22 nt, Human
aagagggaggugcgggugcaga

SEQ ID NO: 320618 - RNA, 22 nt, Human
gccugccuuugugaggaagcgg

SEQ ID NO: 320619 - RNA, 22 nt, Human
cacacauugaauucauucuugu

SEQ ID NO: 320620 - RNA, 22 nt, Human
ugaguucucacccauucuucuu

SEQ ID NO: 320621 - RNA, 22 nt, Human
ugccucugggugaccaaggagc

SEQ ID NO: 320622 - RNA, 22 nt, Human
aaaguugugaaaccgaacaugu

SEQ ID NO: 320623 - RNA, 22 nt, Human
ucaguguagcagacuuguagcc

SEQ ID NO: 320624 - RNA, 22 nt, Human
agcaccugcacaguggaggaaa

SEQ ID NO: 320625 - RNA, 22 nt, Human
agcucuccacacauaggacuag

SEQ ID NO: 320626 - RNA, 22 nt, Human
uaauuauuaugacaacaauugc

SEQ ID NO: 320627 - RNA, 22 nt, Human
uugggcugaaguagagggcaga

SEQ ID NO: 320628 - RNA, 22 nt, Human
ccugagagcgaguggccucaug

SEQ ID NO: 320629 - RNA, 22 nt, Human
ucugaaggugcuagagaaagcu

SEQ ID NO: 320630 - RNA, 22 nt, Human
ggaggagagagguugcaaacac

SEQ ID NO: 320631 - RNA, 22 nt, Human
cacagggcuaaaugaaggguug

SEQ ID NO: 320632 - RNA, 22 nt, Human
guacauuggcaacucucuuaga

SEQ ID NO: 320633 - RNA, 22 nt, Human
ucagcaauaugauaggcuuugu

SEQ ID NO: 320634 - RNA, 22 nt, Human
acccugagucagacagccugac

SEQ ID NO: 320635 - RNA, 22 nt, Human
augcuacauuuugguuuauaaa

SEQ ID NO: 320636 - RNA, 22 nt, Human
uaccaaguguauuaugcuuugu

SEQ ID NO: 320637 - RNA, 18 nt, Human
uggcucuggacuugcucc

SEQ ID NO: 320638 - RNA, 22 nt, Human
ucagaacauuuaaaaagugguu

SEQ ID NO: 320639 - RNA, 19 nt, Human
cacugugguccuucacugc

SEQ ID NO: 320640 - RNA, 22 nt, Human
gggcuggcucugucuagaaagg

SEQ ID NO: 320641 - RNA, 22 nt, Human
gcagcccagagcgcaggacccc

SEQ ID NO: 320642 - RNA, 22 nt, Human
aacacaaagaagcugcaggauc

SEQ ID NO: 320643 - RNA, 22 nt, Human
cuggagccccaggcugugcaga

SEQ ID NO: 320644 - RNA, 20 nt, Human
ugcugcaguuucaugggacu

SEQ ID NO: 320645 - RNA, 22 nt, Human
cagcccugccauggagccuccu

SEQ ID NO: 320646 - RNA, 22 nt, Human
ugcauuauaacugaauguuguu

SEQ ID NO: 320647 - RNA, 22 nt, Human
ucaacugcaaguuugcuuaguu

SEQ ID NO: 320648 - RNA, 22 nt, Human
cagccccucacagagcuguccu

SEQ ID NO: 320649 - RNA, 22 nt, Human
agccuggccacucagggccuga

SEQ ID NO: 320650 - RNA, 22 nt, Human
aaggcucucugauggcagcagu

SEQ ID NO: 320651 - RNA, 22 nt, Human
agaauaguggcaaugacugcac

SEQ ID NO: 320652 - RNA, 22 nt, Human
ccugcagguugcagaggcggaa

SEQ ID NO: 320653 - RNA, 22 nt, Human
cagagcagaagcgguccucaca

SEQ ID NO: 320654 - RNA, 18 nt, Human
augggaggggccaagaga

SEQ ID NO: 320655 - RNA, 22 nt, Human
aagauuucagaguuugggggaa

SEQ ID NO: 320656 - RNA, 22 nt, Human
aguccuucaagaaaucuggaaa

SEQ ID NO: 320657 - RNA, 22 nt, Human
aggucaccauggcaugcuccac

SEQ ID NO: 320658 - RNA, 22 nt, Human
ggggauggauuccgggucccug

SEQ ID NO: 320659 - RNA, 22 nt, Human
cccuggaggcaaagguugcagu

SEQ ID NO: 320660 - RNA, 22 nt, Human
cugaaauuccauuucagccaca

SEQ ID NO: 320661 - RNA, 20 nt, Human
gcccuggagccuuguccugg

SEQ ID NO: 320662 - RNA, 21 nt, Human
cugugcuuuuuaagugugaug

SEQ ID NO: 320663 - RNA, 22 nt, Human
gcugucucauacaaggcccugc

SEQ ID NO: 320664 - RNA, 22 nt, Human
gugcauauaugcacauaugugu

SEQ ID NO: 320665 - RNA, 22 nt, Human
auucuucacaccuguuccuguu

SEQ ID NO: 320666 - RNA, 22 nt, Human
cuuguaauuauaauguacuguu

SEQ ID NO: 320667 - RNA, 22 nt, Human
gggcaugguggugcacaccugu

SEQ ID NO: 320668 - RNA, 22 nt, Human
cauuuccagcuccugcaucaug

SEQ ID NO: 320669 - RNA, 22 nt, Human
uccucagcuuugguuuacucau

SEQ ID NO: 320670 - RNA, 22 nt, Human
acuguagcugccacuggaugca

SEQ ID NO: 320671 - RNA, 22 nt, Human
gcuguccagagcaugggagcaa

SEQ ID NO: 320672 - RNA, 21 nt, Human
aguuuccucaacugcagaagg

SEQ ID NO: 320673 - RNA, 22 nt, Human
ugucccucauugacgcugugcc

SEQ ID NO: 320674 - RNA, 22 nt, Human
agggcccaggacagcaucaggg

SEQ ID NO: 320675 - RNA, 22 nt, Human
ucugucacucccugaugaugaa

SEQ ID NO: 320676 - RNA, 23 nt, Human
acuauaaaguuguucugauuuac

SEQ ID NO: 320677 - RNA, 22 nt, Human
uuuguaaaggccugaauuucag

SEQ ID NO: 320678 - RNA, 19 nt, Human
cagcccucuuaccacugug

SEQ ID NO: 320679 - RNA, 22 nt, Human
cugccagcagaggccagcgcug

SEQ ID NO: 320680 - RNA, 22 nt, Human
cuucccacuaguaucacagagc

SEQ ID NO: 320681 - RNA, 22 nt, Human
aagauuauggcagauaacaauu

SEQ ID NO: 320682 - RNA, 22 nt, Human
ggaggccaguccuggccgggcu

SEQ ID NO: 320683 - RNA, 22 nt, Human
aacagacagaaaaaugugaucu

SEQ ID NO: 320684 - RNA, 22 nt, Human
gggcuggagccagcuguggcug

SEQ ID NO: 320685 - RNA, 22 nt, Human
ugggcuggcugaacuucaaccu

SEQ ID NO: 320686 - RNA, 19 nt, Human
ugcuuccucaccaucuccc

SEQ ID NO: 320687 - RNA, 22 nt, Human
ugcugaugcuguucuguuagga

SEQ ID NO: 320688 - RNA, 22 nt, Human
gcaggaugccagggcagcagcg

SEQ ID NO: 320689 - RNA, 22 nt, Human
agcuguucccucacugcaguca

SEQ ID NO: 320690 - RNA, 22 nt, Human
uuuuggucagguuggucucgaa

SEQ ID NO: 320691 - RNA, 22 nt, Human
ucugucacucuagagauggcag

SEQ ID NO: 320692 - RNA, 22 nt, Human
gcugcugcuugaaggcucggag

SEQ ID NO: 320693 - RNA, 22 nt, Human
ugugucagagguagagauggca

SEQ ID NO: 320694 - RNA, 22 nt, Human
ccuguccuccaagagcacaucu

SEQ ID NO: 320695 - RNA, 22 nt, Human
cagugcauaaucuaaauggggg

SEQ ID NO: 320696 - RNA, 21 nt, Human
gaacauuuggguuguuucuac

SEQ ID NO: 320697 - RNA, 22 nt, Human
aaauuucuggaagugucagagu

SEQ ID NO: 320698 - RNA, 22 nt, Human
uccacagaauguaagauccaca

SEQ ID NO: 320699 - RNA, 22 nt, Human
cuuacauugugugcaugagggg

SEQ ID NO: 320700 - RNA, 22 nt, Human
gagcugggcacacgccacuuga

SEQ ID NO: 320701 - RNA, 22 nt, Human
ccagcccugccucucagggccc

SEQ ID NO: 320702 - RNA, 22 nt, Human
ugucucaguauacgaaacacuu

SEQ ID NO: 320703 - RNA, 20 nt, Human
gugaccagaagacagugggu

SEQ ID NO: 320704 - RNA, 22 nt, Human
ggaaggagcauuugccaguuua

SEQ ID NO: 320705 - RNA, 22 nt, Human
cugcugcauuacucuucucaag

SEQ ID NO: 320706 - RNA, 22 nt, Human
uacaaaugaccauagccacuua

SEQ ID NO: 320707 - RNA, 23 nt, Human
agccuucaggcaaugucaguaga

SEQ ID NO: 320708 - RNA, 22 nt, Human
uuucauaauauccagagauuuu

SEQ ID NO: 320709 - RNA, 22 nt, Human
cuguccuguagcuccaucaguc

SEQ ID NO: 320710 - RNA, 22 nt, Human
ucauuauuuuggacuggagugu

SEQ ID NO: 320711 - RNA, 21 nt, Human
gagcauggcuuacaucagcag

SEQ ID NO: 320712 - RNA, 22 nt, Human
ggcaugggguguauguggcacg

SEQ ID NO: 320713 - RNA, 22 nt, Human
gcugucuggaggcucugaggga

SEQ ID NO: 320714 - RNA, 22 nt, Human
cuuuccaagaaugcagauaccu

SEQ ID NO: 320715 - RNA, 22 nt, Human
uggaaggagcuaaggaccuggg

SEQ ID NO: 320716 - RNA, 22 nt, Human
auuuccuagccucucuugcagu

SEQ ID NO: 320717 - RNA, 22 nt, Human
ucugucaaaugagcaaguaacu

SEQ ID NO: 320718 - RNA, 22 nt, Human
aagggcagaauagagaagaugg

SEQ ID NO: 320719 - RNA, 22 nt, Human
auaaggcagugacuucaucuau

SEQ ID NO: 320720 - RNA, 22 nt, Human
cucaucugauaaaucacucuua

SEQ ID NO: 320721 - RNA, 22 nt, Human
agcugccacaugcccaagggca

SEQ ID NO: 320722 - RNA, 22 nt, Human
caguagcaggcacucagcacgu

SEQ ID NO: 320723 - RNA, 22 nt, Human
uccugucagugaggcagaugaa

SEQ ID NO: 320724 - RNA, 22 nt, Human
gagacaaaaguuggagugcaag

SEQ ID NO: 320725 - RNA, 22 nt, Human
aggcugcuuucauggccgcccc

SEQ ID NO: 320726 - RNA, 22 nt, Human
ucugagccguauggcuuggcua

SEQ ID NO: 320727 - RNA, 22 nt, Human
cugagcugggcucucuugaggg

SEQ ID NO: 320728 - RNA, 22 nt, Human
uccccagccgugaaggagagga

SEQ ID NO: 320729 - RNA, 22 nt, Human
aggagcugaagucucugcacuc

SEQ ID NO: 320730 - RNA, 22 nt, Human
uggcucagugaagagauaacuu

SEQ ID NO: 320731 - RNA, 22 nt, Human
uguaucaaggguuuauguaagc

SEQ ID NO: 320732 - RNA, 22 nt, Human
gucauuccuuauguugauucag

SEQ ID NO: 320733 - RNA, 22 nt, Human
ugggcuccucgucacucgcugu

SEQ ID NO: 320734 - RNA, 22 nt, Human
uaucuguuugcucacagguguu

SEQ ID NO: 320735 - RNA, 22 nt, Human
agcuaggaaauugaggcugaga

SEQ ID NO: 320736 - RNA, 20 nt, Human
ggggcugcaugcagagaaga

SEQ ID NO: 320737 - RNA, 22 nt, Human
auuaguguucuuaucuucuagg

SEQ ID NO: 320738 - RNA, 22 nt, Human
cccucuacagggaagcgcuuuc

SEQ ID NO: 320739 - RNA, 22 nt, Human
gugcucaggaagcuguuccugc

SEQ ID NO: 320740 - RNA, 23 nt, Human
ccaaagucgaagucuaguccaga

SEQ ID NO: 320741 - RNA, 19 nt, Human
ugaagcaggcagagaagau

SEQ ID NO: 320742 - RNA, 17 nt, Human
cccagcuggcagugccg

SEQ ID NO: 320743 - RNA, 22 nt, Human
acacuuuacagcuuccuuugca

SEQ ID NO: 320744 - RNA, 22 nt, Human
cugaggugcuagggucccugcu

SEQ ID NO: 320745 - RNA, 22 nt, Human
gacauguugaagaauauuugga

SEQ ID NO: 320746 - RNA, 22 nt, Human
cagagccucaucauccacucca

SEQ ID NO: 320747 - RNA, 22 nt, Human
gcagcagaugcuuucauggaca

SEQ ID NO: 320748 - RNA, 22 nt, Human
gaggcugcaggcaaugcugccc

SEQ ID NO: 320749 - RNA, 22 nt, Human
cugggcucaaauccuggcccug

SEQ ID NO: 320750 - RNA, 23 nt, Human
uguagcaucucuuauuucucagc

SEQ ID NO: 320751 - RNA, 22 nt, Human
ugaccacagacccaaugacuac

SEQ ID NO: 320752 - RNA, 22 nt, Human
aaaaaucuaugacugcuucucc

SEQ ID NO: 320753 - RNA, 22 nt, Human
cugccucuccccagaguggccc

SEQ ID NO: 320754 - RNA, 22 nt, Human
uggcugaauaaaauaugguguu

SEQ ID NO: 320755 - RNA, 20 nt, Human
ugccaugguaacagagugug

SEQ ID NO: 320756 - RNA, 22 nt, Human
aauuuagaauucgcuagcuaau

SEQ ID NO: 320757 - RNA, 22 nt, Human
gcagaggcauuucugacgcugc

SEQ ID NO: 320758 - RNA, 22 nt, Human
cuacagacccaccuuggaagaa

SEQ ID NO: 320759 - RNA, 22 nt, Human
gcagaugauguagacagacagu

SEQ ID NO: 320760 - RNA, 22 nt, Human
gaaauauucuugucuuguuuuc

SEQ ID NO: 320761 - RNA, 22 nt, Human
uucugucaugcucauguaauug

SEQ ID NO: 320762 - RNA, 22 nt, Human
agugaaaucagguuuugacugc

SEQ ID NO: 320763 - RNA, 22 nt, Human
aguaaacauaauuuaccuguag

SEQ ID NO: 320764 - RNA, 22 nt, Human
aauacaaucaaauucacuagca

SEQ ID NO: 320765 - RNA, 22 nt, Human
ucaggaugaccacgagccucua

SEQ ID NO: 320766 - RNA, 22 nt, Human
uaugagaaucugcaguaugcuu

SEQ ID NO: 320767 - RNA, 22 nt, Human
gaccaaggaagaggggagccag

SEQ ID NO: 320768 - RNA, 22 nt, Human
ucauuucuauugcuacugucug

SEQ ID NO: 320769 - RNA, 22 nt, Human
ggggcagagcauagcuccaauu

SEQ ID NO: 320770 - RNA, 22 nt, Human
cuuuggcagccucugcuauuga

SEQ ID NO: 320771 - RNA, 22 nt, Human
uggagcagagaugguggccuuc

SEQ ID NO: 320772 - RNA, 22 nt, Human
acaauacuauuuucaguauccu

SEQ ID NO: 320773 - RNA, 22 nt, Human
uuaauaaaguaugaauuggaaa

SEQ ID NO: 320774 - RNA, 16 nt, Human
ccacagggcaaggggc

SEQ ID NO: 320775 - RNA, 22 nt, Human
caggagcccagaguccucagcu

SEQ ID NO: 320776 - RNA, 22 nt, Human
uggagcaggaagucuauggcug

SEQ ID NO: 320777 - RNA, 22 nt, Human
uggcucuggauuaaucuaggaa

SEQ ID NO: 320778 - RNA, 22 nt, Human
gagcugggcuggcuuccucccu

SEQ ID NO: 320779 - RNA, 22 nt, Human
uggcuuucucccccagcuucuc

SEQ ID NO: 320780 - RNA, 22 nt, Human
ugaggcaggagguugagaacug

SEQ ID NO: 320781 - RNA, 22 nt, Human
uggaggcaucagagugcuuggc

SEQ ID NO: 320782 - RNA, 22 nt, Human
uuucuucagccuucacaaccug

SEQ ID NO: 320783 - RNA, 22 nt, Human
aacuuucagaauccuaugcauu

SEQ ID NO: 320784 - RNA, 22 nt, Human
uugggguguuggauggagcaag

SEQ ID NO: 320785 - RNA, 22 nt, Human
cagugcagacguggagggggca

SEQ ID NO: 320786 - RNA, 22 nt, Human
agcccagccggauucccaguuc

SEQ ID NO: 320787 - RNA, 19 nt, Human
cugugcuuuaaacuccuau

SEQ ID NO: 320788 - RNA, 22 nt, Human
gugggaugguagguagguaaua

SEQ ID NO: 320789 - RNA, 22 nt, Human
uucuguguggguagcuccuguu

SEQ ID NO: 320790 - RNA, 22 nt, Human
aggaccuguagggccugcaucc

SEQ ID NO: 320791 - RNA, 22 nt, Human
cuggcccuucucuugcuuccug

SEQ ID NO: 320792 - RNA, 22 nt, Human
gcucuguguugucagaggcacc

SEQ ID NO: 320793 - RNA, 22 nt, Human
ugggcugcagagcccggccuuc

SEQ ID NO: 320794 - RNA, 22 nt, Human
uuugacaucaauacccuagaau

SEQ ID NO: 320795 - RNA, 22 nt, Human
caugggggucuggacaacaggc

SEQ ID NO: 320796 - RNA, 22 nt, Human
uuucagaucauuuuuuaaguac

SEQ ID NO: 320797 - RNA, 22 nt, Human
cugcuguguuucacaccucugg

SEQ ID NO: 320798 - RNA, 21 nt, Human
uggcucuggguaggagagugc

SEQ ID NO: 320799 - RNA, 22 nt, Human
ggccuugggaggagggucagaa

SEQ ID NO: 320800 - RNA, 22 nt, Human
ucacugcucagucuguacuaca

SEQ ID NO: 320801 - RNA, 22 nt, Human
augaugguggguaauguguaaa

SEQ ID NO: 320802 - RNA, 22 nt, Human
gaggcucugugaugugccaggc

SEQ ID NO: 320803 - RNA, 22 nt, Human
aggggugaaggcccgauaggag

SEQ ID NO: 320804 - RNA, 22 nt, Human
ugggcugcugucugcacaugcu

SEQ ID NO: 320805 - RNA, 22 nt, Human
gcugaagcugcagcaggaggaa

SEQ ID NO: 320806 - RNA, 22 nt, Human
gccauuuagggaggcaagguga

SEQ ID NO: 320807 - RNA, 22 nt, Human
agauuucagguuggggcagaag

SEQ ID NO: 320808 - RNA, 22 nt, Human
guuguauagagggcaugaaucu

SEQ ID NO: 320809 - RNA, 22 nt, Human
ugaaggagauuuuuagggaggc

SEQ ID NO: 320810 - RNA, 22 nt, Human
ucuucuuccuccacagggccca

SEQ ID NO: 320811 - RNA, 19 nt, Human
auuuacugccuaaaaucuc

SEQ ID NO: 320812 - RNA, 22 nt, Human
uagcucuucauuucaucugauu

SEQ ID NO: 320813 - RNA, 22 nt, Human
gggcaagcucuucagaagcucu

SEQ ID NO: 320814 - RNA, 22 nt, Human
uccuucaguuaucacaguacug

SEQ ID NO: 320815 - RNA, 22 nt, Human
acauacuaugaauacauguguc

SEQ ID NO: 320816 - RNA, 20 nt, Human
gcugcucuccacggucugca

SEQ ID NO: 320817 - RNA, 19 nt, Human
gcuguauuaaagauacaug

SEQ ID NO: 320818 - RNA, 18 nt, Human
gugcugugggcaguggcc

SEQ ID NO: 320819 - RNA, 22 nt, Human
ucagcugagcuccagcucauag

SEQ ID NO: 320820 - RNA, 22 nt, Human
uagucaaaccucagaauacccc

SEQ ID NO: 320821 - RNA, 22 nt, Human
agagugauggguugugcugacc

SEQ ID NO: 320822 - RNA, 22 nt, Human
gcucccaccaggcagaccuacc

SEQ ID NO: 320823 - RNA, 22 nt, Human
cuucuuccugcugcagccucca

SEQ ID NO: 320824 - RNA, 22 nt, Human
ugauuuccucuacuagcaauua

SEQ ID NO: 320825 - RNA, 22 nt, Human
uuccuacaucaccagggggagu

SEQ ID NO: 320826 - RNA, 22 nt, Human
gcaguaaaaaaggauaugugca

SEQ ID NO: 320827 - RNA, 22 nt, Human
gcuggaaggcuaggcucaguug

SEQ ID NO: 320828 - RNA, 22 nt, Human
cuguccuggagggcauaggacg

SEQ ID NO: 320829 - RNA, 22 nt, Human
ugacaaaacugcaauuacuuuu

SEQ ID NO: 320830 - RNA, 22 nt, Human
ucccaguguggcaggccaugga

SEQ ID NO: 320831 - RNA, 22 nt, Human
uagaaagugaagguuaauuaau

SEQ ID NO: 320832 - RNA, 22 nt, Human
ccagagucuaugaguccucauu

SEQ ID NO: 320833 - RNA, 18 nt, Human
agugugugcccuuucagg

SEQ ID NO: 320834 - RNA, 22 nt, Human
cugggcuggcgcauccgacacg

SEQ ID NO: 320835 - RNA, 22 nt, Human
agugaggcuaauaggcaauggu

SEQ ID NO: 320836 - RNA, 22 nt, Human
ugucaccucuuuggcugcagcu

SEQ ID NO: 320837 - RNA, 22 nt, Human
gagcugggaagauagcuugagc

SEQ ID NO: 320838 - RNA, 22 nt, Human
acuuuacaagcuuauagccuag

SEQ ID NO: 320839 - RNA, 22 nt, Human
ccuggcagcaggugggcccgug

SEQ ID NO: 320840 - RNA, 22 nt, Human
agguaggguuaauggagauaua

SEQ ID NO: 320841 - RNA, 22 nt, Human
gagagugaaggcuucccagcaa

SEQ ID NO: 320842 - RNA, 22 nt, Human
ucaaaugcuucuacuccuaaga

SEQ ID NO: 320843 - RNA, 22 nt, Human
cccuggaggucagaggccuggg

SEQ ID NO: 320844 - RNA, 17 nt, Human
cgagggcuugcuggcuc

SEQ ID NO: 320845 - RNA, 22 nt, Human
uaguaaaaguuuaguugaaagu

SEQ ID NO: 320846 - RNA, 22 nt, Human
ggcucuggugcccuggcuccca

SEQ ID NO: 320847 - RNA, 22 nt, Human
cagagccagaacuagaccuugu

SEQ ID NO: 320848 - RNA, 22 nt, Human
uggccucugggaaagcagauuc

SEQ ID NO: 320849 - RNA, 22 nt, Human
aacuuucuuggaugucucaaca

SEQ ID NO: 320850 - RNA, 22 nt, Human
uaugaagaaguucugugaaaug

SEQ ID NO: 320851 - RNA, 22 nt, Human
cauggcagagaaggggaacugg

SEQ ID NO: 320852 - RNA, 22 nt, Human
caaggccuucgucuccuagcuu

SEQ ID NO: 320853 - RNA, 22 nt, Human
aggagcagaccguaguccugca

SEQ ID NO: 320854 - RNA, 22 nt, Human
agaaagggagcguggaucaauu

SEQ ID NO: 320855 - RNA, 22 nt, Human
aggcaguuuaggcagcgauuua

SEQ ID NO: 320856 - RNA, 22 nt, Human
gaagagcugacagugucauccu

SEQ ID NO: 320857 - RNA, 22 nt, Human
uucuggaguauuccuggcaccu

SEQ ID NO: 320858 - RNA, 22 nt, Human
cuuucucugugugguaaagggc

SEQ ID NO: 320859 - RNA, 22 nt, Human
gcuuccuaaaugcacagggcag

SEQ ID NO: 320860 - RNA, 22 nt, Human
gucaggauuaaugggaguaugc

SEQ ID NO: 320861 - RNA, 22 nt, Human
aaggagugcaugacucagagua

SEQ ID NO: 320862 - RNA, 22 nt, Human
caguacuuuucaaccaguauga

SEQ ID NO: 320863 - RNA, 22 nt, Human
ggccugcuccgggggcugagcu

SEQ ID NO: 320864 - RNA, 22 nt, Human
aacugguaucucuucaguguaa

SEQ ID NO: 320865 - RNA, 22 nt, Human
ugggacugcucuugcugggguc

SEQ ID NO: 320866 - RNA, 22 nt, Human
aggcacugaauauccaguaaaa

SEQ ID NO: 320867 - RNA, 22 nt, Human
guuugcauguauuaagucaaua

SEQ ID NO: 320868 - RNA, 22 nt, Human
uugcauuuccuguacuguuuga

SEQ ID NO: 320869 - RNA, 22 nt, Human
aagaugauaggacuugcuuaag

SEQ ID NO: 320870 - RNA, 22 nt, Human
uuaacauuguccuuagcagauu

SEQ ID NO: 320871 - RNA, 22 nt, Human
agcagggcuucugugccugugc

SEQ ID NO: 320872 - RNA, 22 nt, Human
uuugcaaagugacuauuauaug

SEQ ID NO: 320873 - RNA, 22 nt, Human
cacugggcguguccugggugag

SEQ ID NO: 320874 - RNA, 20 nt, Human
gucugaggagcagugggaaa

SEQ ID NO: 320875 - RNA, 22 nt, Human
ugcccacauggugccauggcca

SEQ ID NO: 320876 - RNA, 22 nt, Human
ugagggaggcccuuugagcaga

SEQ ID NO: 320877 - RNA, 22 nt, Human
ugaaggccagggauuugcagcc

SEQ ID NO: 320878 - RNA, 22 nt, Human
ccaggagcaaagaucacuggga

SEQ ID NO: 320879 - RNA, 22 nt, Human
ccaggaggugcuggaagaaagc

SEQ ID NO: 320880 - RNA, 21 nt, Human
agggcagauuagcuguaagag

SEQ ID NO: 320881 - RNA, 22 nt, Human
uccugccucuuuucuuauucca

SEQ ID NO: 320882 - RNA, 23 nt, Human
aggauccugguacaggagcagag

SEQ ID NO: 320883 - RNA, 22 nt, Human
ucucugauguauaucagagaac

SEQ ID NO: 320884 - RNA, 22 nt, Human
gaaaaggaaauuuauagagauc

SEQ ID NO: 320885 - RNA, 18 nt, Human
uggagcagguaggcauga

SEQ ID NO: 320886 - RNA, 22 nt, Human
agaucucaccucuguguauuau

SEQ ID NO: 320887 - RNA, 22 nt, Human
gaaggccacggaauggagcugg

SEQ ID NO: 320888 - RNA, 22 nt, Human
ggccugucucacccccgggugc

SEQ ID NO: 320889 - RNA, 20 nt, Human
cucaggauacugcaaaguug

SEQ ID NO: 320890 - RNA, 22 nt, Human
ucaacacucuuuggcacaguua

SEQ ID NO: 320891 - RNA, 23 nt, Human
uguugaaguaacuguuacauaga

SEQ ID NO: 320892 - RNA, 18 nt, Human
uccugccugugccccagg

SEQ ID NO: 320893 - RNA, 22 nt, Human
caggugcccagcuccugcugug

SEQ ID NO: 320894 - RNA, 22 nt, Human
gaagcacauggcuauagcuauu

SEQ ID NO: 320895 - RNA, 22 nt, Human
uuaacauacaucaugaacaaug

SEQ ID NO: 320896 - RNA, 22 nt, Human
cagaauaugacaagauuuuccu

SEQ ID NO: 320897 - RNA, 22 nt, Human
gcugguuagaaaacagagcuca

SEQ ID NO: 320898 - RNA, 22 nt, Human
uugaauuagacuuugcuacagg

SEQ ID NO: 320899 - RNA, 22 nt, Human
uggcucaguuucugcccagcug

SEQ ID NO: 320900 - RNA, 22 nt, Human
uggcagcugauuagauggugcc

SEQ ID NO: 320901 - RNA, 22 nt, Human
agccuggauucgugcauccaca

SEQ ID NO: 320902 - RNA, 22 nt, Human
ggagggcucaauugacuccuga

SEQ ID NO: 320903 - RNA, 21 nt, Human
cugcuguggcccccgacaugc

SEQ ID NO: 320904 - RNA, 22 nt, Human
ccauuugucaccucugcacucc

SEQ ID NO: 320905 - RNA, 22 nt, Human
aggggugugcauccuggaggau

SEQ ID NO: 320906 - RNA, 22 nt, Human
accauguuggccaagcuggucu

SEQ ID NO: 320907 - RNA, 22 nt, Human
cccauuuagauaacaguucaaa

SEQ ID NO: 320908 - RNA, 22 nt, Human
uagucccauuuugagguauuug

SEQ ID NO: 320909 - RNA, 21 nt, Human
agugaaaugaaguguaugcuc

SEQ ID NO: 320910 - RNA, 22 nt, Human
ugcagggcuaagucagagccug

SEQ ID NO: 320911 - RNA, 22 nt, Human
augugaggcagcacggagauua

SEQ ID NO: 320912 - RNA, 22 nt, Human
ccuguggagcuuucagcagcuc

SEQ ID NO: 320913 - RNA, 22 nt, Human
cagcuucugucugauuagcaag

SEQ ID NO: 320914 - RNA, 22 nt, Human
ucgagucauguucucccauuaa

SEQ ID NO: 320915 - RNA, 22 nt, Human
guaacagaaagucaugcucauu

SEQ ID NO: 320916 - RNA, 22 nt, Human
agccagcugccuuucacaucug

SEQ ID NO: 320917 - RNA, 22 nt, Human
cauugcacuccacccuaggcaa

SEQ ID NO: 320918 - RNA, 22 nt, Human
ccugccagggccuuggaagaaa

SEQ ID NO: 320919 - RNA, 22 nt, Human
auguuauggcucaaacauuugg

SEQ ID NO: 320920 - RNA, 22 nt, Human
uagcugucaccagaaauggcca

SEQ ID NO: 320921 - RNA, 22 nt, Human
cucauggauauaagaacuguuu

SEQ ID NO: 320922 - RNA, 22 nt, Human
uuguuugaggucacugauauuu

SEQ ID NO: 320923 - RNA, 22 nt, Human
gcucucuugguggcuguccugg

SEQ ID NO: 320924 - RNA, 22 nt, Human
ucaagauaccaccauuauaugu

SEQ ID NO: 320925 - RNA, 22 nt, Human
uacagcuaggcaaaaaugacau

SEQ ID NO: 320926 - RNA, 22 nt, Human
uggccugacugucaggcuguau

SEQ ID NO: 320927 - RNA, 16 nt, Human
cagcccugaggaagaa

SEQ ID NO: 320928 - RNA, 19 nt, Human
gcugucugaugcugagguc

SEQ ID NO: 320929 - RNA, 22 nt, Human
uauguacaccggggaagguggg

SEQ ID NO: 320930 - RNA, 22 nt, Human
cacugaagguaggaccaaggcu

SEQ ID NO: 320931 - RNA, 22 nt, Human
uugaaggaggcuccuuuuuaaa

SEQ ID NO: 320932 - RNA, 22 nt, Human
uuccucaugggguuccuucaga

SEQ ID NO: 320933 - RNA, 20 nt, Human
uauuuacaacuuagagccuc

SEQ ID NO: 320934 - RNA, 22 nt, Human
aaguucuacuguggguaaaaug

SEQ ID NO: 320935 - RNA, 22 nt, Human
ugaaaucaaugucuucugucuc

SEQ ID NO: 320936 - RNA, 22 nt, Human
cugugccuuuguagcugugccu

SEQ ID NO: 320937 - RNA, 23 nt, Human
aggugccaacugagagcugagag

SEQ ID NO: 320938 - RNA, 22 nt, Human
aaaaagauagcauugugcuccu

SEQ ID NO: 320939 - RNA, 22 nt, Human
auucuguauggaaaagcacuau

SEQ ID NO: 320940 - RNA, 22 nt, Human
cccagcccacgguccugggugg

SEQ ID NO: 320941 - RNA, 22 nt, Human
ggucccaguccucucccugcua

SEQ ID NO: 320942 - RNA, 19 nt, Human
caucuggaugauucuccug

SEQ ID NO: 320943 - RNA, 22 nt, Human
uacaguagacaauguuaguaug

SEQ ID NO: 320944 - RNA, 22 nt, Human
uagcugucagcaaucaaguggu

SEQ ID NO: 320945 - RNA, 22 nt, Human
cauuguuaccaucuuuuaccua

SEQ ID NO: 320946 - RNA, 22 nt, Human
uaaaugagggcugacaugauug

SEQ ID NO: 320947 - RNA, 18 nt, Human
gaaaggagagacaguagg

SEQ ID NO: 320948 - RNA, 22 nt, Human
cugaggucucuuuccauaguga

SEQ ID NO: 320949 - RNA, 20 nt, Human
guaaaauauggucuuugggu

SEQ ID NO: 320950 - RNA, 21 nt, Human
ggcagcccgcccucuccuggc

SEQ ID NO: 320951 - RNA, 22 nt, Human
agagacaccgcgcaucauggcu

SEQ ID NO: 320952 - RNA, 22 nt, Human
gucuuucuuaauucaagugcuu

SEQ ID NO: 320953 - RNA, 22 nt, Human
aaaaaugucauuauggaacuga

SEQ ID NO: 320954 - RNA, 22 nt, Human
ugcagaagacacaagguaacgu

SEQ ID NO: 320955 - RNA, 22 nt, Human
aagcaagacagaaguuacugcc

SEQ ID NO: 320956 - RNA, 22 nt, Human
gcugccaauccagcugugggag

SEQ ID NO: 320957 - RNA, 22 nt, Human
ucuggcucaaaauacguacucu

SEQ ID NO: 320958 - RNA, 22 nt, Human
uugcacuaggaaaaggcagcca

SEQ ID NO: 320959 - RNA, 22 nt, Human
cuugaaagauuuggccucugug

SEQ ID NO: 320960 - RNA, 22 nt, Human
ugcauugauagaaaaacaugga

SEQ ID NO: 320961 - RNA, 19 nt, Human
uucauucucuuauuguugu

SEQ ID NO: 320962 - RNA, 22 nt, Human
gcagccccaggagacgcccagg

SEQ ID NO: 320963 - RNA, 22 nt, Human
gagggcugcugccagauaugcc

SEQ ID NO: 320964 - RNA, 22 nt, Human
ggcugaguugagaggauuacuu

SEQ ID NO: 320965 - RNA, 22 nt, Human
ugaugaaacugagguuccaaga

SEQ ID NO: 320966 - RNA, 22 nt, Human
ugggcucauggcccagcacugg

SEQ ID NO: 320967 - RNA, 22 nt, Human
uggcucagaugcucuuccagug

SEQ ID NO: 320968 - RNA, 22 nt, Human
ucagaaaugaucguuauucauu

SEQ ID NO: 320969 - RNA, 22 nt, Human
aggcacugacucaagggagcca

SEQ ID NO: 320970 - RNA, 22 nt, Human
agaggcugucccuugcuauucc

SEQ ID NO: 320971 - RNA, 22 nt, Human
agcuuccuacaaccaucucaga

SEQ ID NO: 320972 - RNA, 22 nt, Human
ccugggagagccaucuguggcc

SEQ ID NO: 320973 - RNA, 22 nt, Human
ucucagucuuugcaaggaugcu

SEQ ID NO: 320974 - RNA, 22 nt, Human
ggcuuggaaauugcaggacaca

SEQ ID NO: 320975 - RNA, 22 nt, Human
ucugucaccauucagcuugaau

SEQ ID NO: 320976 - RNA, 22 nt, Human
gccugcuguuaacugcaggaau

SEQ ID NO: 320977 - RNA, 22 nt, Human
uggagacugugcuaagggaguu

SEQ ID NO: 320978 - RNA, 22 nt, Human
agucucugagguucagaugccu

SEQ ID NO: 320979 - RNA, 22 nt, Human
ccaggcucaggugcgagagaca

SEQ ID NO: 320980 - RNA, 22 nt, Human
ucucagaggucuucagccucug

SEQ ID NO: 320981 - RNA, 22 nt, Human
aagcagcagaccugauuuugaa

SEQ ID NO: 320982 - RNA, 16 nt, Human
agcagggcgggaagga

SEQ ID NO: 320983 - RNA, 22 nt, Human
aagauguaucaguuaagucuuc

SEQ ID NO: 320984 - RNA, 22 nt, Human
agcuuccuuggcgcugaggccu

SEQ ID NO: 320985 - RNA, 22 nt, Human
uugcacuccagcccgagcaaca

SEQ ID NO: 320986 - RNA, 22 nt, Human
uggcccagagcacugcugggca

SEQ ID NO: 320987 - RNA, 22 nt, Human
ucucugggauaaacugggccag

SEQ ID NO: 320988 - RNA, 22 nt, Human
ccagcuggagccaagguggacu

SEQ ID NO: 320989 - RNA, 20 nt, Human
ucuggcucuuugcuccuccc

SEQ ID NO: 320990 - RNA, 22 nt, Human
gguuugcacgauauuuccaugg

SEQ ID NO: 320991 - RNA, 22 nt, Human
cugaggcuuugugugcaugccu

SEQ ID NO: 320992 - RNA, 22 nt, Human
ggucccugcugaagccuuggug

SEQ ID NO: 320993 - RNA, 22 nt, Human
aggaugagagauacauggagca

SEQ ID NO: 320994 - RNA, 22 nt, Human
gugucaugggagucagaaguga

SEQ ID NO: 320995 - RNA, 22 nt, Human
cccagguggguuggccucuguc

SEQ ID NO: 320996 - RNA, 23 nt, Human
cuccucguaacucuguggugggu

SEQ ID NO: 320997 - RNA, 22 nt, Human
uggagcugagaaguggagcucu

SEQ ID NO: 320998 - RNA, 22 nt, Human
agugaguggguuacagauggga

SEQ ID NO: 320999 - RNA, 22 nt, Human
uaaugcacaugacugaacuauu

SEQ ID NO: 321000 - RNA, 22 nt, Human
ucucuucuauuugagacuauuu

SEQ ID NO: 321001 - RNA, 22 nt, Human
cagagguagccgagugcaaucg

SEQ ID NO: 321002 - RNA, 22 nt, Human
ccuuagagaguacugggcugcc

SEQ ID NO: 321003 - RNA, 22 nt, Human
uaaagguaacaugaacugcuuu

SEQ ID NO: 321004 - RNA, 21 nt, Human
ggccugaguauaggacaggcc

SEQ ID NO: 321005 - RNA, 22 nt, Human
aaaugguguuucuaaugcuaga

SEQ ID NO: 321006 - RNA, 22 nt, Human
cuuacauugucuuaguuuucaa

SEQ ID NO: 321007 - RNA, 20 nt, Human
acagccagaggaggcagaca

SEQ ID NO: 321008 - RNA, 22 nt, Human
ggagggagggcuagaccaaaga

SEQ ID NO: 321009 - RNA, 20 nt, Human
aagcacauuucuacaauaau

SEQ ID NO: 321010 - RNA, 22 nt, Human
cucuuucaguucugauagucuc

SEQ ID NO: 321011 - RNA, 22 nt, Human
cuuugggcaaagggccaauucg

SEQ ID NO: 321012 - RNA, 22 nt, Human
cagcaucuuucucuucuggagu

SEQ ID NO: 321013 - RNA, 22 nt, Human
uuugacaguaauaaagcacaag

SEQ ID NO: 321014 - RNA, 19 nt, Human
ggccaggcugacugugguc

SEQ ID NO: 321015 - RNA, 21 nt, Human
ggcaucccaggccagugacug

SEQ ID NO: 321016 - RNA, 20 nt, Human
gcucccagccugcagucccc

SEQ ID NO: 321017 - RNA, 22 nt, Human
aguauaaagugguuuucagcac

SEQ ID NO: 321018 - RNA, 22 nt, Human
aaggcagucugguuucaaagca

SEQ ID NO: 321019 - RNA, 22 nt, Human
cucacugcaaguuccaccuacc

SEQ ID NO: 321020 - RNA, 22 nt, Human
ugggacacccucacgccugcac

SEQ ID NO: 321021 - RNA, 22 nt, Human
gggagggaaggaccuuaugaau

SEQ ID NO: 321022 - RNA, 22 nt, Human
uggcugccuagucccucagccu

SEQ ID NO: 321023 - RNA, 22 nt, Human
cagaaaaccugacucuagaacu

SEQ ID NO: 321024 - RNA, 22 nt, Human
augcuguggggagugaggguag

SEQ ID NO: 321025 - RNA, 21 nt, Human
gcucagaguauugcacuguuu

SEQ ID NO: 321026 - RNA, 22 nt, Human
aaauguauugcauaggauauuu

SEQ ID NO: 321027 - RNA, 19 nt, Human
gcaugcuugguggcuucug

SEQ ID NO: 321028 - RNA, 22 nt, Human
aagaaaagaaaccugaggcuuu

SEQ ID NO: 321029 - RNA, 20 nt, Human
gcucccugguagaaauguuu

SEQ ID NO: 321030 - RNA, 22 nt, Human
aagacccacaaggcugaauguu

SEQ ID NO: 321031 - RNA, 22 nt, Human
ugaaaugauuauaugguguuug

SEQ ID NO: 321032 - RNA, 22 nt, Human
gggguugguuuaaaugcuugag

SEQ ID NO: 321033 - RNA, 22 nt, Human
guccuggggaauacagaagccg

SEQ ID NO: 321034 - RNA, 22 nt, Human
ucucuucuuuggggugggcuca

SEQ ID NO: 321035 - RNA, 22 nt, Human
uaaagguacgaagugagggauu

SEQ ID NO: 321036 - RNA, 21 nt, Human
gugguuauuuucauuagcauc

SEQ ID NO: 321037 - RNA, 22 nt, Human
uccagucaagcuugagaauuuc

SEQ ID NO: 321038 - RNA, 22 nt, Human
agcucacagaaauccugcagga

SEQ ID NO: 321039 - RNA, 22 nt, Human
caggcugggaacgccacccgcu

SEQ ID NO: 321040 - RNA, 22 nt, Human
acagagcaauucuuggguguuu

SEQ ID NO: 321041 - RNA, 22 nt, Human
aauguauuccucaugcaagagu

SEQ ID NO: 321042 - RNA, 19 nt, Human
ccuguucaugacucugucc

SEQ ID NO: 321043 - RNA, 20 nt, Human
auccaugagagucuggauuc

SEQ ID NO: 321044 - RNA, 22 nt, Human
ucugccuguucaagucuucuag

SEQ ID NO: 321045 - RNA, 21 nt, Human
gauuugcagaaacuagacagg

SEQ ID NO: 321046 - RNA, 22 nt, Human
ucucccagaggaucccagugga

SEQ ID NO: 321047 - RNA, 22 nt, Human
ugcuugcaagagaugcaaugac

SEQ ID NO: 321048 - RNA, 22 nt, Human
uaucuuuagaggaagagaaucu

SEQ ID NO: 321049 - RNA, 22 nt, Human
ugugcagcuaguccuggacuug

SEQ ID NO: 321050 - RNA, 22 nt, Human
auaaaaguaggaccaacuuaca

SEQ ID NO: 321051 - RNA, 22 nt, Human
aucugccuccaaguccaugugu

SEQ ID NO: 321052 - RNA, 21 nt, Human
ggcagccucuguggaagggga

SEQ ID NO: 321053 - RNA, 22 nt, Human
gucccuuggcucacaaacagcu

SEQ ID NO: 321054 - RNA, 22 nt, Human
ugcuaucucuauauccauuuau

SEQ ID NO: 321055 - RNA, 22 nt, Human
cuggcagcugcccgagaugccc

SEQ ID NO: 321056 - RNA, 22 nt, Human
uuuccauguuggugaaaugagg

SEQ ID NO: 321057 - RNA, 22 nt, Human
ucaguccugaugacaggcccaa

SEQ ID NO: 321058 - RNA, 22 nt, Human
ugacacauuaaaugcucacaaa

SEQ ID NO: 321059 - RNA, 22 nt, Human
gcuggcuguguuccuucugcca

SEQ ID NO: 321060 - RNA, 22 nt, Human
aguuuucacacucaccaaaagg

SEQ ID NO: 321061 - RNA, 22 nt, Human
ucaucacucauuggacaacaga

SEQ ID NO: 321062 - RNA, 22 nt, Human
auucuuggcaaggagauuuaaa

SEQ ID NO: 321063 - RNA, 22 nt, Human
uggcucaguuccaucaucugga

SEQ ID NO: 321064 - RNA, 22 nt, Human
aauuccugucuuaacaguucug

SEQ ID NO: 321065 - RNA, 22 nt, Human
ggcagcuggccuccucgcccac

SEQ ID NO: 321066 - RNA, 22 nt, Human
aaaagggacuacucucagcucc

SEQ ID NO: 321067 - RNA, 22 nt, Human
ggcuucugagugcucugcuguu

SEQ ID NO: 321068 - RNA, 22 nt, Human
ucaggggcuugaggugcauguc

SEQ ID NO: 321069 - RNA, 22 nt, Human
ucuggccugggccugccggugc

SEQ ID NO: 321070 - RNA, 21 nt, Human
agcugccacccuagcuucuga

SEQ ID NO: 321071 - RNA, 22 nt, Human
uucaagauaauaggaaugaaaa

SEQ ID NO: 321072 - RNA, 19 nt, Human
aguccaugaauggaggaug

SEQ ID NO: 321073 - RNA, 22 nt, Human
ugcucccaggcucuguggucug

SEQ ID NO: 321074 - RNA, 22 nt, Human
ggcugccuccucgagacaggau

SEQ ID NO: 321075 - RNA, 22 nt, Human
agcugcucaggagagccagguc

SEQ ID NO: 321076 - RNA, 22 nt, Human
cagcacugcuucgcagccaggg

SEQ ID NO: 321077 - RNA, 22 nt, Human
cugucuccuccacugcauggga

SEQ ID NO: 321078 - RNA, 20 nt, Human
ccugucugcaauggagguca

SEQ ID NO: 321079 - RNA, 22 nt, Human
gcucuguacgcaggaugagggg

SEQ ID NO: 321080 - RNA, 22 nt, Human
acagaauuaaugaaaauuacaa

SEQ ID NO: 321081 - RNA, 22 nt, Human
uagugauuaaaggcagaauguu

SEQ ID NO: 321082 - RNA, 22 nt, Human
agggccugggauguccuccuag

SEQ ID NO: 321083 - RNA, 19 nt, Human
gccaggagggcucuggcug

SEQ ID NO: 321084 - RNA, 22 nt, Human
ucuggccaacaaaaacuaaguc

SEQ ID NO: 321085 - RNA, 22 nt, Human
gcagagccugacgggauuuuuc

SEQ ID NO: 321086 - RNA, 22 nt, Human
aagacaauuugauacuaguugc

SEQ ID NO: 321087 - RNA, 22 nt, Human
ucaggccuuguccugaccuccu

SEQ ID NO: 321088 - RNA, 22 nt, Human
cugggagguggagguugcauug

SEQ ID NO: 321089 - RNA, 22 nt, Human
agucccagaucuccauucgguc

SEQ ID NO: 321090 - RNA, 22 nt, Human
auggagggugguaagacagaga

SEQ ID NO: 321091 - RNA, 22 nt, Human
cagcugcccauccugggaaaug

SEQ ID NO: 321092 - RNA, 22 nt, Human
gcucccagcauugcuucccagg

SEQ ID NO: 321093 - RNA, 22 nt, Human
auguagaaauuaggaugauagu

SEQ ID NO: 321094 - RNA, 22 nt, Human
caagagcuggagaggcagucua

SEQ ID NO: 321095 - RNA, 22 nt, Human
aggcucagaggugagcaucugc

SEQ ID NO: 321096 - RNA, 22 nt, Human
ucaggcugagaaaaucuggacc

SEQ ID NO: 321097 - RNA, 22 nt, Human
acuucuggugucauacugcauu

SEQ ID NO: 321098 - RNA, 22 nt, Human
gggcugucaugugucagugacc

SEQ ID NO: 321099 - RNA, 22 nt, Human
ggaccugccagaacucaggcua

SEQ ID NO: 321100 - RNA, 22 nt, Human
agcugcccccagggcugugcuu

SEQ ID NO: 321101 - RNA, 22 nt, Human
cugcucuggggaagccagaugu

SEQ ID NO: 321102 - RNA, 22 nt, Human
gcauuuccugugcuuggcauau

SEQ ID NO: 321103 - RNA, 22 nt, Human
gucugucucucuccagagugca

SEQ ID NO: 321104 - RNA, 18 nt, Human
agucuucugauccauuuu

SEQ ID NO: 321105 - RNA, 22 nt, Human
gcagcccaauggacugagacag

SEQ ID NO: 321106 - RNA, 22 nt, Human
guggagaccuccuaggaugugu

SEQ ID NO: 321107 - RNA, 22 nt, Human
uguuauugagguuacuuauaag

SEQ ID NO: 321108 - RNA, 22 nt, Human
gagaugagugggggaucucuca

SEQ ID NO: 321109 - RNA, 22 nt, Human
ugcugucaguuggcaggaugag

SEQ ID NO: 321110 - RNA, 22 nt, Human
gggccaggucggugaaugguca

SEQ ID NO: 321111 - RNA, 22 nt, Human
acugucuuccaggucuggaggu

SEQ ID NO: 321112 - RNA, 22 nt, Human
uuugacaugcaaagcacuuuag

SEQ ID NO: 321113 - RNA, 22 nt, Human
cuggguaaguuccuaaggcuca

SEQ ID NO: 321114 - RNA, 22 nt, Human
aggccuggugaaugaaguaucu

SEQ ID NO: 321115 - RNA, 22 nt, Human
acugagcucuugacugggaguu

SEQ ID NO: 321116 - RNA, 22 nt, Human
ggccagaaguuggaaaagagcc

SEQ ID NO: 321117 - RNA, 22 nt, Human
ggagagcagggaggcugcucug

SEQ ID NO: 321118 - RNA, 22 nt, Human
cugugucggacgugggcagcag

SEQ ID NO: 321119 - RNA, 22 nt, Human
aaaugcaucagcucauaagaga

SEQ ID NO: 321120 - RNA, 22 nt, Human
ccaguguucccucggguucaug

SEQ ID NO: 321121 - RNA, 22 nt, Human
cagucucuugcuucauuaguug

SEQ ID NO: 321122 - RNA, 22 nt, Human
cuggcagcucuacucagagccu

SEQ ID NO: 321123 - RNA, 22 nt, Human
ugaacagaucaauagaacugac

SEQ ID NO: 321124 - RNA, 22 nt, Human
ucugagaguacgggcugcgcgc

SEQ ID NO: 321125 - RNA, 22 nt, Human
augagaaagaguuguaucuaga

SEQ ID NO: 321126 - RNA, 22 nt, Human
auaggagaucaauaugcaauuu

SEQ ID NO: 321127 - RNA, 22 nt, Human
caggauggccccggggcugugc

SEQ ID NO: 321128 - RNA, 22 nt, Human
cuuguucaguccugacuuccug

SEQ ID NO: 321129 - RNA, 22 nt, Human
ggcuggcucagggcuugagaga

SEQ ID NO: 321130 - RNA, 22 nt, Human
aagggcuggcccugggaagagu

SEQ ID NO: 321131 - RNA, 22 nt, Human
uccagaguacggaagagucauc

SEQ ID NO: 321132 - RNA, 22 nt, Human
cagggacaauggcagagccuga

SEQ ID NO: 321133 - RNA, 22 nt, Human
uagauuucgcugcaucucaauc

SEQ ID NO: 321134 - RNA, 22 nt, Human
cagaugcuauguauuauguaug

SEQ ID NO: 321135 - RNA, 21 nt, Human
aggcagcucaggcccagagag

SEQ ID NO: 321136 - RNA, 22 nt, Human
auuccaguuggguucuaauaca

SEQ ID NO: 321137 - RNA, 19 nt, Human
cuguggcugaccucuggcc

SEQ ID NO: 321138 - RNA, 22 nt, Human
ggagcagacauaaccuuacaga

SEQ ID NO: 321139 - RNA, 22 nt, Human
acuucacagauauuuauuuggu

SEQ ID NO: 321140 - RNA, 22 nt, Human
aggcaucugaguuugcaagcuu

SEQ ID NO: 321141 - RNA, 22 nt, Human
agccauugaguuuuaugugcua

SEQ ID NO: 321142 - RNA, 22 nt, Human
uuagccauuuuauacaagugua

SEQ ID NO: 321143 - RNA, 20 nt, Human
aaaaacaguaaugcugaaga

SEQ ID NO: 321144 - RNA, 21 nt, Human
uucuucaguuuaauauaaaau

SEQ ID NO: 321145 - RNA, 22 nt, Human
aaguucaagagugacauauuag

SEQ ID NO: 321146 - RNA, 22 nt, Human
gcccagcacagcuggaagaguc

SEQ ID NO: 321147 - RNA, 22 nt, Human
cuggccuuggugcuugcagaca

SEQ ID NO: 321148 - RNA, 22 nt, Human
gaugggggccagggccugcuuu

SEQ ID NO: 321149 - RNA, 22 nt, Human
ucaccgccuugcccggccgggc

SEQ ID NO: 321150 - RNA, 22 nt, Human
aucaggauagugguuaccuggg

SEQ ID NO: 321151 - RNA, 22 nt, Human
uggaaauauacaaugugucucu

SEQ ID NO: 321152 - RNA, 22 nt, Human
gggagcugaauggcaauggaga

SEQ ID NO: 321153 - RNA, 22 nt, Human
agcucacaguguccuuccucaa

SEQ ID NO: 321154 - RNA, 22 nt, Human
gcugcccugucugcagcaggac

SEQ ID NO: 321155 - RNA, 22 nt, Human
cagcuggaucccugcagaacuu

SEQ ID NO: 321156 - RNA, 22 nt, Human
acaaaugcuuaguucaccaaaa

SEQ ID NO: 321157 - RNA, 22 nt, Human
ucucaguggcuuccucacuuuu

SEQ ID NO: 321158 - RNA, 22 nt, Human
auucugucuuuuuaaaauaaua

SEQ ID NO: 321159 - RNA, 22 nt, Human
agccagcuggugggucagcugg

SEQ ID NO: 321160 - RNA, 20 nt, Human
auuucaguguuugcaauuuc

SEQ ID NO: 321161 - RNA, 21 nt, Human
ccugggagaucagcugccuuc

SEQ ID NO: 321162 - RNA, 22 nt, Human
uugcauuuugguuguaaauaug

SEQ ID NO: 321163 - RNA, 22 nt, Human
uucuuuccacagaggggaugau

SEQ ID NO: 321164 - RNA, 19 nt, Human
ugagaggcuuaaggcagcu

SEQ ID NO: 321165 - RNA, 19 nt, Human
ugaggggcucacagucuca

SEQ ID NO: 321166 - RNA, 22 nt, Human
ccuggccacucagguguggggc

SEQ ID NO: 321167 - RNA, 22 nt, Human
ucucagagaggggccgggccuu

SEQ ID NO: 321168 - RNA, 22 nt, Human
uugcagcuuagugauguuaucu

SEQ ID NO: 321169 - RNA, 22 nt, Human
uuuaaucaggcaaagcauaaua

SEQ ID NO: 321170 - RNA, 22 nt, Human
gaaggccucacucugcagcaua

SEQ ID NO: 321171 - RNA, 22 nt, Human
auagugguuggauaugucagag

SEQ ID NO: 321172 - RNA, 22 nt, Human
aaagagaaaaagaucccggcuc

SEQ ID NO: 321173 - RNA, 22 nt, Human
aaagagcuaacauugccgagau

SEQ ID NO: 321174 - RNA, 22 nt, Human
augaaggcaguuaaacgucauc

SEQ ID NO: 321175 - RNA, 22 nt, Human
agacaggacacaagcugcauaa

SEQ ID NO: 321176 - RNA, 22 nt, Human
aguuacaaccaugacacaagca

SEQ ID NO: 321177 - RNA, 22 nt, Human
gugaaggauaaggaucuaaauu

SEQ ID NO: 321178 - RNA, 22 nt, Human
uaaaucccuacaucuguguuuu

SEQ ID NO: 321179 - RNA, 22 nt, Human
cagagcuggguuugggaaaccu

SEQ ID NO: 321180 - RNA, 22 nt, Human
caaggccaagguuuugugaacu

SEQ ID NO: 321181 - RNA, 22 nt, Human
ucacaggguguacaucaccuau

SEQ ID NO: 321182 - RNA, 22 nt, Human
aagaauuauugcaauacuagau

SEQ ID NO: 321183 - RNA, 22 nt, Human
uuccauaaugagauucccagcc

SEQ ID NO: 321184 - RNA, 22 nt, Human
ugugaaauauuuauauacucaa

SEQ ID NO: 321185 - RNA, 18 nt, Human
uccauuguucuacuguga

SEQ ID NO: 321186 - RNA, 22 nt, Human
gauuuucaugauaaacuuguga

SEQ ID NO: 321187 - RNA, 22 nt, Human
acagagguguguguaggacagu

SEQ ID NO: 321188 - RNA, 22 nt, Human
cuuuggcacagucucauuugau

SEQ ID NO: 321189 - RNA, 22 nt, Human
gcaggcagagaaggaacauuua

SEQ ID NO: 321190 - RNA, 22 nt, Human
agagaggcugggcguagggcuu

SEQ ID NO: 321191 - RNA, 22 nt, Human
auccaaaccuggacaugagugg

SEQ ID NO: 321192 - RNA, 22 nt, Human
uaaggucauggugaauaauaag

SEQ ID NO: 321193 - RNA, 22 nt, Human
agcuccuccugugccaggccag

SEQ ID NO: 321194 - RNA, 22 nt, Human
ccagggcuggugggagaugcug

SEQ ID NO: 321195 - RNA, 22 nt, Human
gcucucugucguuaugcuucau

SEQ ID NO: 321196 - RNA, 22 nt, Human
agcagccaguucucugugguag

SEQ ID NO: 321197 - RNA, 22 nt, Human
ucagucucaucaacucuauucc

SEQ ID NO: 321198 - RNA, 22 nt, Human
uacauuaacuuacguccacaug

SEQ ID NO: 321199 - RNA, 22 nt, Human
ucugccugaaauucacauguaa

SEQ ID NO: 321200 - RNA, 22 nt, Human
auuuaguguguauugcuauuau

SEQ ID NO: 321201 - RNA, 23 nt, Human
aaauucaguccuucaacucugag

SEQ ID NO: 321202 - RNA, 22 nt, Human
ucugugugcccaccugacaccu

SEQ ID NO: 321203 - RNA, 22 nt, Human
cucugaacucuugggcagcaug

SEQ ID NO: 321204 - RNA, 22 nt, Human
acauuucucauaggagagccac

SEQ ID NO: 321205 - RNA, 22 nt, Human
guggccagcaagugcugccucu

SEQ ID NO: 321206 - RNA, 22 nt, Human
agcugcuggggagggcagacac

SEQ ID NO: 321207 - RNA, 22 nt, Human
aaucugucguaguaaaaagcag

SEQ ID NO: 321208 - RNA, 23 nt, Human
uuucuucagaagccuugcgaggc

SEQ ID NO: 321209 - RNA, 22 nt, Human
caggagacaaguuagcagcuga

SEQ ID NO: 321210 - RNA, 18 nt, Human
aagcugcccucaggcagg

SEQ ID NO: 321211 - RNA, 21 nt, Human
acagauauuucauugaacauu

SEQ ID NO: 321212 - RNA, 22 nt, Human
cagucacauugcccugcauuua

SEQ ID NO: 321213 - RNA, 22 nt, Human
ucauccaguuguggagagggaa

SEQ ID NO: 321214 - RNA, 22 nt, Human
ucaaaguauuuuaacuguaucc

SEQ ID NO: 321215 - RNA, 22 nt, Human
ucucagagaugucaagagucua

SEQ ID NO: 321216 - RNA, 22 nt, Human
uggacagcgaaagugccuggga

SEQ ID NO: 321217 - RNA, 22 nt, Human
auacagaagaacuauagccacu

SEQ ID NO: 321218 - RNA, 22 nt, Human
cuuccucccggcccaugcucug

SEQ ID NO: 321219 - RNA, 22 nt, Human
ccagcugguguuccuuaggacc

SEQ ID NO: 321220 - RNA, 22 nt, Human
uugacacaguuuucucauuaag

SEQ ID NO: 321221 - RNA, 22 nt, Human
uaagaagcuucugcuaaugccu

SEQ ID NO: 321222 - RNA, 22 nt, Human
uuaagacauucagauauuucua

SEQ ID NO: 321223 - RNA, 22 nt, Human
cauugcacuccagcuugggcaa

SEQ ID NO: 321224 - RNA, 22 nt, Human
caggcacuggccagucagcaca

SEQ ID NO: 321225 - RNA, 22 nt, Human
gcucugagauugagccuuuggu

SEQ ID NO: 321226 - RNA, 22 nt, Human
agagcugcaggguggacccagg

SEQ ID NO: 321227 - RNA, 22 nt, Human
gugucccagccccacaggccug

SEQ ID NO: 321228 - RNA, 22 nt, Human
gcugccagcuuuccuuggcuga

SEQ ID NO: 321229 - RNA, 22 nt, Human
uuccaggaagcaguuagcagcc

SEQ ID NO: 321230 - RNA, 20 nt, Human
ggccacagggugcuggugga

SEQ ID NO: 321231 - RNA, 22 nt, Human
ccaguguucaucaagaaaaugu

SEQ ID NO: 321232 - RNA, 22 nt, Human
ucucaaaucaaacuuugagcuu

SEQ ID NO: 321233 - RNA, 22 nt, Human
uugaagcauuucuuugagcuuc

SEQ ID NO: 321234 - RNA, 22 nt, Human
uucaggauuguguuuuuccuga

SEQ ID NO: 321235 - RNA, 22 nt, Human
gaacacauguccuccuuggauu

SEQ ID NO: 321236 - RNA, 22 nt, Human
ucaaacuagccugacugguauu

SEQ ID NO: 321237 - RNA, 22 nt, Human
uuuugucuaagaacuuugcaaa

SEQ ID NO: 321238 - RNA, 22 nt, Human
gauuucaagcccccagagauuc

SEQ ID NO: 321239 - RNA, 22 nt, Human
ucacugcugcugccaugaugga

SEQ ID NO: 321240 - RNA, 22 nt, Human
agggcacaucugcugggaaugg

SEQ ID NO: 321241 - RNA, 17 nt, Human
gugcagggaugaaggau

SEQ ID NO: 321242 - RNA, 22 nt, Human
gcuuggaaguaggauugggaga

SEQ ID NO: 321243 - RNA, 22 nt, Human
aggcucugguuggcaaguaaag

SEQ ID NO: 321244 - RNA, 19 nt, Human
acaggcagaauugggugug

SEQ ID NO: 321245 - RNA, 22 nt, Human
uacauguguucuguuucaaguu

SEQ ID NO: 321246 - RNA, 23 nt, Human
cuggccuccgacacuggccaaga

SEQ ID NO: 321247 - RNA, 22 nt, Human
uuggcauuggagaugcaagaac

SEQ ID NO: 321248 - RNA, 20 nt, Human
uaaggcuguuuuguauuccu

SEQ ID NO: 321249 - RNA, 22 nt, Human
gcugccuguguggccacucacu

SEQ ID NO: 321250 - RNA, 22 nt, Human
acucagaaccauuuacucugag

SEQ ID NO: 321251 - RNA, 22 nt, Human
agacuuugagcucuuagagaag

SEQ ID NO: 321252 - RNA, 22 nt, Human
auucaaauuaaguuaauucagc

SEQ ID NO: 321253 - RNA, 22 nt, Human
uagggcaggggaggaaucugaa

SEQ ID NO: 321254 - RNA, 22 nt, Human
gcacccaggccggcgacugcag

SEQ ID NO: 321255 - RNA, 22 nt, Human
aaaucaaaagacauguguuuua

SEQ ID NO: 321256 - RNA, 22 nt, Human
ggacuggccggcgcugaggccc

SEQ ID NO: 321257 - RNA, 22 nt, Human
gggaugaauugagucagaaggg

SEQ ID NO: 321258 - RNA, 22 nt, Human
gaaggagcuaccaagacugaau

SEQ ID NO: 321259 - RNA, 22 nt, Human
uuggccuuaaccucucugugcc

SEQ ID NO: 321260 - RNA, 22 nt, Human
auguuuccagguucuuccuaug

SEQ ID NO: 321261 - RNA, 22 nt, Human
agaauuagucacaauuauagga

SEQ ID NO: 321262 - RNA, 22 nt, Human
acaguguuuaaaaaucagaucu

SEQ ID NO: 321263 - RNA, 22 nt, Human
cagagccucagaauccugugga

SEQ ID NO: 321264 - RNA, 22 nt, Human
uauaauccauucauugauuucu

SEQ ID NO: 321265 - RNA, 22 nt, Human
ucaguguuggagauaauugcac

SEQ ID NO: 321266 - RNA, 22 nt, Human
gggcugcuuuuaagggucucag

SEQ ID NO: 321267 - RNA, 21 nt, Human
ugcugaugucagagaagcaag

SEQ ID NO: 321268 - RNA, 22 nt, Human
ggggacaguuaaagaccaagac

SEQ ID NO: 321269 - RNA, 22 nt, Human
gaggacaggagacucacuguuu

SEQ ID NO: 321270 - RNA, 22 nt, Human
accucugcaacccuggaauggg

SEQ ID NO: 321271 - RNA, 22 nt, Human
auuguauuagcacaauacaauu

SEQ ID NO: 321272 - RNA, 17 nt, Human
ucugaggccucuaggag

SEQ ID NO: 321273 - RNA, 22 nt, Human
ccuauugacaauucucuucucc

SEQ ID NO: 321274 - RNA, 22 nt, Human
ucuuugcagaauuuaacuuugc

SEQ ID NO: 321275 - RNA, 22 nt, Human
auguucuuccaaaucuguaaca

SEQ ID NO: 321276 - RNA, 22 nt, Human
aaaguauuugugauuuuuacca

SEQ ID NO: 321277 - RNA, 22 nt, Human
ugcauuaucuuuaauguucuca

SEQ ID NO: 321278 - RNA, 22 nt, Human
cuggagcucuguguguuccuga

SEQ ID NO: 321279 - RNA, 22 nt, Human
ugugucagaaggcaauggggau

SEQ ID NO: 321280 - RNA, 22 nt, Human
uuucacaaucaaauggugaaau

SEQ ID NO: 321281 - RNA, 22 nt, Human
ggagugggaacaaugacauggu

SEQ ID NO: 321282 - RNA, 22 nt, Human
uccuccucacgcuguugcuugu

SEQ ID NO: 321283 - RNA, 22 nt, Human
agcagggcagcugaugcgcacg

SEQ ID NO: 321284 - RNA, 22 nt, Human
ucuggcucuccagugcucuuag

SEQ ID NO: 321285 - RNA, 22 nt, Human
gucccagaggacagggucacau

SEQ ID NO: 321286 - RNA, 22 nt, Human
uugaauaggacucagcagugau

SEQ ID NO: 321287 - RNA, 22 nt, Human
cucaguccgucccgcuaggugc

SEQ ID NO: 321288 - RNA, 22 nt, Human
ggcagagacuggguuggcagag

SEQ ID NO: 321289 - RNA, 22 nt, Human
uucuuacuacauuugcaggcua

SEQ ID NO: 321290 - RNA, 22 nt, Human
uuugaaguguuauuucuaucac

SEQ ID NO: 321291 - RNA, 22 nt, Human
acucagaguuugcguuccauac

SEQ ID NO: 321292 - RNA, 22 nt, Human
uagcagggaagaugaucagaau

SEQ ID NO: 321293 - RNA, 22 nt, Human
gcugccuucccggaaugucauc

SEQ ID NO: 321294 - RNA, 22 nt, Human
uaaugucaaggugauagauuug

SEQ ID NO: 321295 - RNA, 22 nt, Human
uggcucaggccacuucuuuuau

SEQ ID NO: 321296 - RNA, 22 nt, Human
ucuugauuacaaauaacaucau

SEQ ID NO: 321297 - RNA, 22 nt, Human
gcugucaccaaagcaggcacug

SEQ ID NO: 321298 - RNA, 22 nt, Human
acauuuaaauaugccuuauauu

SEQ ID NO: 321299 - RNA, 19 nt, Human
ugaagcaauaccauuuuug

SEQ ID NO: 321300 - RNA, 22 nt, Human
gggcugcugccaaucacagccu

SEQ ID NO: 321301 - RNA, 22 nt, Human
gcucugcuggaaguucucugga

SEQ ID NO: 321302 - RNA, 17 nt, Human
auuucacuuagcaugag

SEQ ID NO: 321303 - RNA, 22 nt, Human
gcugagggcauguguggcgacu

SEQ ID NO: 321304 - RNA, 22 nt, Human
uccuggauucugcccugaaggc

SEQ ID NO: 321305 - RNA, 22 nt, Human
ccugcagggugcugccacagau

SEQ ID NO: 321306 - RNA, 22 nt, Human
ugaaggaaugagggaguggguc

SEQ ID NO: 321307 - RNA, 23 nt, Human
ugcauuauccucucugaagacca

SEQ ID NO: 321308 - RNA, 19 nt, Human
agcaacaccguuuauuucc

SEQ ID NO: 321309 - RNA, 22 nt, Human
gagccugagugcugccuccccu

SEQ ID NO: 321310 - RNA, 22 nt, Human
gugccuggcaugcgccggugcu

SEQ ID NO: 321311 - RNA, 22 nt, Human
acuccuggggcugccaucacag

SEQ ID NO: 321312 - RNA, 22 nt, Human
uacauagcaaggaaaugacaga

SEQ ID NO: 321313 - RNA, 22 nt, Human
uauacuuuccugcaacuuugau

SEQ ID NO: 321314 - RNA, 22 nt, Human
gacaauaaaaugaucuuacagu

SEQ ID NO: 321315 - RNA, 22 nt, Human
uggcccugcagaacuagccugg

SEQ ID NO: 321316 - RNA, 22 nt, Human
uacaaaguuugagaaugcuuuc

SEQ ID NO: 321317 - RNA, 22 nt, Human
ccaggccaaauucagucagcag

SEQ ID NO: 321318 - RNA, 22 nt, Human
acccaggccugagagacaggag

SEQ ID NO: 321319 - RNA, 22 nt, Human
ccaguguucauaauuuuacacu

SEQ ID NO: 321320 - RNA, 20 nt, Human
aucaggauucuugcuuuguu

SEQ ID NO: 321321 - RNA, 22 nt, Human
gagcuuccauggacgccaucug

SEQ ID NO: 321322 - RNA, 22 nt, Human
guaggcagucucucaggugauc

SEQ ID NO: 321323 - RNA, 23 nt, Human
ugcagccacucaggagcucagug

SEQ ID NO: 321324 - RNA, 22 nt, Human
uguauaaauuuaaauuccugcu

SEQ ID NO: 321325 - RNA, 22 nt, Human
cugccuggggaaugugaggauu

SEQ ID NO: 321326 - RNA, 22 nt, Human
aaggcugagacagcacaggucc

SEQ ID NO: 321327 - RNA, 22 nt, Human
gagccuggggacccuccugagu

SEQ ID NO: 321328 - RNA, 22 nt, Human
cagccagguucaaguccuuaua

SEQ ID NO: 321329 - RNA, 22 nt, Human
aauucuguaacuuuacugaauu

SEQ ID NO: 321330 - RNA, 22 nt, Human
ccaggagcagauauggacauaa

SEQ ID NO: 321331 - RNA, 22 nt, Human
acaaaugucuccucuuuuguua

SEQ ID NO: 321332 - RNA, 22 nt, Human
gccacagucacugcugcagggg

SEQ ID NO: 321333 - RNA, 22 nt, Human
agagauucauguuuacuguagg

SEQ ID NO: 321334 - RNA, 22 nt, Human
cugggccucaaucucagaguuu

SEQ ID NO: 321335 - RNA, 22 nt, Human
agagcuguggauaguccuggau

SEQ ID NO: 321336 - RNA, 22 nt, Human
aaugggagagaacacaaagucc

SEQ ID NO: 321337 - RNA, 22 nt, Human
cacauuucugugagucaauauu

SEQ ID NO: 321338 - RNA, 22 nt, Human
ggcacugaucugauuucccucc

SEQ ID NO: 321339 - RNA, 22 nt, Human
agcagcuccugccaugagugcu

SEQ ID NO: 321340 - RNA, 22 nt, Human
uccaguggugguuugaagggca

SEQ ID NO: 321341 - RNA, 22 nt, Human
caauaguucgguccugaaggcc

SEQ ID NO: 321342 - RNA, 22 nt, Human
cagggcuguuagcugcugcucu

SEQ ID NO: 321343 - RNA, 22 nt, Human
agcucccagaaggcccugcgcc

SEQ ID NO: 321344 - RNA, 22 nt, Human
cugggaggcggagguuguagug

SEQ ID NO: 321345 - RNA, 22 nt, Human
aaauauaauuucugccucaaua

SEQ ID NO: 321346 - RNA, 22 nt, Human
ucuuuauugcuacugguuuguc

SEQ ID NO: 321347 - RNA, 22 nt, Human
agcuccugugugaagccucccu

SEQ ID NO: 321348 - RNA, 22 nt, Human
uuucaugugcaauuagcaauau

SEQ ID NO: 321349 - RNA, 22 nt, Human
uaccuuuugcuuauuaugacac

SEQ ID NO: 321350 - RNA, 21 nt, Human
auacauucuauuaagcauuua

SEQ ID NO: 321351 - RNA, 22 nt, Human
ccugguggacagcagccagcag

SEQ ID NO: 321352 - RNA, 23 nt, Human
uccagcucccuucaauggcacug

SEQ ID NO: 321353 - RNA, 22 nt, Human
auuucuuccucugucaguaacu

SEQ ID NO: 321354 - RNA, 23 nt, Human
ucugucacuuucugcuguggagu

SEQ ID NO: 321355 - RNA, 22 nt, Human
gcugccucugcgacucugggcg

SEQ ID NO: 321356 - RNA, 22 nt, Human
cagcuccugcagcuggcuccca

SEQ ID NO: 321357 - RNA, 22 nt, Human
ugaaggagcugauguaaggggu

SEQ ID NO: 321358 - RNA, 22 nt, Human
aagacagaccacgugacagggc

SEQ ID NO: 321359 - RNA, 22 nt, Human
uugaagcauuguggcuuguauu

SEQ ID NO: 321360 - RNA, 22 nt, Human
caggggcuguggcacauggugu

SEQ ID NO: 321361 - RNA, 22 nt, Human
ggccugcacagagguggcucua

SEQ ID NO: 321362 - RNA, 22 nt, Human
gcuugaaaauucauagguauuu

SEQ ID NO: 321363 - RNA, 22 nt, Human
ccaaaugcuccacugacuuugg

SEQ ID NO: 321364 - RNA, 22 nt, Human
cagggcagccaggccccguggg

SEQ ID NO: 321365 - RNA, 22 nt, Human
gcugggaagugcaagaucaagg

SEQ ID NO: 321366 - RNA, 22 nt, Human
cccucugaccuccugccacagu

SEQ ID NO: 321367 - RNA, 22 nt, Human
ucucucagaggaagaggcagug

SEQ ID NO: 321368 - RNA, 22 nt, Human
gcaggugggggucggugcaucu

SEQ ID NO: 321369 - RNA, 22 nt, Human
aacauucaaaacccaguucagu

SEQ ID NO: 321370 - RNA, 22 nt, Human
caggagcuacucagguuggguu

SEQ ID NO: 321371 - RNA, 22 nt, Human
ggaagggcaaaagagaugaacu

SEQ ID NO: 321372 - RNA, 22 nt, Human
acugcuuacccggccugacuuc

SEQ ID NO: 321373 - RNA, 18 nt, Human
ugggcugccuggccucug

SEQ ID NO: 321374 - RNA, 22 nt, Human
ccuggcagcagcacaugccuuc

SEQ ID NO: 321375 - RNA, 22 nt, Human
cagucuuuguucccauuacuga

SEQ ID NO: 321376 - RNA, 22 nt, Human
ucagaagcugguguccuuugaa

SEQ ID NO: 321377 - RNA, 17 nt, Human
aaugaaugaauucuuug

SEQ ID NO: 321378 - RNA, 22 nt, Human
ugucaugggcauuuauugaggg

SEQ ID NO: 321379 - RNA, 22 nt, Human
gcaguggcuaagcucgcaugca

SEQ ID NO: 321380 - RNA, 22 nt, Human
cuuguccccagcagguugguuu

SEQ ID NO: 321381 - RNA, 22 nt, Human
uggcugggugcuauccaguacu

SEQ ID NO: 321382 - RNA, 22 nt, Human
acaggugguaaaauggacuguc

SEQ ID NO: 321383 - RNA, 22 nt, Human
aggccugaaggaagaugagcug

SEQ ID NO: 321384 - RNA, 22 nt, Human
ucuguucagaauuguaacacuc

SEQ ID NO: 321385 - RNA, 22 nt, Human
gaaggaagugcucauacuaguu

SEQ ID NO: 321386 - RNA, 22 nt, Human
uuuuccucugcagagcaguuag

SEQ ID NO: 321387 - RNA, 22 nt, Human
agcuuuauuugucauucacggc

SEQ ID NO: 321388 - RNA, 22 nt, Human
uucauggaucaugccuuuugug

SEQ ID NO: 321389 - RNA, 22 nt, Human
ugcugucuuccaggauggugaa

SEQ ID NO: 321390 - RNA, 22 nt, Human
uaggacaugcuacauaaauagg

SEQ ID NO: 321391 - RNA, 22 nt, Human
ccucugugucagggaagagacu

SEQ ID NO: 321392 - RNA, 22 nt, Human
uccuggagaauccugccaccug

SEQ ID NO: 321393 - RNA, 22 nt, Human
uauugaaauucuucauguccuc

SEQ ID NO: 321394 - RNA, 18 nt, Human
gcugccugcauuccucac

SEQ ID NO: 321395 - RNA, 22 nt, Human
agaaaugcauuagcacauauag

SEQ ID NO: 321396 - RNA, 22 nt, Human
cuggagccuucaccaggggaaa

SEQ ID NO: 321397 - RNA, 19 nt, Human
cugugcaggccgggcugag

SEQ ID NO: 321398 - RNA, 22 nt, Human
ugucuucaguaaaauacacuau

SEQ ID NO: 321399 - RNA, 22 nt, Human
ggcaguggguggaucucaggga

SEQ ID NO: 321400 - RNA, 22 nt, Human
uuuuugaaggcugaugugauua

SEQ ID NO: 321401 - RNA, 22 nt, Human
ucagccugcuccaagugcugcc

SEQ ID NO: 321402 - RNA, 22 nt, Human
caguguccucagccagcagcua

SEQ ID NO: 321403 - RNA, 22 nt, Human
cauacuuugggauaagagugga

SEQ ID NO: 321404 - RNA, 22 nt, Human
guuuuauaauugcuucauaaga

SEQ ID NO: 321405 - RNA, 22 nt, Human
gauacaaauucaugucugaauu

SEQ ID NO: 321406 - RNA, 22 nt, Human
aaauguguauaugaaacaugau

SEQ ID NO: 321407 - RNA, 19 nt, Human
cgcaggagccgaggugacc

SEQ ID NO: 321408 - RNA, 22 nt, Human
uuaaacagacaguaaaugaaac

SEQ ID NO: 321409 - RNA, 22 nt, Human
agugcauuauauguuucaaugg

SEQ ID NO: 321410 - RNA, 22 nt, Human
augggcuguccuaguccagccc

SEQ ID NO: 321411 - RNA, 22 nt, Human
caaucccaucaccaucugcucu

SEQ ID NO: 321412 - RNA, 22 nt, Human
cagaguggcacucugcuggaug

SEQ ID NO: 321413 - RNA, 22 nt, Human
agcugccacugagggugcacag

SEQ ID NO: 321414 - RNA, 22 nt, Human
gccagacacuccccugggcagg

SEQ ID NO: 321415 - RNA, 18 nt, Human
uguacaguuaugagcauu

SEQ ID NO: 321416 - RNA, 22 nt, Human
agagcugggacuuggacucaau

SEQ ID NO: 321417 - RNA, 22 nt, Human
agagauggccuuaggugggaau

SEQ ID NO: 321418 - RNA, 22 nt, Human
uuugaaaggaauuaggaugaca

SEQ ID NO: 321419 - RNA, 22 nt, Human
cacugggcaauucugagccuaa

SEQ ID NO: 321420 - RNA, 22 nt, Human
gcacagaacagagaaauagcca

SEQ ID NO: 321421 - RNA, 22 nt, Human
agccagccaguucacuaggaaa

SEQ ID NO: 321422 - RNA, 22 nt, Human
cagggccauaucuugugcacca

SEQ ID NO: 321423 - RNA, 22 nt, Human
gacauucacagguaaacauucc

SEQ ID NO: 321424 - RNA, 22 nt, Human
agaggccuaauugcuacccuuu

SEQ ID NO: 321425 - RNA, 22 nt, Human
ggcugggcaggucugcacaggg

SEQ ID NO: 321426 - RNA, 22 nt, Human
ggacuucuaagugccagacacu

SEQ ID NO: 321427 - RNA, 22 nt, Human
ggaaggaucuggcugaaaucca

SEQ ID NO: 321428 - RNA, 22 nt, Human
ucauuauccuaguaucuugaau

SEQ ID NO: 321429 - RNA, 22 nt, Human
uucuuucccuuccagcagcucc

SEQ ID NO: 321430 - RNA, 21 nt, Human
uggcucugagccucauggcug

SEQ ID NO: 321431 - RNA, 22 nt, Human
auggcaggcccagguguucauu

SEQ ID NO: 321432 - RNA, 22 nt, Human
ucucuacagacacuguugacuu

SEQ ID NO: 321433 - RNA, 22 nt, Human
aaggacuccaauucuuucaucu

SEQ ID NO: 321434 - RNA, 19 nt, Human
uggcaggcccaggauggac

SEQ ID NO: 321435 - RNA, 22 nt, Human
cccucugcugccuggcuggguc

SEQ ID NO: 321436 - RNA, 22 nt, Human
ugaauggucacugagcaucugu

SEQ ID NO: 321437 - RNA, 22 nt, Human
uacagcauguccuuagcaaggc

SEQ ID NO: 321438 - RNA, 22 nt, Human
auguucuuguucaaaugucagu

SEQ ID NO: 321439 - RNA, 22 nt, Human
gcugccagucuaaugggaaaca

SEQ ID NO: 321440 - RNA, 22 nt, Human
cacaggagcuguggggcagugu

SEQ ID NO: 321441 - RNA, 22 nt, Human
ucagaaagaacacaggcaguag

SEQ ID NO: 321442 - RNA, 22 nt, Human
acaguguucuugauauuacagu

SEQ ID NO: 321443 - RNA, 22 nt, Human
gcucugucuucagcacacagua

SEQ ID NO: 321444 - RNA, 22 nt, Human
ucaugcccagagcaguaaauua

SEQ ID NO: 321445 - RNA, 20 nt, Human
aggcugccaggucucacauc

SEQ ID NO: 321446 - RNA, 22 nt, Human
uccugguggugccggugcccgg

SEQ ID NO: 321447 - RNA, 22 nt, Human
ggccugagcucuggggaggcaa

SEQ ID NO: 321448 - RNA, 22 nt, Human
auauuucuugagcaccugguau

SEQ ID NO: 321449 - RNA, 22 nt, Human
agaagccaauucugugugaguc

SEQ ID NO: 321450 - RNA, 22 nt, Human
ugcuggcuguauaugugagagu

SEQ ID NO: 321451 - RNA, 22 nt, Human
agugcuuuagcauccaacuguc

SEQ ID NO: 321452 - RNA, 22 nt, Human
auggaguucuuuaaauucacag

SEQ ID NO: 321453 - RNA, 22 nt, Human
uggcagcaguggagguagaaag

SEQ ID NO: 321454 - RNA, 22 nt, Human
gcacaugagcugcugggauggg

SEQ ID NO: 321455 - RNA, 21 nt, Human
agggaaagaaaaugagcuaau

SEQ ID NO: 321456 - RNA, 22 nt, Human
ccugcagguaaggcuaacugcc

SEQ ID NO: 321457 - RNA, 22 nt, Human
acagucuacuugagcuuguaua

SEQ ID NO: 321458 - RNA, 19 nt, Human
uuucaauggcuuagagaaa

SEQ ID NO: 321459 - RNA, 22 nt, Human
aaggcaguaaaaucuaccuugc

SEQ ID NO: 321460 - RNA, 22 nt, Human
auguaucagauaaagcaugugg

SEQ ID NO: 321461 - RNA, 22 nt, Human
cacugagcugauagaauuccag

SEQ ID NO: 321462 - RNA, 22 nt, Human
gggagacaaggagaaccaaaga

SEQ ID NO: 321463 - RNA, 22 nt, Human
aaggcacugaacuuaaauucug

SEQ ID NO: 321464 - RNA, 22 nt, Human
gcuucuggaggagcugggcuga

SEQ ID NO: 321465 - RNA, 22 nt, Human
cucacaggcaucucaucaggcu

SEQ ID NO: 321466 - RNA, 17 nt, Human
aaucuguuuacagucag

SEQ ID NO: 321467 - RNA, 22 nt, Human
ugugcuucagguugucgccacg

SEQ ID NO: 321468 - RNA, 22 nt, Human
aacaaaugauaccaguucucaa

SEQ ID NO: 321469 - RNA, 22 nt, Human
ggucccagguugacagggagac

SEQ ID NO: 321470 - RNA, 22 nt, Human
cugaggcucccucgggucugcu

SEQ ID NO: 321471 - RNA, 22 nt, Human
gaugaaaugcugagccugaguu

SEQ ID NO: 321472 - RNA, 21 nt, Human
cugccuugaaugguacuggga

SEQ ID NO: 321473 - RNA, 22 nt, Human
aucuggcucucucauuuacaaa

SEQ ID NO: 321474 - RNA, 22 nt, Human
uccauuuucaucucauguauaa

SEQ ID NO: 321475 - RNA, 22 nt, Human
cagcaugcaaguccagaugugg

SEQ ID NO: 321476 - RNA, 22 nt, Human
uggaagggggaagacagcucug

SEQ ID NO: 321477 - RNA, 22 nt, Human
ccauggccgccgcugcucagga

SEQ ID NO: 321478 - RNA, 22 nt, Human
cuccuggacauggagcggagga

SEQ ID NO: 321479 - RNA, 22 nt, Human
uggcucagugacauuccuccca

SEQ ID NO: 321480 - RNA, 22 nt, Human
gcuucucuggccugcagggcau

SEQ ID NO: 321481 - RNA, 22 nt, Human
aagauuucugcuccugagagaa

SEQ ID NO: 321482 - RNA, 22 nt, Human
gagguagcaugcuggaagggac

SEQ ID NO: 321483 - RNA, 22 nt, Human
gcacagaagagcuuuggaauga

SEQ ID NO: 321484 - RNA, 22 nt, Human
gguggagcuggaccaggagagg

SEQ ID NO: 321485 - RNA, 22 nt, Human
ucccagagguugagucacuuau

SEQ ID NO: 321486 - RNA, 22 nt, Human
uguuaaauguuccuuuacugga

SEQ ID NO: 321487 - RNA, 22 nt, Human
uuuucacacaaggugauaaguu

SEQ ID NO: 321488 - RNA, 22 nt, Human
caggaaugacugcagauggggc

SEQ ID NO: 321489 - RNA, 22 nt, Human
uuaauuuauguccaaaccagau

SEQ ID NO: 321490 - RNA, 22 nt, Human
aaaggugacugcagcagcuauu

SEQ ID NO: 321491 - RNA, 21 nt, Human
gauaaaaugggccuugguccu

SEQ ID NO: 321492 - RNA, 22 nt, Human
agucuugcucuugcaucugcuu

SEQ ID NO: 321493 - RNA, 22 nt, Human
accaccccaaaugaaccucugu

SEQ ID NO: 321494 - RNA, 19 nt, Human
ucucaauguucagaaagcu

SEQ ID NO: 321495 - RNA, 22 nt, Human
cagggcagagggaaacuccuuu

SEQ ID NO: 321496 - RNA, 22 nt, Human
uggaagcagugauucuugucug

SEQ ID NO: 321497 - RNA, 22 nt, Human
cagcugagaccagaaugcaggu

SEQ ID NO: 321498 - RNA, 22 nt, Human
ccaggccagcaggcacaccugc

SEQ ID NO: 321499 - RNA, 22 nt, Human
gcaggagcagucaggggcagcu

SEQ ID NO: 321500 - RNA, 22 nt, Human
auuugcagagcucugaauuuug

SEQ ID NO: 321501 - RNA, 22 nt, Human
ucacugcaaucucugccuucca

SEQ ID NO: 321502 - RNA, 20 nt, Human
guugaaaguaauaugaugcu

SEQ ID NO: 321503 - RNA, 20 nt, Human
accaauguuagcuuaguacu

SEQ ID NO: 321504 - RNA, 19 nt, Human
aggcagcacccaguccuug

SEQ ID NO: 321505 - RNA, 22 nt, Human
aguaaaaauugaggugcaaaau

SEQ ID NO: 321506 - RNA, 21 nt, Human
augacagaugcugcagaucgu

SEQ ID NO: 321507 - RNA, 22 nt, Human
aagagcuggagcugcuacagga

SEQ ID NO: 321508 - RNA, 22 nt, Human
gggucuggacggcugcaggaag

SEQ ID NO: 321509 - RNA, 21 nt, Human
uggcagaguugaguaguuaug

SEQ ID NO: 321510 - RNA, 22 nt, Human
gaccugccugagcugccucugc

SEQ ID NO: 321511 - RNA, 22 nt, Human
ugggcucuccuggaggacaaca

SEQ ID NO: 321512 - RNA, 22 nt, Human
gggcagcugcagggauggugac

SEQ ID NO: 321513 - RNA, 22 nt, Human
cugacucuccucaagcauaaau

SEQ ID NO: 321514 - RNA, 22 nt, Human
cagcccugcuuccccgcuaguu

SEQ ID NO: 321515 - RNA, 22 nt, Human
cucccagggccaucgagucacu

SEQ ID NO: 321516 - RNA, 22 nt, Human
guccucuggccuuucccaggac

SEQ ID NO: 321517 - RNA, 22 nt, Human
accugccuauggagccacaugg

SEQ ID NO: 321518 - RNA, 22 nt, Human
cagcagcaaaucuagaagagga

SEQ ID NO: 321519 - RNA, 22 nt, Human
agacaaauggaguaugagcaac

SEQ ID NO: 321520 - RNA, 22 nt, Human
aaauugcucuuuaaaaguacug

SEQ ID NO: 321521 - RNA, 22 nt, Human
uccugcugagcgucugucauuu

SEQ ID NO: 321522 - RNA, 17 nt, Human
ccucagcuucuuuccuc

SEQ ID NO: 321523 - RNA, 22 nt, Human
ucagggcauccauugccuguug

SEQ ID NO: 321524 - RNA, 22 nt, Human
cggcuggguucggcugcaggcc

SEQ ID NO: 321525 - RNA, 19 nt, Human
agguggucuaggcuggaga

SEQ ID NO: 321526 - RNA, 22 nt, Human
gcagcuggagcaucuucucauc

SEQ ID NO: 321527 - RNA, 22 nt, Human
aagauucagccaaauuguucau

SEQ ID NO: 321528 - RNA, 22 nt, Human
gagcuggcaggaggcuccccga

SEQ ID NO: 321529 - RNA, 22 nt, Human
ccaaggagcaaguuuacaccug

SEQ ID NO: 321530 - RNA, 20 nt, Human
agacaaaaugacuucaugca

SEQ ID NO: 321531 - RNA, 22 nt, Human
auugacaagcaguaugucuuag

SEQ ID NO: 321532 - RNA, 22 nt, Human
auuuccaggagaaaggauuuua

SEQ ID NO: 321533 - RNA, 22 nt, Human
cagcccuggccucuucgcuuuc

SEQ ID NO: 321534 - RNA, 22 nt, Human
cuggaguuagaguagacacuga

SEQ ID NO: 321535 - RNA, 22 nt, Human
ccuggaggagcgcugaccagcu

SEQ ID NO: 321536 - RNA, 22 nt, Human
ucaaagucuaucuguaauuacu

SEQ ID NO: 321537 - RNA, 22 nt, Human
ccuccagcgcgauccacuccgg

SEQ ID NO: 321538 - RNA, 22 nt, Human
uuuuagauaguuuaacugcacu

SEQ ID NO: 321539 - RNA, 22 nt, Human
cucuucuuggcccccaugaggg

SEQ ID NO: 321540 - RNA, 22 nt, Human
caguuucugggcguucacaggu

SEQ ID NO: 321541 - RNA, 22 nt, Human
cuccucacacccacugcaacca

SEQ ID NO: 321542 - RNA, 22 nt, Human
uuugugaaaugaagucacaacu

SEQ ID NO: 321543 - RNA, 22 nt, Human
aucugucagccugggauuaggg

SEQ ID NO: 321544 - RNA, 22 nt, Human
uccuggaggcaaaugaagacuc

SEQ ID NO: 321545 - RNA, 22 nt, Human
uuuuuauaacucuuuugugaca

SEQ ID NO: 321546 - RNA, 22 nt, Human
ugccuugguucucuacuuggag

SEQ ID NO: 321547 - RNA, 22 nt, Human
auuguguaauuuucagcucaua

SEQ ID NO: 321548 - RNA, 21 nt, Human
agagagaaggccauauggucc

SEQ ID NO: 321549 - RNA, 22 nt, Human
aaagacugguguguuacauaua

SEQ ID NO: 321550 - RNA, 22 nt, Human
ugccagcacuucuggcugucug

SEQ ID NO: 321551 - RNA, 22 nt, Human
cuggcagucugccucuucacug

SEQ ID NO: 321552 - RNA, 22 nt, Human
agcuguguggugucugacagcu

SEQ ID NO: 321553 - RNA, 22 nt, Human
acagagauguggaugagggauu

SEQ ID NO: 321554 - RNA, 22 nt, Human
ucucagggcgcagugaggcagu

SEQ ID NO: 321555 - RNA, 22 nt, Human
ucaguguugaauuuuuugcaaa

SEQ ID NO: 321556 - RNA, 22 nt, Human
ugcuggcuacugauggcaggcc

SEQ ID NO: 321557 - RNA, 22 nt, Human
auaguaacuggcauguuuauga

SEQ ID NO: 321558 - RNA, 22 nt, Human
uauaaaugccaggacuuuagau

SEQ ID NO: 321559 - RNA, 20 nt, Human
uuugucuguuaaguguuucu

SEQ ID NO: 321560 - RNA, 21 nt, Human
auucugucaucccagcuacuu

SEQ ID NO: 321561 - RNA, 22 nt, Human
acacaggaagucagcacugaug

SEQ ID NO: 321562 - RNA, 22 nt, Human
aaaucaguuagugguaggauug

SEQ ID NO: 321563 - RNA, 22 nt, Human
gugccugggguugagcuaugaa

SEQ ID NO: 321564 - RNA, 22 nt, Human
aggacuucuccgauaagucaga

SEQ ID NO: 321565 - RNA, 22 nt, Human
gcugggagcaaagccaugcaua

SEQ ID NO: 321566 - RNA, 22 nt, Human
augagcuguaagguggcuuccu

SEQ ID NO: 321567 - RNA, 23 nt, Human
ucagagaaguuguaggcugggga

SEQ ID NO: 321568 - RNA, 22 nt, Human
guaaaguucuauuugaauuuag

SEQ ID NO: 321569 - RNA, 22 nt, Human
acacacagguaaaggagccugg

SEQ ID NO: 321570 - RNA, 22 nt, Human
uucugucagcugcuuugucuca

SEQ ID NO: 321571 - RNA, 22 nt, Human
cugccuuccaaccccagacucc

SEQ ID NO: 321572 - RNA, 22 nt, Human
ucccagagucagagguggggcc

SEQ ID NO: 321573 - RNA, 22 nt, Human
auguagaagcugacagugcugu

SEQ ID NO: 321574 - RNA, 22 nt, Human
ucuggcuccacucugugcaugc

SEQ ID NO: 321575 - RNA, 22 nt, Human
gggcucuggauggagccugcag

SEQ ID NO: 321576 - RNA, 22 nt, Human
uaacagaaaggcucaggugcuc

SEQ ID NO: 321577 - RNA, 22 nt, Human
auuacucugucugccucugacc

SEQ ID NO: 321578 - RNA, 22 nt, Human
uuacuuuggguccugcuuauaa

SEQ ID NO: 321579 - RNA, 22 nt, Human
gaaauacaaagccagccauuuu

SEQ ID NO: 321580 - RNA, 22 nt, Human
acagaauacuacagacugguua

SEQ ID NO: 321581 - RNA, 22 nt, Human
acaguggagaaggcaugaggcu

SEQ ID NO: 321582 - RNA, 22 nt, Human
ugcagggcacacgcacgggugu

SEQ ID NO: 321583 - RNA, 22 nt, Human
gcaguguugagccagcuggggg

SEQ ID NO: 321584 - RNA, 22 nt, Human
uaugcuuucauucauaugugag

SEQ ID NO: 321585 - RNA, 22 nt, Human
ccacagaaaguugucuagagua

SEQ ID NO: 321586 - RNA, 18 nt, Human
gagaggcccggcugugcc

SEQ ID NO: 321587 - RNA, 22 nt, Human
ugccuguccugaggaugagggu

SEQ ID NO: 321588 - RNA, 22 nt, Human
ugguaaaguguacugaauauga

SEQ ID NO: 321589 - RNA, 22 nt, Human
auguaucaugcaggguccauga

SEQ ID NO: 321590 - RNA, 22 nt, Human
gggcagcagagcccugccgagu

SEQ ID NO: 321591 - RNA, 22 nt, Human
cagugcagccaaggacaggcac

SEQ ID NO: 321592 - RNA, 22 nt, Human
gcuucauuacugacagucugug

SEQ ID NO: 321593 - RNA, 22 nt, Human
cccaggucugugccagcucuga

SEQ ID NO: 321594 - RNA, 18 nt, Human
aggcccuggccucgaaca

SEQ ID NO: 321595 - RNA, 22 nt, Human
gcaguguuucccagagauggaa

SEQ ID NO: 321596 - RNA, 22 nt, Human
cuggcuucugggccagggcaga

SEQ ID NO: 321597 - RNA, 22 nt, Human
ggucagguuuuuaggagugacc

SEQ ID NO: 321598 - RNA, 22 nt, Human
ucaguuuugauuccugguucuc

SEQ ID NO: 321599 - RNA, 22 nt, Human
ucagagcuaaggggagagcaaa

SEQ ID NO: 321600 - RNA, 17 nt, Human
gucauucucagaaaaug

SEQ ID NO: 321601 - RNA, 22 nt, Human
ccugucugcggaggaguggaag

SEQ ID NO: 321602 - RNA, 22 nt, Human
cagagcaggcccacugcccucc

SEQ ID NO: 321603 - RNA, 22 nt, Human
ggcugcugaguuggccaggaga

SEQ ID NO: 321604 - RNA, 22 nt, Human
gccuggagaaaggaagguggga

SEQ ID NO: 321605 - RNA, 22 nt, Human
gucuggggaagucagggcauca

SEQ ID NO: 321606 - RNA, 22 nt, Human
uccagggaucuuuagagucuuu

SEQ ID NO: 321607 - RNA, 22 nt, Human
ugcagugccucggcagugcagc

SEQ ID NO: 321608 - RNA, 22 nt, Human
aagcugccaccagcccagggca

SEQ ID NO: 321609 - RNA, 22 nt, Human
ucuucauauauaaaguggaaua

SEQ ID NO: 321610 - RNA, 22 nt, Human
uagcagcucugauucugggccc

SEQ ID NO: 321611 - RNA, 22 nt, Human
aagggcaggcacccacccucac

SEQ ID NO: 321612 - RNA, 22 nt, Human
acuccuggguugcaguccucaa

SEQ ID NO: 321613 - RNA, 22 nt, Human
cagggcugugcccaucuucccc

SEQ ID NO: 321614 - RNA, 22 nt, Human
ccaccccaaaugaagaccucuc

SEQ ID NO: 321615 - RNA, 22 nt, Human
gcaugcugcaccagagccucuc

SEQ ID NO: 321616 - RNA, 22 nt, Human
cauguacaguuuuucuguccug

SEQ ID NO: 321617 - RNA, 22 nt, Human
gagggucccgagcccugucaga

SEQ ID NO: 321618 - RNA, 22 nt, Human
ccugggucacucaggcaggcgg

SEQ ID NO: 321619 - RNA, 22 nt, Human
ugcauauuuguaugauguuuag

SEQ ID NO: 321620 - RNA, 22 nt, Human
aagggccauaacuugcaguguu

SEQ ID NO: 321621 - RNA, 22 nt, Human
aggcucugaucagguggcugug

SEQ ID NO: 321622 - RNA, 22 nt, Human
ccaggaugacccccacuuuccu

SEQ ID NO: 321623 - RNA, 22 nt, Human
aaggagcucccggcagaccagg

SEQ ID NO: 321624 - RNA, 21 nt, Human
ucccagagugcuugggacugc

SEQ ID NO: 321625 - RNA, 22 nt, Human
uguauuuucugaagauaaucaa

SEQ ID NO: 321626 - RNA, 22 nt, Human
auaauucagguuuucuggcaca

SEQ ID NO: 321627 - RNA, 22 nt, Human
accuuaaaacugacacauggag

SEQ ID NO: 321628 - RNA, 22 nt, Human
cacagcugucagcugaccuagg

SEQ ID NO: 321629 - RNA, 21 nt, Human
aggucccagguuugggcagca

SEQ ID NO: 321630 - RNA, 22 nt, Human
ugucuuuucuacuguaagcaua

SEQ ID NO: 321631 - RNA, 22 nt, Human
ccaguccucagauggucugugc

SEQ ID NO: 321632 - RNA, 21 nt, Human
ccuucuccacagggucuccgg

SEQ ID NO: 321633 - RNA, 22 nt, Human
agugcuuugguauagaacuauu

SEQ ID NO: 321634 - RNA, 22 nt, Human
uguggccuccccacuucugggg

SEQ ID NO: 321635 - RNA, 22 nt, Human
agggccagggaagcuguauuuu

SEQ ID NO: 321636 - RNA, 22 nt, Human
aucuucucaagcagcauccugu

SEQ ID NO: 321637 - RNA, 22 nt, Human
ugcacacaaaugugaacgugcc

SEQ ID NO: 321638 - RNA, 22 nt, Human
cuggagaggcugggaacagguu

SEQ ID NO: 321639 - RNA, 22 nt, Human
ggcugcugguggaaugguaggc

SEQ ID NO: 321640 - RNA, 22 nt, Human
cagguggcaugacugccuacaa

SEQ ID NO: 321641 - RNA, 22 nt, Human
augucuuucgcaucaguagcua

SEQ ID NO: 321642 - RNA, 18 nt, Human
acagaaauagcugugccu

SEQ ID NO: 321643 - RNA, 22 nt, Human
cagagccaacgccaccugccca

SEQ ID NO: 321644 - RNA, 22 nt, Human
cugcagaggucuugcugauggu

SEQ ID NO: 321645 - RNA, 22 nt, Human
aaugaacaucaaaugccuacca

SEQ ID NO: 321646 - RNA, 22 nt, Human
gccuuggcugaugugcgaauga

SEQ ID NO: 321647 - RNA, 22 nt, Human
gcauucaucuuccuccaugcag

SEQ ID NO: 321648 - RNA, 22 nt, Human
uggcugucagcugccuggugcg

SEQ ID NO: 321649 - RNA, 22 nt, Human
uuaagaaugugccuuuugguug

SEQ ID NO: 321650 - RNA, 22 nt, Human
gaggccacgguuuuccuugggg

SEQ ID NO: 321651 - RNA, 22 nt, Human
cagcccuuuccuucucagcuuu

SEQ ID NO: 321652 - RNA, 22 nt, Human
ugcaaucucggcacuuugggag

SEQ ID NO: 321653 - RNA, 22 nt, Human
aucugucaagauagacucugca

SEQ ID NO: 321654 - RNA, 22 nt, Human
guacauuuuacuuuguuugaau

SEQ ID NO: 321655 - RNA, 22 nt, Human
ccucaggggcuuuucguuguug

SEQ ID NO: 321656 - RNA, 21 nt, Human
acucaggagacuaacuauguc

SEQ ID NO: 321657 - RNA, 22 nt, Human
ugucccagacauaaguggacau

SEQ ID NO: 321658 - RNA, 22 nt, Human
ugguccugccccgugcacagag

SEQ ID NO: 321659 - RNA, 22 nt, Human
cuggcaggagcauucacagagg

SEQ ID NO: 321660 - RNA, 22 nt, Human
gagaaguuucugguuugcauag

SEQ ID NO: 321661 - RNA, 22 nt, Human
ccaggcagccaagugugugugu

SEQ ID NO: 321662 - RNA, 22 nt, Human
ggcugggccagggccuguggac

SEQ ID NO: 321663 - RNA, 23 nt, Human
ugcugggcagagcuggugcugag

SEQ ID NO: 321664 - RNA, 22 nt, Human
acuugcauuauauuuaucacaa

SEQ ID NO: 321665 - RNA, 22 nt, Human
gcaagcugaugugauagugaaa

SEQ ID NO: 321666 - RNA, 22 nt, Human
aggccugagguuccugugcuca

SEQ ID NO: 321667 - RNA, 22 nt, Human
uagagcugauaaugaggccaag

SEQ ID NO: 321668 - RNA, 22 nt, Human
aggccuccuggcuccaggccuu

SEQ ID NO: 321669 - RNA, 22 nt, Human
gcugucacaaauauuucucagc

SEQ ID NO: 321670 - RNA, 22 nt, Human
uuguaacaaucugucauaaaug

SEQ ID NO: 321671 - RNA, 22 nt, Human
uucuccuugaaaagcugcaucu

SEQ ID NO: 321672 - RNA, 19 nt, Human
caaggccaccauuucuccg

SEQ ID NO: 321673 - RNA, 22 nt, Human
ugcaccccauuuuacauuuaca

SEQ ID NO: 321674 - RNA, 21 nt, Human
aagcuucccugcucuccaggg

SEQ ID NO: 321675 - RNA, 22 nt, Human
agagcagauggagcuggaagag

SEQ ID NO: 321676 - RNA, 22 nt, Human
aucaauucuuaggaaaauagcu

SEQ ID NO: 321677 - RNA, 22 nt, Human
uuucauggcuaggacuagagug

SEQ ID NO: 321678 - RNA, 22 nt, Human
uggcuuccuggacagaugcggu

SEQ ID NO: 321679 - RNA, 22 nt, Human
cccucccagaugggcuugaggu

SEQ ID NO: 321680 - RNA, 22 nt, Human
uagagcuagcuucaaaaugcga

SEQ ID NO: 321681 - RNA, 22 nt, Human
cccacaggcuagggguagggca

SEQ ID NO: 321682 - RNA, 22 nt, Human
ucuguucauacagaguauagua

SEQ ID NO: 321683 - RNA, 22 nt, Human
aucacauugccagugauuaccc

SEQ ID NO: 321684 - RNA, 22 nt, Human
ggcccacuugaaauggagcuca

SEQ ID NO: 321685 - RNA, 22 nt, Human
caggcugggcagccuccccggc

SEQ ID NO: 321686 - RNA, 20 nt, Human
agguauaagaaaugugauuu

SEQ ID NO: 321687 - RNA, 22 nt, Human
uuucauuacguguuugacuugu

SEQ ID NO: 321688 - RNA, 22 nt, Human
uuucagaaaacuuaucaucagu

SEQ ID NO: 321689 - RNA, 22 nt, Human
ccucugaguccucccugguugc

SEQ ID NO: 321690 - RNA, 22 nt, Human
agugcacagcgugauguauugg

SEQ ID NO: 321691 - RNA, 22 nt, Human
auccaugauuaguaggauaaag

SEQ ID NO: 321692 - RNA, 22 nt, Human
aggucauuccagccauuccccu

SEQ ID NO: 321693 - RNA, 22 nt, Human
cagugcaguugguggcaggggu

SEQ ID NO: 321694 - RNA, 22 nt, Human
aagacugucuuuucugagugac

SEQ ID NO: 321695 - RNA, 22 nt, Human
ggcuucagugagcugagcucac

SEQ ID NO: 321696 - RNA, 22 nt, Human
aggcaagggggcgccaccuucc

SEQ ID NO: 321697 - RNA, 22 nt, Human
acauuucuuucuauucaguagc

SEQ ID NO: 321698 - RNA, 22 nt, Human
gccagagccacuuuugggugau

SEQ ID NO: 321699 - RNA, 22 nt, Human
uauuaaauuauggauuuaggag

SEQ ID NO: 321700 - RNA, 22 nt, Human
ugggcugcacccucagccucug

SEQ ID NO: 321701 - RNA, 22 nt, Human
caggccacaaguuggguucaag

SEQ ID NO: 321702 - RNA, 23 nt, Human
cagcugaagcagccugggcugga

SEQ ID NO: 321703 - RNA, 22 nt, Human
aguuuuauuccaaugugcagca

SEQ ID NO: 321704 - RNA, 22 nt, Human
gugcaggggaucagguugcagc

SEQ ID NO: 321705 - RNA, 22 nt, Human
gagggcugccacguugggcgag

SEQ ID NO: 321706 - RNA, 18 nt, Human
gcccugguggagcuggug

SEQ ID NO: 321707 - RNA, 22 nt, Human
ucuggagccacaaaccucagcu

SEQ ID NO: 321708 - RNA, 22 nt, Human
acuuccugcaaucguccacucc

SEQ ID NO: 321709 - RNA, 22 nt, Human
ucagugugaggucuuccacccg

SEQ ID NO: 321710 - RNA, 22 nt, Human
ucugcaggaggcuggcugcagg

SEQ ID NO: 321711 - RNA, 22 nt, Human
agcagcaggagccgugggguga

SEQ ID NO: 321712 - RNA, 22 nt, Human
gcuggggcugggcugaggaaga

SEQ ID NO: 321713 - RNA, 22 nt, Human
aaaaguuuaagacucauucuag

SEQ ID NO: 321714 - RNA, 22 nt, Human
agcaccugcuuaaugugcagug

SEQ ID NO: 321715 - RNA, 22 nt, Human
agcauggggcaaugcaugugcu

SEQ ID NO: 321716 - RNA, 22 nt, Human
gagcagcuguccccaaagcuuc

SEQ ID NO: 321717 - RNA, 22 nt, Human
uguaggaauguuuuuaaguugg

SEQ ID NO: 321718 - RNA, 22 nt, Human
uuaugcuaaaugaaucaaguca

SEQ ID NO: 321719 - RNA, 22 nt, Human
ggagcuguucaggacugcuuca

SEQ ID NO: 321720 - RNA, 23 nt, Human
cugucuccugggcuagguggaau

SEQ ID NO: 321721 - RNA, 22 nt, Human
cuggccagcauuuuugcuuuag

SEQ ID NO: 321722 - RNA, 22 nt, Human
uugcuguguaacuccuggccug

SEQ ID NO: 321723 - RNA, 22 nt, Human
caggggcuguuugccucaggcc

SEQ ID NO: 321724 - RNA, 22 nt, Human
cccugugggguccgccuguccg

SEQ ID NO: 321725 - RNA, 22 nt, Human
ggacacagcugcagccacaccc

SEQ ID NO: 321726 - RNA, 22 nt, Human
uuccaguuaaggaagcuauucu

SEQ ID NO: 321727 - RNA, 22 nt, Human
gccugccuuuguaugacccuga

SEQ ID NO: 321728 - RNA, 22 nt, Human
gagguauguaugcuacauucuu

SEQ ID NO: 321729 - RNA, 22 nt, Human
aggggcugcuggguccgccccu

SEQ ID NO: 321730 - RNA, 22 nt, Human
uaacagaaauaguaggugaggg

SEQ ID NO: 321731 - RNA, 22 nt, Human
acugugugggccgcucacuggg

SEQ ID NO: 321732 - RNA, 22 nt, Human
cacacaggaugaagcagcagaa

SEQ ID NO: 321733 - RNA, 19 nt, Human
ucuggcuccugccaggcug

SEQ ID NO: 321734 - RNA, 22 nt, Human
aggguccugggugcaguugcuu

SEQ ID NO: 321735 - RNA, 22 nt, Human
ucauggauggccgggaggugau

SEQ ID NO: 321736 - RNA, 22 nt, Human
ucuguucauuugccucggcucu

SEQ ID NO: 321737 - RNA, 22 nt, Human
auugcaccuuggguuuugaaag

SEQ ID NO: 321738 - RNA, 22 nt, Human
acauuucuuagccuaguuccag

SEQ ID NO: 321739 - RNA, 18 nt, Human
caggucagccuggccuca

SEQ ID NO: 321740 - RNA, 22 nt, Human
gccuggagugguccugcugccc

SEQ ID NO: 321741 - RNA, 22 nt, Human
caggaaagaaaugagaacacca

SEQ ID NO: 321742 - RNA, 22 nt, Human
aaggcuaugaucuuuuucauga

SEQ ID NO: 321743 - RNA, 22 nt, Human
uguuccauaaguggugcuuugu

SEQ ID NO: 321744 - RNA, 22 nt, Human
ugagguguguccccagggaggu

SEQ ID NO: 321745 - RNA, 22 nt, Human
cugcugccggcgagccucccuu

SEQ ID NO: 321746 - RNA, 22 nt, Human
uggcagagucucuccuuuccag

SEQ ID NO: 321747 - RNA, 22 nt, Human
ggacaggguaaguacuagugug

SEQ ID NO: 321748 - RNA, 19 nt, Human
ccauggcaaugaucugaug

SEQ ID NO: 321749 - RNA, 22 nt, Human
ccuggcucuucagagguuccua

SEQ ID NO: 321750 - RNA, 22 nt, Human
uauuaucauugguaauaugguc

SEQ ID NO: 321751 - RNA, 22 nt, Human
uucaggaucaaguugccaguag

SEQ ID NO: 321752 - RNA, 22 nt, Human
cagccucugagccuuggcagau

SEQ ID NO: 321753 - RNA, 19 nt, Human
aaacucugaaggccacugg

SEQ ID NO: 321754 - RNA, 22 nt, Human
cuggccugcugggugagguccu

SEQ ID NO: 321755 - RNA, 22 nt, Human
agauuucccacuccauguauug

SEQ ID NO: 321756 - RNA, 18 nt, Human
ccuggagcuccacagcaa

SEQ ID NO: 321757 - RNA, 22 nt, Human
uucccaguauuaccuucaggaa

SEQ ID NO: 321758 - RNA, 22 nt, Human
agaugugagaaucaagugacca

SEQ ID NO: 321759 - RNA, 22 nt, Human
cuggggcuucaaugcuucggug

SEQ ID NO: 321760 - RNA, 22 nt, Human
ugcaguggcgccaucucagcuc

SEQ ID NO: 321761 - RNA, 22 nt, Human
ucagagugugacuuggucauga

SEQ ID NO: 321762 - RNA, 22 nt, Human
cccucccaggaguggccagaga

SEQ ID NO: 321763 - RNA, 22 nt, Human
cagcaggcccagaguuucaugg

SEQ ID NO: 321764 - RNA, 22 nt, Human
gaaauaagaguccaugccaggu

SEQ ID NO: 321765 - RNA, 22 nt, Human
cagggagcucugggccggacuc

SEQ ID NO: 321766 - RNA, 22 nt, Human
agggcacagccuaaagccuaug

SEQ ID NO: 321767 - RNA, 22 nt, Human
ggggcugguggugguuucucca

SEQ ID NO: 321768 - RNA, 22 nt, Human
cucucuggaagggggagcugau

SEQ ID NO: 321769 - RNA, 22 nt, Human
ugaguuuuuucaacauaugaag

SEQ ID NO: 321770 - RNA, 22 nt, Human
aguaacuaugcuugagaaucag

SEQ ID NO: 321771 - RNA, 22 nt, Human
aagagcugauuaagucaugagg

SEQ ID NO: 321772 - RNA, 22 nt, Human
uaaauguguuagucaugguuuu

SEQ ID NO: 321773 - RNA, 22 nt, Human
cucuccagccacagaagcugcu

SEQ ID NO: 321774 - RNA, 22 nt, Human
ccugcagagccacgugccagcg

SEQ ID NO: 321775 - RNA, 22 nt, Human
cuguuuaucucuaaccuguuua

SEQ ID NO: 321776 - RNA, 22 nt, Human
ggcugcugguagggguaggaag

SEQ ID NO: 321777 - RNA, 22 nt, Human
agcuguccuggcucaggcugug

SEQ ID NO: 321778 - RNA, 22 nt, Human
cacucugcgcugggcgccagcg

SEQ ID NO: 321779 - RNA, 22 nt, Human
agaccacagucaggcuccuggu

SEQ ID NO: 321780 - RNA, 22 nt, Human
uuuuagauugggaaauguaaag

SEQ ID NO: 321781 - RNA, 22 nt, Human
ucugggguuuucacgcugucuc

SEQ ID NO: 321782 - RNA, 22 nt, Human
ugugaaaagggcuuuguacaaa

SEQ ID NO: 321783 - RNA, 22 nt, Human
aaaguuucaauagaggaagugg

SEQ ID NO: 321784 - RNA, 22 nt, Human
aaaggccauuacuugcuuuuag

SEQ ID NO: 321785 - RNA, 22 nt, Human
aaucaguuucuuggcaaguuua

SEQ ID NO: 321786 - RNA, 22 nt, Human
uggcuaggcuccaagagcugga

SEQ ID NO: 321787 - RNA, 22 nt, Human
aggcagcaugcucugcuucuac

SEQ ID NO: 321788 - RNA, 22 nt, Human
ugaaagguuauuuaggucugcu

SEQ ID NO: 321789 - RNA, 22 nt, Human
ucccuggagauaacuucuggga

SEQ ID NO: 321790 - RNA, 22 nt, Human
auuuugcuggucugaauuacuu

SEQ ID NO: 321791 - RNA, 22 nt, Human
cagcuguuacucugaguaaaug

SEQ ID NO: 321792 - RNA, 22 nt, Human
uaugugcaguuugcucuuaaca

SEQ ID NO: 321793 - RNA, 22 nt, Human
agagugggccucugagucccag

SEQ ID NO: 321794 - RNA, 22 nt, Human
gcaggcagucaucuuucauauu

SEQ ID NO: 321795 - RNA, 22 nt, Human
ucacuuuugaucccuaugcagu

SEQ ID NO: 321796 - RNA, 20 nt, Human
cugccaugauugauagagug

SEQ ID NO: 321797 - RNA, 22 nt, Human
guggauggacaugggcaagagg

SEQ ID NO: 321798 - RNA, 22 nt, Human
gccccagguugccugucccagg

SEQ ID NO: 321799 - RNA, 22 nt, Human
acuccugguuuguguccuggcu

SEQ ID NO: 321800 - RNA, 22 nt, Human
uaauuauucuagucacauagca

SEQ ID NO: 321801 - RNA, 22 nt, Human
uucuuguauguaugcaaaauca

SEQ ID NO: 321802 - RNA, 22 nt, Human
ccagggccucguguucugagug

SEQ ID NO: 321803 - RNA, 22 nt, Human
gagguuagaggucagugcaguc

SEQ ID NO: 321804 - RNA, 20 nt, Human
ccaggccugggccugcucua

SEQ ID NO: 321805 - RNA, 22 nt, Human
gauuauauaauggaagcucuug

SEQ ID NO: 321806 - RNA, 22 nt, Human
uaauuauaacaguuacaucuua

SEQ ID NO: 321807 - RNA, 22 nt, Human
ucucagagccuaacuaaccuaa

SEQ ID NO: 321808 - RNA, 22 nt, Human
ggagaagggacagacucagcuu

SEQ ID NO: 321809 - RNA, 22 nt, Human
cugcagccucaaccuccugagc

SEQ ID NO: 321810 - RNA, 22 nt, Human
cauuuacauuuaagguuaauau

SEQ ID NO: 321811 - RNA, 22 nt, Human
agccagcuggagaccacuguuu

SEQ ID NO: 321812 - RNA, 22 nt, Human
cugcugugugaccauggacagg

SEQ ID NO: 321813 - RNA, 20 nt, Human
uccagggcuagggagcucau

SEQ ID NO: 321814 - RNA, 22 nt, Human
ugccugucuuuccucccucgua

SEQ ID NO: 321815 - RNA, 22 nt, Human
ggaaaaggccacagggacacau

SEQ ID NO: 321816 - RNA, 22 nt, Human
agugaccaaucaugguuagauu

SEQ ID NO: 321817 - RNA, 22 nt, Human
aucacgucaugguuugaucugg

SEQ ID NO: 321818 - RNA, 21 nt, Human
agaggccuuacaggauagacc

SEQ ID NO: 321819 - RNA, 22 nt, Human
cucagugcagcuaggcaugaga

SEQ ID NO: 321820 - RNA, 22 nt, Human
aaauuauucucauguguuucuu

SEQ ID NO: 321821 - RNA, 21 nt, Human
ccucugcucgggcaugcguuu

SEQ ID NO: 321822 - RNA, 22 nt, Human
ggccucucauguccugggcuuc

SEQ ID NO: 321823 - RNA, 22 nt, Human
aacuagucagugauucucagaa

SEQ ID NO: 321824 - RNA, 18 nt, Human
uggcagagugucuguucu

SEQ ID NO: 321825 - RNA, 23 nt, Human
ucaguccuguaggggcuccaggu

SEQ ID NO: 321826 - RNA, 22 nt, Human
cugggcagcuaccaccacugcu

SEQ ID NO: 321827 - RNA, 22 nt, Human
ucugucccugagagcucaggag

SEQ ID NO: 321828 - RNA, 19 nt, Human
agucccaggcccgaaagag

SEQ ID NO: 321829 - RNA, 22 nt, Human
ggggacccucaggacugcgucu

SEQ ID NO: 321830 - RNA, 22 nt, Human
acaacauuauacauagaaagcu

SEQ ID NO: 321831 - RNA, 22 nt, Human
aucaggauuacacggggaugcu

SEQ ID NO: 321832 - RNA, 20 nt, Human
agaaauauugaguucagagg

SEQ ID NO: 321833 - RNA, 22 nt, Human
caugagaagguuuuggcauaua

SEQ ID NO: 321834 - RNA, 22 nt, Human
aagagcuggaugaagaaaucaa

SEQ ID NO: 321835 - RNA, 22 nt, Human
cagagagaggccacugcuauua

SEQ ID NO: 321836 - RNA, 23 nt, Human
ucagugauguugaaccuagcagu

SEQ ID NO: 321837 - RNA, 22 nt, Human
uggaugcuguaggacacgcucu

SEQ ID NO: 321838 - RNA, 22 nt, Human
ucuuagcauuucauaacaacug

SEQ ID NO: 321839 - RNA, 22 nt, Human
uuugacagcuuguuacaaaguu

SEQ ID NO: 321840 - RNA, 22 nt, Human
cagggccauuggcguggcuguc

SEQ ID NO: 321841 - RNA, 22 nt, Human
cuggcucuucagugcuugguuc

SEQ ID NO: 321842 - RNA, 22 nt, Human
gagauucuguagucaggcaucu

SEQ ID NO: 321843 - RNA, 22 nt, Human
cagccagcuggugcggcagagc

SEQ ID NO: 321844 - RNA, 20 nt, Human
augccucuaauuuugcaaac

SEQ ID NO: 321845 - RNA, 22 nt, Human
gagcuggcuccgccaugcugcu

SEQ ID NO: 321846 - RNA, 22 nt, Human
agccccuugcugcccucuagag

SEQ ID NO: 321847 - RNA, 22 nt, Human
aguauuuccuggcuuaucugcu

SEQ ID NO: 321848 - RNA, 22 nt, Human
gagggcagugaauuuugaagcu

SEQ ID NO: 321849 - RNA, 22 nt, Human
ugaagcaguucucagaaguggg

SEQ ID NO: 321850 - RNA, 22 nt, Human
aaauaguuacuucugcugucuu

SEQ ID NO: 321851 - RNA, 22 nt, Human
gcuaugcaggagccuaaugaca

SEQ ID NO: 321852 - RNA, 22 nt, Human
ugcagaagaaugagcuuggagu

SEQ ID NO: 321853 - RNA, 22 nt, Human
agccucucugaugugacagcua

SEQ ID NO: 321854 - RNA, 22 nt, Human
gggacuggaguagaggccggug

SEQ ID NO: 321855 - RNA, 22 nt, Human
acaauguguuuuuauacauuug

SEQ ID NO: 321856 - RNA, 22 nt, Human
acagggccucagccagggcaga

SEQ ID NO: 321857 - RNA, 22 nt, Human
cacaguggcagguguggguugu

SEQ ID NO: 321858 - RNA, 22 nt, Human
ccuuuccuuuuuagugugggag

SEQ ID NO: 321859 - RNA, 22 nt, Human
uuucaaagaccauuaacuauca

SEQ ID NO: 321860 - RNA, 22 nt, Human
gagagcuguaauagucaugucu

SEQ ID NO: 321861 - RNA, 18 nt, Human
ggcugccuguuccugaag

SEQ ID NO: 321862 - RNA, 22 nt, Human
gugugaaaaugugcacaauaug

SEQ ID NO: 321863 - RNA, 22 nt, Human
agccucugcuuaugcaaaggua

SEQ ID NO: 321864 - RNA, 22 nt, Human
aggggcuggaguucgagguuac

SEQ ID NO: 321865 - RNA, 22 nt, Human
ggcaaaaaguucccaucagugu

SEQ ID NO: 321866 - RNA, 22 nt, Human
uccuucagggcugaccacaggc

SEQ ID NO: 321867 - RNA, 22 nt, Human
gccaggcagcagcgaggauggu

SEQ ID NO: 321868 - RNA, 22 nt, Human
auaucaaacgaaguuauuuuaa

SEQ ID NO: 321869 - RNA, 22 nt, Human
ccaguguuccagagagcugaug

SEQ ID NO: 321870 - RNA, 22 nt, Human
aacaaaugaccugauuucuucc

SEQ ID NO: 321871 - RNA, 22 nt, Human
agauacauugaguuuccuccug

SEQ ID NO: 321872 - RNA, 22 nt, Human
cuuguacauagagaagaagccu

SEQ ID NO: 321873 - RNA, 22 nt, Human
cugccacuagcuuucacaucuu

SEQ ID NO: 321874 - RNA, 22 nt, Human
ugcugucugcaacaguacuaca

SEQ ID NO: 321875 - RNA, 22 nt, Human
ugagaugaauaacuccugcuaa

SEQ ID NO: 321876 - RNA, 22 nt, Human
ugcauuauacuuuuagaaauuu

SEQ ID NO: 321877 - RNA, 22 nt, Human
cuguauuuguccucuauuuauu

SEQ ID NO: 321878 - RNA, 22 nt, Human
gcaguggcuaggagucuggcgu

SEQ ID NO: 321879 - RNA, 22 nt, Human
cucaggaugaaagucaugguga

SEQ ID NO: 321880 - RNA, 22 nt, Human
uuuggaaaguugucacuuuaga

SEQ ID NO: 321881 - RNA, 18 nt, Human
gcugucugaggucugagg

SEQ ID NO: 321882 - RNA, 22 nt, Human
uuucauaauacuguacaugaaa

SEQ ID NO: 321883 - RNA, 22 nt, Human
aucuaggauuugaaugcacagu

SEQ ID NO: 321884 - RNA, 18 nt, Human
uucacaggaaaugucuuu

SEQ ID NO: 321885 - RNA, 22 nt, Human
uuuauuauagugguggggacug

SEQ ID NO: 321886 - RNA, 22 nt, Human
ccucagugaguguuuccuucuu

SEQ ID NO: 321887 - RNA, 22 nt, Human
uugcaucuagggcaacccagag

SEQ ID NO: 321888 - RNA, 22 nt, Human
gccagcagggcccaaaugcugg

SEQ ID NO: 321889 - RNA, 22 nt, Human
caagagcucccagaccugggca

SEQ ID NO: 321890 - RNA, 22 nt, Human
uuuagacauggcuugcucacuu

SEQ ID NO: 321891 - RNA, 22 nt, Human
ucaaagucauggcaggcucaga

SEQ ID NO: 321892 - RNA, 22 nt, Human
uccaugaggaccaaauucguag

SEQ ID NO: 321893 - RNA, 22 nt, Human
gucacuggggccacaugcagaa

SEQ ID NO: 321894 - RNA, 22 nt, Human
agcugccugcuuaugagcucca

SEQ ID NO: 321895 - RNA, 22 nt, Human
cugccccuggugauggacgcca

SEQ ID NO: 321896 - RNA, 22 nt, Human
caggagccccaggcugacaaua

SEQ ID NO: 321897 - RNA, 22 nt, Human
ggcagugaaugaaacagaggcu

SEQ ID NO: 321898 - RNA, 21 nt, Human
uggcugccuacaugcugcagg

SEQ ID NO: 321899 - RNA, 22 nt, Human
ccuggcuccugccucugcaggg

SEQ ID NO: 321900 - RNA, 22 nt, Human
cccaucaggaacccaggagccc

SEQ ID NO: 321901 - RNA, 22 nt, Human
gcaaaugcuaaaguguagagac

SEQ ID NO: 321902 - RNA, 22 nt, Human
auuugucuucaguagguucuuc

SEQ ID NO: 321903 - RNA, 22 nt, Human
caggucagaggcgcagccccca

SEQ ID NO: 321904 - RNA, 22 nt, Human
agaguguuauuugcucuguauu

SEQ ID NO: 321905 - RNA, 22 nt, Human
uggccuuccuggugacucauga

SEQ ID NO: 321906 - RNA, 22 nt, Human
cugggcugagccugggcugugu

SEQ ID NO: 321907 - RNA, 18 nt, Human
cagagcagagguggagcg

SEQ ID NO: 321908 - RNA, 22 nt, Human
uguuugaaacuuugaucacuaa

SEQ ID NO: 321909 - RNA, 22 nt, Human
acuaaauacacacauuuguuca

SEQ ID NO: 321910 - RNA, 22 nt, Human
agagagcccgggccagggcaca

SEQ ID NO: 321911 - RNA, 19 nt, Human
ggcugccuggagcgagggc

SEQ ID NO: 321912 - RNA, 18 nt, Human
aggcuucccaggcaggcc

SEQ ID NO: 321913 - RNA, 22 nt, Human
cccugugguugcuagggcacag

SEQ ID NO: 321914 - RNA, 22 nt, Human
gugaaggacuagcauggagggc

SEQ ID NO: 321915 - RNA, 22 nt, Human
caccaucagcagcaggugucaa

SEQ ID NO: 321916 - RNA, 22 nt, Human
caagaacaguuugccaaauugg

SEQ ID NO: 321917 - RNA, 22 nt, Human
ggcagcagaacuggcccuguau

SEQ ID NO: 321918 - RNA, 22 nt, Human
aaggcacuagcaagcugccugg

SEQ ID NO: 321919 - RNA, 22 nt, Human
caagagcuggguggcaagcuag

SEQ ID NO: 321920 - RNA, 18 nt, Human
ucaaagucuggcuccacu

SEQ ID NO: 321921 - RNA, 22 nt, Human
agagcuggcugcugcggugcuu

SEQ ID NO: 321922 - RNA, 22 nt, Human
agugcuguaacaacuuauuugg

SEQ ID NO: 321923 - RNA, 22 nt, Human
cugcugugccuuaaaaugcaag

SEQ ID NO: 321924 - RNA, 22 nt, Human
uaaaugcaagugcuccugggag

SEQ ID NO: 321925 - RNA, 22 nt, Human
aagauggagcacgagcagaagc

SEQ ID NO: 321926 - RNA, 22 nt, Human
ucucuggggauggaccugggag

SEQ ID NO: 321927 - RNA, 22 nt, Human
gcccauggcagaacugugagca

SEQ ID NO: 321928 - RNA, 22 nt, Human
agucagcagccuggccaggaga

SEQ ID NO: 321929 - RNA, 22 nt, Human
aagcugggagggagcccagagu

SEQ ID NO: 321930 - RNA, 22 nt, Human
ucccagccauuccuuuaggugu

SEQ ID NO: 321931 - RNA, 19 nt, Human
ggcugcugguuacagaggc

SEQ ID NO: 321932 - RNA, 22 nt, Human
cagaggcucaccagccuuucac

SEQ ID NO: 321933 - RNA, 22 nt, Human
cuggccucauagccaagcugug

SEQ ID NO: 321934 - RNA, 22 nt, Human
gaaagaggaaggagauguauua

SEQ ID NO: 321935 - RNA, 22 nt, Human
ccuccuggugggcgcuucuggc

SEQ ID NO: 321936 - RNA, 22 nt, Human
cuggcugcuuguagacucgacu

SEQ ID NO: 321937 - RNA, 22 nt, Human
caagaugaucccugaaggcagc

SEQ ID NO: 321938 - RNA, 22 nt, Human
ccagcuggucugugcucauguu

SEQ ID NO: 321939 - RNA, 22 nt, Human
uccaguucuaggucacucucug

SEQ ID NO: 321940 - RNA, 22 nt, Human
caggcuggaguuaccuuuaggg

SEQ ID NO: 321941 - RNA, 22 nt, Human
gucaggaucucccaguacauau

SEQ ID NO: 321942 - RNA, 22 nt, Human
uggcucugccacuaacuuggua

SEQ ID NO: 321943 - RNA, 19 nt, Human
cugcucccuccuucuggca

SEQ ID NO: 321944 - RNA, 22 nt, Human
ucaauauauuccauguuuucuc

SEQ ID NO: 321945 - RNA, 22 nt, Human
aguaauaauuuauauuagggag

SEQ ID NO: 321946 - RNA, 22 nt, Human
acccagagcugggcuuggcaaa

SEQ ID NO: 321947 - RNA, 22 nt, Human
aaaaaugaauucuucaguggca

SEQ ID NO: 321948 - RNA, 22 nt, Human
uagccaggcgaggucagugucg

SEQ ID NO: 321949 - RNA, 22 nt, Human
uggagccagagcgcagccuggg

SEQ ID NO: 321950 - RNA, 22 nt, Human
agggcugccauuucuggcccaa

SEQ ID NO: 321951 - RNA, 22 nt, Human
ggccccaguucacuccuggccg

SEQ ID NO: 321952 - RNA, 22 nt, Human
gggcugcuuuuuucuuagcaga

SEQ ID NO: 321953 - RNA, 19 nt, Human
acauuuagaauguacuugc

SEQ ID NO: 321954 - RNA, 22 nt, Human
uugucuguaaagacggccacca

SEQ ID NO: 321955 - RNA, 21 nt, Human
cugcucugacagugaggccag

SEQ ID NO: 321956 - RNA, 22 nt, Human
ccaggcaucacgggcauguggc

SEQ ID NO: 321957 - RNA, 22 nt, Human
ggcugcagaaguacuuccggau

SEQ ID NO: 321958 - RNA, 22 nt, Human
agaggcaggagguugacuugag

SEQ ID NO: 321959 - RNA, 22 nt, Human
ugccugagugauguggcagcca

SEQ ID NO: 321960 - RNA, 22 nt, Human
uuugaaaggugucgagaugugu

SEQ ID NO: 321961 - RNA, 22 nt, Human
ucuugccucuuccccuuuccau

SEQ ID NO: 321962 - RNA, 22 nt, Human
ugaaagguuaaaaguaguauug

SEQ ID NO: 321963 - RNA, 22 nt, Human
agcugauuccacuuuuucccca

SEQ ID NO: 321964 - RNA, 22 nt, Human
cccagcucuuuuagcggcaucu

SEQ ID NO: 321965 - RNA, 22 nt, Human
ucacaguaucacacaaggauua

SEQ ID NO: 321966 - RNA, 22 nt, Human
ucuguucaucucaugggagaau

SEQ ID NO: 321967 - RNA, 22 nt, Human
cugggacagcugagacaggaga

SEQ ID NO: 321968 - RNA, 22 nt, Human
ugcaaacuauugguagagaugg

SEQ ID NO: 321969 - RNA, 21 nt, Human
guucuuaguuauauucucaau

SEQ ID NO: 321970 - RNA, 20 nt, Human
aggcagagcgcacuuuuaga

SEQ ID NO: 321971 - RNA, 22 nt, Human
cugccagucuaugcugcucggc

SEQ ID NO: 321972 - RNA, 23 nt, Human
aguuccagaaaaaugcucaagca

SEQ ID NO: 321973 - RNA, 22 nt, Human
acuguucauauucuuagaaauu

SEQ ID NO: 321974 - RNA, 22 nt, Human
acagggcagagggcaguuggua

SEQ ID NO: 321975 - RNA, 22 nt, Human
uugccaggagcucaucugaggg

SEQ ID NO: 321976 - RNA, 16 nt, Human
gcagagcucagggacu

SEQ ID NO: 321977 - RNA, 22 nt, Human
acuucauuguaauauuauagca

SEQ ID NO: 321978 - RNA, 22 nt, Human
uuuccuuguucauuugcccuau

SEQ ID NO: 321979 - RNA, 22 nt, Human
ucuggcucacuucaggcuucac

SEQ ID NO: 321980 - RNA, 22 nt, Human
cuaguucugccauucaguguca

SEQ ID NO: 321981 - RNA, 23 nt, Human
ucccagccucuucucuugcauac

SEQ ID NO: 321982 - RNA, 20 nt, Human
ccugaggguuuguguucuuu

SEQ ID NO: 321983 - RNA, 22 nt, Human
ggcaccaggcugggcauaggcc

SEQ ID NO: 321984 - RNA, 22 nt, Human
uccuucagugucccgcucaggu

SEQ ID NO: 321985 - RNA, 22 nt, Human
ucucagggccucccucuguuuc

SEQ ID NO: 321986 - RNA, 22 nt, Human
uucuuguaauuuggagaaauga

SEQ ID NO: 321987 - RNA, 22 nt, Human
ugucucagaggcaggaagagcc

SEQ ID NO: 321988 - RNA, 17 nt, Human
ggccuugggcugcucuu

SEQ ID NO: 321989 - RNA, 22 nt, Human
auuuguagugaagugaaaauaa

SEQ ID NO: 321990 - RNA, 22 nt, Human
cuacuucuaaguacauggugau

SEQ ID NO: 321991 - RNA, 22 nt, Human
ggccuucacgugaccuggcgug

SEQ ID NO: 321992 - RNA, 21 nt, Human
aggcccagcuuuccucuugcu

SEQ ID NO: 321993 - RNA, 22 nt, Human
agucucugcugguugugccuau

SEQ ID NO: 321994 - RNA, 22 nt, Human
uucuuacuaguauguuucagca

SEQ ID NO: 321995 - RNA, 22 nt, Human
agccuggaagaaccugaagucu

SEQ ID NO: 321996 - RNA, 22 nt, Human
auuugaauggcuuaacacaacg

SEQ ID NO: 321997 - RNA, 22 nt, Human
cuggccucaccucagacuuacu

SEQ ID NO: 321998 - RNA, 22 nt, Human
ccaggccuuucuucuuggucug

SEQ ID NO: 321999 - RNA, 22 nt, Human
ccaggcucugcgcuggacaugg

SEQ ID NO: 322000 - RNA, 23 nt, Human
ucuugaaaagccuacagcaguuc

SEQ ID NO: 322001 - RNA, 22 nt, Human
ccaggccauucccagaguugcu

SEQ ID NO: 322002 - RNA, 22 nt, Human
ggcugcuggggacgugggagag

SEQ ID NO: 322003 - RNA, 22 nt, Human
cucagccugugaagagcagagg

SEQ ID NO: 322004 - RNA, 22 nt, Human
aggcagagaaaaaccagauaug

SEQ ID NO: 322005 - RNA, 22 nt, Human
ucuucacaugaccuucaugucu

SEQ ID NO: 322006 - RNA, 22 nt, Human
gaggggcugcccuggugucagg

SEQ ID NO: 322007 - RNA, 22 nt, Human
uggguagagacacagucugggg

SEQ ID NO: 322008 - RNA, 22 nt, Human
aguggcagagugcacucaggca

SEQ ID NO: 322009 - RNA, 22 nt, Human
ggaggccaggaagagccgcccu

SEQ ID NO: 322010 - RNA, 17 nt, Human
uccuucagugccucugc

SEQ ID NO: 322011 - RNA, 22 nt, Human
ccaggcccugcuccucacacca

SEQ ID NO: 322012 - RNA, 22 nt, Human
gaagccaacauuccaaguagaa

SEQ ID NO: 322013 - RNA, 20 nt, Human
ucagaugggagugagccauc

SEQ ID NO: 322014 - RNA, 22 nt, Human
acucaguggcacuuuggaauuu

SEQ ID NO: 322015 - RNA, 22 nt, Human
ggcugagcaauuuugaugacau

SEQ ID NO: 322016 - RNA, 22 nt, Human
uagagacaccaguaccauucug

SEQ ID NO: 322017 - RNA, 22 nt, Human
gcucugagccgggggccugucc

SEQ ID NO: 322018 - RNA, 22 nt, Human
cauuacaugguccaggauauau

SEQ ID NO: 322019 - RNA, 22 nt, Human
aacagaauaguugauguacagu

SEQ ID NO: 322020 - RNA, 22 nt, Human
cagggcuggcucaugaaaaguu

SEQ ID NO: 322021 - RNA, 18 nt, Human
aaguaacagaagagcaca

SEQ ID NO: 322022 - RNA, 22 nt, Human
gcuuccugucccucagccauga

SEQ ID NO: 322023 - RNA, 22 nt, Human
aagggcaggcagagaucauaua

SEQ ID NO: 322024 - RNA, 22 nt, Human
uggccgggccgggcgccuccac

SEQ ID NO: 322025 - RNA, 22 nt, Human
ccagcuccccucagcagguaau

SEQ ID NO: 322026 - RNA, 22 nt, Human
agagaauuuuaaaagccuugaa

SEQ ID NO: 322027 - RNA, 22 nt, Human
uaguuacagcaggcaggauaua

SEQ ID NO: 322028 - RNA, 22 nt, Human
cuccuucccuucaaguguuccu

SEQ ID NO: 322029 - RNA, 22 nt, Human
gccuuccugcagcucugagcgu

SEQ ID NO: 322030 - RNA, 22 nt, Human
auugaaagagaauguagcucuu

SEQ ID NO: 322031 - RNA, 22 nt, Human
cuggccagaguuggagggugug

SEQ ID NO: 322032 - RNA, 22 nt, Human
aagacuugaccagguugaaggc

SEQ ID NO: 322033 - RNA, 22 nt, Human
caucacagauguuguguggagu

SEQ ID NO: 322034 - RNA, 22 nt, Human
agaguuggccaaaaggggcauu

SEQ ID NO: 322035 - RNA, 22 nt, Human
cuacauggagaagaaaauucuu

SEQ ID NO: 322036 - RNA, 22 nt, Human
cccaggagguggagguugcagc

SEQ ID NO: 322037 - RNA, 22 nt, Human
ugcacccucaucagucaaaugg

SEQ ID NO: 322038 - RNA, 21 nt, Human
gcagccagacgggauucaguu

SEQ ID NO: 322039 - RNA, 22 nt, Human
uggcagagcuggcugcggauga

SEQ ID NO: 322040 - RNA, 22 nt, Human
cugucccuucauuauucacuac

SEQ ID NO: 322041 - RNA, 22 nt, Human
ccagucagccaagcugcagcgg

SEQ ID NO: 322042 - RNA, 22 nt, Human
ucucaggaaauaggauuugagu

SEQ ID NO: 322043 - RNA, 22 nt, Human
cacaaaugguuguagacauuaa

SEQ ID NO: 322044 - RNA, 22 nt, Human
gaaacuguauguaguuuuuggg

SEQ ID NO: 322045 - RNA, 22 nt, Human
uauacaaugaguacauucuggg

SEQ ID NO: 322046 - RNA, 22 nt, Human
ccauggccaauugcaccuugcu

SEQ ID NO: 322047 - RNA, 20 nt, Human
aucuggcucagauccugcag

SEQ ID NO: 322048 - RNA, 22 nt, Human
gagggcacuggguuucaauguc

SEQ ID NO: 322049 - RNA, 22 nt, Human
gcugccuggagcucagccugcc

SEQ ID NO: 322050 - RNA, 22 nt, Human
cgcuggccauagccuccugugu

SEQ ID NO: 322051 - RNA, 22 nt, Human
cauacauaugcauguguguaua

SEQ ID NO: 322052 - RNA, 22 nt, Human
agugcuguccaguuucacaggu

SEQ ID NO: 322053 - RNA, 22 nt, Human
gugaaggaccaauaugacucau

SEQ ID NO: 322054 - RNA, 22 nt, Human
cacccagccuucacacaggagu

SEQ ID NO: 322055 - RNA, 21 nt, Human
ugcaagaaucaggaagcugcc

SEQ ID NO: 322056 - RNA, 22 nt, Human
ccuggcuggcaagaucgugaag

SEQ ID NO: 322057 - RNA, 22 nt, Human
ucaaaccaccuuguuacugggg

SEQ ID NO: 322058 - RNA, 22 nt, Human
gcaggccugacuguagggggca

SEQ ID NO: 322059 - RNA, 22 nt, Human
ucaggaauccagacagggcaca

SEQ ID NO: 322060 - RNA, 16 nt, Human
gaaggagauucagaaa

SEQ ID NO: 322061 - RNA, 22 nt, Human
cuggagcugucuucacaggccu

SEQ ID NO: 322062 - RNA, 22 nt, Human
aaggcacuagcagaauuaguga

SEQ ID NO: 322063 - RNA, 22 nt, Human
gauuucaauccagcuuucuucu

SEQ ID NO: 322064 - RNA, 22 nt, Human
cuaugaaaugucagauucugca

SEQ ID NO: 322065 - RNA, 22 nt, Human
agaaaugaaaccaaagccuaga

SEQ ID NO: 322066 - RNA, 22 nt, Human
ucuacugcacuggugucucauc

SEQ ID NO: 322067 - RNA, 20 nt, Human
cugagcugagcuccaugggu

SEQ ID NO: 322068 - RNA, 22 nt, Human
cagagccaugguaugggcuugu

SEQ ID NO: 322069 - RNA, 22 nt, Human
ccagaggcuggguucaccucag

SEQ ID NO: 322070 - RNA, 22 nt, Human
gugcauuugugcaugcacaugu

SEQ ID NO: 322071 - RNA, 22 nt, Human
ugcugccuucuaggcgugcccu

SEQ ID NO: 322072 - RNA, 22 nt, Human
uagacagauuuaaaggaaugga

SEQ ID NO: 322073 - RNA, 22 nt, Human
ggcagaagaaaggcuaagucuc

SEQ ID NO: 322074 - RNA, 22 nt, Human
auaucacaaacaagucuguacu

SEQ ID NO: 322075 - RNA, 22 nt, Human
gaaggagcuaaagggagcccug

SEQ ID NO: 322076 - RNA, 22 nt, Human
ugucucagggcagcagcagggg

SEQ ID NO: 322077 - RNA, 20 nt, Human
ucauugcacauaauggaagc

SEQ ID NO: 322078 - RNA, 22 nt, Human
ggcugaaaggugggaggauggc

SEQ ID NO: 322079 - RNA, 22 nt, Human
ucagccuggcaggauggccugg

SEQ ID NO: 322080 - RNA, 22 nt, Human
acagacagggcaccugccuccu

SEQ ID NO: 322081 - RNA, 23 nt, Human
ugaugggaaggaacgacuaccac

SEQ ID NO: 322082 - RNA, 22 nt, Human
gggcugggcaugguguucccuc

SEQ ID NO: 322083 - RNA, 22 nt, Human
aaauucaguuuuaauaaucacu

SEQ ID NO: 322084 - RNA, 22 nt, Human
ucucagugggaagggcacaguu

SEQ ID NO: 322085 - RNA, 22 nt, Human
ugggccugccccaggcuucagc

SEQ ID NO: 322086 - RNA, 22 nt, Human
gaggccuggcucugcccuccug

SEQ ID NO: 322087 - RNA, 22 nt, Human
uuuaacacuaguuucuuuaacu

SEQ ID NO: 322088 - RNA, 22 nt, Human
cuuguauuccccuaucucuaaa

SEQ ID NO: 322089 - RNA, 17 nt, Human
gcugcagcgguaggcag

SEQ ID NO: 322090 - RNA, 22 nt, Human
ugacccauggucugaucauagg

SEQ ID NO: 322091 - RNA, 22 nt, Human
gagcagugguugaacagaggca

SEQ ID NO: 322092 - RNA, 22 nt, Human
cugcagugaaaucaggaagcaa

SEQ ID NO: 322093 - RNA, 20 nt, Human
cagcccuccaguggaggcag

SEQ ID NO: 322094 - RNA, 22 nt, Human
ucagcuccucaugcaggggaua

SEQ ID NO: 322095 - RNA, 22 nt, Human
cucagaauuacaucccauuuua

SEQ ID NO: 322096 - RNA, 22 nt, Human
aaucauucuuauuucacagcaa

SEQ ID NO: 322097 - RNA, 22 nt, Human
acacagggcggaaagcaugaga

SEQ ID NO: 322098 - RNA, 22 nt, Human
ugguggcaauguccuggagaag

SEQ ID NO: 322099 - RNA, 23 nt, Human
uuucacaaugagcauuacagaau

SEQ ID NO: 322100 - RNA, 22 nt, Human
caaggccacuccagagacuggu

SEQ ID NO: 322101 - RNA, 20 nt, Human
cugggcucgguggcccuggc

SEQ ID NO: 322102 - RNA, 22 nt, Human
cagagccugccucuggcugugg

SEQ ID NO: 322103 - RNA, 22 nt, Human
uucaggauggaguaccuuuuau

SEQ ID NO: 322104 - RNA, 22 nt, Human
auuugcuugugcuaugaaaguu

SEQ ID NO: 322105 - RNA, 20 nt, Human
gggaguggugguagccugug

SEQ ID NO: 322106 - RNA, 22 nt, Human
gaggccaaguuggagaccaggu

SEQ ID NO: 322107 - RNA, 22 nt, Human
aguaugaaaguuaaucaauuua

SEQ ID NO: 322108 - RNA, 22 nt, Human
ugucagaacucuauugaugucc

SEQ ID NO: 322109 - RNA, 17 nt, Human
ugcauuguaggcuagcc

SEQ ID NO: 322110 - RNA, 22 nt, Human
uucaagucaaggaaagaggucu

SEQ ID NO: 322111 - RNA, 22 nt, Human
ggaggccaggguggguggaucg

SEQ ID NO: 322112 - RNA, 22 nt, Human
uggggacaggagacuuacagcu

SEQ ID NO: 322113 - RNA, 19 nt, Human
uggcucugucgaaggcaca

SEQ ID NO: 322114 - RNA, 22 nt, Human
ugaaauuaugcauuguuguacc

SEQ ID NO: 322115 - RNA, 22 nt, Human
aaauguuuugcucccauguggu

SEQ ID NO: 322116 - RNA, 22 nt, Human
aggucauuaaaguuaaaugagg

SEQ ID NO: 322117 - RNA, 22 nt, Human
auucuagaugcuguaaguagca

SEQ ID NO: 322118 - RNA, 22 nt, Human
cuguguuugaugagaagccacc

SEQ ID NO: 322119 - RNA, 22 nt, Human
guaagggauuugaacauagguu

SEQ ID NO: 322120 - RNA, 22 nt, Human
ugggcacuauggcucugugcac

SEQ ID NO: 322121 - RNA, 22 nt, Human
ggagacagcaggaagaaauauc

SEQ ID NO: 322122 - RNA, 22 nt, Human
gccagggggucagcaggcacuu

SEQ ID NO: 322123 - RNA, 22 nt, Human
aagcaccuggguuauaucuuag

SEQ ID NO: 322124 - RNA, 20 nt, Human
aggagcugaauuagaggguu

SEQ ID NO: 322125 - RNA, 22 nt, Human
cagccaggacagggaaacuagu

SEQ ID NO: 322126 - RNA, 22 nt, Human
aagaaauguagagccuaguaaa

SEQ ID NO: 322127 - RNA, 22 nt, Human
guggauggauugaggcaguggg

SEQ ID NO: 322128 - RNA, 22 nt, Human
gucaggauuugaacucaggucu

SEQ ID NO: 322129 - RNA, 22 nt, Human
ugugugacccccagugaagccu

SEQ ID NO: 322130 - RNA, 22 nt, Human
aaccaggaauugcagggcugca

SEQ ID NO: 322131 - RNA, 22 nt, Human
cugggcucagcccaugcugucc

SEQ ID NO: 322132 - RNA, 17 nt, Human
ucagcaggggccaagcu

SEQ ID NO: 322133 - RNA, 17 nt, Human
uucaagauauugaaaug

SEQ ID NO: 322134 - RNA, 22 nt, Human
gcuuccaaaucuguucaaaaug

SEQ ID NO: 322135 - RNA, 22 nt, Human
aguauuucugcucaugaaagag

SEQ ID NO: 322136 - RNA, 22 nt, Human
ugguggcuguugcagaacugag

SEQ ID NO: 322137 - RNA, 22 nt, Human
uucucuucaucucaguaaaugu

SEQ ID NO: 322138 - RNA, 22 nt, Human
acuccagggcuccaucccuugu

SEQ ID NO: 322139 - RNA, 22 nt, Human
caggguggaaaagcuaguugga

SEQ ID NO: 322140 - RNA, 22 nt, Human
ccaguguuauuuuagaguguga

SEQ ID NO: 322141 - RNA, 22 nt, Human
gcucagagcaucccagugaaug

SEQ ID NO: 322142 - RNA, 22 nt, Human
cugcccugggauggucugugcg

SEQ ID NO: 322143 - RNA, 22 nt, Human
acugccuugucucuugccuguu

SEQ ID NO: 322144 - RNA, 22 nt, Human
aucaguuuaacugucaagagcc

SEQ ID NO: 322145 - RNA, 22 nt, Human
aaaugcauaucaaagacuugaa

SEQ ID NO: 322146 - RNA, 22 nt, Human
ggcagggguccugguguugacu

SEQ ID NO: 322147 - RNA, 22 nt, Human
cucucugggcccaguuggcacc

SEQ ID NO: 322148 - RNA, 22 nt, Human
ucuaggagcaugaagggaaggc

SEQ ID NO: 322149 - RNA, 20 nt, Human
gaagccagaggggaaaggag

SEQ ID NO: 322150 - RNA, 22 nt, Human
ggagcagccacgucucagggca

SEQ ID NO: 322151 - RNA, 22 nt, Human
agguagagcuccaguagaaaau

SEQ ID NO: 322152 - RNA, 22 nt, Human
cugcugugccucuuuucacgug

SEQ ID NO: 322153 - RNA, 22 nt, Human
uauauguaaauaagucuaaugu

SEQ ID NO: 322154 - RNA, 17 nt, Human
gccaaaggguuccaauc

SEQ ID NO: 322155 - RNA, 22 nt, Human
ccugggagugucagacuugcuu

SEQ ID NO: 322156 - RNA, 22 nt, Human
cucuccuugcagauggcugccu

SEQ ID NO: 322157 - RNA, 23 nt, Human
ccacagagcugccaauuccugug

SEQ ID NO: 322158 - RNA, 22 nt, Human
ccaguccuagaagaggagucga

SEQ ID NO: 322159 - RNA, 22 nt, Human
auuuccagcagcauauuugucu

SEQ ID NO: 322160 - RNA, 22 nt, Human
cuucuucaauagcaagcgcaua

SEQ ID NO: 322161 - RNA, 22 nt, Human
agcaauauaaauguuggguaga

SEQ ID NO: 322162 - RNA, 22 nt, Human
acuggcaguggcagcagaaaga

SEQ ID NO: 322163 - RNA, 22 nt, Human
aaguauuucguucugaaaaagu

SEQ ID NO: 322164 - RNA, 22 nt, Human
aagccagauagaagaacucauu

SEQ ID NO: 322165 - RNA, 22 nt, Human
ugcuuccuugaucauucccaaa

SEQ ID NO: 322166 - RNA, 22 nt, Human
ugaaaugacaaagguuuuucuu

SEQ ID NO: 322167 - RNA, 22 nt, Human
ugugacagaucuuuaaauaaug

SEQ ID NO: 322168 - RNA, 22 nt, Human
caaggccaguucaccaagggca

SEQ ID NO: 322169 - RNA, 22 nt, Human
gcuuccugauauucauacuguu

SEQ ID NO: 322170 - RNA, 22 nt, Human
cucccugcuuguuucccuucag

SEQ ID NO: 322171 - RNA, 22 nt, Human
aaauauguauggaguucaugaa

SEQ ID NO: 322172 - RNA, 22 nt, Human
ccagugcaggugagcaccaggu

SEQ ID NO: 322173 - RNA, 22 nt, Human
aucaguuucuaccauguggaau

SEQ ID NO: 322174 - RNA, 19 nt, Human
uucucaguucaggagaaga

SEQ ID NO: 322175 - RNA, 22 nt, Human
gccacaggcacuuaagggcugg

SEQ ID NO: 322176 - RNA, 22 nt, Human
aagaacauguuaaaagauucac

SEQ ID NO: 322177 - RNA, 22 nt, Human
cgccugggaguccacaccugcu

SEQ ID NO: 322178 - RNA, 22 nt, Human
gcucaggaaggcucaaccagga

SEQ ID NO: 322179 - RNA, 22 nt, Human
uguaaucauuacaguacaugga

SEQ ID NO: 322180 - RNA, 22 nt, Human
caggugggagcgaggagcuacu

SEQ ID NO: 322181 - RNA, 23 nt, Human
uaauucacauauacauugcuuca

SEQ ID NO: 322182 - RNA, 22 nt, Human
ucauuuguggaagugauugugg

SEQ ID NO: 322183 - RNA, 22 nt, Human
ccucccuggccagagcagcagc

SEQ ID NO: 322184 - RNA, 22 nt, Human
ccuucagaccuagacaggaauc

SEQ ID NO: 322185 - RNA, 22 nt, Human
cagaggccauauuucuucacuc

SEQ ID NO: 322186 - RNA, 22 nt, Human
ggccucugaggacagccuuggc

SEQ ID NO: 322187 - RNA, 23 nt, Human
gagugcagaauagacaugcagug

SEQ ID NO: 322188 - RNA, 22 nt, Human
cugagaggugacagcgugcugg

SEQ ID NO: 322189 - RNA, 22 nt, Human
ccugcagcuccggauuucuggg

SEQ ID NO: 322190 - RNA, 22 nt, Human
gcugagcucccagcaguaucug

SEQ ID NO: 322191 - RNA, 22 nt, Human
ucauguaaguauagaaagcagu

SEQ ID NO: 322192 - RNA, 22 nt, Human
ucagugcauucauggguggcug

SEQ ID NO: 322193 - RNA, 22 nt, Human
uuuccucuccggggccuccagg

SEQ ID NO: 322194 - RNA, 22 nt, Human
acaggggaauuuacugucauua

SEQ ID NO: 322195 - RNA, 22 nt, Human
caaggccauaagagauacaaaa

SEQ ID NO: 322196 - RNA, 22 nt, Human
augcagguugggcaaguguggg

SEQ ID NO: 322197 - RNA, 22 nt, Human
cggcuggggcuguccccaugac

SEQ ID NO: 322198 - RNA, 22 nt, Human
cccuggaguccggagcucaccu

SEQ ID NO: 322199 - RNA, 22 nt, Human
uguguacacaaugauugcagag

SEQ ID NO: 322200 - RNA, 22 nt, Human
ucacaauauuuaucuuccaauu

SEQ ID NO: 322201 - RNA, 22 nt, Human
uggugcugauaauggcaggauu

SEQ ID NO: 322202 - RNA, 22 nt, Human
acauuguauaaugauuaucaca

SEQ ID NO: 322203 - RNA, 22 nt, Human
ucugcugcacaaauucaucucu

SEQ ID NO: 322204 - RNA, 22 nt, Human
auacaacuuuacaugcaauucc

SEQ ID NO: 322205 - RNA, 22 nt, Human
ucaggccuccagguuaccauuu

SEQ ID NO: 322206 - RNA, 22 nt, Human
gcaccugcaggaugagccaggg

SEQ ID NO: 322207 - RNA, 22 nt, Human
gugcagugacccuggagagcug

SEQ ID NO: 322208 - RNA, 22 nt, Human
uggaagagggagcuggguggcc

SEQ ID NO: 322209 - RNA, 22 nt, Human
agcaggcuuucaagagucuucu

SEQ ID NO: 322210 - RNA, 22 nt, Human
agagccaggcaggcaauguuga

SEQ ID NO: 322211 - RNA, 22 nt, Human
ucaguuuuucuauacuuuguag

SEQ ID NO: 322212 - RNA, 22 nt, Human
ccagagccccugagcuucccug

SEQ ID NO: 322213 - RNA, 22 nt, Human
ccugucugagccagggugggca

SEQ ID NO: 322214 - RNA, 22 nt, Human
auguaacaggugaagcucugag

SEQ ID NO: 322215 - RNA, 22 nt, Human
ugugaaggcagcagcucugucc

SEQ ID NO: 322216 - RNA, 22 nt, Human
aauuaaaaaaggagagcuugcu

SEQ ID NO: 322217 - RNA, 22 nt, Human
ugggcagaggcagcagaaaccu

SEQ ID NO: 322218 - RNA, 22 nt, Human
cucaggaugcaauuccaucaag

SEQ ID NO: 322219 - RNA, 21 nt, Human
aaguaaaucagagaaauaacc

SEQ ID NO: 322220 - RNA, 22 nt, Human
cccagcccccgagugucuggaa

SEQ ID NO: 322221 - RNA, 22 nt, Human
gggcccuggggccugauuugca

SEQ ID NO: 322222 - RNA, 22 nt, Human
ggcuucuguccucuggaucugu

SEQ ID NO: 322223 - RNA, 22 nt, Human
gguggggcccuggcacugguau

SEQ ID NO: 322224 - RNA, 16 nt, Human
uggaaggggucuccgg

SEQ ID NO: 322225 - RNA, 22 nt, Human
cuccaggccagggaaguggaca

SEQ ID NO: 322226 - RNA, 22 nt, Human
ugcagggcuuccucuuggaguu

SEQ ID NO: 322227 - RNA, 22 nt, Human
cugaggaguuuggguuguucaa

SEQ ID NO: 322228 - RNA, 22 nt, Human
ccugggaccucgcgggaagcgg

SEQ ID NO: 322229 - RNA, 22 nt, Human
ggggaggcugaugugggcaaag

SEQ ID NO: 322230 - RNA, 22 nt, Human
cagguggaucucuaaggacuga

SEQ ID NO: 322231 - RNA, 21 nt, Human
agagaagggacucuuccaguc

SEQ ID NO: 322232 - RNA, 22 nt, Human
uugcauugaugucuauacgcug

SEQ ID NO: 322233 - RNA, 22 nt, Human
uugcuuccaguccaagucuguu

SEQ ID NO: 322234 - RNA, 22 nt, Human
aagagcuggcucuugcagcagc

SEQ ID NO: 322235 - RNA, 22 nt, Human
aguugaaauuagaguccuggcu

SEQ ID NO: 322236 - RNA, 22 nt, Human
cuauuucugccuaaugaccugu

SEQ ID NO: 322237 - RNA, 22 nt, Human
uuuuuccuagcgauuugucagc

SEQ ID NO: 322238 - RNA, 22 nt, Human
agggucaggagacacuggcaac

SEQ ID NO: 322239 - RNA, 23 nt, Human
cagggccaggcagcagcugucac

SEQ ID NO: 322240 - RNA, 22 nt, Human
uauauauucuuaaguaguguag

SEQ ID NO: 322241 - RNA, 22 nt, Human
caaaguauauuggauugaaugg

SEQ ID NO: 322242 - RNA, 22 nt, Human
aagcacagggacucaggaccgg

SEQ ID NO: 322243 - RNA, 20 nt, Human
agggcagcuugaggagccgg

SEQ ID NO: 322244 - RNA, 21 nt, Human
ccaggguccagcugccauggu

SEQ ID NO: 322245 - RNA, 22 nt, Human
ccaugagccaggcugaggaagc

SEQ ID NO: 322246 - RNA, 22 nt, Human
agcucuggaauaaugaugugau

SEQ ID NO: 322247 - RNA, 22 nt, Human
ugagcccagagaucugagcuau

SEQ ID NO: 322248 - RNA, 18 nt, Human
auggucucauacugggag

SEQ ID NO: 322249 - RNA, 22 nt, Human
ugucaguguauacauacaguau

SEQ ID NO: 322250 - RNA, 22 nt, Human
cucuggacagcaggugcugugg

SEQ ID NO: 322251 - RNA, 22 nt, Human
auaguuugaaggcuguucuacu

SEQ ID NO: 322252 - RNA, 22 nt, Human
uggccuggcagagcaaggccug

SEQ ID NO: 322253 - RNA, 22 nt, Human
agaggcugcacuugcucaugau

SEQ ID NO: 322254 - RNA, 22 nt, Human
cccuggucagggaaggcgccug

SEQ ID NO: 322255 - RNA, 22 nt, Human
gugcugggugcugcagacaggu

SEQ ID NO: 322256 - RNA, 21 nt, Human
ccauaccuaccucaccugguu

SEQ ID NO: 322257 - RNA, 22 nt, Human
ccagggcagugggagaaggugc

SEQ ID NO: 322258 - RNA, 21 nt, Human
uucagcaguccucuagagaua

SEQ ID NO: 322259 - RNA, 22 nt, Human
aucagcaaggcaaucacugcag

SEQ ID NO: 322260 - RNA, 19 nt, Human
gggaaauucacuugcuucc

SEQ ID NO: 322261 - RNA, 22 nt, Human
aggaggcccuagagcucuagag

SEQ ID NO: 322262 - RNA, 22 nt, Human
acaguguccuuguggucccugu

SEQ ID NO: 322263 - RNA, 22 nt, Human
cacaguccugccagagggccuu

SEQ ID NO: 322264 - RNA, 22 nt, Human
aagagcuggauugugcugcaga

SEQ ID NO: 322265 - RNA, 22 nt, Human
uguguucugaaggagaagagug

SEQ ID NO: 322266 - RNA, 22 nt, Human
cuggcagcgugagcagcaucca

SEQ ID NO: 322267 - RNA, 22 nt, Human
cuuacauuaaguaagagauuga

SEQ ID NO: 322268 - RNA, 22 nt, Human
cugccucucagccugaccgcca

SEQ ID NO: 322269 - RNA, 22 nt, Human
uuuuugcaccaaccuaauagaa

SEQ ID NO: 322270 - RNA, 22 nt, Human
gccugcagaacugugaggcaau

SEQ ID NO: 322271 - RNA, 22 nt, Human
ucugugcucuucucaguaucac

SEQ ID NO: 322272 - RNA, 22 nt, Human
ucaguuaacaacuauuuauuga

SEQ ID NO: 322273 - RNA, 19 nt, Human
agcauuuggaauucuacac

SEQ ID NO: 322274 - RNA, 20 nt, Human
ggggaagaaaaggaugugau

SEQ ID NO: 322275 - RNA, 22 nt, Human
ugagaauuuuuugucaugcauu

SEQ ID NO: 322276 - RNA, 20 nt, Human
acugugaaugcugaauuagc

SEQ ID NO: 322277 - RNA, 22 nt, Human
ugucaaauuuuuauugcaguau

SEQ ID NO: 322278 - RNA, 22 nt, Human
gggcuaggcuuggccagcacug

SEQ ID NO: 322279 - RNA, 22 nt, Human
ccagccuucugagcugccugga

SEQ ID NO: 322280 - RNA, 22 nt, Human
agcagggcugcagugugucuuu

SEQ ID NO: 322281 - RNA, 22 nt, Human
uagagcuggaaaacugcaggua

SEQ ID NO: 322282 - RNA, 22 nt, Human
cuggccaguuguccuggcuugg

SEQ ID NO: 322283 - RNA, 20 nt, Human
ugaaggccagcagcauaggg

SEQ ID NO: 322284 - RNA, 22 nt, Human
gcuggccauagaagccaaagag

SEQ ID NO: 322285 - RNA, 22 nt, Human
cugggugaguugaugaaggaga

SEQ ID NO: 322286 - RNA, 22 nt, Human
augaaggauggcuggcugcccu

SEQ ID NO: 322287 - RNA, 22 nt, Human
gcucagugcaucauuccaggcu

SEQ ID NO: 322288 - RNA, 22 nt, Human
ugaaaucuuauacuuugguagu

SEQ ID NO: 322289 - RNA, 21 nt, Human
aaacugaccuugccugagaca

SEQ ID NO: 322290 - RNA, 22 nt, Human
acuguucacagauuagucgaug

SEQ ID NO: 322291 - RNA, 22 nt, Human
aggugaguugguaggaaguuug

SEQ ID NO: 322292 - RNA, 19 nt, Human
acacagggcuagaguuaca

SEQ ID NO: 322293 - RNA, 22 nt, Human
caaauucagaaaauugguagag

SEQ ID NO: 322294 - RNA, 22 nt, Human
uggcccugcuaugauccugcaa

SEQ ID NO: 322295 - RNA, 22 nt, Human
ccaguccugccacccugucuau

SEQ ID NO: 322296 - RNA, 22 nt, Human
gaggcagaaguugcagugagca

SEQ ID NO: 322297 - RNA, 22 nt, Human
uuggagcccugaggaucuggau

SEQ ID NO: 322298 - RNA, 22 nt, Human
ugagagugaaaugucacauguc

SEQ ID NO: 322299 - RNA, 22 nt, Human
uauugaaauccauuacguucuu

SEQ ID NO: 322300 - RNA, 22 nt, Human
uccaucagauucccuccugaga

SEQ ID NO: 322301 - RNA, 22 nt, Human
uuaacagacauauauauuugua

SEQ ID NO: 322302 - RNA, 22 nt, Human
ggccucgcggcuucugguggcu

SEQ ID NO: 322303 - RNA, 22 nt, Human
gaggaaggucccaucagaauuu

SEQ ID NO: 322304 - RNA, 22 nt, Human
cagggccaagccccuuuggcug

SEQ ID NO: 322305 - RNA, 22 nt, Human
guggaauguccuugaucauaag

SEQ ID NO: 322306 - RNA, 22 nt, Human
agccccuugcacuuccccacgc

SEQ ID NO: 322307 - RNA, 22 nt, Human
ccacacagggggaugaguuauu

SEQ ID NO: 322308 - RNA, 20 nt, Human
cagagcuguuauggaugaug

SEQ ID NO: 322309 - RNA, 22 nt, Human
aaugaaaugaagauaugaucag

SEQ ID NO: 322310 - RNA, 22 nt, Human
ugcugugagguugagaaggaag

SEQ ID NO: 322311 - RNA, 22 nt, Human
ucuuugcaaaauacaacaaugg

SEQ ID NO: 322312 - RNA, 22 nt, Human
caguggagagacuuuuacucuu

SEQ ID NO: 322313 - RNA, 22 nt, Human
accagcuguguccuggcugcag

SEQ ID NO: 322314 - RNA, 22 nt, Human
agcugaaggcuagaacagcugg

SEQ ID NO: 322315 - RNA, 22 nt, Human
gccccugggagcagagccacca

SEQ ID NO: 322316 - RNA, 22 nt, Human
uucacauuugcccuuaugugug

SEQ ID NO: 322317 - RNA, 20 nt, Human
ggaagcagagaacuguuuuc

SEQ ID NO: 322318 - RNA, 22 nt, Human
acuggagcccguggaggcgcag

SEQ ID NO: 322319 - RNA, 22 nt, Human
cagacuggccacaucugcacug

SEQ ID NO: 322320 - RNA, 22 nt, Human
guggccugggguuuguucugag

SEQ ID NO: 322321 - RNA, 20 nt, Human
cucaguguauucugggugcu

SEQ ID NO: 322322 - RNA, 22 nt, Human
auauuuaacuggucccaauaua

SEQ ID NO: 322323 - RNA, 22 nt, Human
ucuguucagacacuuuacaugu

SEQ ID NO: 322324 - RNA, 22 nt, Human
cuuucacauaauugaccuugaa

SEQ ID NO: 322325 - RNA, 22 nt, Human
cugcucuggucucuucauguuu

SEQ ID NO: 322326 - RNA, 22 nt, Human
aaauauugguaggaugcuuguu

SEQ ID NO: 322327 - RNA, 22 nt, Human
uggcagagaugaagaguuguuu

SEQ ID NO: 322328 - RNA, 22 nt, Human
uggggcugugagacuacaggau

SEQ ID NO: 322329 - RNA, 23 nt, Human
gccugggacugguagugugaccu

SEQ ID NO: 322330 - RNA, 22 nt, Human
guucuucaggcugugcucuaga

SEQ ID NO: 322331 - RNA, 22 nt, Human
gcagggucugaggccacagagg

SEQ ID NO: 322332 - RNA, 22 nt, Human
agccacagcgaaccucucuucc

SEQ ID NO: 322333 - RNA, 22 nt, Human
cugcccuggcagccuaccaugg

SEQ ID NO: 322334 - RNA, 22 nt, Human
caauguguuugcauauuaaaau

SEQ ID NO: 322335 - RNA, 22 nt, Human
gccuggguccacugaucaugcu

SEQ ID NO: 322336 - RNA, 22 nt, Human
cugaggccucuguucaccagaa

SEQ ID NO: 322337 - RNA, 23 nt, Human
ucagcugcuuccuccugccugcc

SEQ ID NO: 322338 - RNA, 23 nt, Human
cagggcugguagggaagagcgug

SEQ ID NO: 322339 - RNA, 22 nt, Human
aggaagaauguuuacauaucaa

SEQ ID NO: 322340 - RNA, 22 nt, Human
ucagugugaguaccaugcucag

SEQ ID NO: 322341 - RNA, 22 nt, Human
gcugccacuuggucaugucaug

SEQ ID NO: 322342 - RNA, 22 nt, Human
aaaguguggagauugaacuaaa

SEQ ID NO: 322343 - RNA, 22 nt, Human
cucaggauguacuacagaaggc

SEQ ID NO: 322344 - RNA, 22 nt, Human
ucuggagccuuggaugggaaag

SEQ ID NO: 322345 - RNA, 22 nt, Human
caggccugguugagcccugaga

SEQ ID NO: 322346 - RNA, 22 nt, Human
cacagucccauucgagaguaau

SEQ ID NO: 322347 - RNA, 22 nt, Human
agaggccagcagugccuaucug

SEQ ID NO: 322348 - RNA, 22 nt, Human
aaaugcagcagcuaauugaaaa

SEQ ID NO: 322349 - RNA, 22 nt, Human
agaaaucuaagaugcucaagga

SEQ ID NO: 322350 - RNA, 21 nt, Human
accaggccaggaggcuggcac

SEQ ID NO: 322351 - RNA, 22 nt, Human
ccucuggcaacuucacagccca

SEQ ID NO: 322352 - RNA, 22 nt, Human
aagaacagauucagccugaacu

SEQ ID NO: 322353 - RNA, 22 nt, Human
uagaagcaguaauagaaauagg

SEQ ID NO: 322354 - RNA, 22 nt, Human
cugcucuggcguacucggcauc

SEQ ID NO: 322355 - RNA, 22 nt, Human
aacagacaacuccuguggcuca

SEQ ID NO: 322356 - RNA, 22 nt, Human
uucauugugaacacauucugcc

SEQ ID NO: 322357 - RNA, 23 nt, Human
ugcagcugccucuggcgggccgg

SEQ ID NO: 322358 - RNA, 22 nt, Human
ucaaauaccagcuuuuccagaa

SEQ ID NO: 322359 - RNA, 22 nt, Human
agccaggggauucaucagggac

SEQ ID NO: 322360 - RNA, 22 nt, Human
accaaggaagaaucuauuugag

SEQ ID NO: 322361 - RNA, 22 nt, Human
caguguuuguggaauucaggug

SEQ ID NO: 322362 - RNA, 22 nt, Human
ggcuucccagcagagggcgcac

SEQ ID NO: 322363 - RNA, 22 nt, Human
caaugauguuuagauaaaaucc

SEQ ID NO: 322364 - RNA, 22 nt, Human
cccuguacagucucuguggcac

SEQ ID NO: 322365 - RNA, 22 nt, Human
uguauacauucucuuggguuug

SEQ ID NO: 322366 - RNA, 22 nt, Human
auaugaagucagacaaacuggg

SEQ ID NO: 322367 - RNA, 22 nt, Human
aaggcagcaccgccuccugaaa

SEQ ID NO: 322368 - RNA, 22 nt, Human
ccagcuuguuugaagcucguca

SEQ ID NO: 322369 - RNA, 22 nt, Human
agggcagagggugccucaccug

SEQ ID NO: 322370 - RNA, 19 nt, Human
ucugcuggcagaauucccu

SEQ ID NO: 322371 - RNA, 18 nt, Human
cucugggagaggcauaca

SEQ ID NO: 322372 - RNA, 22 nt, Human
acagacauuuucuguauugccu

SEQ ID NO: 322373 - RNA, 22 nt, Human
aaccauuugcaguuacugagac

SEQ ID NO: 322374 - RNA, 22 nt, Human
cuugcuggugguguuuucuaug

SEQ ID NO: 322375 - RNA, 22 nt, Human
uccuggcccacuaugccagcau

SEQ ID NO: 322376 - RNA, 22 nt, Human
agccccaguccgcugcgggcgg

SEQ ID NO: 322377 - RNA, 22 nt, Human
uccuggagggaggcggugcuac

SEQ ID NO: 322378 - RNA, 19 nt, Human
ucucagagcccuagaggcc

SEQ ID NO: 322379 - RNA, 22 nt, Human
gagaugaauguaaacaaaggca

SEQ ID NO: 322380 - RNA, 22 nt, Human
gcgaaaaauguguaaauauguu

SEQ ID NO: 322381 - RNA, 22 nt, Human
uucaguuucagucuugcaaaaa

SEQ ID NO: 322382 - RNA, 22 nt, Human
ggcugaaggaugaaagcugcag

SEQ ID NO: 322383 - RNA, 22 nt, Human
uaacacauuuuccucauacgga

SEQ ID NO: 322384 - RNA, 22 nt, Human
ccuggaaguuggagguugcagu

SEQ ID NO: 322385 - RNA, 22 nt, Human
aagauacugaugauguaggcua

SEQ ID NO: 322386 - RNA, 22 nt, Human
cugccugugugugccugcagaa

SEQ ID NO: 322387 - RNA, 21 nt, Human
aaggcagaagcauggaaugag

SEQ ID NO: 322388 - RNA, 22 nt, Human
uugaaagucacaauggcauuaa

SEQ ID NO: 322389 - RNA, 22 nt, Human
uggcuucaucugcagcacugcc

SEQ ID NO: 322390 - RNA, 22 nt, Human
cauuucugcagaauugcucuuc

SEQ ID NO: 322391 - RNA, 22 nt, Human
agugaaauaugcccauugcugu

SEQ ID NO: 322392 - RNA, 22 nt, Human
uguuuuguuuaugagagcacag

SEQ ID NO: 322393 - RNA, 22 nt, Human
agcugcagucaagcugggccac

SEQ ID NO: 322394 - RNA, 22 nt, Human
aauagguagccagauauauaaa

SEQ ID NO: 322395 - RNA, 22 nt, Human
aaaauacacauacuaggggaaa

SEQ ID NO: 322396 - RNA, 22 nt, Human
cugugaggcccugggugcugga

SEQ ID NO: 322397 - RNA, 22 nt, Human
aggaagcccuugucauuucugu

SEQ ID NO: 322398 - RNA, 22 nt, Human
ggcugccuugacccuggcuccg

SEQ ID NO: 322399 - RNA, 22 nt, Human
gcucccagaaccaaggcugggg

SEQ ID NO: 322400 - RNA, 22 nt, Human
caggaugaagggcaaaggcaag

SEQ ID NO: 322401 - RNA, 22 nt, Human
ucuguucacugagcaauggcaa

SEQ ID NO: 322402 - RNA, 22 nt, Human
aauuuggcagugucuugaagua

SEQ ID NO: 322403 - RNA, 22 nt, Human
uccaggaggguuuucugccuuc

SEQ ID NO: 322404 - RNA, 22 nt, Human
ucagcagggcugugguguggcu

SEQ ID NO: 322405 - RNA, 22 nt, Human
gcuggcaggguucucacugaaa

SEQ ID NO: 322406 - RNA, 22 nt, Human
agcuccugaaaagcgcuugcuu

SEQ ID NO: 322407 - RNA, 22 nt, Human
gcagggcagccacaggcccccu

SEQ ID NO: 322408 - RNA, 22 nt, Human
agcagcugcagagggcuccccc

SEQ ID NO: 322409 - RNA, 23 nt, Human
aauguauguuaguaucuuagaga

SEQ ID NO: 322410 - RNA, 22 nt, Human
uccaguccuagaaacuggagag

SEQ ID NO: 322411 - RNA, 22 nt, Human
uagagugguuaacaguuuagaa

SEQ ID NO: 322412 - RNA, 22 nt, Human
uccagccaugacucggacagug

SEQ ID NO: 322413 - RNA, 22 nt, Human
uaggagaggugaauggcacacu

SEQ ID NO: 322414 - RNA, 22 nt, Human
cucuucuugucucugguuagaa

SEQ ID NO: 322415 - RNA, 22 nt, Human
ggaggcugagaaguccaagauc

SEQ ID NO: 322416 - RNA, 22 nt, Human
gccuggcacauugcaguggauu

SEQ ID NO: 322417 - RNA, 22 nt, Human
gaggccaaucaauagggcaaua

SEQ ID NO: 322418 - RNA, 22 nt, Human
caguggguggcuaaguggcuga

SEQ ID NO: 322419 - RNA, 22 nt, Human
uggcuggcccugggagugcaga

SEQ ID NO: 322420 - RNA, 22 nt, Human
cugccuggguucaaguccuguu

SEQ ID NO: 322421 - RNA, 22 nt, Human
uaucuguucaauggaagaugac

SEQ ID NO: 322422 - RNA, 22 nt, Human
gcugcucuugaggggcucacug

SEQ ID NO: 322423 - RNA, 22 nt, Human
aauaugugagguauguucagug

SEQ ID NO: 322424 - RNA, 22 nt, Human
aaggcacugagccagccgucuc

SEQ ID NO: 322425 - RNA, 22 nt, Human
uccuuuuugguccaaggugacc

SEQ ID NO: 322426 - RNA, 22 nt, Human
gaaccaaguaggauacaaggag

SEQ ID NO: 322427 - RNA, 22 nt, Human
gagcacaggcuuugguggacac

SEQ ID NO: 322428 - RNA, 22 nt, Human
cuuccuggccauugccauggca

SEQ ID NO: 322429 - RNA, 22 nt, Human
agccuuguuggucugaguuugg

SEQ ID NO: 322430 - RNA, 22 nt, Human
ucccugcucagcucaccuggca

SEQ ID NO: 322431 - RNA, 17 nt, Human
gucugggcuuuagagac

SEQ ID NO: 322432 - RNA, 22 nt, Human
cuggagagaccgaaagaggcug

SEQ ID NO: 322433 - RNA, 22 nt, Human
cagggccuucguaaguguccgg

SEQ ID NO: 322434 - RNA, 22 nt, Human
aggcuucccaagcagcugcaaa

SEQ ID NO: 322435 - RNA, 17 nt, Human
ggcagagcugacagggc

SEQ ID NO: 322436 - RNA, 22 nt, Human
aguggcagaucucuggucugga

SEQ ID NO: 322437 - RNA, 22 nt, Human
aaaaucuaaguagcgaguaagg

SEQ ID NO: 322438 - RNA, 22 nt, Human
uuuccauauucugcgucugcca

SEQ ID NO: 322439 - RNA, 22 nt, Human
auuucuguugcuuauaaauuac

SEQ ID NO: 322440 - RNA, 22 nt, Human
cugugugcugaaaugcagugag

SEQ ID NO: 322441 - RNA, 22 nt, Human
aaauguauccuacuuccugagu

SEQ ID NO: 322442 - RNA, 22 nt, Human
ccaggggaaacagggagcacuc

SEQ ID NO: 322443 - RNA, 22 nt, Human
ucaugccacuuacaaaauaaug

SEQ ID NO: 322444 - RNA, 22 nt, Human
cucaccccuguaauuccagcac

SEQ ID NO: 322445 - RNA, 22 nt, Human
guggcuucuggcugggccucag

SEQ ID NO: 322446 - RNA, 22 nt, Human
ggcuccuguggcaagacagcuu

SEQ ID NO: 322447 - RNA, 22 nt, Human
caaaugauagagccgauuauca

SEQ ID NO: 322448 - RNA, 22 nt, Human
gagggauggugugagaggcuca

SEQ ID NO: 322449 - RNA, 22 nt, Human
auauucuugugauuauaaagua

SEQ ID NO: 322450 - RNA, 22 nt, Human
ggucccagcugcucaagaggcu

SEQ ID NO: 322451 - RNA, 22 nt, Human
uccugcagccauuagaggucaa

SEQ ID NO: 322452 - RNA, 19 nt, Human
gcuuuuuguugucaaaggu

SEQ ID NO: 322453 - RNA, 22 nt, Human
caaauguauucucacuucaggg

SEQ ID NO: 322454 - RNA, 22 nt, Human
aacaugaagguaggaugguuuu

SEQ ID NO: 322455 - RNA, 22 nt, Human
agggcagauggaacuuccccga

SEQ ID NO: 322456 - RNA, 22 nt, Human
guccucagggagucccagucau

SEQ ID NO: 322457 - RNA, 22 nt, Human
gcagugguccaguucacaccca

SEQ ID NO: 322458 - RNA, 21 nt, Human
uccuccuucaaguccuggccu

SEQ ID NO: 322459 - RNA, 22 nt, Human
aucauguuccagaaacagugau

SEQ ID NO: 322460 - RNA, 18 nt, Human
acugugguuuauguguag

SEQ ID NO: 322461 - RNA, 22 nt, Human
agcugggaggugggcagugaga

SEQ ID NO: 322462 - RNA, 22 nt, Human
ugaaggccagcucuuuaucagc

SEQ ID NO: 322463 - RNA, 22 nt, Human
agccucugguccucccucagcu

SEQ ID NO: 322464 - RNA, 22 nt, Human
gcagaggccaucaacuuugcca

SEQ ID NO: 322465 - RNA, 22 nt, Human
ccuccugggcuccugucugcac

SEQ ID NO: 322466 - RNA, 22 nt, Human
acuguguccuauuuccuugaca

SEQ ID NO: 322467 - RNA, 22 nt, Human
aaaggagacagucuuaccugga

SEQ ID NO: 322468 - RNA, 22 nt, Human
ugggaggacuugugggcuucau

SEQ ID NO: 322469 - RNA, 22 nt, Human
aaaguucuggcauuuucugucu

SEQ ID NO: 322470 - RNA, 22 nt, Human
aaugauggauuuagacaagcug

SEQ ID NO: 322471 - RNA, 18 nt, Human
auuuugaacaaugcugua

SEQ ID NO: 322472 - RNA, 22 nt, Human
agagcagguggcaacucuggga

SEQ ID NO: 322473 - RNA, 22 nt, Human
cugaaggagcauagucaguuuu

SEQ ID NO: 322474 - RNA, 22 nt, Human
aggcacaggccucagcacccag

SEQ ID NO: 322475 - RNA, 22 nt, Human
gagggggagaugugcacacacu

SEQ ID NO: 322476 - RNA, 22 nt, Human
gaaaucugcggugaggccugag

SEQ ID NO: 322477 - RNA, 21 nt, Human
cagaggggcuagccuggcugc

SEQ ID NO: 322478 - RNA, 22 nt, Human
gaagcagcaaguauaggacagg

SEQ ID NO: 322479 - RNA, 22 nt, Human
ggaggccagggacccagucagc

SEQ ID NO: 322480 - RNA, 22 nt, Human
ugcuuccuugagcucuccaauc

SEQ ID NO: 322481 - RNA, 22 nt, Human
gcugucccgaaccccugguaau

SEQ ID NO: 322482 - RNA, 22 nt, Human
uggcucaguuucaguccugguu

SEQ ID NO: 322483 - RNA, 22 nt, Human
augaggcaucugcagucacuag

SEQ ID NO: 322484 - RNA, 22 nt, Human
agcuccaggugcaagucauggu

SEQ ID NO: 322485 - RNA, 22 nt, Human
uuguuuuuaugaacauccagga

SEQ ID NO: 322486 - RNA, 22 nt, Human
auguauuucuauguagugaaga

SEQ ID NO: 322487 - RNA, 22 nt, Human
gucccucugugucccugcaguc

SEQ ID NO: 322488 - RNA, 22 nt, Human
uugaaagugccaaguccuagug

SEQ ID NO: 322489 - RNA, 22 nt, Human
ucccagcauaacaaacugcccg

SEQ ID NO: 322490 - RNA, 22 nt, Human
aggcuucccagcugagcucagc

SEQ ID NO: 322491 - RNA, 23 nt, Human
cagcccuggagaugugggaggca

SEQ ID NO: 322492 - RNA, 22 nt, Human
cagcugcuuuaguuuuccaucc

SEQ ID NO: 322493 - RNA, 22 nt, Human
caaauauuccagguacaucccu

SEQ ID NO: 322494 - RNA, 22 nt, Human
ggccagggggcuucagacucca

SEQ ID NO: 322495 - RNA, 22 nt, Human
aaguuuuaacaaguacuuacua

SEQ ID NO: 322496 - RNA, 22 nt, Human
augggaggaagagaagaugucu

SEQ ID NO: 322497 - RNA, 22 nt, Human
caagcagagacuagauagcugu

SEQ ID NO: 322498 - RNA, 22 nt, Human
ucacaccuguaaucccaggccu

SEQ ID NO: 322499 - RNA, 22 nt, Human
aggcugucugaccccagagccc

SEQ ID NO: 322500 - RNA, 22 nt, Human
auucuucacauggauaggaucu

SEQ ID NO: 322501 - RNA, 22 nt, Human
caucagcaggcaacacucuugg

SEQ ID NO: 322502 - RNA, 22 nt, Human
ggcuucucgugccgaagcaaga

SEQ ID NO: 322503 - RNA, 22 nt, Human
ugugaugguucacugggcauga

SEQ ID NO: 322504 - RNA, 22 nt, Human
guugaaagaucauguggcugcc

SEQ ID NO: 322505 - RNA, 22 nt, Human
ugucuguacaaauuuucugugu

SEQ ID NO: 322506 - RNA, 18 nt, Human
cggcagagugcuucuagc

SEQ ID NO: 322507 - RNA, 20 nt, Human
augugucuguaaacaacucu

SEQ ID NO: 322508 - RNA, 22 nt, Human
gaugcacugcaguauauacugu

SEQ ID NO: 322509 - RNA, 22 nt, Human
gccugaugagcuuccagcugag

SEQ ID NO: 322510 - RNA, 22 nt, Human
uucaaaggcaggauagcagcug

SEQ ID NO: 322511 - RNA, 22 nt, Human
cagagccccucagcucucuccc

SEQ ID NO: 322512 - RNA, 22 nt, Human
auugugcaaauauuaucuguag

SEQ ID NO: 322513 - RNA, 22 nt, Human
acagugaaugcccaagaaaagu

SEQ ID NO: 322514 - RNA, 22 nt, Human
uugcagcuucgagucuaucugu

SEQ ID NO: 322515 - RNA, 22 nt, Human
caugucuguguacacaugcaca

SEQ ID NO: 322516 - RNA, 22 nt, Human
agcagccagugggagugauaca

SEQ ID NO: 322517 - RNA, 23 nt, Human
aucauucuccaaucuggagcagg

SEQ ID NO: 322518 - RNA, 22 nt, Human
auuugucuuugagugcccugcu

SEQ ID NO: 322519 - RNA, 22 nt, Human
gcugggagaggcccugaaguga

SEQ ID NO: 322520 - RNA, 20 nt, Human
cugcuguguuauuguagaac

SEQ ID NO: 322521 - RNA, 22 nt, Human
gaaacugugaucguguucuggg

SEQ ID NO: 322522 - RNA, 22 nt, Human
ccauaagguuuggggccaugca

SEQ ID NO: 322523 - RNA, 22 nt, Human
ccaggguggcguagaugcuggg

SEQ ID NO: 322524 - RNA, 22 nt, Human
ucucaguguuaucuaucugccu

SEQ ID NO: 322525 - RNA, 22 nt, Human
ggcugccauaacagaguaccac

SEQ ID NO: 322526 - RNA, 22 nt, Human
acugaaggguaaugugggagcc

SEQ ID NO: 322527 - RNA, 23 nt, Human
uagaaugucauucaaugauaugg

SEQ ID NO: 322528 - RNA, 18 nt, Human
ugugaacacauuuuucug

SEQ ID NO: 322529 - RNA, 22 nt, Human
ggccagcagucacagggucaga

SEQ ID NO: 322530 - RNA, 22 nt, Human
cagcauuuggugaucaucuuaa

SEQ ID NO: 322531 - RNA, 22 nt, Human
aacccuggggcagcugcuaggg

SEQ ID NO: 322532 - RNA, 22 nt, Human
gggggacaggaugaauaucugu

SEQ ID NO: 322533 - RNA, 22 nt, Human
ucuuucaaugagcauucuuucc

SEQ ID NO: 322534 - RNA, 22 nt, Human
cugcuuugaaaauaaacuuguc

SEQ ID NO: 322535 - RNA, 22 nt, Human
gcugaaugaauguauuuuaaaa

SEQ ID NO: 322536 - RNA, 22 nt, Human
ucugucuccucugaggugccag

SEQ ID NO: 322537 - RNA, 22 nt, Human
gagaggccauggcugugcagug

SEQ ID NO: 322538 - RNA, 22 nt, Human
ugaucccaaucuuuccugcucc

SEQ ID NO: 322539 - RNA, 22 nt, Human
uggaggaaucagggcuuaggcu

SEQ ID NO: 322540 - RNA, 22 nt, Human
aaggucauuuuuuccucuguug

SEQ ID NO: 322541 - RNA, 21 nt, Human
ugcaggcaggcagagaugcug

SEQ ID NO: 322542 - RNA, 22 nt, Human
uugucugugaaauggaaauagu

SEQ ID NO: 322543 - RNA, 22 nt, Human
agcaggaggguuuuguagaguc

SEQ ID NO: 322544 - RNA, 22 nt, Human
ugaagcagagaauuugacaguc

SEQ ID NO: 322545 - RNA, 22 nt, Human
uggcagcuacagacagagguga

SEQ ID NO: 322546 - RNA, 22 nt, Human
gaagaacaccugcugcccagug

SEQ ID NO: 322547 - RNA, 22 nt, Human
gcaguguuauguuuucuauaau

SEQ ID NO: 322548 - RNA, 22 nt, Human
ggagacagugguagggccuaag

SEQ ID NO: 322549 - RNA, 22 nt, Human
agauguaguagugggucuuuua

SEQ ID NO: 322550 - RNA, 22 nt, Human
gaagagcuguagccugcucuuu

SEQ ID NO: 322551 - RNA, 19 nt, Human
gcagccaggugcucuaccu

SEQ ID NO: 322552 - RNA, 22 nt, Human
cacacucauuagucauuucucu

SEQ ID NO: 322553 - RNA, 19 nt, Human
ccuuugaaucaggacacuu

SEQ ID NO: 322554 - RNA, 22 nt, Human
uucucagauauuuacugagcau

SEQ ID NO: 322555 - RNA, 22 nt, Human
gcccagagagaugcuguagacc

SEQ ID NO: 322556 - RNA, 19 nt, Human
agcaccugugagagccugg

SEQ ID NO: 322557 - RNA, 22 nt, Human
gcucuccaaacccuguggcuuu

SEQ ID NO: 322558 - RNA, 22 nt, Human
uagauauguguuuauuaugcug

SEQ ID NO: 322559 - RNA, 22 nt, Human
gcuuccuggagggagagagcug

SEQ ID NO: 322560 - RNA, 22 nt, Human
uucuaacucuguuauguguuuc

SEQ ID NO: 322561 - RNA, 20 nt, Human
cugggcagguguuugaucuc

SEQ ID NO: 322562 - RNA, 22 nt, Human
ucauuuguugcuguuaccugag

SEQ ID NO: 322563 - RNA, 18 nt, Human
agggucagugucacuggc

SEQ ID NO: 322564 - RNA, 23 nt, Human
uacaugcuauaauuucacccuca

SEQ ID NO: 322565 - RNA, 22 nt, Human
ucuucucucauguaggagggaa

SEQ ID NO: 322566 - RNA, 22 nt, Human
aggcacugggggaugagcaagg

SEQ ID NO: 322567 - RNA, 22 nt, Human
cucucugaggaaggagcaucug

SEQ ID NO: 322568 - RNA, 22 nt, Human
caauagcagcuucugaaugcaa

SEQ ID NO: 322569 - RNA, 22 nt, Human
cagauccacccuuguagugaca

SEQ ID NO: 322570 - RNA, 22 nt, Human
ggugaaggcacaagagggcaag

SEQ ID NO: 322571 - RNA, 22 nt, Human
cuucuucauguauugauagucu

SEQ ID NO: 322572 - RNA, 22 nt, Human
ccugccuggagcugagugugga

SEQ ID NO: 322573 - RNA, 22 nt, Human
auugacaaucuacuauguucug

SEQ ID NO: 322574 - RNA, 22 nt, Human
caccaggcuggagugcagaggu

SEQ ID NO: 322575 - RNA, 22 nt, Human
gauuuccuugcauauugguaau

SEQ ID NO: 322576 - RNA, 19 nt, Human
ucagaggauuuggcuauga

SEQ ID NO: 322577 - RNA, 22 nt, Human
uuucuagucucgaucucuuaau

SEQ ID NO: 322578 - RNA, 22 nt, Human
ggugacugguuuaucuggcagu

SEQ ID NO: 322579 - RNA, 22 nt, Human
ucagagcugcccaugcaagggg

SEQ ID NO: 322580 - RNA, 22 nt, Human
uggcucagcuuuccccaucugg

SEQ ID NO: 322581 - RNA, 22 nt, Human
cugucagcacucuacuacagau

SEQ ID NO: 322582 - RNA, 22 nt, Human
cuccucacuuuccagacugggc

SEQ ID NO: 322583 - RNA, 22 nt, Human
cugugcaagcccaagauaaaac

SEQ ID NO: 322584 - RNA, 22 nt, Human
caucagcagucacaugaugcug

SEQ ID NO: 322585 - RNA, 22 nt, Human
gauuuccucacuaacauccauc

SEQ ID NO: 322586 - RNA, 22 nt, Human
agagcugcccacacagcagauu

SEQ ID NO: 322587 - RNA, 22 nt, Human
ucauccaguaccauggaaggca

SEQ ID NO: 322588 - RNA, 22 nt, Human
ccugcuguaaugugucuuuauu

SEQ ID NO: 322589 - RNA, 22 nt, Human
guguuuccucuagaagccaugg

SEQ ID NO: 322590 - RNA, 18 nt, Human
ucuuggaguaaugaucaa

SEQ ID NO: 322591 - RNA, 21 nt, Human
ucucugggaggacuugugaga

SEQ ID NO: 322592 - RNA, 21 nt, Human
gccugccugcgugacccucuu

SEQ ID NO: 322593 - RNA, 22 nt, Human
agcuugccucuuaaucaccuca

SEQ ID NO: 322594 - RNA, 22 nt, Human
gcucccaccuuugcuaucagua

SEQ ID NO: 322595 - RNA, 22 nt, Human
uuccuucucagcccucgaggau

SEQ ID NO: 322596 - RNA, 22 nt, Human
ccaggccugauugggaaucuug

SEQ ID NO: 322597 - RNA, 18 nt, Human
agagaugguguagaguuu

SEQ ID NO: 322598 - RNA, 22 nt, Human
aagcuggaacaucuugaggaag

SEQ ID NO: 322599 - RNA, 22 nt, Human
agucagugaaggcauugcucaa

SEQ ID NO: 322600 - RNA, 22 nt, Human
ccacccuuggguucggaggccg

SEQ ID NO: 322601 - RNA, 22 nt, Human
acccugggcuuggccugcucag

SEQ ID NO: 322602 - RNA, 22 nt, Human
ggaaagaggauaguggguaggu

SEQ ID NO: 322603 - RNA, 22 nt, Human
cccagcucaagcagagagcuaa

SEQ ID NO: 322604 - RNA, 22 nt, Human
ugagccuguggggugacaacca

SEQ ID NO: 322605 - RNA, 22 nt, Human
cucuguccacagguuugucccu

SEQ ID NO: 322606 - RNA, 22 nt, Human
agcaggugacagggcuguggug

SEQ ID NO: 322607 - RNA, 22 nt, Human
aauguguagauguugcauuccu

SEQ ID NO: 322608 - RNA, 22 nt, Human
uugauacaggcucuauuucauc

SEQ ID NO: 322609 - RNA, 22 nt, Human
agcugccacauggugucacugu

SEQ ID NO: 322610 - RNA, 22 nt, Human
uauuuagaugcauuuggauugc

SEQ ID NO: 322611 - RNA, 22 nt, Human
ucuuggagacucuuguauauuu

SEQ ID NO: 322612 - RNA, 22 nt, Human
gccugaagaacagcugugagga

SEQ ID NO: 322613 - RNA, 22 nt, Human
cugaggcuggggaagggaagug

SEQ ID NO: 322614 - RNA, 22 nt, Human
gcucugcuggagggaaagagaa

SEQ ID NO: 322615 - RNA, 22 nt, Human
caacugugaauuuuaugauacc

SEQ ID NO: 322616 - RNA, 22 nt, Human
guguaugaggggagaauguuuu

SEQ ID NO: 322617 - RNA, 20 nt, Human
cugugccuaaaccuccgggu

SEQ ID NO: 322618 - RNA, 22 nt, Human
gcugccaguguggcaugaugca

SEQ ID NO: 322619 - RNA, 22 nt, Human
auuugcuucugugaaaucaagu

SEQ ID NO: 322620 - RNA, 22 nt, Human
gacagagugcagggcuagaaga

SEQ ID NO: 322621 - RNA, 22 nt, Human
ccuugcugcgugcuagcacaga

SEQ ID NO: 322622 - RNA, 22 nt, Human
ucagggcaggacaguguaggcc

SEQ ID NO: 322623 - RNA, 22 nt, Human
ggcaccagggaaggaaggcugg

SEQ ID NO: 322624 - RNA, 22 nt, Human
ugagguggcuagggaggcacuc

SEQ ID NO: 322625 - RNA, 22 nt, Human
ucuuguccuaagagcuggauuc

SEQ ID NO: 322626 - RNA, 18 nt, Human
acaggccucaguccugca

SEQ ID NO: 322627 - RNA, 22 nt, Human
cccaucacagacacuggguuau

SEQ ID NO: 322628 - RNA, 19 nt, Human
guggccucggagcgcgcgg

SEQ ID NO: 322629 - RNA, 22 nt, Human
cacauauuguaguucaccagga

SEQ ID NO: 322630 - RNA, 22 nt, Human
cugggcaggagggcucuaugga

SEQ ID NO: 322631 - RNA, 17 nt, Human
uggcucugaggcugaau

SEQ ID NO: 322632 - RNA, 22 nt, Human
ucugagaguccaucuccaagcc

SEQ ID NO: 322633 - RNA, 22 nt, Human
cagugccaugucugagccccua

SEQ ID NO: 322634 - RNA, 22 nt, Human
cugggguggauggguccaaguu

SEQ ID NO: 322635 - RNA, 22 nt, Human
aucuggcuccuacacuugaaga

SEQ ID NO: 322636 - RNA, 22 nt, Human
uaaaucacuccuaauaaucagu

SEQ ID NO: 322637 - RNA, 22 nt, Human
ccacagggaacaugacagccuu

SEQ ID NO: 322638 - RNA, 22 nt, Human
uugucugaaagaucauuacauu

SEQ ID NO: 322639 - RNA, 23 nt, Human
gggagaauaugaggaugauggug

SEQ ID NO: 322640 - RNA, 22 nt, Human
gaaucacgguauucugcacggg

SEQ ID NO: 322641 - RNA, 22 nt, Human
agcuagaauauugaucugaaau

SEQ ID NO: 322642 - RNA, 22 nt, Human
gguggccucgguggugcacagg

SEQ ID NO: 322643 - RNA, 22 nt, Human
uaucuaaauggaauauuccaga

SEQ ID NO: 322644 - RNA, 17 nt, Human
ugaggccugcaucagug

SEQ ID NO: 322645 - RNA, 22 nt, Human
gcuccagguauuugcccuuuua

SEQ ID NO: 322646 - RNA, 22 nt, Human
agcagagcgccugcucagaggg

SEQ ID NO: 322647 - RNA, 22 nt, Human
cagcaugguggagcugcucuuu

SEQ ID NO: 322648 - RNA, 22 nt, Human
ggaggccaucuggcuggaggcu

SEQ ID NO: 322649 - RNA, 22 nt, Human
uccagccaccaccuugauugcc

SEQ ID NO: 322650 - RNA, 22 nt, Human
gcuuggggagcucaguguccuu

SEQ ID NO: 322651 - RNA, 22 nt, Human
gccugggagugcacagugaggu

SEQ ID NO: 322652 - RNA, 22 nt, Human
ugaugcugagccugggacugac

SEQ ID NO: 322653 - RNA, 22 nt, Human
aggaaaaucgagucuggaggca

SEQ ID NO: 322654 - RNA, 22 nt, Human
agagcagauggccagggggccu

SEQ ID NO: 322655 - RNA, 22 nt, Human
cagagacaaccugguagagaaa

SEQ ID NO: 322656 - RNA, 22 nt, Human
caaugugugcuuacaggccagu

SEQ ID NO: 322657 - RNA, 22 nt, Human
auagacauauggcuuuguuucu

SEQ ID NO: 322658 - RNA, 21 nt, Human
uucaaugaaaacaaagugagg

SEQ ID NO: 322659 - RNA, 20 nt, Human
ucucaggguucagcaaagua

SEQ ID NO: 322660 - RNA, 22 nt, Human
ccaaaguccuuucuccaccugc

SEQ ID NO: 322661 - RNA, 22 nt, Human
ugaacacauaaggcuuuccugu

SEQ ID NO: 322662 - RNA, 22 nt, Human
uuugaaagaauuuauguacuuu

SEQ ID NO: 322663 - RNA, 22 nt, Human
uuuaacagaugcuaugucuacc

SEQ ID NO: 322664 - RNA, 22 nt, Human
auggaagguccuacagagcgca

SEQ ID NO: 322665 - RNA, 22 nt, Human
ggccucacccaucggugccuuu

SEQ ID NO: 322666 - RNA, 22 nt, Human
uccuucaaagcuccuagugagc

SEQ ID NO: 322667 - RNA, 18 nt, Human
aguaguggguuuagcuuc

SEQ ID NO: 322668 - RNA, 22 nt, Human
gaggcagcugaaggagugacag

SEQ ID NO: 322669 - RNA, 22 nt, Human
acagagcuucccagccugagca

SEQ ID NO: 322670 - RNA, 22 nt, Human
uccucaugccgggucucacgcu

SEQ ID NO: 322671 - RNA, 22 nt, Human
uuccucuccucacaugagucac

SEQ ID NO: 322672 - RNA, 22 nt, Human
gauggcagcagcagccagggau

SEQ ID NO: 322673 - RNA, 22 nt, Human
cugggcucaagaagucuucccu

SEQ ID NO: 322674 - RNA, 22 nt, Human
ucuucaucucagauuaacagga

SEQ ID NO: 322675 - RNA, 21 nt, Human
ucccagggccaggugccauca

SEQ ID NO: 322676 - RNA, 22 nt, Human
caagagcuagacuuugucagga

SEQ ID NO: 322677 - RNA, 22 nt, Human
ucugcgcugccuugauccuugg

SEQ ID NO: 322678 - RNA, 22 nt, Human
ucuggccagugaaaugcagaau

SEQ ID NO: 322679 - RNA, 22 nt, Human
ccaggcugcucacaagcugccc

SEQ ID NO: 322680 - RNA, 22 nt, Human
ggaggaccugcuggcccugcaa

SEQ ID NO: 322681 - RNA, 22 nt, Human
gggccucucccuucucacgcau

SEQ ID NO: 322682 - RNA, 22 nt, Human
uccagcucuggcuuggcuagcu

SEQ ID NO: 322683 - RNA, 22 nt, Human
acauuucucuugaugucucuau

SEQ ID NO: 322684 - RNA, 22 nt, Human
augucuuuauaaauguauaaug

SEQ ID NO: 322685 - RNA, 22 nt, Human
gcccugggauuggguggaggcu

SEQ ID NO: 322686 - RNA, 22 nt, Human
ucuucaauuagauuuaccaauu

SEQ ID NO: 322687 - RNA, 22 nt, Human
agagacagaggcaauauagcuu

SEQ ID NO: 322688 - RNA, 22 nt, Human
uggcaucucaaacaggcagauu

SEQ ID NO: 322689 - RNA, 22 nt, Human
caagggugguauugggagcaua

SEQ ID NO: 322690 - RNA, 22 nt, Human
uggcagagucugggcuugggca

SEQ ID NO: 322691 - RNA, 22 nt, Human
uucacaggauauaugugcaggg

SEQ ID NO: 322692 - RNA, 22 nt, Human
aguggggacuuaugccagcauu

SEQ ID NO: 322693 - RNA, 22 nt, Human
cuguucaugcugauucuguaug

SEQ ID NO: 322694 - RNA, 19 nt, Human
acuuugcaugugugucuaa

SEQ ID NO: 322695 - RNA, 22 nt, Human
acuuguguaacacagaaagaac

SEQ ID NO: 322696 - RNA, 22 nt, Human
uaauucagggccagaaucccca

SEQ ID NO: 322697 - RNA, 22 nt, Human
cucccaggguagggagagacua

SEQ ID NO: 322698 - RNA, 22 nt, Human
auuaaauuggaucugcauaguu

SEQ ID NO: 322699 - RNA, 22 nt, Human
uggcccugcugggucagagcug

SEQ ID NO: 322700 - RNA, 23 nt, Human
uccucccaaauuucagccucauu

SEQ ID NO: 322701 - RNA, 22 nt, Human
uaaauuguuuucuagaaguugu

SEQ ID NO: 322702 - RNA, 22 nt, Human
cagaguguuucuuugggugggu

SEQ ID NO: 322703 - RNA, 22 nt, Human
aggcuucuacguggucccaggg

SEQ ID NO: 322704 - RNA, 22 nt, Human
ggagugaguacuggaguagcug

SEQ ID NO: 322705 - RNA, 22 nt, Human
uugauacaggccuucuagauga

SEQ ID NO: 322706 - RNA, 18 nt, Human
acauuucuaggugaaagc

SEQ ID NO: 322707 - RNA, 22 nt, Human
uucuccagaccuugugacuaug

SEQ ID NO: 322708 - RNA, 22 nt, Human
gcacagaaguaaaauacaaguc

SEQ ID NO: 322709 - RNA, 22 nt, Human
aagcaacucccuccucauuuuu

SEQ ID NO: 322710 - RNA, 22 nt, Human
ucagcugccuuucccaugcuag

SEQ ID NO: 322711 - RNA, 21 nt, Human
gaggccacuaauaggggcaga

SEQ ID NO: 322712 - RNA, 22 nt, Human
uggagcauauucuggagcuugg

SEQ ID NO: 322713 - RNA, 22 nt, Human
aguucuuuugugaacauaugcu

SEQ ID NO: 322714 - RNA, 22 nt, Human
uacuuccagcaaucugcauauu

SEQ ID NO: 322715 - RNA, 22 nt, Human
uacaaagugugcccaugcugag

SEQ ID NO: 322716 - RNA, 22 nt, Human
ucccagggcagcuguccagaag

SEQ ID NO: 322717 - RNA, 22 nt, Human
ggcagcugcaaaucugcucugu

SEQ ID NO: 322718 - RNA, 22 nt, Human
cuugucugugucggauaaaacu

SEQ ID NO: 322719 - RNA, 22 nt, Human
ucucucagaggccaggguccug

SEQ ID NO: 322720 - RNA, 22 nt, Human
ucuggcucucaacaaauauuua

SEQ ID NO: 322721 - RNA, 22 nt, Human
uuuauuaugauggacaccuucg

SEQ ID NO: 322722 - RNA, 22 nt, Human
auuccuugggaauuauugaaug

SEQ ID NO: 322723 - RNA, 22 nt, Human
agaaaaaucuuggcgcuugucu

SEQ ID NO: 322724 - RNA, 22 nt, Human
ggcaugggagugagcaaccuua

SEQ ID NO: 322725 - RNA, 22 nt, Human
cauuacauuucaaaauguuucc

SEQ ID NO: 322726 - RNA, 21 nt, Human
aaauguguuccauaaugcuuu

SEQ ID NO: 322727 - RNA, 21 nt, Human
gagugucuaauccaggcuguc

SEQ ID NO: 322728 - RNA, 20 nt, Human
uauuuguauuugggaaaguu

SEQ ID NO: 322729 - RNA, 22 nt, Human
acaggcuuacaggcugcaagua

SEQ ID NO: 322730 - RNA, 22 nt, Human
ugcaagcacucaaugcaaacag

SEQ ID NO: 322731 - RNA, 22 nt, Human
cauucugugauucuaaaucccu

SEQ ID NO: 322732 - RNA, 22 nt, Human
cagagggcucuuggcugccugc

SEQ ID NO: 322733 - RNA, 20 nt, Human
uuucuguaaggcauuaaucu

SEQ ID NO: 322734 - RNA, 22 nt, Human
cucuguccuaugcuugauagaa

SEQ ID NO: 322735 - RNA, 22 nt, Human
cagggcagaaggcacucuacuc

SEQ ID NO: 322736 - RNA, 21 nt, Human
ucauuuuuauugcuaccuugc

SEQ ID NO: 322737 - RNA, 22 nt, Human
aaaagucagucucuccuagcuc

SEQ ID NO: 322738 - RNA, 20 nt, Human
uuucugugcccaggucuguu

SEQ ID NO: 322739 - RNA, 22 nt, Human
uucaggaugcucagaguagucu

SEQ ID NO: 322740 - RNA, 22 nt, Human
ugggaaauguguuucuggacca

SEQ ID NO: 322741 - RNA, 19 nt, Human
gggaugggcccucacccuc

SEQ ID NO: 322742 - RNA, 21 nt, Human
ccccugggagcccugucagua

SEQ ID NO: 322743 - RNA, 22 nt, Human
gccagcagguugucaaggagcu

SEQ ID NO: 322744 - RNA, 22 nt, Human
cuuccuucugaagcauagaagc

SEQ ID NO: 322745 - RNA, 22 nt, Human
ugagccuggggccugggcagcg

SEQ ID NO: 322746 - RNA, 22 nt, Human
ucuggcucauacaagccugcaa

SEQ ID NO: 322747 - RNA, 22 nt, Human
gucugggguacuuucaucugau

SEQ ID NO: 322748 - RNA, 22 nt, Human
cggcagcaaaggaagccagguc

SEQ ID NO: 322749 - RNA, 22 nt, Human
ggcucagaaacuaaaggcgcug

SEQ ID NO: 322750 - RNA, 22 nt, Human
acagagcacauagauuggaguu

SEQ ID NO: 322751 - RNA, 20 nt, Human
uggagcuccagcguccaugu

SEQ ID NO: 322752 - RNA, 22 nt, Human
uggcucaggccuacgacgccuu

SEQ ID NO: 322753 - RNA, 22 nt, Human
aagggcagagggaaucccacau

SEQ ID NO: 322754 - RNA, 20 nt, Human
cagccuccacucacucagcu

SEQ ID NO: 322755 - RNA, 22 nt, Human
ucaggggacuuaggagagaagu

SEQ ID NO: 322756 - RNA, 22 nt, Human
ggaggccuagccagcuccaguu

SEQ ID NO: 322757 - RNA, 22 nt, Human
accugccuaucagcugccugcu

SEQ ID NO: 322758 - RNA, 21 nt, Human
gagccuucccucugcccuuuc

SEQ ID NO: 322759 - RNA, 19 nt, Human
cagaugagaaaagugaggu

SEQ ID NO: 322760 - RNA, 22 nt, Human
ggagugucagaaacaguguccu

SEQ ID NO: 322761 - RNA, 22 nt, Human
aacuuaaacccacucauguaga

SEQ ID NO: 322762 - RNA, 22 nt, Human
aggcaggcucaggcccaugcuu

SEQ ID NO: 322763 - RNA, 22 nt, Human
uguaaauaaugcauguaaauca

SEQ ID NO: 322764 - RNA, 22 nt, Human
cagcaggguauacagggaauuu

SEQ ID NO: 322765 - RNA, 22 nt, Human
acaauucuggguauuuauauag

SEQ ID NO: 322766 - RNA, 22 nt, Human
caaaugcuaacuucuuuccaaa

SEQ ID NO: 322767 - RNA, 22 nt, Human
uccuucagggggccgccugcac

SEQ ID NO: 322768 - RNA, 22 nt, Human
agcucccauuaucuucugaaac

SEQ ID NO: 322769 - RNA, 22 nt, Human
gucaccagucccagcuccugaa

SEQ ID NO: 322770 - RNA, 22 nt, Human
uccagaggcuccaaagggagau

SEQ ID NO: 322771 - RNA, 22 nt, Human
aaaugcuguaacugauauucug

SEQ ID NO: 322772 - RNA, 22 nt, Human
uuugaaagggacaaagucacug

SEQ ID NO: 322773 - RNA, 22 nt, Human
ggagccagggaagcugcuuccu

SEQ ID NO: 322774 - RNA, 22 nt, Human
caggaaccuaaagagacauuac

SEQ ID NO: 322775 - RNA, 22 nt, Human
aaagcccauguggaaguacagg

SEQ ID NO: 322776 - RNA, 22 nt, Human
gcaguguuccuucuacuggggc

SEQ ID NO: 322777 - RNA, 22 nt, Human
gcugaagcccacguggcuugua

SEQ ID NO: 322778 - RNA, 22 nt, Human
aucagcaaguccuguuaauucu

SEQ ID NO: 322779 - RNA, 22 nt, Human
ugggauggcauccugggccuug

SEQ ID NO: 322780 - RNA, 22 nt, Human
gggagucugggcuagacuccuu

SEQ ID NO: 322781 - RNA, 19 nt, Human
ugcauaaauuauauacuuu

SEQ ID NO: 322782 - RNA, 22 nt, Human
cugaagcaaaggaucgagcuaa

SEQ ID NO: 322783 - RNA, 22 nt, Human
gcuggcagucccaucagcuggg

SEQ ID NO: 322784 - RNA, 22 nt, Human
agggcagacuaggauggaagug

SEQ ID NO: 322785 - RNA, 22 nt, Human
ugcuuuauuuauaaaauagcaa

SEQ ID NO: 322786 - RNA, 22 nt, Human
gcugcccaguucugcugcugcc

SEQ ID NO: 322787 - RNA, 20 nt, Human
aagggcagagggaacagacu

SEQ ID NO: 322788 - RNA, 18 nt, Human
ggcugugcguggaggcug

SEQ ID NO: 322789 - RNA, 20 nt, Human
agcccaggccugugugaguc

SEQ ID NO: 322790 - RNA, 22 nt, Human
uugaauaguguuuucaguauac

SEQ ID NO: 322791 - RNA, 22 nt, Human
aaaguuguucaguaagaaacuc

SEQ ID NO: 322792 - RNA, 22 nt, Human
agggccuggaacugugggcagg

SEQ ID NO: 322793 - RNA, 22 nt, Human
ccucagaggugaacaucagugc

SEQ ID NO: 322794 - RNA, 22 nt, Human
aggccucacucucagagcuucu

SEQ ID NO: 322795 - RNA, 22 nt, Human
ugagccagaggaggcugugugg

SEQ ID NO: 322796 - RNA, 22 nt, Human
gugucccaggccucuggaauua

SEQ ID NO: 322797 - RNA, 22 nt, Human
ugugaaauucuugaaaugcaca

SEQ ID NO: 322798 - RNA, 22 nt, Human
agggggugcuacuuccagaguu

SEQ ID NO: 322799 - RNA, 22 nt, Human
ggcaccagggcaagggucuuuc

SEQ ID NO: 322800 - RNA, 22 nt, Human
aggguggggugcuacaucuuua

SEQ ID NO: 322801 - RNA, 22 nt, Human
gcuccucuauuccccacauuuu

SEQ ID NO: 322802 - RNA, 22 nt, Human
gaggaaaagagacagguuauug

SEQ ID NO: 322803 - RNA, 22 nt, Human
ggcuggcaagugucugcucaug

SEQ ID NO: 322804 - RNA, 22 nt, Human
cuucucagaggccagaagcuau

SEQ ID NO: 322805 - RNA, 22 nt, Human
acagguggcuuauuggcugauu

SEQ ID NO: 322806 - RNA, 22 nt, Human
caggaggcccaaagggcgcaga

SEQ ID NO: 322807 - RNA, 22 nt, Human
cuuaaauuggaugaguuaaguu

SEQ ID NO: 322808 - RNA, 22 nt, Human
aaggcucuuggagugaaugcag

SEQ ID NO: 322809 - RNA, 22 nt, Human
agcuuuauauuuaaugaauucu

SEQ ID NO: 322810 - RNA, 22 nt, Human
uccagccccggcuuccuuacag

SEQ ID NO: 322811 - RNA, 22 nt, Human
acacccagagcgccagugccga

SEQ ID NO: 322812 - RNA, 22 nt, Human
cugcuguguuucugcuagaaaa

SEQ ID NO: 322813 - RNA, 22 nt, Human
aguugucccggucuagccacuu

SEQ ID NO: 322814 - RNA, 22 nt, Human
aaucuguucuacucuauucaga

SEQ ID NO: 322815 - RNA, 22 nt, Human
aggagaguucacacuggucaga

SEQ ID NO: 322816 - RNA, 22 nt, Human
gaggaaccaaaucagcuugcac

SEQ ID NO: 322817 - RNA, 22 nt, Human
uuggaaggugagucccuggguu

SEQ ID NO: 322818 - RNA, 22 nt, Human
cauagaaacuugcagcaagcac

SEQ ID NO: 322819 - RNA, 22 nt, Human
cuugccuguggcuaguuggcuc

SEQ ID NO: 322820 - RNA, 18 nt, Human
ugaucuuugaguauaaug

SEQ ID NO: 322821 - RNA, 18 nt, Human
aucuuuccauagcauguu

SEQ ID NO: 322822 - RNA, 22 nt, Human
agcagcauguugggaugugaaa

SEQ ID NO: 322823 - RNA, 23 nt, Human
ugcaugugaauucauacuuguuu

SEQ ID NO: 322824 - RNA, 22 nt, Human
cugaaggacacgugaggagcca

SEQ ID NO: 322825 - RNA, 22 nt, Human
auagacauggucuuuugucauu

SEQ ID NO: 322826 - RNA, 22 nt, Human
caagagcauuuaguuagcuggu

SEQ ID NO: 322827 - RNA, 19 nt, Human
aaaugugaugguacaauuc

SEQ ID NO: 322828 - RNA, 22 nt, Human
gcaguguucagugaagcaggag

SEQ ID NO: 322829 - RNA, 22 nt, Human
gcagggccagggcucaggcugu

SEQ ID NO: 322830 - RNA, 22 nt, Human
auguguagaacuguaaugccca

SEQ ID NO: 322831 - RNA, 22 nt, Human
uccuggagccacggagcuuuca

SEQ ID NO: 322832 - RNA, 22 nt, Human
ggcacagggagccgcaguugca

SEQ ID NO: 322833 - RNA, 22 nt, Human
agagcuuauaucuuggccaucc

SEQ ID NO: 322834 - RNA, 22 nt, Human
uuugaaugcaggacauacagaa

SEQ ID NO: 322835 - RNA, 22 nt, Human
gaguguggugaacaggagcacc

SEQ ID NO: 322836 - RNA, 22 nt, Human
gccaggcagcugggagggugcc

SEQ ID NO: 322837 - RNA, 22 nt, Human
ucaaaaguuucacauagagaua

SEQ ID NO: 322838 - RNA, 22 nt, Human
cugcugugggcaggguagcugg

SEQ ID NO: 322839 - RNA, 22 nt, Human
gcuguucagaugcgauucagga

SEQ ID NO: 322840 - RNA, 22 nt, Human
gcagccacccucaaggcugaau

SEQ ID NO: 322841 - RNA, 22 nt, Human
cugaggaugguguggucuucuc

SEQ ID NO: 322842 - RNA, 22 nt, Human
cacagguguaugaauaugucca

SEQ ID NO: 322843 - RNA, 22 nt, Human
ucaccugggagggcugugguag

SEQ ID NO: 322844 - RNA, 22 nt, Human
uauuugaaggcauacauuuuga

SEQ ID NO: 322845 - RNA, 22 nt, Human
ucagcagggagaggagaaugca

SEQ ID NO: 322846 - RNA, 22 nt, Human
cuuucauaaaggaaaugaugag

SEQ ID NO: 322847 - RNA, 22 nt, Human
cucaggacccgguccagguggg

SEQ ID NO: 322848 - RNA, 22 nt, Human
uacuuugucauucuaaccuucc

SEQ ID NO: 322849 - RNA, 22 nt, Human
uccauuuuguagguaugcuaca

SEQ ID NO: 322850 - RNA, 22 nt, Human
uucacagaauggcaaguuaugg

SEQ ID NO: 322851 - RNA, 22 nt, Human
cgcugccaggucaccaggggua

SEQ ID NO: 322852 - RNA, 22 nt, Human
gaagucuucauucucucugaga

SEQ ID NO: 322853 - RNA, 22 nt, Human
gggcugagggguaucucauggg

SEQ ID NO: 322854 - RNA, 22 nt, Human
agcuggguguguaucagauaaa

SEQ ID NO: 322855 - RNA, 22 nt, Human
gaggugaguggaucacgagguc

SEQ ID NO: 322856 - RNA, 22 nt, Human
uuaaagggccgauuuccaggcc

SEQ ID NO: 322857 - RNA, 22 nt, Human
cauuuguuaauuacuauuaucu

SEQ ID NO: 322858 - RNA, 22 nt, Human
ugcagccuugccuccucccagc

SEQ ID NO: 322859 - RNA, 23 nt, Human
ggccucuguguucugcccacaug

SEQ ID NO: 322860 - RNA, 21 nt, Human
agccuguugguuuacugcuca

SEQ ID NO: 322861 - RNA, 23 nt, Human
cuuugccacccagagccugacag

SEQ ID NO: 322862 - RNA, 22 nt, Human
ucagggcaagauugguuaauaa

SEQ ID NO: 322863 - RNA, 22 nt, Human
uauuucagacacugaucuugca

SEQ ID NO: 322864 - RNA, 18 nt, Human
cagcagagacauucaaaa

SEQ ID NO: 322865 - RNA, 22 nt, Human
ucugggaaguccucugucaugc

SEQ ID NO: 322866 - RNA, 22 nt, Human
uuucagugcuucuguuuaccgg

SEQ ID NO: 322867 - RNA, 22 nt, Human
auucuucacauaagugcuguac

SEQ ID NO: 322868 - RNA, 22 nt, Human
aagccagggucaggggccuccu

SEQ ID NO: 322869 - RNA, 23 nt, Human
ccaggccucucagagggugugcc

SEQ ID NO: 322870 - RNA, 22 nt, Human
uccucaggaugugggguagaau

SEQ ID NO: 322871 - RNA, 22 nt, Human
ccaggagcaggagcuggacaga

SEQ ID NO: 322872 - RNA, 22 nt, Human
ugaagcaacuggacaaguuggc

SEQ ID NO: 322873 - RNA, 23 nt, Human
agaagcagcuucuggaguaucgg

SEQ ID NO: 322874 - RNA, 22 nt, Human
ucaucacauaugucaugauuug

SEQ ID NO: 322875 - RNA, 23 nt, Human
ugggaguguugggaucucugcuc

SEQ ID NO: 322876 - RNA, 22 nt, Human
cagggcaguuugugccuaugag

SEQ ID NO: 322877 - RNA, 22 nt, Human
aagugagugguaaggagcaugg

SEQ ID NO: 322878 - RNA, 22 nt, Human
aagccuuccugagugcaaggcc

SEQ ID NO: 322879 - RNA, 22 nt, Human
agcaggaguuugaugcuuuuau

SEQ ID NO: 322880 - RNA, 22 nt, Human
aagccaggcaugcuuggacagu

SEQ ID NO: 322881 - RNA, 22 nt, Human
uuguuauaaagacuaaauaugu

SEQ ID NO: 322882 - RNA, 22 nt, Human
aguaaugugccugaaauacuug

SEQ ID NO: 322883 - RNA, 22 nt, Human
uugaaucuggguacuuguaaua

SEQ ID NO: 322884 - RNA, 17 nt, Human
ugagaaguaggcaucau

SEQ ID NO: 322885 - RNA, 22 nt, Human
gccuuucaguuccaucaaagga

SEQ ID NO: 322886 - RNA, 23 nt, Human
ccugucugugcuggguggacaca

SEQ ID NO: 322887 - RNA, 20 nt, Human
uuucaguuaucuugaccuuc

SEQ ID NO: 322888 - RNA, 22 nt, Human
uauuuucaucuuguccuuggau

SEQ ID NO: 322889 - RNA, 23 nt, Human
cccuggaguaaauucuuggaagg

SEQ ID NO: 322890 - RNA, 22 nt, Human
aaagaacaaauuagcuguuuua

SEQ ID NO: 322891 - RNA, 23 nt, Human
auguuauuauuagcagucuugcc

SEQ ID NO: 322892 - RNA, 22 nt, Human
aaagauaauguuuccuuauucu

SEQ ID NO: 322893 - RNA, 22 nt, Human
cuccauugaacauccucucaga

SEQ ID NO: 322894 - RNA, 22 nt, Human
agaaaucauucccaaacccaua

SEQ ID NO: 322895 - RNA, 22 nt, Human
gagaggaguaggcugauggugc

SEQ ID NO: 322896 - RNA, 22 nt, Human
ucagugcuuauauucugagccu

SEQ ID NO: 322897 - RNA, 23 nt, Human
gugagucuugccuuugcugugga

SEQ ID NO: 322898 - RNA, 22 nt, Human
cccuggagggacagcugcucua

SEQ ID NO: 322899 - RNA, 22 nt, Human
ggcuggcauccagggaaaucca

SEQ ID NO: 322900 - RNA, 22 nt, Human
gcagcugccuauucagggcuug

SEQ ID NO: 322901 - RNA, 22 nt, Human
ucucaggguuuguacaagugua

SEQ ID NO: 322902 - RNA, 22 nt, Human
agccagccgggggaccacagug

SEQ ID NO: 322903 - RNA, 21 nt, Human
uggcagggguaguaguacagc

SEQ ID NO: 322904 - RNA, 22 nt, Human
ucuggagauaagacagacagau

SEQ ID NO: 322905 - RNA, 22 nt, Human
cagaggcugcucuggguggcau

SEQ ID NO: 322906 - RNA, 22 nt, Human
aauuuuaagcauaugacugguu

SEQ ID NO: 322907 - RNA, 22 nt, Human
ccaggagccacucaggcccaca

SEQ ID NO: 322908 - RNA, 22 nt, Human
uuuccucuuccgagggggaggc

SEQ ID NO: 322909 - RNA, 22 nt, Human
uugaaggacaucuuguuucuag

SEQ ID NO: 322910 - RNA, 22 nt, Human
guucuuccucauugcuuugaag

SEQ ID NO: 322911 - RNA, 22 nt, Human
uagcagcuuaaguaauuagaau

SEQ ID NO: 322912 - RNA, 22 nt, Human
aaguuacaggagaaagagauca

SEQ ID NO: 322913 - RNA, 22 nt, Human
uguccucuaauuggccucuugc

SEQ ID NO: 322914 - RNA, 22 nt, Human
gggcugcuuccuggggaaugcu

SEQ ID NO: 322915 - RNA, 22 nt, Human
ggcugugcgggcagccguggga

SEQ ID NO: 322916 - RNA, 22 nt, Human
ucuugaaggggggcaguguuga

SEQ ID NO: 322917 - RNA, 23 nt, Human
ggguccagagacaggcaugggug

SEQ ID NO: 322918 - RNA, 23 nt, Human
ucuguucaaggcuuucuccuuga

SEQ ID NO: 322919 - RNA, 22 nt, Human
aaauugugagcuauagaucuag

SEQ ID NO: 322920 - RNA, 22 nt, Human
ugcagauucaaaugaaaugcaa

SEQ ID NO: 322921 - RNA, 22 nt, Human
uaguaacagauuuauacagucu

SEQ ID NO: 322922 - RNA, 22 nt, Human
ugaacaguuucaagaaaacuuu

SEQ ID NO: 322923 - RNA, 22 nt, Human
ggauggcagucugcaugagaaa

SEQ ID NO: 322924 - RNA, 22 nt, Human
ugaaaggugacauuucuuggau

SEQ ID NO: 322925 - RNA, 22 nt, Human
ggucccaggauugguugcgcag

SEQ ID NO: 322926 - RNA, 22 nt, Human
ggcugcaguuugucuuuugcuu

SEQ ID NO: 322927 - RNA, 22 nt, Human
agucugggagaaggugagauua

SEQ ID NO: 322928 - RNA, 22 nt, Human
cagcaguggaacuacccaggga

SEQ ID NO: 322929 - RNA, 22 nt, Human
cagcauggcuugaguguuuccu

SEQ ID NO: 322930 - RNA, 22 nt, Human
guauucuugguuaucaaaauac

SEQ ID NO: 322931 - RNA, 22 nt, Human
uauugucuguccgggucaaagc

SEQ ID NO: 322932 - RNA, 22 nt, Human
agugguaacuaaguccugcuua

SEQ ID NO: 322933 - RNA, 22 nt, Human
ggagccagaggcugcugcugug

SEQ ID NO: 322934 - RNA, 22 nt, Human
gcagagccaggagcccaggauc

SEQ ID NO: 322935 - RNA, 22 nt, Human
aucuggcucauucagggaacgg

SEQ ID NO: 322936 - RNA, 22 nt, Human
aguugacauccauaacaggaag

SEQ ID NO: 322937 - RNA, 22 nt, Human
ccuugcugaccaucaccuuuga

SEQ ID NO: 322938 - RNA, 22 nt, Human
ugcuggagaucauuaauguuca

SEQ ID NO: 322939 - RNA, 22 nt, Human
ccugccaggacauugcuugaag

SEQ ID NO: 322940 - RNA, 22 nt, Human
gcucagaggaugcuccuuuaug

SEQ ID NO: 322941 - RNA, 22 nt, Human
uagcauuuauuccagauuugga

SEQ ID NO: 322942 - RNA, 22 nt, Human
aaggcugagagucacaguccua

SEQ ID NO: 322943 - RNA, 22 nt, Human
cucugggcaaagaugccucauc

SEQ ID NO: 322944 - RNA, 23 nt, Human
ugcagagggacugaagccagcuu

SEQ ID NO: 322945 - RNA, 22 nt, Human
acuggcugaaguuuacuuuuug

SEQ ID NO: 322946 - RNA, 22 nt, Human
uacauuugcuuugauuuucagc

SEQ ID NO: 322947 - RNA, 22 nt, Human
auacacauguguaugugcaugc

SEQ ID NO: 322948 - RNA, 23 nt, Human
gccucagagaaacagcugcacac

SEQ ID NO: 322949 - RNA, 22 nt, Human
cucuuuccaggguaccccaggu

SEQ ID NO: 322950 - RNA, 22 nt, Human
cagcccugagaaggaggaucuc

SEQ ID NO: 322951 - RNA, 22 nt, Human
guuaaauucgaugauggauaaa

SEQ ID NO: 322952 - RNA, 22 nt, Human
cagccugacaccagcuuugggc

SEQ ID NO: 322953 - RNA, 22 nt, Human
ugaggggcggccugcagaggcc

SEQ ID NO: 322954 - RNA, 22 nt, Human
aaaguuugucacuuggcuagaa

SEQ ID NO: 322955 - RNA, 22 nt, Human
guguuccauguuugagguaguu

SEQ ID NO: 322956 - RNA, 22 nt, Human
acacugaauauacaaugaauau

SEQ ID NO: 322957 - RNA, 22 nt, Human
ccaggaggcggaagguacagug

SEQ ID NO: 322958 - RNA, 22 nt, Human
cuacauuuguucuauagcuuuu

SEQ ID NO: 322959 - RNA, 22 nt, Human
gagcugcccugagcuuugcaug

SEQ ID NO: 322960 - RNA, 22 nt, Human
ccucaguguguuuggggugagg

SEQ ID NO: 322961 - RNA, 22 nt, Human
agcagagccagaauuggaccag

SEQ ID NO: 322962 - RNA, 22 nt, Human
gugcuuucugcugcauuccucu

SEQ ID NO: 322963 - RNA, 22 nt, Human
uggcucugugcuucuaguaucu

SEQ ID NO: 322964 - RNA, 22 nt, Human
agaggucagaacaggaaagugu

SEQ ID NO: 322965 - RNA, 22 nt, Human
gucuuuggagaggugccauuuc

SEQ ID NO: 322966 - RNA, 19 nt, Human
ugcagaagacacaguggug

SEQ ID NO: 322967 - RNA, 22 nt, Human
ucagggcauggcugcacuuggc

SEQ ID NO: 322968 - RNA, 22 nt, Human
uuguaauuugcaaauguauugu

SEQ ID NO: 322969 - RNA, 22 nt, Human
uccagggcuuggcugggacggu

SEQ ID NO: 322970 - RNA, 22 nt, Human
ggcccugagcugaaguacugug

SEQ ID NO: 322971 - RNA, 21 nt, Human
agcugcuuucagcuccuagag

SEQ ID NO: 322972 - RNA, 22 nt, Human
uacauucuggaaaggcacagac

SEQ ID NO: 322973 - RNA, 22 nt, Human
ccuuucucuaucgacccaucgc

SEQ ID NO: 322974 - RNA, 22 nt, Human
ucagcugaguucuagagcacuc

SEQ ID NO: 322975 - RNA, 22 nt, Human
ucaggcacugcuuucugauaug

SEQ ID NO: 322976 - RNA, 22 nt, Human
cauuaaaauaucucaugguguu

SEQ ID NO: 322977 - RNA, 21 nt, Human
ucugggggugagccuagaaau

SEQ ID NO: 322978 - RNA, 22 nt, Human
aaggcagcagugcacgacugau

SEQ ID NO: 322979 - RNA, 22 nt, Human
auaucacaguaguuguuuaguu

SEQ ID NO: 322980 - RNA, 22 nt, Human
cucagcuggcaauucuggcucc

SEQ ID NO: 322981 - RNA, 22 nt, Human
augaaacacacacgcgcauacu

SEQ ID NO: 322982 - RNA, 22 nt, Human
ucugugacuugcgggaggagaa

SEQ ID NO: 322983 - RNA, 17 nt, Human
gagauggguggaucacc

SEQ ID NO: 322984 - RNA, 22 nt, Human
ugggggugacuaucucgggaau

SEQ ID NO: 322985 - RNA, 19 nt, Human
acagagcucucugcuucug

SEQ ID NO: 322986 - RNA, 22 nt, Human
uuaaauuuuagaaacagacucu

SEQ ID NO: 322987 - RNA, 22 nt, Human
aucaguuuuuauuaauguagcu

SEQ ID NO: 322988 - RNA, 22 nt, Human
aguccagggcuuagucagcggg

SEQ ID NO: 322989 - RNA, 22 nt, Human
uuugcauuuuagauuuaggccu

SEQ ID NO: 322990 - RNA, 17 nt, Human
ugcauuguuggaaauuu

SEQ ID NO: 322991 - RNA, 22 nt, Human
gggcugcugcccaggaggcacc

SEQ ID NO: 322992 - RNA, 22 nt, Human
ucuacagacagagcagguggga

SEQ ID NO: 322993 - RNA, 22 nt, Human
gagucacauuaauuuaauuuua

SEQ ID NO: 322994 - RNA, 22 nt, Human
accagagcuggcucugagcacc

SEQ ID NO: 322995 - RNA, 22 nt, Human
gggagcuguaguccagauaccg

SEQ ID NO: 322996 - RNA, 22 nt, Human
ccucugccugcacaucauccug

SEQ ID NO: 322997 - RNA, 22 nt, Human
aaugggaggauuuucucucuug

SEQ ID NO: 322998 - RNA, 22 nt, Human
agacuucucaguuuuauuagua

SEQ ID NO: 322999 - RNA, 20 nt, Human
gggcuggcgcauggggaaag

SEQ ID NO: 323000 - RNA, 22 nt, Human
aggcccuggguuagggcccacu

SEQ ID NO: 323001 - RNA, 22 nt, Human
agccacagagcaggagaccuuu

SEQ ID NO: 323002 - RNA, 22 nt, Human
ucuccuuugaaaguuaggacug

SEQ ID NO: 323003 - RNA, 22 nt, Human
gcucaguguuucugguagaaaa

SEQ ID NO: 323004 - RNA, 22 nt, Human
auuucuuuucaagagggugcuu

SEQ ID NO: 323005 - RNA, 22 nt, Human
acacagggcagagagcuggcuc

SEQ ID NO: 323006 - RNA, 22 nt, Human
ugauuucaaguagugacaugcu

SEQ ID NO: 323007 - RNA, 22 nt, Human
cuugaaucuggcuuugccacuu

SEQ ID NO: 323008 - RNA, 22 nt, Human
uugaagaggacuuugcagcugu

SEQ ID NO: 323009 - RNA, 23 nt, Human
auuugagaaaguauuuuuaagac

SEQ ID NO: 323010 - RNA, 22 nt, Human
gcucagugaauuuuugcccaug

SEQ ID NO: 323011 - RNA, 22 nt, Human
ccuaagaauuaaugaauacacc

SEQ ID NO: 323012 - RNA, 23 nt, Human
uccagcagagccuuccaggaggg

SEQ ID NO: 323013 - RNA, 22 nt, Human
gauuucuuuagguguaauagug

SEQ ID NO: 323014 - RNA, 22 nt, Human
cacagguguucuugcagugaaa

SEQ ID NO: 323015 - RNA, 22 nt, Human
ucauuuugggguuugucaucuu

SEQ ID NO: 323016 - RNA, 20 nt, Human
acagaaagagagaaugucag

SEQ ID NO: 323017 - RNA, 23 nt, Human
gcagauggccccagagugcugcc

SEQ ID NO: 323018 - RNA, 22 nt, Human
agagcuggugcauauucagaaa

SEQ ID NO: 323019 - RNA, 22 nt, Human
cagaaccaggaacugauggaga

SEQ ID NO: 323020 - RNA, 22 nt, Human
ucucagugcagcuugacagaga

SEQ ID NO: 323021 - RNA, 22 nt, Human
uuucacagguacaaacacuccu

SEQ ID NO: 323022 - RNA, 22 nt, Human
cagagccaggguugcaccccug

SEQ ID NO: 323023 - RNA, 22 nt, Human
ccugcagcuguaggagaaggcg

SEQ ID NO: 323024 - RNA, 22 nt, Human
ccagcccuugagauggaaggga

SEQ ID NO: 323025 - RNA, 22 nt, Human
ccagccagucccgcaugaccgc

SEQ ID NO: 323026 - RNA, 22 nt, Human
ccaggccugugcaaggagggag

SEQ ID NO: 323027 - RNA, 22 nt, Human
cauugcacagcccuguggugau

SEQ ID NO: 323028 - RNA, 22 nt, Human
gggcacuguggggcccaugcug

SEQ ID NO: 323029 - RNA, 22 nt, Human
gaaaguuuauagguuauauaau

SEQ ID NO: 323030 - RNA, 22 nt, Human
ugacuucaaaggcucuacuccu

SEQ ID NO: 323031 - RNA, 22 nt, Human
caaggccacguucugcaugcgg

SEQ ID NO: 323032 - RNA, 22 nt, Human
gacagccaugcacuucugcugu

SEQ ID NO: 323033 - RNA, 22 nt, Human
uguggcugacuccuggucccca

SEQ ID NO: 323034 - RNA, 22 nt, Human
gaugguuuggaaugaaguagcu

SEQ ID NO: 323035 - RNA, 22 nt, Human
guccucugggagccuugagccu

SEQ ID NO: 323036 - RNA, 19 nt, Human
cucugccucuggcuguggc

SEQ ID NO: 323037 - RNA, 22 nt, Human
auucaaguggcugcuauguuaa

SEQ ID NO: 323038 - RNA, 22 nt, Human
uuggaaagcaagcuggacauac

SEQ ID NO: 323039 - RNA, 22 nt, Human
cucuggaguucucaugaggaac

SEQ ID NO: 323040 - RNA, 22 nt, Human
cugugcuugcggguguggagcc

SEQ ID NO: 323041 - RNA, 22 nt, Human
aucaguuuguauaugaaacacu

SEQ ID NO: 323042 - RNA, 22 nt, Human
uuucucuugcgauaugcuacac

SEQ ID NO: 323043 - RNA, 22 nt, Human
ugaagguggcauaggagagaug

SEQ ID NO: 323044 - RNA, 22 nt, Human
ugguuuauuucucugaaagguu

SEQ ID NO: 323045 - RNA, 22 nt, Human
ggaaccaguggaaugauaugcu

SEQ ID NO: 323046 - RNA, 22 nt, Human
agagauggagagcacuggggcu

SEQ ID NO: 323047 - RNA, 22 nt, Human
auaauuuaaauuaguaugugau

SEQ ID NO: 323048 - RNA, 22 nt, Human
ucucuggaguauaaccagggau

SEQ ID NO: 323049 - RNA, 22 nt, Human
uuaagauagaacccaguagucu

SEQ ID NO: 323050 - RNA, 22 nt, Human
augggaggguggaaaggcucug

SEQ ID NO: 323051 - RNA, 22 nt, Human
auuugucucugcacuuuacuca

SEQ ID NO: 323052 - RNA, 22 nt, Human
ucugucacccgagcaggcgaga

SEQ ID NO: 323053 - RNA, 22 nt, Human
augcaguacugauacaugccac

SEQ ID NO: 323054 - RNA, 22 nt, Human
gccuaggaguacagaaugguuu

SEQ ID NO: 323055 - RNA, 22 nt, Human
agucucagaaaauaugcuuuuu

SEQ ID NO: 323056 - RNA, 19 nt, Human
cugagcagcggcagcacuu

SEQ ID NO: 323057 - RNA, 22 nt, Human
aguguuuaaugccuuuuccagc

SEQ ID NO: 323058 - RNA, 20 nt, Human
uggcuccucuuggcuguggc

SEQ ID NO: 323059 - RNA, 22 nt, Human
cagggcugagaauuuagagaca

SEQ ID NO: 323060 - RNA, 22 nt, Human
ugcuucugggcaaaugugugug

SEQ ID NO: 323061 - RNA, 22 nt, Human
uggccuccccuaacagccucuu

SEQ ID NO: 323062 - RNA, 22 nt, Human
ggaagggccucgggcgugggac

SEQ ID NO: 323063 - RNA, 22 nt, Human
uuuacauggaauauugucuugu

SEQ ID NO: 323064 - RNA, 22 nt, Human
auugaggcagcauaguucaggg

SEQ ID NO: 323065 - RNA, 22 nt, Human
aagaaagggcuauuguucucca

SEQ ID NO: 323066 - RNA, 22 nt, Human
gcauucuuuuuaggagguuccu

SEQ ID NO: 323067 - RNA, 22 nt, Human
uuaugaaagacauuucuguugg

SEQ ID NO: 323068 - RNA, 22 nt, Human
uuccaguucccaugaggauuaa

SEQ ID NO: 323069 - RNA, 22 nt, Human
agagcagagggcucugggacaa

SEQ ID NO: 323070 - RNA, 22 nt, Human
accaggaggccuggagcacaaa

SEQ ID NO: 323071 - RNA, 22 nt, Human
aaaaauguuaucuacuguccga

SEQ ID NO: 323072 - RNA, 22 nt, Human
gggcuucucuuaugcuaacugg

SEQ ID NO: 323073 - RNA, 22 nt, Human
cugcucucuguuccccuggauc

SEQ ID NO: 323074 - RNA, 22 nt, Human
cauuugcagagggugacacucu

SEQ ID NO: 323075 - RNA, 22 nt, Human
ugagccagucugucugggugaa

SEQ ID NO: 323076 - RNA, 22 nt, Human
gcagcuggaagugacacucugu

SEQ ID NO: 323077 - RNA, 22 nt, Human
uuucuucucgacaccuuauccc

SEQ ID NO: 323078 - RNA, 22 nt, Human
gaaggggaaaguugagcaaaua

SEQ ID NO: 323079 - RNA, 22 nt, Human
gggugcugacuggggccugaaa

SEQ ID NO: 323080 - RNA, 22 nt, Human
ugccccucuccugugauccaag

SEQ ID NO: 323081 - RNA, 22 nt, Human
ugagcuggggucagcuccccug

SEQ ID NO: 323082 - RNA, 22 nt, Human
gugcuuccugccuggugccuuu

SEQ ID NO: 323083 - RNA, 22 nt, Human
cagaguguugaccauaagccca

SEQ ID NO: 323084 - RNA, 22 nt, Human
ccaggccuggaccaugccaggg

SEQ ID NO: 323085 - RNA, 22 nt, Human
aagaagagaaaugugcugcugg

SEQ ID NO: 323086 - RNA, 21 nt, Human
ccagcagcucaaggaucucuu

SEQ ID NO: 323087 - RNA, 22 nt, Human
guggcccaggcuuggcgcuggc

SEQ ID NO: 323088 - RNA, 21 nt, Human
ugccagcauguaggcuaguug

SEQ ID NO: 323089 - RNA, 22 nt, Human
uguguaaagcuuguuccagaaa

SEQ ID NO: 323090 - RNA, 22 nt, Human
uucaugaauggaaucaaugcuc

SEQ ID NO: 323091 - RNA, 22 nt, Human
gcagggacaacugugcaccuga

SEQ ID NO: 323092 - RNA, 22 nt, Human
cugucuccagggcaggugcagg

SEQ ID NO: 323093 - RNA, 22 nt, Human
gcucuguccagcgugcacagaa

SEQ ID NO: 323094 - RNA, 22 nt, Human
uuccuuaggcuguuugcagugc

SEQ ID NO: 323095 - RNA, 22 nt, Human
augcuguggaaguuccugaagc

SEQ ID NO: 323096 - RNA, 21 nt, Human
uggcucugcucagagcagucc

SEQ ID NO: 323097 - RNA, 22 nt, Human
uuugaaagacagaauauuuuug

SEQ ID NO: 323098 - RNA, 22 nt, Human
caggagcccguugcuccggcgg

SEQ ID NO: 323099 - RNA, 22 nt, Human
aaauagaaaccaacaaggucag

SEQ ID NO: 323100 - RNA, 22 nt, Human
auaucuuuguaugguucagcag

SEQ ID NO: 323101 - RNA, 19 nt, Human
ccugggagucagcugaagg

SEQ ID NO: 323102 - RNA, 22 nt, Human
cagcagcccacgcgugcugucc

SEQ ID NO: 323103 - RNA, 22 nt, Human
cugggcugcaguuccugguccu

SEQ ID NO: 323104 - RNA, 22 nt, Human
ucccagcgcggggggaggaucc

SEQ ID NO: 323105 - RNA, 21 nt, Human
agcagccauuucacagagacu

SEQ ID NO: 323106 - RNA, 22 nt, Human
guggcugcuguccucucugguu

SEQ ID NO: 323107 - RNA, 22 nt, Human
accuuucauuaaagucuguagu

SEQ ID NO: 323108 - RNA, 22 nt, Human
ggcuucagugacuggugcccuc

SEQ ID NO: 323109 - RNA, 22 nt, Human
aggcucagagaugaguaagcac

SEQ ID NO: 323110 - RNA, 22 nt, Human
cagagccacuuggagaugagaa

SEQ ID NO: 323111 - RNA, 22 nt, Human
cacaugaguccugccagguaug

SEQ ID NO: 323112 - RNA, 22 nt, Human
ucagaggaccuuacugagaacc

SEQ ID NO: 323113 - RNA, 22 nt, Human
caguacuuugcaucauuccacu

SEQ ID NO: 323114 - RNA, 22 nt, Human
ccugccugauuccaggauggcu

SEQ ID NO: 323115 - RNA, 22 nt, Human
caguguacuuggaauguaacag

SEQ ID NO: 323116 - RNA, 22 nt, Human
gcuggagcuugagaggacaggg

SEQ ID NO: 323117 - RNA, 22 nt, Human
gcagcuggugcaaaugucacuc

SEQ ID NO: 323118 - RNA, 22 nt, Human
cugccuguuagucuagcaguua

SEQ ID NO: 323119 - RNA, 22 nt, Human
ccagcugcagguguuccagaug

SEQ ID NO: 323120 - RNA, 20 nt, Human
uuucaagucagcaauucuca

SEQ ID NO: 323121 - RNA, 22 nt, Human
uggagcccagggugagaaggag

SEQ ID NO: 323122 - RNA, 22 nt, Human
cauuguuauagcauuacacacc

SEQ ID NO: 323123 - RNA, 22 nt, Human
uuugaaagcuacuuucggguca

SEQ ID NO: 323124 - RNA, 22 nt, Human
ccagcucugccaagcgucagcu

SEQ ID NO: 323125 - RNA, 22 nt, Human
aggagcugucagagugccagag

SEQ ID NO: 323126 - RNA, 22 nt, Human
ccagccaguccagcauuggugu

SEQ ID NO: 323127 - RNA, 22 nt, Human
ggcagucagugugguucauaaa

SEQ ID NO: 323128 - RNA, 22 nt, Human
agagggcauuaacucugucuug

SEQ ID NO: 323129 - RNA, 22 nt, Human
uuccucugaaauggcuuggaaa

SEQ ID NO: 323130 - RNA, 22 nt, Human
aaaauauuuuagggccaggaga

SEQ ID NO: 323131 - RNA, 22 nt, Human
ucagcaguguaguuuaucauuc

SEQ ID NO: 323132 - RNA, 22 nt, Human
ucauugcagaaauaaaggugaa

SEQ ID NO: 323133 - RNA, 22 nt, Human
uaaguucauaagcuuauucuua

SEQ ID NO: 323134 - RNA, 22 nt, Human
ucuuuuggguucuuaugauuua

SEQ ID NO: 323135 - RNA, 22 nt, Human
ugcugcugauggcaccuaggca

SEQ ID NO: 323136 - RNA, 22 nt, Human
gccugccugcugugugcaaguu

SEQ ID NO: 323137 - RNA, 22 nt, Human
guggguggaucaccugagguca

SEQ ID NO: 323138 - RNA, 22 nt, Human
cacagugugggcauggugccug

SEQ ID NO: 323139 - RNA, 22 nt, Human
cagugggcugugauggauucac

SEQ ID NO: 323140 - RNA, 22 nt, Human
ccuuugggugaauuccucucuu

SEQ ID NO: 323141 - RNA, 22 nt, Human
caaggagauaaaauguugagcu

SEQ ID NO: 323142 - RNA, 22 nt, Human
uaaagauggagaugaccuagga

SEQ ID NO: 323143 - RNA, 19 nt, Human
auuccucaaggacagaaau

SEQ ID NO: 323144 - RNA, 22 nt, Human
ugguaauuaauuugauagguuc

SEQ ID NO: 323145 - RNA, 22 nt, Human
guggccucugugcuccugccua

SEQ ID NO: 323146 - RNA, 22 nt, Human
cuggugcaggaaggagcuggca

SEQ ID NO: 323147 - RNA, 22 nt, Human
uacauguaggugacauuuuaau

SEQ ID NO: 323148 - RNA, 22 nt, Human
acaacaaaaucacuagucuucc

SEQ ID NO: 323149 - RNA, 23 nt, Human
acucagugaagcaaacagauagu

SEQ ID NO: 323150 - RNA, 22 nt, Human
ugaagcagauggucuggucauu

SEQ ID NO: 323151 - RNA, 22 nt, Human
uccugccuagcaggugaccuau

SEQ ID NO: 323152 - RNA, 22 nt, Human
cugucucugucuuaacucccag

SEQ ID NO: 323153 - RNA, 22 nt, Human
acacaaauuguaggauaauugc

SEQ ID NO: 323154 - RNA, 22 nt, Human
auguuagaaucucugaaugugg

SEQ ID NO: 323155 - RNA, 21 nt, Human
ucucuacacuuucacuaggcu

SEQ ID NO: 323156 - RNA, 22 nt, Human
ggcuggaaguccaagaucaaga

SEQ ID NO: 323157 - RNA, 22 nt, Human
uucucagguagugcugaugcug

SEQ ID NO: 323158 - RNA, 22 nt, Human
agcugagagguggcaagcugua

SEQ ID NO: 323159 - RNA, 23 nt, Human
aaagacugcugagaauuuuagga

SEQ ID NO: 323160 - RNA, 22 nt, Human
cagguccuggcaucaggcaggu

SEQ ID NO: 323161 - RNA, 22 nt, Human
ggcugcuucucacucauuugca

SEQ ID NO: 323162 - RNA, 23 nt, Human
ugaaggccuggaggacgcguugu

SEQ ID NO: 323163 - RNA, 22 nt, Human
aaaggcuaugagauagaagaua

SEQ ID NO: 323164 - RNA, 22 nt, Human
ucuggccacccgaggccccugc

SEQ ID NO: 323165 - RNA, 22 nt, Human
gaugcacuugccccuccucaga

SEQ ID NO: 323166 - RNA, 22 nt, Human
ucccagagccucugccacucug

SEQ ID NO: 323167 - RNA, 22 nt, Human
gucuucuuguuuugaaggaaau

SEQ ID NO: 323168 - RNA, 22 nt, Human
ucugggcagcagcagcuaguag

SEQ ID NO: 323169 - RNA, 22 nt, Human
ucuuuacaucacaauuguaugg

SEQ ID NO: 323170 - RNA, 22 nt, Human
ccucaggauacaggagccacag

SEQ ID NO: 323171 - RNA, 22 nt, Human
acagugucugacacauuguagc

SEQ ID NO: 323172 - RNA, 22 nt, Human
uaaggagagaauuuagagguuu

SEQ ID NO: 323173 - RNA, 22 nt, Human
uggcugaaucugcagcaggaag

SEQ ID NO: 323174 - RNA, 22 nt, Human
ucuuugcaacucccauuuccau

SEQ ID NO: 323175 - RNA, 22 nt, Human
gagagucacugucugcauuucc

SEQ ID NO: 323176 - RNA, 22 nt, Human
aaaggucaagcuggacucaggu

SEQ ID NO: 323177 - RNA, 22 nt, Human
acccagagccagggucaggagc

SEQ ID NO: 323178 - RNA, 22 nt, Human
guuagaaacacauucuuauuga

SEQ ID NO: 323179 - RNA, 21 nt, Human
caggccccaggccuggggugc

SEQ ID NO: 323180 - RNA, 22 nt, Human
ugcagcucauugcuggggucug

SEQ ID NO: 323181 - RNA, 22 nt, Human
uacaauauguggccuuuuguga

SEQ ID NO: 323182 - RNA, 22 nt, Human
gcagagcugucuaagucacuuc

SEQ ID NO: 323183 - RNA, 22 nt, Human
uucuuaacucaaauauauaucc

SEQ ID NO: 323184 - RNA, 22 nt, Human
uauuccaagcacagcaacccag

SEQ ID NO: 323185 - RNA, 22 nt, Human
cagaccugagguugaguaccag

SEQ ID NO: 323186 - RNA, 22 nt, Human
acguuuucagccuuaauguaga

SEQ ID NO: 323187 - RNA, 22 nt, Human
uggcugggcccccaccugccuc

SEQ ID NO: 323188 - RNA, 22 nt, Human
gcuggccugcaaagcccggcug

SEQ ID NO: 323189 - RNA, 22 nt, Human
ugggccugugaugcugggcuau

SEQ ID NO: 323190 - RNA, 22 nt, Human
acauguggucaaucuguguagg

SEQ ID NO: 323191 - RNA, 22 nt, Human
augaaacaguguguauagcaaa

SEQ ID NO: 323192 - RNA, 22 nt, Human
ugccucuguggaaauggugguc

SEQ ID NO: 323193 - RNA, 23 nt, Human
gggauauggaccuuggaggaguc

SEQ ID NO: 323194 - RNA, 22 nt, Human
ugcauauuguccuugauauuau

SEQ ID NO: 323195 - RNA, 19 nt, Human
ucaaugcaugaaaucagcc

SEQ ID NO: 323196 - RNA, 22 nt, Human
uucucagagcacugcugacaaa

SEQ ID NO: 323197 - RNA, 22 nt, Human
gcucucuguuauuaagaucuuu

SEQ ID NO: 323198 - RNA, 22 nt, Human
ugcaugcagcuggugauaagaa

SEQ ID NO: 323199 - RNA, 22 nt, Human
gugauaaagacgugucauaauu

SEQ ID NO: 323200 - RNA, 22 nt, Human
ccacagaggacaacugccuggc

SEQ ID NO: 323201 - RNA, 22 nt, Human
aaugaugguauugaugagcuaa

SEQ ID NO: 323202 - RNA, 22 nt, Human
cugggcacaaguggcccuggau

SEQ ID NO: 323203 - RNA, 23 nt, Human
aggagaagagauuuccacaugca

SEQ ID NO: 323204 - RNA, 18 nt, Human
agaauugcugcuucuucu

SEQ ID NO: 323205 - RNA, 22 nt, Human
cugggcagaauuuuaggauggc

SEQ ID NO: 323206 - RNA, 22 nt, Human
uccagggagauggcagaggcug

SEQ ID NO: 323207 - RNA, 22 nt, Human
cugcucugcagcuuggacuccc

SEQ ID NO: 323208 - RNA, 20 nt, Human
aagggagaauaaugauugua

SEQ ID NO: 323209 - RNA, 22 nt, Human
aagcugccugccacgcuagaua

SEQ ID NO: 323210 - RNA, 22 nt, Human
cccugccuacaggguuuucuuu

SEQ ID NO: 323211 - RNA, 22 nt, Human
agauacauauagaaaacaucaa

SEQ ID NO: 323212 - RNA, 22 nt, Human
ggaagggaguaguuggaaugca

SEQ ID NO: 323213 - RNA, 22 nt, Human
cugguggagaugccuggccccu

SEQ ID NO: 323214 - RNA, 22 nt, Human
gagccuccuccuggugugccga

SEQ ID NO: 323215 - RNA, 22 nt, Human
aaagguuaagguguucaagaaa

SEQ ID NO: 323216 - RNA, 22 nt, Human
uagaaaugcaguguacuguguc

SEQ ID NO: 323217 - RNA, 22 nt, Human
gcaggcagagguggaggagaca

SEQ ID NO: 323218 - RNA, 22 nt, Human
ucagcucuaccugggagcuguc

SEQ ID NO: 323219 - RNA, 22 nt, Human
acugcagccuugaacucugggc

SEQ ID NO: 323220 - RNA, 22 nt, Human
agaccuggauuccaauccuacc

SEQ ID NO: 323221 - RNA, 22 nt, Human
aucagcaaaaaugccuucagaa

SEQ ID NO: 323222 - RNA, 22 nt, Human
aaaugucuuugaguauuucugc

SEQ ID NO: 323223 - RNA, 22 nt, Human
aaaugaugauuaaaaugaggua

SEQ ID NO: 323224 - RNA, 22 nt, Human
gcuccacuugcagcuaggcuug

SEQ ID NO: 323225 - RNA, 19 nt, Human
ggucucagugcagcugcag

SEQ ID NO: 323226 - RNA, 22 nt, Human
acuggcagagacccugauggcc

SEQ ID NO: 323227 - RNA, 22 nt, Human
uucauuccuucccuaagcaacu

SEQ ID NO: 323228 - RNA, 22 nt, Human
guguggcuaccucagaggagca

SEQ ID NO: 323229 - RNA, 22 nt, Human
cuggggggagcugcguccagca

SEQ ID NO: 323230 - RNA, 22 nt, Human
ucugggggaggaggcauggccc

SEQ ID NO: 323231 - RNA, 22 nt, Human
augcugucgaaaccaaacaucu

SEQ ID NO: 323232 - RNA, 22 nt, Human
uguuacacagcagaauagcaag

SEQ ID NO: 323233 - RNA, 22 nt, Human
gcagaggcuccauuuuacagau

SEQ ID NO: 323234 - RNA, 22 nt, Human
agugucuuugucucucaagcac

SEQ ID NO: 323235 - RNA, 22 nt, Human
aaugauguauuaguacaacaca

SEQ ID NO: 323236 - RNA, 22 nt, Human
aauauuguuucaagaucacaga

SEQ ID NO: 323237 - RNA, 22 nt, Human
agaagugccauacuguggucca

SEQ ID NO: 323238 - RNA, 22 nt, Human
agggcagaaguacagacacuua

SEQ ID NO: 323239 - RNA, 20 nt, Human
gucucaaguaucucacaguc

SEQ ID NO: 323240 - RNA, 22 nt, Human
caggcagccugagggaucuggg

SEQ ID NO: 323241 - RNA, 22 nt, Human
cccagcccaucucaaaggucua

SEQ ID NO: 323242 - RNA, 22 nt, Human
uaaauucccaacucugcucuuc

SEQ ID NO: 323243 - RNA, 22 nt, Human
uggcagagaacacggcugaucu

SEQ ID NO: 323244 - RNA, 22 nt, Human
cauauucuuuaagcaaugcucu

SEQ ID NO: 323245 - RNA, 22 nt, Human
acagcuguggggacucuugccc

SEQ ID NO: 323246 - RNA, 23 nt, Human
ccagcucccaggucugaggacug

SEQ ID NO: 323247 - RNA, 21 nt, Human
ccugcugugaucuuagugagu

SEQ ID NO: 323248 - RNA, 22 nt, Human
uuaaaaugaauauugauuagca

SEQ ID NO: 323249 - RNA, 22 nt, Human
uuacaguuuaguccaagccaga

SEQ ID NO: 323250 - RNA, 22 nt, Human
gcagcuggucuggccuagagua

SEQ ID NO: 323251 - RNA, 17 nt, Human
cuggagccaagagggcc

SEQ ID NO: 323252 - RNA, 22 nt, Human
ugcugggggcuuucuggauacc

SEQ ID NO: 323253 - RNA, 22 nt, Human
aaugcuguaaagaugcuaucug

SEQ ID NO: 323254 - RNA, 22 nt, Human
ucccuggcagcuaagggugguc

SEQ ID NO: 323255 - RNA, 22 nt, Human
agaugacagccaaggagaugaa

SEQ ID NO: 323256 - RNA, 22 nt, Human
ucagaaaagguagcugugacaa

SEQ ID NO: 323257 - RNA, 22 nt, Human
ugggcagagaguagaggcaacg

SEQ ID NO: 323258 - RNA, 22 nt, Human
gccuuugcaccaucagugcaau

SEQ ID NO: 323259 - RNA, 22 nt, Human
agcagugaugcaugacagccua

SEQ ID NO: 323260 - RNA, 22 nt, Human
caggggccggcuguccgugccc

SEQ ID NO: 323261 - RNA, 22 nt, Human
uugcauaaaagaguauaucuua

SEQ ID NO: 323262 - RNA, 22 nt, Human
auacauguugagaaaauaucug

SEQ ID NO: 323263 - RNA, 22 nt, Human
aagagcuguaugccauaugauu

SEQ ID NO: 323264 - RNA, 22 nt, Human
uuuggaaaguguacaaauuuga

SEQ ID NO: 323265 - RNA, 22 nt, Human
ugcacacacaugaaguagcaug

SEQ ID NO: 323266 - RNA, 22 nt, Human
ccagggcaauuauuuggagggu

SEQ ID NO: 323267 - RNA, 20 nt, Human
gggagucuggaugaaagaug

SEQ ID NO: 323268 - RNA, 22 nt, Human
uccuuccugcaggccaaguccu

SEQ ID NO: 323269 - RNA, 22 nt, Human
ucaguguuuaccguauguuguu

SEQ ID NO: 323270 - RNA, 22 nt, Human
ucaguuuucaauuucaucagag

SEQ ID NO: 323271 - RNA, 22 nt, Human
gugucccaaucuacuuuucccu

SEQ ID NO: 323272 - RNA, 22 nt, Human
ucugagggugggagaaggagcu

SEQ ID NO: 323273 - RNA, 22 nt, Human
uuagccaugugggaaaaacagc

SEQ ID NO: 323274 - RNA, 22 nt, Human
ggccugagcuugggcagcguau

SEQ ID NO: 323275 - RNA, 22 nt, Human
uuauuuaaugugaucugaagag

SEQ ID NO: 323276 - RNA, 22 nt, Human
acagggcaccugagguaggaag

SEQ ID NO: 323277 - RNA, 21 nt, Human
uaauaauuccacuacagagua

SEQ ID NO: 323278 - RNA, 22 nt, Human
aaauauaguaaaugcauaguuc

SEQ ID NO: 323279 - RNA, 22 nt, Human
aaaguuuuagaacuaggaagca

SEQ ID NO: 323280 - RNA, 22 nt, Human
gagguggaaggcaggaacaaau

SEQ ID NO: 323281 - RNA, 22 nt, Human
acaguguucugaaaguugaggg

SEQ ID NO: 323282 - RNA, 22 nt, Human
ucauugaacgaagagcuccauu

SEQ ID NO: 323283 - RNA, 22 nt, Human
gaaggccauuuuuagguagaau

SEQ ID NO: 323284 - RNA, 22 nt, Human
uggcucaggguccccaaauggu

SEQ ID NO: 323285 - RNA, 22 nt, Human
ucaauaaaauuguuuuccuauc

SEQ ID NO: 323286 - RNA, 22 nt, Human
gucccagaugucuggaacuccc

SEQ ID NO: 323287 - RNA, 22 nt, Human
cucagaguccauaguuuacagu

SEQ ID NO: 323288 - RNA, 22 nt, Human
aaacucugccauuuuuggccug

SEQ ID NO: 323289 - RNA, 22 nt, Human
cugggcagugcagcuauagaac

SEQ ID NO: 323290 - RNA, 22 nt, Human
cuccaggauguuagacguccag

SEQ ID NO: 323291 - RNA, 22 nt, Human
ggagcugaugacgucaccaugg

SEQ ID NO: 323292 - RNA, 22 nt, Human
agugugucugaucacuugugag

SEQ ID NO: 323293 - RNA, 21 nt, Human
acaugucucuaaucucaguga

SEQ ID NO: 323294 - RNA, 22 nt, Human
cucccagagaccaagcugagaa

SEQ ID NO: 323295 - RNA, 22 nt, Human
agcugaguuaauucaucacuua

SEQ ID NO: 323296 - RNA, 21 nt, Human
ggucuuccaaauaaggagaaa

SEQ ID NO: 323297 - RNA, 22 nt, Human
uuuauugcauacacaaauguca

SEQ ID NO: 323298 - RNA, 22 nt, Human
ccucacugcuauguguuugcuc

SEQ ID NO: 323299 - RNA, 22 nt, Human
ugucuccucauacugucauauu

SEQ ID NO: 323300 - RNA, 22 nt, Human
acacaguaccccaaggcugggc

SEQ ID NO: 323301 - RNA, 22 nt, Human
gagcucccaggccccagcaagg

SEQ ID NO: 323302 - RNA, 22 nt, Human
cagggugggcacccagccucca

SEQ ID NO: 323303 - RNA, 22 nt, Human
agaggcuggauugagcauagac

SEQ ID NO: 323304 - RNA, 22 nt, Human
cccaggagguagagguugcagu

SEQ ID NO: 323305 - RNA, 22 nt, Human
gagagugagauccuccugggga

SEQ ID NO: 323306 - RNA, 22 nt, Human
uccucacaagcaagcacaggua

SEQ ID NO: 323307 - RNA, 21 nt, Human
cugagggccgcagcugggcuc

SEQ ID NO: 323308 - RNA, 22 nt, Human
uuauuuauuguguaccuacugu

SEQ ID NO: 323309 - RNA, 22 nt, Human
ggagcuggcagcgcaacccaga

SEQ ID NO: 323310 - RNA, 22 nt, Human
aagaagaugguuaacuuucagu

SEQ ID NO: 323311 - RNA, 22 nt, Human
agaggagguggugaugcuuuaa

SEQ ID NO: 323312 - RNA, 22 nt, Human
ugagauguaagguaugcuuacu

SEQ ID NO: 323313 - RNA, 22 nt, Human
cagggcagaacauauagauagu

SEQ ID NO: 323314 - RNA, 22 nt, Human
uguucaaaugaucuucuuaaau

SEQ ID NO: 323315 - RNA, 22 nt, Human
uuagagucaagcugcauguucu

SEQ ID NO: 323316 - RNA, 20 nt, Human
uggaaguucuguugcauugg

SEQ ID NO: 323317 - RNA, 22 nt, Human
ucugggcucugucagcaccucu

SEQ ID NO: 323318 - RNA, 22 nt, Human
uuauucuuuucuccagaauccc

SEQ ID NO: 323319 - RNA, 22 nt, Human
ugccuggguccaggccaagccu

SEQ ID NO: 323320 - RNA, 21 nt, Human
cgcagagcgaacuugcggcgc

SEQ ID NO: 323321 - RNA, 22 nt, Human
uuugcauuuauaaguuggugga

SEQ ID NO: 323322 - RNA, 22 nt, Human
agguauagaauugaaaggguuu

SEQ ID NO: 323323 - RNA, 22 nt, Human
ggcuucaccgcgggguugcagg

SEQ ID NO: 323324 - RNA, 22 nt, Human
ugggccugacucaccugccucc

SEQ ID NO: 323325 - RNA, 22 nt, Human
gaucuguuauaaucucuuuuau

SEQ ID NO: 323326 - RNA, 22 nt, Human
acaggcucuggggcaggauggc

SEQ ID NO: 323327 - RNA, 22 nt, Human
acaaagugaauugcaucgaguu

SEQ ID NO: 323328 - RNA, 22 nt, Human
gugcucuggcuggucucccggu

SEQ ID NO: 323329 - RNA, 22 nt, Human
ucccagugagguccuggcuguc

SEQ ID NO: 323330 - RNA, 22 nt, Human
aagacauugucauuuuauaauu

SEQ ID NO: 323331 - RNA, 22 nt, Human
aggccucagugaucaucaucag

SEQ ID NO: 323332 - RNA, 22 nt, Human
gaagcagcaaaucugcaguauc

SEQ ID NO: 323333 - RNA, 22 nt, Human
auguuggagucguaaggcaugg

SEQ ID NO: 323334 - RNA, 22 nt, Human
agagcugggugaagugccauca

SEQ ID NO: 323335 - RNA, 20 nt, Human
cugggaggucuuccaaauca

SEQ ID NO: 323336 - RNA, 22 nt, Human
cuggcugugcugcaggcuuugg

SEQ ID NO: 323337 - RNA, 22 nt, Human
aguucuggcggcugucggcacu

SEQ ID NO: 323338 - RNA, 21 nt, Human
agaugaggauacugaggccua

SEQ ID NO: 323339 - RNA, 22 nt, Human
gagaggccaccugacgagcagu

SEQ ID NO: 323340 - RNA, 22 nt, Human
uuuuauagcugaauaguauucc

SEQ ID NO: 323341 - RNA, 22 nt, Human
cagucucucuuguagugcagcu

SEQ ID NO: 323342 - RNA, 22 nt, Human
ucucacugcaaauauuauguau

SEQ ID NO: 323343 - RNA, 22 nt, Human
ugaaguccuagaacuccuggua

SEQ ID NO: 323344 - RNA, 22 nt, Human
guucucuaucauuagugaauuu

SEQ ID NO: 323345 - RNA, 19 nt, Human
uuuuccuucuauauguuuc

SEQ ID NO: 323346 - RNA, 22 nt, Human
aguuagaauagucagauuguag

SEQ ID NO: 323347 - RNA, 22 nt, Human
gagcugucuggggacucugggu

SEQ ID NO: 323348 - RNA, 22 nt, Human
ccagcagagucuaggaaggagg

SEQ ID NO: 323349 - RNA, 22 nt, Human
uaauccacaauagagauuaucu

SEQ ID NO: 323350 - RNA, 22 nt, Human
agauacaugucaagagacuuau

SEQ ID NO: 323351 - RNA, 22 nt, Human
guguuuuaagaaagaagcucag

SEQ ID NO: 323352 - RNA, 22 nt, Human
gcucuggacccuggaguggcug

SEQ ID NO: 323353 - RNA, 22 nt, Human
ucuuugaauuucugacugucuu

SEQ ID NO: 323354 - RNA, 22 nt, Human
aggaagccugcaggugacugcu

SEQ ID NO: 323355 - RNA, 22 nt, Human
ugcuggggagugauugaccauc

SEQ ID NO: 323356 - RNA, 22 nt, Human
auguaacuucugugaaucugac

SEQ ID NO: 323357 - RNA, 22 nt, Human
aaugcuguauaucuuagcuaau

SEQ ID NO: 323358 - RNA, 22 nt, Human
gcugauagacugaauguuggga

SEQ ID NO: 323359 - RNA, 22 nt, Human
auccuugaaugacucugcccuc

SEQ ID NO: 323360 - RNA, 22 nt, Human
uuccuuaguguuagauucugug

SEQ ID NO: 323361 - RNA, 22 nt, Human
acacaguauuacaauaggugcu

SEQ ID NO: 323362 - RNA, 22 nt, Human
auuuaugacuggugaauagaac

SEQ ID NO: 323363 - RNA, 20 nt, Human
acaguguuaguuaucaucuc

SEQ ID NO: 323364 - RNA, 22 nt, Human
ucucuucuaauuuucccgagua

SEQ ID NO: 323365 - RNA, 22 nt, Human
cccaccaguacagaugguagau

SEQ ID NO: 323366 - RNA, 22 nt, Human
gcucuccacugaccacggggca

SEQ ID NO: 323367 - RNA, 20 nt, Human
cugagagucugugcuuaguc

SEQ ID NO: 323368 - RNA, 20 nt, Human
augugagggguugaaguggg

SEQ ID NO: 323369 - RNA, 22 nt, Human
cacagggccacuuucccaguaa

SEQ ID NO: 323370 - RNA, 22 nt, Human
agucucuuuaaucacagugucu

SEQ ID NO: 323371 - RNA, 22 nt, Human
ugaggcagcuuuuucugugugu

SEQ ID NO: 323372 - RNA, 18 nt, Human
ggucuuuaggucaguguc

SEQ ID NO: 323373 - RNA, 22 nt, Human
agugcuuugagcguuugaaaag

SEQ ID NO: 323374 - RNA, 22 nt, Human
aucccugcccucauggagcuua

SEQ ID NO: 323375 - RNA, 22 nt, Human
agcaaauacuugaauaaaaaga

SEQ ID NO: 323376 - RNA, 22 nt, Human
gccuggaguucagccaaguccc

SEQ ID NO: 323377 - RNA, 19 nt, Human
ccugggaggcggagguugc

SEQ ID NO: 323378 - RNA, 22 nt, Human
uguaugcaaauuuauuagcaca

SEQ ID NO: 323379 - RNA, 22 nt, Human
uccuggaguauuucuguggugu

SEQ ID NO: 323380 - RNA, 22 nt, Human
agggcuggccacaugauuuggu

SEQ ID NO: 323381 - RNA, 22 nt, Human
cagccccuuccuggcaucugga

SEQ ID NO: 323382 - RNA, 22 nt, Human
cugggaggauacacaagaucag

SEQ ID NO: 323383 - RNA, 22 nt, Human
cuguccugcaguugggggcagg

SEQ ID NO: 323384 - RNA, 22 nt, Human
guugaaaguagaugcuauuugg

SEQ ID NO: 323385 - RNA, 21 nt, Human
gggcagaggggccuccugggu

SEQ ID NO: 323386 - RNA, 22 nt, Human
gcccugucggaacugcgaccuc

SEQ ID NO: 323387 - RNA, 22 nt, Human
agcagagccugggcuaggggug

SEQ ID NO: 323388 - RNA, 22 nt, Human
gcaggauggugcccuuucugcc

SEQ ID NO: 323389 - RNA, 22 nt, Human
uaucauuguguuauuucuucca

SEQ ID NO: 323390 - RNA, 22 nt, Human
guacaauagcaguuuucccuuu

SEQ ID NO: 323391 - RNA, 22 nt, Human
agaaacuucagcuauucuuuug

SEQ ID NO: 323392 - RNA, 22 nt, Human
ggagcuggagagcuagccuagg

SEQ ID NO: 323393 - RNA, 22 nt, Human
ucucuucauagugacacccauc

SEQ ID NO: 323394 - RNA, 22 nt, Human
gaguuauuuguagggauuauau

SEQ ID NO: 323395 - RNA, 22 nt, Human
uggccuggccacauccagcagg

SEQ ID NO: 323396 - RNA, 22 nt, Human
uuguguccugauuugacacaau

SEQ ID NO: 323397 - RNA, 22 nt, Human
uuucaaacauagaucugaauau

SEQ ID NO: 323398 - RNA, 22 nt, Human
aaguucaagcucugccuaaaau

SEQ ID NO: 323399 - RNA, 22 nt, Human
aacuaaaucuggcauuuagagc

SEQ ID NO: 323400 - RNA, 22 nt, Human
cagcauuuucuuaauguaggug

SEQ ID NO: 323401 - RNA, 21 nt, Human
acuguucaucuguucagaagc

SEQ ID NO: 323402 - RNA, 22 nt, Human
uuguuuucacagcuuugcccgg

SEQ ID NO: 323403 - RNA, 22 nt, Human
ggagcugggacccugucaucug

SEQ ID NO: 323404 - RNA, 22 nt, Human
gcaggauggguguagcccagca

SEQ ID NO: 323405 - RNA, 22 nt, Human
ucugaggcuauguucaggcuaa

SEQ ID NO: 323406 - RNA, 20 nt, Human
uccagcugucuuucagagac

SEQ ID NO: 323407 - RNA, 22 nt, Human
ucaggagcagcaugggugagag

SEQ ID NO: 323408 - RNA, 22 nt, Human
gaaggcugaugacagauucugc

SEQ ID NO: 323409 - RNA, 22 nt, Human
gcugggcucuuaucaccuguac

SEQ ID NO: 323410 - RNA, 22 nt, Human
gcucccuccaugaggcagaccg

SEQ ID NO: 323411 - RNA, 21 nt, Human
uugaaaguaaauucagcagcu

SEQ ID NO: 323412 - RNA, 22 nt, Human
ggagccaguauuuaguggucuu

SEQ ID NO: 323413 - RNA, 22 nt, Human
acuuucucccacccacccgucu

SEQ ID NO: 323414 - RNA, 22 nt, Human
uccugcagagacagaggccuca

SEQ ID NO: 323415 - RNA, 23 nt, Human
agcuggaggcugucuacucccaa

SEQ ID NO: 323416 - RNA, 22 nt, Human
uuaggaguccagaugucuuggg

SEQ ID NO: 323417 - RNA, 22 nt, Human
ugcagugggccggaggccaggg

SEQ ID NO: 323418 - RNA, 22 nt, Human
aaacacaucauucaugucguca

SEQ ID NO: 323419 - RNA, 18 nt, Human
ugagagcauucgaggcaa

SEQ ID NO: 323420 - RNA, 22 nt, Human
cccaguccuaaagcagacgcca

SEQ ID NO: 323421 - RNA, 22 nt, Human
cagcugccugcaacacaagcuu

SEQ ID NO: 323422 - RNA, 22 nt, Human
agugaccauuuucagcuagagg

SEQ ID NO: 323423 - RNA, 22 nt, Human
gaguccaguuguucacagaggc

SEQ ID NO: 323424 - RNA, 22 nt, Human
agucccagaugacccagcuacu

SEQ ID NO: 323425 - RNA, 22 nt, Human
uccagccuaggggaacagcugc

SEQ ID NO: 323426 - RNA, 22 nt, Human
aaagauuuaugaaguucaauua

SEQ ID NO: 323427 - RNA, 22 nt, Human
ccagggcauguccaagacuuag

SEQ ID NO: 323428 - RNA, 22 nt, Human
uuccucagcuggccugauuggg

SEQ ID NO: 323429 - RNA, 22 nt, Human
gcugguuaggugagggugcgcc

SEQ ID NO: 323430 - RNA, 22 nt, Human
auguagcagauauuugugcaca

SEQ ID NO: 323431 - RNA, 22 nt, Human
cccuggccagcucaugucugag

SEQ ID NO: 323432 - RNA, 22 nt, Human
gccucugcaucuucgccgcacu

SEQ ID NO: 323433 - RNA, 22 nt, Human
aaggcgacacaggcagcaggcc

SEQ ID NO: 323434 - RNA, 22 nt, Human
ccuguucaaguugcagggcugg

SEQ ID NO: 323435 - RNA, 20 nt, Human
uggcuccugcgguggaacca

SEQ ID NO: 323436 - RNA, 22 nt, Human
cauuugaugacucaacucauaa

SEQ ID NO: 323437 - RNA, 22 nt, Human
uggcugggggugcuauagcugc

SEQ ID NO: 323438 - RNA, 22 nt, Human
acagagcauauaaagugcuuug

SEQ ID NO: 323439 - RNA, 22 nt, Human
gcaguguuacuugguuugcaga

SEQ ID NO: 323440 - RNA, 22 nt, Human
guccagccacccuggaggcacg

SEQ ID NO: 323441 - RNA, 22 nt, Human
gucucccaucguuugugaggaa

SEQ ID NO: 323442 - RNA, 22 nt, Human
agaauucuggaguugggaggaa

SEQ ID NO: 323443 - RNA, 22 nt, Human
agaugaaauuuguguugaguug

SEQ ID NO: 323444 - RNA, 22 nt, Human
uuucuuauauucugucauuguu

SEQ ID NO: 323445 - RNA, 17 nt, Human
agaaagaggauccacag

SEQ ID NO: 323446 - RNA, 22 nt, Human
acaggccacaguggagucucug

SEQ ID NO: 323447 - RNA, 22 nt, Human
ggcagggugccuggcuccuguu

SEQ ID NO: 323448 - RNA, 22 nt, Human
uaggaaaaauacagaauuauau

SEQ ID NO: 323449 - RNA, 22 nt, Human
ugugaaaagcguguguucuagg

SEQ ID NO: 323450 - RNA, 22 nt, Human
uccauucauucauugaugaaca

SEQ ID NO: 323451 - RNA, 22 nt, Human
gcugguccacucccuggaggcu

SEQ ID NO: 323452 - RNA, 22 nt, Human
ugggcagacugagcccuguccc

SEQ ID NO: 323453 - RNA, 18 nt, Human
gagacacaagggccugga

SEQ ID NO: 323454 - RNA, 22 nt, Human
acacaaugcauauuuuuccaga

SEQ ID NO: 323455 - RNA, 23 nt, Human
uugaaagguagcuggcagcuaga

SEQ ID NO: 323456 - RNA, 22 nt, Human
aaauguguuugauaggaauauu

SEQ ID NO: 323457 - RNA, 22 nt, Human
gcuggcugaggucuagcucuuu

SEQ ID NO: 323458 - RNA, 22 nt, Human
auguauguuaguguauuaucua

SEQ ID NO: 323459 - RNA, 22 nt, Human
aguuuccaaagcauguucacac

SEQ ID NO: 323460 - RNA, 22 nt, Human
aguucuucauaaccuuacugug

SEQ ID NO: 323461 - RNA, 22 nt, Human
gcucugugccacaugcaguguu

SEQ ID NO: 323462 - RNA, 22 nt, Human
aguggcagagcugugucuugaa

SEQ ID NO: 323463 - RNA, 18 nt, Human
agagaugggaguuggaaa

SEQ ID NO: 323464 - RNA, 22 nt, Human
ggaaagagcccagcagugcuug

SEQ ID NO: 323465 - RNA, 22 nt, Human
cagucccagacauaguaaggga

SEQ ID NO: 323466 - RNA, 22 nt, Human
agcuccuguggcagcucuucug

SEQ ID NO: 323467 - RNA, 22 nt, Human
gucaggaucaaauugaaguuau

SEQ ID NO: 323468 - RNA, 22 nt, Human
auucuccagcucacuguccaua

SEQ ID NO: 323469 - RNA, 22 nt, Human
ugucaugggucuaaacauugau

SEQ ID NO: 323470 - RNA, 22 nt, Human
uuccauaaaggugauaguauac

SEQ ID NO: 323471 - RNA, 22 nt, Human
gcucaggauuucauccaugugu

SEQ ID NO: 323472 - RNA, 22 nt, Human
aucucuguaaaccauaaauuga

SEQ ID NO: 323473 - RNA, 22 nt, Human
aucaggaugaagcuguagcgaa

SEQ ID NO: 323474 - RNA, 22 nt, Human
cagugggugaugaguccugggg

SEQ ID NO: 323475 - RNA, 22 nt, Human
uggcucaggagggaucuuugcu

SEQ ID NO: 323476 - RNA, 22 nt, Human
gcuggccugcugggcaccaccg

SEQ ID NO: 323477 - RNA, 22 nt, Human
ggccugcugcuaugacuuccug

SEQ ID NO: 323478 - RNA, 22 nt, Human
gggaugucacugugccuggcac

SEQ ID NO: 323479 - RNA, 22 nt, Human
gcugcagcucgccuuccggccu

SEQ ID NO: 323480 - RNA, 22 nt, Human
gagagcugggcuuugggugaag

SEQ ID NO: 323481 - RNA, 22 nt, Human
gccuggagggcucuagagaggc

SEQ ID NO: 323482 - RNA, 22 nt, Human
gaaaggcaguacagcugagccu

SEQ ID NO: 323483 - RNA, 22 nt, Human
gcugguuuccuuaucuauaaag

SEQ ID NO: 323484 - RNA, 22 nt, Human
gaggggcuggcacgauggcugc

SEQ ID NO: 323485 - RNA, 22 nt, Human
agaaaauauucauugagaggcu

SEQ ID NO: 323486 - RNA, 22 nt, Human
ucagaagccggaagugcuccuc

SEQ ID NO: 323487 - RNA, 22 nt, Human
ccccuuucucccgcgucuggcc

SEQ ID NO: 323488 - RNA, 22 nt, Human
cuggccugaggucggcuguagg

SEQ ID NO: 323489 - RNA, 20 nt, Human
caccaggcgcucugagaaca

SEQ ID NO: 323490 - RNA, 22 nt, Human
cagcucugugggagcguaugug

SEQ ID NO: 323491 - RNA, 22 nt, Human
uggcucagcgcggccuggucuu

SEQ ID NO: 323492 - RNA, 22 nt, Human
agggacagucuacuguucacug

SEQ ID NO: 323493 - RNA, 22 nt, Human
ucauuuccucaaauucaagguu

SEQ ID NO: 323494 - RNA, 22 nt, Human
gugucccagcagcacauuggcu

SEQ ID NO: 323495 - RNA, 22 nt, Human
agucccagaucuacaggaggga

SEQ ID NO: 323496 - RNA, 22 nt, Human
ccagucugaggccuggugaggg

SEQ ID NO: 323497 - RNA, 22 nt, Human
gccugcagggugaugggcugcc

SEQ ID NO: 323498 - RNA, 22 nt, Human
uguggccuugcagccuggaggu

SEQ ID NO: 323499 - RNA, 22 nt, Human
aaacacauuuuaggaaaaucua

SEQ ID NO: 323500 - RNA, 23 nt, Human
uaugagaacccauacgcugucuu

SEQ ID NO: 323501 - RNA, 22 nt, Human
aguacagaccugucucuuccug

SEQ ID NO: 323502 - RNA, 22 nt, Human
agcugaagggaggauauguaca

SEQ ID NO: 323503 - RNA, 22 nt, Human
uucugugauugacauguggcuu

SEQ ID NO: 323504 - RNA, 22 nt, Human
gcucccagcaauugaggcagcc

SEQ ID NO: 323505 - RNA, 22 nt, Human
cuggcucaugugaugagggcaa

SEQ ID NO: 323506 - RNA, 22 nt, Human
agcauucauugcuagaauguaa

SEQ ID NO: 323507 - RNA, 22 nt, Human
uuacaagcagcuacauaucaca

SEQ ID NO: 323508 - RNA, 22 nt, Human
ucagugcuaaaagagcuggugu

SEQ ID NO: 323509 - RNA, 22 nt, Human
ucauucuuuaccaaguugucac

SEQ ID NO: 323510 - RNA, 22 nt, Human
ugugccagccucuggcuguguc

SEQ ID NO: 323511 - RNA, 22 nt, Human
gccuugccucagccauggaaac

SEQ ID NO: 323512 - RNA, 22 nt, Human
ccugcucagagcgucuugugug

SEQ ID NO: 323513 - RNA, 22 nt, Human
gggcuggcaucaguugccgaga

SEQ ID NO: 323514 - RNA, 22 nt, Human
ccaggccuagccccugagggua

SEQ ID NO: 323515 - RNA, 22 nt, Human
acccagcuggaugcauggaggc

SEQ ID NO: 323516 - RNA, 22 nt, Human
ugaaaaggagccuuagguaggu

SEQ ID NO: 323517 - RNA, 20 nt, Human
cccagccccuaccuguugcc

SEQ ID NO: 323518 - RNA, 22 nt, Human
ccuccagucaccuggaugagaa

SEQ ID NO: 323519 - RNA, 20 nt, Human
ccaccuggccaaggcugugc

SEQ ID NO: 323520 - RNA, 17 nt, Human
agugacuuggaaagagc

SEQ ID NO: 323521 - RNA, 22 nt, Human
gugcccugaguggguaggagag

SEQ ID NO: 323522 - RNA, 22 nt, Human
uaucuguugucuuuuacaugua

SEQ ID NO: 323523 - RNA, 22 nt, Human
ucccagccggugccuggguccc

SEQ ID NO: 323524 - RNA, 22 nt, Human
gcaguguuucagugcuuuuucu

SEQ ID NO: 323525 - RNA, 22 nt, Human
caaggcaggcaguucacuugag

SEQ ID NO: 323526 - RNA, 22 nt, Human
ucucagaguuuacggggcugaa

SEQ ID NO: 323527 - RNA, 17 nt, Human
aaucucaguggcuuaag

SEQ ID NO: 323528 - RNA, 22 nt, Human
gccagguggucuggcuccagag

SEQ ID NO: 323529 - RNA, 22 nt, Human
uucugucuguaaacuucucaau

SEQ ID NO: 323530 - RNA, 22 nt, Human
agccagcagggcuuagaggaca

SEQ ID NO: 323531 - RNA, 22 nt, Human
ugcaguggaaagacucagacuu

SEQ ID NO: 323532 - RNA, 22 nt, Human
auugaaaaaugacuauugcuua

SEQ ID NO: 323533 - RNA, 22 nt, Human
caguggaggcucaagugugcuu

SEQ ID NO: 323534 - RNA, 22 nt, Human
uccucacauggugagccacaca

SEQ ID NO: 323535 - RNA, 22 nt, Human
aagaguuuucuauaaucuuggc

SEQ ID NO: 323536 - RNA, 22 nt, Human
uuaugauuugccacagauuggu

SEQ ID NO: 323537 - RNA, 22 nt, Human
auccuugacacacuccaguacu

SEQ ID NO: 323538 - RNA, 22 nt, Human
ucccacacagcccgcucaccgg

SEQ ID NO: 323539 - RNA, 22 nt, Human
uagagcuguaucaaagagccuu

SEQ ID NO: 323540 - RNA, 22 nt, Human
aagaaaugcagaaaugugcugg

SEQ ID NO: 323541 - RNA, 22 nt, Human
aagcaggcauuccagagacaau

SEQ ID NO: 323542 - RNA, 22 nt, Human
ggcugucucugugacugccacc

SEQ ID NO: 323543 - RNA, 22 nt, Human
uaauuucaauagcuugcauaau

SEQ ID NO: 323544 - RNA, 21 nt, Human
agcuggugucagagcucuggg

SEQ ID NO: 323545 - RNA, 22 nt, Human
aaugcacauaaauauggucuua

SEQ ID NO: 323546 - RNA, 22 nt, Human
aagcugcccaagacugaagcau

SEQ ID NO: 323547 - RNA, 22 nt, Human
gagagcugcagccgagaggggg

SEQ ID NO: 323548 - RNA, 22 nt, Human
ccucagcugcuucccuggagcc

SEQ ID NO: 323549 - RNA, 22 nt, Human
agggagccagaguugggagcuc

SEQ ID NO: 323550 - RNA, 22 nt, Human
cuugugcauuucauuccucagg

SEQ ID NO: 323551 - RNA, 22 nt, Human
acaggccugacacacagagggc

SEQ ID NO: 323552 - RNA, 22 nt, Human
ccagcccuguaaggaugaggca

SEQ ID NO: 323553 - RNA, 17 nt, Human
ugaaacaccaagacugu

SEQ ID NO: 323554 - RNA, 22 nt, Human
ucagggcaaaagggaaaccauu

SEQ ID NO: 323555 - RNA, 22 nt, Human
gcucccugacucaguuccugag

SEQ ID NO: 323556 - RNA, 20 nt, Human
accuugaacccgccagccau

SEQ ID NO: 323557 - RNA, 22 nt, Human
aaugaaauaguuggcuguagag

SEQ ID NO: 323558 - RNA, 22 nt, Human
ucaguuuucauuucaugagcag

SEQ ID NO: 323559 - RNA, 22 nt, Human
guuauauauaguauuucucuga

SEQ ID NO: 323560 - RNA, 22 nt, Human
ggcccagcugugcuuccagccc

SEQ ID NO: 323561 - RNA, 21 nt, Human
aaaaaugaaguuguucaggaa

SEQ ID NO: 323562 - RNA, 22 nt, Human
aggacccagaggcagaggacgu

SEQ ID NO: 323563 - RNA, 22 nt, Human
cugugcugauucagcacaggcc

SEQ ID NO: 323564 - RNA, 22 nt, Human
acauauuuugaaagcuuucuaa

SEQ ID NO: 323565 - RNA, 22 nt, Human
agggccaggaacaccugaaggg

SEQ ID NO: 323566 - RNA, 22 nt, Human
ucucagaggugcccuggcaucu

SEQ ID NO: 323567 - RNA, 23 nt, Human
uaacucugugaagggugacuggg

SEQ ID NO: 323568 - RNA, 20 nt, Human
ggcagcaggaguuuccucuu

SEQ ID NO: 323569 - RNA, 22 nt, Human
auuugcauaauagugauuugua

SEQ ID NO: 323570 - RNA, 17 nt, Human
ggcugcugugcuggugc

SEQ ID NO: 323571 - RNA, 22 nt, Human
gugaaggaggggccacagauau

SEQ ID NO: 323572 - RNA, 22 nt, Human
ugcagggccuucuagaccaugg

SEQ ID NO: 323573 - RNA, 20 nt, Human
cauuuguuagcuuucuacug

SEQ ID NO: 323574 - RNA, 22 nt, Human
ggaggagacaguaaaaagcacg

SEQ ID NO: 323575 - RNA, 22 nt, Human
uugauacauagcacaguuuagg

SEQ ID NO: 323576 - RNA, 22 nt, Human
aaucuucuuucuuaacaguaca

SEQ ID NO: 323577 - RNA, 22 nt, Human
cugcagcuuuggaaaccuguuu

SEQ ID NO: 323578 - RNA, 22 nt, Human
gcagugguggagcuuacauauc

SEQ ID NO: 323579 - RNA, 22 nt, Human
uucuuuuacauuaagauuucag

SEQ ID NO: 323580 - RNA, 22 nt, Human
cuuuuuccagcuucaggguggg

SEQ ID NO: 323581 - RNA, 22 nt, Human
agaaaacuugucacagcucuca

SEQ ID NO: 323582 - RNA, 22 nt, Human
auccuugagaaaauaaaugacc

SEQ ID NO: 323583 - RNA, 22 nt, Human
ucagaaauacuaucagcuuuug

SEQ ID NO: 323584 - RNA, 22 nt, Human
agagggcccauguugggcugcu

SEQ ID NO: 323585 - RNA, 23 nt, Human
ucagugugcaagaauggagaagc

SEQ ID NO: 323586 - RNA, 22 nt, Human
uggccugucuuguugugcuaga

SEQ ID NO: 323587 - RNA, 22 nt, Human
aaaaucaguacacuuuauuuug

SEQ ID NO: 323588 - RNA, 22 nt, Human
gccucugcccauccaccaucag

SEQ ID NO: 323589 - RNA, 22 nt, Human
cagagacagggcagggagugug

SEQ ID NO: 323590 - RNA, 22 nt, Human
ucugucuccugccagugccucu

SEQ ID NO: 323591 - RNA, 22 nt, Human
uugugugguagcuucauugaac

SEQ ID NO: 323592 - RNA, 22 nt, Human
cugcugugcaacauugcaccua

SEQ ID NO: 323593 - RNA, 22 nt, Human
agcccaagcuaugaggugaccu

SEQ ID NO: 323594 - RNA, 22 nt, Human
agaagauuuagguugacgcuau

SEQ ID NO: 323595 - RNA, 22 nt, Human
uuagacauguuugcuaaaauga

SEQ ID NO: 323596 - RNA, 22 nt, Human
cugcucuaauaucagauagacu

SEQ ID NO: 323597 - RNA, 22 nt, Human
acauuucucauucuccccuaac

SEQ ID NO: 323598 - RNA, 22 nt, Human
agaccagcugccucccagggcc

SEQ ID NO: 323599 - RNA, 22 nt, Human
accaugggucagccaccucagc

SEQ ID NO: 323600 - RNA, 22 nt, Human
gggcacugugcuaggugcugag

SEQ ID NO: 323601 - RNA, 18 nt, Human
uggagccauugccaccau

SEQ ID NO: 323602 - RNA, 22 nt, Human
agccucuguagaaagcagugug

SEQ ID NO: 323603 - RNA, 22 nt, Human
ucccaggacaggccacauggaa

SEQ ID NO: 323604 - RNA, 22 nt, Human
ccucagagguguggcaucucug

SEQ ID NO: 323605 - RNA, 22 nt, Human
uggcaggagguuuucuccagga

SEQ ID NO: 323606 - RNA, 22 nt, Human
aaacuguauauuuauggcaugu

SEQ ID NO: 323607 - RNA, 17 nt, Human
gcacugaacaauccugu

SEQ ID NO: 323608 - RNA, 22 nt, Human
agcuggcccucgagagccaauu

SEQ ID NO: 323609 - RNA, 22 nt, Human
uuucacaacugcuuauuugaga

SEQ ID NO: 323610 - RNA, 22 nt, Human
ccaggggcuggugcugagcugg

SEQ ID NO: 323611 - RNA, 22 nt, Human
cuuaaagaaauugaggagagga

SEQ ID NO: 323612 - RNA, 22 nt, Human
caguuucuuggaugccaauuuc

SEQ ID NO: 323613 - RNA, 22 nt, Human
gcugucugggaggccuccacuu

SEQ ID NO: 323614 - RNA, 22 nt, Human
gggcagaggggcgcuucccucu

SEQ ID NO: 323615 - RNA, 22 nt, Human
aggcugcuuccuuacguggcug

SEQ ID NO: 323616 - RNA, 22 nt, Human
acagaaauauucguggugcuug

SEQ ID NO: 323617 - RNA, 22 nt, Human
uuccaggaagauucaacaaaag

SEQ ID NO: 323618 - RNA, 22 nt, Human
aaggccauuauucugauauauu

SEQ ID NO: 323619 - RNA, 22 nt, Human
aagggccuccuggggagccugg

SEQ ID NO: 323620 - RNA, 22 nt, Human
guaagcaucugucucuucugca

SEQ ID NO: 323621 - RNA, 22 nt, Human
ggcaggcgugguggccucagaa

SEQ ID NO: 323622 - RNA, 22 nt, Human
gcuguucauuagaaauagaaug

SEQ ID NO: 323623 - RNA, 22 nt, Human
uccaugugccaaggggcagagg

SEQ ID NO: 323624 - RNA, 22 nt, Human
ccagcuggcaggagagucaggg

SEQ ID NO: 323625 - RNA, 23 nt, Human
ucucagugccgauugcauacaca

SEQ ID NO: 323626 - RNA, 22 nt, Human
aauuucaaugcacucaugguug

SEQ ID NO: 323627 - RNA, 22 nt, Human
gcacccagaauaaggacaggac

SEQ ID NO: 323628 - RNA, 22 nt, Human
cgcagaagagguugucuagucc

SEQ ID NO: 323629 - RNA, 20 nt, Human
ccuggagccuggaaggaguc

SEQ ID NO: 323630 - RNA, 22 nt, Human
gaaagagaaccugggccuagau

SEQ ID NO: 323631 - RNA, 22 nt, Human
ggggaugguggcauuuguaaaa

SEQ ID NO: 323632 - RNA, 22 nt, Human
agagugaaguucaucgugcagc

SEQ ID NO: 323633 - RNA, 22 nt, Human
ugaaaaggaguccuuguuuuca

SEQ ID NO: 323634 - RNA, 23 nt, Human
uggcagugaucaaaagcuuacau

SEQ ID NO: 323635 - RNA, 22 nt, Human
auaguggugagcugcauuuaug

SEQ ID NO: 323636 - RNA, 22 nt, Human
aaauugugcucacacugauauu

SEQ ID NO: 323637 - RNA, 22 nt, Human
auuuaagauugcguauucaugu

SEQ ID NO: 323638 - RNA, 22 nt, Human
cccuggagcaucucugcugucu

SEQ ID NO: 323639 - RNA, 19 nt, Human
augauacaggugaaaauug

SEQ ID NO: 323640 - RNA, 22 nt, Human
ccugggcauucuuugaguucuc

SEQ ID NO: 323641 - RNA, 22 nt, Human
agggccugucagcgguguccug

SEQ ID NO: 323642 - RNA, 22 nt, Human
gaugaaaaaagacgagcauaua

SEQ ID NO: 323643 - RNA, 22 nt, Human
gggcuacauugugagagaaguu

SEQ ID NO: 323644 - RNA, 22 nt, Human
agugcuggagggaggcagguuc

SEQ ID NO: 323645 - RNA, 20 nt, Human
gcagcugaaaguaugacacc

SEQ ID NO: 323646 - RNA, 22 nt, Human
caagaugaaacuacagggagga

SEQ ID NO: 323647 - RNA, 22 nt, Human
ugaaacuuauaagaauaugaau

SEQ ID NO: 323648 - RNA, 22 nt, Human
auuucuguuugcuacuauaagu

SEQ ID NO: 323649 - RNA, 22 nt, Human
ggguguguuccuaaggaaacca

SEQ ID NO: 323650 - RNA, 22 nt, Human
aggccuagaggaauggccaggg

SEQ ID NO: 323651 - RNA, 22 nt, Human
caggagcagaggguggucagca

SEQ ID NO: 323652 - RNA, 22 nt, Human
agaccaugggcucugaagagca

SEQ ID NO: 323653 - RNA, 22 nt, Human
agucuggggucugguagaacga

SEQ ID NO: 323654 - RNA, 22 nt, Human
gguaacaguauguagaguaaga

SEQ ID NO: 323655 - RNA, 22 nt, Human
auaaaaacugacccauccuuug

SEQ ID NO: 323656 - RNA, 19 nt, Human
uuugcagugguuccuuugu

SEQ ID NO: 323657 - RNA, 23 nt, Human
uugcauguagcccaugaguaacu

SEQ ID NO: 323658 - RNA, 22 nt, Human
gcucccugcagcugagaguucc

SEQ ID NO: 323659 - RNA, 22 nt, Human
uucaauucuaaacuaauauucu

SEQ ID NO: 323660 - RNA, 22 nt, Human
uugcauuucccauugaguaaug

SEQ ID NO: 323661 - RNA, 22 nt, Human
ucugggaaccagugcggcuggg

SEQ ID NO: 323662 - RNA, 15 nt, Human
cuccaugauuuugca

SEQ ID NO: 323663 - RNA, 22 nt, Human
uccugcagaccucagucagguc

SEQ ID NO: 323664 - RNA, 20 nt, Human
cuuggccuacuuagcuuugu

SEQ ID NO: 323665 - RNA, 22 nt, Human
gccaccaggagcccaguccaaa

SEQ ID NO: 323666 - RNA, 22 nt, Human
aagauucuacaguagguacauu

SEQ ID NO: 323667 - RNA, 22 nt, Human
cccgucccuuuugcccgcuggu

SEQ ID NO: 323668 - RNA, 22 nt, Human
cugccucuguugggcauggucu

SEQ ID NO: 323669 - RNA, 19 nt, Human
agcauccagucaugggauc

SEQ ID NO: 323670 - RNA, 20 nt, Human
cuaucuccuggcgugccuuc

SEQ ID NO: 323671 - RNA, 22 nt, Human
uuucuuauacuauauugucauc

SEQ ID NO: 323672 - RNA, 22 nt, Human
uggcccaggcgaggugggcaga

SEQ ID NO: 323673 - RNA, 18 nt, Human
cagauccaggcagcuauu

SEQ ID NO: 323674 - RNA, 22 nt, Human
ugaagccacagagcaucugccu

SEQ ID NO: 323675 - RNA, 22 nt, Human
aggagccuccuucucaugugca

SEQ ID NO: 323676 - RNA, 22 nt, Human
acaguguucaaaccacuaggcu

SEQ ID NO: 323677 - RNA, 22 nt, Human
aaagacuagcauuuauauguac

SEQ ID NO: 323678 - RNA, 22 nt, Human
cuggugccuccucccugugcuu

SEQ ID NO: 323679 - RNA, 22 nt, Human
aagugggaauagaaaugaaggu

SEQ ID NO: 323680 - RNA, 22 nt, Human
cugaaggauucaaaauggcagg

SEQ ID NO: 323681 - RNA, 22 nt, Human
gcagauggcugagccugcagau

SEQ ID NO: 323682 - RNA, 17 nt, Human
gagagcugcugcuuccg

SEQ ID NO: 323683 - RNA, 22 nt, Human
cauaauaucuccgauuacuugc

SEQ ID NO: 323684 - RNA, 22 nt, Human
uguaugaaagaacaagggcuua

SEQ ID NO: 323685 - RNA, 22 nt, Human
uauuuugucuucugcucaucac

SEQ ID NO: 323686 - RNA, 22 nt, Human
uucaacuagauuuauacaauuc

SEQ ID NO: 323687 - RNA, 22 nt, Human
aucugcuugaguuugaagucag

SEQ ID NO: 323688 - RNA, 22 nt, Human
acaaaguuaacaguuggauagu

SEQ ID NO: 323689 - RNA, 22 nt, Human
ggaaccaggaguuacacgaguu

SEQ ID NO: 323690 - RNA, 22 nt, Human
uacaggaggauuaucaaaggau

SEQ ID NO: 323691 - RNA, 22 nt, Human
cagaaugagauaacccagauug

SEQ ID NO: 323692 - RNA, 17 nt, Human
uagcugccccgaaugcu

SEQ ID NO: 323693 - RNA, 22 nt, Human
gcagagcccuggggguauggug

SEQ ID NO: 323694 - RNA, 22 nt, Human
gcuugggauaugcugauguaaa

SEQ ID NO: 323695 - RNA, 22 nt, Human
ucugucucaaguucuugcacuc

SEQ ID NO: 323696 - RNA, 22 nt, Human
gauccuugcaacucugugaggu

SEQ ID NO: 323697 - RNA, 19 nt, Human
ccugcagggaugagagguu

SEQ ID NO: 323698 - RNA, 22 nt, Human
cuccugggcucaagugauccuc

SEQ ID NO: 323699 - RNA, 22 nt, Human
uccagggagauacuggcugcca

SEQ ID NO: 323700 - RNA, 23 nt, Human
agucaguguaaguuuggaaugca

SEQ ID NO: 323701 - RNA, 22 nt, Human
uguccucagauaugucuacucu

SEQ ID NO: 323702 - RNA, 22 nt, Human
uuugacaaaggaaaaaugcaca

SEQ ID NO: 323703 - RNA, 22 nt, Human
ccugggugaugugcugcccucg

SEQ ID NO: 323704 - RNA, 22 nt, Human
acuuuggaucugauguaaucag

SEQ ID NO: 323705 - RNA, 22 nt, Human
ggaggugggagacauaggcggc

SEQ ID NO: 323706 - RNA, 22 nt, Human
ugauggcuaucccuggaagggc

SEQ ID NO: 323707 - RNA, 22 nt, Human
ccagguggugaaagugggcccu

SEQ ID NO: 323708 - RNA, 22 nt, Human
cuccucccucuuugccacacau

SEQ ID NO: 323709 - RNA, 22 nt, Human
uggcccugaggacccagugugg

SEQ ID NO: 323710 - RNA, 22 nt, Human
gaggccagcgcgcagcacuuuu

SEQ ID NO: 323711 - RNA, 22 nt, Human
gcugugcugauucauucccugc

SEQ ID NO: 323712 - RNA, 22 nt, Human
acagauugaucuugagaauuau

SEQ ID NO: 323713 - RNA, 22 nt, Human
gcacagggcaacaggucuguua

SEQ ID NO: 323714 - RNA, 22 nt, Human
aauaaacugcucaauugcauca

SEQ ID NO: 323715 - RNA, 23 nt, Human
agaugaaagcuucccaucacagu

SEQ ID NO: 323716 - RNA, 22 nt, Human
cucaggaucgcuugcccuaggg

SEQ ID NO: 323717 - RNA, 22 nt, Human
accugagggcccaaacuuggua

SEQ ID NO: 323718 - RNA, 22 nt, Human
uaaggccagccagcaaaucugu

SEQ ID NO: 323719 - RNA, 20 nt, Human
ggcugccuccuuccuuuccu

SEQ ID NO: 323720 - RNA, 22 nt, Human
gccuuuuuuguugcucugucac

SEQ ID NO: 323721 - RNA, 22 nt, Human
cauugcuuccuaugucccuucu

SEQ ID NO: 323722 - RNA, 22 nt, Human
ccagggugaggaggcucccacg

SEQ ID NO: 323723 - RNA, 19 nt, Human
cugaggcccauguaccaug

SEQ ID NO: 323724 - RNA, 22 nt, Human
aaggcagccucugccagccggg

SEQ ID NO: 323725 - RNA, 22 nt, Human
ggcccuguuagagcucccacaa

SEQ ID NO: 323726 - RNA, 22 nt, Human
cagccaggagccucugcaacua

SEQ ID NO: 323727 - RNA, 22 nt, Human
ucuuuacaguccucugucaauc

SEQ ID NO: 323728 - RNA, 22 nt, Human
aaaguuagacagcaucauuucu

SEQ ID NO: 323729 - RNA, 23 nt, Human
aggcccugccugucccucuuuuu

SEQ ID NO: 323730 - RNA, 21 nt, Human
agcuuccugcagugggagguc

SEQ ID NO: 323731 - RNA, 22 nt, Human
gccuggaguuguggugaagcca

SEQ ID NO: 323732 - RNA, 22 nt, Human
gcaggagagucugugccagguu

SEQ ID NO: 323733 - RNA, 22 nt, Human
acaguaccugcucucaagcaaa

SEQ ID NO: 323734 - RNA, 22 nt, Human
uuugaaaucuaaucaaggaaca

SEQ ID NO: 323735 - RNA, 22 nt, Human
agucccagugacuuggccagaa

SEQ ID NO: 323736 - RNA, 22 nt, Human
uggagccaaggccaguucucag

SEQ ID NO: 323737 - RNA, 21 nt, Human
ggucagggggugccuccaggu

SEQ ID NO: 323738 - RNA, 22 nt, Human
ugguccugagcaccagccugac

SEQ ID NO: 323739 - RNA, 22 nt, Human
gcagagccugugucugagcaaa

SEQ ID NO: 323740 - RNA, 22 nt, Human
cucaggguaaugaaagacgaau

SEQ ID NO: 323741 - RNA, 23 nt, Human
uccagcagccaagaaggguagaa

SEQ ID NO: 323742 - RNA, 22 nt, Human
aagcagcauaauugcuauuuua

SEQ ID NO: 323743 - RNA, 22 nt, Human
gggcacuguacacugugcaugg

SEQ ID NO: 323744 - RNA, 22 nt, Human
ccagagccugcugagccccauu

SEQ ID NO: 323745 - RNA, 22 nt, Human
acagccagguaaaggcauggca

SEQ ID NO: 323746 - RNA, 22 nt, Human
cagagcugggcauggugaaagg

SEQ ID NO: 323747 - RNA, 22 nt, Human
uaaaauguguuucuguaugguu

SEQ ID NO: 323748 - RNA, 22 nt, Human
aaggagacauuugcagagcacc

SEQ ID NO: 323749 - RNA, 22 nt, Human
gaaaguuucuucauuaagaugu

SEQ ID NO: 323750 - RNA, 22 nt, Human
uuggcaguaaaagaaaaugcuu

SEQ ID NO: 323751 - RNA, 22 nt, Human
agggcagcagcggcccaggccu

SEQ ID NO: 323752 - RNA, 18 nt, Human
ucugcugcugcguccugc

SEQ ID NO: 323753 - RNA, 22 nt, Human
cuggccugaggccgccuucaga

SEQ ID NO: 323754 - RNA, 22 nt, Human
cugggcagugguggcaucuuug

SEQ ID NO: 323755 - RNA, 22 nt, Human
ggagccugcgggagcucccauu

SEQ ID NO: 323756 - RNA, 22 nt, Human
ccuggagcacagcccaguccca

SEQ ID NO: 323757 - RNA, 22 nt, Human
auuuagaaguuggagggcaaga

SEQ ID NO: 323758 - RNA, 19 nt, Human
ggaggccuggguauuugcc

SEQ ID NO: 323759 - RNA, 23 nt, Human
uccuuccuuugagaggcuccauc

SEQ ID NO: 323760 - RNA, 22 nt, Human
ugguggccaauucacagggcuc

SEQ ID NO: 323761 - RNA, 22 nt, Human
acugucugcccugagaugccag

SEQ ID NO: 323762 - RNA, 22 nt, Human
uuuccucugucaugacagcuga

SEQ ID NO: 323763 - RNA, 22 nt, Human
ccaagggcucugacuugccugc

SEQ ID NO: 323764 - RNA, 22 nt, Human
gugcauuuggugacucucaccc

SEQ ID NO: 323765 - RNA, 22 nt, Human
agcugcucccuauccuuuccuu

SEQ ID NO: 323766 - RNA, 22 nt, Human
ucaguguuuguggcaaauguua

SEQ ID NO: 323767 - RNA, 22 nt, Human
cagggugacugcccuggccacu

SEQ ID NO: 323768 - RNA, 22 nt, Human
caagagcucaccggagagcauu

SEQ ID NO: 323769 - RNA, 22 nt, Human
gucuugaucuccugaccuugug

SEQ ID NO: 323770 - RNA, 23 nt, Human
aaacuacauuuauaguuuuucuc

SEQ ID NO: 323771 - RNA, 22 nt, Human
cagggugcagugucgcugcuag

SEQ ID NO: 323772 - RNA, 22 nt, Human
auuuuccucaagccucuggaag

SEQ ID NO: 323773 - RNA, 22 nt, Human
ggcucaggcuggagugcagugg

SEQ ID NO: 323774 - RNA, 22 nt, Human
guccucugaaguugugcaaugc

SEQ ID NO: 323775 - RNA, 22 nt, Human
caugcacaacauacucaagagg

SEQ ID NO: 323776 - RNA, 22 nt, Human
uggcagagagagugcagucgac

SEQ ID NO: 323777 - RNA, 22 nt, Human
ugccuggaugugcuggccucac

SEQ ID NO: 323778 - RNA, 22 nt, Human
caaagugcuggaauuacaggug

SEQ ID NO: 323779 - RNA, 22 nt, Human
agccuggacagcuacggagaac

SEQ ID NO: 323780 - RNA, 22 nt, Human
ucaugaacauggaauaucuuuu

SEQ ID NO: 323781 - RNA, 21 nt, Human
cuugaaagguagagucuacag

SEQ ID NO: 323782 - RNA, 21 nt, Human
uaagaacauuaucuucuuccu

SEQ ID NO: 323783 - RNA, 22 nt, Human
agggccagaggcaccuugcagc

SEQ ID NO: 323784 - RNA, 22 nt, Human
aaucaagaguuguguaauauuu

SEQ ID NO: 323785 - RNA, 22 nt, Human
aaaaguuaccucuguaauauaa

SEQ ID NO: 323786 - RNA, 22 nt, Human
gcugcucuggcucugcaguguc

SEQ ID NO: 323787 - RNA, 22 nt, Human
caaaucuccuuaaagguaaaau

SEQ ID NO: 323788 - RNA, 22 nt, Human
uaucuugagagacaacacagca

SEQ ID NO: 323789 - RNA, 22 nt, Human
uggcagggaguugcaggauuuc

SEQ ID NO: 323790 - RNA, 22 nt, Human
uacccaggagaaacagcagggc

SEQ ID NO: 323791 - RNA, 22 nt, Human
ccugcacuaccuggggcugcug

SEQ ID NO: 323792 - RNA, 22 nt, Human
uuuuuccaccguacuuccugag

SEQ ID NO: 323793 - RNA, 22 nt, Human
cacagggcuucucauggggugc

SEQ ID NO: 323794 - RNA, 22 nt, Human
aaagccuugggauuugugauca

SEQ ID NO: 323795 - RNA, 22 nt, Human
gccacagugggcuggggccaga

SEQ ID NO: 323796 - RNA, 22 nt, Human
gggaguaaacuauggugaggau

SEQ ID NO: 323797 - RNA, 23 nt, Human
cagaugagguuggcagcaugguc

SEQ ID NO: 323798 - RNA, 22 nt, Human
guauuuucaagagcaguaguau

SEQ ID NO: 323799 - RNA, 22 nt, Human
uuugacaggacuaacauauggc

SEQ ID NO: 323800 - RNA, 22 nt, Human
cagcuggccugaucccuguggc

SEQ ID NO: 323801 - RNA, 22 nt, Human
gaaguucaggugggaauugagc

SEQ ID NO: 323802 - RNA, 22 nt, Human
uaaaugcaaugugcuuuaccag

SEQ ID NO: 323803 - RNA, 22 nt, Human
gaggagagaacauuccuccaua

SEQ ID NO: 323804 - RNA, 22 nt, Human
gcaguguucuaaauugggugug

SEQ ID NO: 323805 - RNA, 22 nt, Human
ccauaaggagccagacauucca

SEQ ID NO: 323806 - RNA, 22 nt, Human
acaggcugcccgcuccccaccu

SEQ ID NO: 323807 - RNA, 22 nt, Human
ggcucaggaccugggauugcca

SEQ ID NO: 323808 - RNA, 22 nt, Human
ugagaaccaugaaaagcuguca

SEQ ID NO: 323809 - RNA, 20 nt, Human
ccagcugagccaaggggaga

SEQ ID NO: 323810 - RNA, 22 nt, Human
auuguauuuccagcuugaaugu

SEQ ID NO: 323811 - RNA, 22 nt, Human
uauuccagguuucuuguuguau

SEQ ID NO: 323812 - RNA, 22 nt, Human
gcuggcaucacuggcuucggug

SEQ ID NO: 323813 - RNA, 22 nt, Human
cuuuauguccaccagacugcaa

SEQ ID NO: 323814 - RNA, 22 nt, Human
aucauaaagugcuaucugauug

SEQ ID NO: 323815 - RNA, 22 nt, Human
uauguacaucguugaauucaaa

SEQ ID NO: 323816 - RNA, 22 nt, Human
aacagcauaaguauuuauuuca

SEQ ID NO: 323817 - RNA, 22 nt, Human
gcaucuuucuguccauucagca

SEQ ID NO: 323818 - RNA, 20 nt, Human
ccagacagcaccugccuggu

SEQ ID NO: 323819 - RNA, 22 nt, Human
acacugaaugcuguuuagaaau

SEQ ID NO: 323820 - RNA, 22 nt, Human
acagaugaaaaagcuuguggau

SEQ ID NO: 323821 - RNA, 22 nt, Human
ucuuugcaugugcuucuuggcc

SEQ ID NO: 323822 - RNA, 22 nt, Human
uccucagcaaacacuucacucu

SEQ ID NO: 323823 - RNA, 22 nt, Human
acuguucaaguuuuaugcugga

SEQ ID NO: 323824 - RNA, 22 nt, Human
gcaggaugguggaaggccugcu

SEQ ID NO: 323825 - RNA, 22 nt, Human
cccagggagguagcaggagaaa

SEQ ID NO: 323826 - RNA, 22 nt, Human
caguccuguuccuggaguaguu

SEQ ID NO: 323827 - RNA, 22 nt, Human
guggagacgggacagaagcuaa

SEQ ID NO: 323828 - RNA, 22 nt, Human
gagguuggugaggggacacggu

SEQ ID NO: 323829 - RNA, 18 nt, Human
cguuuuuccgggauugca

SEQ ID NO: 323830 - RNA, 22 nt, Human
aggcucugcagaccccagcugu

SEQ ID NO: 323831 - RNA, 22 nt, Human
guagcuuauuagggauaauagu

SEQ ID NO: 323832 - RNA, 22 nt, Human
ugacaugcuuguuuuccuugaa

SEQ ID NO: 323833 - RNA, 22 nt, Human
acagacagauuuugucugaugu

SEQ ID NO: 323834 - RNA, 21 nt, Human
gccacugcacuccagccuggg

SEQ ID NO: 323835 - RNA, 22 nt, Human
cucugagaggugagaagcagca

SEQ ID NO: 323836 - RNA, 22 nt, Human
aggagcugaaacuucucauaug

SEQ ID NO: 323837 - RNA, 21 nt, Human
guuugcaugaacaagucagcc

SEQ ID NO: 323838 - RNA, 22 nt, Human
aggcugggcaccguuuugaucc

SEQ ID NO: 323839 - RNA, 22 nt, Human
ggcuggcuggcuuagcagagga

SEQ ID NO: 323840 - RNA, 22 nt, Human
auggggagcucaccaccuguuu

SEQ ID NO: 323841 - RNA, 22 nt, Human
gcaguugcaggauuuguguugu

SEQ ID NO: 323842 - RNA, 20 nt, Human
cuguuugcuaucaugagcug

SEQ ID NO: 323843 - RNA, 22 nt, Human
caugccugccuggugggcgugg

SEQ ID NO: 323844 - RNA, 22 nt, Human
uuauggcauucauuggggcuuu

SEQ ID NO: 323845 - RNA, 22 nt, Human
uggagcagccuuuucuaagcaa

SEQ ID NO: 323846 - RNA, 22 nt, Human
ucccaguggcuucauaaggcag

SEQ ID NO: 323847 - RNA, 22 nt, Human
guucucugccggcaccuacccg

SEQ ID NO: 323848 - RNA, 22 nt, Human
ugccuguggaaaggcuggugcu

SEQ ID NO: 323849 - RNA, 22 nt, Human
cagcuggaggagcagcuuccag

SEQ ID NO: 323850 - RNA, 22 nt, Human
uccacagggaugccugcggcuu

SEQ ID NO: 323851 - RNA, 22 nt, Human
acugauuucagggaugagaaga

SEQ ID NO: 323852 - RNA, 22 nt, Human
gucuagggcuccucagugacaa

SEQ ID NO: 323853 - RNA, 22 nt, Human
ugcuccaggcugcugaagaucu

SEQ ID NO: 323854 - RNA, 22 nt, Human
uggaaggggccaggcgcggagu

SEQ ID NO: 323855 - RNA, 22 nt, Human
ccauggccugaaggagugcauc

SEQ ID NO: 323856 - RNA, 21 nt, Human
uguguucuucuaggucagcua

SEQ ID NO: 323857 - RNA, 22 nt, Human
agaagagccacuguugacggca

SEQ ID NO: 323858 - RNA, 22 nt, Human
cugcauaucaaauuacuccugg

SEQ ID NO: 323859 - RNA, 22 nt, Human
cagacucuugagcugauuguau

SEQ ID NO: 323860 - RNA, 22 nt, Human
ugcaucuaaguggcuaacaacc

SEQ ID NO: 323861 - RNA, 22 nt, Human
uuuguagauuuucucuccagua

SEQ ID NO: 323862 - RNA, 22 nt, Human
cugguuaauccauaaacagaga

SEQ ID NO: 323863 - RNA, 22 nt, Human
uccguuuucacacugcuauaaa

SEQ ID NO: 323864 - RNA, 22 nt, Human
aagagcuggcucuugcagcagc

SEQ ID NO: 323865 - RNA, 23 nt, Human
gguuggcuguacccaggcucccu

SEQ ID NO: 323866 - RNA, 22 nt, Human
uuucauguuggauacuguuuca

SEQ ID NO: 323867 - RNA, 22 nt, Human
cuuccagcugauuggcauccag

SEQ ID NO: 323868 - RNA, 22 nt, Human
ugggaagaguuagagacagcug

SEQ ID NO: 323869 - RNA, 22 nt, Human
gggcuccagaggcucacccugg

SEQ ID NO: 323870 - RNA, 22 nt, Human
ugguccucacccuacccagcug

SEQ ID NO: 323871 - RNA, 22 nt, Human
aguuggcuucaaaggcagagag

SEQ ID NO: 323872 - RNA, 22 nt, Human
ucagcacaggucuugcaaaaca

SEQ ID NO: 323873 - RNA, 18 nt, Human
ucuuccaacacugacacc

SEQ ID NO: 323874 - RNA, 22 nt, Human
auguacaaucuaucacaagaag

SEQ ID NO: 323875 - RNA, 21 nt, Human
agccugcaauguagguaccgg

SEQ ID NO: 323876 - RNA, 22 nt, Human
uccgguccggguacuccucucu

SEQ ID NO: 323877 - RNA, 22 nt, Human
ugcgccugcgcaaagguuucug

SEQ ID NO: 323878 - RNA, 22 nt, Human
cagcgguggcaaggugacugug

SEQ ID NO: 323879 - RNA, 22 nt, Human
ugcauuaagaauuucugaggau

SEQ ID NO: 323880 - RNA, 22 nt, Human
aacaucuagguucucaucgaua

SEQ ID NO: 323881 - RNA, 22 nt, Human
agcuccugaaaagcgcuugcuu

SEQ ID NO: 323882 - RNA, 22 nt, Human
ugcuuucaaugaauuguauacu

SEQ ID NO: 323883 - RNA, 22 nt, Human
cucuaaauguggucugcagaua

SEQ ID NO: 323884 - RNA, 17 nt, Human
ccuuucuucccagaggg

SEQ ID NO: 323885 - RNA, 21 nt, Human
uaccaagaaguuugggaaagc

SEQ ID NO: 323886 - RNA, 22 nt, Human
uggugaagucagcggagcccgg

SEQ ID NO: 323887 - RNA, 22 nt, Human
gcucccuggaauguuggcugcc

SEQ ID NO: 323888 - RNA, 22 nt, Human
ucaggccaggagaucagauuga

SEQ ID NO: 323889 - RNA, 22 nt, Human
gugcuaaugaauuggagugccu

SEQ ID NO: 323890 - RNA, 22 nt, Human
uuuuucaagacaaccugcaugu

SEQ ID NO: 323891 - RNA, 22 nt, Human
aagcccucagagccucuuugac

SEQ ID NO: 323892 - RNA, 22 nt, Human
agcgcuugccgcacuccaagca

SEQ ID NO: 323893 - RNA, 22 nt, Human
gggcucaucaagccucuccgcc

SEQ ID NO: 323894 - RNA, 22 nt, Human
agcacauucccaccuguacuuc

SEQ ID NO: 323895 - RNA, 22 nt, Human
aguuggaagacacccugaaauc

SEQ ID NO: 323896 - RNA, 22 nt, Human
cugggguuggccagggcccuag

SEQ ID NO: 323897 - RNA, 22 nt, Human
cacaauuuccauugagcagcag

SEQ ID NO: 323898 - RNA, 22 nt, Human
caucagucugaaagccagggag

SEQ ID NO: 323899 - RNA, 22 nt, Human
ugucuggauagagccuaggccc

SEQ ID NO: 323900 - RNA, 23 nt, Human
cagcugguugugggaguggcugc

SEQ ID NO: 323901 - RNA, 23 nt, Human
gacagagugagaccuugucuuac

SEQ ID NO: 323902 - RNA, 22 nt, Human
cagagcugacccaaggauugaa

SEQ ID NO: 323903 - RNA, 22 nt, Human
uggaaauacaagaaguauguca

SEQ ID NO: 323904 - RNA, 23 nt, Human
caaaaugcuaugugcccaaugca

SEQ ID NO: 323905 - RNA, 22 nt, Human
guuaacaacacugugagugcug

SEQ ID NO: 323906 - RNA, 22 nt, Human
cccuggaacccauggccagugu

SEQ ID NO: 323907 - RNA, 22 nt, Human
auuagguaguauaaucuuuguu

SEQ ID NO: 323908 - RNA, 22 nt, Human
aaugcaaugcagcaccuccuug

SEQ ID NO: 323909 - RNA, 20 nt, Human
cuugaguucagagcugucau

SEQ ID NO: 323910 - RNA, 22 nt, Human
aauacagauggcaugugaagau

SEQ ID NO: 323911 - RNA, 22 nt, Human
aacacugagaggggaguggcac

SEQ ID NO: 323912 - RNA, 22 nt, Human
uucuguuuauaauuugcaguug

SEQ ID NO: 323913 - RNA, 22 nt, Human
agcacugugagcaccagcacgc

SEQ ID NO: 323914 - RNA, 19 nt, Human
ucuggcugccaaggauuga

SEQ ID NO: 323915 - RNA, 22 nt, Human
gucccucugccugugguucucu

SEQ ID NO: 323916 - RNA, 22 nt, Human
aauguuugaacuuugcauauuu

SEQ ID NO: 323917 - RNA, 22 nt, Human
acaccacaaguaacucuuuucc

SEQ ID NO: 323918 - RNA, 22 nt, Human
gcuaagggauaggcugccuccu

SEQ ID NO: 323919 - RNA, 22 nt, Human
cagugacguaaacugcaugugc

SEQ ID NO: 323920 - RNA, 22 nt, Human
cauuguguauuucuguaguacu

SEQ ID NO: 323921 - RNA, 22 nt, Human
caaagcccagaggccucacuuu

SEQ ID NO: 323922 - RNA, 22 nt, Human
uuuccaaagguggcaggaacaa

SEQ ID NO: 323923 - RNA, 22 nt, Human
cuggcuuucauggcgcaguuga

SEQ ID NO: 323924 - RNA, 22 nt, Human
aucucccaaauuagccucuuga

SEQ ID NO: 323925 - RNA, 22 nt, Human
agugcuuuauguuguugugcaa

SEQ ID NO: 323926 - RNA, 22 nt, Human
ccugcgggcugugcugaagccu

SEQ ID NO: 323927 - RNA, 22 nt, Human
uuccagcuaacucacaucccuu

SEQ ID NO: 323928 - RNA, 22 nt, Human
ucucuuugacccuuuagcucca

SEQ ID NO: 323929 - RNA, 22 nt, Human
uuccaggacuggguguuugaag

SEQ ID NO: 323930 - RNA, 22 nt, Human
caauguuuuuccuuccuuaaua

SEQ ID NO: 323931 - RNA, 22 nt, Human
guggcauuugggagaugcgugg

SEQ ID NO: 323932 - RNA, 22 nt, Human
uguguuucugagaaucccaccu

SEQ ID NO: 323933 - RNA, 22 nt, Human
uugagcugccuggcuguggcuc

SEQ ID NO: 323934 - RNA, 22 nt, Human
gcguggcuuagagugggguacc

SEQ ID NO: 323935 - RNA, 22 nt, Human
uuaguguccagaguuuuuauua

SEQ ID NO: 323936 - RNA, 22 nt, Human
guuggcuaugagagcuuuagug

SEQ ID NO: 323937 - RNA, 22 nt, Human
gacuuugccacuugcuccagcu

SEQ ID NO: 323938 - RNA, 22 nt, Human
guguuuugugaggccuucuuuc

SEQ ID NO: 323939 - RNA, 22 nt, Human
agagcaauuagcuuagguaaaa

SEQ ID NO: 323940 - RNA, 18 nt, Human
uccaccgcgugcaccucu

SEQ ID NO: 323941 - RNA, 22 nt, Human
cagguuccaguugcagggacuu

SEQ ID NO: 323942 - RNA, 21 nt, Human
uccaaaggagacugagugugu

SEQ ID NO: 323943 - RNA, 20 nt, Human
uucaugcagugguugcugug

SEQ ID NO: 323944 - RNA, 22 nt, Human
augcuugcccauguuucugaag

SEQ ID NO: 323945 - RNA, 22 nt, Human
acccaggucucucgacuucugg

SEQ ID NO: 323946 - RNA, 21 nt, Human
uggcaggcagcuggaagcuug

SEQ ID NO: 323947 - RNA, 22 nt, Human
uuccagagaguuauuccccugg

SEQ ID NO: 323948 - RNA, 22 nt, Human
ugcacauggccugagugccuga

SEQ ID NO: 323949 - RNA, 22 nt, Human
uuuccacacucacugcacucau

SEQ ID NO: 323950 - RNA, 22 nt, Human
ccgcuguccuggagcugcugcu

SEQ ID NO: 323951 - RNA, 22 nt, Human
uguuuuaagggucaacugucac

SEQ ID NO: 323952 - RNA, 21 nt, Human
ugcaaugcauugacagcagca

SEQ ID NO: 323953 - RNA, 22 nt, Human
uuauuuaaaauguagguuggga

SEQ ID NO: 323954 - RNA, 22 nt, Human
cagcugcucugguggucucucc

SEQ ID NO: 323955 - RNA, 22 nt, Human
cuuucugaggagacgggcuuug

SEQ ID NO: 323956 - RNA, 23 nt, Human
uugguuacuggauuugaggggcc

SEQ ID NO: 323957 - RNA, 22 nt, Human
uuucaaguagagggaucgcuag

SEQ ID NO: 323958 - RNA, 22 nt, Human
aaugaaacuauauuuagagagg

SEQ ID NO: 323959 - RNA, 22 nt, Human
aauucauacucuauauugcuuu

SEQ ID NO: 323960 - RNA, 22 nt, Human
cccacugcaugaguugguauua

SEQ ID NO: 323961 - RNA, 22 nt, Human
aggcuuaacuacaauuuuugcc

SEQ ID NO: 323962 - RNA, 22 nt, Human
ggagaggggaacuuguugcuug

SEQ ID NO: 323963 - RNA, 23 nt, Human
uggcucugagcuuccugguggcc

SEQ ID NO: 323964 - RNA, 17 nt, Human
gcuccagaauucuaguc

SEQ ID NO: 323965 - RNA, 22 nt, Human
uuccagaacaauguggacguau

SEQ ID NO: 323966 - RNA, 22 nt, Human
ugagucaccucucagaagccac

SEQ ID NO: 323967 - RNA, 22 nt, Human
uggcggugacggcggcgccugg

SEQ ID NO: 323968 - RNA, 22 nt, Human
uacauguacaugcauagguaga

SEQ ID NO: 323969 - RNA, 22 nt, Human
agggccagcagcuuggccaacc

SEQ ID NO: 323970 - RNA, 22 nt, Human
ggucuggccuccgggcaggugg

SEQ ID NO: 323971 - RNA, 21 nt, Human
ucccacuggcccagggcucca

SEQ ID NO: 323972 - RNA, 22 nt, Human
gaaaugucaagauauguuugga

SEQ ID NO: 323973 - RNA, 22 nt, Human
uggauaaaaugacauuaccuga

SEQ ID NO: 323974 - RNA, 23 nt, Human
acaaguguuuccaauauggcugg

SEQ ID NO: 323975 - RNA, 22 nt, Human
accccagaggcggaggcugcag

SEQ ID NO: 323976 - RNA, 22 nt, Human
gugcuggcuggggcaucaggca

SEQ ID NO: 323977 - RNA, 22 nt, Human
agggaaauuaaugugagcaaug

SEQ ID NO: 323978 - RNA, 22 nt, Human
ucaggagaguguucaguggagg

SEQ ID NO: 323979 - RNA, 21 nt, Human
uccugccuuaguccagagcag

SEQ ID NO: 323980 - RNA, 22 nt, Human
cuguccagcgacuaggggaugg

SEQ ID NO: 323981 - RNA, 22 nt, Human
uuuccucacacagaagaucuug

SEQ ID NO: 323982 - RNA, 22 nt, Human
ucuggcuucaguaggguucacu

SEQ ID NO: 323983 - RNA, 22 nt, Human
aauuauugagcaucuacugugu

SEQ ID NO: 323984 - RNA, 22 nt, Human
auuucagcagcccauguuugga

SEQ ID NO: 323985 - RNA, 22 nt, Human
guagcccaccuggggagggcga

SEQ ID NO: 323986 - RNA, 21 nt, Human
uccaggagcacgggacuagga

SEQ ID NO: 323987 - RNA, 19 nt, Human
cgcacagccugccaggcgc

SEQ ID NO: 323988 - RNA, 22 nt, Human
gagcugcagcggcugacgcaac

SEQ ID NO: 323989 - RNA, 22 nt, Human
agcaccaggucgcuggcacgcu

SEQ ID NO: 323990 - RNA, 22 nt, Human
uacaaagugauuuuggaauuga

SEQ ID NO: 323991 - RNA, 22 nt, Human
ucacccuucccagcuguccgcc

SEQ ID NO: 323992 - RNA, 22 nt, Human
ccagcugcgggcaucgagaguu

SEQ ID NO: 323993 - RNA, 22 nt, Human
cccaugcacccucuaagaagga

SEQ ID NO: 323994 - RNA, 22 nt, Human
gcuugcuuuguaaauaucugug

SEQ ID NO: 323995 - RNA, 22 nt, Human
auacaacagaaaaugauuauuc

SEQ ID NO: 323996 - RNA, 22 nt, Human
uugaagcauuugcuauagcauu

SEQ ID NO: 323997 - RNA, 22 nt, Human
gauugcugggucccacucccag

SEQ ID NO: 323998 - RNA, 22 nt, Human
gcccaguggcaucuucacugcu

SEQ ID NO: 323999 - RNA, 22 nt, Human
ugucaaguuguuaaguucuggg

SEQ ID NO: 324000 - RNA, 22 nt, Human
ccuuggcuuaccuucugugugg

SEQ ID NO: 324001 - RNA, 22 nt, Human
aucaacuuguccuugauguuaa

SEQ ID NO: 324002 - RNA, 22 nt, Human
cugguuuuccaauguuuugacu

SEQ ID NO: 324003 - RNA, 22 nt, Human
cauuuagaagucuuagaacuau

SEQ ID NO: 324004 - RNA, 22 nt, Human
ggaaggguuuaagcaggagagu

SEQ ID NO: 324005 - RNA, 21 nt, Human
uaaaagaugacaagacagcuc

SEQ ID NO: 324006 - RNA, 22 nt, Human
ugccuggauggcucugagcagg

SEQ ID NO: 324007 - RNA, 20 nt, Human
agcuuugguuaagccagugg

SEQ ID NO: 324008 - RNA, 22 nt, Human
uacugcugagcuggguagaagg

SEQ ID NO: 324009 - RNA, 22 nt, Human
ugcaaaaagagcgaggagcccu

SEQ ID NO: 324010 - RNA, 18 nt, Human
agguguguuucuaggagc

SEQ ID NO: 324011 - RNA, 20 nt, Human
agcuggcccccgguggccug

SEQ ID NO: 324012 - RNA, 22 nt, Human
gaaggcaagcagcauaaauguc

SEQ ID NO: 324013 - RNA, 21 nt, Human
agcugugguuuuacaucuuuu

SEQ ID NO: 324014 - RNA, 22 nt, Human
auuguauacaagcuuaauuguu

SEQ ID NO: 324015 - RNA, 22 nt, Human
cauuuacauuuaagguuaauau

SEQ ID NO: 324016 - RNA, 22 nt, Human
uuccuguucaggaaaguugugu

SEQ ID NO: 324017 - RNA, 22 nt, Human
ugugugggcgaagacagccuuu

SEQ ID NO: 324018 - RNA, 22 nt, Human
cgcgcugcagacagcggaggcc

SEQ ID NO: 324019 - RNA, 20 nt, Human
acagagauccucucuuuauc

SEQ ID NO: 324020 - RNA, 22 nt, Human
gaaacauuuguugaguacuugc

SEQ ID NO: 324021 - RNA, 22 nt, Human
aaagaugucauacacauuaaga

SEQ ID NO: 324022 - RNA, 22 nt, Human
gaccacaguccagucaucaugg

SEQ ID NO: 324023 - RNA, 22 nt, Human
agagacauagcacaguuuuucg

SEQ ID NO: 324024 - RNA, 22 nt, Human
uacauuccaaaggaaacuggcu

SEQ ID NO: 324025 - RNA, 22 nt, Human
uuacuguagcuugacauauguc

SEQ ID NO: 324026 - RNA, 22 nt, Human
cuccguggcuguggacgcagcc

SEQ ID NO: 324027 - RNA, 22 nt, Human
ggagcugugcugggugaucagg

SEQ ID NO: 324028 - RNA, 22 nt, Human
guccuguguaaguacuugcuca

SEQ ID NO: 324029 - RNA, 22 nt, Human
agcucaguggcuggggcgcugc

SEQ ID NO: 324030 - RNA, 22 nt, Human
uucuuuuaauagagauccugug

SEQ ID NO: 324031 - RNA, 22 nt, Human
cauggccaaagaauuauauuuu

SEQ ID NO: 324032 - RNA, 22 nt, Human
guagcagagggcccagguaacu

SEQ ID NO: 324033 - RNA, 22 nt, Human
cccagagcaugugcugccuuug

SEQ ID NO: 324034 - RNA, 21 nt, Human
gcugcucgagauccagugcuu

SEQ ID NO: 324035 - RNA, 17 nt, Human
uccuggccuggugugug

SEQ ID NO: 324036 - RNA, 22 nt, Human
uaaucuuagacauguauuuuuc

SEQ ID NO: 324037 - RNA, 22 nt, Human
gcccuguuuucuggguuccuug

SEQ ID NO: 324038 - RNA, 22 nt, Human
gaagguuuuguuugcaaaucau

SEQ ID NO: 324039 - RNA, 21 nt, Human
uuccuggaggcagaaacguga

SEQ ID NO: 324040 - RNA, 22 nt, Human
acugcauuaucaccaagaugua

SEQ ID NO: 324041 - RNA, 22 nt, Human
gcaggcuuauggggagacagag

SEQ ID NO: 324042 - RNA, 22 nt, Human
ugggcugcuuccucagcugaga

SEQ ID NO: 324043 - RNA, 22 nt, Human
uccuggcccuguggccugcagu

SEQ ID NO: 324044 - RNA, 17 nt, Human
caguuucuucccccucu

SEQ ID NO: 324045 - RNA, 22 nt, Human
ugggggagccuucacaguagcu

SEQ ID NO: 324046 - RNA, 22 nt, Human
ggagacucaccccgcauucuag

SEQ ID NO: 324047 - RNA, 22 nt, Human
uuuagcaaaaaagcucugcgua

SEQ ID NO: 324048 - RNA, 22 nt, Human
uccagcucugcugugcgccggu

SEQ ID NO: 324049 - RNA, 22 nt, Human
uggcugaggagagggcggaagu

SEQ ID NO: 324050 - RNA, 22 nt, Human
cugagcugguucucuugugaaa

SEQ ID NO: 324051 - RNA, 22 nt, Human
uggcuccuuccgcagcaugccu

SEQ ID NO: 324052 - RNA, 19 nt, Human
gggaaugauggaagacuuc

SEQ ID NO: 324053 - RNA, 22 nt, Human
uguccagaucaaugcccacaug

SEQ ID NO: 324054 - RNA, 22 nt, Human
uccagcaguccaugugagacac

SEQ ID NO: 324055 - RNA, 23 nt, Human
gccagagcugccugcccuugcug

SEQ ID NO: 324056 - RNA, 22 nt, Human
uagaaaagccccagcuggaggg

SEQ ID NO: 324057 - RNA, 22 nt, Human
gucaggggccaugggccaagga

SEQ ID NO: 324058 - RNA, 22 nt, Human
gcuuccuucuaccacaucaugc

SEQ ID NO: 324059 - RNA, 22 nt, Human
cgcaggugccggcagauggggu

SEQ ID NO: 324060 - RNA, 22 nt, Human
caguauuucauucagaauuguu

SEQ ID NO: 324061 - RNA, 22 nt, Human
gucccuggucuaccguggcuuc

SEQ ID NO: 324062 - RNA, 22 nt, Human
ggagguggagcuggaaguucca

SEQ ID NO: 324063 - RNA, 17 nt, Human
aguuuuuggaccugugu

SEQ ID NO: 324064 - RNA, 22 nt, Human
uguaagcuucaaauaucuguga

SEQ ID NO: 324065 - RNA, 22 nt, Human
gcuuccaaugcuucuaucacau

SEQ ID NO: 324066 - RNA, 22 nt, Human
aaguuugucucauuugaucuuc

SEQ ID NO: 324067 - RNA, 22 nt, Human
gguggcagaggugcaucagccc

SEQ ID NO: 324068 - RNA, 17 nt, Human
aguuggcagccguugcu

SEQ ID NO: 324069 - RNA, 22 nt, Human
acagcuucgaggaucucauccc

SEQ ID NO: 324070 - RNA, 22 nt, Human
gcagcagaaggccaaggggagc

SEQ ID NO: 324071 - RNA, 23 nt, Human
gacagguaaggguugggagaauc

SEQ ID NO: 324072 - RNA, 22 nt, Human
gcacaaaagguacuucauguag

SEQ ID NO: 324073 - RNA, 22 nt, Human
aaugguaauauuucauaguugu

SEQ ID NO: 324074 - RNA, 22 nt, Human
uuuucaguugugcucucuaguu

SEQ ID NO: 324075 - RNA, 22 nt, Human
aauuauguuugcuuuagaugga

SEQ ID NO: 324076 - RNA, 22 nt, Human
ucaccccuugugaaugcugcuc

SEQ ID NO: 324077 - RNA, 22 nt, Human
cauggcaggugcagauucugug

SEQ ID NO: 324078 - RNA, 22 nt, Human
uuagaaaaaggcuguggucuua

SEQ ID NO: 324079 - RNA, 21 nt, Human
gacauugagcgugucgcagug

SEQ ID NO: 324080 - RNA, 20 nt, Human
ucagugggaaagugagagug

SEQ ID NO: 324081 - RNA, 22 nt, Human
agagcuauuucuuaaaagcugu

SEQ ID NO: 324082 - RNA, 22 nt, Human
ugucacagagcgugcaacagaa

SEQ ID NO: 324083 - RNA, 22 nt, Human
uggaagggguuacgcagcagga

SEQ ID NO: 324084 - RNA, 22 nt, Human
ucuauuaaugauucaauagugu

SEQ ID NO: 324085 - RNA, 22 nt, Human
ugcagguggcagcggggcacca

SEQ ID NO: 324086 - RNA, 22 nt, Human
gugccaccagaugcuguugcua

SEQ ID NO: 324087 - RNA, 22 nt, Human
ugcucuguucaguguaucuugu

SEQ ID NO: 324088 - RNA, 22 nt, Human
gucauuuuugacuuugaaguga

SEQ ID NO: 324089 - RNA, 20 nt, Human
gggcucugcauccaucagcc

SEQ ID NO: 324090 - RNA, 22 nt, Human
aucccaggcggcacagguugca

SEQ ID NO: 324091 - RNA, 22 nt, Human
ugcaaauucuuuacucugugau

SEQ ID NO: 324092 - RNA, 22 nt, Human
guuuccaagucucucaacaccc

SEQ ID NO: 324093 - RNA, 22 nt, Human
uugauggacagggaccacuguc

SEQ ID NO: 324094 - RNA, 22 nt, Human
guucuucaggcugugcucuaga

SEQ ID NO: 324095 - RNA, 22 nt, Human
cugggguccuugccauguguca

SEQ ID NO: 324096 - RNA, 22 nt, Human
uaacaaaguauuguuuguguau

SEQ ID NO: 324097 - RNA, 22 nt, Human
cuggcagcucugagucccuucu

SEQ ID NO: 324098 - RNA, 22 nt, Human
gagggugguggcuuaaggugcu

SEQ ID NO: 324099 - RNA, 22 nt, Human
acauuguugagccucuuguuca

SEQ ID NO: 324100 - RNA, 22 nt, Human
caguggaugucucauaguguga

SEQ ID NO: 324101 - RNA, 22 nt, Human
ucugcuggaaaaccagggaauu

SEQ ID NO: 324102 - RNA, 22 nt, Human
guuuuaguggguggccacugau

SEQ ID NO: 324103 - RNA, 22 nt, Human
gcagcuuuggagguggaacucu

SEQ ID NO: 324104 - RNA, 22 nt, Human
ccaaggcuggagggcuuaugua

SEQ ID NO: 324105 - RNA, 22 nt, Human
aggcugcagaggugcugccaga

SEQ ID NO: 324106 - RNA, 22 nt, Human
cucugagguuccuuugcccucg

SEQ ID NO: 324107 - RNA, 22 nt, Human
uuguugcaagccuggaaucugg

SEQ ID NO: 324108 - RNA, 22 nt, Human
uacagcuugauguuuguguguu

SEQ ID NO: 324109 - RNA, 22 nt, Human
uggcuuuugaaaaggugaugua

SEQ ID NO: 324110 - RNA, 22 nt, Human
cagagcugucauuugccaguga

SEQ ID NO: 324111 - RNA, 20 nt, Human
auuugcuuaccuuguuucua

SEQ ID NO: 324112 - RNA, 22 nt, Human
gguggcaccuuacccugcgcag

SEQ ID NO: 324113 - RNA, 22 nt, Human
ccagcugcugcaccgugcaugg

SEQ ID NO: 324114 - RNA, 22 nt, Human
uaaagcauguuucaguaagguu

SEQ ID NO: 324115 - RNA, 21 nt, Human
aucuuaaaaggucuuaacuuu

SEQ ID NO: 324116 - RNA, 23 nt, Human
aggcagguuugggcucuucuugu

SEQ ID NO: 324117 - RNA, 22 nt, Human
ggcgcggugacucagccucgcu

SEQ ID NO: 324118 - RNA, 22 nt, Human
augcauaucuccuaucuccuca

SEQ ID NO: 324119 - RNA, 22 nt, Human
aacugcuaacugguuugauacu

SEQ ID NO: 324120 - RNA, 18 nt, Human
gcugaaauucuaaacaaa

SEQ ID NO: 324121 - RNA, 22 nt, Human
acauuuuuggguugaugucuga

SEQ ID NO: 324122 - RNA, 22 nt, Human
ggccuugguaaauuggcauuug

SEQ ID NO: 324123 - RNA, 22 nt, Human
acaguguuacuugauaguguau

SEQ ID NO: 324124 - RNA, 19 nt, Human
acaguuugggaaaugagca

SEQ ID NO: 324125 - RNA, 22 nt, Human
gugccgcuggagcuggaauuga

SEQ ID NO: 324126 - RNA, 22 nt, Human
cuuuacagauggauaauuguuu

SEQ ID NO: 324127 - RNA, 22 nt, Human
uggccagaacucagacaugugg

SEQ ID NO: 324128 - RNA, 19 nt, Human
ugguggaggccccauguuc

SEQ ID NO: 324129 - RNA, 22 nt, Human
ggggaagaaauagaacauuuug

SEQ ID NO: 324130 - RNA, 22 nt, Human
guggcagagagcaagugucuga

SEQ ID NO: 324131 - RNA, 22 nt, Human
uccaagaagcuuacaaucuaau

SEQ ID NO: 324132 - RNA, 22 nt, Human
ccacugauucugccaggucucu

SEQ ID NO: 324133 - RNA, 22 nt, Human
agccacauggaccugaugcuag

SEQ ID NO: 324134 - RNA, 22 nt, Human
caggaggaaaguuccacucaac

SEQ ID NO: 324135 - RNA, 22 nt, Human
ccugcacuaccuggggcugcug

SEQ ID NO: 324136 - RNA, 22 nt, Human
ggagacagugacuuagagacug

SEQ ID NO: 324137 - RNA, 22 nt, Human
auggcauuugaaucugucuuuu

SEQ ID NO: 324138 - RNA, 22 nt, Human
uuuggcaagcgaguacuuucug

SEQ ID NO: 324139 - RNA, 22 nt, Human
cuggcuuuuggaggagggucag

SEQ ID NO: 324140 - RNA, 22 nt, Human
gcugggagucgcgucuguggcc

SEQ ID NO: 324141 - RNA, 19 nt, Human
ggcugccuucugcucaucu

SEQ ID NO: 324142 - RNA, 22 nt, Human
caucuugucuuuuugggccuga

SEQ ID NO: 324143 - RNA, 22 nt, Human
cuaguucugccauucaguguca

SEQ ID NO: 324144 - RNA, 22 nt, Human
guucuccaggggcuguucaucu

SEQ ID NO: 324145 - RNA, 18 nt, Human
uccauccucugcucuuca

SEQ ID NO: 324146 - RNA, 22 nt, Human
auauaugaagaagucuugauua

SEQ ID NO: 324147 - RNA, 22 nt, Human
ucugcuugugucuguccagccu

SEQ ID NO: 324148 - RNA, 22 nt, Human
aagcuggccuguaccugcugag

SEQ ID NO: 324149 - RNA, 22 nt, Human
ugaugggaggugcugcaggacc

SEQ ID NO: 324150 - RNA, 22 nt, Human
cugccaucugagccaaaagugc

SEQ ID NO: 324151 - RNA, 22 nt, Human
cuggagcuggcccaggcuggcc

SEQ ID NO: 324152 - RNA, 22 nt, Human
aacuuucagaauccuaugcauu

SEQ ID NO: 324153 - RNA, 22 nt, Human
guugcagcaucacugcugagug

SEQ ID NO: 324154 - RNA, 22 nt, Human
auaguagcgagaucucagcuca

SEQ ID NO: 324155 - RNA, 22 nt, Human
ccaggugugcucugcaguggau

SEQ ID NO: 324156 - RNA, 22 nt, Human
ccuuuuaagggagacuagagau

SEQ ID NO: 324157 - RNA, 22 nt, Human
uuuucuuggaguggcuguccuu

SEQ ID NO: 324158 - RNA, 22 nt, Human
ugccaggccucaggagucucca

SEQ ID NO: 324159 - RNA, 22 nt, Human
uuguuuguaaggcucuuagaau

SEQ ID NO: 324160 - RNA, 22 nt, Human
augcugccuccucuucagccgc

SEQ ID NO: 324161 - RNA, 22 nt, Human
acaaacugggauaggauccugu

SEQ ID NO: 324162 - RNA, 22 nt, Human
gaugggcaucaaacaugacgug

SEQ ID NO: 324163 - RNA, 22 nt, Human
acugcauucuuuaucccacaac

SEQ ID NO: 324164 - RNA, 22 nt, Human
aaauugcuugagauuagucucc

SEQ ID NO: 324165 - RNA, 22 nt, Human
uuguuuaaagaacuucugacuu

SEQ ID NO: 324166 - RNA, 22 nt, Human
ggccgcggauuuucccgcuggc

SEQ ID NO: 324167 - RNA, 21 nt, Human
ucuuggggaggagggcugcac

SEQ ID NO: 324168 - RNA, 22 nt, Human
ugugacguuguucuggauuccc

SEQ ID NO: 324169 - RNA, 21 nt, Human
acucugaaaauuaauaguuau

SEQ ID NO: 324170 - RNA, 22 nt, Human
uuagccaugcccuagaagagga

SEQ ID NO: 324171 - RNA, 22 nt, Human
gagcuguguaugcaucauucug

SEQ ID NO: 324172 - RNA, 22 nt, Human
ucagaacauccugguuuaaaau

SEQ ID NO: 324173 - RNA, 22 nt, Human
cacuguugagcaauguacagug

SEQ ID NO: 324174 - RNA, 22 nt, Human
aaagcacauuacaagcucaguc

SEQ ID NO: 324175 - RNA, 21 nt, Human
auccauccaucuuggccuaac

SEQ ID NO: 324176 - RNA, 22 nt, Human
uuucugcagcagacucagugug

SEQ ID NO: 324177 - RNA, 22 nt, Human
cagcuccagcccaggcagcucc

SEQ ID NO: 324178 - RNA, 22 nt, Human
ucuucaugaaauugauugcuua

SEQ ID NO: 324179 - RNA, 22 nt, Human
gcuagaaacuguuuaaucucuu

SEQ ID NO: 324180 - RNA, 22 nt, Human
ugucuuuagccacuugccucuu

SEQ ID NO: 324181 - RNA, 22 nt, Human
ugguggcacugacaucagacac

SEQ ID NO: 324182 - RNA, 18 nt, Human
cccacggugcuguagggc

SEQ ID NO: 324183 - RNA, 22 nt, Human
ugccgcgcgcccagguuaggug

SEQ ID NO: 324184 - RNA, 22 nt, Human
ggcuucuuagaauuugacuuac

SEQ ID NO: 324185 - RNA, 22 nt, Human
ucacaauacucacucaauggcu

SEQ ID NO: 324186 - RNA, 22 nt, Human
guuuacaacaucuuguccuuca

SEQ ID NO: 324187 - RNA, 22 nt, Human
ugggcacagugaguugccuuua

SEQ ID NO: 324188 - RNA, 22 nt, Human
agucaacauuugagaugcaaug

SEQ ID NO: 324189 - RNA, 22 nt, Human
cgcugcgaggcgcccuuguugc

SEQ ID NO: 324190 - RNA, 23 nt, Human
uuguucuuggaucuuccugaagc

SEQ ID NO: 324191 - RNA, 22 nt, Human
caguauuuaggauuaggagaga

SEQ ID NO: 324192 - RNA, 22 nt, Human
uaucuguauucugacagucacu

SEQ ID NO: 324193 - RNA, 22 nt, Human
uguauuucugcuuucucuagua

SEQ ID NO: 324194 - RNA, 22 nt, Human
gucuggaggaggaagaaggcac

SEQ ID NO: 324195 - RNA, 22 nt, Human
ucuucaugucaugguauauuga

SEQ ID NO: 324196 - RNA, 22 nt, Human
aaaacauuuuacugccaucuca

SEQ ID NO: 324197 - RNA, 22 nt, Human
ucaaagcacuggggaaagccug

SEQ ID NO: 324198 - RNA, 22 nt, Human
cuugcuuuaucugguuucucau

SEQ ID NO: 324199 - RNA, 22 nt, Human
ggcagcaggguagccauuucuc

SEQ ID NO: 324200 - RNA, 22 nt, Human
gguucaguggaauguguugacc

SEQ ID NO: 324201 - RNA, 22 nt, Human
gggaagugcccucuucaggaga

SEQ ID NO: 324202 - RNA, 22 nt, Human
gccagugccugcugcucagggc

SEQ ID NO: 324203 - RNA, 22 nt, Human
ugcauuucccauuguguggcuc

SEQ ID NO: 324204 - RNA, 22 nt, Human
uuauuccauagaagucaaggaa

SEQ ID NO: 324205 - RNA, 21 nt, Human
gucuuuuuaauugcgauuucc

SEQ ID NO: 324206 - RNA, 22 nt, Human
uuaaaagaauccuguuauccuc

SEQ ID NO: 324207 - RNA, 22 nt, Human
uggaaagaggaagugcccagca

SEQ ID NO: 324208 - RNA, 22 nt, Human
aauagcaaaugcucauuugaaa

SEQ ID NO: 324209 - RNA, 22 nt, Human
ugcuucucucuaggaagacgcu

SEQ ID NO: 324210 - RNA, 22 nt, Human
uuccuuggaaagagacgucgcu

SEQ ID NO: 324211 - RNA, 22 nt, Human
cuuauuugcccauguuucuuua

SEQ ID NO: 324212 - RNA, 22 nt, Human
gcccucugguggccgccucggc

SEQ ID NO: 324213 - RNA, 22 nt, Human
aggcauuacaucuaaauauuua

SEQ ID NO: 324214 - RNA, 22 nt, Human
uggcugaggcuuuucuuaaaga

SEQ ID NO: 324215 - RNA, 22 nt, Human
aauguuaaguuuagauuauaac

SEQ ID NO: 324216 - RNA, 22 nt, Human
augacagcucuagcacacagua

SEQ ID NO: 324217 - RNA, 22 nt, Human
gagcacugauuuauuuuugucu

SEQ ID NO: 324218 - RNA, 18 nt, Human
gacaaaaguacagacaga

SEQ ID NO: 324219 - RNA, 22 nt, Human
gggagacaaaggugagguucuu

SEQ ID NO: 324220 - RNA, 22 nt, Human
ggagccaguuuagaccucaguu

SEQ ID NO: 324221 - RNA, 22 nt, Human
cagaaagugauuugcuauucca

SEQ ID NO: 324222 - RNA, 22 nt, Human
ccucuggccuaggccgggagag

SEQ ID NO: 324223 - RNA, 22 nt, Human
aggaauuugggguuacaugaug

SEQ ID NO: 324224 - RNA, 22 nt, Human
cgggaagguggagguugcagug

SEQ ID NO: 324225 - RNA, 22 nt, Human
ugcacccacuuagcugaaguuc

SEQ ID NO: 324226 - RNA, 23 nt, Human
ccacuggagaaaguggcaggugg

SEQ ID NO: 324227 - RNA, 22 nt, Human
uccaggagcucauccacgucaa

SEQ ID NO: 324228 - RNA, 22 nt, Human
ucauggcucuaaagacauagau

SEQ ID NO: 324229 - RNA, 19 nt, Human
ccuggcccugcugcgcggg

SEQ ID NO: 324230 - RNA, 22 nt, Human
cuguguccaauggccuuagcag

SEQ ID NO: 324231 - RNA, 22 nt, Human
gcuucugcagagccguccugag

SEQ ID NO: 324232 - RNA, 22 nt, Human
acagugcuaucaauagcuagaa

SEQ ID NO: 324233 - RNA, 22 nt, Human
aucuggcucccuuggaauccgu

SEQ ID NO: 324234 - RNA, 22 nt, Human
ucugcucagccgaucugcuccg

SEQ ID NO: 324235 - RNA, 22 nt, Human
uauuuggauagacagggagaug

SEQ ID NO: 324236 - RNA, 20 nt, Human
gcugugccaugacccucgag

SEQ ID NO: 324237 - RNA, 23 nt, Human
aguguucagcauguaguaaauac

SEQ ID NO: 324238 - RNA, 22 nt, Human
caugcaugccgggcugacagag

SEQ ID NO: 324239 - RNA, 22 nt, Human
uguuccucugaacuucuuccaa

SEQ ID NO: 324240 - RNA, 22 nt, Human
caaacuuacuguguuuaaagag

SEQ ID NO: 324241 - RNA, 22 nt, Human
auauguggcauuauuucugagg

SEQ ID NO: 324242 - RNA, 18 nt, Human
uggguggcuagggaguuu

SEQ ID NO: 324243 - RNA, 22 nt, Human
cugcggcuggggacagcuguug

SEQ ID NO: 324244 - RNA, 22 nt, Human
ugagaagcauuaggaagaacau

SEQ ID NO: 324245 - RNA, 22 nt, Human
auuuccuauacaguuguccaua

SEQ ID NO: 324246 - RNA, 22 nt, Human
uccucauucuuggugcaucaaa

SEQ ID NO: 324247 - RNA, 22 nt, Human
gccagcuggcugcaggucccag

SEQ ID NO: 324248 - RNA, 22 nt, Human
cucagcuucuaccuccugagug

SEQ ID NO: 324249 - RNA, 22 nt, Human
auccauuugccgugcuaugugc

SEQ ID NO: 324250 - RNA, 19 nt, Human
gagcagcuuccuaucuggu

SEQ ID NO: 324251 - RNA, 22 nt, Human
aacagaaaucauuuagggcucu

SEQ ID NO: 324252 - RNA, 22 nt, Human
ugguuacccagucgcuggaguu

SEQ ID NO: 324253 - RNA, 22 nt, Human
gaauguuauugaacuacgagcu

SEQ ID NO: 324254 - RNA, 22 nt, Human
uuuauccaccuuacccuguucc

SEQ ID NO: 324255 - RNA, 22 nt, Human
ccacuuaagagaacagcuauag

SEQ ID NO: 324256 - RNA, 20 nt, Human
ucucuggcaagaagcugcag

SEQ ID NO: 324257 - RNA, 22 nt, Human
cagcuggcgacucuccucgaug

SEQ ID NO: 324258 - RNA, 22 nt, Human
ucagaagguacugaagacaugg

SEQ ID NO: 324259 - RNA, 22 nt, Human
cgugcagcggagcuggucacug

SEQ ID NO: 324260 - RNA, 22 nt, Human
gagggaaacagauggguugugg

SEQ ID NO: 324261 - RNA, 22 nt, Human
gagguggcugcuugcugggaaa

SEQ ID NO: 324262 - RNA, 22 nt, Human
ccauggccaggaaagccaaggu

SEQ ID NO: 324263 - RNA, 22 nt, Human
augacuuaaucauacuugcauu

SEQ ID NO: 324264 - RNA, 22 nt, Human
ggcaguggcuccucucuacucc

SEQ ID NO: 324265 - RNA, 22 nt, Human
uaaagugaaguucagaauggcu

SEQ ID NO: 324266 - RNA, 22 nt, Human
auguccagaguaaagcacauuc

SEQ ID NO: 324267 - RNA, 22 nt, Human
ggcagguguuuuuauauuaaag

SEQ ID NO: 324268 - RNA, 22 nt, Human
guuuuguucaugaacauugggu

SEQ ID NO: 324269 - RNA, 22 nt, Human
uccuccuuuccccgcuggagcc

SEQ ID NO: 324270 - RNA, 22 nt, Human
acuagaaacuaauggauuauua

SEQ ID NO: 324271 - RNA, 22 nt, Human
gcugucugcugggucgcucagg

SEQ ID NO: 324272 - RNA, 22 nt, Human
acucauuugcaugaugugcuau

SEQ ID NO: 324273 - RNA, 18 nt, Human
uauaaacacacuuagguu

SEQ ID NO: 324274 - RNA, 22 nt, Human
uucaccugugacagguagaguu

SEQ ID NO: 324275 - RNA, 22 nt, Human
uguacauauucaagcacuucua

SEQ ID NO: 324276 - RNA, 22 nt, Human
caaagaugccaaaaggaagaca

SEQ ID NO: 324277 - RNA, 22 nt, Human
uuuggauugcuuggaugcuucg

SEQ ID NO: 324278 - RNA, 22 nt, Human
uaaaugcaguacaaauuguucu

SEQ ID NO: 324279 - RNA, 22 nt, Human
ccacugcuguuacuuacgcaaa

SEQ ID NO: 324280 - RNA, 22 nt, Human
gcauuuaaauuugaacuucaga

SEQ ID NO: 324281 - RNA, 22 nt, Human
caguguuuagcacagugcuugg

SEQ ID NO: 324282 - RNA, 22 nt, Human
uugcaaauaauagccugaaacu

SEQ ID NO: 324283 - RNA, 22 nt, Human
cauuuugugcuagacacuaugg

SEQ ID NO: 324284 - RNA, 22 nt, Human
aguccgcgcuccaugggagucc

SEQ ID NO: 324285 - RNA, 22 nt, Human
gaaggagaggauugugaggcug

SEQ ID NO: 324286 - RNA, 22 nt, Human
uuauuugcccauguuuagcaga

SEQ ID NO: 324287 - RNA, 22 nt, Human
gaaccuggcagcccuauaucug

SEQ ID NO: 324288 - RNA, 22 nt, Human
gucuuaagaaugaaugcugaga

SEQ ID NO: 324289 - RNA, 22 nt, Human
cugcaucaguggauaugauggu

SEQ ID NO: 324290 - RNA, 22 nt, Human
acaguuaguugaggaguguuug

SEQ ID NO: 324291 - RNA, 22 nt, Human
aaaugccucauuuucucucacu

SEQ ID NO: 324292 - RNA, 19 nt, Human
augggaagcggccagcgga

SEQ ID NO: 324293 - RNA, 22 nt, Human
aaugcuuuuugcgaaaugugca

SEQ ID NO: 324294 - RNA, 22 nt, Human
cagagcugagucuucaagguug

SEQ ID NO: 324295 - RNA, 23 nt, Human
agcccagcagagaaccuaggucc

SEQ ID NO: 324296 - RNA, 22 nt, Human
ucucauuuacuuccacaggcug

SEQ ID NO: 324297 - RNA, 22 nt, Human
uccuggccucugagucaagaac

SEQ ID NO: 324298 - RNA, 22 nt, Human
uagaaguuaaaggaauacagaa

SEQ ID NO: 324299 - RNA, 22 nt, Human
gcagaagcccggucagcgcacg

SEQ ID NO: 324300 - RNA, 19 nt, Human
ccugcugaagugaugcagc

SEQ ID NO: 324301 - RNA, 22 nt, Human
ucauuguuucugcuuuucauga

SEQ ID NO: 324302 - RNA, 22 nt, Human
auuaguguuguggcuucauggc

SEQ ID NO: 324303 - RNA, 22 nt, Human
ccaugcagugcuggagcugauu

SEQ ID NO: 324304 - RNA, 22 nt, Human
aaaagagccacuuaugaccuca

SEQ ID NO: 324305 - RNA, 22 nt, Human
auggccagcaagguagggcaau

SEQ ID NO: 324306 - RNA, 22 nt, Human
cauggaaggcaaaagacacaga

SEQ ID NO: 324307 - RNA, 22 nt, Human
gcucaugggcccagagcagccc

SEQ ID NO: 324308 - RNA, 22 nt, Human
uggcacagcuugucauaaacuc

SEQ ID NO: 324309 - RNA, 22 nt, Human
caauuaccaguaauugagguuu

SEQ ID NO: 324310 - RNA, 22 nt, Human
gauuuucauuauagcuaguuuc

SEQ ID NO: 324311 - RNA, 20 nt, Human
cucuuuucacucucaguggu

SEQ ID NO: 324312 - RNA, 22 nt, Human
uggucaggcugcucugcggcgu

SEQ ID NO: 324313 - RNA, 22 nt, Human
uuuugucagugagaacagaguu

SEQ ID NO: 324314 - RNA, 22 nt, Human
aacuugccaagagcuuugcuag

SEQ ID NO: 324315 - RNA, 22 nt, Human
cucuggcaauugcugcugacuc

SEQ ID NO: 324316 - RNA, 22 nt, Human
aggcaguugaguggcuuuuuca

SEQ ID NO: 324317 - RNA, 22 nt, Human
acagugcugaucuagacugacc

SEQ ID NO: 324318 - RNA, 22 nt, Human
aucuaaagugucauaaguagcu

SEQ ID NO: 324319 - RNA, 22 nt, Human
uuugaacuucuaccugucauau

SEQ ID NO: 324320 - RNA, 22 nt, Human
ucaguccuuaucugguguucag

SEQ ID NO: 324321 - RNA, 22 nt, Human
aagauuuaccacuuuauucaag

SEQ ID NO: 324322 - RNA, 22 nt, Human
cccucucccugcagaauguggc

SEQ ID NO: 324323 - RNA, 19 nt, Human
gcagcugugggaagagcca

SEQ ID NO: 324324 - RNA, 22 nt, Human
ccagcuggcccagcugugcucc

SEQ ID NO: 324325 - RNA, 18 nt, Human
gccagcccuccaaccucc

SEQ ID NO: 324326 - RNA, 19 nt, Human
cagcaaacacuguaaaugg

SEQ ID NO: 324327 - RNA, 22 nt, Human
aaggcacuugcccagagcugca

SEQ ID NO: 324328 - RNA, 20 nt, Human
ggcagcaaccauaugcuaca

SEQ ID NO: 324329 - RNA, 22 nt, Human
ucuccacaccagaaggagcuga

SEQ ID NO: 324330 - RNA, 19 nt, Human
ucuuucauuucuagcucug

SEQ ID NO: 324331 - RNA, 22 nt, Human
guaaagcaaaauguagagauug

SEQ ID NO: 324332 - RNA, 22 nt, Human
uacugucuuuuccuaaaugggu

SEQ ID NO: 324333 - RNA, 22 nt, Human
acagagacacggaagcuaaaga

SEQ ID NO: 324334 - RNA, 22 nt, Human
gugggggcaggcagugcuagga

SEQ ID NO: 324335 - RNA, 22 nt, Human
uaaaaguuagcuaggacaaagu

SEQ ID NO: 324336 - RNA, 22 nt, Human
ucuuauaccccuaaacugcagc

SEQ ID NO: 324337 - RNA, 22 nt, Human
uauuacaguucgaguuucuagg

SEQ ID NO: 324338 - RNA, 22 nt, Human
ugggaagauaugagugaccaac

SEQ ID NO: 324339 - RNA, 22 nt, Human
uguuucaggcuucugggauuuu

SEQ ID NO: 324340 - RNA, 22 nt, Human
acauuuguuucucuagaguagg

SEQ ID NO: 324341 - RNA, 22 nt, Human
guggccuuuucaaguaggguau

SEQ ID NO: 324342 - RNA, 22 nt, Human
uuugaagauaaauauggagaaa

SEQ ID NO: 324343 - RNA, 22 nt, Human
acacuccagggagggagggaau

SEQ ID NO: 324344 - RNA, 22 nt, Human
gauccacaggaaccaaaacgca

SEQ ID NO: 324345 - RNA, 21 nt, Human
ucucuccucaagcucgacccc

SEQ ID NO: 324346 - RNA, 22 nt, Human
uuuguugguugcacuggugggu

SEQ ID NO: 324347 - RNA, 22 nt, Human
agccagugucgugugacaugag

SEQ ID NO: 324348 - RNA, 22 nt, Human
ugcauuugcaauggguacacaa

SEQ ID NO: 324349 - RNA, 22 nt, Human
agggcucacuacaacccuggga

SEQ ID NO: 324350 - RNA, 22 nt, Human
ugaaaugccuaugaagucagga

SEQ ID NO: 324351 - RNA, 22 nt, Human
accauccaaacugcuuucugug

SEQ ID NO: 324352 - RNA, 22 nt, Human
acccagcucuuugauggucuug

SEQ ID NO: 324353 - RNA, 22 nt, Human
uugcugccagcgcccugcaggg

SEQ ID NO: 324354 - RNA, 22 nt, Human
aggagacaguuuggacguguag

SEQ ID NO: 324355 - RNA, 22 nt, Human
acuggcccuggcugcuaggcug

SEQ ID NO: 324356 - RNA, 23 nt, Human
aaauugucguaagguggagaugu

SEQ ID NO: 324357 - RNA, 22 nt, Human
uggaaggggagcuggaaagggg

SEQ ID NO: 324358 - RNA, 22 nt, Human
uuugccaguauuuuauugauga

SEQ ID NO: 324359 - RNA, 22 nt, Human
aguggcaguagaugagcugguu

SEQ ID NO: 324360 - RNA, 22 nt, Human
agaugguucagaauuauaaaga

SEQ ID NO: 324361 - RNA, 22 nt, Human
gugguuguuuccagguuugaaa

SEQ ID NO: 324362 - RNA, 22 nt, Human
auuaggcauucugaaugagguc

SEQ ID NO: 324363 - RNA, 22 nt, Human
ucuggcuucaacuuuacugaaa

SEQ ID NO: 324364 - RNA, 23 nt, Human
cuuuccuuucuuugacacccagc

SEQ ID NO: 324365 - RNA, 22 nt, Human
ggcaagaaccucaauuaccuuu

SEQ ID NO: 324366 - RNA, 22 nt, Human
gacaaauguaccccuagagucu

SEQ ID NO: 324367 - RNA, 22 nt, Human
auacaggaugcugaacaucucu

SEQ ID NO: 324368 - RNA, 22 nt, Human
auuuccuggaggaauggaagca

SEQ ID NO: 324369 - RNA, 22 nt, Human
gacacuacguggcucacauuuc

SEQ ID NO: 324370 - RNA, 22 nt, Human
ucaugucccguugcuggcugcc

SEQ ID NO: 324371 - RNA, 22 nt, Human
gaguuucuucauggugcagagg

SEQ ID NO: 324372 - RNA, 22 nt, Human
uccuucccaggugucgccgccu

SEQ ID NO: 324373 - RNA, 22 nt, Human
uaauuuugucacagugacaugc

SEQ ID NO: 324374 - RNA, 22 nt, Human
cuggcuuuuuucccauuaugca

SEQ ID NO: 324375 - RNA, 22 nt, Human
cugggguaucugccacaacucu

SEQ ID NO: 324376 - RNA, 22 nt, Human
aagcugccugggaggaagggcu

SEQ ID NO: 324377 - RNA, 22 nt, Human
ucuccucuccuuucauguuguu

SEQ ID NO: 324378 - RNA, 22 nt, Human
ggaagcaaauuccagaaccaca

SEQ ID NO: 324379 - RNA, 22 nt, Human
aguggcagggacuucauauaaa

SEQ ID NO: 324380 - RNA, 18 nt, Human
gccuggcuucggagccgc

SEQ ID NO: 324381 - RNA, 22 nt, Human
cccaccacgugcuuugcuggag

SEQ ID NO: 324382 - RNA, 19 nt, Human
cugaaacacagagagggcu

SEQ ID NO: 324383 - RNA, 23 nt, Human
uggccucuccccaccuggcagaa

SEQ ID NO: 324384 - RNA, 22 nt, Human
uuuacaaggcaguuauuuuccu

SEQ ID NO: 324385 - RNA, 22 nt, Human
aguuuccacuggagacacugug

SEQ ID NO: 324386 - RNA, 22 nt, Human
cugaaggacacgugaggagcca

SEQ ID NO: 324387 - RNA, 22 nt, Human
uugcugugucauuuguuuaauc

SEQ ID NO: 324388 - RNA, 22 nt, Human
aucaugugacuagguuuggcca

SEQ ID NO: 324389 - RNA, 17 nt, Human
gccuggcccagccuggc

SEQ ID NO: 324390 - RNA, 21 nt, Human
caggccaaaagguucaacauu

SEQ ID NO: 324391 - RNA, 22 nt, Human
guagagcagggagcaggaagcu

SEQ ID NO: 324392 - RNA, 22 nt, Human
auggcugugguaucagacgcag

SEQ ID NO: 324393 - RNA, 20 nt, Human
ucccuggggcccuacuuccu

SEQ ID NO: 324394 - RNA, 22 nt, Human
aaaauuaagugucugggaagcc

SEQ ID NO: 324395 - RNA, 22 nt, Human
ccucuucuaggacguccuugug

SEQ ID NO: 324396 - RNA, 22 nt, Human
ccauuuguaccauuucuuugua

SEQ ID NO: 324397 - RNA, 22 nt, Human
aaguuacacauuuucauuguaa

SEQ ID NO: 324398 - RNA, 20 nt, Human
uugcaaagugaauagcaauu

SEQ ID NO: 324399 - RNA, 22 nt, Human
uggcagaaugaagacuggggcc

SEQ ID NO: 324400 - RNA, 22 nt, Human
ucuuugcagaauuuaacuuugc

SEQ ID NO: 324401 - RNA, 22 nt, Human
gccucugcacuguggcacacca

SEQ ID NO: 324402 - RNA, 22 nt, Human
aaugaaacuaguagaaucuuug

SEQ ID NO: 324403 - RNA, 22 nt, Human
uuuuuggguccaggcuguaucu

SEQ ID NO: 324404 - RNA, 19 nt, Human
augagcuggcauuucaggu

SEQ ID NO: 324405 - RNA, 22 nt, Human
cuggcuuugaucagagugaccu

SEQ ID NO: 324406 - RNA, 22 nt, Human
ucuguggcaugguaucuggagg

SEQ ID NO: 324407 - RNA, 22 nt, Human
auuccucagcaggccuuuuguu

SEQ ID NO: 324408 - RNA, 22 nt, Human
gcagcagcggggccccugcgcg

SEQ ID NO: 324409 - RNA, 22 nt, Human
acuggcuuugagggaauagcua

SEQ ID NO: 324410 - RNA, 22 nt, Human
gaaugcuggcuuacaggcaguu

SEQ ID NO: 324411 - RNA, 22 nt, Human
aaugcauacguguuuguggcaa

SEQ ID NO: 324412 - RNA, 22 nt, Human
caagauauguccuguuacuaag

SEQ ID NO: 324413 - RNA, 22 nt, Human
caaugggccuggagagagcugg

SEQ ID NO: 324414 - RNA, 19 nt, Human
uggcucugucgaaggcaca

SEQ ID NO: 324415 - RNA, 22 nt, Human
uaaugccuuaugucaaauguaa

SEQ ID NO: 324416 - RNA, 22 nt, Human
cagguagaggcugccaucagcu

SEQ ID NO: 324417 - RNA, 22 nt, Human
ccagcuugcuccucugcaaugg

SEQ ID NO: 324418 - RNA, 22 nt, Human
gcaaaacagucgaugccuccca

SEQ ID NO: 324419 - RNA, 22 nt, Human
caggaagucgcagagcuggggg

SEQ ID NO: 324420 - RNA, 22 nt, Human
cacuuggaggaaggccuauuca

SEQ ID NO: 324421 - RNA, 22 nt, Human
uagauacauacauuuuaaaaug

SEQ ID NO: 324422 - RNA, 22 nt, Human
auagcuuugagggcuccuuagg

SEQ ID NO: 324423 - RNA, 22 nt, Human
cagguguugcaguugaagacug

SEQ ID NO: 324424 - RNA, 22 nt, Human
cuuugcagagggggugggagcu

SEQ ID NO: 324425 - RNA, 22 nt, Human
gggaagugagcuggaaucaagg

SEQ ID NO: 324426 - RNA, 22 nt, Human
uuuaaacuaacaguacacguug

SEQ ID NO: 324427 - RNA, 22 nt, Human
uagcagcacuauuuguuguagu

SEQ ID NO: 324428 - RNA, 22 nt, Human
cagcagcucaggcuccuuccca

SEQ ID NO: 324429 - RNA, 22 nt, Human
auucaugcaggauugucuccaa

SEQ ID NO: 324430 - RNA, 22 nt, Human
cagcuuuugcagacuucuugcc

SEQ ID NO: 324431 - RNA, 22 nt, Human
ggggucugggcuuagcuggaau

SEQ ID NO: 324432 - RNA, 22 nt, Human
accagucauagaaagcaguggu

SEQ ID NO: 324433 - RNA, 22 nt, Human
caucugcaggggaagccaguuu

SEQ ID NO: 324434 - RNA, 22 nt, Human
uccacccugcuuuugucuuuga

SEQ ID NO: 324435 - RNA, 22 nt, Human
uugaacaguuuugucagguuca

SEQ ID NO: 324436 - RNA, 22 nt, Human
gccaaaguccuccagccaugca

SEQ ID NO: 324437 - RNA, 22 nt, Human
uggcugagcugcagcguggcuu

SEQ ID NO: 324438 - RNA, 22 nt, Human
ccugaaaugaguucugcucacu

SEQ ID NO: 324439 - RNA, 22 nt, Human
ucuuuuaucuguuguguaacaa

SEQ ID NO: 324440 - RNA, 22 nt, Human
uugccaggggacaucuggagcc

SEQ ID NO: 324441 - RNA, 22 nt, Human
ggggaagucggagccugagcac

SEQ ID NO: 324442 - RNA, 22 nt, Human
aagacacuuucuaaauagaagu

SEQ ID NO: 324443 - RNA, 22 nt, Human
caauuuuuaaacuaugaaguug

SEQ ID NO: 324444 - RNA, 22 nt, Human
uagaugaacagaaagccacugu

SEQ ID NO: 324445 - RNA, 23 nt, Human
uguacacuuggucaagguacuua

SEQ ID NO: 324446 - RNA, 22 nt, Human
ccuuuuggccaggucagugcag

SEQ ID NO: 324447 - RNA, 22 nt, Human
uggcaugcaagaggaggcuccc

SEQ ID NO: 324448 - RNA, 22 nt, Human
ugucacagugcacagcuaagaa

SEQ ID NO: 324449 - RNA, 20 nt, Human
uccagccacuuccgcugguc

SEQ ID NO: 324450 - RNA, 22 nt, Human
uuuacgaauggggugacaacuu

SEQ ID NO: 324451 - RNA, 22 nt, Human
uggcacuugauauuugauuugc

SEQ ID NO: 324452 - RNA, 22 nt, Human
uuuccuguccugguacuuggca

SEQ ID NO: 324453 - RNA, 22 nt, Human
ugggcacacugaaucugcuauu

SEQ ID NO: 324454 - RNA, 22 nt, Human
cuucauuaaugucuauaaguuu

SEQ ID NO: 324455 - RNA, 22 nt, Human
cauuaacacuuuggauuuagac

SEQ ID NO: 324456 - RNA, 19 nt, Human
auucuucucuuccugcugu

SEQ ID NO: 324457 - RNA, 22 nt, Human
uccugcagccauuagaggucaa

SEQ ID NO: 324458 - RNA, 22 nt, Human
cacugguugccucuuucuguuc

SEQ ID NO: 324459 - RNA, 22 nt, Human
guaaacugaauuggauacugug

SEQ ID NO: 324460 - RNA, 22 nt, Human
agcagugccgcaucuugugacc

SEQ ID NO: 324461 - RNA, 22 nt, Human
uguucauucugugaccugguuc

SEQ ID NO: 324462 - RNA, 22 nt, Human
ccccagcagacucagggcaggu

SEQ ID NO: 324463 - RNA, 19 nt, Human
agggaguuuauauuugcac

SEQ ID NO: 324464 - RNA, 22 nt, Human
cgcacuggagcuggaacgaguc

SEQ ID NO: 324465 - RNA, 22 nt, Human
gaggugggaugugugugcuacu

SEQ ID NO: 324466 - RNA, 22 nt, Human
caguuuccugaagagaaagaau

SEQ ID NO: 324467 - RNA, 22 nt, Human
agguggcagacuaacagaagga

SEQ ID NO: 324468 - RNA, 22 nt, Human
ccaggcuaggaccgauuucccu

SEQ ID NO: 324469 - RNA, 22 nt, Human
uauugccaaaugucugcuggaa

SEQ ID NO: 324470 - RNA, 22 nt, Human
uaaacagagaugccugggucug

SEQ ID NO: 324471 - RNA, 22 nt, Human
aaauugcauuuuaaagguagau

SEQ ID NO: 324472 - RNA, 22 nt, Human
cacaccuuaggccugagcgcuu

SEQ ID NO: 324473 - RNA, 22 nt, Human
gagaaagggaacuuacagagug

SEQ ID NO: 324474 - RNA, 22 nt, Human
augugaaagagguguucagugg

SEQ ID NO: 324475 - RNA, 22 nt, Human
caugggcucuucuggacugcac

SEQ ID NO: 324476 - RNA, 22 nt, Human
gaccaaggaagaggggagccag

SEQ ID NO: 324477 - RNA, 22 nt, Human
uggauguuugaaguugcaugug

SEQ ID NO: 324478 - RNA, 22 nt, Human
agucuggagugauuauguggga

SEQ ID NO: 324479 - RNA, 22 nt, Human
aucagagcugcauuuuagagcc

SEQ ID NO: 324480 - RNA, 22 nt, Human
augaagcugguuuuggcuuggg

SEQ ID NO: 324481 - RNA, 22 nt, Human
uauaagaaacaaggcaaauuuu

SEQ ID NO: 324482 - RNA, 22 nt, Human
ucauaggaguagcagugagagg

SEQ ID NO: 324483 - RNA, 22 nt, Human
uuucucuuucaaucugcaguac

SEQ ID NO: 324484 - RNA, 22 nt, Human
uggcauuuuguagcuguguauc

SEQ ID NO: 324485 - RNA, 22 nt, Human
caagagcucccagaccugggca

SEQ ID NO: 324486 - RNA, 22 nt, Human
aaugacaguggcacagucacuu

SEQ ID NO: 324487 - RNA, 22 nt, Human
caugucacaauucuuaauggga

SEQ ID NO: 324488 - RNA, 22 nt, Human
aagggaaacuuucacaaugucc

SEQ ID NO: 324489 - RNA, 22 nt, Human
ccccaacccugguuccguggcg

SEQ ID NO: 324490 - RNA, 22 nt, Human
ucugcgcccugucgccugcucc

SEQ ID NO: 324491 - RNA, 22 nt, Human
caaugcagauaccuuccagaga

SEQ ID NO: 324492 - RNA, 22 nt, Human
gcacccagggcaggaagugagg

SEQ ID NO: 324493 - RNA, 22 nt, Human
gcagucauggguagaacucaag

SEQ ID NO: 324494 - RNA, 22 nt, Human
agcuuuauuugucauucacggc

SEQ ID NO: 324495 - RNA, 22 nt, Human
gggcauuucuugucaauguagg

SEQ ID NO: 324496 - RNA, 22 nt, Human
ugcuugacuuaguuucucauuu

SEQ ID NO: 324497 - RNA, 18 nt, Human
cugccagugugcucuccg

SEQ ID NO: 324498 - RNA, 22 nt, Human
auggcagcggagcuggaaauga

SEQ ID NO: 324499 - RNA, 22 nt, Human
auggauggaacucugcuguggu

SEQ ID NO: 324500 - RNA, 22 nt, Human
acaguucuguccuagacuucgu

SEQ ID NO: 324501 - RNA, 23 nt, Human
agcaacagugggugaguguugcu

SEQ ID NO: 324502 - RNA, 22 nt, Human
uuguccagcgaccaggcucugu

SEQ ID NO: 324503 - RNA, 22 nt, Human
uuuugaauaauucagaaacagc

SEQ ID NO: 324504 - RNA, 22 nt, Human
ugaggaggugggcacacagagu

SEQ ID NO: 324505 - RNA, 22 nt, Human
agaggaaguaaucaggaccugc

SEQ ID NO: 324506 - RNA, 22 nt, Human
uuacaguuaaugugacuaacca

SEQ ID NO: 324507 - RNA, 22 nt, Human
gccuuuuaaggcagagggagau

SEQ ID NO: 324508 - RNA, 22 nt, Human
aauaucaucucucuuuucugca

SEQ ID NO: 324509 - RNA, 22 nt, Human
cuggccagggugcgaucguggu

SEQ ID NO: 324510 - RNA, 22 nt, Human
caacagcuggaggcuuggcccg

SEQ ID NO: 324511 - RNA, 22 nt, Human
ugugugaacucucugauguaca

SEQ ID NO: 324512 - RNA, 22 nt, Human
guggucaucuaacuaaauuuuc

SEQ ID NO: 324513 - RNA, 22 nt, Human
agauguuuauaacucaugagug

SEQ ID NO: 324514 - RNA, 22 nt, Human
agcugccgaugcccagcugcau

SEQ ID NO: 324515 - RNA, 22 nt, Human
ccaaaauauuagugcuuaagua

SEQ ID NO: 324516 - RNA, 22 nt, Human
agcuggugauguggucccucac

SEQ ID NO: 324517 - RNA, 22 nt, Human
cuguggcuaggaagcuguggga

SEQ ID NO: 324518 - RNA, 22 nt, Human
cuuguuuucuucugcagucuau

SEQ ID NO: 324519 - RNA, 18 nt, Human
ggaaggugcuggagugca

SEQ ID NO: 324520 - RNA, 22 nt, Human
gagcaacacauugaaugaggau

SEQ ID NO: 324521 - RNA, 22 nt, Human
uggucccuagugugggagcuug

SEQ ID NO: 324522 - RNA, 22 nt, Human
ucuuucagaaacuuugucugcg

SEQ ID NO: 324523 - RNA, 22 nt, Human
cggcagcgguuggagguuguag

SEQ ID NO: 324524 - RNA, 22 nt, Human
gaguuugugggaauggaguauu

SEQ ID NO: 324525 - RNA, 22 nt, Human
ucuuccuggauggggguugaug

SEQ ID NO: 324526 - RNA, 21 nt, Human
uaaacauaaccuuguauggcu

SEQ ID NO: 324527 - RNA, 22 nt, Human
ggcaagagggcagauggagugc

SEQ ID NO: 324528 - RNA, 22 nt, Human
caguggguccugcgucugccag

SEQ ID NO: 324529 - RNA, 22 nt, Human
gacauacagcccucucccuggu

SEQ ID NO: 324530 - RNA, 22 nt, Human
guggcauuuuagaacagcugac

SEQ ID NO: 324531 - RNA, 22 nt, Human
uuucauuauaaaaaguuggcuu

SEQ ID NO: 324532 - RNA, 22 nt, Human
gcugcagugagccaagaucgug

SEQ ID NO: 324533 - RNA, 22 nt, Human
uuuaaaccuaucuaagaaauag

SEQ ID NO: 324534 - RNA, 22 nt, Human
accagagcuggcagaguaucaa

SEQ ID NO: 324535 - RNA, 19 nt, Human
ugcucucuggugcuucaug

SEQ ID NO: 324536 - RNA, 22 nt, Human
agaaaucugacugcugugcaca

SEQ ID NO: 324537 - RNA, 22 nt, Human
cugaggagauccccccagaagu

SEQ ID NO: 324538 - RNA, 17 nt, Human
ugagcaguagaagaugc

SEQ ID NO: 324539 - RNA, 19 nt, Human
cuccacagggauugugauu

SEQ ID NO: 324540 - RNA, 22 nt, Human
gggcggggcuuccguccuccac

SEQ ID NO: 324541 - RNA, 22 nt, Human
cagagccaaaccucagggcccg

SEQ ID NO: 324542 - RNA, 22 nt, Human
auguaugagagauucuuuuauu

SEQ ID NO: 324543 - RNA, 20 nt, Human
uucuccacaggguggaggag

SEQ ID NO: 324544 - RNA, 22 nt, Human
ugugcugcucucagugacagcc

SEQ ID NO: 324545 - RNA, 22 nt, Human
aaucuguuuuaaaguuugugcc

SEQ ID NO: 324546 - RNA, 22 nt, Human
ggaaugugcugacacgcgagag

SEQ ID NO: 324547 - RNA, 22 nt, Human
ucguuagccucgagaucuuugu

SEQ ID NO: 324548 - RNA, 22 nt, Human
gcccuguguguuugcacugauu

SEQ ID NO: 324549 - RNA, 22 nt, Human
cuucuucagaggccagccucug

SEQ ID NO: 324550 - RNA, 22 nt, Human
ucccacacagcccgcucaccgg

SEQ ID NO: 324551 - RNA, 22 nt, Human
ccugggacgacucuguacccuu

SEQ ID NO: 324552 - RNA, 22 nt, Human
uuggauggagguucaagcacua

SEQ ID NO: 324553 - RNA, 22 nt, Human
cuggcuccauccuugagcucug

SEQ ID NO: 324554 - RNA, 22 nt, Human
aaauacaguggcagcagauaau

SEQ ID NO: 324555 - RNA, 22 nt, Human
cucuccaggcgagguccuacug

SEQ ID NO: 324556 - RNA, 22 nt, Human
guaugugucuuagaacuuggga

SEQ ID NO: 324557 - RNA, 22 nt, Human
cuuucuuucgaagacgugauua

SEQ ID NO: 324558 - RNA, 22 nt, Human
aacagguagggacucuaacuug

SEQ ID NO: 324559 - RNA, 22 nt, Human
cuggcuccucaggacugcggga

SEQ ID NO: 324560 - RNA, 22 nt, Human
ucauacauguuguguucaaaug

SEQ ID NO: 324561 - RNA, 22 nt, Human
ugggcccaucauugcugugggc

SEQ ID NO: 324562 - RNA, 23 nt, Human
ugaaagcaaugggucuauaguau

SEQ ID NO: 324563 - RNA, 22 nt, Human
ugcucccaggcauucucuguug

SEQ ID NO: 324564 - RNA, 22 nt, Human
ugcugggauuacagucaugagc

SEQ ID NO: 324565 - RNA, 21 nt, Human
agcauucaaaagaugccauaa

SEQ ID NO: 324566 - RNA, 20 nt, Human
agugauuuguuaguacauug

SEQ ID NO: 324567 - RNA, 22 nt, Human
acugcuuacccggccugacuuc

SEQ ID NO: 324568 - RNA, 22 nt, Human
ugaaaacacuuuaguuuagguc

SEQ ID NO: 324569 - RNA, 22 nt, Human
acucuguuugcagguagcucag

SEQ ID NO: 324570 - RNA, 22 nt, Human
cugaaagcaaaguaauucuuaa

SEQ ID NO: 324571 - RNA, 21 nt, Human
gcuggcugucucuuacacggu

SEQ ID NO: 324572 - RNA, 22 nt, Human
ggaagcuguuaucaucuguauc

SEQ ID NO: 324573 - RNA, 22 nt, Human
cacaguuuuaucuuauacugau

SEQ ID NO: 324574 - RNA, 22 nt, Human
gacuacaggugugugccaccau

SEQ ID NO: 324575 - RNA, 19 nt, Human
ugggcagugccagggcuua

SEQ ID NO: 324576 - RNA, 19 nt, Human
cauaauacaguggaucuga

SEQ ID NO: 324577 - RNA, 22 nt, Human
uucuccacccacucuuuuguug

SEQ ID NO: 324578 - RNA, 22 nt, Human
cugauggagagugugauuuggg

SEQ ID NO: 324579 - RNA, 22 nt, Human
auuuccaggaguugaggucuga

SEQ ID NO: 324580 - RNA, 22 nt, Human
aucuuuggguacaaacuugccu

SEQ ID NO: 324581 - RNA, 22 nt, Human
caggugggagccacagcguaca

SEQ ID NO: 324582 - RNA, 18 nt, Human
uacagcuugaguugacug

SEQ ID NO: 324583 - RNA, 22 nt, Human
cagggagccccaauuccaugcc

SEQ ID NO: 324584 - RNA, 22 nt, Human
cugcugucuuuauuucacugcu

SEQ ID NO: 324585 - RNA, 22 nt, Human
gaauguuaaugcacuucuagcu

SEQ ID NO: 324586 - RNA, 17 nt, Human
cagucacaggucuuuuc

SEQ ID NO: 324587 - RNA, 22 nt, Human
guuuccaggcuuugguaugguu

SEQ ID NO: 324588 - RNA, 22 nt, Human
cagcaguacuucucagagguau

SEQ ID NO: 324589 - RNA, 22 nt, Human
uuuaagguacagcuagcagcau

SEQ ID NO: 324590 - RNA, 22 nt, Human
guaguucuuucucaauguucaa

SEQ ID NO: 324591 - RNA, 22 nt, Human
uuugcaaaguccauugaaguua

SEQ ID NO: 324592 - RNA, 22 nt, Human
ucaugacaacuugcacaguuuu

SEQ ID NO: 324593 - RNA, 22 nt, Human
gccuggaaugcaaugugacgaa

SEQ ID NO: 324594 - RNA, 22 nt, Human
auuauguagcuaaaaauugugu

SEQ ID NO: 324595 - RNA, 22 nt, Human
uggcugcccccucccguggaca

SEQ ID NO: 324596 - RNA, 22 nt, Human
gauucugaaauuaacagacugg

SEQ ID NO: 324597 - RNA, 22 nt, Human
ggcuuccuccuuccugcuguca

SEQ ID NO: 324598 - RNA, 22 nt, Human
uccaaauagcuggaugauggug

SEQ ID NO: 324599 - RNA, 19 nt, Human
cacuaagaagcaggggagc

SEQ ID NO: 324600 - RNA, 22 nt, Human
uuggaaaugcauuuguuauuau

SEQ ID NO: 324601 - RNA, 22 nt, Human
uuuggagagaugaaguucugug

SEQ ID NO: 324602 - RNA, 22 nt, Human
acacaucagaaauaugaaugag

SEQ ID NO: 324603 - RNA, 22 nt, Human
augaaaacggaccagagcuauu

SEQ ID NO: 324604 - RNA, 22 nt, Human
uagcauuucacugaucuucacu

SEQ ID NO: 324605 - RNA, 22 nt, Human
gaagagguucaacguggucauc

SEQ ID NO: 324606 - RNA, 22 nt, Human
gccuguuucuccuccuuggccc

SEQ ID NO: 324607 - RNA, 22 nt, Human
guguguggaaugcucauuuauu

SEQ ID NO: 324608 - RNA, 22 nt, Human
aaagacuaaccaguugucaaaa

SEQ ID NO: 324609 - RNA, 22 nt, Human
uauccaaaggaacaaucacagc

SEQ ID NO: 324610 - RNA, 22 nt, Human
cuggccgcaguguggaguugug

SEQ ID NO: 324611 - RNA, 22 nt, Human
cugaaggauguguggugggagu

SEQ ID NO: 324612 - RNA, 22 nt, Human
ugggcugcuucuauuggugguc

SEQ ID NO: 324613 - RNA, 22 nt, Human
uuuguucaccuagcaaacuuuu

SEQ ID NO: 324614 - RNA, 22 nt, Human
auagucuuagaaucuugagugu

SEQ ID NO: 324615 - RNA, 23 nt, Human
gggaaaucaaaagauauuucuuc

SEQ ID NO: 324616 - RNA, 23 nt, Human
cguuuuuuccucagauguucugg

SEQ ID NO: 324617 - RNA, 20 nt, Human
ggucacuguggcugcaggau

SEQ ID NO: 324618 - RNA, 22 nt, Human
gcucgcuuagauuuuccucuga

SEQ ID NO: 324619 - RNA, 21 nt, Human
uccugcugagaaacagauggu

SEQ ID NO: 324620 - RNA, 22 nt, Human
ggcacagcugaugcagacacac

SEQ ID NO: 324621 - RNA, 21 nt, Human
uuuaaggccagcaggagguga

SEQ ID NO: 324622 - RNA, 22 nt, Human
guuguuuuugaacggugguggc

SEQ ID NO: 324623 - RNA, 22 nt, Human
auuguugacuugauuacucaac

SEQ ID NO: 324624 - RNA, 22 nt, Human
ccgcgagguggagguugcagug

SEQ ID NO: 324625 - RNA, 17 nt, Human
gcaggcacugcugccug

SEQ ID NO: 324626 - RNA, 22 nt, Human
augguuuuguccucuuugguuc

SEQ ID NO: 324627 - RNA, 22 nt, Human
auugaagacuugguauccgugg

SEQ ID NO: 324628 - RNA, 22 nt, Human
agcuuucuauauaugaguugcu

SEQ ID NO: 324629 - RNA, 18 nt, Human
ucugaaggaaugauucca

SEQ ID NO: 324630 - RNA, 22 nt, Human
gccagccccagacauccuaucg

SEQ ID NO: 324631 - RNA, 22 nt, Human
ucuuugcauggacauguguuuu

SEQ ID NO: 324632 - RNA, 21 nt, Human
uaagaacauuaucuucuuccu

SEQ ID NO: 324633 - RNA, 20 nt, Human
acuagaaagucacugggggg

SEQ ID NO: 324634 - RNA, 22 nt, Human
auguggcuuucugcguuuucuc

SEQ ID NO: 324635 - RNA, 18 nt, Human
ggaaaaggagugucuagc

SEQ ID NO: 324636 - RNA, 19 nt, Human
aucaggcuucuauuuucuc

SEQ ID NO: 324637 - RNA, 22 nt, Human
ggccuugggauguggcugcagc

SEQ ID NO: 324638 - RNA, 22 nt, Human
cuguucaguaaccuauaaaaca

SEQ ID NO: 324639 - RNA, 22 nt, Human
uuggggaagcuuugaaauacuu

SEQ ID NO: 324640 - RNA, 22 nt, Human
uaguguguggucucucccuugu

SEQ ID NO: 324641 - RNA, 22 nt, Human
ccucccugccggcuggacuagu

SEQ ID NO: 324642 - RNA, 22 nt, Human
uggcuccaggggacacgcagua

SEQ ID NO: 324643 - RNA, 22 nt, Human
uuccuggugguggugacagcac

SEQ ID NO: 324644 - RNA, 22 nt, Human
uauggcuucugggccaaauuua

SEQ ID NO: 324645 - RNA, 22 nt, Human
cccagcauuucugggcugcacu

SEQ ID NO: 324646 - RNA, 22 nt, Human
uuauuuaaaagugguaagauuc

SEQ ID NO: 324647 - RNA, 22 nt, Human
acugccaguuguuuuguccagu

SEQ ID NO: 324648 - RNA, 22 nt, Human
gcauaaaggacuauaaggauca

SEQ ID NO: 324649 - RNA, 21 nt, Human
uuuguucaggggcaaaguuaa

SEQ ID NO: 324650 - RNA, 22 nt, Human
gccugccuucggugcgcagcgg

SEQ ID NO: 324651 - RNA, 22 nt, Human
caggccugugacaccgugucug

SEQ ID NO: 324652 - RNA, 22 nt, Human
ugcuugucacccugccugagug

SEQ ID NO: 324653 - RNA, 22 nt, Human
ccucguccacaauccuugcaca

SEQ ID NO: 324654 - RNA, 22 nt, Human
uguccagcugaaggcagccuca

SEQ ID NO: 324655 - RNA, 22 nt, Human
gcugcaagugcauguugcaacu

SEQ ID NO: 324656 - RNA, 21 nt, Human
auacaagaagauggcagucug

SEQ ID NO: 324657 - RNA, 22 nt, Human
aagucaauuaguaaacuuggaa

SEQ ID NO: 324658 - RNA, 22 nt, Human
cugcaccgugucucgggcugcc

SEQ ID NO: 324659 - RNA, 21 nt, Human
ugucagcaacaauacuuucuc

SEQ ID NO: 324660 - RNA, 22 nt, Human
uugggugcugucauggggcacg

SEQ ID NO: 324661 - RNA, 22 nt, Human
cauaaauuguacccauuccaac

SEQ ID NO: 324662 - RNA, 22 nt, Human
aaugcugugauuuauuaaguau

SEQ ID NO: 324663 - RNA, 22 nt, Human
ugggcaaaugcuuuuuagucaa

SEQ ID NO: 324664 - RNA, 22 nt, Human
ucaaaaugccgagugcccaggu

SEQ ID NO: 324665 - RNA, 21 nt, Human
uuccuccucuggagaagaaga

SEQ ID NO: 324666 - RNA, 22 nt, Human
ggcacuggcaaagcaaagucug

SEQ ID NO: 324667 - RNA, 22 nt, Human
cagcuuguuuacaugcuuauuc

SEQ ID NO: 324668 - RNA, 22 nt, Human
acaggacagucuaguaacagua

SEQ ID NO: 324669 - RNA, 22 nt, Human
aagccugagccaugcuuuacug

SEQ ID NO: 324670 - RNA, 22 nt, Human
guggcgcagaggguggcagaga

SEQ ID NO: 324671 - RNA, 22 nt, Human
aacuuucuuugcaucuaaguuu

SEQ ID NO: 324672 - RNA, 22 nt, Human
gacaguggagccacguugggag

SEQ ID NO: 324673 - RNA, 22 nt, Human
uuggaaguucuuagccuuuuca

SEQ ID NO: 324674 - RNA, 22 nt, Human
ccaagcuggacagcagcaagga

SEQ ID NO: 324675 - RNA, 22 nt, Human
uaaaccuuauuugaauaccaac

SEQ ID NO: 324676 - RNA, 22 nt, Human
uaaaguuuauuggcaccaccau

SEQ ID NO: 324677 - RNA, 22 nt, Human
cuggucagggcucuuugggagc

SEQ ID NO: 324678 - RNA, 22 nt, Human
auggaguugagcucuguugucc

SEQ ID NO: 324679 - RNA, 22 nt, Human
uuuuuugucuugaagaaauggu

SEQ ID NO: 324680 - RNA, 22 nt, Human
uggcuccacaggccagggugug

SEQ ID NO: 324681 - RNA, 22 nt, Human
gggaggugauuaggaccaugua

SEQ ID NO: 324682 - RNA, 22 nt, Human
cauugcuguuaauugucucuag

SEQ ID NO: 324683 - RNA, 22 nt, Human
accuggccaguggggccgcgcu

SEQ ID NO: 324684 - RNA, 22 nt, Human
uaccuugugagcuuucuaacau

SEQ ID NO: 324685 - RNA, 22 nt, Human
ugccucugcugcauauucaccu

SEQ ID NO: 324686 - RNA, 22 nt, Human
aggcuguagaucuagacaugua

SEQ ID NO: 324687 - RNA, 22 nt, Human
ccuggcagaauauuaaagugca

SEQ ID NO: 324688 - RNA, 22 nt, Human
cugagcagaagggugcacgugc

SEQ ID NO: 324689 - RNA, 22 nt, Human
uggcuggcuguccagcugggca

SEQ ID NO: 324690 - RNA, 22 nt, Human
uguuccugacggccaaagaggu

SEQ ID NO: 324691 - RNA, 22 nt, Human
uguaaagaaagacgcagaguua

SEQ ID NO: 324692 - RNA, 21 nt, Human
aaacugaccuugccugagaca

SEQ ID NO: 324693 - RNA, 22 nt, Human
aggcaguuguugcugagcagcu

SEQ ID NO: 324694 - RNA, 22 nt, Human
agccagugcagcuggaaauuca

SEQ ID NO: 324695 - RNA, 22 nt, Human
gcaguaaauugagagucauguu

SEQ ID NO: 324696 - RNA, 22 nt, Human
auuuccuguaggggcuugcgaa

SEQ ID NO: 324697 - RNA, 22 nt, Human
aaugccuuggagagccuagagg

SEQ ID NO: 324698 - RNA, 22 nt, Human
gugcaggacagcacaucuccug

SEQ ID NO: 324699 - RNA, 22 nt, Human
cuugccagggacucagucaggg

SEQ ID NO: 324700 - RNA, 22 nt, Human
acuuccagaaaugauuuaauuu

SEQ ID NO: 324701 - RNA, 22 nt, Human
cuggaaggagcccgggcggauc

SEQ ID NO: 324702 - RNA, 22 nt, Human
guggcaggagggcaucacuugg

SEQ ID NO: 324703 - RNA, 20 nt, Human
caacacugcccauuguuugc

SEQ ID NO: 324704 - RNA, 22 nt, Human
gauuguacuuauugagcuaaac

SEQ ID NO: 324705 - RNA, 22 nt, Human
gucuccugaggcauccauugaa

SEQ ID NO: 324706 - RNA, 20 nt, Human
gugcccaguuggugacagac

SEQ ID NO: 324707 - RNA, 22 nt, Human
gaugaaggggcuggugcccucu

SEQ ID NO: 324708 - RNA, 22 nt, Human
gcagccuccgcacugcgagucc

SEQ ID NO: 324709 - RNA, 22 nt, Human
ccucuaaauuguuugaaguugg

SEQ ID NO: 324710 - RNA, 22 nt, Human
uaaugccuuucuguacuauaug

SEQ ID NO: 324711 - RNA, 21 nt, Human
ugcauauauaagugcauacac

SEQ ID NO: 324712 - RNA, 22 nt, Human
ucuggaaggggaucugugguca

SEQ ID NO: 324713 - RNA, 22 nt, Human
uagugucucuuccuguuugaaa

SEQ ID NO: 324714 - RNA, 22 nt, Human
acuugcaucuuagagacucacc

SEQ ID NO: 324715 - RNA, 22 nt, Human
gcucagugaagggugccaagua

SEQ ID NO: 324716 - RNA, 23 nt, Human
uguguucagucaaggaucagagu

SEQ ID NO: 324717 - RNA, 22 nt, Human
uuuucuaacaucuaguaauuug

SEQ ID NO: 324718 - RNA, 22 nt, Human
aaaacuuucagggauacagaaa

SEQ ID NO: 324719 - RNA, 22 nt, Human
cucucuguuaugcuuucaugaa

SEQ ID NO: 324720 - RNA, 22 nt, Human
gcucuggcuacuguggcuaccg

SEQ ID NO: 324721 - RNA, 22 nt, Human
auuggagccccagaagcaaggu

SEQ ID NO: 324722 - RNA, 22 nt, Human
acacugguucucuuaacccuau

SEQ ID NO: 324723 - RNA, 22 nt, Human
cuuguauuaggaagaaugcuuu

SEQ ID NO: 324724 - RNA, 22 nt, Human
agauuucaauggauauugcaag

SEQ ID NO: 324725 - RNA, 23 nt, Human
acucugacuuaguuauagcuauu

SEQ ID NO: 324726 - RNA, 23 nt, Human
aagugcucaguggacagcauugc

SEQ ID NO: 324727 - RNA, 18 nt, Human
uccuuucaccccuucucu

SEQ ID NO: 324728 - RNA, 22 nt, Human
aguguuaaggcugguugcuaua

SEQ ID NO: 324729 - RNA, 22 nt, Human
guuuccuuuuggaauuagagcu

SEQ ID NO: 324730 - RNA, 22 nt, Human
ucuggauggucagcucuuccug

SEQ ID NO: 324731 - RNA, 22 nt, Human
ccucuuccuucucacuguggaa

SEQ ID NO: 324732 - RNA, 22 nt, Human
ugguuggauggcucuuguggcu

SEQ ID NO: 324733 - RNA, 22 nt, Human
cuccagcagaaagggcgagugg

SEQ ID NO: 324734 - RNA, 22 nt, Human
ccuggccgacauggugaaacgc

SEQ ID NO: 324735 - RNA, 22 nt, Human
ggacucuggcucaguguugcuu

SEQ ID NO: 324736 - RNA, 22 nt, Human
cauugcugugggcauuugcugc

SEQ ID NO: 324737 - RNA, 22 nt, Human
acggccgaugacuccagcaugg

SEQ ID NO: 324738 - RNA, 22 nt, Human
gccuggcucugaguuucucucc

SEQ ID NO: 324739 - RNA, 22 nt, Human
uccaggcugacgcagcuauuua

SEQ ID NO: 324740 - RNA, 22 nt, Human
guagaggggugauucugugaga

SEQ ID NO: 324741 - RNA, 22 nt, Human
ugcuggccucggcgcugggccu

SEQ ID NO: 324742 - RNA, 22 nt, Human
agcagugugggcugcacgcugg

SEQ ID NO: 324743 - RNA, 22 nt, Human
uaaaguuggaccugauuuuauu

SEQ ID NO: 324744 - RNA, 22 nt, Human
guggcauugccuucugcaggaa

SEQ ID NO: 324745 - RNA, 22 nt, Human
aacaggcuaaauuguccauuuc

SEQ ID NO: 324746 - RNA, 22 nt, Human
cgcagcugcugcucugaaacag

SEQ ID NO: 324747 - RNA, 22 nt, Human
uaaagcaaugaaaguuuugcag

SEQ ID NO: 324748 - RNA, 23 nt, Human
cauuugauccucacaauaaaugg

SEQ ID NO: 324749 - RNA, 23 nt, Human
ugcaaaauuugcagaguucgaug

SEQ ID NO: 324750 - RNA, 22 nt, Human
cuguucccgguggccgggccag

SEQ ID NO: 324751 - RNA, 22 nt, Human
ggauguggaccuugccugguga

SEQ ID NO: 324752 - RNA, 20 nt, Human
uuucacuggcuugauaaggu

SEQ ID NO: 324753 - RNA, 22 nt, Human
caguuuuacccaagcuuauuuu

SEQ ID NO: 324754 - RNA, 22 nt, Human
cuugaggcugcacuccagggcc

SEQ ID NO: 324755 - RNA, 22 nt, Human
cuucacugcagucauggcucug

SEQ ID NO: 324756 - RNA, 22 nt, Human
uccucacagcugguucauucag

SEQ ID NO: 324757 - RNA, 18 nt, Human
ucaguccuccauagagcu

SEQ ID NO: 324758 - RNA, 22 nt, Human
guugcaaaugggaagaugguua

SEQ ID NO: 324759 - RNA, 22 nt, Human
agguuuggguucauugcuggcu

SEQ ID NO: 324760 - RNA, 22 nt, Human
ucuacaacgugguuuuguugua

SEQ ID NO: 324761 - RNA, 22 nt, Human
cgccaguggcagcuggaacagg

SEQ ID NO: 324762 - RNA, 22 nt, Human
cugucaccucugcccuuugccc

SEQ ID NO: 324763 - RNA, 22 nt, Human
gguuuguugggguccaggccca

SEQ ID NO: 324764 - RNA, 22 nt, Human
gguauggagucugaguuucuag

SEQ ID NO: 324765 - RNA, 22 nt, Human
aaugaguuuguucuauuauuug

SEQ ID NO: 324766 - RNA, 22 nt, Human
cuuccugcaacaccuguguugc

SEQ ID NO: 324767 - RNA, 22 nt, Human
gauugcugccagcguguccgug

SEQ ID NO: 324768 - RNA, 22 nt, Human
ccagagcugcagguaaaaugcu

SEQ ID NO: 324769 - RNA, 22 nt, Human
cucaguguuaaagacuuuccag

SEQ ID NO: 324770 - RNA, 21 nt, Human
cuggagcuuggugagaagugu

SEQ ID NO: 324771 - RNA, 22 nt, Human
ccuguaccgcgaucugcugcgc

SEQ ID NO: 324772 - RNA, 22 nt, Human
uuugucaccaguggcuuuggua

SEQ ID NO: 324773 - RNA, 22 nt, Human
ugugagauuuuauuugauaugc

SEQ ID NO: 324774 - RNA, 22 nt, Human
uuuacuuuugguaaggucauuu

SEQ ID NO: 324775 - RNA, 22 nt, Human
aacaugaugacauuguaagcuu

SEQ ID NO: 324776 - RNA, 20 nt, Human
gcucaguggagaaaugcacc

SEQ ID NO: 324777 - RNA, 23 nt, Human
uugggcaaaucacuaacgucucc

SEQ ID NO: 324778 - RNA, 23 nt, Human
uacagccaugucgcugauuuaac

SEQ ID NO: 324779 - RNA, 15 nt, Human
caguuucugaucauc

SEQ ID NO: 324780 - RNA, 22 nt, Human
caaaauuguugaugcugcuuug

SEQ ID NO: 324781 - RNA, 22 nt, Human
ggcagcagaacuggcccuguau

SEQ ID NO: 324782 - RNA, 22 nt, Human
cugucaaauggaaacuuauccu

SEQ ID NO: 324783 - RNA, 22 nt, Human
aaaaugcucaucagcgauggcu

SEQ ID NO: 324784 - RNA, 22 nt, Human
ugggaaggggagcuggaaagga

SEQ ID NO: 324785 - RNA, 22 nt, Human
aaccauggauuucaguucaccu

SEQ ID NO: 324786 - RNA, 22 nt, Human
ugcugaggagguggcugugcuu

SEQ ID NO: 324787 - RNA, 22 nt, Human
gaaaacacuuugaucugaaagu

SEQ ID NO: 324788 - RNA, 22 nt, Human
uccuucaaucacccagugggga

SEQ ID NO: 324789 - RNA, 22 nt, Human
ucuucaugucucugcuugaguc

SEQ ID NO: 324790 - RNA, 22 nt, Human
ugcacaguuggcuacaucgugg

SEQ ID NO: 324791 - RNA, 22 nt, Human
gggagcuggagcuggaagacuc

SEQ ID NO: 324792 - RNA, 22 nt, Human
acaaagugaaaagcaucgaauu

SEQ ID NO: 324793 - RNA, 21 nt, Human
ccaugucagaugugggcugug

SEQ ID NO: 324794 - RNA, 22 nt, Human
gcugauggcuugcuggcugaca

SEQ ID NO: 324795 - RNA, 22 nt, Human
uagcgggucacccugcugugaa

SEQ ID NO: 324796 - RNA, 22 nt, Human
guacacucccccugugaaguug

SEQ ID NO: 324797 - RNA, 22 nt, Human
uugcuggaagguggcuggaauc

SEQ ID NO: 324798 - RNA, 22 nt, Human
ggccagccuggggcucccagac

SEQ ID NO: 324799 - RNA, 22 nt, Human
uccuuggagaaucuuguuuuac

SEQ ID NO: 324800 - RNA, 22 nt, Human
ugaagccagggacugacacuuc

SEQ ID NO: 324801 - RNA, 22 nt, Human
gaacugcauugugguauauguu

SEQ ID NO: 324802 - RNA, 22 nt, Human
ugcaaauauuccaugcuguuca

SEQ ID NO: 324803 - RNA, 22 nt, Human
augcauugaggaugacaugagu

SEQ ID NO: 324804 - RNA, 22 nt, Human
uuugaaauguaucaguauaggu

SEQ ID NO: 324805 - RNA, 22 nt, Human
guuaaugcaaagcagagggcaa

SEQ ID NO: 324806 - RNA, 22 nt, Human
uguaauguuagaaacaauugcu

SEQ ID NO: 324807 - RNA, 22 nt, Human
gucuugcacuuaccuaagaacu

SEQ ID NO: 324808 - RNA, 22 nt, Human
cauggccagauucuuucuucuc

SEQ ID NO: 324809 - RNA, 22 nt, Human
aaagccauaucuauucuauucu

SEQ ID NO: 324810 - RNA, 22 nt, Human
uuuuccuucugauacuccauuu

SEQ ID NO: 324811 - RNA, 22 nt, Human
cuguccuaugaguacucacuag

SEQ ID NO: 324812 - RNA, 23 nt, Human
ucuggcugcuccuuucaaugcuc

SEQ ID NO: 324813 - RNA, 22 nt, Human
gagucacuucccgaauaaaccc

SEQ ID NO: 324814 - RNA, 22 nt, Human
cguggcucugggcuccuuugcc

SEQ ID NO: 324815 - RNA, 22 nt, Human
aagcauuuuagauaaagcauca

SEQ ID NO: 324816 - RNA, 22 nt, Human
ugcuugcugaaaggcauuuaga

SEQ ID NO: 324817 - RNA, 22 nt, Human
uuucugugauaggcugcgacgc

SEQ ID NO: 324818 - RNA, 22 nt, Human
aggugggacccguggggugcga

SEQ ID NO: 324819 - RNA, 22 nt, Human
agucacuguucugucaugucaa

SEQ ID NO: 324820 - RNA, 22 nt, Human
uccggcggccggccugagcccg

SEQ ID NO: 324821 - RNA, 22 nt, Human
augccuguuugaaauuggaccu

SEQ ID NO: 324822 - RNA, 23 nt, Human
ggaggcacuuaggcagagcagag

SEQ ID NO: 324823 - RNA, 22 nt, Human
gugcgccagcucaaggggaggc

SEQ ID NO: 324824 - RNA, 19 nt, Human
uuugauagggcauaauaua

SEQ ID NO: 324825 - RNA, 22 nt, Human
agccaggucaggaaagguccca

SEQ ID NO: 324826 - RNA, 22 nt, Human
cacagcuucuccccgcugcggc

SEQ ID NO: 324827 - RNA, 22 nt, Human
ggagggaguuucauuccugccc

SEQ ID NO: 324828 - RNA, 22 nt, Human
acaaaggugagcagaagacaca

SEQ ID NO: 324829 - RNA, 18 nt, Human
aaacauggcuuaaaggcu

SEQ ID NO: 324830 - RNA, 22 nt, Human
ugcaucauuaagguacaguugg

SEQ ID NO: 324831 - RNA, 22 nt, Human
uugauguaauacuuugcaacca

SEQ ID NO: 324832 - RNA, 22 nt, Human
gaggggcucuugggcaugaagg

SEQ ID NO: 324833 - RNA, 22 nt, Human
ggcggcgcguagccggagacuu

SEQ ID NO: 324834 - RNA, 22 nt, Human
agcugcaccggcuggaccacug

SEQ ID NO: 324835 - RNA, 22 nt, Human
ccagcugggucccugcuggggc

SEQ ID NO: 324836 - RNA, 22 nt, Human
cuccugcagcccucagcagcca

SEQ ID NO: 324837 - RNA, 23 nt, Human
aauagcugguaaugauagcacaa

SEQ ID NO: 324838 - RNA, 23 nt, Human
aggcugcagaagaauagggucau

SEQ ID NO: 324839 - RNA, 22 nt, Human
auuuugacauugcggcauugcu

SEQ ID NO: 324840 - RNA, 22 nt, Human
agcugaaacuucccauuaauug

SEQ ID NO: 324841 - RNA, 19 nt, Human
uggcagcauugguaccuug

SEQ ID NO: 324842 - RNA, 22 nt, Human
cagcccaggacugcagguguuu

SEQ ID NO: 324843 - RNA, 22 nt, Human
auuguuacuggguuaauuugga

SEQ ID NO: 324844 - RNA, 19 nt, Human
uuacaugacauaugaagga

SEQ ID NO: 324845 - RNA, 22 nt, Human
gaccacugaaugcacuucuaau

SEQ ID NO: 324846 - RNA, 22 nt, Human
uuagacaucaagaagccaaugu

SEQ ID NO: 324847 - RNA, 22 nt, Human
uuccuucuucauuguguuacag

SEQ ID NO: 324848 - RNA, 22 nt, Human
cuucacaaaauauuucauuaua

SEQ ID NO: 324849 - RNA, 22 nt, Human
uuugcuugauuaggauauggaa

SEQ ID NO: 324850 - RNA, 22 nt, Human
ugacuuuggacuagugauuuaa

SEQ ID NO: 324851 - RNA, 22 nt, Human
caggguggcaggcaccauggcc

SEQ ID NO: 324852 - RNA, 22 nt, Human
cuuggcugaacuccaggaugca

SEQ ID NO: 324853 - RNA, 22 nt, Human
agucaguaugacuuauaguucu

SEQ ID NO: 324854 - RNA, 22 nt, Human
gacagcagccacagggagaggg

SEQ ID NO: 324855 - RNA, 22 nt, Human
augcaucaccgaguugcccacc

SEQ ID NO: 324856 - RNA, 22 nt, Human
cuggagaacagagcuguuuaga

SEQ ID NO: 324857 - RNA, 22 nt, Human
uguguuucucugaggggucccu

SEQ ID NO: 324858 - RNA, 22 nt, Human
gccaugaacucgggcauggaga

SEQ ID NO: 324859 - RNA, 22 nt, Human
uccuggccaaguagauguggcg

SEQ ID NO: 324860 - RNA, 22 nt, Human
uaguauuuccuguaagcuauag

SEQ ID NO: 324861 - RNA, 22 nt, Human
aguggcugugaaauacauggga

SEQ ID NO: 324862 - RNA, 22 nt, Human
cugagcaugcuacaugcagcac

SEQ ID NO: 324863 - RNA, 22 nt, Human
aggcucagcaucugauucauau

SEQ ID NO: 324864 - RNA, 22 nt, Human
agaaaagaggcuuucuaagcau

SEQ ID NO: 324865 - RNA, 22 nt, Human
ccaguccaggccauggauuuug

SEQ ID NO: 324866 - RNA, 22 nt, Human
uagaucuuucacuacuguguag

SEQ ID NO: 324867 - RNA, 22 nt, Human
aagaaaagguaaccgcuuaucu

SEQ ID NO: 324868 - RNA, 22 nt, Human
gccugcuuccuagccuuccaag

SEQ ID NO: 324869 - RNA, 22 nt, Human
ugauuuacaguagugucuaaac

SEQ ID NO: 324870 - RNA, 22 nt, Human
agccaugcaccuuacucuugcu

SEQ ID NO: 324871 - RNA, 22 nt, Human
uuccuccagccuggagcacuuc

SEQ ID NO: 324872 - RNA, 22 nt, Human
aaagucuuaauguaaguuuagu

SEQ ID NO: 324873 - RNA, 22 nt, Human
gcugcagggagcuggaaggcuc

SEQ ID NO: 324874 - RNA, 22 nt, Human
uugcauauccuccaacacaugg

SEQ ID NO: 324875 - RNA, 22 nt, Human
agcugucuaccugcagaguccu

SEQ ID NO: 324876 - RNA, 20 nt, Human
uuuuccacuccucaaaacag

SEQ ID NO: 324877 - RNA, 22 nt, Human
uagaagaacaugucaaacuaua

SEQ ID NO: 324878 - RNA, 22 nt, Human
gcaguggccacauggaggagga

SEQ ID NO: 324879 - RNA, 22 nt, Human
acuucccacugcagugacugag

SEQ ID NO: 324880 - RNA, 22 nt, Human
guucugucugagcaccacagga

SEQ ID NO: 324881 - RNA, 22 nt, Human
ugcugcucuucaccauggccuc

SEQ ID NO: 324882 - RNA, 22 nt, Human
aaagagcucggaaaguguugaa

SEQ ID NO: 324883 - RNA, 23 nt, Human
gcauccagagcucaguccccuuu

SEQ ID NO: 324884 - RNA, 22 nt, Human
uuucccaggcuggaaugcagug

SEQ ID NO: 324885 - RNA, 22 nt, Human
uccucuucaaaauagcucugaa

SEQ ID NO: 324886 - RNA, 22 nt, Human
gugugcgccgacacagccaggu

SEQ ID NO: 324887 - RNA, 22 nt, Human
aggguccugggugcaguugcuu

SEQ ID NO: 324888 - RNA, 22 nt, Human
caaacauuuguuggaaccccug

SEQ ID NO: 324889 - RNA, 22 nt, Human
uuacaguuuacauaagaauugu

SEQ ID NO: 324890 - RNA, 22 nt, Human
acaguguuucacuuaaccguuu

SEQ ID NO: 324891 - RNA, 19 nt, Human
aaauccaagcucaggccuc

SEQ ID NO: 324892 - RNA, 22 nt, Human
ccuuaauuucuguccuucagau

SEQ ID NO: 324893 - RNA, 22 nt, Human
ucaauuuauguggcuauucauu

SEQ ID NO: 324894 - RNA, 22 nt, Human
ugcagcuucucugcaacaggag

SEQ ID NO: 324895 - RNA, 23 nt, Human
gcugccaaggaggcaggggugcc

SEQ ID NO: 324896 - RNA, 22 nt, Human
ggagaggguguggaaaguuauc

SEQ ID NO: 324897 - RNA, 22 nt, Human
acaguaaucugggaacuuguua

SEQ ID NO: 324898 - RNA, 22 nt, Human
uuggaaagggauaucuguacuu

SEQ ID NO: 324899 - RNA, 22 nt, Human
ggacauggaaguauggagugga

SEQ ID NO: 324900 - RNA, 22 nt, Human
ggcggcacgcaggcugcugucg

SEQ ID NO: 324901 - RNA, 22 nt, Human
uguucaguuugcuaucauaauc

SEQ ID NO: 324902 - RNA, 22 nt, Human
ggcagugaugucaaacagugaa

SEQ ID NO: 324903 - RNA, 22 nt, Human
uagcauuuagaacaccuugaga

SEQ ID NO: 324904 - RNA, 22 nt, Human
ugugguuuugguucagaaacaa

SEQ ID NO: 324905 - RNA, 22 nt, Human
ucuaaagcuccuuccacuaaaa

SEQ ID NO: 324906 - RNA, 22 nt, Human
ugguuuguauauguuugugaga

SEQ ID NO: 324907 - RNA, 20 nt, Human
uugagcagcagugcuguguc

SEQ ID NO: 324908 - RNA, 22 nt, Human
gcaagcagcccagaacagcucu

SEQ ID NO: 324909 - RNA, 22 nt, Human
acucaucuuugaauuuucagua

SEQ ID NO: 324910 - RNA, 22 nt, Human
uguacauacauagauauacaca

SEQ ID NO: 324911 - RNA, 22 nt, Human
uauaugcagauuuucaucaucg

SEQ ID NO: 324912 - RNA, 22 nt, Human
cuggagaggcugggaacagguu

SEQ ID NO: 324913 - RNA, 22 nt, Human
gaaauguuggacacuugaaauu

SEQ ID NO: 324914 - RNA, 22 nt, Human
uuuguaguuguggaugcugaag

SEQ ID NO: 324915 - RNA, 22 nt, Human
guguccagagccgggcugaaug

SEQ ID NO: 324916 - RNA, 22 nt, Human
uaggcagauuccauauuuuggc

SEQ ID NO: 324917 - RNA, 22 nt, Human
aguguugucaaacggcucagca

SEQ ID NO: 324918 - RNA, 22 nt, Human
auauaccucauucuuugagugc

SEQ ID NO: 324919 - RNA, 22 nt, Human
uguuggcagugcuacagucagu

SEQ ID NO: 324920 - RNA, 22 nt, Human
uccucuccaggugagccgaaau

SEQ ID NO: 324921 - RNA, 22 nt, Human
guaaaucagugucauuuuagaa

SEQ ID NO: 324922 - RNA, 18 nt, Human
cuggucucccuucgcuuu

SEQ ID NO: 324923 - RNA, 22 nt, Human
uugaacaguccuaagagacccu

SEQ ID NO: 324924 - RNA, 22 nt, Human
cugggaggcagucucucuagaa

SEQ ID NO: 324925 - RNA, 22 nt, Human
uuucacauacaguguauaguag

SEQ ID NO: 324926 - RNA, 22 nt, Human
agcuccacucccugccuguuuc

SEQ ID NO: 324927 - RNA, 22 nt, Human
gaaaauaguucaucacaaugau

SEQ ID NO: 324928 - RNA, 22 nt, Human
ggugagaggcagugcuguggaa

SEQ ID NO: 324929 - RNA, 20 nt, Human
caucaacaccuugucagccu

SEQ ID NO: 324930 - RNA, 22 nt, Human
ggcaguggugggaggcucgcuc

SEQ ID NO: 324931 - RNA, 22 nt, Human
ugugucuuuggcgaugucugga

SEQ ID NO: 324932 - RNA, 22 nt, Human
ucccagucuagagccggauugg

SEQ ID NO: 324933 - RNA, 22 nt, Human
agcuggugugccaguuccaguu

SEQ ID NO: 324934 - RNA, 22 nt, Human
gucugcugacagagcauggacc

SEQ ID NO: 324935 - RNA, 22 nt, Human
cuggagcucuguguguuccuga

SEQ ID NO: 324936 - RNA, 21 nt, Human
ucuccucccggggagaggccg

SEQ ID NO: 324937 - RNA, 21 nt, Human
uuuguucacacacagggcagc

SEQ ID NO: 324938 - RNA, 21 nt, Human
ggccuuggcgggggccgaauu

SEQ ID NO: 324939 - RNA, 22 nt, Human
cuacuguaguuaaaguuuugua

SEQ ID NO: 324940 - RNA, 22 nt, Human
uuuaauuauaucugggcaguua

SEQ ID NO: 324941 - RNA, 22 nt, Human
ucaguguagcagacuuguagcc

SEQ ID NO: 324942 - RNA, 22 nt, Human
uuuccaaggaugugucucucua

SEQ ID NO: 324943 - RNA, 22 nt, Human
agcagcaccuguccucgcugcu

SEQ ID NO: 324944 - RNA, 22 nt, Human
uucagagcuggugucuacagcu

SEQ ID NO: 324945 - RNA, 22 nt, Human
aguguuugaguuugcggcauug

SEQ ID NO: 324946 - RNA, 22 nt, Human
cucaugucggcaggacucgccc

SEQ ID NO: 324947 - RNA, 22 nt, Human
uggccccugaggagcgucagcc

SEQ ID NO: 324948 - RNA, 22 nt, Human
cuucauuucaggcugaagaaua

SEQ ID NO: 324949 - RNA, 22 nt, Human
ccucuucagcaaaguucggccc

SEQ ID NO: 324950 - RNA, 20 nt, Human
ugugguuuuugccaguugaa

SEQ ID NO: 324951 - RNA, 22 nt, Human
agagaagagucuugucaaauua

SEQ ID NO: 324952 - RNA, 21 nt, Human
uccuccuguagaggguccugg

SEQ ID NO: 324953 - RNA, 22 nt, Human
gcuucccacagcuggacugggg

SEQ ID NO: 324954 - RNA, 22 nt, Human
aacagauuguaaccugauagcc

SEQ ID NO: 324955 - RNA, 23 nt, Human
augccaggcugccuggccagccu

SEQ ID NO: 324956 - RNA, 19 nt, Human
uaugaaguugauaaaaguu

SEQ ID NO: 324957 - RNA, 22 nt, Human
ugcauguuuuauaccaaagcuu

SEQ ID NO: 324958 - RNA, 22 nt, Human
acauuuaaugauccuacuguga

SEQ ID NO: 324959 - RNA, 22 nt, Human
agcuuugggcagaagaggauuc

SEQ ID NO: 324960 - RNA, 22 nt, Human
aauucagguuauauuugcaacu

SEQ ID NO: 324961 - RNA, 22 nt, Human
uucuccucagcaaggcagcuuu

SEQ ID NO: 324962 - RNA, 22 nt, Human
acuuuuaaggggccuugauuua

SEQ ID NO: 324963 - RNA, 22 nt, Human
uucacagcuaagagcuaaguaa

SEQ ID NO: 324964 - RNA, 22 nt, Human
acagccaggaauucuggagaag

SEQ ID NO: 324965 - RNA, 22 nt, Human
uugcugccuuuguacucugaug

SEQ ID NO: 324966 - RNA, 22 nt, Human
ugcccguggccuggggcagcuu

SEQ ID NO: 324967 - RNA, 22 nt, Human
uuuaauuuucugggcccagcag

SEQ ID NO: 324968 - RNA, 22 nt, Human
ucacuaugcccagaauacaguu

SEQ ID NO: 324969 - RNA, 19 nt, Human
ugcagcuguaugagcuuaa

SEQ ID NO: 324970 - RNA, 22 nt, Human
acaucucacuucuuugaaggcu

SEQ ID NO: 324971 - RNA, 20 nt, Human
auuagcuuggagacaguggc

SEQ ID NO: 324972 - RNA, 22 nt, Human
guacuuucaggcuuucccuuaa

SEQ ID NO: 324973 - RNA, 22 nt, Human
accuggaggcagagguugcagu

SEQ ID NO: 324974 - RNA, 22 nt, Human
gugauuuucuccuccuagaagu

SEQ ID NO: 324975 - RNA, 22 nt, Human
caguuuuucaaaauuacaugau

SEQ ID NO: 324976 - RNA, 22 nt, Human
ggaacuccugcuccaagcagcu

SEQ ID NO: 324977 - RNA, 22 nt, Human
uuaccuuguaaaacauauuccu

SEQ ID NO: 324978 - RNA, 22 nt, Human
ccuaggcuaauucaguccagua

SEQ ID NO: 324979 - RNA, 22 nt, Human
caguuaaacagauugaguguua

SEQ ID NO: 324980 - RNA, 22 nt, Human
uugccaggagacaucuggagcc

SEQ ID NO: 324981 - RNA, 22 nt, Human
aaauugcaaaaguacuuuuagg

SEQ ID NO: 324982 - RNA, 22 nt, Human
ccagcagccaccuucucgaaau

SEQ ID NO: 324983 - RNA, 22 nt, Human
cuggaagcgucggaggaagggc

SEQ ID NO: 324984 - RNA, 23 nt, Human
auaugucaugcaccagcacuuua

SEQ ID NO: 324985 - RNA, 22 nt, Human
ugcugcgggacccacugugggc

SEQ ID NO: 324986 - RNA, 22 nt, Human
uacuuucuagcucuccccaguu

SEQ ID NO: 324987 - RNA, 22 nt, Human
augcaguuagguaauagucuca

SEQ ID NO: 324988 - RNA, 23 nt, Human
uggcuugcuaauguuccaaauaa

SEQ ID NO: 324989 - RNA, 22 nt, Human
gccuggcaaggcccuguugacu

SEQ ID NO: 324990 - RNA, 22 nt, Human
ggcuggccuguguggccgccac

SEQ ID NO: 324991 - RNA, 20 nt, Human
uacaauauucccacuuugcu

SEQ ID NO: 324992 - RNA, 22 nt, Human
gguuauuguggagaaguuccgg

SEQ ID NO: 324993 - RNA, 22 nt, Human
uuuguguuggaagaaaugcuac

SEQ ID NO: 324994 - RNA, 22 nt, Human
gagcuuuucccgucuuucucgu

SEQ ID NO: 324995 - RNA, 22 nt, Human
ggaggugacuggaucaugggca

SEQ ID NO: 324996 - RNA, 22 nt, Human
ucuccucuauuucuguauguau

SEQ ID NO: 324997 - RNA, 20 nt, Human
gggugugggcccggccaggc

SEQ ID NO: 324998 - RNA, 22 nt, Human
cuugaaguggagcuuuugaaau

SEQ ID NO: 324999 - RNA, 22 nt, Human
uccaggagggggagccgugccg

SEQ ID NO: 325000 - RNA, 22 nt, Human
ccuucaaucuuaagucagccca

SEQ ID NO: 325001 - RNA, 22 nt, Human
auuuacucgugcuucauugaau

SEQ ID NO: 325002 - RNA, 22 nt, Human
cuggccagccucccagguaccc

SEQ ID NO: 325003 - RNA, 22 nt, Human
gagugugucggucagcguggcg

SEQ ID NO: 325004 - RNA, 22 nt, Human
uaugcuguauucuguauguuag

SEQ ID NO: 325005 - RNA, 22 nt, Human
ugauuugaauuuuaaaacacug

SEQ ID NO: 325006 - RNA, 22 nt, Human
cuuccucuguggccagagugua

SEQ ID NO: 325007 - RNA, 22 nt, Human
uuuuguguugccauguuaagca

SEQ ID NO: 325008 - RNA, 22 nt, Human
uucuuuuaauuucugucugcag

SEQ ID NO: 325009 - RNA, 22 nt, Human
ucaaagaucagaugguuguagg

SEQ ID NO: 325010 - RNA, 22 nt, Human
cuuuauguuggggugucuuagu

SEQ ID NO: 325011 - RNA, 22 nt, Human
cuucuccgacaaccgacgccgg

SEQ ID NO: 325012 - RNA, 22 nt, Human
uacuguauacuacugcuguucu

SEQ ID NO: 325013 - RNA, 22 nt, Human
uuugggaaacuuaggggucaga

SEQ ID NO: 325014 - RNA, 22 nt, Human
acacauggucuacuucuucuca

SEQ ID NO: 325015 - RNA, 22 nt, Human
acuggaaaguauucuuucacug

SEQ ID NO: 325016 - RNA, 22 nt, Human
auuuacagccuugccaucuaua

SEQ ID NO: 325017 - RNA, 22 nt, Human
uugucgggcuuacgcagggcca

SEQ ID NO: 325018 - RNA, 22 nt, Human
gggagcugagcuggaagagaau

SEQ ID NO: 325019 - RNA, 22 nt, Human
uaaguugauuauaaccacugga

SEQ ID NO: 325020 - RNA, 22 nt, Human
cugggcuguuuguucuggucuc

SEQ ID NO: 325021 - RNA, 22 nt, Human
agcauggcuuuggaggauagca

SEQ ID NO: 325022 - RNA, 22 nt, Human
agcuaauguauguugaaagcac

SEQ ID NO: 325023 - RNA, 22 nt, Human
uuccaaguuaggcgagcuggug

SEQ ID NO: 325024 - RNA, 22 nt, Human
gcuuucuuuucaagaauguauu

SEQ ID NO: 325025 - RNA, 22 nt, Human
caaagccaggcuuucuaaugua

SEQ ID NO: 325026 - RNA, 22 nt, Human
gguggcaagggcagccaguaac

SEQ ID NO: 325027 - RNA, 20 nt, Human
uccuccuugcagagcccaga

SEQ ID NO: 325028 - RNA, 22 nt, Human
aagcuguuagggagugguaggu

SEQ ID NO: 325029 - RNA, 22 nt, Human
caagagcuggguggcaagcuag

SEQ ID NO: 325030 - RNA, 22 nt, Human
ucugagugggaacucucaugac

SEQ ID NO: 325031 - RNA, 22 nt, Human
ucaagaaagggcuucaccagga

SEQ ID NO: 325032 - RNA, 22 nt, Human
ccaguucuuucugugugcaaca

SEQ ID NO: 325033 - RNA, 22 nt, Human
cccugacccuaucagagggcca

SEQ ID NO: 325034 - RNA, 20 nt, Human
uuugauugccccucugacuu

SEQ ID NO: 325035 - RNA, 22 nt, Human
ugcuuuauucgacaucugguag

SEQ ID NO: 325036 - RNA, 22 nt, Human
uuuguguuguacuucugugcau

SEQ ID NO: 325037 - RNA, 22 nt, Human
aaaucugagaaauauuguccag

SEQ ID NO: 325038 - RNA, 22 nt, Human
uacauggauguuauccuuacug

SEQ ID NO: 325039 - RNA, 22 nt, Human
uuguacuuaaauaugcaaauag

SEQ ID NO: 325040 - RNA, 22 nt, Human
caggcacaaugagcgccaucuu

SEQ ID NO: 325041 - RNA, 22 nt, Human
aggacaaaggaccagaucugga

SEQ ID NO: 325042 - RNA, 22 nt, Human
cccagccucuggguucugccgg

SEQ ID NO: 325043 - RNA, 22 nt, Human
auggccuuucucaguggugcuu

SEQ ID NO: 325044 - RNA, 22 nt, Human
gcugccuggaauaacggcuggc

SEQ ID NO: 325045 - RNA, 22 nt, Human
ggcugcccucggggucgcaggc

SEQ ID NO: 325046 - RNA, 22 nt, Human
gacagguaaagaugguggcagg

SEQ ID NO: 325047 - RNA, 19 nt, Human
uugcuucaugucuuuugcu

SEQ ID NO: 325048 - RNA, 22 nt, Human
acugguuuuggaaaucaguaca

SEQ ID NO: 325049 - RNA, 16 nt, Human
aggagcuggguaggag

SEQ ID NO: 325050 - RNA, 22 nt, Human
aggacagcagugcuggcacuug

SEQ ID NO: 325051 - RNA, 22 nt, Human
cauuuuccucugcugguguuca

SEQ ID NO: 325052 - RNA, 22 nt, Human
uaaguauuggccuauagcuaga

SEQ ID NO: 325053 - RNA, 22 nt, Human
cuggccucacagaggcuaagcc

SEQ ID NO: 325054 - RNA, 22 nt, Human
gcagcugccgugagcucacgcc

SEQ ID NO: 325055 - RNA, 22 nt, Human
ggcagucuuucccuugagcucu

SEQ ID NO: 325056 - RNA, 18 nt, Human
aguaaauguuaaauauug

SEQ ID NO: 325057 - RNA, 22 nt, Human
aaggaggaauguagccagcucc

SEQ ID NO: 325058 - RNA, 22 nt, Human
agaacaggaggaagccagcucc

SEQ ID NO: 325059 - RNA, 22 nt, Human
caaaugaugcauggcuagugag

SEQ ID NO: 325060 - RNA, 22 nt, Human
gugggcaucuccuuggaagcca

SEQ ID NO: 325061 - RNA, 21 nt, Human
ugcuccaggagggggcagucc

SEQ ID NO: 325062 - RNA, 22 nt, Human
aaacucuacauggucgcaaaaa

SEQ ID NO: 325063 - RNA, 19 nt, Human
ggguccauggugucaagga

SEQ ID NO: 325064 - RNA, 22 nt, Human
agcaauguuggccuauauaccu

SEQ ID NO: 325065 - RNA, 22 nt, Human
uggaggcagccgugaaccaccu

SEQ ID NO: 325066 - RNA, 22 nt, Human
uguuugcucugacuaucuugcg

SEQ ID NO: 325067 - RNA, 22 nt, Human
uuguugcugcucaaccucuaua

SEQ ID NO: 325068 - RNA, 22 nt, Human
aggcucgcaugcccugcaccac

SEQ ID NO: 325069 - RNA, 22 nt, Human
aguacuuuuuguucaauugugc

SEQ ID NO: 325070 - RNA, 22 nt, Human
uuggccguuucacugggcaguu

SEQ ID NO: 325071 - RNA, 22 nt, Human
auuuuagagaaacaaacguagg

SEQ ID NO: 325072 - RNA, 22 nt, Human
acaaacuucccagacaagcucc

SEQ ID NO: 325073 - RNA, 22 nt, Human
ggcagguguggugaccagagau

SEQ ID NO: 325074 - RNA, 22 nt, Human
auguuguugaacucuuugcaug

SEQ ID NO: 325075 - RNA, 21 nt, Human
uugcuguuuucccaaugcagu

SEQ ID NO: 325076 - RNA, 22 nt, Human
uuugacaacugugcaguuugua

SEQ ID NO: 325077 - RNA, 22 nt, Human
ccacugugcccagccucauggg

SEQ ID NO: 325078 - RNA, 21 nt, Human
caagacauaugaguacucugg

SEQ ID NO: 325079 - RNA, 22 nt, Human
cacaguuuugucuugguuucca

SEQ ID NO: 325080 - RNA, 21 nt, Human
aaagugguaaggauuauuuug

SEQ ID NO: 325081 - RNA, 22 nt, Human
caggaaugguuaaucuaaagug

SEQ ID NO: 325082 - RNA, 22 nt, Human
agucaacagaguggccgcagcg

SEQ ID NO: 325083 - RNA, 22 nt, Human
gcuucuggaagcauaugcaaga

SEQ ID NO: 325084 - RNA, 22 nt, Human
agcacuggaaaguuaagaguuu

SEQ ID NO: 325085 - RNA, 22 nt, Human
uuccuuggagucaaacagggag

SEQ ID NO: 325086 - RNA, 22 nt, Human
ggaaggaucuggcugaaaucca

SEQ ID NO: 325087 - RNA, 22 nt, Human
ggaaaaugggaaccugaagcca

SEQ ID NO: 325088 - RNA, 22 nt, Human
accuccuccaaggagccauagg

SEQ ID NO: 325089 - RNA, 22 nt, Human
agcucuuuuaucaugaggagag

SEQ ID NO: 325090 - RNA, 22 nt, Human
ccagacuggggcuccuugaggg

SEQ ID NO: 325091 - RNA, 22 nt, Human
caauguacaaaauaauuacaca

SEQ ID NO: 325092 - RNA, 23 nt, Human
augcaacauugccaguaugggca

SEQ ID NO: 325093 - RNA, 23 nt, Human
aacauuuguaaggugauuuuguu

SEQ ID NO: 325094 - RNA, 22 nt, Human
agcugugaccuucaagagcuac

SEQ ID NO: 325095 - RNA, 22 nt, Human
auuagccuguugcauuuucacu

SEQ ID NO: 325096 - RNA, 18 nt, Human
auuugcaggcaugcaggc

SEQ ID NO: 325097 - RNA, 22 nt, Human
cagcuggacugggauguagcga

SEQ ID NO: 325098 - RNA, 22 nt, Human
aguucugacucugaaucuggga

SEQ ID NO: 325099 - RNA, 22 nt, Human
cacuguuuuacauguuauuuaa

SEQ ID NO: 325100 - RNA, 22 nt, Human
acucagaguuugcguuccauac

SEQ ID NO: 325101 - RNA, 22 nt, Human
uugggauacaucuugcugagcc

SEQ ID NO: 325102 - RNA, 22 nt, Human
cccaggaguuagagguuguggu

SEQ ID NO: 325103 - RNA, 18 nt, Human
gggguagaguguccuauu

SEQ ID NO: 325104 - RNA, 22 nt, Human
gcugucaggaacaugccuuggu

SEQ ID NO: 325105 - RNA, 22 nt, Human
gucuuuuuuacaccuuacauca

SEQ ID NO: 325106 - RNA, 22 nt, Human
ucacaguucaacuaguucagau

SEQ ID NO: 325107 - RNA, 22 nt, Human
uaucuuugguagcuuuccuaag

SEQ ID NO: 325108 - RNA, 22 nt, Human
gucuggagccacugcugcugcu

SEQ ID NO: 325109 - RNA, 22 nt, Human
cuccacagccccuccaguggca

SEQ ID NO: 325110 - RNA, 22 nt, Human
uggaagggagcuggaauuugga

SEQ ID NO: 325111 - RNA, 22 nt, Human
gacaaagcgccugcucgcgggc

SEQ ID NO: 325112 - RNA, 22 nt, Human
ccaggcagccugcuccauucug

SEQ ID NO: 325113 - RNA, 22 nt, Human
gauguggcugcucuaaagccca

SEQ ID NO: 325114 - RNA, 22 nt, Human
ugccugugggugaugauuugau

SEQ ID NO: 325115 - RNA, 22 nt, Human
gggcagcaaaucugagucuggu

SEQ ID NO: 325116 - RNA, 22 nt, Human
ugucuagaaaugcugagucuca

SEQ ID NO: 325117 - RNA, 22 nt, Human
augcaauaguaauucuagucug

SEQ ID NO: 325118 - RNA, 22 nt, Human
agcaggugucacuuucacucca

SEQ ID NO: 325119 - RNA, 22 nt, Human
uguucauaucauuuugaaagcu

SEQ ID NO: 325120 - RNA, 20 nt, Human
ucaggguuucccauucuugg

SEQ ID NO: 325121 - RNA, 22 nt, Human
uccgcgcucucacccgcucccg

SEQ ID NO: 325122 - RNA, 22 nt, Human
auguccaggaagucuuaacuca

SEQ ID NO: 325123 - RNA, 22 nt, Human
aggaaaauggaccagaguuguu

SEQ ID NO: 325124 - RNA, 22 nt, Human
uaggcacugggcuaggacaggu

SEQ ID NO: 325125 - RNA, 22 nt, Human
uguguacauguaucaacuaucg

SEQ ID NO: 325126 - RNA, 22 nt, Human
uuugagaagcauggcuguauuc

SEQ ID NO: 325127 - RNA, 22 nt, Human
ggcugcugcccaccccugcaug

SEQ ID NO: 325128 - RNA, 22 nt, Human
uggaaaauauuuaggugaauga

SEQ ID NO: 325129 - RNA, 22 nt, Human
uguuaguauuggcaaauuuguu

SEQ ID NO: 325130 - RNA, 22 nt, Human
ggcuguggucauuaggagguug

SEQ ID NO: 325131 - RNA, 22 nt, Human
guguuuaaugcagaugugggug

SEQ ID NO: 325132 - RNA, 20 nt, Human
aaaaacaguaaugcugaaga

SEQ ID NO: 325133 - RNA, 22 nt, Human
uauuaugguuguagguuaacaa

SEQ ID NO: 325134 - RNA, 22 nt, Human
uuuauucucuaguuggucagau

SEQ ID NO: 325135 - RNA, 22 nt, Human
gcggcuccgaagccaggccgcg

SEQ ID NO: 325136 - RNA, 22 nt, Human
agggcucagaaagcagguuuuc

SEQ ID NO: 325137 - RNA, 22 nt, Human
accauccuuuaguuugcguuuc

SEQ ID NO: 325138 - RNA, 22 nt, Human
gcacuucaccacuguccugguu

SEQ ID NO: 325139 - RNA, 22 nt, Human
gucucuaucauagcugaacccu

SEQ ID NO: 325140 - RNA, 22 nt, Human
uuuccuacugcccuauacacac

SEQ ID NO: 325141 - RNA, 22 nt, Human
auguaagagcuuugcagggaaa

SEQ ID NO: 325142 - RNA, 22 nt, Human
ccacuuugagaagcugaugaaa

SEQ ID NO: 325143 - RNA, 23 nt, Human
gggcugcuccaggccaaggcugg

SEQ ID NO: 325144 - RNA, 22 nt, Human
uuuggucuggaaucuucagggu

SEQ ID NO: 325145 - RNA, 22 nt, Human
ucaugcaccucuccaugucccc

SEQ ID NO: 325146 - RNA, 22 nt, Human
agcaguuuauccucauaaugga

SEQ ID NO: 325147 - RNA, 22 nt, Human
uuugaaaggagcuuuauccaga

SEQ ID NO: 325148 - RNA, 22 nt, Human
cugacagcgagagaguugcccc

SEQ ID NO: 325149 - RNA, 22 nt, Human
uuccaaggagagcucgaccuca

SEQ ID NO: 325150 - RNA, 22 nt, Human
acccugccucugcuuccuguag

SEQ ID NO: 325151 - RNA, 22 nt, Human
agccacagucuguagccagcuu

SEQ ID NO: 325152 - RNA, 22 nt, Human
gacagcaggaugugaggggaug

SEQ ID NO: 325153 - RNA, 22 nt, Human
uucccuuucuuaaagaguuagg

SEQ ID NO: 325154 - RNA, 22 nt, Human
uucuuuccucccagccuuugga

SEQ ID NO: 325155 - RNA, 22 nt, Human
ggcacugggugagggucacugg

SEQ ID NO: 325156 - RNA, 22 nt, Human
uugcaucagcaggcauaauugg

SEQ ID NO: 325157 - RNA, 22 nt, Human
cccuggcucaggcagcuuuguu

SEQ ID NO: 325158 - RNA, 22 nt, Human
guccguaguggcugaugcuuug

SEQ ID NO: 325159 - RNA, 22 nt, Human
ucacuguuaauaaauagcaaag

SEQ ID NO: 325160 - RNA, 22 nt, Human
ugaacagugugagggugugacc

SEQ ID NO: 325161 - RNA, 22 nt, Human
uuaaguauauccauuugacugg

SEQ ID NO: 325162 - RNA, 22 nt, Human
agaaagcacccugcacuuucug

SEQ ID NO: 325163 - RNA, 22 nt, Human
gugcucacugugagacguccug

SEQ ID NO: 325164 - RNA, 22 nt, Human
gccagguaugaauuacgcacga

SEQ ID NO: 325165 - RNA, 22 nt, Human
gugccuccaggcucgacuaguc

SEQ ID NO: 325166 - RNA, 22 nt, Human
accuggaccugccaccuaugag

SEQ ID NO: 325167 - RNA, 22 nt, Human
gcagcccaggcucgcucacugc

SEQ ID NO: 325168 - RNA, 22 nt, Human
ggagccuggaguuucugauggg

SEQ ID NO: 325169 - RNA, 22 nt, Human
ucugagagcuguagaagccuau

SEQ ID NO: 325170 - RNA, 18 nt, Human
agcugaggggacugaaga

SEQ ID NO: 325171 - RNA, 22 nt, Human
uaacacauagauauuuuaacuu

SEQ ID NO: 325172 - RNA, 22 nt, Human
ggcucuguaaguguugcaggua

SEQ ID NO: 325173 - RNA, 22 nt, Human
cuucucuuggguguggugucuu

SEQ ID NO: 325174 - RNA, 22 nt, Human
gcugcuggcuuccugcuguuuu

SEQ ID NO: 325175 - RNA, 22 nt, Human
auggugguagaagcacuaugug

SEQ ID NO: 325176 - RNA, 22 nt, Human
ugugcuauuuuugcauaugugu

SEQ ID NO: 325177 - RNA, 22 nt, Human
auccauuuuuucagaaugcucu

SEQ ID NO: 325178 - RNA, 22 nt, Human
uccuuucugucuuuacucugga

SEQ ID NO: 325179 - RNA, 22 nt, Human
uugcacagaugcacaugguugc

SEQ ID NO: 325180 - RNA, 22 nt, Human
caugcuggucagccaguggaug

SEQ ID NO: 325181 - RNA, 22 nt, Human
gaauacaaauaauaccaaggug

SEQ ID NO: 325182 - RNA, 22 nt, Human
gggagcugaaggagccggcggg

SEQ ID NO: 325183 - RNA, 22 nt, Human
auguucaaguaccuuugugucu

SEQ ID NO: 325184 - RNA, 17 nt, Human
gagguaggaagugaguc

SEQ ID NO: 325185 - RNA, 22 nt, Human
agcugcugcaaguggugcuaac

SEQ ID NO: 325186 - RNA, 22 nt, Human
auucugcugccuaguuuaugaa

SEQ ID NO: 325187 - RNA, 22 nt, Human
gggagcugaacugcugaaguug

SEQ ID NO: 325188 - RNA, 22 nt, Human
acagcuggaggucugugagcac

SEQ ID NO: 325189 - RNA, 18 nt, Human
auggcuccagugucuucc

SEQ ID NO: 325190 - RNA, 22 nt, Human
acaggaaaugaaaugguaucua

SEQ ID NO: 325191 - RNA, 22 nt, Human
cugccuuggcccuaguucaugg

SEQ ID NO: 325192 - RNA, 22 nt, Human
agucacuguuuaaucuagcuaa

SEQ ID NO: 325193 - RNA, 22 nt, Human
ccgagcuguggucucuuuuacg

SEQ ID NO: 325194 - RNA, 22 nt, Human
cugggaagggacgccagugccu

SEQ ID NO: 325195 - RNA, 22 nt, Human
uggagcugguucuggggaagcu

SEQ ID NO: 325196 - RNA, 22 nt, Human
gagaugaagaggcccuuggagu

SEQ ID NO: 325197 - RNA, 22 nt, Human
uuacaauuacuugaucucagcu

SEQ ID NO: 325198 - RNA, 19 nt, Human
acccucuccccacuggguc

SEQ ID NO: 325199 - RNA, 22 nt, Human
gcugguggcagagcuccgcggc

SEQ ID NO: 325200 - RNA, 22 nt, Human
augcuuucucuuaguucauuga

SEQ ID NO: 325201 - RNA, 22 nt, Human
agguggaguuaagugugaacug

SEQ ID NO: 325202 - RNA, 22 nt, Human
auucccagauuuauauugauag

SEQ ID NO: 325203 - RNA, 21 nt, Human
ugcuuugcagguggauuuagu

SEQ ID NO: 325204 - RNA, 22 nt, Human
auacuaagcucauuacauuuug

SEQ ID NO: 325205 - RNA, 22 nt, Human
gcgacgcaggcacgacguguug

SEQ ID NO: 325206 - RNA, 22 nt, Human
gaccugugcagugacugguggc

SEQ ID NO: 325207 - RNA, 22 nt, Human
uccugucucaguguauuugcag

SEQ ID NO: 325208 - RNA, 22 nt, Human
uuugacucugggugcuuuuucg

SEQ ID NO: 325209 - RNA, 22 nt, Human
cuuuacuucagcaagcuuuccu

SEQ ID NO: 325210 - RNA, 22 nt, Human
aggcuuucgaugaacgcuugcu

SEQ ID NO: 325211 - RNA, 22 nt, Human
ugccuggcugggcugcucaugg

SEQ ID NO: 325212 - RNA, 22 nt, Human
uguguuuuggaaggaacaugca

SEQ ID NO: 325213 - RNA, 22 nt, Human
cugcugagguggagauugcagu

SEQ ID NO: 325214 - RNA, 22 nt, Human
uucagaaagugaaucuuguuau

SEQ ID NO: 325215 - RNA, 22 nt, Human
aggcugcugccuuggagagugu

SEQ ID NO: 325216 - RNA, 22 nt, Human
cacucucacaugcccugucagu

SEQ ID NO: 325217 - RNA, 22 nt, Human
acaauuucuaauauagaucuua

SEQ ID NO: 325218 - RNA, 22 nt, Human
aggcauuuaaagauguaagacu

SEQ ID NO: 325219 - RNA, 17 nt, Human
uuucugcaugauuggac

SEQ ID NO: 325220 - RNA, 22 nt, Human
aaggcaguuaauuuggcuagaa

SEQ ID NO: 325221 - RNA, 22 nt, Human
cuugccaguguugcagaagcuc

SEQ ID NO: 325222 - RNA, 22 nt, Human
gugucccaaagauuagaaauca

SEQ ID NO: 325223 - RNA, 22 nt, Human
caagagcuuuagaaaugcucau

SEQ ID NO: 325224 - RNA, 22 nt, Human
agugauguagguggauucuggc

SEQ ID NO: 325225 - RNA, 22 nt, Human
uugucucuacagagaguaguag

SEQ ID NO: 325226 - RNA, 22 nt, Human
uuuuccuuaacagagggagaaa

SEQ ID NO: 325227 - RNA, 22 nt, Human
gguguuguacauucuguggauu

SEQ ID NO: 325228 - RNA, 23 nt, Human
ugggcagcuucugcaugcccacc

SEQ ID NO: 325229 - RNA, 22 nt, Human
ucugagagccacugaacagcaa

SEQ ID NO: 325230 - RNA, 22 nt, Human
agugggaauuuucucccaggga

SEQ ID NO: 325231 - RNA, 22 nt, Human
gaaacacucaauuuaguaauuc

SEQ ID NO: 325232 - RNA, 22 nt, Human
ucuuuuccuugaugguuaaaua

SEQ ID NO: 325233 - RNA, 22 nt, Human
ucugugggcauuuauaaucugg

SEQ ID NO: 325234 - RNA, 22 nt, Human
augcccugggagugcuguacca

SEQ ID NO: 325235 - RNA, 20 nt, Human
uccaguuuuggagacauucu

SEQ ID NO: 325236 - RNA, 22 nt, Human
uccugaccacuaggaccaggcu

SEQ ID NO: 325237 - RNA, 22 nt, Human
cuugaaagucagcagaguggau

SEQ ID NO: 325238 - RNA, 22 nt, Human
augcacuaugaugagcuagucu

SEQ ID NO: 325239 - RNA, 22 nt, Human
gaaacuguauguaguuuuuggg

SEQ ID NO: 325240 - RNA, 22 nt, Human
uucucaggaacucagugucagc

SEQ ID NO: 325241 - RNA, 22 nt, Human
ggaaacugcuuacacuagaggg

SEQ ID NO: 325242 - RNA, 22 nt, Human
cagcuugcacacauauuagacg

SEQ ID NO: 325243 - RNA, 22 nt, Human
gugcagcugggcgcugaccuuc

SEQ ID NO: 325244 - RNA, 22 nt, Human
uccccaguaagccugcacugug

SEQ ID NO: 325245 - RNA, 22 nt, Human
caguuuuaugaaugcuuauuag

SEQ ID NO: 325246 - RNA, 20 nt, Human
uuucacaaugaacaugucuc

SEQ ID NO: 325247 - RNA, 22 nt, Human
cagaugaaguaggugacgagca

SEQ ID NO: 325248 - RNA, 22 nt, Human
gcugccaauccagcugugggag

SEQ ID NO: 325249 - RNA, 18 nt, Human
ucaugcaaacgcuucaua

SEQ ID NO: 325250 - RNA, 22 nt, Human
aagugcaggucucagcuacucu

SEQ ID NO: 325251 - RNA, 22 nt, Human
uaacauuucggugacaguggga

SEQ ID NO: 325252 - RNA, 22 nt, Human
uuguaagacuguagaaugcaaa

SEQ ID NO: 325253 - RNA, 22 nt, Human
cugcagggcccaaggucaacgg

SEQ ID NO: 325254 - RNA, 22 nt, Human
guaugucuuaggguucaguaac

SEQ ID NO: 325255 - RNA, 22 nt, Human
cuuugcuaauguugcauuuuca

SEQ ID NO: 325256 - RNA, 22 nt, Human
acagcugggaacucacacagca

SEQ ID NO: 325257 - RNA, 22 nt, Human
aauggcagagacuguugaaaua

SEQ ID NO: 325258 - RNA, 22 nt, Human
guuugcaaauuguguuaaagcu

SEQ ID NO: 325259 - RNA, 22 nt, Human
uggcaauguggaaugguccagg

SEQ ID NO: 325260 - RNA, 22 nt, Human
uacucuggaguugagaugcgag

SEQ ID NO: 325261 - RNA, 22 nt, Human
acugcauuugguaaagucaaga

SEQ ID NO: 325262 - RNA, 22 nt, Human
uccagccauaucuuguagcccu

SEQ ID NO: 325263 - RNA, 22 nt, Human
agcucagggccaggcgcguuuc

SEQ ID NO: 325264 - RNA, 22 nt, Human
guugcauuaaucugcucaggcu

SEQ ID NO: 325265 - RNA, 22 nt, Human
guguggcuaggauggcuuugcu

SEQ ID NO: 325266 - RNA, 22 nt, Human
cauguguauuauucuuguggaa

SEQ ID NO: 325267 - RNA, 20 nt, Human
uauuucugggcaaccauuua

SEQ ID NO: 325268 - RNA, 20 nt, Human
ggcagagcuaugucuguugc

SEQ ID NO: 325269 - RNA, 22 nt, Human
cugcugccuuccaaaggccagg

SEQ ID NO: 325270 - RNA, 22 nt, Human
agggggcuccuuggugugcaga

SEQ ID NO: 325271 - RNA, 22 nt, Human
gaugugucccuuucaacucaga

SEQ ID NO: 325272 - RNA, 22 nt, Human
caagcuuguuucuccugggggu

SEQ ID NO: 325273 - RNA, 22 nt, Human
gagcugagggucuaggaggguu

SEQ ID NO: 325274 - RNA, 22 nt, Human
augaugaagcaugguuacacug

SEQ ID NO: 325275 - RNA, 22 nt, Human
cacagaggaugcccaagcgauc

SEQ ID NO: 325276 - RNA, 22 nt, Human
gggaaacuuucacaauguccag

SEQ ID NO: 325277 - RNA, 22 nt, Human
ccuggaaaaugccacuuucaca

SEQ ID NO: 325278 - RNA, 19 nt, Human
ugccuggcaccagcuccac

SEQ ID NO: 325279 - RNA, 22 nt, Human
uggcagugugggaggaagguac

SEQ ID NO: 325280 - RNA, 22 nt, Human
ggcuuuuguuucagcucugcua

SEQ ID NO: 325281 - RNA, 17 nt, Human
agcagcuggguugaucu

SEQ ID NO: 325282 - RNA, 22 nt, Human
gagauuuccauauuuuguaaca

SEQ ID NO: 325283 - RNA, 22 nt, Human
aaguguguauuuuucuucagug

SEQ ID NO: 325284 - RNA, 22 nt, Human
gguuguaguuggagguuguaua

SEQ ID NO: 325285 - RNA, 22 nt, Human adenovirus A
ugccagcguccggguucacuac

SEQ ID NO: 325286 - RNA, 22 nt, Human adenovirus A
uauuugguuacgccgggcucgu

SEQ ID NO: 325287 - RNA, 22 nt, Human adenovirus A
ugaaagcacuggcggguaccaa

SEQ ID NO: 325288 - RNA, 22 nt, Human adenovirus A
uuuacugcuaggggggcgcucc

SEQ ID NO: 325289 - RNA, 22 nt, Human adenovirus A
uugcugcuggcuucugauuugu

SEQ ID NO: 325290 - RNA, 22 nt, Human adenovirus A
augaguguauggaaaauuuggg

SEQ ID NO: 325291 - RNA, 22 nt, Human adenovirus A
gucuacggcuaggggcuguggc

SEQ ID NO: 325292 - RNA, 22 nt, Human adenovirus A
ugugcucauagcggauccugcc

SEQ ID NO: 325293 - RNA, 19 nt, Human adenovirus A
auuaagaugucagcugcga

SEQ ID NO: 325294 - RNA, 23 nt, Human adenovirus A
caaaaaggacgaggugcgauaac

SEQ ID NO: 325295 - RNA, 22 nt, Human adenovirus A
caagcuuggcaagcauaacagu

SEQ ID NO: 325296 - RNA, 22 nt, Human adenovirus A
ccaauguuguaaugacuaagca

SEQ ID NO: 325297 - RNA, 21 nt, Human adenovirus A
ccacgguacccaggcgugggc

SEQ ID NO: 325298 - RNA, 22 nt, Human adenovirus A
caggccaacucacggaggaguc

SEQ ID NO: 325299 - RNA, 22 nt, Human adenovirus A
uccuuagucauauugcauuggg

SEQ ID NO: 325300 - RNA, 22 nt, Human adenovirus A
gggguccggcgcuuaaccaauu

SEQ ID NO: 325301 - RNA, 22 nt, Human adenovirus A
gggguuccucgcuaugguaccc

SEQ ID NO: 325302 - RNA, 22 nt, Human adenovirus A
guacucagccggcuaauguucc

SEQ ID NO: 325303 - RNA, 22 nt, Human adenovirus A
aacaaugcuauuauugagcauu

SEQ ID NO: 325304 - RNA, 22 nt, Human adenovirus A
gcgcucuuguguuaagugugag

SEQ ID NO: 325305 - RNA, 22 nt, Human adenovirus A
acugcggugcgugucacagcau

SEQ ID NO: 325306 - RNA, 22 nt, Human adenovirus A
gggaugcuuuugggacgcuggu

SEQ ID NO: 325307 - RNA, 22 nt, Human adenovirus A
gacaccuucuuaaaaguguggu

SEQ ID NO: 325308 - RNA, 22 nt, Human
cuauuuucccauaugguugaca

SEQ ID NO: 325309 - RNA, 22 nt, Human
uuucgggaaaaacugguaagac

SEQ ID NO: 325310 - RNA, 22 nt, Human
ucugggagaguagauaaaggaa

SEQ ID NO: 325311 - RNA, 22 nt, Human
acgucuucguuggcagagauuu

SEQ ID NO: 325312 - RNA, 19 nt, Human
agcagggagugguuguggg

SEQ ID NO: 325313 - RNA, 22 nt, Human
cuugaaguggagcuuuugaaau

SEQ ID NO: 325314 - RNA, 22 nt, Human
auggccagcaagguagggcaau

SEQ ID NO: 325315 - RNA, 22 nt, Human
cccaggaguaagugacauuguu

SEQ ID NO: 325316 - RNA, 22 nt, Human
caggugggagccacagcguaca

SEQ ID NO: 325317 - RNA, 22 nt, Human
caggccugugacaccgugucug

SEQ ID NO: 325318 - RNA, 22 nt, Human
ggggucugggcuuagcuggaau

SEQ ID NO: 325319 - RNA, 22 nt, Human
ugcugcccacuguauuucucca

SEQ ID NO: 325320 - RNA, 22 nt, Human
gugcugcagagucucgugccgc

SEQ ID NO: 325321 - RNA, 22 nt, Human
uccaagacaagcacauuccugc

SEQ ID NO: 325322 - RNA, 22 nt, Human
cuggccagccucccagguaccc

SEQ ID NO: 325323 - RNA, 22 nt, Human
guucuccaggggcuguucaucu

SEQ ID NO: 325324 - RNA, 22 nt, Human
aggggagguguccccaaaucuc

SEQ ID NO: 325325 - RNA, 22 nt, Human
cuccagauuccguuuauucagg

SEQ ID NO: 325326 - RNA, 22 nt, Human
uuugcuggagaugagcgugggu

SEQ ID NO: 325327 - RNA, 22 nt, Human
ugcuccugaacacagcccuaug

SEQ ID NO: 325328 - RNA, 22 nt, Human
gugguuguuuccagguuugaaa

SEQ ID NO: 325329 - RNA, 22 nt, Human
aucauuugaacagaauuuguuu

SEQ ID NO: 325330 - RNA, 22 nt, Human
aaggccaucuacuuacggaauu

SEQ ID NO: 325331 - RNA, 22 nt, Human
aaaacauuuuacugccaucuca

SEQ ID NO: 325332 - RNA, 20 nt, Human
ggcauggcaaauguucuugc

SEQ ID NO: 325333 - RNA, 22 nt, Human
ucagguagugguuaaguucugu

SEQ ID NO: 325334 - RNA, 22 nt, Human
cuguggccagagcgccguugac

SEQ ID NO: 325335 - RNA, 22 nt, Human
uacugcugagcuggguagaagg

SEQ ID NO: 325336 - RNA, 22 nt, Human
ccuguggccgcgucgggcggcg

SEQ ID NO: 325337 - RNA, 22 nt, Human
cugcugucuuuauuucacugcu

SEQ ID NO: 325338 - RNA, 22 nt, Human
aggcaguguggagggcuguugc

SEQ ID NO: 325339 - RNA, 22 nt, Human
ucaucuccauacggucucgcag

SEQ ID NO: 325340 - RNA, 22 nt, Human
auaggcauaacacugauguccu

SEQ ID NO: 325341 - RNA, 22 nt, Human
uccucuucaaaauagcucugaa

SEQ ID NO: 325342 - RNA, 22 nt, Human
ucaggccaggagaucagauuga

SEQ ID NO: 325343 - RNA, 22 nt, Human
gugggggcaggcagugcuagga

SEQ ID NO: 325344 - RNA, 22 nt, Human
cuggagaggcugggaacagguu

SEQ ID NO: 325345 - RNA, 22 nt, Human
ugugugaacucucugauguaca

SEQ ID NO: 325346 - RNA, 20 nt, Human
uccagccacuuccgcugguc

SEQ ID NO: 325347 - RNA, 22 nt, Human
agauggcagggguaccuggaag

SEQ ID NO: 325348 - RNA, 22 nt, Human
ggcgcggugacucagccucgcu

SEQ ID NO: 325349 - RNA, 22 nt, Human
uuugaaauguaucaguauaggu

SEQ ID NO: 325350 - RNA, 22 nt, Human
gguggcaagggcagccaguaac

SEQ ID NO: 325351 - RNA, 22 nt, Human
gaguuugugggaauggaguauu

SEQ ID NO: 325352 - RNA, 22 nt, Human
cugcccaucuggccacacacag

SEQ ID NO: 325353 - RNA, 22 nt, Human
agucacuguucugucaugucaa

SEQ ID NO: 325354 - RNA, 22 nt, Human
aggagucaccugcccaaaguca

SEQ ID NO: 325355 - RNA, 22 nt, Human
uauaagaaacaaggcaaauuuu

SEQ ID NO: 325356 - RNA, 22 nt, Human
cagcugacaagaguccuuggag

SEQ ID NO: 325357 - RNA, 22 nt, Human
gcucugugccccugccguggac

SEQ ID NO: 325358 - RNA, 22 nt, Human
ugggagcaagcuggugcuggag

SEQ ID NO: 325359 - RNA, 22 nt, Human
gcuuccuucuaccacaucaugc

SEQ ID NO: 325360 - RNA, 20 nt, Human
ugcuggaggcgccggcgcuc

SEQ ID NO: 325361 - RNA, 22 nt, Human
uucacagugguagugcauuuag

SEQ ID NO: 325362 - RNA, 22 nt, Human
auggcugugguaucagacgcag

SEQ ID NO: 325363 - RNA, 20 nt, Human
aucaggcuuucuguugcgau

SEQ ID NO: 325364 - RNA, 22 nt, Human
augcaucaccgaguugcccacc

SEQ ID NO: 325365 - RNA, 22 nt, Human
agugggaauuuucucccaggga

SEQ ID NO: 325366 - RNA, 22 nt, Human
auguaguauuuggaaauguaaa

SEQ ID NO: 325367 - RNA, 22 nt, Human
ugcaggcuggaggagggacuaa

SEQ ID NO: 325368 - RNA, 18 nt, Human
acuguggcucagaguugc

SEQ ID NO: 325369 - RNA, 22 nt, Human
cucugggguggaggaggcugac

SEQ ID NO: 325370 - RNA, 22 nt, Human
agucugaaccagauggcaaggu

SEQ ID NO: 325371 - RNA, 22 nt, Human
agccagucggggccaugcuggg

SEQ ID NO: 325372 - RNA, 22 nt, Human
accaggcccuccagcugcgugg

SEQ ID NO: 325373 - RNA, 22 nt, Human
uuggaaagggauaucuguacuu

SEQ ID NO: 325374 - RNA, 22 nt, Human
ccucuuccuucucacuguggaa

SEQ ID NO: 325375 - RNA, 22 nt, Human
ucugggaguuucugugggagcu

SEQ ID NO: 325376 - RNA, 22 nt, Human
ugcucccaggcauucucuguug

SEQ ID NO: 325377 - RNA, 22 nt, Human
cuucacaaaauauuucauuaua

SEQ ID NO: 325378 - RNA, 22 nt, Human
cucuguccugguuuauacuggc

SEQ ID NO: 325379 - RNA, 22 nt, Human
ggcuuggaaauugcaggacaca

SEQ ID NO: 325380 - RNA, 21 nt, Human
acucugaaaauuaauaguuau

SEQ ID NO: 325381 - RNA, 22 nt, Human
cauuucaaacaguuacagcugc

SEQ ID NO: 325382 - RNA, 22 nt, Human
uguagggaggaaggguuggaaa

SEQ ID NO: 325383 - RNA, 22 nt, Human
uccaggauugucagccagaagg

SEQ ID NO: 325384 - RNA, 22 nt, Human
uuugagaagcauggcuguauuc

SEQ ID NO: 325385 - RNA, 22 nt, Human
cugguggaauggcagagggaac

SEQ ID NO: 325386 - RNA, 22 nt, Human
agcugaacgugcuucugcagca

SEQ ID NO: 325387 - RNA, 22 nt, Human
ugcaucuaaguggcuaacaacc

SEQ ID NO: 325388 - RNA, 22 nt, Human
aagccacugcagcaggagcugc

SEQ ID NO: 325389 - RNA, 22 nt, Human
gcagaagucagaccaucugaau

SEQ ID NO: 325390 - RNA, 22 nt, Human
gauuccugcuauucacagggcu

SEQ ID NO: 325391 - RNA, 22 nt, Human
aagcauuuuagauaaagcauca

SEQ ID NO: 325392 - RNA, 22 nt, Human
ggagaagggaacugaguuuuug

SEQ ID NO: 325393 - RNA, 22 nt, Human
ggugagaggcagugcuguggaa

SEQ ID NO: 325394 - RNA, 22 nt, Human
cuucuggguauuccagauaccu

SEQ ID NO: 325395 - RNA, 22 nt, Human
ucuccucuccuuucauguuguu

SEQ ID NO: 325396 - RNA, 22 nt, Human
gucugcugacagagcauggacc

SEQ ID NO: 325397 - RNA, 22 nt, Human
cccaggucgucagcaguguggu

SEQ ID NO: 325398 - RNA, 22 nt, Human
acauccaguaucagaagcauca

SEQ ID NO: 325399 - RNA, 22 nt, Human
ccucauucucgcguguguuucu

SEQ ID NO: 325400 - RNA, 22 nt, Human
aauagcaaaugcucauuugaaa

SEQ ID NO: 325401 - RNA, 22 nt, Human
aagugauuucugccugcauguu

SEQ ID NO: 325402 - RNA, 22 nt, Human
cuggugcuguagccugauugag

SEQ ID NO: 325403 - RNA, 22 nt, Human
aucauuuaguggggcauuggaa

SEQ ID NO: 325404 - RNA, 22 nt, Human
accuccuccaaggagccauagg

SEQ ID NO: 325405 - RNA, 22 nt, Human
ucaagaaagggcuucaccagga

SEQ ID NO: 325406 - RNA, 22 nt, Human
acaaacuucccagacaagcucc

SEQ ID NO: 325407 - RNA, 22 nt, Human
uuguagucuaggauagauuuuu

SEQ ID NO: 325408 - RNA, 22 nt, Human
auuaaauuggacgcugggggaa

SEQ ID NO: 325409 - RNA, 22 nt, Human
ugguggggccagacuucagcuc

SEQ ID NO: 325410 - RNA, 22 nt, Human
cccuguccugcuaggcccuggu

SEQ ID NO: 325411 - RNA, 22 nt, Human
uuggaaaugcauuuguuauuau

SEQ ID NO: 325412 - RNA, 22 nt, Human
cuuccagugcauagguagauca

SEQ ID NO: 325413 - RNA, 22 nt, Human
gccuucugaucgcuggacugac

SEQ ID NO: 325414 - RNA, 22 nt, Human
uucuuuuaauuucugucugcag

SEQ ID NO: 325415 - RNA, 17 nt, Human
agccugcugaucucaca

SEQ ID NO: 325416 - RNA, 22 nt, Human
cugcaucaguggauaugauggu

SEQ ID NO: 325417 - RNA, 22 nt, Human
cgcugcgaggcgcccuuguugc

SEQ ID NO: 325418 - RNA, 20 nt, Human
uucaugcagugguugcugug

SEQ ID NO: 325419 - RNA, 23 nt, Human
cauuugauccucacaauaaaugg

SEQ ID NO: 325420 - RNA, 22 nt, Human
agauguuuauaacucaugagug

SEQ ID NO: 325421 - RNA, 22 nt, Human
gggagccagcagggcauggagc

SEQ ID NO: 325422 - RNA, 22 nt, Human
ucccagauuccugcucuuauau

SEQ ID NO: 325423 - RNA, 22 nt, Human
gguuguaguuggagguuguaua

SEQ ID NO: 325424 - RNA, 22 nt, Human
auguaugagagauucuuuuauu

SEQ ID NO: 325425 - RNA, 21 nt, Human
uccugcugagaaacagauggu

SEQ ID NO: 325426 - RNA, 22 nt, Human
caggaaugguuaaucuaaagug

SEQ ID NO: 325427 - RNA, 22 nt, Human
uuccuccagccuggagcacuuc

SEQ ID NO: 325428 - RNA, 22 nt, Human
augcaauaguaauucuagucug

SEQ ID NO: 325429 - RNA, 22 nt, Human
cccaggcuggggcuccuccagc

SEQ ID NO: 325430 - RNA, 22 nt, Human
auaguguguaaagugcagugau

SEQ ID NO: 325431 - RNA, 22 nt, Human
caaauguuugguggcauuuugu

SEQ ID NO: 325432 - RNA, 22 nt, Human
caugucacaauucuuaauggga

SEQ ID NO: 325433 - RNA, 22 nt, Human
ccucuucuaggacguccuugug

SEQ ID NO: 325434 - RNA, 22 nt, Human
agcucagaacugcagacaugug

SEQ ID NO: 325435 - RNA, 22 nt, Human
cuuggcugaacuccaggaugca

SEQ ID NO: 325436 - RNA, 19 nt, Human
uuacaugacauaugaagga

SEQ ID NO: 325437 - RNA, 22 nt, Human
gugaccagacagagucuagccc

SEQ ID NO: 325438 - RNA, 22 nt, Human
cugggaggcggagguuguagug

SEQ ID NO: 325439 - RNA, 22 nt, Human
ggugaccagggucaguagcuuu

SEQ ID NO: 325440 - RNA, 22 nt, Human
cacucucacaugcccugucagu

SEQ ID NO: 325441 - RNA, 22 nt, Human
ccgcgagguggagguugcagug

SEQ ID NO: 325442 - RNA, 22 nt, Human
augcacaagguagauuauuauu

SEQ ID NO: 325443 - RNA, 22 nt, Human
agggugugcuguugggucuuuc

SEQ ID NO: 325444 - RNA, 22 nt, Human
cugggaccugugugccugggcc

SEQ ID NO: 325445 - RNA, 22 nt, Human
ggagaguggauuccagcuguau

SEQ ID NO: 325446 - RNA, 22 nt, Human
uacccacugucauauucagggu

SEQ ID NO: 325447 - RNA, 22 nt, Human
ggcagguguggugaccagagau

SEQ ID NO: 325448 - RNA, 22 nt, Human
gcucaugggcccagagcagccc

SEQ ID NO: 325449 - RNA, 22 nt, Human
gccauguuuugguaaauaccau

SEQ ID NO: 325450 - RNA, 22 nt, Human
aaguuugucucauuugaucuuc

SEQ ID NO: 325451 - RNA, 22 nt, Human
aggcugcagaggugcugccaga

SEQ ID NO: 325452 - RNA, 22 nt, Human
gcagaagcugggcagcgaggug

SEQ ID NO: 325453 - RNA, 22 nt, Human
ucuuccagauacuuccugacuu

SEQ ID NO: 325454 - RNA, 22 nt, Human
ggauguuuauccuaucuuaguu

SEQ ID NO: 325455 - RNA, 22 nt, Human
agccacagucuguagccagcuu

SEQ ID NO: 325456 - RNA, 22 nt, Human
acauuugauauggaguugugua

SEQ ID NO: 325457 - RNA, 22 nt, Human
uucugagguccaugcaguacug

SEQ ID NO: 325458 - RNA, 22 nt, Human
gauacuugaggagaucaccaca

SEQ ID NO: 325459 - RNA, 22 nt, Human
caugggaauaaaguuauuucaa

SEQ ID NO: 325460 - RNA, 22 nt, Human
aggcaaucaguguagaguaaca

SEQ ID NO: 325461 - RNA, 22 nt, Human
guacuuucaggcuuucccuuaa

SEQ ID NO: 325462 - RNA, 22 nt, Human
agcugcugcaaguggugcuaac

SEQ ID NO: 325463 - RNA, 22 nt, Human
ggcggugguugagaggacggcg

SEQ ID NO: 325464 - RNA, 22 nt, Human
gggggcuggacuuucccacaca

SEQ ID NO: 325465 - RNA, 22 nt, Human
acacuggacucagaggccagaa

SEQ ID NO: 325466 - RNA, 22 nt, Human
agaguguguggggcugagguca

SEQ ID NO: 325467 - RNA, 22 nt, Human
acuggcuuugagggaauagcua

SEQ ID NO: 325468 - RNA, 22 nt, Human
augaacaguacaaagcacagac

SEQ ID NO: 325469 - RNA, 22 nt, Human
ugacccucuuccccaugcgcuc

SEQ ID NO: 325470 - RNA, 22 nt, Human
ccagagaggccuuggcaagaca

SEQ ID NO: 325471 - RNA, 18 nt, Human
aguaaauguuaaauauug

SEQ ID NO: 325472 - RNA, 19 nt, Human
agcaguggagccaugccug

SEQ ID NO: 325473 - RNA, 22 nt, Human
cuggccagggugcgaucguggu

SEQ ID NO: 325474 - RNA, 22 nt, Human
cacugggagcagcuccaacauu

SEQ ID NO: 325475 - RNA, 22 nt, Human
ucuggaaggggaucugugguca

SEQ ID NO: 325476 - RNA, 22 nt, Human
ugucaaguuguuaaguucuggg

SEQ ID NO: 325477 - RNA, 18 nt, Human
uccaggcuccaggcuaac

SEQ ID NO: 325478 - RNA, 22 nt, Human
gaguggggcccacugcugggug

SEQ ID NO: 325479 - RNA, 22 nt, Human
aaagugacaaccauuuauuaag

SEQ ID NO: 325480 - RNA, 21 nt, Human
gcaggguuugugcugugaguu

SEQ ID NO: 325481 - RNA, 22 nt, Human
ccaggcagccugcuccauucug

SEQ ID NO: 325482 - RNA, 22 nt, Human
aagaugauuauguagauuggga

SEQ ID NO: 325483 - RNA, 22 nt, Human
gguagggaaggucucccacauu

SEQ ID NO: 325484 - RNA, 22 nt, Human
acccggaggcgggggaugcagu

SEQ ID NO: 325485 - RNA, 22 nt, Human
acagagccuccaggagugcugg

SEQ ID NO: 325486 - RNA, 20 nt, Human
ucauccaguugguuuauggu

SEQ ID NO: 325487 - RNA, 22 nt, Human
ggugauuuccuuuugcaaaguc

SEQ ID NO: 325488 - RNA, 19 nt, Human
aaauccaagcucaggccuc

SEQ ID NO: 325489 - RNA, 22 nt, Human
uggaaauacaagaaguauguca

SEQ ID NO: 325490 - RNA, 22 nt, Human
caggcgaccccuaggagcaaca

SEQ ID NO: 325491 - RNA, 22 nt, Human
uucuguaauucuguuaguuuca

SEQ ID NO: 325492 - RNA, 22 nt, Human
uuugcuugauuaggauauggaa

SEQ ID NO: 325493 - RNA, 22 nt, Human
caaacuuacuguguuuaaagag

SEQ ID NO: 325494 - RNA, 18 nt, Human
uccauccucugcucuuca

SEQ ID NO: 325495 - RNA, 22 nt, Human
acuguucacccagcacuagcag

SEQ ID NO: 325496 - RNA, 22 nt, Human
cccagguaaggaugcuccucau

SEQ ID NO: 325497 - RNA, 22 nt, Human
cuccagaggcgacuugcaucac

SEQ ID NO: 325498 - RNA, 22 nt, Human
ucccaaguagaugggaauacag

SEQ ID NO: 325499 - RNA, 22 nt, Human
gccugcacucaaacacucucuu

SEQ ID NO: 325500 - RNA, 22 nt, Human
agguggucuuguggaugccgca

SEQ ID NO: 325501 - RNA, 22 nt, Human
guucugucugagcaccacagga

SEQ ID NO: 325502 - RNA, 22 nt, Human
agccuugcaugauuucauucau

SEQ ID NO: 325503 - RNA, 22 nt, Human
aguucugggaggugcacgucca

SEQ ID NO: 325504 - RNA, 22 nt, Human
uuuuucaagacaaccugcaugu

SEQ ID NO: 325505 - RNA, 22 nt, Human
ugcuggaguggcacuguguggc

SEQ ID NO: 325506 - RNA, 22 nt, Human
acagugcugaucuagacugacc

SEQ ID NO: 325507 - RNA, 23 nt, Human
gguucugccgcuuacugcugugc

SEQ ID NO: 325508 - RNA, 18 nt, Human
ggaaaaggagugucuagc

SEQ ID NO: 325509 - RNA, 22 nt, Human
cagcuuguuuacaugcuuauuc

SEQ ID NO: 325510 - RNA, 22 nt, Human
aggagccauugcaggauggcag

SEQ ID NO: 325511 - RNA, 17 nt, Human
cauucuguaaucuuucu

SEQ ID NO: 325512 - RNA, 22 nt, Human
ugccaggccucaggagucucca

SEQ ID NO: 325513 - RNA, 22 nt, Human
cgugcggccucggggcccggcu

SEQ ID NO: 325514 - RNA, 23 nt, Human
caccccacccugaggaggaggga

SEQ ID NO: 325515 - RNA, 22 nt, Human
aggcucgcaugcccugcaccac

SEQ ID NO: 325516 - RNA, 22 nt, Human
agcaugucuaacucuucagggu

SEQ ID NO: 325517 - RNA, 22 nt, Human
uuguugcaagccuggaaucugg

SEQ ID NO: 325518 - RNA, 22 nt, Human
aauguuugaacuuugcauauuu

SEQ ID NO: 325519 - RNA, 22 nt, Human
aaugaaacuauauuuagagagg

SEQ ID NO: 325520 - RNA, 22 nt, Human
uagcauuuagaacaccuugaga

SEQ ID NO: 325521 - RNA, 22 nt, Human
ugcaugacaauugccgucaagu

SEQ ID NO: 325522 - RNA, 23 nt, Human
acugccugugccgaucucucuca

SEQ ID NO: 325523 - RNA, 22 nt, Human
ccucguccacaauccuugcaca

SEQ ID NO: 325524 - RNA, 22 nt, Human
gugggugucaguaucuuuaacg

SEQ ID NO: 325525 - RNA, 22 nt, Human
ccacugauucugccaggucucu

SEQ ID NO: 325526 - RNA, 22 nt, Human
cuuuauguuggggugucuuagu

SEQ ID NO: 325527 - RNA, 22 nt, Human
uaugcuguauucuguauguuag

SEQ ID NO: 325528 - RNA, 22 nt, Human
acuuugccuucuuacuguguug

SEQ ID NO: 325529 - RNA, 22 nt, Human
gcuggguggaucggaggcucug

SEQ ID NO: 325530 - RNA, 22 nt, Human
cccaggaguuagagguuguggu

SEQ ID NO: 325531 - RNA, 22 nt, Human
agugucugcgggcagaggagcg

SEQ ID NO: 325532 - RNA, 22 nt, Human
cugggagaugacucagagcagg

SEQ ID NO: 325533 - RNA, 22 nt, Human
agugagaguauuaaugugaacu

SEQ ID NO: 325534 - RNA, 22 nt, Human
agguggcagacuaacagaagga

SEQ ID NO: 325535 - RNA, 19 nt, Human
uuugauagggcauaauaua

SEQ ID NO: 325536 - RNA, 22 nt, Human
uaaaguuuauuggcaccaccau

SEQ ID NO: 325537 - RNA, 22 nt, Human
gaugucuucagauggcaagaga

SEQ ID NO: 325538 - RNA, 22 nt, Human
cccugcacagccuggcucucuu

SEQ ID NO: 325539 - RNA, 22 nt, Human
cacagaaucugugacuccaaga

SEQ ID NO: 325540 - RNA, 22 nt, Human
aagcauuucagguagagauauu

SEQ ID NO: 325541 - RNA, 18 nt, Human
ucuuccaacacugacacc

SEQ ID NO: 325542 - RNA, 22 nt, Human
guggggacgggauggcucacug

SEQ ID NO: 325543 - RNA, 22 nt, Human
cugggccacaagccugugugau

SEQ ID NO: 325544 - RNA, 22 nt, Human
uucuguuuauaauuugcaguug

SEQ ID NO: 325545 - RNA, 22 nt, Human
aauucauacucuauauugcuuu

SEQ ID NO: 325546 - RNA, 21 nt, Human
ucauccagguccugcuucuuc

SEQ ID NO: 325547 - RNA, 17 nt, Human
ucuggaugucauggaag

SEQ ID NO: 325548 - RNA, 22 nt, Human
aaaauuaagugucugggaagcc

SEQ ID NO: 325549 - RNA, 19 nt, Human
cucugccauuugcugccug

SEQ ID NO: 325550 - RNA, 22 nt, Human
ucuacaacgugguuuuguugua

SEQ ID NO: 325551 - RNA, 22 nt, Human
uggauguuugaaguugcaugug

SEQ ID NO: 325552 - RNA, 21 nt, Human
uccaaaggagacugagugugu

SEQ ID NO: 325553 - RNA, 22 nt, Human
agaguggcaccuuaccugagac

SEQ ID NO: 325554 - RNA, 22 nt, Human
aaggcaguuaauuuggcuagaa

SEQ ID NO: 325555 - RNA, 22 nt, Human
gguuccaggcauggcaggaugu

SEQ ID NO: 325556 - RNA, 22 nt, Human
ucuuccuggauggggguugaug

SEQ ID NO: 325557 - RNA, 22 nt, Human
gcagcagcggggccccugcgcg

SEQ ID NO: 325558 - RNA, 22 nt, Human
uccucacagcugguucauucag

SEQ ID NO: 325559 - RNA, 22 nt, Human
uuucauguuggauacuguuuca

SEQ ID NO: 325560 - RNA, 22 nt, Human
acagagacacggaagcuaaaga

SEQ ID NO: 325561 - RNA, 22 nt, Human
ccagacuggggcuccuugaggg

SEQ ID NO: 325562 - RNA, 22 nt, Human
gaaaggagaggguuaaggagcu

SEQ ID NO: 325563 - RNA, 22 nt, Human
ugcagcaccuauggacacuugu

SEQ ID NO: 325564 - RNA, 17 nt, Human
cucugggucuccugcuu

SEQ ID NO: 325565 - RNA, 22 nt, Human
uguccagcugaaggcagccuca

SEQ ID NO: 325566 - RNA, 22 nt, Human
aaaugcaugugcuauagaugug

SEQ ID NO: 325567 - RNA, 22 nt, Human
caagaaguugacagccagguga

SEQ ID NO: 325568 - RNA, 22 nt, Human
acuuuuaaggggccuugauuua

SEQ ID NO: 325569 - RNA, 23 nt, Human
gggugcugccuguagucaugcug

SEQ ID NO: 325570 - RNA, 22 nt, Human
uauuuguuucuaguggcagcaa

SEQ ID NO: 325571 - RNA, 22 nt, Human
uccucccugcacucagugaagu

SEQ ID NO: 325572 - RNA, 22 nt, Human
gaauaauugugaugcuugaagu

SEQ ID NO: 325573 - RNA, 22 nt, Human
uaggggugggauccaggaauua

SEQ ID NO: 325574 - RNA, 22 nt, Human
gggaagugcccucuucaggaga

SEQ ID NO: 325575 - RNA, 22 nt, Human
cgcacuggagcuggaacgaguc

SEQ ID NO: 325576 - RNA, 22 nt, Human
gccacaggaaagcacccuggag

SEQ ID NO: 325577 - RNA, 22 nt, Human
cacccugaggccacccagaccu

SEQ ID NO: 325578 - RNA, 22 nt, Human
aucucccaaauuagccucuuga

SEQ ID NO: 325579 - RNA, 22 nt, Human
aguguuaaggcugguugcuaua

SEQ ID NO: 325580 - RNA, 22 nt, Human
gaaagcagaugaaauugcaaca

SEQ ID NO: 325581 - RNA, 22 nt, Human
uuugccaguauuuuauugauga

SEQ ID NO: 325582 - RNA, 23 nt, Human
aggcugcagaagaauagggucau

SEQ ID NO: 325583 - RNA, 22 nt, Human
aggagacaguuuggacguguag

SEQ ID NO: 325584 - RNA, 22 nt, Human
gugauuucaaauauagagugag

SEQ ID NO: 325585 - RNA, 15 nt, Human
gccccaggaaucaaa

SEQ ID NO: 325586 - RNA, 22 nt, Human
gcugggagucgcgucuguggcc

SEQ ID NO: 325587 - RNA, 22 nt, Human
gcuucuggugaggccucaggaa

SEQ ID NO: 325588 - RNA, 21 nt, Human
uccuccuguagaggguccugg

SEQ ID NO: 325589 - RNA, 22 nt, Human
uguggccaccagagcugcuauu

SEQ ID NO: 325590 - RNA, 21 nt, Human
ucucuccucaagcucgacccc

SEQ ID NO: 325591 - RNA, 22 nt, Human
uacuuugucauucuaaccuucc

SEQ ID NO: 325592 - RNA, 22 nt, Human
gguguuguacauucuguggauu

SEQ ID NO: 325593 - RNA, 22 nt, Human
ccauggccugaaggagugcauc

SEQ ID NO: 325594 - RNA, 22 nt, Human
cccaccagaccugcaccggcac

SEQ ID NO: 325595 - RNA, 22 nt, Human
ccagagagggcgccaccuggag

SEQ ID NO: 325596 - RNA, 22 nt, Human
ggcgcucaguguugccccagag

SEQ ID NO: 325597 - RNA, 22 nt, Human
uuucaaguagagggaucgcuag

SEQ ID NO: 325598 - RNA, 22 nt, Human
guccaucuaaguauccagccug

SEQ ID NO: 325599 - RNA, 22 nt, Human
cugaugcucuggauguagucaa

SEQ ID NO: 325600 - RNA, 22 nt, Human
aggguugaagucugguccucau

SEQ ID NO: 325601 - RNA, 21 nt, Human
ucaggaagagccaguucaugc

SEQ ID NO: 325602 - RNA, 22 nt, Human
cgccaguggcagcuggaacagg

SEQ ID NO: 325603 - RNA, 22 nt, Human
agagacuguaaugagagguaca

SEQ ID NO: 325604 - RNA, 22 nt, Human
cuccagcagaaagggcgagugg

SEQ ID NO: 325605 - RNA, 22 nt, Human
ggauguggaccuugccugguga

SEQ ID NO: 325606 - RNA, 22 nt, Human
aggcagugguguuugcuggugg

SEQ ID NO: 325607 - RNA, 22 nt, Human
gugcagcugggcgcugaccuuc

SEQ ID NO: 325608 - RNA, 22 nt, Human
uggggucagcaggccuggccug

SEQ ID NO: 325609 - RNA, 22 nt, Human
uguuaguauuggcaaauuuguu

SEQ ID NO: 325610 - RNA, 22 nt, Human
cuguggaguccuggggaaugga

SEQ ID NO: 325611 - RNA, 22 nt, Human
uugcaguugcuguauuuaagga

SEQ ID NO: 325612 - RNA, 22 nt, Human
aaggcuuguugucacgcucuug

SEQ ID NO: 325613 - RNA, 22 nt, Human
uuuucuaacaucuaguaauuug

SEQ ID NO: 325614 - RNA, 22 nt, Human
accaggaguuuugaccaggggc

SEQ ID NO: 325615 - RNA, 22 nt, Human
cauuguguauuucuguaguacu

SEQ ID NO: 325616 - RNA, 22 nt, Human
ggaagcuguuaucaucuguauc

SEQ ID NO: 325617 - RNA, 22 nt, Human
aacuuucagaauccuaugcauu

SEQ ID NO: 325618 - RNA, 22 nt, Human
gcucugugcaguucagggacac

SEQ ID NO: 325619 - RNA, 22 nt, Human
gauucugaaauuaacagacugg

SEQ ID NO: 325620 - RNA, 22 nt, Human
ugcagcaucuccuugugccaug

SEQ ID NO: 325621 - RNA, 22 nt, Human
aguacuuuuuguucaauugugc

SEQ ID NO: 325622 - RNA, 22 nt, Human
ggcuacagcgggguggagacgg

SEQ ID NO: 325623 - RNA, 22 nt, Human
cccaggaggcagaaguugcagu

SEQ ID NO: 325624 - RNA, 18 nt, Human
ucaugcaaacgcuucaua

SEQ ID NO: 325625 - RNA, 22 nt, Human
ucuguggcaaacacagugacca

SEQ ID NO: 325626 - RNA, 21 nt, Human
agcaucugaggcaguuuccua

SEQ ID NO: 325627 - RNA, 22 nt, Human
ucauccugaagaaccugcuucc

SEQ ID NO: 325628 - RNA, 22 nt, Human
auucucuguacagaagguaccg

SEQ ID NO: 325629 - RNA, 22 nt, Human
cagguugaaaguggaggagcua

SEQ ID NO: 325630 - RNA, 22 nt, Human
acagagggucugggcacaggac

SEQ ID NO: 325631 - RNA, 22 nt, Human
gccuucugauugcuggacugac

SEQ ID NO: 325632 - RNA, 22 nt, Human
ucugcgcccugucgccugcucc

SEQ ID NO: 325633 - RNA, 22 nt, Human
cuguggcuaggaagcuguggga

SEQ ID NO: 325634 - RNA, 22 nt, Human
uguggagcccccaggagugggg

SEQ ID NO: 325635 - RNA, 22 nt, Human
aaagcacauuacaagcucaguc

SEQ ID NO: 325636 - RNA, 22 nt, Human
ugcugcucaagcugcagcaaaa

SEQ ID NO: 325637 - RNA, 22 nt, Human
ggggaagaaauagaacauuuug

SEQ ID NO: 325638 - RNA, 22 nt, Human
ccaucgcuucaaaucucagacu

SEQ ID NO: 325639 - RNA, 22 nt, Human
agcucuuuuaucaugaggagag

SEQ ID NO: 325640 - RNA, 22 nt, Human
ggagaggggaacuuguugcuug

SEQ ID NO: 325641 - RNA, 22 nt, Human
ugauuugaaaccuuuggcaaga

SEQ ID NO: 325642 - RNA, 22 nt, Human
uugcuggaguagaaaacuuaac

SEQ ID NO: 325643 - RNA, 22 nt, Human
aaaguaauugugguucuugcca

SEQ ID NO: 325644 - RNA, 22 nt, Human
aggacagagggaccagagccca

SEQ ID NO: 325645 - RNA, 22 nt, Human
aagcucuuuccacuaaaccacu

SEQ ID NO: 325646 - RNA, 22 nt, Human
acauauuuugaaagcuuucuaa

SEQ ID NO: 325647 - RNA, 22 nt, Human
agcuccugaaaauccagacugg

SEQ ID NO: 325648 - RNA, 22 nt, Human
ggguggaaaguauuuggggacc

SEQ ID NO: 325649 - RNA, 22 nt, Human
aucuuacaauuacaagacacuc

SEQ ID NO: 325650 - RNA, 22 nt, Human
auggcuucugucuuggaaauuu

SEQ ID NO: 325651 - RNA, 22 nt, Human
acacuccagggagggagggaau

SEQ ID NO: 325652 - RNA, 22 nt, Human
uugucucuacagagaguaguag

SEQ ID NO: 325653 - RNA, 18 nt, Human
cagaaaguuauuuacucu

SEQ ID NO: 325654 - RNA, 22 nt, Human
aaagacuaaccaguugucaaaa

SEQ ID NO: 325655 - RNA, 22 nt, Human
uggcaugcaagaggaggcuccc

SEQ ID NO: 325656 - RNA, 22 nt, Human
uccucuccaggugagccgaaau

SEQ ID NO: 325657 - RNA, 22 nt, Human
aaaccggguccagaucuucagg

SEQ ID NO: 325658 - RNA, 22 nt, Human
gaagcuucgaaagagugauuuc

SEQ ID NO: 325659 - RNA, 22 nt, Human
ggcuggacuugguccuguuuug

SEQ ID NO: 325660 - RNA, 22 nt, Human
cugcugagguggagauugcagu

SEQ ID NO: 325661 - RNA, 22 nt, Human
auugagaaggagauuggcaucu

SEQ ID NO: 325662 - RNA, 22 nt, Human
cagcauggagacaaagugggca

SEQ ID NO: 325663 - RNA, 22 nt, Human
gaugugugugcccugggccugc

SEQ ID NO: 325664 - RNA, 22 nt, Human
ugguaccagcuguguguucacu

SEQ ID NO: 325665 - RNA, 21 nt, Human
cccgugccuucagcaguccug

SEQ ID NO: 325666 - RNA, 22 nt, Human
ccuggccauagggcccaggaaa

SEQ ID NO: 325667 - RNA, 22 nt, Human
ggaacuccugcuccaagcagcu

SEQ ID NO: 325668 - RNA, 22 nt, Human
aguucugacucugaaucuggga

SEQ ID NO: 325669 - RNA, 22 nt, Human
uugcuggaagguggcuggaauc

SEQ ID NO: 325670 - RNA, 22 nt, Human
cacucacccgguccuucccagu

SEQ ID NO: 325671 - RNA, 22 nt, Human
caagagcucccagaccugggca

SEQ ID NO: 325672 - RNA, 19 nt, Human
uucacuaggucacaagguc

SEQ ID NO: 325673 - RNA, 22 nt, Human
cguggggcggguggacacuugc

SEQ ID NO: 325674 - RNA, 22 nt, Human
gaugggcaucaaacaugacgug

SEQ ID NO: 325675 - RNA, 21 nt, Human
gccaccucaaucuucuagcgc

SEQ ID NO: 325676 - RNA, 22 nt, Human
agcuccugaaaagcgcuugcuu

SEQ ID NO: 325677 - RNA, 22 nt, Human
ggcagccagagggcagcuggau

SEQ ID NO: 325678 - RNA, 22 nt, Human
uccagguccuacuggcccauag

SEQ ID NO: 325679 - RNA, 22 nt, Human
auuucauccauuaagaguacuc

SEQ ID NO: 325680 - RNA, 22 nt, Human
ucuguggcauguugcacuugua

SEQ ID NO: 325681 - RNA, 22 nt, Human
acaagucaguggaauuaauauu

SEQ ID NO: 325682 - RNA, 20 nt, Human
aggggcaccugcgacggggc

SEQ ID NO: 325683 - RNA, 22 nt, Human
agccagcauauauauaguugaa

SEQ ID NO: 325684 - RNA, 22 nt, Human
cacuuuuaacaggagaauuccc

SEQ ID NO: 325685 - RNA, 22 nt, Human
uggagccagcaggacucagagg

SEQ ID NO: 325686 - RNA, 22 nt, Human
acauuguugagccucuuguuca

SEQ ID NO: 325687 - RNA, 22 nt, Human
acaugcacccaguuacacucuc

SEQ ID NO: 325688 - RNA, 23 nt, Human
uguacacuuggucaagguacuua

SEQ ID NO: 325689 - RNA, 22 nt, Human
auucccagauuuauauugauag

SEQ ID NO: 325690 - RNA, 22 nt, Human
accccagaggcggaggcugcag

SEQ ID NO: 325691 - RNA, 22 nt, Human
uuccaaggcugcuauuuguuuc

SEQ ID NO: 325692 - RNA, 22 nt, Human
uccugagauaggaguugaaggc

SEQ ID NO: 325693 - RNA, 21 nt, Human
uugcuguuuucccaaugcagu

SEQ ID NO: 325694 - RNA, 22 nt, Human
uccuuggcaugccgucuucucc

SEQ ID NO: 325695 - RNA, 22 nt, Human
ugugugcacaaagaguacaugg

SEQ ID NO: 325696 - RNA, 22 nt, Human
uggaucugcucuaugaacugcu

SEQ ID NO: 325697 - RNA, 22 nt, Human
ccuucuagcaaaucaacauaaa

SEQ ID NO: 325698 - RNA, 22 nt, Human
ugcugggauuacagucaugagc

SEQ ID NO: 325699 - RNA, 22 nt, Human
ugcaugcagcuggucgggcgcc

SEQ ID NO: 325700 - RNA, 22 nt, Human
acacaucagaaauaugaaugag

SEQ ID NO: 325701 - RNA, 22 nt, Human
aucuucaaagcacaucguuugu

SEQ ID NO: 325702 - RNA, 22 nt, Human
ggcugcugcccaccccugcaug

SEQ ID NO: 325703 - RNA, 21 nt, Human
ugcuggguuugcccaucaggc

SEQ ID NO: 325704 - RNA, 20 nt, Human
cagcucugggcaggucgagg

SEQ ID NO: 325705 - RNA, 22 nt, Human
ccagcaggagacuagcaacaua

SEQ ID NO: 325706 - RNA, 22 nt, Human
gccccagcguggcuguguuagg

SEQ ID NO: 325707 - RNA, 21 nt, Human
aggcaugagcccugcauggac

SEQ ID NO: 325708 - RNA, 22 nt, Human
cuucucggccguguggaugcgc

SEQ ID NO: 325709 - RNA, 22 nt, Human
ccaccagaccaccaagagcaac

SEQ ID NO: 325710 - RNA, 17 nt, Human
ggccugcaccuccugcu

SEQ ID NO: 325711 - RNA, 22 nt, Human
gagaacuugaacuuuuccucug

SEQ ID NO: 325712 - RNA, 22 nt, Human
aggcaguguguagcuggaagag

SEQ ID NO: 325713 - RNA, 17 nt, Human
uuucugcaugauuggac

SEQ ID NO: 325714 - RNA, 22 nt, Human
uggcaaggccacaggugcaguu

SEQ ID NO: 325715 - RNA, 21 nt, Human
cagagcuguccaaacccugac

SEQ ID NO: 325716 - RNA, 22 nt, Human
gcccugugccagucacgcugug

SEQ ID NO: 325717 - RNA, 22 nt, Human
cugcagccucaaccuccugagc

SEQ ID NO: 325718 - RNA, 22 nt, Human
agagcuggugcauauucagaaa

SEQ ID NO: 325719 - RNA, 22 nt, Human
gccuguggggcugaggcugccu

SEQ ID NO: 325720 - RNA, 22 nt, Human
uaggacauaaguauucuaacuu

SEQ ID NO: 325721 - RNA, 20 nt, Human
cccagcccgggccgcgcucg

SEQ ID NO: 325722 - RNA, 22 nt, Human
gagcugggcgagccggggaagu

SEQ ID NO: 325723 - RNA, 20 nt, Human
acaaaauagguacuggguag

SEQ ID NO: 325724 - RNA, 22 nt, Human
cagccccuuguccgguagccac

SEQ ID NO: 325725 - RNA, 22 nt, Human
cagggagcagcgcuggggccuc

SEQ ID NO: 325726 - RNA, 22 nt, Human
gaucucaaagcaguguggguug

SEQ ID NO: 325727 - RNA, 22 nt, Human
ucagcuucagaucagcuagaga

SEQ ID NO: 325728 - RNA, 22 nt, Human
gagccuggccuccugccucagc

SEQ ID NO: 325729 - RNA, 22 nt, Human
cagagcugcaaaugccccuccg

SEQ ID NO: 325730 - RNA, 22 nt, Human
cugugcccaggccccuggggau

SEQ ID NO: 325731 - RNA, 22 nt, Human
agagcuggggcccguaaagcca

SEQ ID NO: 325732 - RNA, 22 nt, Human
uagcuggggcuuucauucuugc

SEQ ID NO: 325733 - RNA, 22 nt, Human
gcugauagacugaauguuggga

SEQ ID NO: 325734 - RNA, 22 nt, Human
agagcuggggcauaaaugccac

SEQ ID NO: 325735 - RNA, 22 nt, Human
cccuguggcaggaggaggagca

SEQ ID NO: 325736 - RNA, 23 nt, Human
aauuuaguuugagacauuagccu

SEQ ID NO: 325737 - RNA, 22 nt, Human
ggcaccagggcaagggucuuuc

SEQ ID NO: 325738 - RNA, 22 nt, Human
uaggacauguguuuuauauaug

SEQ ID NO: 325739 - RNA, 22 nt, Human
ugcuggggcagaagagccaaga

SEQ ID NO: 325740 - RNA, 22 nt, Human
agcugggguugcacacauuuug

SEQ ID NO: 325741 - RNA, 22 nt, Human
gcaggagcugcucuccugacga

SEQ ID NO: 325742 - RNA, 22 nt, Human
gcugccucaggcaccuccuggc

SEQ ID NO: 325743 - RNA, 22 nt, Human
caggcucagcaggagccugacc

SEQ ID NO: 325744 - RNA, 22 nt, Human
ccaggccccagggcuggcuuuc

SEQ ID NO: 325745 - RNA, 22 nt, Human
aaauauguauggaguucaugaa

SEQ ID NO: 325746 - RNA, 22 nt, Human
aaaauaguuaacguucagagua

SEQ ID NO: 325747 - RNA, 22 nt, Human
gauguuuuaggucccuguagcu

SEQ ID NO: 325748 - RNA, 22 nt, Human
uccacuggcccaccuccucagu

SEQ ID NO: 325749 - RNA, 21 nt, Human
ggagcuggggagcuggcccca

SEQ ID NO: 325750 - RNA, 22 nt, Human
ugggcaccuagcaacccuucuc

SEQ ID NO: 325751 - RNA, 22 nt, Human
gaugcuggaagugcugaucuug

SEQ ID NO: 325752 - RNA, 22 nt, Human
aacuaaaucuggcauuuagagc

SEQ ID NO: 325753 - RNA, 22 nt, Human
gagcugggauuugaaccuggga

SEQ ID NO: 325754 - RNA, 22 nt, Human
gagcuggggcagcuuaggagug

SEQ ID NO: 325755 - RNA, 22 nt, Human
ccaggcccugccugugguuccu

SEQ ID NO: 325756 - RNA, 22 nt, Human
ccuguggagcuuucagcagcuc

SEQ ID NO: 325757 - RNA, 22 nt, Human
agcuccugcaccaggggccccu

SEQ ID NO: 325758 - RNA, 22 nt, Human
agcccugucucucacuccaggu

SEQ ID NO: 325759 - RNA, 22 nt, Human
cucagccugugaagagcagagg

SEQ ID NO: 325760 - RNA, 22 nt, Human
gcccuugggagguuccacuggg

SEQ ID NO: 325761 - RNA, 20 nt, Human
uggcaccaggugguggcccc

SEQ ID NO: 325762 - RNA, 22 nt, Human
ccauggccaauugcaccuugcu

SEQ ID NO: 325763 - RNA, 22 nt, Human
acaacaaaaucacuagucuucc

SEQ ID NO: 325764 - RNA, 22 nt, Human
ccucucccgggugccgcugggc

SEQ ID NO: 325765 - RNA, 22 nt, Human
agagcugggugaagugccauca

SEQ ID NO: 325766 - RNA, 22 nt, Human
gcccugugcuuggauggcagau

SEQ ID NO: 325767 - RNA, 22 nt, Human
cugcaggagugaaagcaggccu

SEQ ID NO: 325768 - RNA, 21 nt, Human
agagcuggccugccaggcccu

SEQ ID NO: 325769 - RNA, 22 nt, Human
agagcuggagcagccccacugg

SEQ ID NO: 325770 - RNA, 17 nt, Human
uggcacagaggugcuau

SEQ ID NO: 325771 - RNA, 22 nt, Human
agcuggggguuggauaagggua

SEQ ID NO: 325772 - RNA, 22 nt, Human
cugucccucaucaccucugggu

SEQ ID NO: 325773 - RNA, 22 nt, Human
cccuggucagggaaggcgccug

SEQ ID NO: 325774 - RNA, 22 nt, Human
ccuggggagccgccugagcccc

SEQ ID NO: 325775 - RNA, 22 nt, Human
gcugggcucuuaucaccuguac

SEQ ID NO: 325776 - RNA, 22 nt, Human
gcccugugagucaugcggcaga

SEQ ID NO: 325777 - RNA, 22 nt, Human
cccacucccugcacgccugccg

SEQ ID NO: 325778 - RNA, 22 nt, Human
ucugcaggucacgcuccagccu

SEQ ID NO: 325779 - RNA, 22 nt, Human
ggcacagggggcugaggacuag

SEQ ID NO: 325780 - RNA, 21 nt, Human
ugggcaccaaaaccuaggagu

SEQ ID NO: 325781 - RNA, 22 nt, Human
uagcuggguugaggucaucuac

SEQ ID NO: 325782 - RNA, 19 nt, Human
ggcagagcuccugcuuucu

SEQ ID NO: 325783 - RNA, 21 nt, Human
ggugacacguggccccgcucu

SEQ ID NO: 325784 - RNA, 22 nt, Human
uccugaggagaagagugcuagg

SEQ ID NO: 325785 - RNA, 22 nt, Human
cccugugggaacuccugaguug

SEQ ID NO: 325786 - RNA, 22 nt, Human
uccugaggcacaauccuagaau

SEQ ID NO: 325787 - RNA, 22 nt, Human
ccugcagggugcugccacagau

SEQ ID NO: 325788 - RNA, 22 nt, Human
agagcuggguggacuuguaguu

SEQ ID NO: 325789 - RNA, 22 nt, Human
uccugcaguuacaucccagcca

SEQ ID NO: 325790 - RNA, 22 nt, Human
ugcugaggcccaggagcacuuu

SEQ ID NO: 325791 - RNA, 21 nt, Human
caggccccaggccuggggugc

SEQ ID NO: 325792 - RNA, 22 nt, Human
agaggacacaucuuuccucaaa

SEQ ID NO: 325793 - RNA, 22 nt, Human
gcagcaggcuuuucauaccuug

SEQ ID NO: 325794 - RNA, 22 nt, Human
gcugggaggaucucucccuguc

SEQ ID NO: 325795 - RNA, 22 nt, Human
cugggauccacgggcucccaag

SEQ ID NO: 325796 - RNA, 22 nt, Human
agguggcagagugacaggcuga

SEQ ID NO: 325797 - RNA, 22 nt, Human
uuucagaucauuuuuuaaguac

SEQ ID NO: 325798 - RNA, 20 nt, Human
agcccuguuuccuggagaga

SEQ ID NO: 325799 - RNA, 19 nt, Human
auccuggguccuccagcug

SEQ ID NO: 325800 - RNA, 22 nt, Human
cugggcucaguggcucauggcu

SEQ ID NO: 325801 - RNA, 22 nt, Human
auauaucaugaguaaaacuuga

SEQ ID NO: 325802 - RNA, 22 nt, Human
agagcugguuuacucaggaauu

SEQ ID NO: 325803 - RNA, 22 nt, Human
gucugggguacuuucaucugau

SEQ ID NO: 325804 - RNA, 22 nt, Human
caugagauaauuuuucuccagu

SEQ ID NO: 325805 - RNA, 22 nt, Human
ugcuggggcucugaccacucca

SEQ ID NO: 325806 - RNA, 22 nt, Human
gagcugggaggacugggaacuu

SEQ ID NO: 325807 - RNA, 22 nt, Human
gcuuggggagcucaguguccuu

SEQ ID NO: 325808 - RNA, 22 nt, Human
uccugcagagacagaggccuca

SEQ ID NO: 325809 - RNA, 22 nt, Human
gagggcacgaaacaaccacuuc

SEQ ID NO: 325810 - RNA, 22 nt, Human
ggcaccaggaucagucugucau

SEQ ID NO: 325811 - RNA, 22 nt, Human
gcaugcugcaccagagccucuc

SEQ ID NO: 325812 - RNA, 22 nt, Human
gcagagcuucuguccuucagga

SEQ ID NO: 325813 - RNA, 22 nt, Human
gcccugugcucaugggaacauc

SEQ ID NO: 325814 - RNA, 22 nt, Human
ggagcuggagagcuagccuagg

SEQ ID NO: 325815 - RNA, 22 nt, Human
cugcagaguggagccucggcug

SEQ ID NO: 325816 - RNA, 22 nt, Human
ucugggguuuucacgcugucuc

SEQ ID NO: 325817 - RNA, 22 nt, Human
cugcaggggcaguccacuuccu

SEQ ID NO: 325818 - RNA, 19 nt, Human
ccuggcccugcugcgcggg

SEQ ID NO: 325819 - RNA, 22 nt, Human
uccugcagaccucagucagguc

SEQ ID NO: 325820 - RNA, 22 nt, Human
gagcugggauucaucuaugucu

SEQ ID NO: 325821 - RNA, 23 nt, Human
ccagcccuccaccagcucuaggc

SEQ ID NO: 325822 - RNA, 22 nt, Human
ccuggguacccuuggcggccuu

SEQ ID NO: 325823 - RNA, 22 nt, Human
agagcuggaaucagaccucagg

SEQ ID NO: 325824 - RNA, 22 nt, Human
ucaaaguauuuuaacuguaucc

SEQ ID NO: 325825 - RNA, 22 nt, Human
gcccuuggaacagccuccugcu

SEQ ID NO: 325826 - RNA, 16 nt, Human
ggcaccagugaacaca

SEQ ID NO: 325827 - RNA, 20 nt, Human
aggcuccuguaccugaggaa

SEQ ID NO: 325828 - RNA, 20 nt, Human
acuuuacugagcuguaauuc

SEQ ID NO: 325829 - RNA, 18 nt, Human
gagcugggagaaggaagg

SEQ ID NO: 325830 - RNA, 17 nt, Human
auguauauuaacucuga

SEQ ID NO: 325831 - RNA, 20 nt, Human
ugcagagcugacauuaccug

SEQ ID NO: 325832 - RNA, 22 nt, Human
ggaggccaccugaccugcuguu

SEQ ID NO: 325833 - RNA, 22 nt, Human
ggcaucccuagaauagccaggu

SEQ ID NO: 325834 - RNA, 22 nt, Human
gaccaggcuuccccagaccuca

SEQ ID NO: 325835 - RNA, 22 nt, Human
agagcuggggcucuggguuuaa

SEQ ID NO: 325836 - RNA, 22 nt, Human
ccuggggagagaaagcccagcc

SEQ ID NO: 325837 - RNA, 22 nt, Human
gcuuccuggagggagagagcug

SEQ ID NO: 325838 - RNA, 22 nt, Human
agagcuggaagcugcucuuaga

SEQ ID NO: 325839 - RNA, 18 nt, Human
ggagcugggccccacucc

SEQ ID NO: 325840 - RNA, 22 nt, Human
cccugguguccacuggaggaag

SEQ ID NO: 325841 - RNA, 22 nt, Human
agagcugggaccgucuggaagu

SEQ ID NO: 325842 - RNA, 22 nt, Human
ggcauccugggacuggcuucuu

SEQ ID NO: 325843 - RNA, 22 nt, Human
cugggcuagaaggaccaggaug

SEQ ID NO: 325844 - RNA, 21 nt, Human
ggcaucccaggccagugacug

SEQ ID NO: 325845 - RNA, 22 nt, Human
cagggagcuggugccagccgac

SEQ ID NO: 325846 - RNA, 22 nt, Human
uuucagaugguauauacaguag

SEQ ID NO: 325847 - RNA, 22 nt, Human
ggagcugggaacuauguaguau

SEQ ID NO: 325848 - RNA, 22 nt, Human
ccagggagcggggcugggucuc

SEQ ID NO: 325849 - RNA, 22 nt, Human
cagaugcuauguauuauguaug

SEQ ID NO: 325850 - RNA, 22 nt, Human
gagguggcgcgccaucccugcc

SEQ ID NO: 325851 - RNA, 22 nt, Human
ccugcagggaaucgaggcagaa

SEQ ID NO: 325852 - RNA, 22 nt, Human
cacuguaauagcauuauaagug

SEQ ID NO: 325853 - RNA, 22 nt, Human
agagcuggcagcagcuucuccu

SEQ ID NO: 325854 - RNA, 20 nt, Human
cugggcucgguggcccuggc

SEQ ID NO: 325855 - RNA, 22 nt, Human
ggcaccagggacaauccucuuc

SEQ ID NO: 325856 - RNA, 22 nt, Human
cagggagcucugggccggacuc

SEQ ID NO: 325857 - RNA, 22 nt, Human
auaugaaaagaagucaccauug

SEQ ID NO: 325858 - RNA, 22 nt, Human
agaggaggccaggcccacaccu

SEQ ID NO: 325859 - RNA, 22 nt, Human
ggcagagccuucuggagcucgc

SEQ ID NO: 325860 - RNA, 22 nt, Human
ggcaccagcacuugggauggcu

SEQ ID NO: 325861 - RNA, 22 nt, Human
ggagcuggucagccuugagcau

SEQ ID NO: 325862 - RNA, 22 nt, Human
ccagcccucgguagucccauag

SEQ ID NO: 325863 - RNA, 22 nt, Human
gagcuccucccaggguagcacu

SEQ ID NO: 325864 - RNA, 22 nt, Human
gccccuggcuggccagcuccuc

SEQ ID NO: 325865 - RNA, 22 nt, Human
cugggcucagaugagaggaagg

SEQ ID NO: 325866 - RNA, 22 nt, Human
acauuucaguaaguguuaauuu

SEQ ID NO: 325867 - RNA, 22 nt, Human
auauaacauacauacagaaaag

SEQ ID NO: 325868 - RNA, 22 nt, Human
aaaaugauauccugacuuuuau

SEQ ID NO: 325869 - RNA, 20 nt, Human
ugcuggggacauacagggug

SEQ ID NO: 325870 - RNA, 22 nt, Human
ugggcaccugaggccuggcagg

SEQ ID NO: 325871 - RNA, 23 nt, Human
gagcugggauacaggcuuacugc

SEQ ID NO: 325872 - RNA, 22 nt, Human
gagggcacaaaggcaacauuca

SEQ ID NO: 325873 - RNA, 20 nt, Human
ccuguggagcugccuccucc

SEQ ID NO: 325874 - RNA, 22 nt, Human
cccugccugugggcaucaacau

SEQ ID NO: 325875 - RNA, 22 nt, Human
cccagcccacgguccugggugg

SEQ ID NO: 325876 - RNA, 22 nt, Human
cccucagcuccacccucagcag

SEQ ID NO: 325877 - RNA, 22 nt, Human
cuccaggauguuagacguccag

SEQ ID NO: 325878 - RNA, 22 nt, Human
agcuggggguagugagaaauaa

SEQ ID NO: 325879 - RNA, 22 nt, Human
aagaaaacaugaucuaauuuaa

SEQ ID NO: 325880 - RNA, 22 nt, Human
uccuguggcucuguggaaccuu

SEQ ID NO: 325881 - RNA, 19 nt, Human
gcugggagcagacccuccc

SEQ ID NO: 325882 - RNA, 22 nt, Human
cagccccuuccuggcaucugga

SEQ ID NO: 325883 - RNA, 22 nt, Human
cucucugaggaaggagcaucug

SEQ ID NO: 325884 - RNA, 22 nt, Human
agccugggcccugccucuucuc

SEQ ID NO: 325885 - RNA, 20 nt, Human
agggcagcuugaggagccgg

SEQ ID NO: 325886 - RNA, 22 nt, Human
gcagagcugggauaugaaccca

SEQ ID NO: 325887 - RNA, 22 nt, Human
ugggcuccggcggccucaggcu

SEQ ID NO: 325888 - RNA, 22 nt, Human
agagcuggcacugacccucacc

SEQ ID NO: 325889 - RNA, 21 nt, Human
gcaaaugaguuaacuaacuca

SEQ ID NO: 325890 - RNA, 22 nt, Human
uaaauguauaggcacuaaaccu

SEQ ID NO: 325891 - RNA, 20 nt, Human
aagcuggguaggagaggagc

SEQ ID NO: 325892 - RNA, 22 nt, Human
augcugggaaguccuaaccaca

SEQ ID NO: 325893 - RNA, 22 nt, Human
gagcugggagcugggauuugga

SEQ ID NO: 325894 - RNA, 22 nt, Human
ccaggcccuugcaagucccacc

SEQ ID NO: 325895 - RNA, 22 nt, Human
cugcaggacgaccgccucaucu

SEQ ID NO: 325896 - RNA, 22 nt, Human
ugagcuggggucagcuccccug

SEQ ID NO: 325897 - RNA, 22 nt, Human
uccugcagccauuagaggucaa

SEQ ID NO: 325898 - RNA, 22 nt, Human
aggcccuggguuagggcccacu

SEQ ID NO: 325899 - RNA, 22 nt, Human
cccgucccuuuugcccgcuggu

SEQ ID NO: 325900 - RNA, 22 nt, Human
cccugugguugcuagggcacag

SEQ ID NO: 325901 - RNA, 22 nt, Human
gagggcacucgagacuacggca

SEQ ID NO: 325902 - RNA, 22 nt, Human
cugggcuccuaaccauccaggu

SEQ ID NO: 325903 - RNA, 22 nt, Human
agcccugugggccuuguggcac

SEQ ID NO: 325904 - RNA, 22 nt, Human
augccuggucccaccucuaggu

SEQ ID NO: 325905 - RNA, 22 nt, Human
gagcugggucuccaccuuggca

SEQ ID NO: 325906 - RNA, 22 nt, Human
aagcugggagggagcccagagu

SEQ ID NO: 325907 - RNA, 22 nt, Human
ccuggugaauguucauggacug

SEQ ID NO: 325908 - RNA, 22 nt, Human
ccugguggccuucagcccacaa

SEQ ID NO: 325909 - RNA, 22 nt, Human
agaagucauuuauguuagauga

SEQ ID NO: 325910 - RNA, 22 nt, Human
cagagcuggagggaacccuggc

SEQ ID NO: 325911 - RNA, 22 nt, Human
gcaggagcucguuuccaggcug

SEQ ID NO: 325912 - RNA, 20 nt, Human
uuucagauuuacagaaaugu

SEQ ID NO: 325913 - RNA, 22 nt, Human
agcaauaacagaaaacuuuccu

SEQ ID NO: 325914 - RNA, 22 nt, Human
gcagagcugcagcgaggccugg

SEQ ID NO: 325915 - RNA, 22 nt, Human
gcagagcuccccaagacaccaa

SEQ ID NO: 325916 - RNA, 22 nt, Human
uccugguggugccggugcccgg

SEQ ID NO: 325917 - RNA, 22 nt, Human
gagcugggacauggguccucuc

SEQ ID NO: 325918 - RNA, 22 nt, Human
ccuguccagggacugagggaga

SEQ ID NO: 325919 - RNA, 22 nt, Human
ugcaggagcaccagcucacccu

SEQ ID NO: 325920 - RNA, 22 nt, Human
cugguggagaugccuggccccu

SEQ ID NO: 325921 - RNA, 22 nt, Human
agagcuggaaaaguuguuuuaa

SEQ ID NO: 325922 - RNA, 22 nt, Human
cugggcucaaauccuggcccug

SEQ ID NO: 325923 - RNA, 22 nt, Human
ccugcaggcugcaggccaguuc

SEQ ID NO: 325924 - RNA, 22 nt, Human
gggcccugugauuucuugagga

SEQ ID NO: 325925 - RNA, 22 nt, Human
cugucccucaguucugggcaaa

SEQ ID NO: 325926 - RNA, 22 nt, Human
ccuggagcuuggucacgcugcg

SEQ ID NO: 325927 - RNA, 18 nt, Human
auccaaaaagauggaagu

SEQ ID NO: 325928 - RNA, 22 nt, Human
cacagcugaaguagccaugugg

SEQ ID NO: 325929 - RNA, 22 nt, Human
augcugggacguacuuguucau

SEQ ID NO: 325930 - RNA, 20 nt, Human
ucccugccuuuuacugcugg

SEQ ID NO: 325931 - RNA, 22 nt, Human
guaucacuuuugagagugagaa

SEQ ID NO: 325932 - RNA, 22 nt, Human
aaaaguauuuuggaucucagau

SEQ ID NO: 325933 - RNA, 22 nt, Human
caccaggcugcccaggacaggg

SEQ ID NO: 325934 - RNA, 22 nt, Human
acaaacuuccaucaugaauuuu

SEQ ID NO: 325935 - RNA, 22 nt, Human
ccugcuggccacugcuccaccu

SEQ ID NO: 325936 - RNA, 17 nt, Human
ggcaccagacggagagu

SEQ ID NO: 325937 - RNA, 22 nt, Human
ccugggcagggagaccaggcuc

SEQ ID NO: 325938 - RNA, 22 nt, Human
ccucagccuuggccccaggcag

SEQ ID NO: 325939 - RNA, 22 nt, Human
ccugucaggguuugccucagaa

SEQ ID NO: 325940 - RNA, 22 nt, Human
cugucuccagggcaggugcagg

SEQ ID NO: 325941 - RNA, 22 nt, Human
cauaaucagauguguacauaag

SEQ ID NO: 325942 - RNA, 19 nt, Human
uguagcuagugucuaucca

SEQ ID NO: 325943 - RNA, 22 nt, Human
ugcugggcuggagcugccaggg

SEQ ID NO: 325944 - RNA, 22 nt, Human
ccugacagcgugucccuggccc

SEQ ID NO: 325945 - RNA, 22 nt, Human
agagcuggagaugcagguuucg

SEQ ID NO: 325946 - RNA, 22 nt, Human
ccuggagcacauggcaggaggc

SEQ ID NO: 325947 - RNA, 22 nt, Human
gcaccaggcagcugagcaggcc

SEQ ID NO: 325948 - RNA, 22 nt, Human
agaugguagguggcaggacuga

SEQ ID NO: 325949 - RNA, 22 nt, Human
ucccugucuaauaugccaugaa

SEQ ID NO: 325950 - RNA, 22 nt, Human
aacuaaaacugguuuguucucu

SEQ ID NO: 325951 - RNA, 22 nt, Human
cugggugagcuggccagagggu

SEQ ID NO: 325952 - RNA, 22 nt, Human
gcccagcccugaggucacagcu

SEQ ID NO: 325953 - RNA, 22 nt, Human
gcccauggcagaacugugagca

SEQ ID NO: 325954 - RNA, 22 nt, Human
caccaggcugaaccagagggga

SEQ ID NO: 325955 - RNA, 23 nt, Human
uggcaccaggcauucuaggggua

SEQ ID NO: 325956 - RNA, 22 nt, Human
uccugcagccacugcaggcaga

SEQ ID NO: 325957 - RNA, 22 nt, Human
aaugauugucauuccaaaaagu

SEQ ID NO: 325958 - RNA, 22 nt, Human
aucauccuagaaggaagcuagg

SEQ ID NO: 325959 - RNA, 22 nt, Human
gagcugggccucagaacacagu

SEQ ID NO: 325960 - RNA, 22 nt, Human
uagcugggucucuguuuucuca

SEQ ID NO: 325961 - RNA, 22 nt, Human
agcuggggcauuuauccacuaa

SEQ ID NO: 325962 - RNA, 22 nt, Human
ccagcccugaacccugcugcau

SEQ ID NO: 325963 - RNA, 22 nt, Human
ccugguggacagcagccagcag

SEQ ID NO: 325964 - RNA, 17 nt, Human
guccuggugugugagga

SEQ ID NO: 325965 - RNA, 22 nt, Human
agcccuguagauuuaggagagu

SEQ ID NO: 325966 - RNA, 22 nt, Human
gcugggcuucacagagccuuua

SEQ ID NO: 325967 - RNA, 22 nt, Human
agagcuggggccagagucaagg

SEQ ID NO: 325968 - RNA, 22 nt, Human
caccagguuccgggcagagcug

SEQ ID NO: 325969 - RNA, 21 nt, Human
agagcugggacuugccugaga

SEQ ID NO: 325970 - RNA, 22 nt, Human
gagcugggaguuauagcauguu

SEQ ID NO: 325971 - RNA, 22 nt, Human
aguaaaauuguauuggaaaaca

SEQ ID NO: 325972 - RNA, 22 nt, Human
ccuggggucagggacgcugugc

SEQ ID NO: 325973 - RNA, 22 nt, Human
aagcugggacuuagcgcagaua

SEQ ID NO: 325974 - RNA, 17 nt, Human
ccagggaggggccgcgc

SEQ ID NO: 325975 - RNA, 22 nt, Human
uucaguaugauuccuccaguag

SEQ ID NO: 325976 - RNA, 22 nt, Human
gacacuccagcuuuuggcucaa

SEQ ID NO: 325977 - RNA, 22 nt, Human
aaauaucauuuauaacuuuuaa

SEQ ID NO: 325978 - RNA, 22 nt, Human
ucccugaggaagggguguggug

SEQ ID NO: 325979 - RNA, 22 nt, Human
gcaccgagaaggaagcaugccu

SEQ ID NO: 325980 - RNA, 22 nt, Human
gcuggggagcuagaccucagca

SEQ ID NO: 325981 - RNA, 22 nt, Human
cugggguuggccagggcccuag

SEQ ID NO: 325982 - RNA, 22 nt, Human
auguaaacucacauuuucuuca

SEQ ID NO: 325983 - RNA, 22 nt, Human
aaacacaauguuucuuuguucu

SEQ ID NO: 325984 - RNA, 22 nt, Human
cagaugcuuggaggacacuugg

SEQ ID NO: 325985 - RNA, 22 nt, Human
ucucagccucaccucuauggag

SEQ ID NO: 325986 - RNA, 22 nt, Human
uguggcacuucucuccuuguaa

SEQ ID NO: 325987 - RNA, 22 nt, Human
caauacaauuaccaguuaauca

SEQ ID NO: 325988 - RNA, 20 nt, Human
ggcaccaggcuaggauugga

SEQ ID NO: 325989 - RNA, 22 nt, Human
uccugcaggccagaggggugag

SEQ ID NO: 325990 - RNA, 22 nt, Human
uuucagaucacuuucaggaaag

SEQ ID NO: 325991 - RNA, 22 nt, Human
cugggcucuaagggagcaccgu

SEQ ID NO: 325992 - RNA, 22 nt, Human
gcaccaggcuuagagccccagg

SEQ ID NO: 325993 - RNA, 22 nt, Human
gagcugggacuuggaauccaca

SEQ ID NO: 325994 - RNA, 22 nt, Human
ggcaccaggacaugacucccag

SEQ ID NO: 325995 - RNA, 23 nt, Human
uccugaggaauggcaucucacau

SEQ ID NO: 325996 - RNA, 22 nt, Human
gcagagcucaugccugcaccuc

SEQ ID NO: 325997 - RNA, 22 nt, Human
ggcaccagggaaggaaggcugg

SEQ ID NO: 325998 - RNA, 22 nt, Human
uccacuggaacaacucugaggc

SEQ ID NO: 325999 - RNA, 22 nt, Human
ccuggagcuuuuccauccugga

SEQ ID NO: 326000 - RNA, 22 nt, Human
uugucuaaugagcuccacuuca

SEQ ID NO: 326001 - RNA, 20 nt, Human
gcugggcuaccacuggcccu

SEQ ID NO: 326002 - RNA, 22 nt, Human
ggagcuggcagcgcaacccaga

SEQ ID NO: 326003 - RNA, 22 nt, Human
cagcuccugccugggcagcugu

SEQ ID NO: 326004 - RNA, 17 nt, Human
ggcagagcugacagggc

SEQ ID NO: 326005 - RNA, 21 nt, Human
gcagagcuggaaccaggaccc

SEQ ID NO: 326006 - RNA, 22 nt, Human
cuggugcacauucgcucucaua

SEQ ID NO: 326007 - RNA, 22 nt, Human
cccuguccuuggcugugaggcu

SEQ ID NO: 326008 - RNA, 22 nt, Human
ggcaucccuucuuccaguguca

SEQ ID NO: 326009 - RNA, 21 nt, Human
ccagccucagaucagggagcu

SEQ ID NO: 326010 - RNA, 22 nt, Human
uuuacugaacugcuaguacagg

SEQ ID NO: 326011 - RNA, 22 nt, Human
gcccaugguuacuuuucuggcu

SEQ ID NO: 326012 - RNA, 22 nt, Human
uucaaaugcaaguuacuacuuu

SEQ ID NO: 326013 - RNA, 17 nt, Human
agcccugugcucuuuuu

SEQ ID NO: 326014 - RNA, 19 nt, Human
cagccucaaucccucgggc

SEQ ID NO: 326015 - RNA, 22 nt, Human
agagcuggcugugggugacuuu

SEQ ID NO: 326016 - RNA, 22 nt, Human
cagcuccugcagcuggcuccca

SEQ ID NO: 326017 - RNA, 19 nt, Human
cagcccucuuaccacugug

SEQ ID NO: 326018 - RNA, 22 nt, Human
ggcaccaggcugggcauaggcc

SEQ ID NO: 326019 - RNA, 22 nt, Human
ggaggccaggaagagccgcccu

SEQ ID NO: 326020 - RNA, 20 nt, Human
agagcugggaagcucccuau

SEQ ID NO: 326021 - RNA, 22 nt, Human
uccugcaggggcugaggaacca

SEQ ID NO: 326022 - RNA, 23 nt, Human
agcuggaggcugucuacucccaa

SEQ ID NO: 326023 - RNA, 22 nt, Human
cugcagaggccucgccuccucu

SEQ ID NO: 326024 - RNA, 22 nt, Human
gagcuggguauauggcuuuaug

SEQ ID NO: 326025 - RNA, 22 nt, Human
uccugcagagccgcccucaggu

SEQ ID NO: 326026 - RNA, 22 nt, Human
uccuguggcguuaucaugugau

SEQ ID NO: 326027 - RNA, 22 nt, Human
gugcugggcuccaccccagagg

SEQ ID NO: 326028 - RNA, 22 nt, Human
ugcugggggugucucaccaggc

SEQ ID NO: 326029 - RNA, 22 nt, Human
cugggcuuguguuagcugacaa

SEQ ID NO: 326030 - RNA, 22 nt, Human
cagcccucaaaccacuuccagg

SEQ ID NO: 326031 - RNA, 23 nt, Human
ccugaagggucaggguccucagc

SEQ ID NO: 326032 - RNA, 22 nt, Human
aaauauguuuuccaguugucau

SEQ ID NO: 326033 - RNA, 16 nt, Human
gcagagcucagggacu

SEQ ID NO: 326034 - RNA, 22 nt, Human
cugucuccuccacugcauggga

SEQ ID NO: 326035 - RNA, 22 nt, Human
uaugauaugcacuuuaucagaa

SEQ ID NO: 326036 - RNA, 22 nt, Human
agagcugggacuuggacucaau

SEQ ID NO: 326037 - RNA, 21 nt, Human
agagcugguagguagguaggu

SEQ ID NO: 326038 - RNA, 22 nt, Human
uagucaaaccucagaauacccc

SEQ ID NO: 326039 - RNA, 22 nt, Human
ucagacaaguaaaauaauguaa

SEQ ID NO: 326040 - RNA, 22 nt, Human
gagggcacuggguuucaauguc

SEQ ID NO: 326041 - RNA, 22 nt, Human
ugaguuauaaugaauauuugaa

SEQ ID NO: 326042 - RNA, 18 nt, Human
ugcugggguagaauccac

SEQ ID NO: 326043 - RNA, 22 nt, Human
ccagccccuauccucgcuccac

SEQ ID NO: 326044 - RNA, 22 nt, Human
caaguaaagaaucacauuucuu

SEQ ID NO: 326045 - RNA, 22 nt, Human
aaguaaaauucaaucuucacug

SEQ ID NO: 326046 - RNA, 21 nt, Human
accaggccaggaggcuggcac

SEQ ID NO: 326047 - RNA, 22 nt, Human
ccuggggucacuugcagccgca

SEQ ID NO: 326048 - RNA, 22 nt, Human
gaggccuggaccagccacagag

SEQ ID NO: 326049 - RNA, 22 nt, Human
gugcaccccggggcccugcucc

SEQ ID NO: 326050 - RNA, 22 nt, Human
ggagcuggccgccuaugugcag

SEQ ID NO: 326051 - RNA, 22 nt, Human
cugggcucaagaagucuucccu

SEQ ID NO: 326052 - RNA, 22 nt, Human
gagcuggggcggauacucagcu

SEQ ID NO: 326053 - RNA, 22 nt, Human
uaggacaugcuacauaaauagg

SEQ ID NO: 326054 - RNA, 22 nt, Human
agcuccugcgcacggugcacac

SEQ ID NO: 326055 - RNA, 22 nt, Human
agcccuguuuaugccacaucau

SEQ ID NO: 326056 - RNA, 22 nt, Human
gagcuggguguuuauuugccaa

SEQ ID NO: 326057 - RNA, 22 nt, Human
ucaaaguagccggauggaauuu

SEQ ID NO: 326058 - RNA, 18 nt, Human
gcagagcugggauuccca

SEQ ID NO: 326059 - RNA, 18 nt, Human
aagcugggaaggagacag

SEQ ID NO: 326060 - RNA, 23 nt, Human
uccuggugacaugccugagcauc

SEQ ID NO: 326061 - RNA, 22 nt, Human
cugcagagcagccaguccccca

SEQ ID NO: 326062 - RNA, 22 nt, Human
acuuuacuccccaacauaaaug

SEQ ID NO: 326063 - RNA, 22 nt, Human
ccccugccagcuaucccugaac

SEQ ID NO: 326064 - RNA, 18 nt, Human
ucuggaacaacuucaugu

SEQ ID NO: 326065 - RNA, 22 nt, Human
ucccugagcucacauggcagga

SEQ ID NO: 326066 - RNA, 22 nt, Human
agagcuggacgucugagcccua

SEQ ID NO: 326067 - RNA, 22 nt, Human
ucccagccuuccagucugguuu

SEQ ID NO: 326068 - RNA, 22 nt, Human
ccugggaccucgcgggaagcgg

SEQ ID NO: 326069 - RNA, 20 nt, Human
cugggcucaagugauccucc

SEQ ID NO: 326070 - RNA, 22 nt, Human
uagcugggaauuaucugguugc

SEQ ID NO: 326071 - RNA, 22 nt, Human
uccugaggcuaaagugcagugg

SEQ ID NO: 326072 - RNA, 22 nt, Human
uauccaaaguuucucagaaacu

SEQ ID NO: 326073 - RNA, 22 nt, Human
agagcugggugguggugacuca

SEQ ID NO: 326074 - RNA, 22 nt, Human
cugucacccacccagccuguca

SEQ ID NO: 326075 - RNA, 22 nt, Human
uccuguggggaaaagccuaucu

SEQ ID NO: 326076 - RNA, 22 nt, Human
gagcugggcuggcuuccucccu

SEQ ID NO: 326077 - RNA, 22 nt, Human
uaguaacccacacaacaguaga

SEQ ID NO: 326078 - RNA, 19 nt, Human
agcuccuguucagcagcuc

SEQ ID NO: 326079 - RNA, 22 nt, Human
ggaggccacgguuuagcaccga

SEQ ID NO: 326080 - RNA, 19 nt, Human
cugcucccuccuucuggca

SEQ ID NO: 326081 - RNA, 22 nt, Human
ccugcagguugcagaggcggaa

SEQ ID NO: 326082 - RNA, 22 nt, Human
cccugccuuguuggagccuaug

SEQ ID NO: 326083 - RNA, 22 nt, Human
gauaauauuagaagauacaaau

SEQ ID NO: 326084 - RNA, 22 nt, Human
gucaaaugcacagaaccauuaa

SEQ ID NO: 326085 - RNA, 22 nt, Human
cccuguccugcuaggcccuggu

SEQ ID NO: 326086 - RNA, 22 nt, Human
cagagcuguccaaacccugaca

SEQ ID NO: 326087 - RNA, 22 nt, Human
agcuccugugugaagccucccu

SEQ ID NO: 326088 - RNA, 20 nt, Human
agcuccugguauaggugccu

SEQ ID NO: 326089 - RNA, 22 nt, Human
ccugggcuuucggcggcuuccu

SEQ ID NO: 326090 - RNA, 22 nt, Human
uccugagggcucggggcucaug

SEQ ID NO: 326091 - RNA, 22 nt, Human
cccuguggaggcagcauccugc

SEQ ID NO: 326092 - RNA, 22 nt, Human
uucuagauugccuguaaguaaa

SEQ ID NO: 326093 - RNA, 22 nt, Human
augcugggagugaagccccugg

SEQ ID NO: 326094 - RNA, 22 nt, Human
agacuuuaaugugcaaaugaaa

SEQ ID NO: 326095 - RNA, 21 nt, Human
gagcugggcgaggcuccgggg

SEQ ID NO: 326096 - RNA, 22 nt, Human
uggcaccaggcgggguggcugu

SEQ ID NO: 326097 - RNA, 22 nt, Human
gagcugggcacacgccacuuga

SEQ ID NO: 326098 - RNA, 22 nt, Human
ggcagagcugcaugagcacuca

SEQ ID NO: 326099 - RNA, 20 nt, Human
ggcagagcuaugucuguugc

SEQ ID NO: 326100 - RNA, 22 nt, Human
caccaggcuggagugcagaggu

SEQ ID NO: 326101 - RNA, 22 nt, Human
uuccugguaaauuauguccagg

SEQ ID NO: 326102 - RNA, 22 nt, Human
gcugggcuugguuucccugcuu

SEQ ID NO: 326103 - RNA, 22 nt, Human
aacugguaucucuucaguguaa

SEQ ID NO: 326104 - RNA, 22 nt, Human
gagcugggaagauagcuugagc

SEQ ID NO: 326105 - RNA, 22 nt, Human
cagcccacugccucugugguag

SEQ ID NO: 326106 - RNA, 22 nt, Human
cacagcugucagcugaccuagg

SEQ ID NO: 326107 - RNA, 22 nt, Human
agguauuauuagcaucucuauu

SEQ ID NO: 326108 - RNA, 22 nt, Human
ccugcagguuucccccggacgg

SEQ ID NO: 326109 - RNA, 22 nt, Human
gcccuguguguuugcacugauu

SEQ ID NO: 326110 - RNA, 22 nt, Human
auaaaugauucagcaggaaaua

SEQ ID NO: 326111 - RNA, 22 nt, Human
cccugccccaggcggcuucacu

SEQ ID NO: 326112 - RNA, 22 nt, Human
ccugcagguccccggaugcgca

SEQ ID NO: 326113 - RNA, 22 nt, Human
cccagcccagcguucgaggggu

SEQ ID NO: 326114 - RNA, 19 nt, Human
agcuggggcgguguguguu

SEQ ID NO: 326115 - RNA, 22 nt, Human
gggcuccuccucugacuguggc

SEQ ID NO: 326116 - RNA, 22 nt, Human
ccacucccuuccgguccagggc

SEQ ID NO: 326117 - RNA, 19 nt, Human
gggcuccuugggccucucu

SEQ ID NO: 326118 - RNA, 22 nt, Human
agagcuggcugcugcggugcuu

SEQ ID NO: 326119 - RNA, 22 nt, Human
agagcuggcugguagcccugau

SEQ ID NO: 326120 - RNA, 22 nt, Human
cccugcagccuugcaugccuuc

SEQ ID NO: 326121 - RNA, 22 nt, Human
cccuguccuggaugggagcacu

SEQ ID NO: 326122 - RNA, 22 nt, Human
ugcagagcuucauugcauaggc

SEQ ID NO: 326123 - RNA, 22 nt, Human
agagcuggccagggaucacucu

SEQ ID NO: 326124 - RNA, 22 nt, Human
gcugggcucuuuaccccuguac

SEQ ID NO: 326125 - RNA, 22 nt, Human
caccaggcacauaguaggcacu

SEQ ID NO: 326126 - RNA, 22 nt, Human
uuaugguaauuaaaacauguau

SEQ ID NO: 326127 - RNA, 22 nt, Human
agagcuggauggucaagauggc

SEQ ID NO: 326128 - RNA, 22 nt, Human
uauaaaugccaggacuuuagau

SEQ ID NO: 326129 - RNA, 22 nt, Human
ccuggcagcaggugggcccgug

SEQ ID NO: 326130 - RNA, 22 nt, Human
agcuggggcugcagagaacagg

SEQ ID NO: 326131 - RNA, 22 nt, Human
ugguauucuuucuguagaucau

SEQ ID NO: 326132 - RNA, 22 nt, Human
ggcaccagcaggcaccgaugcc

SEQ ID NO: 326133 - RNA, 22 nt, Human
agcuccugucucaagggagccu

SEQ ID NO: 326134 - RNA, 22 nt, Human
cccugugggguccgccuguccg

SEQ ID NO: 326135 - RNA, 22 nt, Human
ugaucaaaacauuacuccacca

SEQ ID NO: 326136 - RNA, 22 nt, Human
gggccccugggaauucugugau

SEQ ID NO: 326137 - RNA, 19 nt, Human
uccagccccucugugugug

SEQ ID NO: 326138 - RNA, 18 nt, Human
agcuggggccucuggucc

SEQ ID NO: 326139 - RNA, 22 nt, Human
gugcauccacuagggcucuccc

SEQ ID NO: 326140 - RNA, 22 nt, Human
ccuggagcaaaaaucuaaggag

SEQ ID NO: 326141 - RNA, 22 nt, Human
ccagccucaucgccugccuguc

SEQ ID NO: 326142 - RNA, 22 nt, Human
auggaggaugugcagcaugggc

SEQ ID NO: 326143 - RNA, 20 nt, Human
caauaauuuacuucccuauu

SEQ ID NO: 326144 - RNA, 22 nt, Human
gcuucugcagagccguccugag

SEQ ID NO: 326145 - RNA, 22 nt, Human
gggagaguagcuggaagguucu

SEQ ID NO: 326146 - RNA, 22 nt, Human
cugagcaucauggcagaaucuu

SEQ ID NO: 326147 - RNA, 22 nt, Human
cuggaaggagcccgggcggauc

SEQ ID NO: 326148 - RNA, 22 nt, Human
gcucguacaccagcguggaggu

SEQ ID NO: 326149 - RNA, 19 nt, Human
aucaggcuucuauuuucuc

SEQ ID NO: 326150 - RNA, 22 nt, Human
ucaucuguuaugggaguuuuug

SEQ ID NO: 326151 - RNA, 23 nt, Human
acacauguuuaugcuugggggca

SEQ ID NO: 326152 - RNA, 19 nt, Human
ucuuucauuucuagcucug

SEQ ID NO: 326153 - RNA, 22 nt, Human
agcauggcuuuggaggauagca

SEQ ID NO: 326154 - RNA, 22 nt, Human
cgugaugcucaggaggucauag

SEQ ID NO: 326155 - RNA, 23 nt, Human
auaauaacgucugucuugucucu

SEQ ID NO: 326156 - RNA, 22 nt, Human
uuccuggcagaggccccgacag

SEQ ID NO: 326157 - RNA, 22 nt, Human
auuuccuggaggaauggaagca

SEQ ID NO: 326158 - RNA, 22 nt, Human
guggcccaggcuuggcgcuggc

SEQ ID NO: 326159 - RNA, 22 nt, Human
gggcugagggguaucucauggg

SEQ ID NO: 326160 - RNA, 22 nt, Human
cugcauaucaaauuacuccugg

SEQ ID NO: 326161 - RNA, 21 nt, Human
uuccuccucuggagaagaaga

SEQ ID NO: 326162 - RNA, 21 nt, Human
caggaacauucuuuacauuua

SEQ ID NO: 326163 - RNA, 22 nt, Human
gagagaagggggauaugagccu

SEQ ID NO: 326164 - RNA, 22 nt, Human
gagucacauacuauguaauaga

SEQ ID NO: 326165 - RNA, 22 nt, Human
gcuguauuuauaugaaggcaug

SEQ ID NO: 326166 - RNA, 22 nt, Human
acuggaaaguauucuuucacug

SEQ ID NO: 326167 - RNA, 22 nt, Human
cuguccauggcaaugaugcaga

SEQ ID NO: 326168 - RNA, 22 nt, Human
uggggugugcucagagcagggg

SEQ ID NO: 326169 - RNA, 22 nt, Human
cggcagcgguuggagguuguag

SEQ ID NO: 326170 - RNA, 22 nt, Human
acagacacaggcguggagucgc

SEQ ID NO: 326171 - RNA, 22 nt, Human
ugagcauuaccugaggccacug

SEQ ID NO: 326172 - RNA, 22 nt, Human
cucagucucuugggcugugaag

SEQ ID NO: 326173 - RNA, 22 nt, Human
ccucugcccuuuuccuguauca

SEQ ID NO: 326174 - RNA, 22 nt, Human
ugggaagauaugagugaccaac

SEQ ID NO: 326175 - RNA, 22 nt, Human
cuccugcagcccucagcagcca

SEQ ID NO: 326176 - RNA, 22 nt, Human
uugggacaaagacuccuugaau

SEQ ID NO: 326177 - RNA, 22 nt, Human
gcugugaaagcugccacacugu

SEQ ID NO: 326178 - RNA, 22 nt, Human
cuucaguucuaaaguagaaugu

SEQ ID NO: 326179 - RNA, 22 nt, Human
ugagaagcauuaggaagaacau

SEQ ID NO: 326180 - RNA, 23 nt, Human
ggaagcucacguaguccugcacu

SEQ ID NO: 326181 - RNA, 22 nt, Human
auggaguugagcucuguugucc

SEQ ID NO: 326182 - RNA, 22 nt, Human
cccuggcucaggcagcuuuguu

SEQ ID NO: 326183 - RNA, 22 nt, Human
cagcuccccucuguggggcagu

SEQ ID NO: 326184 - RNA, 22 nt, Human
gccucugcacuguggcacacca

SEQ ID NO: 326185 - RNA, 22 nt, Human
uuuccaaagguggcaggaacaa

SEQ ID NO: 326186 - RNA, 22 nt, Human
ucagugauuucuggggugaggg

SEQ ID NO: 326187 - RNA, 22 nt, Human
uggcagcagggccccuggagga

SEQ ID NO: 326188 - RNA, 22 nt, Human
uuucuggcagcgggacaggggu

SEQ ID NO: 326189 - RNA, 22 nt, Human
guucacauccuugugaggauuu

SEQ ID NO: 326190 - RNA, 22 nt, Human
uaggaaugcagaugcauaauaa

SEQ ID NO: 326191 - RNA, 22 nt, Human
acagcagguuauuguuauggca

SEQ ID NO: 326192 - RNA, 22 nt, Human
ugacauuugagagagauauaca

SEQ ID NO: 326193 - RNA, 22 nt, Human
augaugaagcaugguuacacug

SEQ ID NO: 326194 - RNA, 22 nt, Human
auggccugcagugcugccacag

SEQ ID NO: 326195 - RNA, 22 nt, Human
uugcaaauaauagccugaaacu

SEQ ID NO: 326196 - RNA, 22 nt, Human
ccucuggccuaggccgggagag

SEQ ID NO: 326197 - RNA, 22 nt, Human
ccuguacuuguauuaaaggucc

SEQ ID NO: 326198 - RNA, 22 nt, Human
ugucuucuaccuugacagcauu

SEQ ID NO: 326199 - RNA, 22 nt, Human
agcauggccucccgggccuggc

SEQ ID NO: 326200 - RNA, 22 nt, Human
gugcugccuccauauccgucag

SEQ ID NO: 326201 - RNA, 22 nt, Human
guauuucuuuacauaugcucau

SEQ ID NO: 326202 - RNA, 22 nt, Human
cugugcuggcagaccuggaguu

SEQ ID NO: 326203 - RNA, 22 nt, Human
acccagcucuuugauggucuug

SEQ ID NO: 326204 - RNA, 20 nt, Human
uuuuccacuccucaaaacag

SEQ ID NO: 326205 - RNA, 22 nt, Human
uucucugguuugcuguuucuga

SEQ ID NO: 326206 - RNA, 22 nt, Human
uuugcacuuaaauuuacaacac

SEQ ID NO: 326207 - RNA, 22 nt, Human
auacacauguuauuguggaagc

SEQ ID NO: 326208 - RNA, 22 nt, Human
uggcugaggagagggcggaagu

SEQ ID NO: 326209 - RNA, 22 nt, Human
cagaugaaguaggugacgagca

SEQ ID NO: 326210 - RNA, 22 nt, Human
gaagaccccagagcgagguaag

SEQ ID NO: 326211 - RNA, 18 nt, Human
ugugccucugcaggacgu

SEQ ID NO: 326212 - RNA, 21 nt, Human
aaacugaccuugccugagaca

SEQ ID NO: 326213 - RNA, 22 nt, Human
uucaacaacuugguucaaaugg

SEQ ID NO: 326214 - RNA, 17 nt, Human
ucugccaguuuuagaau

SEQ ID NO: 326215 - RNA, 22 nt, Human
uggcucaggccuacgacgccuu

SEQ ID NO: 326216 - RNA, 22 nt, Human
uuuccagaaauaccauuuggug

SEQ ID NO: 326217 - RNA, 22 nt, Human
uaaaaguuagcuaggacaaagu

SEQ ID NO: 326218 - RNA, 22 nt, Human
gagcacugagcuggaauuggag

SEQ ID NO: 326219 - RNA, 22 nt, Human
ugucacagagcgugcaacagaa

SEQ ID NO: 326220 - RNA, 22 nt, Human
ucccuggcacaagaaggcuguc

SEQ ID NO: 326221 - RNA, 22 nt, Human
gcugauggcuugcuggcugaca

SEQ ID NO: 326222 - RNA, 22 nt, Human
cuccacagccccuccaguggca

SEQ ID NO: 326223 - RNA, 22 nt, Human
cauggaaggcaaaagacacaga

SEQ ID NO: 326224 - RNA, 22 nt, Human
gcagcccaggcucgcucacugc

SEQ ID NO: 326225 - RNA, 22 nt, Human
gaaguucugguguaugugauaa

SEQ ID NO: 326226 - RNA, 22 nt, Human
ggcuguggucauuaggagguug

SEQ ID NO: 326227 - RNA, 22 nt, Human
agugauguagguggauucuggc

SEQ ID NO: 326228 - RNA, 22 nt, Human
ugucuguccaucugucugggac

SEQ ID NO: 326229 - RNA, 22 nt, Human
gcagcugcgcugguguggggca

SEQ ID NO: 326230 - RNA, 22 nt, Human
gugcuggggagauaggaagaga

SEQ ID NO: 326231 - RNA, 22 nt, Human
ggagguggagcuggaaguucca

SEQ ID NO: 326232 - RNA, 22 nt, Human
ggaaugugcugacacgcgagag

SEQ ID NO: 326233 - RNA, 22 nt, Human
guugcagauguggaacucgugc

SEQ ID NO: 326234 - RNA, 20 nt, Human
gaccagaucccuuaccagcu

SEQ ID NO: 326235 - RNA, 22 nt, Human
gccuggaaugcaaugugacgaa

SEQ ID NO: 326236 - RNA, 22 nt, Human
uagaaaagccccagcuggaggg

SEQ ID NO: 326237 - RNA, 22 nt, Human
ucuuucagaaacuuugucugcg

SEQ ID NO: 326238 - RNA, 22 nt, Human
auggaguucugccagcgcugcu

SEQ ID NO: 326239 - RNA, 22 nt, Human
cugggauccacgggcucccaag

SEQ ID NO: 326240 - RNA, 18 nt, Human
uagcucuuguugguccau

SEQ ID NO: 326241 - RNA, 22 nt, Human
ucccagaacccugccagguccu

SEQ ID NO: 326242 - RNA, 22 nt, Human
aaucuucaggguccuggggcuc

SEQ ID NO: 326243 - RNA, 22 nt, Human
ccuugcagcauauagagucccu

SEQ ID NO: 326244 - RNA, 22 nt, Human
uugcaucagcaggcauaauugg

SEQ ID NO: 326245 - RNA, 22 nt, Human
uuuucaguuccaucucugcucu

SEQ ID NO: 326246 - RNA, 22 nt, Human
agcagugugggcugcacgcugg

SEQ ID NO: 326247 - RNA, 22 nt, Human
agcagcaggugaccucgaugcc

SEQ ID NO: 326248 - RNA, 22 nt, Human
gaggaggcuuccgggaggcacg

SEQ ID NO: 326249 - RNA, 21 nt, Human
gcuguucggcggcccucgcgc

SEQ ID NO: 326250 - RNA, 22 nt, Human
ggcagugaugucaaacagugaa

SEQ ID NO: 326251 - RNA, 19 nt, Human
cucugccucuggcuguggc

SEQ ID NO: 326252 - RNA, 22 nt, Human
gccucugcaccaguacugugcc

SEQ ID NO: 326253 - RNA, 22 nt, Human
ccgcuguccuggagcugcugcu

SEQ ID NO: 326254 - RNA, 20 nt, Human
cuugaguucagagcugucau

SEQ ID NO: 326255 - RNA, 22 nt, Human
ugaaagcucugucaucauuccu

SEQ ID NO: 326256 - RNA, 22 nt, Human
augaaacucuagcuuucagcac

SEQ ID NO: 326257 - RNA, 22 nt, Human
gaaacacucaauuuaguaauuc

SEQ ID NO: 326258 - RNA, 22 nt, Human
uaucacauacuucucauccagg

SEQ ID NO: 326259 - RNA, 22 nt, Human
uuucuaguggguauucccuguu

SEQ ID NO: 326260 - RNA, 22 nt, Human
aaagcagcagcacguggaagag

SEQ ID NO: 326261 - RNA, 20 nt, Human
gugcccaguuggugacagac

SEQ ID NO: 326262 - RNA, 22 nt, Human
ggcucuggcgagcuuuaguaca

SEQ ID NO: 326263 - RNA, 22 nt, Human
aauggcaaaguguuuucauacc

SEQ ID NO: 326264 - RNA, 22 nt, Human
ccaggugugcucugcaguggau

SEQ ID NO: 326265 - RNA, 22 nt, Human
agagaauuaacauuccauggcu

SEQ ID NO: 326266 - RNA, 22 nt, Human
uuuccucacacagaagaucuug

SEQ ID NO: 326267 - RNA, 22 nt, Human
cagaaacacuguauuuagggaa

SEQ ID NO: 326268 - RNA, 22 nt, Human
uuccagagaguuauuccccugg

SEQ ID NO: 326269 - RNA, 22 nt, Human
uggcugagugaacauguccauu

SEQ ID NO: 326270 - RNA, 22 nt, Human
gcugcuggcuuccugcuguuuu

SEQ ID NO: 326271 - RNA, 22 nt, Human
gccugcuggcuggaaauucucc

SEQ ID NO: 326272 - RNA, 22 nt, Human
gcacugguuuauuuaagaacaa

SEQ ID NO: 326273 - RNA, 22 nt, Human
cagaaagugauuugcuauucca

SEQ ID NO: 326274 - RNA, 22 nt, Human
agacacauuuucagcucugcca

SEQ ID NO: 326275 - RNA, 22 nt, Human
gcugcaagugcauguugcaacu

SEQ ID NO: 326276 - RNA, 22 nt, Human
gucccucugccugugguucucu

SEQ ID NO: 326277 - RNA, 22 nt, Human
gguggcaccuuacccugcgcag

SEQ ID NO: 326278 - RNA, 22 nt, Human
guggauggagcuggaagccauu

SEQ ID NO: 326279 - RNA, 22 nt, Human
guggcauuugggagaugcgugg

SEQ ID NO: 326280 - RNA, 22 nt, Human
uuguacuuaaauaugcaaauag

SEQ ID NO: 326281 - RNA, 20 nt, Human
uugaggagauauugaauacu

SEQ ID NO: 326282 - RNA, 19 nt, Human
ugguggaggugcaccugac

SEQ ID NO: 326283 - RNA, 22 nt, Human
ugcccauggcaggauuucugaa

SEQ ID NO: 326284 - RNA, 22 nt, Human
cuggccuggcaggggaccucua

SEQ ID NO: 326285 - RNA, 22 nt, Human
ugcauguuuuauaccaaagcuu

SEQ ID NO: 326286 - RNA, 22 nt, Human
gagcaacacauugaaugaggau

SEQ ID NO: 326287 - RNA, 22 nt, Human
ucagagaaguaggcuaauggug

SEQ ID NO: 326288 - RNA, 22 nt, Human
auugagaaaauucgagcaaguu

SEQ ID NO: 326289 - RNA, 22 nt, Human
uaggcagggauuaggguugauu

SEQ ID NO: 326290 - RNA, 21 nt, Human
cuagaaagaauguugucgucu

SEQ ID NO: 326291 - RNA, 22 nt, Human
gcuugcugaacaggaaccuggc

SEQ ID NO: 326292 - RNA, 23 nt, Human
cagcacaguacauuuccugucuc

SEQ ID NO: 326293 - RNA, 22 nt, Human
ugcuggccucggcgcugggccu

SEQ ID NO: 326294 - RNA, 22 nt, Human
ucugguuucccaguuccuccgu

SEQ ID NO: 326295 - RNA, 22 nt, Human
cuuugcuaauguugcauuuuca

SEQ ID NO: 326296 - RNA, 22 nt, Human
aaacuagguucugauuuccaag

SEQ ID NO: 326297 - RNA, 22 nt, Human
ugguggcacugacaucagacac

SEQ ID NO: 326298 - RNA, 22 nt, Human
cugacagcgagagaguugcccc

SEQ ID NO: 326299 - RNA, 22 nt, Human
ucaccucucuggccgucuaccu

SEQ ID NO: 326300 - RNA, 22 nt, Human
cagcaguguacaaggugucaga

SEQ ID NO: 326301 - RNA, 22 nt, Human
gcuguaacuuuuucauuuucaa

SEQ ID NO: 326302 - RNA, 22 nt, Human
agaagagccacuguugacggca

SEQ ID NO: 326303 - RNA, 21 nt, Human
uugauuuagcagaucuagcug

SEQ ID NO: 326304 - RNA, 21 nt, Human
ggcagcucagcagauggggac

SEQ ID NO: 326305 - RNA, 22 nt, Human
ucaggagaguguucaguggagg

SEQ ID NO: 326306 - RNA, 22 nt, Human
aggccagaacagcucugcacca

SEQ ID NO: 326307 - RNA, 22 nt, Human
uucuccagcucaucagggaggg

SEQ ID NO: 326308 - RNA, 22 nt, Human
guggcagagagcaagugucuga

SEQ ID NO: 326309 - RNA, 22 nt, Human
aggaauuugggguuacaugaug

SEQ ID NO: 326310 - RNA, 22 nt, Human
guggaaauuuuaggaucaucuu

SEQ ID NO: 326311 - RNA, 22 nt, Human
gcacuuguuuuauguuccugag

SEQ ID NO: 326312 - RNA, 22 nt, Human
ugaggaaugugacaaaaccaag

SEQ ID NO: 326313 - RNA, 22 nt, Human
ucauuguuucugcuuuucauga

SEQ ID NO: 326314 - RNA, 22 nt, Human
ucaagcggacugagauacucug

SEQ ID NO: 326315 - RNA, 22 nt, Human
uugagcugccuggcuguggcuc

SEQ ID NO: 326316 - RNA, 22 nt, Human
cugccaucugagccaaaagugc

SEQ ID NO: 326317 - RNA, 18 nt, Human
augggcagguaagaucca

SEQ ID NO: 326318 - RNA, 19 nt, Human
acaguuugggaaaugagca

SEQ ID NO: 326319 - RNA, 22 nt, Human
ugcuuucaaugaauuguauacu

SEQ ID NO: 326320 - RNA, 22 nt, Human
agucuggagugauuauguggga

SEQ ID NO: 326321 - RNA, 22 nt, Human
uuaccuuguaaaacauauuccu

SEQ ID NO: 326322 - RNA, 22 nt, Human
uggcucugccccauaccccugc

SEQ ID NO: 326323 - RNA, 22 nt, Human
aucaugcagcaacaagcaaggc

SEQ ID NO: 326324 - RNA, 20 nt, Human
uugcaaagugaauagcaauu

SEQ ID NO: 326325 - RNA, 22 nt, Human
caucagucugaaagccagggag

SEQ ID NO: 326326 - RNA, 22 nt, Human
augccccagugugugcuuccuu

SEQ ID NO: 326327 - RNA, 22 nt, Human
augauacaccuaggagugggag

SEQ ID NO: 326328 - RNA, 22 nt, Human
agaguguggaaauguucagagu

SEQ ID NO: 326329 - RNA, 22 nt, Human
cagagcugucauuugccaguga

SEQ ID NO: 326330 - RNA, 22 nt, Human
uggcagugugggaggaagguac

SEQ ID NO: 326331 - RNA, 23 nt, Human
agugaugucacccacagacaagg

SEQ ID NO: 326332 - RNA, 22 nt, Human
augcccagaacccccuggaugg

SEQ ID NO: 326333 - RNA, 20 nt, Human
ucuggggaugaggucuagga

SEQ ID NO: 326334 - RNA, 22 nt, Human
aauggcuguucucugugauugg

SEQ ID NO: 326335 - RNA, 22 nt, Human
uuugacucugggugcuuuuucg

SEQ ID NO: 326336 - RNA, 22 nt, Human
aaugaacacuuagccuuucuau

SEQ ID NO: 326337 - RNA, 22 nt, Human
aucuuuggguacaaacuugccu

SEQ ID NO: 326338 - RNA, 22 nt, Human
aacuagaaagaacauauuucca

SEQ ID NO: 326339 - RNA, 22 nt, Human
ggccuugggauguggcugcagc

SEQ ID NO: 326340 - RNA, 22 nt, Human
agcuccagggaaagaguggauc

SEQ ID NO: 326341 - RNA, 22 nt, Human
uuuaaacuaacaguacacguug

SEQ ID NO: 326342 - RNA, 22 nt, Human
ccuacucccuuucuagaguaug

SEQ ID NO: 326343 - RNA, 22 nt, Human
ccaugcccuugucaucuccagg

SEQ ID NO: 326344 - RNA, 22 nt, Human
gucuguccacuuggaagcuccc

SEQ ID NO: 326345 - RNA, 22 nt, Human
agcugcaccggcuggaccacug

SEQ ID NO: 326346 - RNA, 22 nt, Human
ccaucuucucuugaaccuccuu

SEQ ID NO: 326347 - RNA, 22 nt, Human
gugagguccucccugcugggag

SEQ ID NO: 326348 - RNA, 22 nt, Human
guuuuguucaugaacauugggu

SEQ ID NO: 326349 - RNA, 22 nt, Human
ggacugucuccuugcugguagg

SEQ ID NO: 326350 - RNA, 22 nt, Human
uuuccaaggaugugucucucua

SEQ ID NO: 326351 - RNA, 19 nt, Human
ugggcagugccagggcuua

SEQ ID NO: 326352 - RNA, 22 nt, Human
cauugcaacuucaaacuccugg

SEQ ID NO: 326353 - RNA, 18 nt, Human
auuugcaggcaugcaggc

SEQ ID NO: 326354 - RNA, 22 nt, Human
gugauuucagguuuuucauacu

SEQ ID NO: 326355 - RNA, 22 nt, Human
aucagagcugcauuuuagagcc

SEQ ID NO: 326356 - RNA, 22 nt, Human
ugugucuuuggcgaugucugga

SEQ ID NO: 326357 - RNA, 22 nt, Human
auguccaggaagucuuaacuca

SEQ ID NO: 326358 - RNA, 22 nt, Human
guggcgcagaggguggcagaga

SEQ ID NO: 326359 - RNA, 22 nt, Human
ucacuuuaccucauucaggcag

SEQ ID NO: 326360 - RNA, 22 nt, Human
agugcuuuauguuguugugcaa

SEQ ID NO: 326361 - RNA, 22 nt, Human
cuggcucgcauuauauuuuggg

SEQ ID NO: 326362 - RNA, 22 nt, Human
ucuguagcauucaccagcccug

SEQ ID NO: 326363 - RNA, 22 nt, Human
uuuccacacucacugcacucau

SEQ ID NO: 326364 - RNA, 22 nt, Human
gaugauuacacuuuuaaaacag

SEQ ID NO: 326365 - RNA, 22 nt, Human
ucugggugucacuccugccugc

SEQ ID NO: 326366 - RNA, 22 nt, Human
caugcaugccgggcugacagag

SEQ ID NO: 326367 - RNA, 22 nt, Human
cugggguuggccagggcccuag

SEQ ID NO: 326368 - RNA, 22 nt, Human
uccuggccaaguagauguggcg

SEQ ID NO: 326369 - RNA, 22 nt, Human
caucuugucuuuuugggccuga

SEQ ID NO: 326370 - RNA, 22 nt, Human
uauucacagcugccgcacucag

SEQ ID NO: 326371 - RNA, 22 nt, Human
ucccacugcuuugcucugcuca

SEQ ID NO: 326372 - RNA, 22 nt, Human
auguaagagcuuugcagggaaa

SEQ ID NO: 326373 - RNA, 18 nt, Human
ucugagggugcgggagcu

SEQ ID NO: 326374 - RNA, 22 nt, Human
cauguguauuauucuuguggaa

SEQ ID NO: 326375 - RNA, 22 nt, Human
uccuggcccuguggccugcagu

SEQ ID NO: 326376 - RNA, 22 nt, Human
aauugguuugaauaaauaaaga

SEQ ID NO: 326377 - RNA, 22 nt, Human
ucuguggcaugguaucuggagg

SEQ ID NO: 326378 - RNA, 22 nt, Human
cucucugggcccaguuggcacc

SEQ ID NO: 326379 - RNA, 22 nt, Human
ucagcacaggucuugcaaaaca

SEQ ID NO: 326380 - RNA, 20 nt, Human
uucacagaggacucagguca

SEQ ID NO: 326381 - RNA, 22 nt, Human
caaagccaggcuuucuaaugua

SEQ ID NO: 326382 - RNA, 22 nt, Human
ccugggacuuggucugggguuu

SEQ ID NO: 326383 - RNA, 18 nt, Human
gaacagcaauuucauguu

SEQ ID NO: 326384 - RNA, 22 nt, Human
aaaacuuucagggauacagaaa

SEQ ID NO: 326385 - RNA, 22 nt, Human
gagauuuccauauuuuguaaca

SEQ ID NO: 326386 - RNA, 21 nt, Human
uuccuggaggcagaaacguga

SEQ ID NO: 326387 - RNA, 22 nt, Human
gaugucuggcuaccacucgcac

SEQ ID NO: 326388 - RNA, 22 nt, Human
agucaagguggaccagaaaaau

SEQ ID NO: 326389 - RNA, 22 nt, Human
aagagcuggcucuugcagcagc

SEQ ID NO: 326390 - RNA, 22 nt, Human
acgugcuggagaagagcucgcc

SEQ ID NO: 326391 - RNA, 19 nt, Human
uccagaacugcccuggccu

SEQ ID NO: 326392 - RNA, 22 nt, Human
gugagagugguuuauguccaug

SEQ ID NO: 326393 - RNA, 22 nt, Human
cugguuuuuagugcuuaggagu

SEQ ID NO: 326394 - RNA, 21 nt, Human
gcucuguguuacaaguugggg

SEQ ID NO: 326395 - RNA, 19 nt, Human
cuucuggauccgcagggcc

SEQ ID NO: 326396 - RNA, 22 nt, Human
ccaggccuguguuguguggagg

SEQ ID NO: 326397 - RNA, 21 nt, Human
ggagucagggucuggcugggg

SEQ ID NO: 326398 - RNA, 22 nt, Human
agcagcaggagccgugggguga

SEQ ID NO: 326399 - RNA, 22 nt, Human
uaguggggaaggaggacaagaa

SEQ ID NO: 326400 - RNA, 20 nt, Human
ucucuggcaagaagcugcag

SEQ ID NO: 326401 - RNA, 22 nt, Human
gggaagugagcuggaaucaagg

SEQ ID NO: 326402 - RNA, 22 nt, Human
uaggauaugcauuuuuauacau

SEQ ID NO: 326403 - RNA, 22 nt, Human
agcuccacucccugccuguuuc

SEQ ID NO: 326404 - RNA, 22 nt, Human
uaaaguauaagcauuggaguau

SEQ ID NO: 326405 - RNA, 22 nt, Human
gcggagaggcagagacuccgcg

SEQ ID NO: 326406 - RNA, 22 nt, Human
uggccaggcagguagaacggcc

SEQ ID NO: 326407 - RNA, 22 nt, Human
uaccaaaaccaagccauuaucu

SEQ ID NO: 326408 - RNA, 22 nt, Human
uaauuucagugcaagcucacgg

SEQ ID NO: 326409 - RNA, 22 nt, Human
ucuccucuauuucuguauguau

SEQ ID NO: 326410 - RNA, 19 nt, Human
cacuguccuagucgaggcc

SEQ ID NO: 326411 - RNA, 22 nt, Human
caggaaugccaaccagugcaug

SEQ ID NO: 326412 - RNA, 22 nt, Human
caugucaagacugaagauccag

SEQ ID NO: 326413 - RNA, 22 nt, Human
ccagucagccaagcugcagcgg

SEQ ID NO: 326414 - RNA, 22 nt, Human
aguccagggcuuagucagcggg

SEQ ID NO: 326415 - RNA, 22 nt, Human
aaggugccacuucccucagacu

SEQ ID NO: 326416 - RNA, 22 nt, Human
gcugcccauugcucucccacuc

SEQ ID NO: 326417 - RNA, 22 nt, Human
aaugagaauguaagugaagaga

SEQ ID NO: 326418 - RNA, 22 nt, Human
ucuggcuucaacuuuacugaaa

SEQ ID NO: 326419 - RNA, 22 nt, Human
caggaacacaaugagucucaaa

SEQ ID NO: 326420 - RNA, 22 nt, Human
uauggcaagaugacauguucuc

SEQ ID NO: 326421 - RNA, 22 nt, Human
cugucuacagaugaaauaagca

SEQ ID NO: 326422 - RNA, 22 nt, Human
ugcaggaacucgaaaacuauag

SEQ ID NO: 326423 - RNA, 22 nt, Human
uuuauccaccuuacccuguucc

SEQ ID NO: 326424 - RNA, 22 nt, Human
cuggcagcugcccgagaugccc

SEQ ID NO: 326425 - RNA, 22 nt, Human
cauugcugugggcauuugcugc

SEQ ID NO: 326426 - RNA, 22 nt, Human
auggcauuugaaucugucuuuu

SEQ ID NO: 326427 - RNA, 22 nt, Human
caauaauugcuuuccagaguua

SEQ ID NO: 326428 - RNA, 22 nt, Human
ggcuggaaggcccuuuguugau

SEQ ID NO: 326429 - RNA, 22 nt, Human
uuuucaguugugcucucuaguu

SEQ ID NO: 326430 - RNA, 22 nt, Human
ucugcuggaaaaccagggaauu

SEQ ID NO: 326431 - RNA, 22 nt, Human
agcaauguuggccuauauaccu

SEQ ID NO: 326432 - RNA, 22 nt, Human
ugcagugaugcuucuggcucag

SEQ ID NO: 326433 - RNA, 22 nt, Human
ugucuuacagcaaucuguucug

SEQ ID NO: 326434 - RNA, 22 nt, Human
cgcaggugccggcagauggggu

SEQ ID NO: 326435 - RNA, 22 nt, Human
ccaggcuccccaggaggcccuu

SEQ ID NO: 326436 - RNA, 22 nt, Human
ucucugccacagcuucugccuu

SEQ ID NO: 326437 - RNA, 22 nt, Human
ggugcccaaggaagguugccgu

SEQ ID NO: 326438 - RNA, 22 nt, Human
aguggcaguagaugagcugguu

SEQ ID NO: 326439 - RNA, 22 nt, Human
cugguuuuccaauguuuugacu

SEQ ID NO: 326440 - RNA, 22 nt, Human
gagugugucggucagcguggcg

SEQ ID NO: 326441 - RNA, 20 nt, Human
aaaaacaguaaugcugaaga

SEQ ID NO: 326442 - RNA, 22 nt, Human
auauacacuguuucaguugaag

SEQ ID NO: 326443 - RNA, 22 nt, Human
gcuuccaaugcuucuaucacau

SEQ ID NO: 326444 - RNA, 22 nt, Human
ccugggcaaaugccagagacaa

SEQ ID NO: 326445 - RNA, 21 nt, Human
cugcacugugauuuaaaaugu

SEQ ID NO: 326446 - RNA, 22 nt, Human
ugucauuggugaucugaugccu

SEQ ID NO: 326447 - RNA, 22 nt, Human
uuggcugacaaauggaaucucu

SEQ ID NO: 326448 - RNA, 22 nt, Human
caagcuuguuucuccugggggu

SEQ ID NO: 326449 - RNA, 22 nt, Human
uugggauuacagguguaagcca

SEQ ID NO: 326450 - RNA, 22 nt, Human
gccuggcaaggcccuguugacu

SEQ ID NO: 326451 - RNA, 22 nt, Human
cagcugcucugguggucucucc

SEQ ID NO: 326452 - RNA, 19 nt, Human
ccauucugucucugccaca

SEQ ID NO: 326453 - RNA, 22 nt, Human
ugggaacuguacugccuugaac

SEQ ID NO: 326454 - RNA, 22 nt, Human
agcagcaccuguccucgcugcu

SEQ ID NO: 326455 - RNA, 22 nt, Human
ucaucaucauucucccccacuu

SEQ ID NO: 326456 - RNA, 22 nt, Human
cugcaucacagcaggaggcaca

SEQ ID NO: 326457 - RNA, 22 nt, Human
uggcacagcuugucauaaacuc

SEQ ID NO: 326458 - RNA, 22 nt, Human
acugggcaaggauaugaugggu

SEQ ID NO: 326459 - RNA, 22 nt, Human
guggccaucuuuggcccugacu

SEQ ID NO: 326460 - RNA, 22 nt, Human
cuccaggacugaggacagagcu

SEQ ID NO: 326461 - RNA, 22 nt, Human
cacacuguccccuucuccccag

SEQ ID NO: 326462 - RNA, 22 nt, Human
cugaaggauguguggugggagu

SEQ ID NO: 326463 - RNA, 22 nt, Human
aaacccugagacuuggggccag

SEQ ID NO: 326464 - RNA, 22 nt, Human
cuuugugauaguguuaagacca

SEQ ID NO: 326465 - RNA, 22 nt, Human
ugggcagacgggagcuugccuu

SEQ ID NO: 326466 - RNA, 22 nt, Human
uugaagcauuugcuauagcauu

SEQ ID NO: 326467 - RNA, 22 nt, Human
cugucuggaaugcaguacauag

SEQ ID NO: 326468 - RNA, 22 nt, Human
gcucugugggggaaauccuggg

SEQ ID NO: 326469 - RNA, 20 nt, Human
ugggaucgaaucaagucugu

SEQ ID NO: 326470 - RNA, 22 nt, Human
gcugugcagaggugagaaucca

SEQ ID NO: 326471 - RNA, 22 nt, Human
ccaggagaaugggauuacccua

SEQ ID NO: 326472 - RNA, 22 nt, Human
gggcuguuugcauauguuuaua

SEQ ID NO: 326473 - RNA, 22 nt, Human
uugaauaguuuuggauagcaua

SEQ ID NO: 326474 - RNA, 22 nt, Human
guugcauuaaucugcucaggcu

SEQ ID NO: 326475 - RNA, 22 nt, Human
uagaucuuucacuacuguguag

SEQ ID NO: 326476 - RNA, 22 nt, Human
cuggcagcucugagucccuucu

SEQ ID NO: 326477 - RNA, 22 nt, Human
ucuguccauucagaauggcccu

SEQ ID NO: 326478 - RNA, 22 nt, Human
aaauugcauuuuaaagguagau

SEQ ID NO: 326479 - RNA, 22 nt, Human
aucugucccuccucacagccuc

SEQ ID NO: 326480 - RNA, 22 nt, Human
ggcuagggaucuagaccaggac

SEQ ID NO: 326481 - RNA, 21 nt, Human
ucugaugguagaugagaugug

SEQ ID NO: 326482 - RNA, 19 nt, Human
ugguucuccuuccacaguc

SEQ ID NO: 326483 - RNA, 22 nt, Human
ggcacagcugaugcagacacac

SEQ ID NO: 326484 - RNA, 22 nt, Human
cugggagggguagccaauccua

SEQ ID NO: 326485 - RNA, 22 nt, Human
ucaccuguuggauguauacugu

SEQ ID NO: 326486 - RNA, 23 nt, Human
guccuagugcuuggugcccaggc

SEQ ID NO: 326487 - RNA, 22 nt, Human
cagugcugcaggcgccugcggu

SEQ ID NO: 326488 - RNA, 22 nt, Human
cuuccugcaacaccuguguugc

SEQ ID NO: 326489 - RNA, 22 nt, Human
cuccuucacgcaggcugccaug

SEQ ID NO: 326490 - RNA, 22 nt, Human
gagcugcuggccuccugcggga

SEQ ID NO: 326491 - RNA, 22 nt, Human
caucugcaggggaagccaguuu

SEQ ID NO: 326492 - RNA, 22 nt, Human
ucauccagccucaucaggagcu

SEQ ID NO: 326493 - RNA, 22 nt, Human
ggcuuuuguuucagcucugcua

SEQ ID NO: 326494 - RNA, 22 nt, Human
agagcuccaggguuuuguagug

SEQ ID NO: 326495 - RNA, 22 nt, Human
ccaggagcccugccacaauggu

SEQ ID NO: 326496 - RNA, 22 nt, Human
uacagcuugauguuuguguguu

SEQ ID NO: 326497 - RNA, 23 nt, Human
guguggccccagggccuccucgc

SEQ ID NO: 326498 - RNA, 22 nt, Human
uauaugcagauuuucaucaucg

SEQ ID NO: 326499 - RNA, 22 nt, Human
aaaucccacucacgaguuuugc

SEQ ID NO: 326500 - RNA, 22 nt, Human
agucaacauuugagaugcaaug

SEQ ID NO: 326501 - RNA, 22 nt, Human
uuucuucucacccaggacagag

SEQ ID NO: 326502 - RNA, 22 nt, Human
ggaccugcucucccaguucucu

SEQ ID NO: 326503 - RNA, 22 nt, Human
aggagcggauguguccugccag

SEQ ID NO: 326504 - RNA, 22 nt, Human
guucucugccggcaccuacccg

SEQ ID NO: 326505 - RNA, 22 nt, Human
uugggagaaauaguugauccgc

SEQ ID NO: 326506 - RNA, 22 nt, Human
gagaauacaaccagaagcugag

SEQ ID NO: 326507 - RNA, 20 nt, Human
gagcagugagccagggaaag

SEQ ID NO: 326508 - RNA, 22 nt, Human
caucaguuccugccccugcccc

SEQ ID NO: 326509 - RNA, 22 nt, Human
ugaugggaggugcugcaggacc

SEQ ID NO: 326510 - RNA, 22 nt, Human
agugaauuagccuauuuguaaa

SEQ ID NO: 326511 - RNA, 20 nt, Human
guggcagugguggcagcagu

SEQ ID NO: 326512 - RNA, 22 nt, Human
gaccaggagauuugagcuaggc

SEQ ID NO: 326513 - RNA, 22 nt, Human
uacaggcucuugucagacguau

SEQ ID NO: 326514 - RNA, 18 nt, Human
cugccagugugcucuccg

SEQ ID NO: 326515 - RNA, 22 nt, Human
ccucccugccggcuggacuagu

SEQ ID NO: 326516 - RNA, 22 nt, Human
auguuguugaacucuuugcaug

SEQ ID NO: 326517 - RNA, 22 nt, Human
aucagagcuaguacuugcaggu

SEQ ID NO: 326518 - RNA, 22 nt, Human
guaaagcaaaauguagagauug

SEQ ID NO: 326519 - RNA, 21 nt, Human
gcugcucgagauccagugcuu

SEQ ID NO: 326520 - RNA, 22 nt, Human
aacaucuagguucucaucgaua

SEQ ID NO: 326521 - RNA, 22 nt, Human
augguuuuguccucuuugguuc

SEQ ID NO: 326522 - RNA, 22 nt, Human
ucuucacaguccuggucagugg

SEQ ID NO: 326523 - RNA, 22 nt, Human
aggaagccuggaguccugccca

SEQ ID NO: 326524 - RNA, 22 nt, Human
uuuuuugucuugaagaaauggu

SEQ ID NO: 326525 - RNA, 22 nt, Human
cucucuguuaugcuuucaugaa

SEQ ID NO: 326526 - RNA, 22 nt, Human
ccugugguuuacucuguggcua

SEQ ID NO: 326527 - RNA, 22 nt, Human
ucuguggcuuucguguaagaug

SEQ ID NO: 326528 - RNA, 22 nt, Human
gggaccuggacaugugugugcu

SEQ ID NO: 326529 - RNA, 17 nt, Human
aaaugguccuagggauu

SEQ ID NO: 326530 - RNA, 22 nt, Human
agcaguuuauccucauaaugga

SEQ ID NO: 326531 - RNA, 22 nt, Human
gcugucugcugggucgcucagg

SEQ ID NO: 326532 - RNA, 22 nt, Human
ggagacucaccccgcauucuag

SEQ ID NO: 326533 - RNA, 22 nt, Human
cagugcagccaaggacaggcac

SEQ ID NO: 326534 - RNA, 22 nt, Human
ccagagacaaggagcuggaguc

SEQ ID NO: 326535 - RNA, 22 nt, Human
guucuucaggcugugcucuaga

SEQ ID NO: 326536 - RNA, 22 nt, Human
gcccucugguggccgccucggc

SEQ ID NO: 326537 - RNA, 22 nt, Human
uccaggagcucauccacgucaa

SEQ ID NO: 326538 - RNA, 21 nt, Human
gcagcaugagaaagccccaaa

SEQ ID NO: 326539 - RNA, 22 nt, Human
ugcuugucacccugccugagug

SEQ ID NO: 326540 - RNA, 18 nt, Human
uccaccgcgugcaccucu

SEQ ID NO: 326541 - RNA, 23 nt, Human
cguuuuuuccucagauguucugg

SEQ ID NO: 326542 - RNA, 22 nt, Human
acugagaacuuggggacagagg

SEQ ID NO: 326543 - RNA, 22 nt, Human
uaagaaacauuuuuaugacagu

SEQ ID NO: 326544 - RNA, 22 nt, Human
uuggaaauguagaaaagcagau

SEQ ID NO: 326545 - RNA, 22 nt, Human
uggcuccguuguacaggcugga

SEQ ID NO: 326546 - RNA, 22 nt, Human
ccugucugaaggcagggggaug

SEQ ID NO: 326547 - RNA, 22 nt, Human
aacacuaaaggucaguuagaag

SEQ ID NO: 326548 - RNA, 22 nt, Human
ccagaacagaccugccugaccu

SEQ ID NO: 326549 - RNA, 22 nt, Human
agacgcgguggugcaugccugu

SEQ ID NO: 326550 - RNA, 22 nt, Human
auggcuguguuguuccucugaa

SEQ ID NO: 326551 - RNA, 22 nt, Human
ccuggccgacauggugaaacgc

SEQ ID NO: 326552 - RNA, 17 nt, Human
gugcuggccuggggcuc

SEQ ID NO: 326553 - RNA, 22 nt, Human
gauccacagcugcgguaggaga

SEQ ID NO: 326554 - RNA, 22 nt, Human
cacagagagcuacgugcagcgu

SEQ ID NO: 326555 - RNA, 22 nt, Human
ccagaucccuguuugccucugg

SEQ ID NO: 326556 - RNA, 22 nt, Human
cuucucaaaguugugaaucagg

SEQ ID NO: 326557 - RNA, 22 nt, Human
cugcggcuggggacagcuguug

SEQ ID NO: 326558 - RNA, 22 nt, Human
ggagaggguguggaaaguuauc

SEQ ID NO: 326559 - RNA, 23 nt, Human
ucuggcugcuccuuucaaugcuc

SEQ ID NO: 326560 - RNA, 22 nt, Human
ugguccagacuuugaccucuca

SEQ ID NO: 326561 - RNA, 22 nt, Human
ccugcgggcugugcugaagccu

SEQ ID NO: 326562 - RNA, 22 nt, Human
uucagaagguaggaaugucccu

SEQ ID NO: 326563 - RNA, 22 nt, Human
cccuggaacccauggccagugu

SEQ ID NO: 326564 - RNA, 22 nt, Human
caaagaagagauuuacagagcu

SEQ ID NO: 326565 - RNA, 22 nt, Human
ugcuggcugggcugcuggagac

SEQ ID NO: 326566 - RNA, 22 nt, Human
ugucugccugcgggccggcaca

SEQ ID NO: 326567 - RNA, 22 nt, Human
uuauuuuguagcucugaucuuu

SEQ ID NO: 326568 - RNA, 22 nt, Human
uguaauguuagaaacaauugcu

SEQ ID NO: 326569 - RNA, 18 nt, Human
ggaaggugcuggagugca

SEQ ID NO: 326570 - RNA, 22 nt, Human
uggcacaguuaaaguuguagaa

SEQ ID NO: 326571 - RNA, 22 nt, Human
gucuuuuuuacaccuuacauca

SEQ ID NO: 326572 - RNA, 22 nt, Human
ccagcagccaccuucucgaaau

SEQ ID NO: 326573 - RNA, 22 nt, Human
ucccacagcuucgugcuucccc

SEQ ID NO: 326574 - RNA, 22 nt, Human
ucccagugggaagcagcacgcu

SEQ ID NO: 326575 - RNA, 22 nt, Human
uggcaggaaaaagggccagagg

SEQ ID NO: 326576 - RNA, 22 nt, Human
ugucauggacuggauuucugcu

SEQ ID NO: 326577 - RNA, 22 nt, Human
ugggaagaguuagagacagcug

SEQ ID NO: 326578 - RNA, 22 nt, Human
agagaagagucuugucaaauua

SEQ ID NO: 326579 - RNA, 22 nt, Human
cuggcccagguggucguugagg

SEQ ID NO: 326580 - RNA, 22 nt, Human
auuccaaagccugaauaaugga

SEQ ID NO: 326581 - RNA, 22 nt, Human
cuccaaaggauaaaagcagagu

SEQ ID NO: 326582 - RNA, 22 nt, Human
gggcacagucugcagcccccca

SEQ ID NO: 326583 - RNA, 22 nt, Human
aggugggacccguggggugcga

SEQ ID NO: 326584 - RNA, 22 nt, Human
gccgugcgugcgcaggugcugu

SEQ ID NO: 326585 - RNA, 22 nt, Human
cauuuacauuuaagguuaauau

SEQ ID NO: 326586 - RNA, 22 nt, Human
aaugguaauauuucauaguugu

SEQ ID NO: 326587 - RNA, 22 nt, Human
cagucccaguuugagacucugg

SEQ ID NO: 326588 - RNA, 22 nt, Human
augauuuguuaacagacuuaau

SEQ ID NO: 326589 - RNA, 22 nt, Human
uaauccaaaacugaaucugugg

SEQ ID NO: 326590 - RNA, 22 nt, Human
cucaugucggcaggacucgccc

SEQ ID NO: 326591 - RNA, 22 nt, Human
ucagagacaucagguuguagca

SEQ ID NO: 326592 - RNA, 22 nt, Human
aggcaguggcuuuuguuguguu

SEQ ID NO: 326593 - RNA, 19 nt, Human
augggaagcggccagcgga

SEQ ID NO: 326594 - RNA, 22 nt, Human
gcagugacagacaacuguuuga

SEQ ID NO: 326595 - RNA, 20 nt, Human
cucaccagguguaggcugag

SEQ ID NO: 326596 - RNA, 22 nt, Human
acagcugugggcucugcauaua

SEQ ID NO: 326597 - RNA, 22 nt, Human
auuuggcauaggcagaggccca

SEQ ID NO: 326598 - RNA, 22 nt, Human
ugugcugcucucagugacagcc

SEQ ID NO: 326599 - RNA, 22 nt, Human
uacugucuuuuccuaaaugggu

SEQ ID NO: 326600 - RNA, 22 nt, Human
ucccuguccugggcaaucccag

SEQ ID NO: 326601 - RNA, 22 nt, Human
ugggucagauugagccccuggu

SEQ ID NO: 326602 - RNA, 22 nt, Human
auuuuguaucuuacggggacua

SEQ ID NO: 326603 - RNA, 22 nt, Human
uuugagaaacagacgaaagaca

SEQ ID NO: 326604 - RNA, 19 nt, Human
ugcuccaggccuugccgca

SEQ ID NO: 326605 - RNA, 22 nt, Human
ucauaggaguagcagugagagg

SEQ ID NO: 326606 - RNA, 22 nt, Human
cggagcagagccacucgggccg

SEQ ID NO: 326607 - RNA, 22 nt, Human
acacugagcuuccaagaugggg

SEQ ID NO: 326608 - RNA, 22 nt, Human
caugaaaugauauuuggguggg

SEQ ID NO: 326609 - RNA, 22 nt, Human
uccagcagguccgagacaaguu

SEQ ID NO: 326610 - RNA, 22 nt, Human
cugcagggcagggccuccuggc

SEQ ID NO: 326611 - RNA, 22 nt, Human
ugcucccaaaccugacaggcuc

SEQ ID NO: 326612 - RNA, 22 nt, Human
uuuauucucuaguuggucagau

SEQ ID NO: 326613 - RNA, 22 nt, Human
ugugaagaauuaaugugaauca

SEQ ID NO: 326614 - RNA, 22 nt, Human
cugggaguugacgaggcuugua

SEQ ID NO: 326615 - RNA, 22 nt, Human
ccugugggcgcagcuggaguca

SEQ ID NO: 326616 - RNA, 22 nt, Human
aauuccagcugauugacuuucc

SEQ ID NO: 326617 - RNA, 21 nt, Human
ucuccucccggggagaggccg

SEQ ID NO: 326618 - RNA, 22 nt, Human
uuucacaugguacugccuguuu

SEQ ID NO: 326619 - RNA, 22 nt, Human
cuucauguacaguuauuggaga

SEQ ID NO: 326620 - RNA, 22 nt, Human
acaugcauaaacuacuucuuau

SEQ ID NO: 326621 - RNA, 22 nt, Human
cuuucuuucgaagacgugauua

SEQ ID NO: 326622 - RNA, 22 nt, Human
aggccugggacgggagccguga

SEQ ID NO: 326623 - RNA, 22 nt, Human
uggcauuggaauuuguguugca

SEQ ID NO: 326624 - RNA, 22 nt, Human
uuuacagcuacuguccuauuuc

SEQ ID NO: 326625 - RNA, 22 nt, Human
cugaaacuauggggaggggagc

SEQ ID NO: 326626 - RNA, 23 nt, Human
aucauagucuuugugacuggccc

SEQ ID NO: 326627 - RNA, 19 nt, Human
cuggcuucaagcaguccuc

SEQ ID NO: 326628 - RNA, 22 nt, Human
uacauguuauuucacuauuggu

SEQ ID NO: 326629 - RNA, 23 nt, Human
ugaaagcaaugggucuauaguau

SEQ ID NO: 326630 - RNA, 22 nt, Human
gccagcagcgagaguuuaaccu

SEQ ID NO: 326631 - RNA, 22 nt, Human
gccagguugcugacgacgaucu

SEQ ID NO: 326632 - RNA, 22 nt, Human
cucaggaaaauauugaagaagu

SEQ ID NO: 326633 - RNA, 22 nt, Human
uucacagaauugucuugacugg

SEQ ID NO: 326634 - RNA, 22 nt, Human
uagcuucccugcuggaucauaa

SEQ ID NO: 326635 - RNA, 22 nt, Human
uggcugaguuacgaacagagca

SEQ ID NO: 326636 - RNA, 23 nt, Human
caaaaugcuaugugcccaaugca

SEQ ID NO: 326637 - RNA, 22 nt, Human
ggagugggaacaaugacauggu

SEQ ID NO: 326638 - RNA, 22 nt, Human
ggcuauguguccagcaucuuug

SEQ ID NO: 326639 - RNA, 22 nt, Human
uugcaggguugacacugccugc

SEQ ID NO: 326640 - RNA, 20 nt, Human
acagaugaggaugcggaggc

SEQ ID NO: 326641 - RNA, 22 nt, Human
ugcaucauuaagguacaguugg

SEQ ID NO: 326642 - RNA, 18 nt, Human
uggcaugcuuugauacau

SEQ ID NO: 326643 - RNA, 22 nt, Human
auguuuguguuucccauucagg

SEQ ID NO: 326644 - RNA, 22 nt, Human
ucauggcacaugcccuccaggg

SEQ ID NO: 326645 - RNA, 22 nt, Human
uugcacagaugcacaugguugc

SEQ ID NO: 326646 - RNA, 22 nt, Human
acacucaugcucagcuggugcu

SEQ ID NO: 326647 - RNA, 19 nt, Human
cuucaguguucaccuggcc

SEQ ID NO: 326648 - RNA, 18 nt, Human
uauaaacacacuuagguu

SEQ ID NO: 326649 - RNA, 22 nt, Human
gcagcagcaggcgcucggccgu

SEQ ID NO: 326650 - RNA, 22 nt, Human
ugagcucaagcaauucacccgc

SEQ ID NO: 326651 - RNA, 22 nt, Human
ugcuccaggcugcugaagaucu

SEQ ID NO: 326652 - RNA, 23 nt, Human
augcuagcugugccaacaccaua

SEQ ID NO: 326653 - RNA, 22 nt, Human
uccuccuuuccccgcuggagcc

SEQ ID NO: 326654 - RNA, 20 nt, Human
uucuccacaggguggaggag

SEQ ID NO: 326655 - RNA, 22 nt, Human
agacagcacuuuuguauggggg

SEQ ID NO: 326656 - RNA, 19 nt, Human
agggaguuuauauuugcac

SEQ ID NO: 326657 - RNA, 22 nt, Human
gaguaauuuucuuaaaacauca

SEQ ID NO: 326658 - RNA, 22 nt, Human
ggcucugcugguaagaugccuc

SEQ ID NO: 326659 - RNA, 22 nt, Human
aucugguuuggggauccuugug

SEQ ID NO: 326660 - RNA, 22 nt, Human
gcugccuggaauaacggcuggc

SEQ ID NO: 326661 - RNA, 22 nt, Human
gcagcagugugggcugaaccua

SEQ ID NO: 326662 - RNA, 20 nt, Human
uggcccagcacgacgaggac

SEQ ID NO: 326663 - RNA, 22 nt, Human
ccuccccacagcccaggagacu

SEQ ID NO: 326664 - RNA, 22 nt, Human
cagguagaggcugccaucagcu

SEQ ID NO: 326665 - RNA, 22 nt, Human
ugcugcucuucaccauggccuc

SEQ ID NO: 326666 - RNA, 22 nt, Human
ugccagcaguagcaguaggcca

SEQ ID NO: 326667 - RNA, 22 nt, Human
gucccugauaagagccaucgau

SEQ ID NO: 326668 - RNA, 22 nt, Human
uccagugguggcucccggaccu

SEQ ID NO: 326669 - RNA, 22 nt, Human
cuguccuaugaguacucacuag

SEQ ID NO: 326670 - RNA, 22 nt, Human
auuuccuguaggggcuugcgaa

SEQ ID NO: 326671 - RNA, 22 nt, Human
caaugggccuggagagagcugg

SEQ ID NO: 326672 - RNA, 22 nt, Human
guugcagcaucacugcugagug

SEQ ID NO: 326673 - RNA, 21 nt, Human
ugcuccaggagggggcagucc

SEQ ID NO: 326674 - RNA, 22 nt, Human
cuguuuauucucaucuaaaaug

SEQ ID NO: 326675 - RNA, 22 nt, Human
ucuacugagugcugagauuuug

SEQ ID NO: 326676 - RNA, 22 nt, Human
augaaaacggaccagagcuauu

SEQ ID NO: 326677 - RNA, 22 nt, Human
acauuuuuggguugaugucuga

SEQ ID NO: 326678 - RNA, 21 nt, Human
agccaggcaagcacccccacu

SEQ ID NO: 326679 - RNA, 22 nt, Human
guagagcagggagcaggaagcu

SEQ ID NO: 326680 - RNA, 22 nt, Human
auguaacauaugugaucgcauu

SEQ ID NO: 326681 - RNA, 22 nt, Human
ccagcugcgggcaucgagaguu

SEQ ID NO: 326682 - RNA, 22 nt, Human
gugccuccaggcucgacuaguc

SEQ ID NO: 326683 - RNA, 22 nt, Human
gguggcagaggugcaucagccc

SEQ ID NO: 326684 - RNA, 22 nt, Human
guuauacuuaugugcaaaaaua

SEQ ID NO: 326685 - RNA, 17 nt, Human
ucugagaaugcuggagg

SEQ ID NO: 326686 - RNA, 22 nt, Human
uccaggcuccccugcgugcucc

SEQ ID NO: 326687 - RNA, 22 nt, Human
uccagcaguccaugugagacac

SEQ ID NO: 326688 - RNA, 22 nt, Human
gccaggucgucuccauguccaa

SEQ ID NO: 326689 - RNA, 20 nt, Human
cagagccaggguuuuguuuu

SEQ ID NO: 326690 - RNA, 22 nt, Human
ugagaagcaguuucaguaagaa

SEQ ID NO: 326691 - RNA, 22 nt, Human
uaggugucuggacaacuuugua

SEQ ID NO: 326692 - RNA, 22 nt, Human
cuagagaaaaagcuuagguacg

SEQ ID NO: 326693 - RNA, 22 nt, Human
cuucuggcguuggaggucugag

SEQ ID NO: 326694 - RNA, 22 nt, Human
cugcagaugguauuguucuggu

SEQ ID NO: 326695 - RNA, 23 nt, Human
agguggagcugugcagccggggc

SEQ ID NO: 326696 - RNA, 22 nt, Human
aaaucaugguggaagaaacaga

SEQ ID NO: 326697 - RNA, 22 nt, Human
ugucacagugcacagcuaagaa

SEQ ID NO: 326698 - RNA, 22 nt, Human
aaaugcacaauaaaguaaaggc

SEQ ID NO: 326699 - RNA, 22 nt, Human
uucagagcuggugucuacagcu

SEQ ID NO: 326700 - RNA, 22 nt, Human
ggcaccuuucaucccaucuaga

SEQ ID NO: 326701 - RNA, 22 nt, Human
ucuccaggcuuaaucucagcuu

SEQ ID NO: 326702 - RNA, 22 nt, Human
ugaagccagggacugacacuuc

SEQ ID NO: 326703 - RNA, 22 nt, Human
aagaagguugaaugacuacuuu

SEQ ID NO: 326704 - RNA, 22 nt, Human
ugugaagaucaggguccuagag

SEQ ID NO: 326705 - RNA, 22 nt, Human
gagguggcugcuugcugggaaa

SEQ ID NO: 326706 - RNA, 22 nt, Human
ucugcucagccgaucugcuccg

SEQ ID NO: 326707 - RNA, 22 nt, Human
gcuugcuuuguaaauaucugug

SEQ ID NO: 326708 - RNA, 22 nt, Human
uggcacugucaccaaugcuguc

SEQ ID NO: 326709 - RNA, 22 nt, Human
cuccagcucgcgagcucugcuc

SEQ ID NO: 326710 - RNA, 22 nt, Human
ucauggcucuaaagacauagau

SEQ ID NO: 326711 - RNA, 22 nt, Human
cacauuggcaaacgggguugca

SEQ ID NO: 326712 - RNA, 22 nt, Human
cuuccagcugauuggcauccag

SEQ ID NO: 326713 - RNA, 22 nt, Human
ggaagcaaauuccagaaccaca

SEQ ID NO: 326714 - RNA, 22 nt, Human
ugggugcucugcgaccguaggg

SEQ ID NO: 326715 - RNA, 22 nt, Human
cugcuguguggauucaauggcu

SEQ ID NO: 326716 - RNA, 22 nt, Human
uuuuguguugccauguuaagca

SEQ ID NO: 326717 - RNA, 18 nt, Human
gaaggcauucaguggcuu

SEQ ID NO: 326718 - RNA, 18 nt, Human
ccucuggguuuuguuccc

SEQ ID NO: 326719 - RNA, 22 nt, Human
uucagaaaggcugugccagcca

SEQ ID NO: 326720 - RNA, 22 nt, Human
gcuguggcuccaauggugagcc

SEQ ID NO: 326721 - RNA, 22 nt, Human
cauuuugugcuagacacuaugg

SEQ ID NO: 326722 - RNA, 22 nt, Human
ucaaaaugccgagugcccaggu

SEQ ID NO: 326723 - RNA, 20 nt, Human
gggugugugcagggccuggu

SEQ ID NO: 326724 - RNA, 22 nt, Human
gugggcaucuccuuggaagcca

SEQ ID NO: 326725 - RNA, 22 nt, Human
gccaccagccccaugcgcugug

SEQ ID NO: 326726 - RNA, 22 nt, Human
aggaaaugccgcggcucucuuu

SEQ ID NO: 326727 - RNA, 22 nt, Human
auacaccaccuuggaucuuuca

SEQ ID NO: 326728 - RNA, 22 nt, Human
gcucguugaaccuguccccgag

SEQ ID NO: 326729 - RNA, 22 nt, Human
gagggugguggcuuaaggugcu

SEQ ID NO: 326730 - RNA, 22 nt, Human
cugcacagucauuuccucucaa

SEQ ID NO: 326731 - RNA, 22 nt, Human
cagcuuugccaaguaaggucuu

SEQ ID NO: 326732 - RNA, 22 nt, Human
ucacuucguaaaccccucccau

SEQ ID NO: 326733 - RNA, 22 nt, Human
uucacguuguugaagaaaauac

SEQ ID NO: 326734 - RNA, 22 nt, Human
cucuggcaauugcugcugacuc

SEQ ID NO: 326735 - RNA, 22 nt, Human
gcugcugcuugaaggcucggag

SEQ ID NO: 326736 - RNA, 22 nt, Human
agcucugcuucuugggaagaug

SEQ ID NO: 326737 - RNA, 22 nt, Human
uuccuguucaggaaaguugugu

SEQ ID NO: 326738 - RNA, 22 nt, Human
uguucaguuugcuaucauaauc

SEQ ID NO: 326739 - RNA, 22 nt, Human
gccggucuuaagcugacuguga

SEQ ID NO: 326740 - RNA, 22 nt, Human
agccagggacgcugcaggcuac

SEQ ID NO: 326741 - RNA, 17 nt, Human
uaaguccuaguuauuuu

SEQ ID NO: 326742 - RNA, 22 nt, Human
ggcagguguuuuuauauuaaag

SEQ ID NO: 326743 - RNA, 19 nt, Human
ugcagcuguaugagcuuaa

SEQ ID NO: 326744 - RNA, 22 nt, Human
gaagaaguguaagucuguuuca

SEQ ID NO: 326745 - RNA, 22 nt, Human
agugaaauaugcccauugcugu

SEQ ID NO: 326746 - RNA, 22 nt, Human
cccaggcacacugaagugacau

SEQ ID NO: 326747 - RNA, 22 nt, Human
aagcagcacagcaaugacucua

SEQ ID NO: 326748 - RNA, 22 nt, Human
ugacauccuacaccccuggguc

SEQ ID NO: 326749 - RNA, 20 nt, Human
caucaacaccuugucagccu

SEQ ID NO: 326750 - RNA, 20 nt, Human
ucagugggaaagugagagug

SEQ ID NO: 326751 - RNA, 22 nt, Human
ugcucuguucaguguaucuugu

SEQ ID NO: 326752 - RNA, 22 nt, Human
auacaugacucacacauucugc

SEQ ID NO: 326753 - RNA, 22 nt, Human
cucaguggggcgacagggugcu

SEQ ID NO: 326754 - RNA, 17 nt, Human
agcagcuggguugaucu

SEQ ID NO: 326755 - RNA, 22 nt, Human
uggcccagaucucugaccuuga

SEQ ID NO: 326756 - RNA, 22 nt, Human
gcaguugcaggauuuguguugu

SEQ ID NO: 326757 - RNA, 22 nt, Human
acuggcaguagagggagcgcau

SEQ ID NO: 326758 - RNA, 22 nt, Human
gucuugcacuuaccuaagaacu

SEQ ID NO: 326759 - RNA, 22 nt, Human
acagagacaauauuuguaaagu

SEQ ID NO: 326760 - RNA, 22 nt, Human
ugggugguugcugaggcuccuu

SEQ ID NO: 326761 - RNA, 22 nt, Human
uggcuuccagaacugagcaaca

SEQ ID NO: 326762 - RNA, 22 nt, Human
ucuccacaccagaaggagcuga

SEQ ID NO: 326763 - RNA, 22 nt, Human
cccuggcucugccucagagccc

SEQ ID NO: 326764 - RNA, 20 nt, Human
cuguuugcuaucaugagcug

SEQ ID NO: 326765 - RNA, 22 nt, Human
agugauaggacauauggauuuu

SEQ ID NO: 326766 - RNA, 22 nt, Human
cccagccuuugcuuccugguuc

SEQ ID NO: 326767 - RNA, 22 nt, Human
ccucuuccacugggccccaucc

SEQ ID NO: 326768 - RNA, 22 nt, Human
agcaggaggagagccuggcggu

SEQ ID NO: 326769 - RNA, 22 nt, Human
guucaguuauuucugaagauau

SEQ ID NO: 326770 - RNA, 22 nt, Human
gaaggagaggauugugaggcug

SEQ ID NO: 326771 - RNA, 22 nt, Human
uccaggcugacgcagcuauuua

SEQ ID NO: 326772 - RNA, 22 nt, Human
ggcagagcuugcagugagccga

SEQ ID NO: 326773 - RNA, 22 nt, Human
uucugauuguuggaggaugcuu

SEQ ID NO: 326774 - RNA, 22 nt, Human
agaagugaguugugacuauggg

SEQ ID NO: 326775 - RNA, 22 nt, Human
uacagcagcccaccuucuucug

SEQ ID NO: 326776 - RNA, 22 nt, Human
ucauuccuccagcgggagucca

SEQ ID NO: 326777 - RNA, 19 nt, Human
agcagccaucgaccaugga

SEQ ID NO: 326778 - RNA, 22 nt, Human
ggcugcccucggggucgcaggc

SEQ ID NO: 326779 - RNA, 22 nt, Human
aaggcagcaugaaucccuguac

SEQ ID NO: 326780 - RNA, 22 nt, Human
uccugccaccggggguggcgau

SEQ ID NO: 326781 - RNA, 22 nt, Human
uauuuggauagacagggagaug

SEQ ID NO: 326782 - RNA, 22 nt, Human
gaacaguuucccuguagaaaau

SEQ ID NO: 326783 - RNA, 22 nt, Human
uugcuugaacccaggaagugga

SEQ ID NO: 326784 - RNA, 22 nt, Human
ccagcaggaaagugacguuuga

SEQ ID NO: 326785 - RNA, 22 nt, Human
ccugugggagggagcggcugga

SEQ ID NO: 326786 - RNA, 22 nt, Human
gcacaguauuuaguagaaugag

SEQ ID NO: 326787 - RNA, 22 nt, Human
uguucugcaaugcugccuccuu

SEQ ID NO: 326788 - RNA, 22 nt, Human
uucuucauucccuuacuuccga

SEQ ID NO: 326789 - RNA, 22 nt, Human
cuuguuuucuucugcagucuau

SEQ ID NO: 326790 - RNA, 22 nt, Human
cugcaccgugucucgggcugcc

SEQ ID NO: 326791 - RNA, 22 nt, Human
guuuacaacaucuuguccuuca

SEQ ID NO: 326792 - RNA, 22 nt, Human
agaaggcaucagaaguguguag

SEQ ID NO: 326793 - RNA, 22 nt, Human
auccauuugccgugcuaugugc

SEQ ID NO: 326794 - RNA, 22 nt, Human
gugacagguauacucaccauug

SEQ ID NO: 326795 - RNA, 22 nt, Human
uauucauguguuggaaaggaac

SEQ ID NO: 326796 - RNA, 22 nt, Human
ugcauguuucuguauguuaaug

SEQ ID NO: 326797 - RNA, 22 nt, Human
uagcugcuugaccaggcagugg

SEQ ID NO: 326798 - RNA, 23 nt, Human
uccaguuaaugguucccagucug

SEQ ID NO: 326799 - RNA, 22 nt, Human
cgucauuuguaaaugaucaaga

SEQ ID NO: 326800 - RNA, 22 nt, Human
cgagagauggguuggcaggggc

SEQ ID NO: 326801 - RNA, 22 nt, Human
cgggcagugcccagcggggcag

SEQ ID NO: 326802 - RNA, 22 nt, Human
uccuuucuucuucugcccaugg

SEQ ID NO: 326803 - RNA, 22 nt, Human
uguguuuuggaaggaacaugca

SEQ ID NO: 326804 - RNA, 22 nt, Human
aagcaaaagguuacacuucugg

SEQ ID NO: 326805 - RNA, 22 nt, Human
guggcauuuuagaacagcugac

SEQ ID NO: 326806 - RNA, 23 nt, Human
augcaacauugccaguaugggca

SEQ ID NO: 326807 - RNA, 22 nt, Human
cagaaccaggaacugauggaga

SEQ ID NO: 326808 - RNA, 22 nt, Human
ggacauggaaguauggagugga

SEQ ID NO: 326809 - RNA, 22 nt, Human
gccauguucuugaaucuggguc

SEQ ID NO: 326810 - RNA, 22 nt, Human
uuauuccauagaagucaaggaa

SEQ ID NO: 326811 - RNA, 19 nt, Human
ugguggaggccccauguuc

SEQ ID NO: 326812 - RNA, 22 nt, Human
agaaacaucgcuuaguccucau

SEQ ID NO: 326813 - RNA, 22 nt, Human
aggcucaguauagcuggcaagu

SEQ ID NO: 326814 - RNA, 22 nt, Human
acugagcaggguuccgcaugga

SEQ ID NO: 326815 - RNA, 19 nt, Human
agugagcauggcuugacug

SEQ ID NO: 326816 - RNA, 22 nt, Human
gugaagaugccucaggugaccc

SEQ ID NO: 326817 - RNA, 22 nt, Human
cucugcaggcacccaggguggg

SEQ ID NO: 326818 - RNA, 22 nt, Human
uguauuucugcuuucucuagua

SEQ ID NO: 326819 - RNA, 22 nt, Human
gcuucuggaagcauaugcaaga

SEQ ID NO: 326820 - RNA, 22 nt, Human
ucacuugaaccugggaggcaga

SEQ ID NO: 326821 - RNA, 22 nt, Human
gugggaguggagcucagcaugu

SEQ ID NO: 326822 - RNA, 22 nt, Human
gcagagauccaggguauagguu

SEQ ID NO: 326823 - RNA, 22 nt, Human
ugcugugcuggcggcagaggcc

SEQ ID NO: 326824 - RNA, 22 nt, Human
cccaggagacugagcuguaacc

SEQ ID NO: 326825 - RNA, 22 nt, Human
ugcauuucccauuguguggcuc

SEQ ID NO: 326826 - RNA, 22 nt, Human
ugcugcacuuauggcucugagg

SEQ ID NO: 326827 - RNA, 18 nt, Human
gguccugggccuggcuca

SEQ ID NO: 326828 - RNA, 22 nt, Human
gugcuggcuggggcaucaggca

SEQ ID NO: 326829 - RNA, 23 nt, Human
uuguccucuggaucgguuugguu

SEQ ID NO: 326830 - RNA, 22 nt, Human
gucuccugaggcauccauugaa

SEQ ID NO: 326831 - RNA, 22 nt, Human
ugagccaaguucacaccauugc

SEQ ID NO: 326832 - RNA, 22 nt, Human
aaagagcucggaaaguguugaa

SEQ ID NO: 326833 - RNA, 22 nt, Human
uaaagcauguuucaguaagguu

SEQ ID NO: 326834 - RNA, 22 nt, Human
uuccaggaagcucucggccucu

SEQ ID NO: 326835 - RNA, 22 nt, Human
uuuguguuguacuucugugcau

SEQ ID NO: 326836 - RNA, 22 nt, Human
acucuguuugcagguagcucag

SEQ ID NO: 326837 - RNA, 22 nt, Human
aaagcugcaagcuccugaggaa

SEQ ID NO: 326838 - RNA, 22 nt, Human
gccggggcuggggagagacaug

SEQ ID NO: 326839 - RNA, 22 nt, Human
cugucucugauaagcucgaggg

SEQ ID NO: 326840 - RNA, 22 nt, Human
guguggcuaggauggcuuugcu

SEQ ID NO: 326841 - RNA, 22 nt, Human
ggucuggccuccgggcaggugg

SEQ ID NO: 326842 - RNA, 22 nt, Human
ugcugcuuguuuuguaaauaaa

SEQ ID NO: 326843 - RNA, 22 nt, Human
auccauuuuuucagaaugcucu

SEQ ID NO: 326844 - RNA, 22 nt, Human
ugacuuuggacuagugauuuaa

SEQ ID NO: 326845 - RNA, 22 nt, Human
guccagaguagucgaguauucu

SEQ ID NO: 326846 - RNA, 22 nt, Human
cuuccucuguggccagagugua

SEQ ID NO: 326847 - RNA, 22 nt, Human
aaugaaacuaguagaaucuuug

SEQ ID NO: 326848 - RNA, 22 nt, Human
uuccuucuucauuguguuacag

SEQ ID NO: 326849 - RNA, 17 nt, Human
ugagcaguagaagaugc

SEQ ID NO: 326850 - RNA, 22 nt, Human
gcaguccuuaggagaggaagua

SEQ ID NO: 326851 - RNA, 22 nt, Human
auccuucaaaaggaauagcagg

SEQ ID NO: 326852 - RNA, 22 nt, Human
auacagguucucuagggaacag

SEQ ID NO: 326853 - RNA, 22 nt, Human
uccuggcaaagauguugguguu

SEQ ID NO: 326854 - RNA, 22 nt, Human
gucauuuuugacuuugaaguga

SEQ ID NO: 326855 - RNA, 22 nt, Human
caggaacagcaccaggagcuag

SEQ ID NO: 326856 - RNA, 22 nt, Human
ccaggcauccauugcuuccucu

SEQ ID NO: 326857 - RNA, 22 nt, Human
ucuguaaacacccguaagcuuu

SEQ ID NO: 326858 - RNA, 22 nt, Human
cuggcaguguccagcucgugau

SEQ ID NO: 326859 - RNA, 22 nt, Human
aacuuucuuugcaucuaaguuu

SEQ ID NO: 326860 - RNA, 22 nt, Human
cugcugccuuccaaaggccagg

SEQ ID NO: 326861 - RNA, 22 nt, Human
gucaggaugagggaugaggagu

SEQ ID NO: 326862 - RNA, 22 nt, Human
gcugcaggcucugcaggaauug

SEQ ID NO: 326863 - RNA, 22 nt, Human
cauggccaaagaauuauauuuu

SEQ ID NO: 326864 - RNA, 22 nt, Human
guuguuuuugaacggugguggc

SEQ ID NO: 326865 - RNA, 22 nt, Human
acugauuucagggaugagaaga

SEQ ID NO: 326866 - RNA, 22 nt, Human
acugugacugugucuucugggc

SEQ ID NO: 326867 - RNA, 22 nt, Human
gccaggcaggccacgcuguguu

SEQ ID NO: 326868 - RNA, 22 nt, Human
cauggcaggugcagauucugug

SEQ ID NO: 326869 - RNA, 22 nt, Human
auuaguagcacacagagaucag

SEQ ID NO: 326870 - RNA, 22 nt, Human
ggaaacugcuuacacuagaggg

SEQ ID NO: 326871 - RNA, 22 nt, Human
aaaugcacugaauauuccaaau

SEQ ID NO: 326872 - RNA, 22 nt, Human
caggguggcaggcaccauggcc

SEQ ID NO: 326873 - RNA, 22 nt, Human
ccuugagacacagccaaagaug

SEQ ID NO: 326874 - RNA, 22 nt, Human
ucccuggcugguguagagggau

SEQ ID NO: 326875 - RNA, 22 nt, Human
uuccaaguuaggcgagcuggug

SEQ ID NO: 326876 - RNA, 22 nt, Human
agccacauggaccugaugcuag

SEQ ID NO: 326877 - RNA, 22 nt, Human
aggaaauuuugaaucagugucu

SEQ ID NO: 326878 - RNA, 22 nt, Human
auagcaaaggacaauagucagu

SEQ ID NO: 326879 - RNA, 22 nt, Human
aaguccagguccucauuccauc

SEQ ID NO: 326880 - RNA, 22 nt, Human
cugagauggaguuucgcucuuc

SEQ ID NO: 326881 - RNA, 22 nt, Human
uuucucagccuccuugcuggag

SEQ ID NO: 326882 - RNA, 22 nt, Human
uauuuggugaaucuauggucag

SEQ ID NO: 326883 - RNA, 23 nt, Human
aacucuggcuagcauagaauaga

SEQ ID NO: 326884 - RNA, 20 nt, Human
ucauccaggacaggaguggc

SEQ ID NO: 326885 - RNA, 22 nt, Human
ugcuuuauucgacaucugguag

SEQ ID NO: 326886 - RNA, 22 nt, Human
ccuguggcacaugcagggauuc

SEQ ID NO: 326887 - RNA, 23 nt, Human
gguuggcuguacccaggcucccu

SEQ ID NO: 326888 - RNA, 23 nt, Human
gggcugcuccaggccaaggcugg

SEQ ID NO: 326889 - RNA, 22 nt, Human
augugaaagagguguucagugg

SEQ ID NO: 326890 - RNA, 22 nt, Human
agauaucuuacacuuugaaguu

SEQ ID NO: 326891 - RNA, 22 nt, Human
ucugcuugugucuguccagccu

SEQ ID NO: 326892 - RNA, 22 nt, Human
gucagaggggcagcugccaggc

SEQ ID NO: 326893 - RNA, 21 nt, Human
gccaucaccaagcucuucccc

SEQ ID NO: 326894 - RNA, 22 nt, Human
ccaggagagcucucguucagug

SEQ ID NO: 326895 - RNA, 22 nt, Human
cucagaguccauaguuuacagu

SEQ ID NO: 326896 - RNA, 22 nt, Human
gccagugccugcugcucagggc

SEQ ID NO: 326897 - RNA, 23 nt, Human
ugucuccaucucauuacuugggg

SEQ ID NO: 326898 - RNA, 22 nt, Human
aucugccuggcuccaggugagc

SEQ ID NO: 326899 - RNA, 22 nt, Human
agccagcuaccggggcuccugg

SEQ ID NO: 326900 - RNA, 22 nt, Human
agauguuuuuccaggucuaauu

SEQ ID NO: 326901 - RNA, 22 nt, Human
guuugagauggguuauugcucu

SEQ ID NO: 326902 - RNA, 22 nt, Human
ggcacuggcaaagcaaagucug

SEQ ID NO: 326903 - RNA, 22 nt, Human
aaggauuuuuggaaugagaugg

SEQ ID NO: 326904 - RNA, 19 nt, Human
cucuggcuccugggcugcc

SEQ ID NO: 326905 - RNA, 15 nt, Human
cccaggaguucgaga

SEQ ID NO: 326906 - RNA, 22 nt, Human
uagauuaucccugauuugucca

SEQ ID NO: 326907 - RNA, 22 nt, Human
uggcagcauuuuuuccagaaca

SEQ ID NO: 326908 - RNA, 22 nt, Human
caggguggaacaggcaauacuu

SEQ ID NO: 326909 - RNA, 22 nt, Human
gccuggcgccgggcugccuguc

SEQ ID NO: 326910 - RNA, 20 nt, Human
uuucacaaugaacaugucuc

SEQ ID NO: 326911 - RNA, 17 nt, Human
uggcacagaggugcuau

SEQ ID NO: 326912 - RNA, 22 nt, Human
gcgguauuugugugggugucga

SEQ ID NO: 326913 - RNA, 21 nt, Human
uccugccuuaguccagagcag

SEQ ID NO: 326914 - RNA, 19 nt, Human
ucaaagucugagucacuuu

SEQ ID NO: 326915 - RNA, 22 nt, Human
augaaaacagccuccugugaua

SEQ ID NO: 326916 - RNA, 22 nt, Human
ucaugcagauaagaauaaguaa

SEQ ID NO: 326917 - RNA, 21 nt, Human
agcugugguuuuacaucuuuu

SEQ ID NO: 326918 - RNA, 22 nt, Human
uguuccucugaacuucuuccaa

SEQ ID NO: 326919 - RNA, 22 nt, Human
acccaggucucucgacuucugg

SEQ ID NO: 326920 - RNA, 22 nt, Human
cuacuucuguggcucuaagaga

SEQ ID NO: 326921 - RNA, 22 nt, Human
aaguguguauuuuucuucagug

SEQ ID NO: 326922 - RNA, 22 nt, Human
ugagacaaagcagcugacagaa

SEQ ID NO: 326923 - RNA, 22 nt, Human
uagaagaacaugucaaacuaua

SEQ ID NO: 326924 - RNA, 22 nt, Human
ccugcacuaccuggggcugcug

SEQ ID NO: 326925 - RNA, 22 nt, Human
uuucugcagcagacucagugug

SEQ ID NO: 326926 - RNA, 22 nt, Human
cuaguauuaagugugaguaaaa

SEQ ID NO: 326927 - RNA, 22 nt, Human
ugccgcugucgccaccauggcu

SEQ ID NO: 326928 - RNA, 22 nt, Human
aacccuggggcugcucugccug

SEQ ID NO: 326929 - RNA, 22 nt, Human
aaagucuuaauguaaguuuagu

SEQ ID NO: 326930 - RNA, 22 nt, Human
uugcaguuuugacagaccaaau

SEQ ID NO: 326931 - RNA, 22 nt, Human
uuucacauacaguguauaguag

SEQ ID NO: 326932 - RNA, 22 nt, Human
uuuggauugcuuggaugcuucg

SEQ ID NO: 326933 - RNA, 22 nt, Human
cagugacguaaacugcaugugc

SEQ ID NO: 326934 - RNA, 22 nt, Human
uuucaugauuaacuuagugaau

SEQ ID NO: 326935 - RNA, 22 nt, Human
uuugagaagauaggggaauacu

SEQ ID NO: 326936 - RNA, 22 nt, Human
gacagcagccacagggagaggg

SEQ ID NO: 326937 - RNA, 22 nt, Human
cugggaagggacgccagugccu

SEQ ID NO: 326938 - RNA, 22 nt, Human
auuacugaggcaaaguaguuuu

SEQ ID NO: 326939 - RNA, 22 nt, Human
cugggcuuguguuagcugacaa

SEQ ID NO: 326940 - RNA, 22 nt, Human
ccagcccucgguagucccauag

SEQ ID NO: 326941 - RNA, 22 nt, Human
gucaaaugcacagaaccauuaa

SEQ ID NO: 326942 - RNA, 22 nt, Human
uccugcagccacugcaggcaga

SEQ ID NO: 326943 - RNA, 22 nt, Human
ccugggaccucgcgggaagcgg

SEQ ID NO: 326944 - RNA, 22 nt, Human
gcuggggagcuagaccucagca

SEQ ID NO: 326945 - RNA, 22 nt, Human
aagaaaacaugaucuaauuuaa

SEQ ID NO: 326946 - RNA, 22 nt, Human
cugggcucaagaagucuucccu

SEQ ID NO: 326947 - RNA, 21 nt, Human
ggagcuggggagcuggcccca

SEQ ID NO: 326948 - RNA, 22 nt, Human
gcagagcugcagcgaggccugg

SEQ ID NO: 326949 - RNA, 22 nt, Human
gcaggagcucguuuccaggcug

SEQ ID NO: 326950 - RNA, 22 nt, Human
cugguggagaugccuggccccu

SEQ ID NO: 326951 - RNA, 22 nt, Human
uccugcaguuacaucccagcca

SEQ ID NO: 326952 - RNA, 22 nt, Human
cccagcccacgguccugggugg

SEQ ID NO: 326953 - RNA, 22 nt, Human
ccugguggccuucagcccacaa

SEQ ID NO: 326954 - RNA, 22 nt, Human
caccaggcacauaguaggcacu

SEQ ID NO: 326955 - RNA, 22 nt, Human
agagcuggauggucaagauggc

SEQ ID NO: 326956 - RNA, 22 nt, Human
ggaggccaggaagagccgcccu

SEQ ID NO: 326957 - RNA, 22 nt, Human
aaacacaauguuucuuuguucu

SEQ ID NO: 326958 - RNA, 22 nt, Human
gcugggcucuuuaccccuguac

SEQ ID NO: 326959 - RNA, 21 nt, Human
agagcugggacuugccugaga

SEQ ID NO: 326960 - RNA, 22 nt, Human
agagcuggggcucuggguuuaa

SEQ ID NO: 326961 - RNA, 22 nt, Human
ccccugccagcuaucccugaac

SEQ ID NO: 326962 - RNA, 22 nt, Human
ccugggcagggagaccaggcuc

SEQ ID NO: 326963 - RNA, 23 nt, Human
agcuggaggcugucuacucccaa

SEQ ID NO: 326964 - RNA, 22 nt, Human
ccagccccuauccucgcuccac

SEQ ID NO: 326965 - RNA, 22 nt, Human
uccugcaggggcugaggaacca

SEQ ID NO: 326966 - RNA, 22 nt, Human
agcuccugcaccaggggccccu

SEQ ID NO: 326967 - RNA, 22 nt, Human
ugcaggagcaccagcucacccu

SEQ ID NO: 326968 - RNA, 22 nt, Human
agcuggggcauuuauccacuaa

SEQ ID NO: 326969 - RNA, 20 nt, Human
ggcaccaggcuaggauugga

SEQ ID NO: 326970 - RNA, 22 nt, Human
gagcugggaagauagcuugagc

SEQ ID NO: 326971 - RNA, 22 nt, Human
gagcuccucccaggguagcacu

SEQ ID NO: 326972 - RNA, 22 nt, Human
gagcugggcuggcuuccucccu

SEQ ID NO: 326973 - RNA, 22 nt, Human
gagcuggguguuuauuugccaa

SEQ ID NO: 326974 - RNA, 22 nt, Human
gggcccugugauuucuugagga

SEQ ID NO: 326975 - RNA, 22 nt, Human
gccccuggcuggccagcuccuc

SEQ ID NO: 326976 - RNA, 22 nt, Human
uugucuaaugagcuccacuuca

SEQ ID NO: 326977 - RNA, 22 nt, Human
gauguuuuaggucccuguagcu

SEQ ID NO: 326978 - RNA, 22 nt, Human
cagcuccugccugggcagcugu

SEQ ID NO: 326979 - RNA, 22 nt, Human
gagcuggggcggauacucagcu

SEQ ID NO: 326980 - RNA, 22 nt, Human
gcccauggcagaacugugagca

SEQ ID NO: 326981 - RNA, 22 nt, Human
cuggugcacauucgcucucaua

SEQ ID NO: 326982 - RNA, 22 nt, Human
cugcaggacgaccgccucaucu

SEQ ID NO: 326983 - RNA, 22 nt, Human
ggcagagcugcaugagcacuca

SEQ ID NO: 326984 - RNA, 22 nt, Human
agguauuauuagcaucucuauu

SEQ ID NO: 326985 - RNA, 19 nt, Human
cagcccucuuaccacugug

SEQ ID NO: 326986 - RNA, 22 nt, Human
cugcagaggccucgccuccucu

SEQ ID NO: 326987 - RNA, 22 nt, Human
agagcuggggccagagucaagg

SEQ ID NO: 326988 - RNA, 22 nt, Human
ccuggagcuuggucacgcugcg

SEQ ID NO: 326989 - RNA, 22 nt, Human
agcuccugugugaagccucccu

SEQ ID NO: 326990 - RNA, 22 nt, Human
agagcuggggcccguaaagcca

SEQ ID NO: 326991 - RNA, 22 nt, Human
ucccugucuaauaugccaugaa

SEQ ID NO: 326992 - RNA, 18 nt, Human
auccaaaaagauggaagu

SEQ ID NO: 326993 - RNA, 22 nt, Human
ugaucaaaacauuacuccacca

SEQ ID NO: 326994 - RNA, 22 nt, Human
uaugauaugcacuuuaucagaa

SEQ ID NO: 326995 - RNA, 22 nt, Human
ccugcagggaaucgaggcagaa

SEQ ID NO: 326996 - RNA, 22 nt, Human
gagcugggauucaucuaugucu

SEQ ID NO: 326997 - RNA, 22 nt, Human
cacagcugaaguagccaugugg

SEQ ID NO: 326998 - RNA, 22 nt, Human
gggccccugggaauucugugau

SEQ ID NO: 326999 - RNA, 22 nt, Human
gcccugugagucaugcggcaga

SEQ ID NO: 327000 - RNA, 22 nt, Human
ggagcuggucagccuugagcau

SEQ ID NO: 327001 - RNA, 22 nt, Human
ugggcuccggcggccucaggcu

SEQ ID NO: 327002 - RNA, 22 nt, Human
ucagcuucagaucagcuagaga

SEQ ID NO: 327003 - RNA, 22 nt, Human
uaaauguauaggcacuaaaccu

SEQ ID NO: 327004 - RNA, 22 nt, Human
ccaggccccagggcuggcuuuc

SEQ ID NO: 327005 - RNA, 22 nt, Human
agccugggcccugccucuucuc

SEQ ID NO: 327006 - RNA, 22 nt, Human
cccuguccuuggcugugaggcu

SEQ ID NO: 327007 - RNA, 22 nt, Human
caccaggcugaaccagagggga

SEQ ID NO: 327008 - RNA, 22 nt, Human
acaaacuuccaucaugaauuuu

SEQ ID NO: 327009 - RNA, 22 nt, Human
ccugcagguuucccccggacgg

SEQ ID NO: 327010 - RNA, 21 nt, Human
ggugacacguggccccgcucu

SEQ ID NO: 327011 - RNA, 22 nt, Human
cccuguccuggaugggagcacu

SEQ ID NO: 327012 - RNA, 22 nt, Human
agagcuggccagggaucacucu

SEQ ID NO: 327013 - RNA, 22 nt, Human
cugucacccacccagccuguca

SEQ ID NO: 327014 - RNA, 22 nt, Human
gugcauccacuagggcucuccc

SEQ ID NO: 327015 - RNA, 22 nt, Human
gugcugggcuccaccccagagg

SEQ ID NO: 327016 - RNA, 20 nt, Human
agcuccugguauaggugccu

SEQ ID NO: 327017 - RNA, 20 nt, Human
agagcugggaagcucccuau

SEQ ID NO: 327018 - RNA, 22 nt, Human
gagggcacgaaacaaccacuuc

SEQ ID NO: 327019 - RNA, 22 nt, Human
gcccaugguuacuuuucuggcu

SEQ ID NO: 327020 - RNA, 22 nt, Human
gcagcaggcuuuucauaccuug

SEQ ID NO: 327021 - RNA, 22 nt, Human
uagcugggaauuaucugguugc

SEQ ID NO: 327022 - RNA, 23 nt, Human
gagcugggauacaggcuuacugc

SEQ ID NO: 327023 - RNA, 22 nt, Human
agcuggggcugcagagaacagg

SEQ ID NO: 327024 - RNA, 19 nt, Human
gcugggagcagacccuccc

SEQ ID NO: 327025 - RNA, 22 nt, Human
agagcuggcagcagcuucuccu

SEQ ID NO: 327026 - RNA, 22 nt, Human
augcugggaaguccuaaccaca

SEQ ID NO: 327027 - RNA, 22 nt, Human
aucauccuagaaggaagcuagg

SEQ ID NO: 327028 - RNA, 22 nt, Human
agcccuguuuaugccacaucau

SEQ ID NO: 327029 - RNA, 22 nt, Human
ccugcagguugcagaggcggaa

SEQ ID NO: 327030 - RNA, 22 nt, Human
ccuguccagggacugagggaga

SEQ ID NO: 327031 - RNA, 22 nt, Human
aagcugggagggagcccagagu

SEQ ID NO: 327032 - RNA, 22 nt, Human
auguaaacucacauuuucuuca

SEQ ID NO: 327033 - RNA, 22 nt, Human
cccugguguccacuggaggaag

SEQ ID NO: 327034 - RNA, 22 nt, Human
gagcugggauuugaaccuggga

SEQ ID NO: 327035 - RNA, 22 nt, Human
aacugguaucucuucaguguaa

SEQ ID NO: 327036 - RNA, 23 nt, Human
uccugaggaauggcaucucacau

SEQ ID NO: 327037 - RNA, 20 nt, Human
ugcagagcugacauuaccug

SEQ ID NO: 327038 - RNA, 22 nt, Human
agaggaggccaggcccacaccu

SEQ ID NO: 327039 - RNA, 22 nt, Human
agagcuggaaaaguuguuuuaa

SEQ ID NO: 327040 - RNA, 22 nt, Human
cauaaucagauguguacauaag

SEQ ID NO: 327041 - RNA, 22 nt, Human
ugguauucuuucuguagaucau

SEQ ID NO: 327042 - RNA, 22 nt, Human
uccuguggcucuguggaaccuu

SEQ ID NO: 327043 - RNA, 22 nt, Human
ugcugaggcccaggagcacuuu

SEQ ID NO: 327044 - RNA, 22 nt, Human
ccugacagcgugucccuggccc

SEQ ID NO: 327045 - RNA, 22 nt, Human
agcugggguugcacacauuuug

SEQ ID NO: 327046 - RNA, 18 nt, Human
aagcugggaaggagacag

SEQ ID NO: 327047 - RNA, 22 nt, Human
gcagagcugggauaugaaccca

SEQ ID NO: 327048 - RNA, 22 nt, Human
caccaggcuggagugcagaggu

SEQ ID NO: 327049 - RNA, 22 nt, Human
uccugcagaccucagucagguc

SEQ ID NO: 327050 - RNA, 22 nt, Human
ugaguuauaaugaauauuugaa

SEQ ID NO: 327051 - RNA, 22 nt, Human
gaugcuggaagugcugaucuug

SEQ ID NO: 327052 - RNA, 22 nt, Human
agagcugguuuacucaggaauu

SEQ ID NO: 327053 - RNA, 22 nt, Human
ucccugaggaagggguguggug

SEQ ID NO: 327054 - RNA, 22 nt, Human
agagcuggacgucugagcccua

SEQ ID NO: 327055 - RNA, 22 nt, Human
cugcagagcagccaguccccca

SEQ ID NO: 327056 - RNA, 22 nt, Human
ggcacagggggcugaggacuag

SEQ ID NO: 327057 - RNA, 22 nt, Human
cccacucccugcacgccugccg

SEQ ID NO: 327058 - RNA, 22 nt, Human
ugcuggggcagaagagccaaga

SEQ ID NO: 327059 - RNA, 22 nt, Human
ggcaccaggcugggcauaggcc

SEQ ID NO: 327060 - RNA, 22 nt, Human
cagaugcuauguauuauguaug

SEQ ID NO: 327061 - RNA, 22 nt, Human
ugggcaccuagcaacccuucuc

SEQ ID NO: 327062 - RNA, 22 nt, Human
aguaaaauuguauuggaaaaca

SEQ ID NO: 327063 - RNA, 22 nt, Human
cugggcuccuaaccauccaggu

SEQ ID NO: 327064 - RNA, 22 nt, Human
uagucaaaccucagaauacccc

SEQ ID NO: 327065 - RNA, 22 nt, Human
ccuggggagccgccugagcccc

SEQ ID NO: 327066 - RNA, 22 nt, Human
gcaccgagaaggaagcaugccu

SEQ ID NO: 327067 - RNA, 22 nt, Human
ccucagccuuggccccaggcag

SEQ ID NO: 327068 - RNA, 22 nt, Human
ccugggcuuucggcggcuuccu

SEQ ID NO: 327069 - RNA, 22 nt, Human
gacacuccagcuuuuggcucaa

SEQ ID NO: 327070 - RNA, 22 nt, Human
agagcugggaccgucuggaagu

SEQ ID NO: 327071 - RNA, 22 nt, Human
agacuuuaaugugcaaaugaaa

SEQ ID NO: 327072 - RNA, 22 nt, Human
cugcaggagugaaagcaggccu

SEQ ID NO: 327073 - RNA, 22 nt, Human
cugucccucaguucugggcaaa

SEQ ID NO: 327074 - RNA, 22 nt, Human
cugggauccacgggcucccaag

SEQ ID NO: 327075 - RNA, 22 nt, Human
cugucccucaucaccucugggu

SEQ ID NO: 327076 - RNA, 22 nt, Human
ccaggcccugccugugguuccu

SEQ ID NO: 327077 - RNA, 22 nt, Human
uguggcacuucucuccuuguaa

SEQ ID NO: 327078 - RNA, 22 nt, Human
ccuggggucagggacgcugugc

SEQ ID NO: 327079 - RNA, 22 nt, Human
cccugccuuguuggagccuaug

SEQ ID NO: 327080 - RNA, 22 nt, Human
agagcuggggcauaaaugccac

SEQ ID NO: 327081 - RNA, 22 nt, Human
caugagauaauuuuucuccagu

SEQ ID NO: 327082 - RNA, 22 nt, Human
gcugggcuucacagagccuuua

SEQ ID NO: 327083 - RNA, 22 nt, Human
uccacuggaacaacucugaggc

SEQ ID NO: 327084 - RNA, 22 nt, Human
cacuguaauagcauuauaagug

SEQ ID NO: 327085 - RNA, 22 nt, Human
cugggcuagaaggaccaggaug

SEQ ID NO: 327086 - RNA, 22 nt, Human
ggcaccagcacuugggauggcu

SEQ ID NO: 327087 - RNA, 22 nt, Human
uucuagauugccuguaaguaaa

SEQ ID NO: 327088 - RNA, 22 nt, Human
gcccugugcuuggauggcagau

SEQ ID NO: 327089 - RNA, 22 nt, Human
acuuuacuccccaacauaaaug

SEQ ID NO: 327090 - RNA, 22 nt, Human
ccagccucaucgccugccuguc

SEQ ID NO: 327091 - RNA, 16 nt, Human
gcagagcucagggacu

SEQ ID NO: 327092 - RNA, 22 nt, Human
auaugaaaagaagucaccauug

SEQ ID NO: 327093 - RNA, 22 nt, Human
ggcaccaggaucagucugucau

SEQ ID NO: 327094 - RNA, 22 nt, Human
ggaggccacgguuuagcaccga

SEQ ID NO: 327095 - RNA, 22 nt, Human
gagccuggccuccugccucagc

SEQ ID NO: 327096 - RNA, 22 nt, Human
ucugcaggucacgcuccagccu

SEQ ID NO: 327097 - RNA, 22 nt, Human
uauccaaaguuucucagaaacu

SEQ ID NO: 327098 - RNA, 22 nt, Human
ggagcuggagagcuagccuagg

SEQ ID NO: 327099 - RNA, 22 nt, Human
agcuccugucucaagggagccu

SEQ ID NO: 327100 - RNA, 22 nt, Human
cucucugaggaaggagcaucug

SEQ ID NO: 327101 - RNA, 22 nt, Human
cugggcucaaauccuggcccug

SEQ ID NO: 327102 - RNA, 22 nt, Human
ggcaccaggacaugacucccag

SEQ ID NO: 327103 - RNA, 22 nt, Human
agaugguagguggcaggacuga

SEQ ID NO: 327104 - RNA, 22 nt, Human
uuucagaucauuuuuuaaguac

SEQ ID NO: 327105 - RNA, 22 nt, Human
gggcuccuccucugacuguggc

SEQ ID NO: 327106 - RNA, 22 nt, Human
cccuguggcaggaggaggagca

SEQ ID NO: 327107 - RNA, 22 nt, Human
ccaggcccuugcaagucccacc

SEQ ID NO: 327108 - RNA, 22 nt, Human
cccagcccagcguucgaggggu

SEQ ID NO: 327109 - RNA, 21 nt, Human
agagcuggccugccaggcccu

SEQ ID NO: 327110 - RNA, 22 nt, Human
gcugauagacugaauguuggga

SEQ ID NO: 327111 - RNA, 22 nt, Human
agcuccugcgcacggugcacac

SEQ ID NO: 327112 - RNA, 22 nt, Human
gagguggcgcgccaucccugcc

SEQ ID NO: 327113 - RNA, 22 nt, Human
cccuguggaggcagcauccugc

SEQ ID NO: 327114 - RNA, 22 nt, Human
uucaaaugcaaguuacuacuuu

SEQ ID NO: 327115 - RNA, 22 nt, Human
ccugcagggugcugccacagau

SEQ ID NO: 327116 - RNA, 22 nt, Human
ccugcagguccccggaugcgca

SEQ ID NO: 327117 - RNA, 22 nt, Human
gcagagcuccccaagacaccaa

SEQ ID NO: 327118 - RNA, 22 nt, Human
uaggacaugcuacauaaauagg

SEQ ID NO: 327119 - RNA, 22 nt, Human
gagcugggcgagccggggaagu

SEQ ID NO: 327120 - RNA, 19 nt, Human
ggcagagcuccugcuuucu

SEQ ID NO: 327121 - RNA, 22 nt, Human
gcugggcuugguuucccugcuu

SEQ ID NO: 327122 - RNA, 22 nt, Human
cccugugggguccgccuguccg

SEQ ID NO: 327123 - RNA, 22 nt, Human
cugggugagcuggccagagggu

SEQ ID NO: 327124 - RNA, 22 nt, Human
caaguaaagaaucacauuucuu

SEQ ID NO: 327125 - RNA, 22 nt, Human
gcagagcuucuguccuucagga

SEQ ID NO: 327126 - RNA, 22 nt, Human
ugcagagcuucauugcauaggc

SEQ ID NO: 327127 - RNA, 20 nt, Human
gcugggcuaccacuggcccu

SEQ ID NO: 327128 - RNA, 22 nt, Human
ggcaccagggaaggaaggcugg

SEQ ID NO: 327129 - RNA, 22 nt, Human
uaggacauguguuuuauauaug

SEQ ID NO: 327130 - RNA, 21 nt, Human
ggcaucccaggccagugacug

SEQ ID NO: 327131 - RNA, 23 nt, Human
ccugaagggucaggguccucagc

SEQ ID NO: 327132 - RNA, 22 nt, Human
ucagacaaguaaaauaauguaa

SEQ ID NO: 327133 - RNA, 22 nt, Human
agagcuggcugcugcggugcuu

SEQ ID NO: 327134 - RNA, 22 nt, Human
guaucacuuuugagagugagaa

SEQ ID NO: 327135 - RNA, 22 nt, Human
agagcuggagcagccccacugg

SEQ ID NO: 327136 - RNA, 21 nt, Human
ccagccucagaucagggagcu

SEQ ID NO: 327137 - RNA, 22 nt, Human
caccagguuccgggcagagcug

SEQ ID NO: 327138 - RNA, 22 nt, Human
agcaauaacagaaaacuuuccu

SEQ ID NO: 327139 - RNA, 20 nt, Human
ggcagagcuaugucuguugc

SEQ ID NO: 327140 - RNA, 22 nt, Human
ggagcugggaacuauguaguau

SEQ ID NO: 327141 - RNA, 21 nt, Human
gagcugggcgaggcuccgggg

SEQ ID NO: 327142 - RNA, 22 nt, Human
uccugguggugccggugcccgg

SEQ ID NO: 327143 - RNA, 18 nt, Human
ucuggaacaacuucaugu

SEQ ID NO: 327144 - RNA, 22 nt, Human
gcccuuggaacagccuccugcu

SEQ ID NO: 327145 - RNA, 22 nt, Human
cugugcccaggccccuggggau

SEQ ID NO: 327146 - RNA, 22 nt, Human
auauaucaugaguaaaacuuga

SEQ ID NO: 327147 - RNA, 22 nt, Human
ugcugggggugucucaccaggc

SEQ ID NO: 327148 - RNA, 22 nt, Human
agaagucauuuauguuagauga

SEQ ID NO: 327149 - RNA, 19 nt, Human
agcuggggcgguguguguu

SEQ ID NO: 327150 - RNA, 22 nt, Human
agaggacacaucuuuccucaaa

SEQ ID NO: 327151 - RNA, 22 nt, Human
ucugggguuuucacgcugucuc

SEQ ID NO: 327152 - RNA, 22 nt, Human
uaggacauaaguauucuaacuu

SEQ ID NO: 327153 - RNA, 17 nt, Human
guccuggugugugagga

SEQ ID NO: 327154 - RNA, 22 nt, Human
gcuuccuggagggagagagcug

SEQ ID NO: 327155 - RNA, 22 nt, Human
ucaaaguagccggauggaauuu

SEQ ID NO: 327156 - RNA, 22 nt, Human
aaauauguuuuccaguugucau

SEQ ID NO: 327157 - RNA, 22 nt, Human
uuucagaucacuuucaggaaag

SEQ ID NO: 327158 - RNA, 22 nt, Human
auauaacauacauacagaaaag

SEQ ID NO: 327159 - RNA, 22 nt, Human
aaguaaaauucaaucuucacug

SEQ ID NO: 327160 - RNA, 22 nt, Human
agagcuggugcauauucagaaa

SEQ ID NO: 327161 - RNA, 22 nt, Human
acauuucaguaaguguuaauuu

SEQ ID NO: 327162 - RNA, 22 nt, Human
gagggcacuggguuucaauguc

SEQ ID NO: 327163 - RNA, 23 nt, Human
aauuuaguuugagacauuagccu

SEQ ID NO: 327164 - RNA, 22 nt, Human
augccuggucccaccucuaggu

SEQ ID NO: 327165 - RNA, 22 nt, Human
uccuguggggaaaagccuaucu

SEQ ID NO: 327166 - RNA, 22 nt, Human
agcccugugggccuuguggcac

SEQ ID NO: 327167 - RNA, 22 nt, Human
gaucucaaagcaguguggguug

SEQ ID NO: 327168 - RNA, 22 nt, Human
cccuggucagggaaggcgccug

SEQ ID NO: 327169 - RNA, 22 nt, Human
aaaaguauuuuggaucucagau

SEQ ID NO: 327170 - RNA, 22 nt, Human
agagcugggacuuggacucaau

SEQ ID NO: 327171 - RNA, 22 nt, Human
gcccagcccugaggucacagcu

SEQ ID NO: 327172 - RNA, 22 nt, Human
ccauggccaauugcaccuugcu

SEQ ID NO: 327173 - RNA, 20 nt, Human
acuuuacugagcuguaauuc

SEQ ID NO: 327174 - RNA, 20 nt, Human
uggcaccaggugguggcccc

SEQ ID NO: 327175 - RNA, 22 nt, Human
aaauauguauggaguucaugaa

SEQ ID NO: 327176 - RNA, 19 nt, Human
uguagcuagugucuaucca

SEQ ID NO: 327177 - RNA, 22 nt, Human
aaauaucauuuauaacuuuuaa

SEQ ID NO: 327178 - RNA, 22 nt, Human
ggcagagccuucuggagcucgc

SEQ ID NO: 327179 - RNA, 22 nt, Human
cugggcucagaugagaggaagg

SEQ ID NO: 327180 - RNA, 22 nt, Human
gcaggagcugcucuccugacga

SEQ ID NO: 327181 - RNA, 19 nt, Human
cugcucccuccuucuggca

SEQ ID NO: 327182 - RNA, 22 nt, Human
ucaaaguauuuuaacuguaucc

SEQ ID NO: 327183 - RNA, 22 nt, Human
cccuguccugcuaggcccuggu

SEQ ID NO: 327184 - RNA, 22 nt, Human
agagcuggaagcugcucuuaga

SEQ ID NO: 327185 - RNA, 22 nt, Human
agagcuggcugguagcccugau

SEQ ID NO: 327186 - RNA, 22 nt, Human
gagcugggucuccaccuuggca

SEQ ID NO: 327187 - RNA, 22 nt, Human
agguggcagagugacaggcuga

SEQ ID NO: 327188 - RNA, 22 nt, Human
cugcagccucaaccuccugagc

SEQ ID NO: 327189 - RNA, 22 nt, Human
gccuguggggcugaggcugccu

SEQ ID NO: 327190 - RNA, 22 nt, Human
ccugcuggccacugcuccaccu

SEQ ID NO: 327191 - RNA, 22 nt, Human
aagcugggacuuagcgcagaua

SEQ ID NO: 327192 - RNA, 22 nt, Human
ccacucccuuccgguccagggc

SEQ ID NO: 327193 - RNA, 22 nt, Human
cucagccugugaagagcagagg

SEQ ID NO: 327194 - RNA, 22 nt, Human
ccugguggacagcagccagcag

SEQ ID NO: 327195 - RNA, 22 nt, Human
gcuuggggagcucaguguccuu

SEQ ID NO: 327196 - RNA, 22 nt, Human
gcccuguguguuugcacugauu

SEQ ID NO: 327197 - RNA, 20 nt, Human
uuucagauuuacagaaaugu

SEQ ID NO: 327198 - RNA, 22 nt, Human
cccugugguugcuagggcacag

SEQ ID NO: 327199 - RNA, 22 nt, Human
uggcaccaggcgggguggcugu

SEQ ID NO: 327200 - RNA, 22 nt, Human
cugggcucaguggcucauggcu

SEQ ID NO: 327201 - RNA, 22 nt, Human
cagagcuggagggaacccuggc

SEQ ID NO: 327202 - RNA, 20 nt, Human
cugggcucgguggcccuggc

SEQ ID NO: 327203 - RNA, 22 nt, Human
gcccuugggagguuccacuggg

SEQ ID NO: 327204 - RNA, 22 nt, Human
uaguaacccacacaacaguaga

SEQ ID NO: 327205 - RNA, 22 nt, Human
gaccaggcuuccccagaccuca

SEQ ID NO: 327206 - RNA, 22 nt, Human
aaaauaguuaacguucagagua

SEQ ID NO: 327207 - RNA, 20 nt, Human
agggcagcuugaggagccgg

SEQ ID NO: 327208 - RNA, 22 nt, Human
uuaugguaauuaaaacauguau

SEQ ID NO: 327209 - RNA, 22 nt, Human
agcccugucucucacuccaggu

SEQ ID NO: 327210 - RNA, 22 nt, Human
ucucagccucaccucuauggag

SEQ ID NO: 327211 - RNA, 21 nt, Human
accaggccaggaggcuggcac

SEQ ID NO: 327212 - RNA, 22 nt, Human
gugcaccccggggcccugcucc

SEQ ID NO: 327213 - RNA, 22 nt, Human
gagcugggccucagaacacagu

SEQ ID NO: 327214 - RNA, 17 nt, Human
ggcaccagacggagagu

SEQ ID NO: 327215 - RNA, 22 nt, Human
ucccugagcucacauggcagga

SEQ ID NO: 327216 - RNA, 22 nt, Human
agagcuggcacugacccucacc

SEQ ID NO: 327217 - RNA, 20 nt, Human
cccagcccgggccgcgcucg

SEQ ID NO: 327218 - RNA, 22 nt, Human
cagagcugcaaaugccccuccg

SEQ ID NO: 327219 - RNA, 22 nt, Human
ggcaucccuucuuccaguguca

SEQ ID NO: 327220 - RNA, 22 nt, Human
cccugccugugggcaucaacau

SEQ ID NO: 327221 - RNA, 22 nt, Human
cccugugggaacuccugaguug

SEQ ID NO: 327222 - RNA, 22 nt, Human
uuucagaugguauauacaguag

SEQ ID NO: 327223 - RNA, 22 nt, Human
cugggcucuaagggagcaccgu

SEQ ID NO: 327224 - RNA, 21 nt, Human
ugggcaccaaaaccuaggagu

SEQ ID NO: 327225 - RNA, 19 nt, Human
uccagccccucugugugug

SEQ ID NO: 327226 - RNA, 22 nt, Human
ccagggagcggggcugggucuc

SEQ ID NO: 327227 - RNA, 22 nt, Human
cugcagaguggagccucggcug

SEQ ID NO: 327228 - RNA, 22 nt, Human
gcugccucaggcaccuccuggc

SEQ ID NO: 327229 - RNA, 22 nt, Human
caccaggcugcccaggacaggg

SEQ ID NO: 327230 - RNA, 22 nt, Human
uccugaggagaagagugcuagg

SEQ ID NO: 327231 - RNA, 22 nt, Human
uccugagggcucggggcucaug

SEQ ID NO: 327232 - RNA, 21 nt, Human
gcaaaugaguuaacuaacuca

SEQ ID NO: 327233 - RNA, 22 nt, Human
cagcuccugcagcuggcuccca

SEQ ID NO: 327234 - RNA, 22 nt, Human
ggcaccagggcaagggucuuuc

SEQ ID NO: 327235 - RNA, 22 nt, Human
gagcugggaguuauagcauguu

SEQ ID NO: 327236 - RNA, 22 nt, Human
uccuguggcguuaucaugugau

SEQ ID NO: 327237 - RNA, 22 nt, Human
auaaaugauucagcaggaaaua

SEQ ID NO: 327238 - RNA, 19 nt, Human
auccuggguccuccagcug

SEQ ID NO: 327239 - RNA, 22 nt, Human
augcugggacguacuuguucau

SEQ ID NO: 327240 - RNA, 22 nt, Human
ugggcaccugaggccuggcagg

SEQ ID NO: 327241 - RNA, 22 nt, Human
cagggagcagcgcuggggccuc

SEQ ID NO: 327242 - RNA, 22 nt, Human
ugcuggggcucugaccacucca

SEQ ID NO: 327243 - RNA, 18 nt, Human
agcuggggccucuggucc

SEQ ID NO: 327244 - RNA, 16 nt, Human
ggcaccagugaacaca

SEQ ID NO: 327245 - RNA, 17 nt, Human
auguauauuaacucuga

SEQ ID NO: 327246 - RNA, 22 nt, Human
gaggccuggaccagccacagag

SEQ ID NO: 327247 - RNA, 22 nt, Human
cugcaggggcaguccacuuccu

SEQ ID NO: 327248 - RNA, 23 nt, Human
uggcaccaggcauucuaggggua

SEQ ID NO: 327249 - RNA, 22 nt, Human
agcccuguagauuuaggagagu

SEQ ID NO: 327250 - RNA, 20 nt, Human
ccuguggagcugccuccucc

SEQ ID NO: 327251 - RNA, 20 nt, Human
aggcuccuguaccugaggaa

SEQ ID NO: 327252 - RNA, 22 nt, Human
aaugauugucauuccaaaaagu

SEQ ID NO: 327253 - RNA, 22 nt, Human
ccugcaggcugcaggccaguuc

SEQ ID NO: 327254 - RNA, 17 nt, Human
agcccugugcucuuuuu

SEQ ID NO: 327255 - RNA, 22 nt, Human
ccuggagcuuuuccauccugga

SEQ ID NO: 327256 - RNA, 22 nt, Human
uagcuggggcuuucauucuugc

SEQ ID NO: 327257 - RNA, 22 nt, Human
caauacaauuaccaguuaauca

SEQ ID NO: 327258 - RNA, 22 nt, Human
agagcugggugaagugccauca

SEQ ID NO: 327259 - RNA, 20 nt, Human
ucccugccuuuuacugcugg

SEQ ID NO: 327260 - RNA, 22 nt, Human
gagcuggguauauggcuuuaug

SEQ ID NO: 327261 - RNA, 22 nt, Human
uccugcagagccgcccucaggu

SEQ ID NO: 327262 - RNA, 22 nt, Human
uuccugguaaauuauguccagg

SEQ ID NO: 327263 - RNA, 22 nt, Human
gcagagcucaugccugcaccuc

SEQ ID NO: 327264 - RNA, 22 nt, Human
gcaccaggcagcugagcaggcc

SEQ ID NO: 327265 - RNA, 22 nt, Human
cccugccccaggcggcuucacu

SEQ ID NO: 327266 - RNA, 22 nt, Human
acaacaaaaucacuagucuucc

SEQ ID NO: 327267 - RNA, 22 nt, Human
gcugggcucuuaucaccuguac

SEQ ID NO: 327268 - RNA, 22 nt, Human
gcugggaggaucucucccuguc

SEQ ID NO: 327269 - RNA, 22 nt, Human
ccuggugaauguucauggacug

SEQ ID NO: 327270 - RNA, 21 nt, Human
caggccccaggccuggggugc

SEQ ID NO: 327271 - RNA, 22 nt, Human
ccuggagcacauggcaggaggc

SEQ ID NO: 327272 - RNA, 22 nt, Human
aacuaaaucuggcauuuagagc

SEQ ID NO: 327273 - RNA, 22 nt, Human
ccuggggagagaaagcccagcc

SEQ ID NO: 327274 - RNA, 22 nt, Human
caggcucagcaggagccugacc

SEQ ID NO: 327275 - RNA, 22 nt, Human
ccuguggagcuuucagcagcuc

SEQ ID NO: 327276 - RNA, 22 nt, Human
ccuggguacccuuggcggccuu

SEQ ID NO: 327277 - RNA, 22 nt, Human
uagcuggguugaggucaucuac

SEQ ID NO: 327278 - RNA, 22 nt, Human
gcccugugccagucacgcugug

SEQ ID NO: 327279 - RNA, 23 nt, Human
ccagcccuccaccagcucuaggc

SEQ ID NO: 327280 - RNA, 22 nt, Human
cuccaggauguuagacguccag

SEQ ID NO: 327281 - RNA, 22 nt, Human
uauaaaugccaggacuuuagau

SEQ ID NO: 327282 - RNA, 18 nt, Human
ugcugggguagaauccac

SEQ ID NO: 327283 - RNA, 22 nt, Human
gagggcacucgagacuacggca

SEQ ID NO: 327284 - RNA, 22 nt, Human
cugucuccuccacugcauggga

SEQ ID NO: 327285 - RNA, 22 nt, Human
cagccccuuccuggcaucugga

SEQ ID NO: 327286 - RNA, 22 nt, Human
uccugcagagacagaggccuca

SEQ ID NO: 327287 - RNA, 22 nt, Human
gagggcacaaaggcaacauuca

SEQ ID NO: 327288 - RNA, 22 nt, Human
augcugggagugaagccccugg

SEQ ID NO: 327289 - RNA, 22 nt, Human
gagcugggcacacgccacuuga

SEQ ID NO: 327290 - RNA, 17 nt, Human
ggcagagcugacagggc

SEQ ID NO: 327291 - RNA, 22 nt, Human
ccuggcagcaggugggcccgug

SEQ ID NO: 327292 - RNA, 20 nt, Human
aagcuggguaggagaggagc

SEQ ID NO: 327293 - RNA, 22 nt, Human
agagcuggaaucagaccucagg

SEQ ID NO: 327294 - RNA, 22 nt, Human
cagagcuguccaaacccugaca

SEQ ID NO: 327295 - RNA, 22 nt, Human
agcuggggguagugagaaauaa

SEQ ID NO: 327296 - RNA, 23 nt, Human
uccuggugacaugccugagcauc

SEQ ID NO: 327297 - RNA, 22 nt, Human
cccugcagccuugcaugccuuc

SEQ ID NO: 327298 - RNA, 22 nt, Human
ggagcuggcagcgcaacccaga

SEQ ID NO: 327299 - RNA, 22 nt, Human
ggcauccugggacuggcuucuu

SEQ ID NO: 327300 - RNA, 21 nt, Human
cagagcuguccaaacccugac

SEQ ID NO: 327301 - RNA, 20 nt, Human
ugcuggggacauacagggug

SEQ ID NO: 327302 - RNA, 22 nt, Human
cagggagcucugggccggacuc

SEQ ID NO: 327303 - RNA, 22 nt, Human
cagcccucaaaccacuuccagg

SEQ ID NO: 327304 - RNA, 22 nt, Human
gagcuggggcagcuuaggagug

SEQ ID NO: 327305 - RNA, 19 nt, Human
cagccucaaucccucgggc

SEQ ID NO: 327306 - RNA, 20 nt, Human
cugggcucaagugauccucc

SEQ ID NO: 327307 - RNA, 22 nt, Human
uucaguaugauuccuccaguag

SEQ ID NO: 327308 - RNA, 22 nt, Human
cugggguuggccagggcccuag

SEQ ID NO: 327309 - RNA, 22 nt, Human
ggcaucccuagaauagccaggu

SEQ ID NO: 327310 - RNA, 21 nt, Human
gcagagcuggaaccaggaccc

SEQ ID NO: 327311 - RNA, 22 nt, Human
gcaugcugcaccagagccucuc

SEQ ID NO: 327312 - RNA, 22 nt, Human
uccugaggcuaaagugcagugg

SEQ ID NO: 327313 - RNA, 22 nt, Human
aaaaugauauccugacuuuuau

SEQ ID NO: 327314 - RNA, 18 nt, Human
ggagcugggccccacucc

SEQ ID NO: 327315 - RNA, 22 nt, Human
uccugcagccauuagaggucaa

SEQ ID NO: 327316 - RNA, 22 nt, Human
cagccccuuguccgguagccac

SEQ ID NO: 327317 - RNA, 22 nt, Human
ggagcuggccgccuaugugcag

SEQ ID NO: 327318 - RNA, 22 nt, Human
cugucuccagggcaggugcagg

SEQ ID NO: 327319 - RNA, 22 nt, Human
gagcugggacauggguccucuc

SEQ ID NO: 327320 - RNA, 22 nt, Human
cagaugcuuggaggacacuugg

SEQ ID NO: 327321 - RNA, 22 nt, Human
ugcugggcuggagcugccaggg

SEQ ID NO: 327322 - RNA, 19 nt, Human
agcuccuguucagcagcuc

SEQ ID NO: 327323 - RNA, 22 nt, Human
ccuggggucacuugcagccgca

SEQ ID NO: 327324 - RNA, 22 nt, Human
agagcuggcugugggugacuuu

SEQ ID NO: 327325 - RNA, 22 nt, Human
ccugucaggguuugccucagaa

SEQ ID NO: 327326 - RNA, 18 nt, Human
gcagagcugggauuccca

SEQ ID NO: 327327 - RNA, 22 nt, Human
gagcugggaggacugggaacuu

SEQ ID NO: 327328 - RNA, 20 nt, Human
agcccuguuuccuggagaga

SEQ ID NO: 327329 - RNA, 22 nt, Human
uccugaggcacaauccuagaau

SEQ ID NO: 327330 - RNA, 22 nt, Human
agagcugggugguggugacuca

SEQ ID NO: 327331 - RNA, 22 nt, Human
uccugcaggccagaggggugag

SEQ ID NO: 327332 - RNA, 22 nt, Human
agagcuggguggacuuguaguu

SEQ ID NO: 327333 - RNA, 22 nt, Human
ccagcccugaacccugcugcau

SEQ ID NO: 327334 - RNA, 22 nt, Human
cacagcugucagcugaccuagg

SEQ ID NO: 327335 - RNA, 22 nt, Human
gagcugggagcugggauuugga

SEQ ID NO: 327336 - RNA, 22 nt, Human
ggcaccagggacaauccucuuc

SEQ ID NO: 327337 - RNA, 22 nt, Human
cccgucccuuuugcccgcuggu

SEQ ID NO: 327338 - RNA, 22 nt, Human
uagcugggucucuguuuucuca

SEQ ID NO: 327339 - RNA, 22 nt, Human
cagggagcuggugccagccgac

SEQ ID NO: 327340 - RNA, 19 nt, Human
gggcuccuugggccucucu

SEQ ID NO: 327341 - RNA, 20 nt, Human
acaaaauagguacuggguag

SEQ ID NO: 327342 - RNA, 19 nt, Human
ccuggcccugcugcgcggg

SEQ ID NO: 327343 - RNA, 22 nt, Human
gcccugugcucaugggaacauc

SEQ ID NO: 327344 - RNA, 22 nt, Human
ucccagccuuccagucugguuu

SEQ ID NO: 327345 - RNA, 21 nt, Human
agagcugguagguagguaggu

SEQ ID NO: 327346 - RNA, 22 nt, Human
aggcccuggguuagggcccacu

SEQ ID NO: 327347 - RNA, 17 nt, Human
ccagggaggggccgcgc

SEQ ID NO: 327348 - RNA, 22 nt, Human
gcaccaggcuuagagccccagg

SEQ ID NO: 327349 - RNA, 22 nt, Human
ugagcuggggucagcuccccug

SEQ ID NO: 327350 - RNA, 22 nt, Human
agcuggggguuggauaagggua

SEQ ID NO: 327351 - RNA, 22 nt, Human
gauaauauuagaagauacaaau

SEQ ID NO: 327352 - RNA, 22 nt, Human
gucugggguacuuucaucugau

SEQ ID NO: 327353 - RNA, 22 nt, Human
ggaggccaccugaccugcuguu

SEQ ID NO: 327354 - RNA, 22 nt, Human
ggcaccagcaggcaccgaugcc

SEQ ID NO: 327355 - RNA, 22 nt, Human
uccacuggcccaccuccucagu

SEQ ID NO: 327356 - RNA, 22 nt, Human
ccucucccgggugccgcugggc

SEQ ID NO: 327357 - RNA, 22 nt, Human
ccuggagcaaaaaucuaaggag

SEQ ID NO: 327358 - RNA, 22 nt, Human
aacuaaaacugguuuguucucu

SEQ ID NO: 327359 - RNA, 22 nt, Human
uuuacugaacugcuaguacagg

SEQ ID NO: 327360 - RNA, 18 nt, Human
gagcugggagaaggaagg

SEQ ID NO: 327361 - RNA, 22 nt, Human
gagcugggacuuggaauccaca

SEQ ID NO: 327362 - RNA, 22 nt, Human
agagcuggagaugcagguuucg

SEQ ID NO: 327363 - RNA, 17 nt, Human
uggcacagaggugcuau

SEQ ID NO: 327364 - RNA, 22 nt, Human
cccucagcuccacccucagcag

SEQ ID NO: 327365 - RNA, 22 nt, Human
cagcccacugccucugugguag

SEQ ID NO: 327366 - RNA, 21 nt, Human
agaugcagugacccacugggg

SEQ ID NO: 327367 - RNA, 22 nt, Human
aaggggaguuagugauaaaacc

SEQ ID NO: 327368 - RNA, 22 nt, Human
cugaccaguccuuagcaccugg

SEQ ID NO: 327369 - RNA, 22 nt, Human
acaaacagaguugaaaaauagg

SEQ ID NO: 327370 - RNA, 22 nt, Human
caugcauuucuaccaaggaaua

SEQ ID NO: 327371 - RNA, 22 nt, Human
gcaccgagaaggaagcaugccu

SEQ ID NO: 327372 - RNA, 22 nt, Human
ugcuccaucuagagcucugcag

SEQ ID NO: 327373 - RNA, 22 nt, Human
cuggcccagguggucguugagg

SEQ ID NO: 327374 - RNA, 22 nt, Human
uugaguuuccugacagcgaagg

SEQ ID NO: 327375 - RNA, 22 nt, Human
gugccacugcacucuagccuag

SEQ ID NO: 327376 - RNA, 22 nt, Human
auuucagcagcccauguuugga

SEQ ID NO: 327377 - RNA, 22 nt, Human
acugauuucagggaugagaaga

SEQ ID NO: 327378 - RNA, 22 nt, Human
uuuucuuggaguggcuguccuu

SEQ ID NO: 327379 - RNA, 22 nt, Human
cuucucuuggguguggugucuu

SEQ ID NO: 327380 - RNA, 22 nt, Human
uauggcaagaugacauguucuc

SEQ ID NO: 327381 - RNA, 22 nt, Human
ucgggguagacgccagcucgga

SEQ ID NO: 327382 - RNA, 22 nt, Human
aagggugguguaggagaucaaa

SEQ ID NO: 327383 - RNA, 22 nt, Human
uuuguagauuuucucuccagua

SEQ ID NO: 327384 - RNA, 22 nt, Human
agaugcugccaggccccucagu

SEQ ID NO: 327385 - RNA, 22 nt, Human
agcugggcuggagcuccaagcg

SEQ ID NO: 327386 - RNA, 22 nt, Human
ggaggugacuggaucaugggca

SEQ ID NO: 327387 - RNA, 22 nt, Human
aagccagguguuuaggccagcg

SEQ ID NO: 327388 - RNA, 22 nt, Human
ggaagaggcugaggccaugcug

SEQ ID NO: 327389 - RNA, 22 nt, Human
ugugaggaccucagcagagucu

SEQ ID NO: 327390 - RNA, 22 nt, Human
uggcucugccccauaccccugc

SEQ ID NO: 327391 - RNA, 22 nt, Human
cccaggucgucagcaguguggu

SEQ ID NO: 327392 - RNA, 22 nt, Human
uccaggcugacgcagcuauuua

SEQ ID NO: 327393 - RNA, 22 nt, Human
uccucauucuuggugcaucaaa

SEQ ID NO: 327394 - RNA, 22 nt, Human
cucucuccuuagcugcagacca

SEQ ID NO: 327395 - RNA, 22 nt, Human
ugagccuggagucguggagggg

SEQ ID NO: 327396 - RNA, 22 nt, Human
agcucugcuucuugggaagaug

SEQ ID NO: 327397 - RNA, 23 nt, Human
gggcagcuuaagcuuguuuuucu

SEQ ID NO: 327398 - RNA, 22 nt, Human
agccagcuaccggggcuccugg

SEQ ID NO: 327399 - RNA, 22 nt, Human
ccucugcccuuuuccuguauca

SEQ ID NO: 327400 - RNA, 21 nt, Human
ugcuccaggagggggcagucc

SEQ ID NO: 327401 - RNA, 22 nt, Human
gcgcuccucccggcccuggugg

SEQ ID NO: 327402 - RNA, 21 nt, Human
agucuacaacuagggaagcug

SEQ ID NO: 327403 - RNA, 22 nt, Human
cucacagcugcuucaggaucca

SEQ ID NO: 327404 - RNA, 21 nt, Human
ccaugucagaugugggcugug

SEQ ID NO: 327405 - RNA, 19 nt, Human
ugggcagugccagggcuua

SEQ ID NO: 327406 - RNA, 22 nt, Human
ccuggcagaauauuaaagugca

SEQ ID NO: 327407 - RNA, 22 nt, Human
agcuccagggaaagaguggauc

SEQ ID NO: 327408 - RNA, 22 nt, Human
aacaucuagguucucaucgaua

SEQ ID NO: 327409 - RNA, 22 nt, Human
gggcagcaaaucugagucuggu

SEQ ID NO: 327410 - RNA, 22 nt, Human
gcuguccugggaacaggcacua

SEQ ID NO: 327411 - RNA, 22 nt, Human
uccagcuccugaguucacugcu

SEQ ID NO: 327412 - RNA, 22 nt, Human
cggcagagcccugagucagccu

SEQ ID NO: 327413 - RNA, 22 nt, Human
gcucugugccccugccguggac

SEQ ID NO: 327414 - RNA, 22 nt, Human
agcaguuuauccucauaaugga

SEQ ID NO: 327415 - RNA, 22 nt, Human
uucuggaguuugaagaucaggu

SEQ ID NO: 327416 - RNA, 22 nt, Human
uaaccaagcaaacuuucauugu

SEQ ID NO: 327417 - RNA, 22 nt, Human
guccaggccugccucugaggag

SEQ ID NO: 327418 - RNA, 22 nt, Human
gcaagcagcccagaacagcucu

SEQ ID NO: 327419 - RNA, 22 nt, Human
uugauggacagggaccacuguc

SEQ ID NO: 327420 - RNA, 17 nt, Human
ggccugcaccuccugcu

SEQ ID NO: 327421 - RNA, 22 nt, Human
cugucaaauggaaacuuauccu

SEQ ID NO: 327422 - RNA, 22 nt, Human
gguuguaguuggagguuguaua

SEQ ID NO: 327423 - RNA, 22 nt, Human
ccacucaggagcuuaucuaugc

SEQ ID NO: 327424 - RNA, 22 nt, Human
aaauugcuugagauuagucucc

SEQ ID NO: 327425 - RNA, 22 nt, Human
ccaggcauccauugcuuccucu

SEQ ID NO: 327426 - RNA, 23 nt, Human
gguucugccgcuuacugcugugc

SEQ ID NO: 327427 - RNA, 22 nt, Human
aagcagaaaaacugagcuccaa

SEQ ID NO: 327428 - RNA, 22 nt, Human
cagcugcucugguggucucucc

SEQ ID NO: 327429 - RNA, 22 nt, Human
gggauaagagaguauuuaugca

SEQ ID NO: 327430 - RNA, 22 nt, Human
aaucuucaggguccuggggcuc

SEQ ID NO: 327431 - RNA, 22 nt, Human
auccaggcgaaugcagaaggcc

SEQ ID NO: 327432 - RNA, 17 nt, Human
gagguaggaagugaguc

SEQ ID NO: 327433 - RNA, 22 nt, Human
cuccaggacugaggacagagcu

SEQ ID NO: 327434 - RNA, 22 nt, Human
ggaccugcucucccaguucucu

SEQ ID NO: 327435 - RNA, 22 nt, Human
cagggcucacucggcuggcguc

SEQ ID NO: 327436 - RNA, 22 nt, Human
cucuggcaauugcugcugacuc

SEQ ID NO: 327437 - RNA, 22 nt, Human
aaagcugcaagcuccugaggaa

SEQ ID NO: 327438 - RNA, 22 nt, Human
agcuauggguguggguuccauu

SEQ ID NO: 327439 - RNA, 22 nt, Human
uuggaaagggauaucuguacuu

SEQ ID NO: 327440 - RNA, 20 nt, Human
ucacuguaauugccuacauu

SEQ ID NO: 327441 - RNA, 22 nt, Human
ggcugagcuuuucaugaugguu

SEQ ID NO: 327442 - RNA, 22 nt, Human
ugagaugaagugauguaaaaca

SEQ ID NO: 327443 - RNA, 22 nt, Human
uucagaagguaggaaugucccu

SEQ ID NO: 327444 - RNA, 22 nt, Human
gcaugcaggaagggcuugggga

SEQ ID NO: 327445 - RNA, 22 nt, Human
caguuuuucaaaauuacaugau

SEQ ID NO: 327446 - RNA, 22 nt, Human
agacacauuuucagcucugcca

SEQ ID NO: 327447 - RNA, 22 nt, Human
gcuggccugaccugaggcuggg

SEQ ID NO: 327448 - RNA, 23 nt, Human
agcaacagugggugaguguugcu

SEQ ID NO: 327449 - RNA, 22 nt, Human
ccaagcuggacagcagcaagga

SEQ ID NO: 327450 - RNA, 22 nt, Human
caagccaggaaggauccagcac

SEQ ID NO: 327451 - RNA, 22 nt, Human
cccuggaacccauggccagugu

SEQ ID NO: 327452 - RNA, 22 nt, Human
gcuggccugcgagggcaggcug

SEQ ID NO: 327453 - RNA, 22 nt, Human
gcgagucgccgcugcagcccua

SEQ ID NO: 327454 - RNA, 22 nt, Human
uuguagucuaggauagauuuuu

SEQ ID NO: 327455 - RNA, 22 nt, Human
agugaauuagccuauuuguaaa

SEQ ID NO: 327456 - RNA, 22 nt, Human
ucaaaggcuugugguucuggga

SEQ ID NO: 327457 - RNA, 22 nt, Human
ucuuucagaaacuuugucugcg

SEQ ID NO: 327458 - RNA, 22 nt, Human
ucuccaggcuuaaucucagcuu

SEQ ID NO: 327459 - RNA, 22 nt, Human
ucagucucuggggcuucuguuu

SEQ ID NO: 327460 - RNA, 22 nt, Human
ccagcagcgauagggugagugc

SEQ ID NO: 327461 - RNA, 22 nt, Human
cuugggcuuagaagguaaguga

SEQ ID NO: 327462 - RNA, 19 nt, Human
ugcuugccugccuuuccca

SEQ ID NO: 327463 - RNA, 22 nt, Human
gugagcugggugaaugguaggg

SEQ ID NO: 327464 - RNA, 22 nt, Human
caaugcacauggacaucaggcu

SEQ ID NO: 327465 - RNA, 22 nt, Human
ugccuguggaaaggcuggugcu

SEQ ID NO: 327466 - RNA, 22 nt, Human
guugaguguugugcaugcacca

SEQ ID NO: 327467 - RNA, 22 nt, Human
agugggaauuuucucccaggga

SEQ ID NO: 327468 - RNA, 22 nt, Human
cgugcggccucggggcccggcu

SEQ ID NO: 327469 - RNA, 22 nt, Human
aggggcacgaguagagcucuag

SEQ ID NO: 327470 - RNA, 22 nt, Human
aguggcaguagaugagcugguu

SEQ ID NO: 327471 - RNA, 22 nt, Human
guugguccuuugagcaagaucc

SEQ ID NO: 327472 - RNA, 22 nt, Human
agggaggucuggcugcccugag

SEQ ID NO: 327473 - RNA, 22 nt, Human
uccagcugugcuccaggaggug

SEQ ID NO: 327474 - RNA, 22 nt, Human
ggacauggaaguauggagugga

SEQ ID NO: 327475 - RNA, 22 nt, Human
ggagcagggaauuacagcgcag

SEQ ID NO: 327476 - RNA, 22 nt, Human
ggucccugcccaaagcccuugg

SEQ ID NO: 327477 - RNA, 22 nt, Human
gucaucaucaggcagaugcugc

SEQ ID NO: 327478 - RNA, 19 nt, Human
cucugccucuggcuguggc

SEQ ID NO: 327479 - RNA, 23 nt, Human
aggcagguuugggcucuucuugu

SEQ ID NO: 327480 - RNA, 22 nt, Human
auggacagcucuuaugugggca

SEQ ID NO: 327481 - RNA, 22 nt, Human
aaugguaauauuucauaguugu

SEQ ID NO: 327482 - RNA, 22 nt, Human
uccaaggacauuguucuaguug

SEQ ID NO: 327483 - RNA, 22 nt, Human
cugggaggcccacguugggaag

SEQ ID NO: 327484 - RNA, 22 nt, Human
gggcggggcuuccguccuccac

SEQ ID NO: 327485 - RNA, 22 nt, Human
ucccagauuccugcucuuauau

SEQ ID NO: 327486 - RNA, 22 nt, Human
acacggcacuuuaggaaggggc

SEQ ID NO: 327487 - RNA, 21 nt, Human
cugcacugugauuuaaaaugu

SEQ ID NO: 327488 - RNA, 22 nt, Human
cccugcacagccuggcucucuu

SEQ ID NO: 327489 - RNA, 20 nt, Human
ggcagcaaccauaugcuaca

SEQ ID NO: 327490 - RNA, 22 nt, Human
cagugcugcaggcgccugcggu

SEQ ID NO: 327491 - RNA, 22 nt, Human
cgcgcugcagacagcggaggcc

SEQ ID NO: 327492 - RNA, 22 nt, Human
uguccuuaucuccaaacaauca

SEQ ID NO: 327493 - RNA, 22 nt, Human
aagaagguugaaugacuacuuu

SEQ ID NO: 327494 - RNA, 22 nt, Human
aucauuaacccuugaugcuggg

SEQ ID NO: 327495 - RNA, 23 nt, Human
aucuguguguggguagggaugau

SEQ ID NO: 327496 - RNA, 22 nt, Human
agaagugaguugugacuauggg

SEQ ID NO: 327497 - RNA, 22 nt, Human
ggaaugugcugacacgcgagag

SEQ ID NO: 327498 - RNA, 22 nt, Human
gcagagcugucuaagucacuuc

SEQ ID NO: 327499 - RNA, 22 nt, Human
uccaggagugauaaggccacug

SEQ ID NO: 327500 - RNA, 22 nt, Human
ucuccuggcauuugguugagua

SEQ ID NO: 327501 - RNA, 20 nt, Human
cugcuccacccggcucucag

SEQ ID NO: 327502 - RNA, 22 nt, Human
agcuggugugccaguuccaguu

SEQ ID NO: 327503 - RNA, 22 nt, Human
auggaggaugugcagcaugggc

SEQ ID NO: 327504 - RNA, 22 nt, Human
gcggcccgagcaggacgggugg

SEQ ID NO: 327505 - RNA, 22 nt, Human
agcugucuaccugcagaguccu

SEQ ID NO: 327506 - RNA, 22 nt, Human
aggcaguggcuuuuguuguguu

SEQ ID NO: 327507 - RNA, 22 nt, Human
uuagccaugcccuagaagagga

SEQ ID NO: 327508 - RNA, 22 nt, Human
uggaaagaggaagugcccagca

SEQ ID NO: 327509 - RNA, 22 nt, Human
ugcugcuuguuuuguaaauaaa

SEQ ID NO: 327510 - RNA, 22 nt, Human
ucaccgccuugcccggccgggc

SEQ ID NO: 327511 - RNA, 22 nt, Human
ucaaagcacuggggaaagccug

SEQ ID NO: 327512 - RNA, 22 nt, Human
ugcuggaagggucggcgugggc

SEQ ID NO: 327513 - RNA, 22 nt, Human
cagagccuuaguucuccuagaa

SEQ ID NO: 327514 - RNA, 18 nt, Human
gccuggcuucggagccgc

SEQ ID NO: 327515 - RNA, 19 nt, Human
aggugaugugacucuagaa

SEQ ID NO: 327516 - RNA, 22 nt, Human
uccuccuuuccccgcuggagcc

SEQ ID NO: 327517 - RNA, 22 nt, Human
acccugccucugcuuccuguag

SEQ ID NO: 327518 - RNA, 22 nt, Human
ccucuucuaggacguccuugug

SEQ ID NO: 327519 - RNA, 21 nt, Human
ugucagcaacaauacuuucuc

SEQ ID NO: 327520 - RNA, 22 nt, Human
cugccaggauucugugaacccc

SEQ ID NO: 327521 - RNA, 22 nt, Human
ugccgcugucgccaccauggcu

SEQ ID NO: 327522 - RNA, 22 nt, Human
uugagcagaucgggcugugggg

SEQ ID NO: 327523 - RNA, 22 nt, Human
uucagcacuggacagcgagucu

SEQ ID NO: 327524 - RNA, 22 nt, Human
uucagguuuuuaaguucugccu

SEQ ID NO: 327525 - RNA, 22 nt, Human
ccaggcaaagcccaugcaagag

SEQ ID NO: 327526 - RNA, 22 nt, Human
cucuggagggaggcugagcugg

SEQ ID NO: 327527 - RNA, 22 nt, Human
gacggggcagccagcugguggc

SEQ ID NO: 327528 - RNA, 22 nt, Human
cagcuccccucuguggggcagu

SEQ ID NO: 327529 - RNA, 22 nt, Human
gcggggggcagcagucgcucag

SEQ ID NO: 327530 - RNA, 22 nt, Human
uggauguuugaaguugcaugug

SEQ ID NO: 327531 - RNA, 22 nt, Human
ggggcccagcaccccuccucgc

SEQ ID NO: 327532 - RNA, 22 nt, Human
auuggccagacuuauccuucag

SEQ ID NO: 327533 - RNA, 20 nt, Human
ggccggggagcucuccaggg

SEQ ID NO: 327534 - RNA, 22 nt, Human
augcugccuccucuucagccgc

SEQ ID NO: 327535 - RNA, 22 nt, Human
gugccuccaggcucgacuaguc

SEQ ID NO: 327536 - RNA, 22 nt, Human
gggcuuuaggggccagugacca

SEQ ID NO: 327537 - RNA, 22 nt, Human
uguggugccgagagucuggacg

SEQ ID NO: 327538 - RNA, 22 nt, Human
cugcgggcugucaggcgugcca

SEQ ID NO: 327539 - RNA, 22 nt, Human
caggguggaacaggcaauacuu

SEQ ID NO: 327540 - RNA, 22 nt, Human
agcuggguacacguugucacaa

SEQ ID NO: 327541 - RNA, 22 nt, Human
uuccuguucaggaaaguugugu

SEQ ID NO: 327542 - RNA, 22 nt, Human
cagagcugacccaaggauugaa

SEQ ID NO: 327543 - RNA, 22 nt, Human
uuugacaugugcuuauaacuuu

SEQ ID NO: 327544 - RNA, 22 nt, Human
cccaggcuggggcuccuccagc

SEQ ID NO: 327545 - RNA, 22 nt, Human
cccagccuuugcuuccugguuc

SEQ ID NO: 327546 - RNA, 22 nt, Human
ugggcaaaugcuuuuuagucaa

SEQ ID NO: 327547 - RNA, 22 nt, Human
aggagcagaacuguuguggagg

SEQ ID NO: 327548 - RNA, 22 nt, Human
ucaguaaaugagcaaaaauuuc

SEQ ID NO: 327549 - RNA, 19 nt, Human
ucuuucauuucuagcucug

SEQ ID NO: 327550 - RNA, 20 nt, Human
auuugcuuaccuuguuucua

SEQ ID NO: 327551 - RNA, 22 nt, Human
aggggcagccucacaauccucu

SEQ ID NO: 327552 - RNA, 22 nt, Human
gccagagggauuccuggugugu

SEQ ID NO: 327553 - RNA, 22 nt, Human
ugcugugcuggcggcagaggcc

SEQ ID NO: 327554 - RNA, 22 nt, Human
ugugacguuguucuggauuccc

SEQ ID NO: 327555 - RNA, 21 nt, Human
gcccacagugaggaggauccc

SEQ ID NO: 327556 - RNA, 22 nt, Human
cugggaguugacgaggcuugua

SEQ ID NO: 327557 - RNA, 22 nt, Human
agcaggccugccaccucggggu

SEQ ID NO: 327558 - RNA, 22 nt, Human
gcgcugccucugcucuccccac

SEQ ID NO: 327559 - RNA, 22 nt, Human
cuccaggacaugacuuucuugc

SEQ ID NO: 327560 - RNA, 22 nt, Human
agcauggcuuuggaggauagca

SEQ ID NO: 327561 - RNA, 22 nt, Human
ugugcccuccugccaggggcug

SEQ ID NO: 327562 - RNA, 20 nt, Human
ucucuggcaagaagcugcag

SEQ ID NO: 327563 - RNA, 22 nt, Human
gugugcgccgacacagccaggu

SEQ ID NO: 327564 - RNA, 22 nt, Human
ccaguucuuucugugugcaaca

SEQ ID NO: 327565 - RNA, 22 nt, Human
ucggugcgcgaggcgcgguccc

SEQ ID NO: 327566 - RNA, 22 nt, Human
uagaagaacaugucaaacuaua

SEQ ID NO: 327567 - RNA, 22 nt, Human
gccucugcacuguggcacacca

SEQ ID NO: 327568 - RNA, 18 nt, Human
ucugaaggaaugauucca

SEQ ID NO: 327569 - RNA, 22 nt, Human
acagcuggccgaggcucaggga

SEQ ID NO: 327570 - RNA, 21 nt, Human
gucuuuuuaauugcgauuucc

SEQ ID NO: 327571 - RNA, 22 nt, Human
ucuguggcauguugcacuugua

SEQ ID NO: 327572 - RNA, 22 nt, Human
aagcccucagagccucuuugac

SEQ ID NO: 327573 - RNA, 22 nt, Human
agcgcuugccgcacuccaagca

SEQ ID NO: 327574 - RNA, 22 nt, Human
ugggguccucucacuuggaggg

SEQ ID NO: 327575 - RNA, 22 nt, Human
gccugccuucggugcgcagcgg

SEQ ID NO: 327576 - RNA, 22 nt, Human
caaggcuaagcuuuggcuuucu

SEQ ID NO: 327577 - RNA, 22 nt, Human
uagcugggacuacuggcccugc

SEQ ID NO: 327578 - RNA, 22 nt, Human
gccaaaguccuccagccaugca

SEQ ID NO: 327579 - RNA, 22 nt, Human
cugcaucacagcaggaggcaca

SEQ ID NO: 327580 - RNA, 22 nt, Human
ugcuucucucuaggaagacgcu

SEQ ID NO: 327581 - RNA, 22 nt, Human
ucugcacccugugguccucuag

SEQ ID NO: 327582 - RNA, 22 nt, Human
gcucagagauguucaguagcuu

SEQ ID NO: 327583 - RNA, 22 nt, Human
ggccuuggaguccuccacugga

SEQ ID NO: 327584 - RNA, 22 nt, Human
aggggaauggguagacuguuga

SEQ ID NO: 327585 - RNA, 22 nt, Human
ugucccuggacuccaggagcca

SEQ ID NO: 327586 - RNA, 22 nt, Human
cucgccccggcacaguguccgu

SEQ ID NO: 327587 - RNA, 22 nt, Human
uccagguccuacuggcccauag

SEQ ID NO: 327588 - RNA, 22 nt, Human
agcaggaggagagccuggcggu

SEQ ID NO: 327589 - RNA, 22 nt, Human
ggccccagggauuaggccaacc

SEQ ID NO: 327590 - RNA, 22 nt, Human
cccaggaggcagaaguugcagu

SEQ ID NO: 327591 - RNA, 17 nt, Human
ucuccuggcucuaucag

SEQ ID NO: 327592 - RNA, 22 nt, Human
ccaggugugcucugcaguggau

SEQ ID NO: 327593 - RNA, 22 nt, Human
agacgcgguggugcaugccugu

SEQ ID NO: 327594 - RNA, 22 nt, Human
cugacucccaaagaggacgcgu

SEQ ID NO: 327595 - RNA, 22 nt, Human
uuugacaacugugcaguuugua

SEQ ID NO: 327596 - RNA, 22 nt, Human
agcuccacucccugccuguuuc

SEQ ID NO: 327597 - RNA, 22 nt, Human
aucucccaaauuagccucuuga

SEQ ID NO: 327598 - RNA, 22 nt, Human
cagccggaccugagggauuccu

SEQ ID NO: 327599 - RNA, 22 nt, Human
ggcaguggugggaggcucgcuc

SEQ ID NO: 327600 - RNA, 22 nt, Human
gcuucugcagagccguccugag

SEQ ID NO: 327601 - RNA, 22 nt, Human
gcagaggggaagcugaggaauu

SEQ ID NO: 327602 - RNA, 22 nt, Human
cuugucuaguuccuggugaugu

SEQ ID NO: 327603 - RNA, 22 nt, Human
caccugagcaacccugugcggg

SEQ ID NO: 327604 - RNA, 22 nt, Human
ucaaaaugccgagugcccaggu

SEQ ID NO: 327605 - RNA, 21 nt, Human
acuguauuguuuucaaggauc

SEQ ID NO: 327606 - RNA, 22 nt, Human
aggguugaagucugguccucau

SEQ ID NO: 327607 - RNA, 22 nt, Human
gagcugcagcggcugacgcaac

SEQ ID NO: 327608 - RNA, 20 nt, Human
gggugugggcccggccaggc

SEQ ID NO: 327609 - RNA, 22 nt, Human
aggcucccaagcacugacccca

SEQ ID NO: 327610 - RNA, 20 nt, Human
aggaaggagaaucugagcaa

SEQ ID NO: 327611 - RNA, 20 nt, Human
gcuccccuucucugggccuc

SEQ ID NO: 327612 - RNA, 22 nt, Human
uacaguaaccagucuacuuaga

SEQ ID NO: 327613 - RNA, 22 nt, Human
agcaaggcagcuuucacugcuu

SEQ ID NO: 327614 - RNA, 23 nt, Human
cuguuauauggguguuaugugcu

SEQ ID NO: 327615 - RNA, 22 nt, Human
ggggaagaaauagaacauuuug

SEQ ID NO: 327616 - RNA, 22 nt, Human
gcacguguucuguggcaugggu

SEQ ID NO: 327617 - RNA, 22 nt, Human
guaaacugaauuggauacugug

SEQ ID NO: 327618 - RNA, 22 nt, Human
cucagcaacccacacacggucu

SEQ ID NO: 327619 - RNA, 22 nt, Human
uaagucauagauuaauggccac

SEQ ID NO: 327620 - RNA, 22 nt, Human
ugugcccuguuaaaugcacagu

SEQ ID NO: 327621 - RNA, 22 nt, Human
uccuggguccauggcagccgaa

SEQ ID NO: 327622 - RNA, 22 nt, Human
uaguggggaaggaggacaagaa

SEQ ID NO: 327623 - RNA, 22 nt, Human
cucaggaaaauauugaagaagu

SEQ ID NO: 327624 - RNA, 22 nt, Human
cugggcuccuaaccauccaggu

SEQ ID NO: 327625 - RNA, 22 nt, Human
ucccaggauguuuauggcuggu

SEQ ID NO: 327626 - RNA, 22 nt, Human
ugcugcucuucaccauggccuc

SEQ ID NO: 327627 - RNA, 22 nt, Human
cagagcagcagagcuuccaugg

SEQ ID NO: 327628 - RNA, 22 nt, Human
cuuccucuguggccagagugua

SEQ ID NO: 327629 - RNA, 22 nt, Human
uggcugaggcacagcugccgcc

SEQ ID NO: 327630 - RNA, 22 nt, Human
uugcaguugcuguauuuaagga

SEQ ID NO: 327631 - RNA, 22 nt, Human
ggagaagggaacugaguuuuug

SEQ ID NO: 327632 - RNA, 18 nt, Human
agcugaggggacugaaga

SEQ ID NO: 327633 - RNA, 22 nt, Human
cugggaggcagucucucuagaa

SEQ ID NO: 327634 - RNA, 20 nt, Human
ccuggagccuggaaggaguc

SEQ ID NO: 327635 - RNA, 22 nt, Human
uccaaggucagcgagagucacu

SEQ ID NO: 327636 - RNA, 22 nt, Human
ugugcugcucucagugacagcc

SEQ ID NO: 327637 - RNA, 22 nt, Human
gaagcgcggcgucggcgugggu

SEQ ID NO: 327638 - RNA, 19 nt, Human
uuuaaugugugcugcaauc

SEQ ID NO: 327639 - RNA, 22 nt, Human
uaaaaucaugacagauugacau

SEQ ID NO: 327640 - RNA, 22 nt, Human
gauugcugccagcguguccgug

SEQ ID NO: 327641 - RNA, 22 nt, Human
ccaggagaaugggauuacccua

SEQ ID NO: 327642 - RNA, 22 nt, Human
uuccuggggacuuaccgucauu

SEQ ID NO: 327643 - RNA, 22 nt, Human
ggcucugcugguaagaugccuc

SEQ ID NO: 327644 - RNA, 22 nt, Human
ccucagucuauuuccagcaggu

SEQ ID NO: 327645 - RNA, 22 nt, Human
agugggagcggcagucggggac

SEQ ID NO: 327646 - RNA, 17 nt, Human
ugggggcccuguguaga

SEQ ID NO: 327647 - RNA, 22 nt, Human
auggccagcaagguagggcaau

SEQ ID NO: 327648 - RNA, 22 nt, Human
ugugagauuuuauuugauaugc

SEQ ID NO: 327649 - RNA, 22 nt, Human
aaguuugucucauuugaucuuc

SEQ ID NO: 327650 - RNA, 22 nt, Human
agccccaguccgcugcgggcgg

SEQ ID NO: 327651 - RNA, 22 nt, Human
acuuuuaaggggccuugauuua

SEQ ID NO: 327652 - RNA, 22 nt, Human
ugggcaaggcuggagccugcag

SEQ ID NO: 327653 - RNA, 22 nt, Human
guauuucuuuacauaugcucau

SEQ ID NO: 327654 - RNA, 22 nt, Human
uccagagaacgaugaaagcugg

SEQ ID NO: 327655 - RNA, 22 nt, Human
gcagcccaggcucgcucacugc

SEQ ID NO: 327656 - RNA, 22 nt, Human
caucugcaggggaagccaguuu

SEQ ID NO: 327657 - RNA, 22 nt, Human
cugcccugcagcuccacggacu

SEQ ID NO: 327658 - RNA, 22 nt, Human
cugcggcuggggacagcuguug

SEQ ID NO: 327659 - RNA, 22 nt, Human
caguguuuagcacagugcuugg

SEQ ID NO: 327660 - RNA, 22 nt, Human
uggaagguguggcaggucuagu

SEQ ID NO: 327661 - RNA, 22 nt, Human
gaggcugugugucccucuggac

SEQ ID NO: 327662 - RNA, 22 nt, Human
ucugcgcccugucgccugcucc

SEQ ID NO: 327663 - RNA, 22 nt, Human
ggugcccaaggaagguugccgu

SEQ ID NO: 327664 - RNA, 22 nt, Human
uguguuucugagaaucccaccu

SEQ ID NO: 327665 - RNA, 22 nt, Human
ccucguccacaauccuugcaca

SEQ ID NO: 327666 - RNA, 22 nt, Human
uuuuuggguccaggcuguaucu

SEQ ID NO: 327667 - RNA, 22 nt, Human
ucugcuguuuacugugugauau

SEQ ID NO: 327668 - RNA, 20 nt, Human
uucaugcagugguugcugug

SEQ ID NO: 327669 - RNA, 22 nt, Human
gacagcagccacagggagaggg

SEQ ID NO: 327670 - RNA, 22 nt, Human
ucccuggcacaagaaggcuguc

SEQ ID NO: 327671 - RNA, 22 nt, Human
ucagccagaggcuucuugguuu

SEQ ID NO: 327672 - RNA, 22 nt, Human
uuuggagagaugaaguucugug

SEQ ID NO: 327673 - RNA, 22 nt, Human
cuguccauggcaaugaugcaga

SEQ ID NO: 327674 - RNA, 22 nt, Human
uccgcgcucucacccgcucccg

SEQ ID NO: 327675 - RNA, 22 nt, Human
agcuaguauuucauugaggauu

SEQ ID NO: 327676 - RNA, 22 nt, Human
gcugcaggcucugcaggaauug

SEQ ID NO: 327677 - RNA, 22 nt, Human
cugggaggcggagguuguagug

SEQ ID NO: 327678 - RNA, 22 nt, Human
aacccuggggcugcucugccug

SEQ ID NO: 327679 - RNA, 22 nt, Human
cagggagcuggugccagccgac

SEQ ID NO: 327680 - RNA, 22 nt, Human
gccuguuucuccuccuuggccc

SEQ ID NO: 327681 - RNA, 22 nt, Human
gggcagcaucaggaggggcuuu

SEQ ID NO: 327682 - RNA, 22 nt, Human
ugggcacacugaaucugcuauu

SEQ ID NO: 327683 - RNA, 22 nt, Human
uuuuuugucuugaagaaauggu

SEQ ID NO: 327684 - RNA, 22 nt, Human
cuuggcauguucaucugcuugg

SEQ ID NO: 327685 - RNA, 19 nt, Human
uggugcgcuguuccugagc

SEQ ID NO: 327686 - RNA, 22 nt, Human
aauggcugccagggcaggaggu

SEQ ID NO: 327687 - RNA, 22 nt, Human
aggggagccagggcugcgaguu

SEQ ID NO: 327688 - RNA, 22 nt, Human
caagggcagaggcagggccccg

SEQ ID NO: 327689 - RNA, 22 nt, Human
gaggugaguggggucuccaggg

SEQ ID NO: 327690 - RNA, 22 nt, Human
uggcccaggugcacccagaggc

SEQ ID NO: 327691 - RNA, 22 nt, Human
ggggugaagguuuucugaaagc

SEQ ID NO: 327692 - RNA, 22 nt, Human
ucugcucagccgaucugcuccg

SEQ ID NO: 327693 - RNA, 19 nt, Human
cuucuggauccgcagggcc

SEQ ID NO: 327694 - RNA, 18 nt, Human
gcugaaauucuaaacaaa

SEQ ID NO: 327695 - RNA, 22 nt, Human
auacaugugugugcauacaugu

SEQ ID NO: 327696 - RNA, 22 nt, Human
gggagaguagcuggaagguucu

SEQ ID NO: 327697 - RNA, 22 nt, Human
uucaacaacuugguucaaaugg

SEQ ID NO: 327698 - RNA, 22 nt, Human
uuucuuggucuucccgaccugg

SEQ ID NO: 327699 - RNA, 22 nt, Human
cuccacagccccuccaguggca

SEQ ID NO: 327700 - RNA, 22 nt, Human
ccuggguccaauucuggcuugu

SEQ ID NO: 327701 - RNA, 22 nt, Human
uucuuggcacagaugagauucu

SEQ ID NO: 327702 - RNA, 22 nt, Human
caaugggccuggagagagcugg

SEQ ID NO: 327703 - RNA, 22 nt, Human
agccacccuaccagcccugaaa

SEQ ID NO: 327704 - RNA, 22 nt, Human
uugcuucacuacuucuaggcuc

SEQ ID NO: 327705 - RNA, 20 nt, Human
ugcuggaggcgccggcgcuc

SEQ ID NO: 327706 - RNA, 22 nt, Human
cucagcaacagcgacuuaaggg

SEQ ID NO: 327707 - RNA, 19 nt, Human
agcagagcagggccguggg

SEQ ID NO: 327708 - RNA, 22 nt, Human
aguccagggcuuagucagcggg

SEQ ID NO: 327709 - RNA, 22 nt, Human
uuaagagaagaguaucuagaac

SEQ ID NO: 327710 - RNA, 20 nt, Human
uggcccagcacgacgaggac

SEQ ID NO: 327711 - RNA, 22 nt, Human
cagaaccaggaacugauggaga

SEQ ID NO: 327712 - RNA, 22 nt, Human
caguauuucauucagaauuguu

SEQ ID NO: 327713 - RNA, 22 nt, Human
aggaagagcuggaccagaggac

SEQ ID NO: 327714 - RNA, 22 nt, Human
gcagcagcggggccccugcgcg

SEQ ID NO: 327715 - RNA, 21 nt, Human
agcaucugaggcaguuuccua

SEQ ID NO: 327716 - RNA, 22 nt, Human
aggccugggacgggagccguga

SEQ ID NO: 327717 - RNA, 22 nt, Human
aaggcuguuugagcacuggagc

SEQ ID NO: 327718 - RNA, 20 nt, Human
auuagcuuggagacaguggc

SEQ ID NO: 327719 - RNA, 21 nt, Human
gcucuguguuacaaguugggg

SEQ ID NO: 327720 - RNA, 23 nt, Human
agcccagcagagaaccuaggucc

SEQ ID NO: 327721 - RNA, 22 nt, Human
uccacccugcuuuugucuuuga

SEQ ID NO: 327722 - RNA, 22 nt, Human
agccugugcuguguuugcucca

SEQ ID NO: 327723 - RNA, 22 nt, Human
gcaccagccugagccucuugca

SEQ ID NO: 327724 - RNA, 22 nt, Human
uggaaauaguugugagucaggc

SEQ ID NO: 327725 - RNA, 22 nt, Human
cccaccacgugcuuugcuggag

SEQ ID NO: 327726 - RNA, 22 nt, Human
acucacagggccucaguuuucc

SEQ ID NO: 327727 - RNA, 22 nt, Human
gccuggaaugcaaugugacgaa

SEQ ID NO: 327728 - RNA, 22 nt, Human
uucucugguuugcuguuucuga

SEQ ID NO: 327729 - RNA, 22 nt, Human
cucaggcuaagaaggccaagug

SEQ ID NO: 327730 - RNA, 19 nt, Human
gcuuccagcacugcaggag

SEQ ID NO: 327731 - RNA, 22 nt, Human
cuucuccgacaaccgacgccgg

SEQ ID NO: 327732 - RNA, 22 nt, Human
agcuccugaaaagcgcuugcuu

SEQ ID NO: 327733 - RNA, 22 nt, Human
gguccagcacaacacuggcaug

SEQ ID NO: 327734 - RNA, 22 nt, Human
gcagcugcgaagaagucuaucu

SEQ ID NO: 327735 - RNA, 22 nt, Human
augaggagucaaggagucggag

SEQ ID NO: 327736 - RNA, 21 nt, Human
ucugugcuuuuuuggcuccua

SEQ ID NO: 327737 - RNA, 19 nt, Human
uggcagcauugguaccuug

SEQ ID NO: 327738 - RNA, 22 nt, Human
ggaagccaguugcuuggugugg

SEQ ID NO: 327739 - RNA, 22 nt, Human
cugguuuuccaauguuuugacu

SEQ ID NO: 327740 - RNA, 22 nt, Human
caguuuuacccaagcuuauuuu

SEQ ID NO: 327741 - RNA, 22 nt, Human
acccggagucggagguugcagu

SEQ ID NO: 327742 - RNA, 22 nt, Human
gccauguucuugaaucuggguc

SEQ ID NO: 327743 - RNA, 22 nt, Human
ccuccccacagcccaggagacu

SEQ ID NO: 327744 - RNA, 22 nt, Human
aggugacaucccggcagcagag

SEQ ID NO: 327745 - RNA, 22 nt, Human
aucuaugugggaaucauaauag

SEQ ID NO: 327746 - RNA, 22 nt, Human
cuccuuaaagggagcagcagcu

SEQ ID NO: 327747 - RNA, 22 nt, Human
uagaaaagccccagcuggaggg

SEQ ID NO: 327748 - RNA, 22 nt, Human
cccccagcucugcugggucccg

SEQ ID NO: 327749 - RNA, 20 nt, Human
uccagccacuuccgcugguc

SEQ ID NO: 327750 - RNA, 22 nt, Human
agccacauggaccugaugcuag

SEQ ID NO: 327751 - RNA, 22 nt, Human
gcccagcugagaagcgcggggc

SEQ ID NO: 327752 - RNA, 22 nt, Human
uguguuucucugaggggucccu

SEQ ID NO: 327753 - RNA, 22 nt, Human
ggccgugcuccaaagucaucgu

SEQ ID NO: 327754 - RNA, 22 nt, Human
ucuggaaggggaucugugguca

SEQ ID NO: 327755 - RNA, 19 nt, Human
ugccuggcaccagcuccac

SEQ ID NO: 327756 - RNA, 22 nt, Human
gcugucucauacaaggcccugc

SEQ ID NO: 327757 - RNA, 20 nt, Human
ccagagcugauggcugcccg

SEQ ID NO: 327758 - RNA, 22 nt, Human
agcagugugggcugcacgcugg

SEQ ID NO: 327759 - RNA, 22 nt, Human
cugagcugguucucuugugaaa

SEQ ID NO: 327760 - RNA, 22 nt, Human
ugcuggccucggcgcugggccu

SEQ ID NO: 327761 - RNA, 22 nt, Human
uggccaggcagguagaacggcc

SEQ ID NO: 327762 - RNA, 22 nt, Human
uggcccugccgccacgacgucu

SEQ ID NO: 327763 - RNA, 22 nt, Human
gucugcacgugccagggagggg

SEQ ID NO: 327764 - RNA, 22 nt, Human
gcucuggcuacuguggcuaccg

SEQ ID NO: 327765 - RNA, 22 nt, Human
gggagccagcagggcauggagc

SEQ ID NO: 327766 - RNA, 20 nt, Human
aucagguguucagccacugc

SEQ ID NO: 327767 - RNA, 22 nt, Human
uggcagaaugaagacuggggcc

SEQ ID NO: 327768 - RNA, 22 nt, Human
cgccccagccaguugagcggcg

SEQ ID NO: 327769 - RNA, 23 nt, Human
aacugcaagguugcugggaagua

SEQ ID NO: 327770 - RNA, 22 nt, Human
uuuccaguuguucuagaaagcu

SEQ ID NO: 327771 - RNA, 22 nt, Human
gccagagaggccuuagaaucca

SEQ ID NO: 327772 - RNA, 22 nt, Human
gacggagcugguugcugcggcu

SEQ ID NO: 327773 - RNA, 22 nt, Human
uccucagcaaacacuucacucu

SEQ ID NO: 327774 - RNA, 22 nt, Human
uuuggucuggaaucuucagggu

SEQ ID NO: 327775 - RNA, 22 nt, Human
aggcugcugccuuggagagugu

SEQ ID NO: 327776 - RNA, 22 nt, Human
agguccugucuuaucucuguaa

SEQ ID NO: 327777 - RNA, 22 nt, Human
ugccuggcugggcugcucaugg

SEQ ID NO: 327778 - RNA, 22 nt, Human
ucaggaugagucaucaagcugc

SEQ ID NO: 327779 - RNA, 22 nt, Human
uucucuucacagggaucauccu

SEQ ID NO: 327780 - RNA, 22 nt, Human
ugcugcacuuauggcucugagg

SEQ ID NO: 327781 - RNA, 22 nt, Human
ucccucugcuagugcuugagcu

SEQ ID NO: 327782 - RNA, 22 nt, Human
gccucugcaccaguacugugcc

SEQ ID NO: 327783 - RNA, 22 nt, Human
ggugggucuuguggggcagcuu

SEQ ID NO: 327784 - RNA, 23 nt, Human
uggcucugagcuuccugguggcc

SEQ ID NO: 327785 - RNA, 22 nt, Human
uggugcagacaggagccccgcu

SEQ ID NO: 327786 - RNA, 22 nt, Human
ccugggaaggugaggcccugga

SEQ ID NO: 327787 - RNA, 22 nt, Human
gacagcaggaugugaggggaug

SEQ ID NO: 327788 - RNA, 22 nt, Human
ccugcgcgucugggucugucuc

SEQ ID NO: 327789 - RNA, 22 nt, Human
ggggaggaagcuggaacacggg

SEQ ID NO: 327790 - RNA, 22 nt, Human
uucuguuuauaauuugcaguug

SEQ ID NO: 327791 - RNA, 22 nt, Human
agcagugccgcaucuugugacc

SEQ ID NO: 327792 - RNA, 22 nt, Human
gucuuuuuuacaccuuacauca

SEQ ID NO: 327793 - RNA, 22 nt, Human
gcugguggcagagcuccgcggc

SEQ ID NO: 327794 - RNA, 22 nt, Human
ccauggccugaaggagugcauc

SEQ ID NO: 327795 - RNA, 22 nt, Human
aagaaaagguaaccgcuuaucu

SEQ ID NO: 327796 - RNA, 22 nt, Human
ugacagcuuggacaggucccuc

SEQ ID NO: 327797 - RNA, 22 nt, Human
gcugggugauucauuuccauaa

SEQ ID NO: 327798 - RNA, 22 nt, Human
aggccagugguucucugugucc

SEQ ID NO: 327799 - RNA, 22 nt, Human
ggcuguggucauuaggagguug

SEQ ID NO: 327800 - RNA, 22 nt, Human
agccagucggggccaugcuggg

SEQ ID NO: 327801 - RNA, 22 nt, Human
auuaauaucccccgccguucug

SEQ ID NO: 327802 - RNA, 23 nt, Human
acagaagccaggagccgcugggc

SEQ ID NO: 327803 - RNA, 22 nt, Human
ccaugcccuugucaucuccagg

SEQ ID NO: 327804 - RNA, 20 nt, Human
uugagcagcagugcuguguc

SEQ ID NO: 327805 - RNA, 22 nt, Human
ggccauggcgggagccggcguc

SEQ ID NO: 327806 - RNA, 22 nt, Human
cuguggaguccuggggaaugga

SEQ ID NO: 327807 - RNA, 22 nt, Human
cugagcugcucccgcugcagcg

SEQ ID NO: 327808 - RNA, 22 nt, Human
aggcuguagaucuagacaugua

SEQ ID NO: 327809 - RNA, 22 nt, Human
agaaacaucgcuuaguccucau

SEQ ID NO: 327810 - RNA, 22 nt, Human
ugcugaggagguggcugugcuu

SEQ ID NO: 327811 - RNA, 22 nt, Human
gaguggggcccacugcugggug

SEQ ID NO: 327812 - RNA, 22 nt, Human
cggcgcaggcagaccgcgggcu

SEQ ID NO: 327813 - RNA, 22 nt, Human
ggcggcacgcaggcugcugucg

SEQ ID NO: 327814 - RNA, 22 nt, Human
guccuggggauuauagaguguu

SEQ ID NO: 327815 - RNA, 22 nt, Human
uuuccaaggaugugucucucua

SEQ ID NO: 327816 - RNA, 22 nt, Human
agcagcaccuguccucgcugcu

SEQ ID NO: 327817 - RNA, 22 nt, Human
auguaagagcuuugcagggaaa

SEQ ID NO: 327818 - RNA, 22 nt, Human
gaccuccguguacaccucccag

SEQ ID NO: 327819 - RNA, 22 nt, Human
gggcauuucuugucaauguagg

SEQ ID NO: 327820 - RNA, 22 nt, Human
uuucucuuucaaucugcaguac

SEQ ID NO: 327821 - RNA, 22 nt, Human
cagaguccugcaccagcuccag

SEQ ID NO: 327822 - RNA, 22 nt, Human
gaagcccuggggucagugucgu

SEQ ID NO: 327823 - RNA, 22 nt, Human
uguuggcagugcuacagucagu

SEQ ID NO: 327824 - RNA, 21 nt, Human
uccugcugagaaacagauggu

SEQ ID NO: 327825 - RNA, 22 nt, Human
ucucugguuaugucauuaagca

SEQ ID NO: 327826 - RNA, 22 nt, Human
aggcagugguguuugcuggugg

SEQ ID NO: 327827 - RNA, 19 nt, Human
cacuguccuagucgaggcc

SEQ ID NO: 327828 - RNA, 22 nt, Human
aucugucccuccucacagccuc

SEQ ID NO: 327829 - RNA, 22 nt, Human
agguuuggguucauugcuggcu

SEQ ID NO: 327830 - RNA, 22 nt, Human
guucuucaaagugacaacuaaa

SEQ ID NO: 327831 - RNA, 22 nt, Human
uggguagggagcuggaauccua

SEQ ID NO: 327832 - RNA, 22 nt, Human
aggcuguccucucuugcucagu

SEQ ID NO: 327833 - RNA, 22 nt, Human
cagugcagccaaggacaggcac

SEQ ID NO: 327834 - RNA, 22 nt, Human
ucccugagugggcugguaguau

SEQ ID NO: 327835 - RNA, 22 nt, Human
ucuacaacgugguuuuguugua

SEQ ID NO: 327836 - RNA, 20 nt, Human
agcuugccccugucuuugcc

SEQ ID NO: 327837 - RNA, 22 nt, Human
guuuuaguggguggccacugau

SEQ ID NO: 327838 - RNA, 22 nt, Human
gcaguccuguagcgacuuuuuu

SEQ ID NO: 327839 - RNA, 22 nt, Human
uccugggcccuccggaucaggu

SEQ ID NO: 327840 - RNA, 22 nt, Human
cuccagcagaaagggcgagugg

SEQ ID NO: 327841 - RNA, 22 nt, Human
uucuccccgucucucugaggcc

SEQ ID NO: 327842 - RNA, 22 nt, Human
gcugggcccugggugcccuagc

SEQ ID NO: 327843 - RNA, 22 nt, Human
cuuccugcaacaccuguguugc

SEQ ID NO: 327844 - RNA, 22 nt, Human
ucacaguucaacuaguucagau

SEQ ID NO: 327845 - RNA, 22 nt, Human
ccugguuugggugccagugagu

SEQ ID NO: 327846 - RNA, 22 nt, Human
ugccgcgcgcccagguuaggug

SEQ ID NO: 327847 - RNA, 22 nt, Human
ugaggcuggaugggaugccucc

SEQ ID NO: 327848 - RNA, 22 nt, Human
aaggaccaguuuugcagaauug

SEQ ID NO: 327849 - RNA, 22 nt, Human
gcugucaggaacaugccuuggu

SEQ ID NO: 327850 - RNA, 22 nt, Human
gucuugcacuuaccuaagaacu

SEQ ID NO: 327851 - RNA, 22 nt, Human
aaacaucuucucuugauucuuu

SEQ ID NO: 327852 - RNA, 22 nt, Human
gcaguaaauugagagucauguu

SEQ ID NO: 327853 - RNA, 22 nt, Human
cuuugcagagggggugggagcu

SEQ ID NO: 327854 - RNA, 22 nt, Human
ggccgcggauuuucccgcuggc

SEQ ID NO: 327855 - RNA, 22 nt, Human
gcaggccuccccugcuggagcu

SEQ ID NO: 327856 - RNA, 22 nt, Human
uugcaaauaauagccugaaacu

SEQ ID NO: 327857 - RNA, 22 nt, Human
cagcugacaagaguccuuggag

SEQ ID NO: 327858 - RNA, 22 nt, Human
uaaagacaauuucgagcuguag

SEQ ID NO: 327859 - RNA, 22 nt, Human
aaagcugggcuggccaacccag

SEQ ID NO: 327860 - RNA, 22 nt, Human
uguuucaggcuucugggauuuu

SEQ ID NO: 327861 - RNA, 16 nt, Human
aggcucagaggcugga

SEQ ID NO: 327862 - RNA, 22 nt, Human
cgcagcugcugcucugaaacag

SEQ ID NO: 327863 - RNA, 22 nt, Human
cugagcaugcuacaugcagcac

SEQ ID NO: 327864 - RNA, 22 nt, Human
caugcuggucagccaguggaug

SEQ ID NO: 327865 - RNA, 22 nt, Human
gugcagcugggcgcugaccuuc

SEQ ID NO: 327866 - RNA, 22 nt, Human
cuggcagcugcccgagaugccc

SEQ ID NO: 327867 - RNA, 22 nt, Human
ugcacagagggaggcauaaaau

SEQ ID NO: 327868 - RNA, 22 nt, Human
uguguuuuggaaggaacaugca

SEQ ID NO: 327869 - RNA, 22 nt, Human
uuugcagagugcagaagcaucu

SEQ ID NO: 327870 - RNA, 15 nt, Human
uggugguguugagac

SEQ ID NO: 327871 - RNA, 22 nt, Human
cugcaccgugucucgggcugcc

SEQ ID NO: 327872 - RNA, 22 nt, Human
ccugggugaugugcugcccucg

SEQ ID NO: 327873 - RNA, 22 nt, Human
uggccuuggcagugagaagagu

SEQ ID NO: 327874 - RNA, 22 nt, Human
agcagcaggugaccucgaugcc

SEQ ID NO: 327875 - RNA, 22 nt, Human
uccagcucugcugugcgccggu

SEQ ID NO: 327876 - RNA, 22 nt, Human
cagcucugguuccugggcccag

SEQ ID NO: 327877 - RNA, 22 nt, Human
cucugcaggcacccaggguggg

SEQ ID NO: 327878 - RNA, 22 nt, Human
cccacucccugcacgccugccg

SEQ ID NO: 327879 - RNA, 22 nt, Human
cuuguuuucuucugcagucuau

SEQ ID NO: 327880 - RNA, 23 nt, Human
aagaaugcuucugaagagcugcc

SEQ ID NO: 327881 - RNA, 22 nt, Human
cuccugcagcccucagcagcca

SEQ ID NO: 327882 - RNA, 22 nt, Human
ggcagcugaagaggaacuuugg

SEQ ID NO: 327883 - RNA, 22 nt, Human
ggccugcuucucugggcuuucu

SEQ ID NO: 327884 - RNA, 22 nt, Human
uagcugcuugaccaggcagugg

SEQ ID NO: 327885 - RNA, 22 nt, Human
gauguggcugcucuaaagccca

SEQ ID NO: 327886 - RNA, 22 nt, Human
ugguaaaugucuaacaaucacu

SEQ ID NO: 327887 - RNA, 22 nt, Human
auggcagcggagcuggaaauga

SEQ ID NO: 327888 - RNA, 22 nt, Human
ugggaagauaugagugaccaac

SEQ ID NO: 327889 - RNA, 20 nt, Human
acguggccaccaguggcuua

SEQ ID NO: 327890 - RNA, 22 nt, Human
gccuggcaaggcccuguugacu

SEQ ID NO: 327891 - RNA, 22 nt, Human
cagcuggaggagcagcuuccag

SEQ ID NO: 327892 - RNA, 22 nt, Human
cuugccaguguugcagaagcuc

SEQ ID NO: 327893 - RNA, 22 nt, Human
caucccugauuccuaguacagu

SEQ ID NO: 327894 - RNA, 22 nt, Human
gcggcccggguccccagcagca

SEQ ID NO: 327895 - RNA, 22 nt, Human
agccugugaaaucucugccacu

SEQ ID NO: 327896 - RNA, 22 nt, Human
ugccuggauggcucugagcagg

SEQ ID NO: 327897 - RNA, 22 nt, Human
aucauccuagaaggaagcuagg

SEQ ID NO: 327898 - RNA, 22 nt, Human
uuuuguguugccauguuaagca

SEQ ID NO: 327899 - RNA, 22 nt, Human
gccuucugaucgcuggacugac

SEQ ID NO: 327900 - RNA, 22 nt, Human
ucugggugucacuccugccugc

SEQ ID NO: 327901 - RNA, 19 nt, Human
ugcuccaggccuugccgca

SEQ ID NO: 327902 - RNA, 22 nt, Human
cagacagagucuucccaucagu

SEQ ID NO: 327903 - RNA, 22 nt, Human
cuggcagcucugagucccuucu

SEQ ID NO: 327904 - RNA, 22 nt, Human
gagcuccugaaacguuccugcc

SEQ ID NO: 327905 - RNA, 22 nt, Human
ugucuucauuccccaugaaguc

SEQ ID NO: 327906 - RNA, 22 nt, Human
uuuccuguccugguacuuggca

SEQ ID NO: 327907 - RNA, 22 nt, Human
ggcacagcugaugcagacacac

SEQ ID NO: 327908 - RNA, 22 nt, Human
acacuggagauggaccucacaa

SEQ ID NO: 327909 - RNA, 22 nt, Human
gaauguuuaaaaggugcaguuu

SEQ ID NO: 327910 - RNA, 20 nt, Human
gacuucaauuucuaucuuuu

SEQ ID NO: 327911 - RNA, 22 nt, Human
caggacccaaccucccugcucu

SEQ ID NO: 327912 - RNA, 22 nt, Human
gaccacuggggugagggccauc

SEQ ID NO: 327913 - RNA, 22 nt, Human
ccuuggcuuaccuucugugugg

SEQ ID NO: 327914 - RNA, 20 nt, Human
caucaacaccuugucagccu

SEQ ID NO: 327915 - RNA, 22 nt, Human
caggccacacggcggcucccug

SEQ ID NO: 327916 - RNA, 22 nt, Human
augugggccgugcggguguccu

SEQ ID NO: 327917 - RNA, 18 nt, Human
gggcuuuacagaguggag

SEQ ID NO: 327918 - RNA, 22 nt, Human
uuucuggcagcgggacaggggu

SEQ ID NO: 327919 - RNA, 22 nt, Human
uggcugaguuacgaacagagca

SEQ ID NO: 327920 - RNA, 22 nt, Human
gagaagguggaccugaaggagc

SEQ ID NO: 327921 - RNA, 22 nt, Human
agcugcugcaaguggugcuaac

SEQ ID NO: 327922 - RNA, 22 nt, Human
cauuucaaacaguuacagcugc

SEQ ID NO: 327923 - RNA, 22 nt, Human
auggaguugagcucuguugucc

SEQ ID NO: 327924 - RNA, 22 nt, Human
uuaaguauauccauuugacugg

SEQ ID NO: 327925 - RNA, 22 nt, Human
aguaacuuaagcaauuguguau

SEQ ID NO: 327926 - RNA, 22 nt, Human
agagcagaggcauggccguggg

SEQ ID NO: 327927 - RNA, 22 nt, Human
ccaaggcuggagggcuuaugua

SEQ ID NO: 327928 - RNA, 22 nt, Human
agagcgagucuggggcucggau

SEQ ID NO: 327929 - RNA, 22 nt, Human
uuuccacacucacugcacucau

SEQ ID NO: 327930 - RNA, 22 nt, Human
gccccgucguggggccagggau

SEQ ID NO: 327931 - RNA, 22 nt, Human
uuuugucagugagaacagaguu

SEQ ID NO: 327932 - RNA, 21 nt, Human
cccgugccuucagcaguccug

SEQ ID NO: 327933 - RNA, 22 nt, Human
auuuuagagaaacaaacguagg

SEQ ID NO: 327934 - RNA, 23 nt, Human
ggucccaguggagaggccucacc

SEQ ID NO: 327935 - RNA, 17 nt, Human
gugcuggccuggggcuc

SEQ ID NO: 327936 - RNA, 22 nt, Human
uccugucucaguguauuugcag

SEQ ID NO: 327937 - RNA, 23 nt, Human
uggaaacauucugaauguccauc

SEQ ID NO: 327938 - RNA, 22 nt, Human
ggaaggaucuggcugaaaucca

SEQ ID NO: 327939 - RNA, 21 nt, Human
caaaagagacugauucuugga

SEQ ID NO: 327940 - RNA, 22 nt, Human
gggagguucuguucgcacuuga

SEQ ID NO: 327941 - RNA, 22 nt, Human
cagcauggagacaaagugggca

SEQ ID NO: 327942 - RNA, 22 nt, Human
gucccugauaagagccaucgau

SEQ ID NO: 327943 - RNA, 22 nt, Human
ucaugucccguugcuggcugcc

SEQ ID NO: 327944 - RNA, 22 nt, Human
ugcaugguuauauacuacuagu

SEQ ID NO: 327945 - RNA, 22 nt, Human
uuggggccgggauaagguuguu

SEQ ID NO: 327946 - RNA, 22 nt, Human
aggcugcagaggugcugccaga

SEQ ID NO: 327947 - RNA, 22 nt, Human
agccccaggcccggacgccucu

SEQ ID NO: 327948 - RNA, 18 nt, Human
gaaggcauucaguggcuu

SEQ ID NO: 327949 - RNA, 22 nt, Human
ccagcaggagacuagcaacaua

SEQ ID NO: 327950 - RNA, 22 nt, Human
agcuuugggcagaagaggauuc

SEQ ID NO: 327951 - RNA, 22 nt, Human
gccagguaugaauuacgcacga

SEQ ID NO: 327952 - RNA, 22 nt, Human
ugguccugagcaccagccugac

SEQ ID NO: 327953 - RNA, 22 nt, Human
uuaccacagugccugucuaaug

SEQ ID NO: 327954 - RNA, 22 nt, Human
gugcgccagcucaaggggaggc

SEQ ID NO: 327955 - RNA, 22 nt, Human
gucuguggaguugcuugcugga

SEQ ID NO: 327956 - RNA, 22 nt, Human
ugaggaaugugacaaaaccaag

SEQ ID NO: 327957 - RNA, 20 nt, Human
cgggacacucaagcucuggg

SEQ ID NO: 327958 - RNA, 22 nt, Human
acagcugggaacucacacagca

SEQ ID NO: 327959 - RNA, 22 nt, Human
ccaggcuccccaggaggcccuu

SEQ ID NO: 327960 - RNA, 22 nt, Human
cuugucugcuauaaaaauccag

SEQ ID NO: 327961 - RNA, 22 nt, Human
uccuggcucaggccccuggugc

SEQ ID NO: 327962 - RNA, 22 nt, Human
gcggcuccgaagccaggccgcg

SEQ ID NO: 327963 - RNA, 22 nt, Human
cauggccaaagaauuauauuuu

SEQ ID NO: 327964 - RNA, 22 nt, Human
cagcuuguuuacaugcuuauuc

SEQ ID NO: 327965 - RNA, 23 nt, Human
gcauccagagcucaguccccuuu

SEQ ID NO: 327966 - RNA, 22 nt, Human
aggcagccuauggggagcucag

SEQ ID NO: 327967 - RNA, 22 nt, Human
uggucaggcugcucugcggcgu

SEQ ID NO: 327968 - RNA, 22 nt, Human
aggggagguggcagaaaugugc

SEQ ID NO: 327969 - RNA, 22 nt, Human
agcaugucuaacucuucagggu

SEQ ID NO: 327970 - RNA, 22 nt, Human
ugaaucaaugaauugcacuuca

SEQ ID NO: 327971 - RNA, 22 nt, Human
cccuggcucaggcagcuuuguu

SEQ ID NO: 327972 - RNA, 22 nt, Human
ugucuuggccacuaggagugcc

SEQ ID NO: 327973 - RNA, 22 nt, Human
ccagagaggccuuggcaagaca

SEQ ID NO: 327974 - RNA, 22 nt, Human
gucaccuugaacaggcuacuca

SEQ ID NO: 327975 - RNA, 22 nt, Human
gccaccagccccaugcgcugug

SEQ ID NO: 327976 - RNA, 22 nt, Human
gccggggcuggggagagacaug

SEQ ID NO: 327977 - RNA, 22 nt, Human
gccugaucagguccucggcaua

SEQ ID NO: 327978 - RNA, 22 nt, Human
accccagaggcggaggcugcag

SEQ ID NO: 327979 - RNA, 22 nt, Human
gaugucuucagauggcaagaga

SEQ ID NO: 327980 - RNA, 22 nt, Human
cccucucgcggggcagcggagg

SEQ ID NO: 327981 - RNA, 22 nt, Human
uaaggacagcagcuacuuuucc

SEQ ID NO: 327982 - RNA, 22 nt, Human
agcuggguguagggcuggacaa

SEQ ID NO: 327983 - RNA, 22 nt, Human
uagcaucuguacugacauaauc

SEQ ID NO: 327984 - RNA, 22 nt, Human
gaugucuggcuaccacucgcac

SEQ ID NO: 327985 - RNA, 22 nt, Human
ccagcagcucccucaggguccg

SEQ ID NO: 327986 - RNA, 22 nt, Human
gagggcucaacuacuacuaggc

SEQ ID NO: 327987 - RNA, 22 nt, Human
cuggagaacagagcuguuuaga

SEQ ID NO: 327988 - RNA, 22 nt, Human
uuggaaauguagaaaagcagau

SEQ ID NO: 327989 - RNA, 22 nt, Human
ccagcagccaccuucucgaaau

SEQ ID NO: 327990 - RNA, 20 nt, Human
ccacccuguccggggcggag

SEQ ID NO: 327991 - RNA, 22 nt, Human
gcagccuccgcacugcgagucc

SEQ ID NO: 327992 - RNA, 22 nt, Human
gcaguggccacauggaggagga

SEQ ID NO: 327993 - RNA, 22 nt, Human
uggcaaggccacaggugcaguu

SEQ ID NO: 327994 - RNA, 22 nt, Human
cauggggcccaugugcuccaag

SEQ ID NO: 327995 - RNA, 22 nt, Human
gcccagcccagaaagguucgga

SEQ ID NO: 327996 - RNA, 22 nt, Human
accuggaggcagagguugcagu

SEQ ID NO: 327997 - RNA, 22 nt, Human
ggucccagucccuuuccaccgu

SEQ ID NO: 327998 - RNA, 22 nt, Human
acagcuggaggucugugagcac

SEQ ID NO: 327999 - RNA, 22 nt, Human
uuugugcaagagggccaccuua

SEQ ID NO: 328000 - RNA, 22 nt, Human
cuggcuccauccuugagcucug

SEQ ID NO: 328001 - RNA, 22 nt, Human
cugggaagggacgccagugccu

SEQ ID NO: 328002 - RNA, 22 nt, Human
guuguuuuugaacggugguggc

SEQ ID NO: 328003 - RNA, 22 nt, Human
gcacccagggcaggaagugagg

SEQ ID NO: 328004 - RNA, 20 nt, Human
agcuuugguuaagccagugg

SEQ ID NO: 328005 - RNA, 21 nt, Human
ccacaauucuaguuacauaug

SEQ ID NO: 328006 - RNA, 22 nt, Human
ucagguccaagauggccaucca

SEQ ID NO: 328007 - RNA, 22 nt, Human
ccagcagaagcucccgcugggu

SEQ ID NO: 328008 - RNA, 22 nt, Human
aucauccauggcugaucauaaa

SEQ ID NO: 328009 - RNA, 22 nt, Human
uuuagcaaggagaaauaauccu

SEQ ID NO: 328010 - RNA, 22 nt, Human
auggguggccccgugugcaguc

SEQ ID NO: 328011 - RNA, 22 nt, Human
agaggcucuuugagcugggaga

SEQ ID NO: 328012 - RNA, 22 nt, Human
ggcugcugcccaccccugcaug

SEQ ID NO: 328013 - RNA, 22 nt, Human
cagcgguggcaaggugacugug

SEQ ID NO: 328014 - RNA, 22 nt, Human
gugggaguggagcucagcaugu

SEQ ID NO: 328015 - RNA, 22 nt, Human
cccacaggcaggugcaugggcu

SEQ ID NO: 328016 - RNA, 22 nt, Human
uauaagaaacaaggcaaauuuu

SEQ ID NO: 328017 - RNA, 22 nt, Human
gccauguuuugguaaauaccau

SEQ ID NO: 328018 - RNA, 22 nt, Human
cucugggguggaggaggcugac

SEQ ID NO: 328019 - RNA, 22 nt, Human
gcuucuggugaggccucaggaa

SEQ ID NO: 328020 - RNA, 22 nt, Human
ugcccugcagacccugcagugu

SEQ ID NO: 328021 - RNA, 18 nt, Human
auuugcaggcaugcaggc

SEQ ID NO: 328022 - RNA, 20 nt, Human
gggugugugcagggccuggu

SEQ ID NO: 328023 - RNA, 22 nt, Human
agucaacagaguggccgcagcg

SEQ ID NO: 328024 - RNA, 22 nt, Human
ggcugcccucggggucgcaggc

SEQ ID NO: 328025 - RNA, 22 nt, Human
gccaggaugacuauacaacagc

SEQ ID NO: 328026 - RNA, 22 nt, Human
augggagugacagggccacugg

SEQ ID NO: 328027 - RNA, 22 nt, Human
gucuccugaggcauccauugaa

SEQ ID NO: 328028 - RNA, 22 nt, Human
ugcuaauaaacuccaggcugag

SEQ ID NO: 328029 - RNA, 22 nt, Human
ucugagcuggagcccaucaccu

SEQ ID NO: 328030 - RNA, 22 nt, Human
uuuggaaaugagaagccaccuu

SEQ ID NO: 328031 - RNA, 22 nt, Human
agagaccuuuugccuucuaguu

SEQ ID NO: 328032 - RNA, 22 nt, Human
uguucuggugaggccauggggu

SEQ ID NO: 328033 - RNA, 22 nt, Human
ucccugagcucacauggcagga

SEQ ID NO: 328034 - RNA, 22 nt, Human
gcugccgacccacagggguuaa

SEQ ID NO: 328035 - RNA, 23 nt, Human
uuguucuuggaucuuccugaagc

SEQ ID NO: 328036 - RNA, 22 nt, Human
acaguuaguugaggaguguuug

SEQ ID NO: 328037 - RNA, 22 nt, Human
agggccacgugcaccgcggucu

SEQ ID NO: 328038 - RNA, 22 nt, Human
ugcauuaagaauuucugaggau

SEQ ID NO: 328039 - RNA, 22 nt, Human
gcccagcugcacccuggugggu

SEQ ID NO: 328040 - RNA, 22 nt, Human
uggcccagaucucugaccuuga

SEQ ID NO: 328041 - RNA, 22 nt, Human
gccagcuggcugcaggucccag

SEQ ID NO: 328042 - RNA, 22 nt, Human
ucuuccagauacuuccugacuu

SEQ ID NO: 328043 - RNA, 22 nt, Human
cccugacccuaucagagggcca

SEQ ID NO: 328044 - RNA, 18 nt, Human
gggguagaguguccuauu

SEQ ID NO: 328045 - RNA, 22 nt, Human
cugcaucaguggauaugauggu

SEQ ID NO: 328046 - RNA, 22 nt, Human
ugggccaggauuucaagacccu

SEQ ID NO: 328047 - RNA, 22 nt, Human
gagcugggaagauagcuugagc

SEQ ID NO: 328048 - RNA, 22 nt, Human
cacgugcaggucuuaggagaca

SEQ ID NO: 328049 - RNA, 22 nt, Human
uccaguggugguuugaagggca

SEQ ID NO: 328050 - RNA, 22 nt, Human
cuggccuggcaggggaccucua

SEQ ID NO: 328051 - RNA, 22 nt, Human
uaaaguuuauuggcaccaccau

SEQ ID NO: 328052 - RNA, 22 nt, Human
gccagaggggcucgaaggcgcg

SEQ ID NO: 328053 - RNA, 22 nt, Human
cuggagauaagcagucccaggc

SEQ ID NO: 328054 - RNA, 22 nt, Human
uguuccucugaacuucuuccaa

SEQ ID NO: 328055 - RNA, 22 nt, Human
guggcgcagaggguggcagaga

SEQ ID NO: 328056 - RNA, 22 nt, Human
gcucguugaaccuguccccgag

SEQ ID NO: 328057 - RNA, 22 nt, Human
cagggccucugugggcucucuc

SEQ ID NO: 328058 - RNA, 22 nt, Human
ggcgcggugacucagccucgcu

SEQ ID NO: 328059 - RNA, 22 nt, Human
gcagcagugugggcugaaccua

SEQ ID NO: 328060 - RNA, 22 nt, Human
uuccugcaggccauagagccug

SEQ ID NO: 328061 - RNA, 22 nt, Human
gcaguugcaggauuuguguugu

SEQ ID NO: 328062 - RNA, 22 nt, Human
ggagcugcucagagccaguccc

SEQ ID NO: 328063 - RNA, 22 nt, Human
gugauuuucuccuccuagaagu

SEQ ID NO: 328064 - RNA, 22 nt, Human
gauuuucauuauagcuaguuuc

SEQ ID NO: 328065 - RNA, 22 nt, Human
cccagagcaugugcugccuuug

SEQ ID NO: 328066 - RNA, 22 nt, Human
aagugucuucugauggggugug

SEQ ID NO: 328067 - RNA, 22 nt, Human
ucagaagcauccauuucaccac

SEQ ID NO: 328068 - RNA, 22 nt, Human
ucugggccggagccgacggcag

SEQ ID NO: 328069 - RNA, 22 nt, Human
acgugcaggaucugguuggcga

SEQ ID NO: 328070 - RNA, 22 nt, Human
gggaggugauuaggaccaugua

SEQ ID NO: 328071 - RNA, 22 nt, Human
gaggagcuucagaggaaucuua

SEQ ID NO: 328072 - RNA, 22 nt, Human
cugagguagaggaaauguagcu

SEQ ID NO: 328073 - RNA, 19 nt, Human
aguguuuauguagugccua

SEQ ID NO: 328074 - RNA, 22 nt, Human
uagaucuuucacuacuguguag

SEQ ID NO: 328075 - RNA, 22 nt, Human
cuaguagcccauuuuggauacc

SEQ ID NO: 328076 - RNA, 22 nt, Human
gcugauggcuugcuggcugaca

SEQ ID NO: 328077 - RNA, 22 nt, Human
ccuggggaccugccucagcccu

SEQ ID NO: 328078 - RNA, 22 nt, Human
agugccucugcagguccgaguu

SEQ ID NO: 328079 - RNA, 22 nt, Human
acaggcgcacaugagggccgug

SEQ ID NO: 328080 - RNA, 22 nt, Human
uggcacaguuaaaguuguagaa

SEQ ID NO: 328081 - RNA, 22 nt, Human
ucaccggcagacguggccugau

SEQ ID NO: 328082 - RNA, 22 nt, Human
acagccaggaauucuggagaag

SEQ ID NO: 328083 - RNA, 22 nt, Human
ucuugccgcgcaggcgcaguuc

SEQ ID NO: 328084 - RNA, 22 nt, Human
ggucuggccuccgggcaggugg

SEQ ID NO: 328085 - RNA, 23 nt, Human
agguggagcugugcagccggggc

SEQ ID NO: 328086 - RNA, 22 nt, Human
cugcugccuuccaaaggccagg

SEQ ID NO: 328087 - RNA, 20 nt, Human
ugugguuuuugccaguugaa

SEQ ID NO: 328088 - RNA, 20 nt, Human
uccaguuuuggagacauucu

SEQ ID NO: 328089 - RNA, 22 nt, Human
gcugccaccguggagaugagug

SEQ ID NO: 328090 - RNA, 22 nt, Human
gagcagcuguucugacuugucu

SEQ ID NO: 328091 - RNA, 22 nt, Human
uguuugcucugacuaucuugcg

SEQ ID NO: 328092 - RNA, 21 nt, Human
uuccuccucuggagaagaaga

SEQ ID NO: 328093 - RNA, 19 nt, Human
gggugaggaagagcguugc

SEQ ID NO: 328094 - RNA, 22 nt, Human
gcagcagcaggcgcucggccgu

SEQ ID NO: 328095 - RNA, 23 nt, Human
aaguaccuacacauuauuucaga

SEQ ID NO: 328096 - RNA, 22 nt, Human
auauaugaagaagucuugauua

SEQ ID NO: 328097 - RNA, 19 nt, Human
ucaaagucugagucacuuu

SEQ ID NO: 328098 - RNA, 22 nt, Human
gaggggcugggguugacuccaa

SEQ ID NO: 328099 - RNA, 19 nt, Human
guuggcacugaaaauggcu

SEQ ID NO: 328100 - RNA, 20 nt, Human
guccugggagccacagcaca

SEQ ID NO: 328101 - RNA, 22 nt, Human
aagcccgguugggaacguggug

SEQ ID NO: 328102 - RNA, 22 nt, Human
gggaagugagcuggaaucaagg

SEQ ID NO: 328103 - RNA, 22 nt, Human
uuggauggagguucaagcacua

SEQ ID NO: 328104 - RNA, 22 nt, Human
uugcuggaagguggcuggaauc

SEQ ID NO: 328105 - RNA, 18 nt, Human
uccaggcuccaggcuaac

SEQ ID NO: 328106 - RNA, 22 nt, Human
aguggcuguuccaggugaggac

SEQ ID NO: 328107 - RNA, 22 nt, Human
augaggccacaguuauagauuu

SEQ ID NO: 328108 - RNA, 23 nt, Human
augcuagcugugccaacaccaua

SEQ ID NO: 328109 - RNA, 22 nt, Human
cagcugccuaugaccuagccuc

SEQ ID NO: 328110 - RNA, 22 nt, Human
ccugcgggcugugcugaagccu

SEQ ID NO: 328111 - RNA, 22 nt, Human
agguggagaagagaugggcagu

SEQ ID NO: 328112 - RNA, 22 nt, Human
ugucauggacuggauuucugcu

SEQ ID NO: 328113 - RNA, 22 nt, Human
acauagcuuaaaugagaagaua

SEQ ID NO: 328114 - RNA, 22 nt, Human
uuugacucugggugcuuuuucg

SEQ ID NO: 328115 - RNA, 21 nt, Human
gcuccuggugcugcguggcgc

SEQ ID NO: 328116 - RNA, 22 nt, Human
gcugccuggaauaacggcuggc

SEQ ID NO: 328117 - RNA, 22 nt, Human
uucaccugugacagguagaguu

SEQ ID NO: 328118 - RNA, 22 nt, Human
cugcugucuuuauuucacugcu

SEQ ID NO: 328119 - RNA, 22 nt, Human
guugcagauguggaacucgugc

SEQ ID NO: 328120 - RNA, 22 nt, Human
cuucuggguauuccagauaccu

SEQ ID NO: 328121 - RNA, 22 nt, Human
aggaaagcucccaguagggcuc

SEQ ID NO: 328122 - RNA, 22 nt, Human
guuaaugcaaagcagagggcaa

SEQ ID NO: 328123 - RNA, 22 nt, Human
cagcccaggacugcagguguuu

SEQ ID NO: 328124 - RNA, 22 nt, Human
cacccucaagcaguggcacgug

SEQ ID NO: 328125 - RNA, 22 nt, Human
gcggccugcgcugcucccgacg

SEQ ID NO: 328126 - RNA, 22 nt, Human
cuugccagggacucagucaggg

SEQ ID NO: 328127 - RNA, 22 nt, Human
uggcugggagcuggaacugggc

SEQ ID NO: 328128 - RNA, 22 nt, Human
gcccagcaccucucucaggguu

SEQ ID NO: 328129 - RNA, 22 nt, Human
agucauguguucaucuuucauu

SEQ ID NO: 328130 - RNA, 21 nt, Human
ugcuggguuugcccaucaggc

SEQ ID NO: 328131 - RNA, 22 nt, Human
gccuucugauugcuggacugac

SEQ ID NO: 328132 - RNA, 21 nt, Human
ucgaccugcugggcucgggcu

SEQ ID NO: 328133 - RNA, 21 nt, Human
ugugacagaggcggugccuac

SEQ ID NO: 328134 - RNA, 22 nt, Human
cucugcguggcugggcccaggg

SEQ ID NO: 328135 - RNA, 22 nt, Human
ggcggcgcguagccggagacuu

SEQ ID NO: 328136 - RNA, 22 nt, Human
agcugcaccggcuggaccacug

SEQ ID NO: 328137 - RNA, 17 nt, Human
ucugcagggggccgugu

SEQ ID NO: 328138 - RNA, 22 nt, Human
gccccagcagcaaugcgguuga

SEQ ID NO: 328139 - RNA, 22 nt, Human
uggugcaggccaagcugcgagc

SEQ ID NO: 328140 - RNA, 22 nt, Human
uuucccaggcuggaaugcagug

SEQ ID NO: 328141 - RNA, 22 nt, Human
agccugugagggaugcugcagu

SEQ ID NO: 328142 - RNA, 22 nt, Human
uguggagcccccaggagugggg

SEQ ID NO: 328143 - RNA, 22 nt, Human
cugcucaauuccggcacgcugg

SEQ ID NO: 328144 - RNA, 22 nt, Human
ucccagccugacagugcaucaa

SEQ ID NO: 328145 - RNA, 18 nt, Human
cuuuagcugucaucuuug

SEQ ID NO: 328146 - RNA, 22 nt, Human
aucucaguucaggcuccacugu

SEQ ID NO: 328147 - RNA, 22 nt, Human
ucccaaguagaugggaauacag

SEQ ID NO: 328148 - RNA, 22 nt, Human
cagcuuuugcagacuucuugcc

SEQ ID NO: 328149 - RNA, 22 nt, Human
gggggcuggacuuucccacaca

SEQ ID NO: 328150 - RNA, 22 nt, Human
gcagcccucuuggucacuaggc

SEQ ID NO: 328151 - RNA, 22 nt, Human
ugccagagaggagaaagcauuu

SEQ ID NO: 328152 - RNA, 22 nt, Human
gcagaagucagaccaucugaau

SEQ ID NO: 328153 - RNA, 22 nt, Human
ugcuugcugaaaggcauuuaga

SEQ ID NO: 328154 - RNA, 22 nt, Human
agaagcagaaggaagcagggcc

SEQ ID NO: 328155 - RNA, 22 nt, Human
cggagcagagccacucgggccg

SEQ ID NO: 328156 - RNA, 22 nt, Human
cuggucaauaaucauguaguac

SEQ ID NO: 328157 - RNA, 22 nt, Human
uccaggagggggagccgugccg

SEQ ID NO: 328158 - RNA, 22 nt, Human
uggagcugguucuggggaagcu

SEQ ID NO: 328159 - RNA, 22 nt, Human
uccucuucaaaauagcucugaa

SEQ ID NO: 328160 - RNA, 22 nt, Human
gagcagcaggccagguugcagg

SEQ ID NO: 328161 - RNA, 22 nt, Human
uuuuucaagacaaccugcaugu

SEQ ID NO: 328162 - RNA, 22 nt, Human
gggcuucuugagcugccggccc

SEQ ID NO: 328163 - RNA, 23 nt, Human
uggugggcccugcuugcucacug

SEQ ID NO: 328164 - RNA, 22 nt, Human
ucccugccuccuggcagugcca

SEQ ID NO: 328165 - RNA, 22 nt, Human
augcaucaccgaguugcccacc

SEQ ID NO: 328166 - RNA, 22 nt, Human
ucuccucuccuuucauguuguu

SEQ ID NO: 328167 - RNA, 22 nt, Human
ugcuugucucucugugcccacu

SEQ ID NO: 328168 - RNA, 22 nt, Human
gggcugcacuagggcaagguga

SEQ ID NO: 328169 - RNA, 22 nt, Human
ggccaaggcucuugagggcuga

SEQ ID NO: 328170 - RNA, 22 nt, Human
gcugucccgaaccccugguaau

SEQ ID NO: 328171 - RNA, 22 nt, Human
gcuuucuuuucaagaauguauu

SEQ ID NO: 328172 - RNA, 22 nt, Human
gggcucaucaagccucuccgcc

SEQ ID NO: 328173 - RNA, 22 nt, Human
aauuccagcugauugacuuucc

SEQ ID NO: 328174 - RNA, 22 nt, Human
ggcgagcaugagucacucuggg

SEQ ID NO: 328175 - RNA, 20 nt, Human
cuuguuaaauaugcagguag

SEQ ID NO: 328176 - RNA, 22 nt, Human
guggcccaggcuuggcgcuggc

SEQ ID NO: 328177 - RNA, 22 nt, Human
ugaccuucgagcugcggguugu

SEQ ID NO: 328178 - RNA, 18 nt, Human
cugccagugugcucuccg

SEQ ID NO: 328179 - RNA, 21 nt, Human
uccagcacagaugaccucccc

SEQ ID NO: 328180 - RNA, 20 nt, Human
ucaggguuucccauucuugg

SEQ ID NO: 328181 - RNA, 22 nt, Human
guugcagcaucacugcugagug

SEQ ID NO: 328182 - RNA, 22 nt, Human
cagggcucgcucgcucgcucgc

SEQ ID NO: 328183 - RNA, 18 nt, Human
ggaaggugcuggagugca

SEQ ID NO: 328184 - RNA, 22 nt, Human
aaucacagccacaaccuggggg

SEQ ID NO: 328185 - RNA, 22 nt, Human
guggacagacauaauccuaauu

SEQ ID NO: 328186 - RNA, 22 nt, Human
uccaggagcucauccacgucaa

SEQ ID NO: 328187 - RNA, 22 nt, Human
guggucaucuaacuaaauuuuc

SEQ ID NO: 328188 - RNA, 22 nt, Human
cacugcccuggggguugccauc

SEQ ID NO: 328189 - RNA, 22 nt, Human
gcaguuaccuauuuuguagaaa

SEQ ID NO: 328190 - RNA, 22 nt, Human
cuaggugauccacugcucucuu

SEQ ID NO: 328191 - RNA, 22 nt, Human
ccgcgagguggagguugcagug

SEQ ID NO: 328192 - RNA, 22 nt, Human
ucagccaggccaggcauucaca

SEQ ID NO: 328193 - RNA, 22 nt, Human
ucaugcagauaagaauaaguaa

SEQ ID NO: 328194 - RNA, 22 nt, Human
caggccgggcacugcgcuaggu

SEQ ID NO: 328195 - RNA, 22 nt, Human
guuucuccucugugucuuguuu

SEQ ID NO: 328196 - RNA, 22 nt, Human
uccugccaccggggguggcgau

SEQ ID NO: 328197 - RNA, 22 nt, Human
uuucaugauuaacuuagugaau

SEQ ID NO: 328198 - RNA, 22 nt, Human
acaccuuuuauucgccaggcac

SEQ ID NO: 328199 - RNA, 22 nt, Human
gccuggcuucccuuggagcauu

SEQ ID NO: 328200 - RNA, 22 nt, Human
guggauggagcuggaagccauu

SEQ ID NO: 328201 - RNA, 22 nt, Human
ccgcuguccuggagcugcugcu

SEQ ID NO: 328202 - RNA, 22 nt, Human
uuggcagugacugcgggccccg

SEQ ID NO: 328203 - RNA, 22 nt, Human
guucuucagauuccauuucagu

SEQ ID NO: 328204 - RNA, 19 nt, Human
ugguggaggugcaccugac

SEQ ID NO: 328205 - RNA, 22 nt, Human
cagagguagccgagugcaaucg

SEQ ID NO: 328206 - RNA, 22 nt, Human
gcugcuccgcagagugugugug

SEQ ID NO: 328207 - RNA, 22 nt, Human
uggaaauacaagaaguauguca

SEQ ID NO: 328208 - RNA, 22 nt, Human
cugggcccacgagggcucuggg

SEQ ID NO: 328209 - RNA, 22 nt, Human
augcugugccuggaaagcggcu

SEQ ID NO: 328210 - RNA, 22 nt, Human
cuggagcucuccagagccccgu

SEQ ID NO: 328211 - RNA, 22 nt, Human
uugagacugagucucgcccugu

SEQ ID NO: 328212 - RNA, 22 nt, Human
guuuauuggguauuguggagcc

SEQ ID NO: 328213 - RNA, 22 nt, Human
uuuaggcucaaaagaguuggug

SEQ ID NO: 328214 - RNA, 22 nt, Human
ugcagcaccuauggacacuugu

SEQ ID NO: 328215 - RNA, 22 nt, Human
gacaaauguaccccuagagucu

SEQ ID NO: 328216 - RNA, 22 nt, Human
aagggggaaauccuagcgccgc

SEQ ID NO: 328217 - RNA, 21 nt, Human
uggcaggcagcuggaagcuug

SEQ ID NO: 328218 - RNA, 19 nt, Human
gagcagcuuccuaucuggu

SEQ ID NO: 328219 - RNA, 22 nt, Human
acccagcucuuugauggucuug

SEQ ID NO: 328220 - RNA, 22 nt, Human
gcucagguagaugggguugucc

SEQ ID NO: 328221 - RNA, 22 nt, Human
caacagcuggaggcuuggcccg

SEQ ID NO: 328222 - RNA, 22 nt, Human
ggugcggagacuccaugaggcc

SEQ ID NO: 328223 - RNA, 22 nt, Human
agcagcaggagccgugggguga

SEQ ID NO: 328224 - RNA, 22 nt, Human
uagcauuucacugaucuucacu

SEQ ID NO: 328225 - RNA, 22 nt, Human
ggcagguguuuuuauauuaaag

SEQ ID NO: 328226 - RNA, 22 nt, Human
ugguacauggguagguaucucu

SEQ ID NO: 328227 - RNA, 22 nt, Human
acucgcggcggacggcggccag

SEQ ID NO: 328228 - RNA, 17 nt, Human
gccuggcccagccuggc

SEQ ID NO: 328229 - RNA, 22 nt, Human
gaguuucuucauggugcagagg

SEQ ID NO: 328230 - RNA, 19 nt, Human
agcagccaucgaccaugga

SEQ ID NO: 328231 - RNA, 19 nt, Human
ggggcccggggucugcgag

SEQ ID NO: 328232 - RNA, 22 nt, Human
ugggaugggaucucgcuguguc

SEQ ID NO: 328233 - RNA, 22 nt, Human
gcagcugccgugagcucacgcc

SEQ ID NO: 328234 - RNA, 22 nt, Human
uccuggccaaguagauguggcg

SEQ ID NO: 328235 - RNA, 20 nt, Human
gcagcagacagacaggggac

SEQ ID NO: 328236 - RNA, 22 nt, Human
gugacagaaacagggcuagaau

SEQ ID NO: 328237 - RNA, 22 nt, Human
uuugcaaaguccauugaaguua

SEQ ID NO: 328238 - RNA, 22 nt, Human
cugcugagguggagauugcagu

SEQ ID NO: 328239 - RNA, 22 nt, Human
gucagcaggguccccuugagug

SEQ ID NO: 328240 - RNA, 22 nt, Human
gguggcaccuuacccugcgcag

SEQ ID NO: 328241 - RNA, 22 nt, Human
uccuuagccagggcagcucaaa

SEQ ID NO: 328242 - RNA, 22 nt, Human
uucaaacaguguagaauauaug

SEQ ID NO: 328243 - RNA, 22 nt, Human
agccaccaccacugaaagguua

SEQ ID NO: 328244 - RNA, 22 nt, Human
cguggcucugggcuccuuugcc

SEQ ID NO: 328245 - RNA, 22 nt, Human
cuggagccggcgagccccagcc

SEQ ID NO: 328246 - RNA, 21 nt, Human
uggcccuggccacggcugcca

SEQ ID NO: 328247 - RNA, 22 nt, Human
uuuuuaagagucuggaaauagu

SEQ ID NO: 328248 - RNA, 22 nt, Human
cugaugcucuggauguagucaa

SEQ ID NO: 328249 - RNA, 22 nt, Human
cugggguuggccagggcccuag

SEQ ID NO: 328250 - RNA, 22 nt, Human
gccgugcgugcgcaggugcugu

SEQ ID NO: 328251 - RNA, 22 nt, Human
acccaggucucucgacuucugg

SEQ ID NO: 328252 - RNA, 22 nt, Human
uucuuuuaauuucugucugcag

SEQ ID NO: 328253 - RNA, 22 nt, Human
auggugguagaagcacuaugug

SEQ ID NO: 328254 - RNA, 22 nt, Human
uuuguaguuguggaugcugaag

SEQ ID NO: 328255 - RNA, 22 nt, Human
ugagcucaagcaauucacccgc

SEQ ID NO: 328256 - RNA, 22 nt, Human
uggcucaggccuacgacgccuu

SEQ ID NO: 328257 - RNA, 19 nt, Human
ugcucucuggugcuucaug

SEQ ID NO: 328258 - RNA, 22 nt, Human
uugaacaguuuugucagguuca

SEQ ID NO: 328259 - RNA, 22 nt, Human
aggugccugucgucucugguua

SEQ ID NO: 328260 - RNA, 22 nt, Human
gcagugacagacaacuguuuga

SEQ ID NO: 328261 - RNA, 22 nt, Human
cccgggaggaggaaguugcagu

SEQ ID NO: 328262 - RNA, 22 nt, Human
ggucuggagcuaaucuuguugg

SEQ ID NO: 328263 - RNA, 22 nt, Human
gugcagcugguggagucugggg

SEQ ID NO: 328264 - RNA, 22 nt, Human
gggccuuggcgaaguguggugg

SEQ ID NO: 328265 - RNA, 22 nt, Human
auugaagcauggagaugaggca

SEQ ID NO: 328266 - RNA, 20 nt, Human
acacugugcuaaggauuuuc

SEQ ID NO: 328267 - RNA, 22 nt, Human
aggugcugccccgagaaggaug

SEQ ID NO: 328268 - RNA, 22 nt, Human
gugcugagugcagagugcagag

SEQ ID NO: 328269 - RNA, 22 nt, Human
gcugcuuugucuguaaaaugga

SEQ ID NO: 328270 - RNA, 22 nt, Human
acccggaggcgggggaugcagu

SEQ ID NO: 328271 - RNA, 22 nt, Human
guggaaggaauuaacagacuag

SEQ ID NO: 328272 - RNA, 21 nt, Human
ucuccucccggggagaggccg

SEQ ID NO: 328273 - RNA, 22 nt, Human
agccuugcaugauuucauucau

SEQ ID NO: 328274 - RNA, 22 nt, Human
ucuucaugucucugcuugaguc

SEQ ID NO: 328275 - RNA, 22 nt, Human
cuggucagggcucuuugggagc

SEQ ID NO: 328276 - RNA, 22 nt, Human
uauggauauaaucagacuggaa

SEQ ID NO: 328277 - RNA, 22 nt, Human
ugcccuggcuccucccacgcug

SEQ ID NO: 328278 - RNA, 19 nt, Human
gaugcucauucagguggaa

SEQ ID NO: 328279 - RNA, 22 nt, Human
uuugcuugauuaggauauggaa

SEQ ID NO: 328280 - RNA, 22 nt, Human
gccuggcuaagcagaaggaccc

SEQ ID NO: 328281 - RNA, 22 nt, Human
accuggaccugccaccuaugag

SEQ ID NO: 328282 - RNA, 22 nt, Human
agcuccugaaaauccagacugg

SEQ ID NO: 328283 - RNA, 22 nt, Human
aagguggcggcugccagguccu

SEQ ID NO: 328284 - RNA, 22 nt, Human
cugcagaugguauuguucuggu

SEQ ID NO: 328285 - RNA, 22 nt, Human
ugggugugagcccgggagccgc

SEQ ID NO: 328286 - RNA, 22 nt, Human
caggacccaucagccaggcacu

SEQ ID NO: 328287 - RNA, 22 nt, Human
uugggcccugcucugaguugcu

SEQ ID NO: 328288 - RNA, 22 nt, Human
cagugccagcugcuuggccuac

SEQ ID NO: 328289 - RNA, 19 nt, Human
gggccucacccacaccucc

SEQ ID NO: 328290 - RNA, 19 nt, Human
agcucaggcccaucguccc

SEQ ID NO: 328291 - RNA, 22 nt, Human
cauuuacauuuaagguuaauau

SEQ ID NO: 328292 - RNA, 22 nt, Human
ugggaaggggagcuggaaagga

SEQ ID NO: 328293 - RNA, 22 nt, Human
aaacccugagacuuggggccag

SEQ ID NO: 328294 - RNA, 22 nt, Human
aggccgugugagcaugugugag

SEQ ID NO: 328295 - RNA, 21 nt, Human
ugacaguguggcauggaaggu

SEQ ID NO: 328296 - RNA, 22 nt, Human
uggcuggcuguccagcugggca

SEQ ID NO: 328297 - RNA, 22 nt, Human
gcuagaaacuguuuaaucucuu

SEQ ID NO: 328298 - RNA, 22 nt, Human
gguggcaagggcagccaguaac

SEQ ID NO: 328299 - RNA, 22 nt, Human
cuucaugcugauauccucgaug

SEQ ID NO: 328300 - RNA, 22 nt, Human
cuccagaggcgacuugcaucac

SEQ ID NO: 328301 - RNA, 22 nt, Human
ggagagagaccuccaugcccag

SEQ ID NO: 328302 - RNA, 22 nt, Human
cuuuaguucuagaaagugaaac

SEQ ID NO: 328303 - RNA, 22 nt, Human
gccccuucguggaagugcauuc

SEQ ID NO: 328304 - RNA, 22 nt, Human
uucuucauucccuuacuuccga

SEQ ID NO: 328305 - RNA, 22 nt, Human
ggcacugggugagggucacugg

SEQ ID NO: 328306 - RNA, 22 nt, Human
uugcaggucuggggguccuggu

SEQ ID NO: 328307 - RNA, 22 nt, Human
ccuggccuccuggccuucucau

SEQ ID NO: 328308 - RNA, 22 nt, Human
agaguggagagaaacaacucug

SEQ ID NO: 328309 - RNA, 22 nt, Human
cuggagcuggcccaggcuggcc

SEQ ID NO: 328310 - RNA, 21 nt, Human
agcgucaauaucgucaacagg

SEQ ID NO: 328311 - RNA, 22 nt, Human
uugcugccagcgcccugcaggg

SEQ ID NO: 328312 - RNA, 22 nt, Human
gguagccaauuuaaacauuucc

SEQ ID NO: 328313 - RNA, 22 nt, Human
agcaccagcucaaggugcaccu

SEQ ID NO: 328314 - RNA, 22 nt, Human
aggacagcagugcuggcacuug

SEQ ID NO: 328315 - RNA, 22 nt, Human
accaggcccuccagcugcgugg

SEQ ID NO: 328316 - RNA, 22 nt, Human
ugcagggcagcuagggagcuuu

SEQ ID NO: 328317 - RNA, 22 nt, Human
cuuuauguuggggugucuuagu

SEQ ID NO: 328318 - RNA, 20 nt, Human
ucagugggaaagugagagug

SEQ ID NO: 328319 - RNA, 22 nt, Human
cauggaaggcaaaagacacaga

SEQ ID NO: 328320 - RNA, 22 nt, Human
uggagcagccuuuucuaagcaa

SEQ ID NO: 328321 - RNA, 22 nt, Human
gcugcagggagcuggaaggcuc

SEQ ID NO: 328322 - RNA, 23 nt, Human
uccugcagauaagcugguugaca

SEQ ID NO: 328323 - RNA, 22 nt, Human
cugccguguuuuucauguuaaa

SEQ ID NO: 328324 - RNA, 22 nt, Human
uccacagggaugccugcggcuu

SEQ ID NO: 328325 - RNA, 22 nt, Human
cagggccugccugguuccugga

SEQ ID NO: 328326 - RNA, 22 nt, Human
uaagccugcaugaaccaugaga

SEQ ID NO: 328327 - RNA, 22 nt, Human
uugauuugauuguaauggcucu

SEQ ID NO: 328328 - RNA, 22 nt, Human
acgccucugcagcugccgggcc

SEQ ID NO: 328329 - RNA, 20 nt, Human
ggcauggcaaauguucuugc

SEQ ID NO: 328330 - RNA, 22 nt, Human
agggugcccaccgcuucugccc

SEQ ID NO: 328331 - RNA, 22 nt, Human
guagcagagggcccagguaacu

SEQ ID NO: 328332 - RNA, 22 nt, Human
gccagcagcucuugggcgggca

SEQ ID NO: 328333 - RNA, 20 nt, Human
ugagccugcuguaggaggcc

SEQ ID NO: 328334 - RNA, 22 nt, Human
gcugaagagagaugcguccagc

SEQ ID NO: 328335 - RNA, 22 nt, Human
uuugucaccaguggcuuuggua

SEQ ID NO: 328336 - RNA, 22 nt, Human
ccuuccaguucuugguuguaau

SEQ ID NO: 328337 - RNA, 22 nt, Human
cucucugggcccaguuggcacc

SEQ ID NO: 328338 - RNA, 23 nt, Human
gggugcugccuguagucaugcug

SEQ ID NO: 328339 - RNA, 22 nt, Human
uccucccugcacucagugaagu

SEQ ID NO: 328340 - RNA, 22 nt, Human
ggagccuggaguuucugauggg

SEQ ID NO: 328341 - RNA, 22 nt, Human
gcaggguaggugacagguaguc

SEQ ID NO: 328342 - RNA, 18 nt, Human
uccauccucugcucuuca

SEQ ID NO: 328343 - RNA, 22 nt, Human
ccgagcuguggucucuuuuacg

SEQ ID NO: 328344 - RNA, 22 nt, Human
ucugggaguuucugugggagcu

SEQ ID NO: 328345 - RNA, 17 nt, Human
gcaggcacugcugccug

SEQ ID NO: 328346 - RNA, 22 nt, Human
ugcuuguauucauaucacagcu

SEQ ID NO: 328347 - RNA, 23 nt, Human
gcacagagcaguuaggggaagau

SEQ ID NO: 328348 - RNA, 22 nt, Human
aggcggcuccgggagugugggc

SEQ ID NO: 328349 - RNA, 22 nt, Human
guuuuguucaugaacauugggu

SEQ ID NO: 328350 - RNA, 22 nt, Human
acucuguuugcagguagcucag

SEQ ID NO: 328351 - RNA, 22 nt, Human
gcuuccuucuaccacaucaugc

SEQ ID NO: 328352 - RNA, 22 nt, Human
guugcauuaaucugcucaggcu

SEQ ID NO: 328353 - RNA, 22 nt, Human
gaauacaaauaauaccaaggug

SEQ ID NO: 328354 - RNA, 22 nt, Human
cugucaccucugcccuuugccc

SEQ ID NO: 328355 - RNA, 22 nt, Human
agcugccgaugcccagcugcau

SEQ ID NO: 328356 - RNA, 18 nt, Human
ucugugggaucagugagg

SEQ ID NO: 328357 - RNA, 22 nt, Human
uggguucgauguauauguagcc

SEQ ID NO: 328358 - RNA, 22 nt, Human
gaggcuguaacuugggcacugg

SEQ ID NO: 328359 - RNA, 22 nt, Human
auuugugggacuauaaugcagg

SEQ ID NO: 328360 - RNA, 18 nt, Human
cccacggugcuguagggc

SEQ ID NO: 328361 - RNA, 22 nt, Human
aggcucagugauguaaaauaua

SEQ ID NO: 328362 - RNA, 23 nt, Human
agccucuuguggauggucagcga

SEQ ID NO: 328363 - RNA, 22 nt, Human
ccagcuggaacggcagcccagc

SEQ ID NO: 328364 - RNA, 22 nt, Human
uguccugugcacuguagcaugu

SEQ ID NO: 328365 - RNA, 22 nt, Human
gaggcucagagggacuuucaag

SEQ ID NO: 328366 - RNA, 22 nt, Human
auagucuuagaaucuugagugu

SEQ ID NO: 328367 - RNA, 19 nt, Human
gcacacccugcaccaccau

SEQ ID NO: 328368 - RNA, 22 nt, Human
ggaaggggagcuggaaagggua

SEQ ID NO: 328369 - RNA, 22 nt, Human
gcccagcgagcagagguggacg

SEQ ID NO: 328370 - RNA, 22 nt, Human
gaugaaggggcuggugcccucu

SEQ ID NO: 328371 - RNA, 22 nt, Human
uuuacuguuuacagcuaaugca

SEQ ID NO: 328372 - RNA, 22 nt, Human
gucauuuuugacuuugaaguga

SEQ ID NO: 328373 - RNA, 22 nt, Human
gguggcugugagcauuauguga

SEQ ID NO: 328374 - RNA, 22 nt, Human
ucaugcaccucuccaugucccc

SEQ ID NO: 328375 - RNA, 22 nt, Human
agggggcuccuuggugugcaga

SEQ ID NO: 328376 - RNA, 23 nt, Human
ugucuccaucucauuacuugggg

SEQ ID NO: 328377 - RNA, 19 nt, Human
cuccacagggauugugauu

SEQ ID NO: 328378 - RNA, 22 nt, Human
cuggagcagcagguggccaggg

SEQ ID NO: 328379 - RNA, 22 nt, Human
ggcucacgcaauuaucccggcc

SEQ ID NO: 328380 - RNA, 22 nt, Human
ggcgcucaguguugccccagag

SEQ ID NO: 328381 - RNA, 22 nt, Human
gagagaagggggauaugagccu

SEQ ID NO: 328382 - RNA, 22 nt, Human
cacgccuggacggcggagggug

SEQ ID NO: 328383 - RNA, 22 nt, Human
gcagcucacagucuccgccauc

SEQ ID NO: 328384 - RNA, 22 nt, Human
ugggcagggagcuggaaccaca

SEQ ID NO: 328385 - RNA, 22 nt, Human
gauggcgguggccaccuccuug

SEQ ID NO: 328386 - RNA, 22 nt, Human
ugacuuuggacuagugauuuaa

SEQ ID NO: 328387 - RNA, 21 nt, Human
uaccaagaaguuugggaaagc

SEQ ID NO: 328388 - RNA, 22 nt, Human
agaauaagccugacgaaaccua

SEQ ID NO: 328389 - RNA, 22 nt, Human
ccuguaccgcgaucugcugcgc

SEQ ID NO: 328390 - RNA, 22 nt, Human
cucagcacauuccuaagggaug

SEQ ID NO: 328391 - RNA, 22 nt, Human
cccagguaaggaugcuccucau

SEQ ID NO: 328392 - RNA, 22 nt, Human
aagcacagggacucaggaccgg

SEQ ID NO: 328393 - RNA, 22 nt, Human
auuuccuguaggggcuugcgaa

SEQ ID NO: 328394 - RNA, 22 nt, Human
ugcugcgggacccacugugggc

SEQ ID NO: 328395 - RNA, 22 nt, Human
gugucccaaagauuagaaauca

SEQ ID NO: 328396 - RNA, 22 nt, Human
aggcugucucaccucaggaggg

SEQ ID NO: 328397 - RNA, 22 nt, Human
gcgacgcaggcacgacguguug

SEQ ID NO: 328398 - RNA, 22 nt, Human
cucgcggcgcccgaagcccuug

SEQ ID NO: 328399 - RNA, 22 nt, Human
gccagcagcgagaguuuaaccu

SEQ ID NO: 328400 - RNA, 22 nt, Human
ggcuagcuccuccgcgcaucca

SEQ ID NO: 328401 - RNA, 22 nt, Human
cgggcuccgggucuuugcaguc

SEQ ID NO: 328402 - RNA, 22 nt, Human
gcuguauuuauaugaaggcaug

SEQ ID NO: 328403 - RNA, 22 nt, Human
acgucuucguuggcagagauuu

SEQ ID NO: 328404 - RNA, 22 nt, Human
cuggccagggugcgaucguggu

SEQ ID NO: 328405 - RNA, 22 nt, Human
gcucagugaagggugccaagua

SEQ ID NO: 328406 - RNA, 22 nt, Human
aaauugcauuuuaaagguagau

SEQ ID NO: 328407 - RNA, 18 nt, Human
agguguguuucuaggagc

SEQ ID NO: 328408 - RNA, 22 nt, Human
guggcagcggcccaggccgucu

SEQ ID NO: 328409 - RNA, 22 nt, Human
ugggcccaucauugcugugggc

SEQ ID NO: 328410 - RNA, 19 nt, Human
cgcacagccugccaggcgc

SEQ ID NO: 328411 - RNA, 22 nt, Human
cagcuggcgacucuccucgaug

SEQ ID NO: 328412 - RNA, 18 nt, Human
aggagcggcugcggcugc

SEQ ID NO: 328413 - RNA, 22 nt, Human
cgaggagugugaaggcuugucg

SEQ ID NO: 328414 - RNA, 22 nt, Human
ugugucuuuggcgaugucugga

SEQ ID NO: 328415 - RNA, 22 nt, Human
uaggugucuggacaacuuugua

SEQ ID NO: 328416 - RNA, 22 nt, Human
ugucaccuugcucauccucgga

SEQ ID NO: 328417 - RNA, 22 nt, Human
gaggugggaugugugugcuacu

SEQ ID NO: 328418 - RNA, 22 nt, Human
guguguggaaugcucauuuauu

SEQ ID NO: 328419 - RNA, 22 nt, Human
cagcuugcacacauauuagacg

SEQ ID NO: 328420 - RNA, 20 nt, Human
uucuccacaggguggaggag

SEQ ID NO: 328421 - RNA, 22 nt, Human
augggaggcagacacuaaguuc

SEQ ID NO: 328422 - RNA, 22 nt, Human
uuauuuuguagcucugaucuuu

SEQ ID NO: 328423 - RNA, 22 nt, Human
caaagaagagauuuacagagcu

SEQ ID NO: 328424 - RNA, 22 nt, Human
uccuggcccuguggccugcagu

SEQ ID NO: 328425 - RNA, 20 nt, Human
cucaccagguguaggcugag

SEQ ID NO: 328426 - RNA, 22 nt, Human
ccugggacuuggucugggguuu

SEQ ID NO: 328427 - RNA, 22 nt, Human
ugcgcaugcguggcucuccggc

SEQ ID NO: 328428 - RNA, 22 nt, Human
ccagguggacggcgaguacagg

SEQ ID NO: 328429 - RNA, 22 nt, Human
uccugaccacuaggaccaggcu

SEQ ID NO: 328430 - RNA, 22 nt, Human
ggcagcagaacuggcccuguau

SEQ ID NO: 328431 - RNA, 22 nt, Human
ucucugagguuguuuccagcac

SEQ ID NO: 328432 - RNA, 22 nt, Human
ugcauguuucuguauguuaaug

SEQ ID NO: 328433 - RNA, 22 nt, Human
agugcguggaccccuggcugcu

SEQ ID NO: 328434 - RNA, 22 nt, Human
ugcagcugccuagggcuggcuu

SEQ ID NO: 328435 - RNA, 22 nt, Human
aagcagccagccaucaugcccg

SEQ ID NO: 328436 - RNA, 22 nt, Human
uacuuucuagcucuccccaguu

SEQ ID NO: 328437 - RNA, 22 nt, Human
gauggaggagauggcagggugc

SEQ ID NO: 328438 - RNA, 22 nt, Human
uuaagguucagaaaucaauacc

SEQ ID NO: 328439 - RNA, 22 nt, Human
aagccugagccaugcuuuacug

SEQ ID NO: 328440 - RNA, 22 nt, Human
gggaagugcccucuucaggaga

SEQ ID NO: 328441 - RNA, 20 nt, Human
cagagccaggguuuuguuuu

SEQ ID NO: 328442 - RNA, 22 nt, Human
cagaccagccauuugccucuuc

SEQ ID NO: 328443 - RNA, 22 nt, Human
cggcagcgguuggagguuguag

SEQ ID NO: 328444 - RNA, 23 nt, Human
augcaacauugccaguaugggca

SEQ ID NO: 328445 - RNA, 18 nt, Human
ucaugcaaacgcuucaua

SEQ ID NO: 328446 - RNA, 22 nt, Human
ccuaggccgcccggugcguggg

SEQ ID NO: 328447 - RNA, 22 nt, Human
cacauuuaaagguugaagcuga

SEQ ID NO: 328448 - RNA, 22 nt, Human
aggacagagggaccagagccca

SEQ ID NO: 328449 - RNA, 22 nt, Human
acagcaucccugaagauaacca

SEQ ID NO: 328450 - RNA, 22 nt, Human
cuccagagagaaaggaggccgc

SEQ ID NO: 328451 - RNA, 20 nt, Human
gcucagggccugggucugga

SEQ ID NO: 328452 - RNA, 22 nt, Human
ccaggagagcucucguucagug

SEQ ID NO: 328453 - RNA, 22 nt, Human
ucucgugcaggccuugcucgga

SEQ ID NO: 328454 - RNA, 22 nt, Human
cugucuggaaugcaguacauag

SEQ ID NO: 328455 - RNA, 22 nt, Human
cacauuggcaaacgggguugca

SEQ ID NO: 328456 - RNA, 20 nt, Human
ccagguggugccuggagagg

SEQ ID NO: 328457 - RNA, 22 nt, Human
uggccugauuuugcuaagagaa

SEQ ID NO: 328458 - RNA, 23 nt, Human
uugcauuaauguggaggcacagg

SEQ ID NO: 328459 - RNA, 22 nt, Human
uggaggcagccgugaaccaccu

SEQ ID NO: 328460 - RNA, 22 nt, Human
accuccuccaaggagccauagg

SEQ ID NO: 328461 - RNA, 22 nt, Human
ucccugggguaucgcugaggca

SEQ ID NO: 328462 - RNA, 22 nt, Human
ccaggcccugccugugguuccu

SEQ ID NO: 328463 - RNA, 22 nt, Human
agcgggucugcaagccuucccu

SEQ ID NO: 328464 - RNA, 22 nt, Human
uggcuccuuccgcagcaugccu

SEQ ID NO: 328465 - RNA, 22 nt, Human
gucuggagccacugcugcugcu

SEQ ID NO: 328466 - RNA, 22 nt, Human
cucagcucauuguggauccggu

SEQ ID NO: 328467 - RNA, 22 nt, Human
ggugggugagcccugggagcug

SEQ ID NO: 328468 - RNA, 22 nt, Human
ccugggcaaaugccagagacaa

SEQ ID NO: 328469 - RNA, 22 nt, Human
gcccucugccacaggacgccag

SEQ ID NO: 328470 - RNA, 22 nt, Human
auuaguagcacacagagaucag

SEQ ID NO: 328471 - RNA, 22 nt, Human
gugcugccuccauauccgucag

SEQ ID NO: 328472 - RNA, 22 nt, Human
ccagcugggucccugcuggggc

SEQ ID NO: 328473 - RNA, 22 nt, Human
uuugcacuuaaauuuacaacac

SEQ ID NO: 328474 - RNA, 22 nt, Human
ccagagacaaggagcuggaguc

SEQ ID NO: 328475 - RNA, 22 nt, Human
ugggcugcuuccucagcugaga

SEQ ID NO: 328476 - RNA, 22 nt, Human
gaaacacucaauuuaguaauuc

SEQ ID NO: 328477 - RNA, 22 nt, Human
gcaggggcugagcaccagcggg

SEQ ID NO: 328478 - RNA, 22 nt, Human
uggcuuccagaacugagcaaca

SEQ ID NO: 328479 - RNA, 22 nt, Human
gcaggaguguggugggacaucc

SEQ ID NO: 328480 - RNA, 22 nt, Human
cugccaucugagccaaaagugc

SEQ ID NO: 328481 - RNA, 22 nt, Human
ccccagcagacucagggcaggu

SEQ ID NO: 328482 - RNA, 22 nt, Human
uccagcagguccgagacaaguu

SEQ ID NO: 328483 - RNA, 22 nt, Human
ugguuacccagucgcuggaguu

SEQ ID NO: 328484 - RNA, 21 nt, Human
uugcuguuuucccaaugcagu

SEQ ID NO: 328485 - RNA, 19 nt, Human
ccugcugaagugaugcagc

SEQ ID NO: 328486 - RNA, 22 nt, Human
caagggcagcagccucaagcgg

SEQ ID NO: 328487 - RNA, 22 nt, Human
uuguacuuaaauaugcaaauag

SEQ ID NO: 328488 - RNA, 22 nt, Human
agguggcagacuaacagaagga

SEQ ID NO: 328489 - RNA, 22 nt, Human
ccacugcuaacuugcugcagcu

SEQ ID NO: 328490 - RNA, 22 nt, Human
acagugcaaauaggacugucuu

SEQ ID NO: 328491 - RNA, 17 nt, Human
uccuggccuggugugug

SEQ ID NO: 328492 - RNA, 23 nt, Human
uggcucuguggaucccucaggag

SEQ ID NO: 328493 - RNA, 21 nt, Human
agccugcaauguagguaccgg

SEQ ID NO: 328494 - RNA, 22 nt, Human
uuugccaguauuuuauugauga

SEQ ID NO: 328495 - RNA, 22 nt, Human
ugccagcaguagcaguaggcca

SEQ ID NO: 328496 - RNA, 21 nt, Human
guuaagccuugaggugauugu

SEQ ID NO: 328497 - RNA, 22 nt, Human
gcacugagcuuuggaggagcag

SEQ ID NO: 328498 - RNA, 22 nt, Human
gggcucuguuuagaccagagau

SEQ ID NO: 328499 - RNA, 22 nt, Human
ggcuggccuguguggccgccac

SEQ ID NO: 328500 - RNA, 22 nt, Human
auguuugaaauuguaaguauau

SEQ ID NO: 328501 - RNA, 22 nt, Human
ccagcuggcccagcugugcucc

SEQ ID NO: 328502 - RNA, 22 nt, Human
ugcuggcugggcugcuggagac

SEQ ID NO: 328503 - RNA, 22 nt, Human
guucuucagcccucagguccua

SEQ ID NO: 328504 - RNA, 22 nt, Human
aggagggagcuuaagccaggca

SEQ ID NO: 328505 - RNA, 22 nt, Human
gaggcaaagcauguggcucagg

SEQ ID NO: 328506 - RNA, 22 nt, Human
uagcccauggacuggucagcug

SEQ ID NO: 328507 - RNA, 22 nt, Human
auguggcuuucugcguuuucuc

SEQ ID NO: 328508 - RNA, 22 nt, Human
gagccugagcaaugugauguuu

SEQ ID NO: 328509 - RNA, 22 nt, Human
agucacuguuuaaucuagcuaa

SEQ ID NO: 328510 - RNA, 22 nt, Human
guggcauugccuucugcaggaa

SEQ ID NO: 328511 - RNA, 22 nt, Human
auguuguugaacucuuugcaug

SEQ ID NO: 328512 - RNA, 22 nt, Human
ggcaguggcuccucucuacucc

SEQ ID NO: 328513 - RNA, 20 nt, Human
gcucaguggagaaaugcacc

SEQ ID NO: 328514 - RNA, 22 nt, Human
gccagguugcugacgacgaucu

SEQ ID NO: 328515 - RNA, 22 nt, Human
gguguuguacauucuguggauu

SEQ ID NO: 328516 - RNA, 22 nt, Human
cugggagggguagccaauccua

SEQ ID NO: 328517 - RNA, 22 nt, Human
aagcuggccuguaccugcugag

SEQ ID NO: 328518 - RNA, 22 nt, Human
gagcaacacauugaaugaggau

SEQ ID NO: 328519 - RNA, 22 nt, Human
ccagcugcugcaccgugcaugg

SEQ ID NO: 328520 - RNA, 22 nt, Human
augcaggaagagcccuggagcu

SEQ ID NO: 328521 - RNA, 22 nt, Human
ugcuccguucuucugcuucuug

SEQ ID NO: 328522 - RNA, 22 nt, Human
gccaggucgucuccauguccaa

SEQ ID NO: 328523 - RNA, 22 nt, Human
gacaguggagccacguugggag

SEQ ID NO: 328524 - RNA, 22 nt, Human
gagcagcagcugggccagguuc

SEQ ID NO: 328525 - RNA, 22 nt, Human
guccacauaggaacccagcuuc

SEQ ID NO: 328526 - RNA, 22 nt, Human
caggaacacaaugagucucaaa

SEQ ID NO: 328527 - RNA, 22 nt, Human
gcccucugguggccgccucggc

SEQ ID NO: 328528 - RNA, 22 nt, Human
aaagaugucauacacauuaaga

SEQ ID NO: 328529 - RNA, 22 nt, Human
gugcuuuaccuuauuggucucg

SEQ ID NO: 328530 - RNA, 22 nt, Human
cugggcccaggcggcucucgga

SEQ ID NO: 328531 - RNA, 22 nt, Human
cacucacccgguccuucccagu

SEQ ID NO: 328532 - RNA, 22 nt, Human
uggccccugaggagcgucagcc

SEQ ID NO: 328533 - RNA, 22 nt, Human
cugagguagggacgugccguag

SEQ ID NO: 328534 - RNA, 22 nt, Human
gaaugcuggcuuacaggcaguu

SEQ ID NO: 328535 - RNA, 22 nt, Human
ccacccuuccauucuuccucuu

SEQ ID NO: 328536 - RNA, 22 nt, Human
accuggccaguggggccgcgcu

SEQ ID NO: 328537 - RNA, 22 nt, Human
gaggagaggcuggacgcgguga

SEQ ID NO: 328538 - RNA, 22 nt, Human
cuggccgcaguguggaguugug

SEQ ID NO: 328539 - RNA, 22 nt, Human
uucuccacccacucuuuuguug

SEQ ID NO: 328540 - RNA, 20 nt, Human
cuguuugcuaucaugagcug

SEQ ID NO: 328541 - RNA, 22 nt, Human
ccuuaauuucuguccuucagau

SEQ ID NO: 328542 - RNA, 22 nt, Human
ugggugccaaccucugguggcc

SEQ ID NO: 328543 - RNA, 23 nt, Human
uggggcugauggagacggaccag

SEQ ID NO: 328544 - RNA, 20 nt, Human
ccuguucacugcgcaguuuc

SEQ ID NO: 328545 - RNA, 22 nt, Human
cuccuucacgcaggcugccaug

SEQ ID NO: 328546 - RNA, 22 nt, Human
uuccagaacaauguggacguau

SEQ ID NO: 328547 - RNA, 22 nt, Human
gcagcccaggaggcgggagccc

SEQ ID NO: 328548 - RNA, 22 nt, Human
ucuguccauucagaauggcccu

SEQ ID NO: 328549 - RNA, 22 nt, Human
uucaaacacugcuuugagaggg

SEQ ID NO: 328550 - RNA, 22 nt, Human
gggaggaaggcuugggugagua

SEQ ID NO: 328551 - RNA, 22 nt, Human
agagcuccaggguuuuguagug

SEQ ID NO: 328552 - RNA, 22 nt, Human
agagaagagucuugucaaauua

SEQ ID NO: 328553 - RNA, 22 nt, Human
uugggauuacagguguaagcca

SEQ ID NO: 328554 - RNA, 22 nt, Human
agccccaguucccuggaagucu

SEQ ID NO: 328555 - RNA, 22 nt, Human
uacagcuugauguuuguguguu

SEQ ID NO: 328556 - RNA, 22 nt, Human
aaagagcucggaaaguguugaa

SEQ ID NO: 328557 - RNA, 22 nt, Human
gugcugucguggaacugggcug

SEQ ID NO: 328558 - RNA, 22 nt, Human
ugguccagacuuugaccucuca

SEQ ID NO: 328559 - RNA, 22 nt, Human
cccucucccugcagaauguggc

SEQ ID NO: 328560 - RNA, 22 nt, Human
caggguggcaggcaccauggcc

SEQ ID NO: 328561 - RNA, 17 nt, Human
cucugggucuccugcuu

SEQ ID NO: 328562 - RNA, 22 nt, Human
aaggcacauauuuuagagucac

SEQ ID NO: 328563 - RNA, 22 nt, Human
uaguauuuccuguaagcuauag

SEQ ID NO: 328564 - RNA, 22 nt, Human
gugcucuggccaagcgcgugcg

SEQ ID NO: 328565 - RNA, 22 nt, Human
ggagaugccuuguuucaggaac

SEQ ID NO: 328566 - RNA, 22 nt, Human
gcugcugcuugaaggcucggag

SEQ ID NO: 328567 - RNA, 22 nt, Human
gggcccugcgacucgcggcgga

SEQ ID NO: 328568 - RNA, 18 nt, Human
ggccucagccuggccgga

SEQ ID NO: 328569 - RNA, 22 nt, Human
ggcgaggugucugccaucaagc

SEQ ID NO: 328570 - RNA, 22 nt, Human
ucaccuguuggauguauacugu

SEQ ID NO: 328571 - RNA, 22 nt, Human
ggcagccagagggcagcuggau

SEQ ID NO: 328572 - RNA, 22 nt, Human
ccuggaaaaugccacuuucaca

SEQ ID NO: 328573 - RNA, 22 nt, Human
aaagugcugggauuacaggugu

SEQ ID NO: 328574 - RNA, 22 nt, Human
guggcuaggcccaacggcagga

SEQ ID NO: 328575 - RNA, 22 nt, Human
gggcugaauuuguugcauguaa

SEQ ID NO: 328576 - RNA, 22 nt, Human
aaaucaugguggaagaaacaga

SEQ ID NO: 328577 - RNA, 22 nt, Human
cagaggccuggcuuggacaccu

SEQ ID NO: 328578 - RNA, 22 nt, Human
ugcucgagguccccaccggcuc

SEQ ID NO: 328579 - RNA, 21 nt, Human
agcugugguuuuacaucuuuu

SEQ ID NO: 328580 - RNA, 22 nt, Human
ccccaacccugguuccguggcg

SEQ ID NO: 328581 - RNA, 22 nt, Human
guccuggugcuggucauugucg

SEQ ID NO: 328582 - RNA, 22 nt, Human
ggagggaguuucauuccugccc

SEQ ID NO: 328583 - RNA, 22 nt, Human
uguaaagaaagacgcagaguua

SEQ ID NO: 328584 - RNA, 22 nt, Human
ggugucagugaagguagaguuu

SEQ ID NO: 328585 - RNA, 22 nt, Human
aggccacaggaguacugucggu

SEQ ID NO: 328586 - RNA, 19 nt, Human
uuugauagggcauaauaua

SEQ ID NO: 328587 - RNA, 22 nt, Human
aaggcaguuaauuuggcuagaa

SEQ ID NO: 328588 - RNA, 22 nt, Human
aggaggguggggucugccuguc

SEQ ID NO: 328589 - RNA, 22 nt, Human
aagcaccuggguuauaucuuag

SEQ ID NO: 328590 - RNA, 22 nt, Human
gggcuggagagucccacguggg

SEQ ID NO: 328591 - RNA, 22 nt, Human
auuuccuggaggaauggaagca

SEQ ID NO: 328592 - RNA, 22 nt, Human
cucuccaggcgagguccuacug

SEQ ID NO: 328593 - RNA, 22 nt, Human
ucuugggcaauuucucuagagg

SEQ ID NO: 328594 - RNA, 22 nt, Human
cugucacagcccgcgucuccuc

SEQ ID NO: 328595 - RNA, 22 nt, Human
cagcugccuguauuguccucau

SEQ ID NO: 328596 - RNA, 22 nt, Human
agccacagucuguagccagcuu

SEQ ID NO: 328597 - RNA, 22 nt, Human
uucccagauuggagggcagggg

SEQ ID NO: 328598 - RNA, 22 nt, Human
gacaagaugacaucauggcuuc

SEQ ID NO: 328599 - RNA, 21 nt, Human
gccaccucaaucuucuagcgc

SEQ ID NO: 328600 - RNA, 22 nt, Human
ggaagcuguuaucaucuguauc

SEQ ID NO: 328601 - RNA, 22 nt, Human
acccgcuuccggagcugcagug

SEQ ID NO: 328602 - RNA, 22 nt, Human
agcggcgccgagcuuggccagg

SEQ ID NO: 328603 - RNA, 18 nt, Human
ggugagggagcuggaagc

SEQ ID NO: 328604 - RNA, 22 nt, Human
aauguuugaacuuugcauauuu

SEQ ID NO: 328605 - RNA, 22 nt, Human
cucccagccuucgccagucuga

SEQ ID NO: 328606 - RNA, 22 nt, Human
cccagccugaucucggccagcu

SEQ ID NO: 328607 - RNA, 22 nt, Human
auggccugcagugcugccacag

SEQ ID NO: 328608 - RNA, 22 nt, Human
ugcccguggccuggggcagcuu

SEQ ID NO: 328609 - RNA, 22 nt, Human
ugcccuccacaguggcuccacc

SEQ ID NO: 328610 - RNA, 17 nt, Human
aaaugguccuagggauu

SEQ ID NO: 328611 - RNA, 22 nt, Human
ugggugguugcugaggcuccuu

SEQ ID NO: 328612 - RNA, 22 nt, Human
cugggaccugugugccugggcc

SEQ ID NO: 328613 - RNA, 22 nt, Human
uccacagguccucuuugcaaag

SEQ ID NO: 328614 - RNA, 22 nt, Human
uuguccuuaccucaaucuggaa

SEQ ID NO: 328615 - RNA, 22 nt, Human
cagggaugggauggagucaguu

SEQ ID NO: 328616 - RNA, 22 nt, Human
uggcacagcuugucauaaacuc

SEQ ID NO: 328617 - RNA, 20 nt, Human
uuuuccacuccucaaaacag

SEQ ID NO: 328618 - RNA, 22 nt, Human
ucaccggugacccucggcucgc

SEQ ID NO: 328619 - RNA, 22 nt, Human
cuggaaggagcccgggcggauc

SEQ ID NO: 328620 - RNA, 22 nt, Human
ugggaagaguuagagacagcug

SEQ ID NO: 328621 - RNA, 22 nt, Human
cuuccagcugauuggcauccag

SEQ ID NO: 328622 - RNA, 22 nt, Human
cuguuuauucucaucuaaaaug

SEQ ID NO: 328623 - RNA, 20 nt, Human
ccacaguggagacuggagac

SEQ ID NO: 328624 - RNA, 22 nt, Human
agggccagcagcuuggccaacc

SEQ ID NO: 328625 - RNA, 22 nt, Human
uaaagugaaguucagaauggcu

SEQ ID NO: 328626 - RNA, 22 nt, Human
gggacagcuguagugcuuggcu

SEQ ID NO: 328627 - RNA, 22 nt, Human
ccugaguucuuauuuccaguca

SEQ ID NO: 328628 - RNA, 22 nt, Human
ugcuugucacccugccugagug

SEQ ID NO: 328629 - RNA, 22 nt, Human
auuuccagcagcauauuugucu

SEQ ID NO: 328630 - RNA, 22 nt, Human
cacaguuuugucuugguuucca

SEQ ID NO: 328631 - RNA, 22 nt, Human
gccacccuggacgcacuguucg

SEQ ID NO: 328632 - RNA, 22 nt, Human
agccagggacgcugcaggcuac

SEQ ID NO: 328633 - RNA, 22 nt, Human
ucaguguagcagacuuguagcc

SEQ ID NO: 328634 - RNA, 22 nt, Human
gcuuccaaugcuucuaucacau

SEQ ID NO: 328635 - RNA, 22 nt, Human
gcucguacaccagcguggaggu

SEQ ID NO: 328636 - RNA, 22 nt, Human
gagguuggagggcuggccugca

SEQ ID NO: 328637 - RNA, 22 nt, Human
acacugguucucuuaacccuau

SEQ ID NO: 328638 - RNA, 22 nt, Human
agcuuuggcaucugacuagccg

SEQ ID NO: 328639 - RNA, 22 nt, Human
uugcuggaguagaaaacuuaac

SEQ ID NO: 328640 - RNA, 22 nt, Human
aaggugccacuucccucagacu

SEQ ID NO: 328641 - RNA, 22 nt, Human
gggcagcaggcuccacguuccu

SEQ ID NO: 328642 - RNA, 22 nt, Human
cugcaguucuucuccucaaggc

SEQ ID NO: 328643 - RNA, 22 nt, Human
agccagcauauauauaguugaa

SEQ ID NO: 328644 - RNA, 22 nt, Human
cagggucuuggcgccaucaccc

SEQ ID NO: 328645 - RNA, 22 nt, Human
cauuguguauuucuguaguacu

SEQ ID NO: 328646 - RNA, 22 nt, Human
ugaggagcaggguggcuuacuc

SEQ ID NO: 328647 - RNA, 21 nt, Human
ccaccaggucuucugcucggg

SEQ ID NO: 328648 - RNA, 22 nt, Human
gcugucugcugggucgcucagg

SEQ ID NO: 328649 - RNA, 21 nt, Human
ccuguggugccagaucgccag

SEQ ID NO: 328650 - RNA, 22 nt, Human
cacuguugagcaauguacagug

SEQ ID NO: 328651 - RNA, 22 nt, Human
ugcuucucaaaaggagguaggu

SEQ ID NO: 328652 - RNA, 22 nt, Human
gugccgcuggagcuggaauuga

SEQ ID NO: 328653 - RNA, 23 nt, Human
aacauuuguaaggugauuuuguu

SEQ ID NO: 328654 - RNA, 22 nt, Human
caaguaugagaaagcuauuacc

SEQ ID NO: 328655 - RNA, 22 nt, Human
acggagcccgugucagguggga

SEQ ID NO: 328656 - RNA, 22 nt, Human
gaaggagaggauugugaggcug

SEQ ID NO: 328657 - RNA, 22 nt, Human
cugcuguguggauucaauggcu

SEQ ID NO: 328658 - RNA, 22 nt, Human
caagagcuuuagaaaugcucau

SEQ ID NO: 328659 - RNA, 22 nt, Human
gagguccacugaggcaacaggg

SEQ ID NO: 328660 - RNA, 22 nt, Human
ccauggccaggaaagccaaggu

SEQ ID NO: 328661 - RNA, 21 nt, Human
ugcaaugcauugacagcagca

SEQ ID NO: 328662 - RNA, 22 nt, Human
ucugaggucauuccaaggacau

SEQ ID NO: 328663 - RNA, 22 nt, Human
uggucccugaagagagaccuug

SEQ ID NO: 328664 - RNA, 22 nt, Human
aggggagguguccccaaaucuc

SEQ ID NO: 328665 - RNA, 22 nt, Human
cuggccagccucccagguaccc

SEQ ID NO: 328666 - RNA, 22 nt, Human
gcaggaguuagagguuuaaucu

SEQ ID NO: 328667 - RNA, 22 nt, Human
uggcaguagagcuggaacuuga

SEQ ID NO: 328668 - RNA, 22 nt, Human
acuuccagaaaugauuuaauuu

SEQ ID NO: 328669 - RNA, 22 nt, Human
cagugccaaggauggccuggga

SEQ ID NO: 328670 - RNA, 22 nt, Human
ugcgggucccagggucacaggc

SEQ ID NO: 328671 - RNA, 22 nt, Human
ucauggcacaugcccuccaggg

SEQ ID NO: 328672 - RNA, 22 nt, Human
uuuguguuguacuucugugcau

SEQ ID NO: 328673 - RNA, 22 nt, Human
ucacccagacugucugacucuu

SEQ ID NO: 328674 - RNA, 22 nt, Human
uggucccuagugugggagcuug

SEQ ID NO: 328675 - RNA, 22 nt, Human
uuuaaacuaacaguacacguug

SEQ ID NO: 328676 - RNA, 22 nt, Human
auuuugacauugcggcauugcu

SEQ ID NO: 328677 - RNA, 22 nt, Human
cagcuccagcccaggcagcucc

SEQ ID NO: 328678 - RNA, 22 nt, Human
caggccugugacaccgugucug

SEQ ID NO: 328679 - RNA, 22 nt, Human
uggcccagcucagggugggcgg

SEQ ID NO: 328680 - RNA, 23 nt, Human
uccaguuaaugguucccagucug

SEQ ID NO: 328681 - RNA, 22 nt, Human
gcugcagugagccaagaucgug

SEQ ID NO: 328682 - RNA, 22 nt, Human
uggcagcauuuuuuccagaaca

SEQ ID NO: 328683 - RNA, 22 nt, Human
caugucacaauucuuaauggga

SEQ ID NO: 328684 - RNA, 22 nt, Human
cucugguuucgcaggaaauaga

SEQ ID NO: 328685 - RNA, 22 nt, Human
ugagcugcuucuuauaaugugu

SEQ ID NO: 328686 - RNA, 22 nt, Human
aggcugagccugggcguggugg

SEQ ID NO: 328687 - RNA, 22 nt, Human
ccagucagccaagcugcagcgg

SEQ ID NO: 328688 - RNA, 22 nt, Human
ucucagaguuccucuggagucc

SEQ ID NO: 328689 - RNA, 22 nt, Human
cggagaggugggggcagcaucu

SEQ ID NO: 328690 - RNA, 21 nt, Human
uaaagcucguucaggaaaguc

SEQ ID NO: 328691 - RNA, 22 nt, Human
cugaggagauccccccagaagu

SEQ ID NO: 328692 - RNA, 22 nt, Human
gcacugccugugagcccugguu

SEQ ID NO: 328693 - RNA, 22 nt, Human
gcggggacagaaggcgguucuc

SEQ ID NO: 328694 - RNA, 18 nt, Human
uccaccgcgugcaccucu

SEQ ID NO: 328695 - RNA, 22 nt, Human
ucaguuacucugauguccugug

SEQ ID NO: 328696 - RNA, 22 nt, Human
aaggcuuguugucacgcucuug

SEQ ID NO: 328697 - RNA, 22 nt, Human
uugaggagucaggggcacggaa

SEQ ID NO: 328698 - RNA, 22 nt, Human
ggcggugguugagaggacggcg

SEQ ID NO: 328699 - RNA, 22 nt, Human
ggagaggguagggguccugccc

SEQ ID NO: 328700 - RNA, 22 nt, Human
aaagccauaucuauucuauucu

SEQ ID NO: 328701 - RNA, 22 nt, Human
gcucugugcaguucagggacac

SEQ ID NO: 328702 - RNA, 22 nt, Human
auacagguucucuagggaacag

SEQ ID NO: 328703 - RNA, 22 nt, Human
ucgcagcacuagcccugcauug

SEQ ID NO: 328704 - RNA, 22 nt, Human
cacccugaggccacccagaccu

SEQ ID NO: 328705 - RNA, 17 nt, Human
gcccgugggcuacggua

SEQ ID NO: 328706 - RNA, 22 nt, Human
uuccaggcgcacgucggccuua

SEQ ID NO: 328707 - RNA, 22 nt, Human
uacagcagcccaccuucuucug

SEQ ID NO: 328708 - RNA, 19 nt, Human
agcaguggagccaugccug

SEQ ID NO: 328709 - RNA, 22 nt, Human
gccccagcguggcuguguuagg

SEQ ID NO: 328710 - RNA, 22 nt, Human
ucccacugucuucucgugcucg

SEQ ID NO: 328711 - RNA, 22 nt, Human
uaggggugggauccaggaauua

SEQ ID NO: 328712 - RNA, 22 nt, Human
cagguguugcaguugaagacug

SEQ ID NO: 328713 - RNA, 22 nt, Human
cgcuuuggagucccugcuuuac

SEQ ID NO: 328714 - RNA, 22 nt, Human
uccagcaguccaugugagacac

SEQ ID NO: 328715 - RNA, 22 nt, Human
uucuccucagcaaggcagcuuu

SEQ ID NO: 328716 - RNA, 22 nt, Human
ugggccagauccauggcaauaa

SEQ ID NO: 328717 - RNA, 22 nt, Human
ccuuugagccugggcgcggacc

SEQ ID NO: 328718 - RNA, 22 nt, Human
gcaguccuuaggagaggaagua

SEQ ID NO: 328719 - RNA, 20 nt, Human
ggacccuggguucuucugag

SEQ ID NO: 328720 - RNA, 22 nt, Human
agccagugcagcuggaaauuca

SEQ ID NO: 328721 - RNA, 19 nt, Human
augggaagcggccagcgga

SEQ ID NO: 328722 - RNA, 22 nt, Human
aggcaguuguugcugagcagcu

SEQ ID NO: 328723 - RNA, 22 nt, Human
ucacuagugguuucuggugguu

SEQ ID NO: 328724 - RNA, 22 nt, Human
cagcagcucaggcuccuuccca

SEQ ID NO: 328725 - RNA, 22 nt, Human
caggccuugaaggccugcggga

SEQ ID NO: 328726 - RNA, 22 nt, Human
ggcccucucuacauguuagacg

SEQ ID NO: 328727 - RNA, 17 nt, Human
agcagcuggguugaucu

SEQ ID NO: 328728 - RNA, 22 nt, Human
ccgugugcacgcgccggugcug

SEQ ID NO: 328729 - RNA, 22 nt, Human
gagcuguguaugcaucauucug

SEQ ID NO: 328730 - RNA, 22 nt, Human
ugcuagguaagaagggggcucc

SEQ ID NO: 328731 - RNA, 18 nt, Human
ugugccucugcaggacgu

SEQ ID NO: 328732 - RNA, 22 nt, Human
gaggggcucuugggcaugaagg

SEQ ID NO: 328733 - RNA, 22 nt, Human
gaggucaggggagaggcugaug

SEQ ID NO: 328734 - RNA, 22 nt, Human
ugggugaagaggcuaugcuacu

SEQ ID NO: 328735 - RNA, 22 nt, Human
aggugggacccguggggugcga

SEQ ID NO: 328736 - RNA, 22 nt, Human
gugcagcugugguggagccagg

SEQ ID NO: 328737 - RNA, 21 nt, Human
uccuccuguagaggguccugg

SEQ ID NO: 328738 - RNA, 22 nt, Human
agcggcgccggagggaggugcg

SEQ ID NO: 328739 - RNA, 22 nt, Human
ggcagcaggguagccauuucuc

SEQ ID NO: 328740 - RNA, 22 nt, Human
gagaugugucagguccuggggg

SEQ ID NO: 328741 - RNA, 22 nt, Human
acauucaugcaccuuccuaucc

SEQ ID NO: 328742 - RNA, 22 nt, Human
ugggagagauaggcuucuggac

SEQ ID NO: 328743 - RNA, 22 nt, Human
gucugcccuuggccugggacuu

SEQ ID NO: 328744 - RNA, 22 nt, Human
ugacccucuuccccaugcgcuc

SEQ ID NO: 328745 - RNA, 22 nt, Human
ggcaagagggcagauggagugc

SEQ ID NO: 328746 - RNA, 22 nt, Human
cauuguccucugaugccuuccc

SEQ ID NO: 328747 - RNA, 22 nt, Human
cacagagagcuacgugcagcgu

SEQ ID NO: 328748 - RNA, 22 nt, Human
cucaggucuuaguucugucauc

SEQ ID NO: 328749 - RNA, 22 nt, Human
aaugacaguggcacagucacuu

SEQ ID NO: 328750 - RNA, 22 nt, Human
gcugcuggcuuccugcuguuuu

SEQ ID NO: 328751 - RNA, 20 nt, Human
aggggcaccugcgacggggc

SEQ ID NO: 328752 - RNA, 23 nt, Human
uuguccucuggaucgguuugguu

SEQ ID NO: 328753 - RNA, 22 nt, Human
augaauaaaacauuuuaaucag

SEQ ID NO: 328754 - RNA, 18 nt, Human
uggggggcuugucugaag

SEQ ID NO: 328755 - RNA, 22 nt, Human
cugggguccuugccauguguca

SEQ ID NO: 328756 - RNA, 22 nt, Human
ucugugggcauuuauaaucugg

SEQ ID NO: 328757 - RNA, 22 nt, Human
cccuggcucugccucagagccc

SEQ ID NO: 328758 - RNA, 22 nt, Human
caguuuuaugaaugcuuauuag

SEQ ID NO: 328759 - RNA, 22 nt, Human
gaagagguucaacguggucauc

SEQ ID NO: 328760 - RNA, 22 nt, Human
ucugaauucuuagaauuaaagg

SEQ ID NO: 328761 - RNA, 22 nt, Human
ugcaaggcacccacucugcuuu

SEQ ID NO: 328762 - RNA, 22 nt, Human
gugccugguuuggggaauguuc

SEQ ID NO: 328763 - RNA, 22 nt, Human
uugcugccuuuguacucugaug

SEQ ID NO: 328764 - RNA, 22 nt, Human
cagcaguacuucucagagguau

SEQ ID NO: 328765 - RNA, 22 nt, Human
agggcccuagggaaugagacau

SEQ ID NO: 328766 - RNA, 22 nt, Human
uuucugaggaauuaauacagaa

SEQ ID NO: 328767 - RNA, 22 nt, Human
acuggcaguagagggagcgcau

SEQ ID NO: 328768 - RNA, 22 nt, Human
cgggagccucugggucacacug

SEQ ID NO: 328769 - RNA, 22 nt, Human
ugggagcaagcuggugcuggag

SEQ ID NO: 328770 - RNA, 22 nt, Human
cauugcuguuaauugucucuag

SEQ ID NO: 328771 - RNA, 22 nt, Human
uggaagggguuacgcagcagga

SEQ ID NO: 328772 - RNA, 22 nt, Human
aaggggggcaccugcaugcccg

SEQ ID NO: 328773 - RNA, 22 nt, Human
auuucauccauuaagaguacuc

SEQ ID NO: 328774 - RNA, 20 nt, Human
gugcccaguuggugacagac

SEQ ID NO: 328775 - RNA, 22 nt, Human
gccugugcuuaacugacgugag

SEQ ID NO: 328776 - RNA, 22 nt, Human
ggcagaggagcuggaaacaugg

SEQ ID NO: 328777 - RNA, 22 nt, Human
gcuucuggaagcauaugcaaga

SEQ ID NO: 328778 - RNA, 22 nt, Human
gccagugccugcugcucagggc

SEQ ID NO: 328779 - RNA, 22 nt, Human
gcugggagucgcgucuguggcc

SEQ ID NO: 328780 - RNA, 22 nt, Human
ccugaggaugccagcaugggug

SEQ ID NO: 328781 - RNA, 22 nt, Human
ucucuuugacccuuuagcucca

SEQ ID NO: 328782 - RNA, 22 nt, Human
cacggccacugcagcaccccag

SEQ ID NO: 328783 - RNA, 22 nt, Human
uguccagcugaaggcagccuca

SEQ ID NO: 328784 - RNA, 19 nt, Human
ccuggcccugcugcgcggg

SEQ ID NO: 328785 - RNA, 22 nt, Human
uuguccagcgaccaggcucugu

SEQ ID NO: 328786 - RNA, 22 nt, Human
uuaagugcuucaagggaagcuc

SEQ ID NO: 328787 - RNA, 22 nt, Human
uuuggauugcuuggaugcuucg

SEQ ID NO: 328788 - RNA, 22 nt, Human
cgcugccuucaucccacgccua

SEQ ID NO: 328789 - RNA, 22 nt, Human
agguggcuaugaggaugcaguc

SEQ ID NO: 328790 - RNA, 22 nt, Human
agucuggagugauuauguggga

SEQ ID NO: 328791 - RNA, 23 nt, Human
aggcugcagaagaauagggucau

SEQ ID NO: 328792 - RNA, 22 nt, Human
ucaccucucuggccgucuaccu

SEQ ID NO: 328793 - RNA, 22 nt, Human
gagggugguggcuuaaggugcu

SEQ ID NO: 328794 - RNA, 22 nt, Human
gguggcagaggugcaucagccc

SEQ ID NO: 328795 - RNA, 22 nt, Human
cccagcauuucugggcugcacu

SEQ ID NO: 328796 - RNA, 22 nt, Human
gcggcgccugggacccgccagc

SEQ ID NO: 328797 - RNA, 22 nt, Human
auguuuguguuucccauucagg

SEQ ID NO: 328798 - RNA, 22 nt, Human
agagcaccaaggugguuuggac

SEQ ID NO: 328799 - RNA, 22 nt, Human
uauugccaaaugucugcuggaa

SEQ ID NO: 328800 - RNA, 22 nt, Human
ccuccugggccuugcucuguga

SEQ ID NO: 328801 - RNA, 22 nt, Human
ggcaucagcccgguccugggcu

SEQ ID NO: 328802 - RNA, 22 nt, Human
aggccagggcacugcucuuuag

SEQ ID NO: 328803 - RNA, 22 nt, Human
gucugcugacagagcauggacc

SEQ ID NO: 328804 - RNA, 22 nt, Human
cauugcugugggcauuugcugc

SEQ ID NO: 328805 - RNA, 22 nt, Human
ugcuggaguggcacuguguggc

SEQ ID NO: 328806 - RNA, 22 nt, Human
uuggcgcccaggacgccgccgc

SEQ ID NO: 328807 - RNA, 22 nt, Human
ucaggggcuugaggugcauguc

SEQ ID NO: 328808 - RNA, 22 nt, Human
agccuggacagcuacggagaac

SEQ ID NO: 328809 - RNA, 22 nt, Human
caggaggaaaguuccacucaac

SEQ ID NO: 328810 - RNA, 22 nt, Human
gccuggcucugaguuucucucc

SEQ ID NO: 328811 - RNA, 22 nt, Human
gagcuccuauggucgguggcuc

SEQ ID NO: 328812 - RNA, 22 nt, Human
uguguggcaagcuguaugcuag

SEQ ID NO: 328813 - RNA, 21 nt, Human
uguguucuucuaggucagcua

SEQ ID NO: 328814 - RNA, 22 nt, Human
uccuggccucugagucaagaac

SEQ ID NO: 328815 - RNA, 22 nt, Human
cagcaguguacaaggugucaga

SEQ ID NO: 328816 - RNA, 21 nt, Human
gcugcucgagauccagugcuu

SEQ ID NO: 328817 - RNA, 22 nt, Human
caagcuuguuucuccugggggu

SEQ ID NO: 328818 - RNA, 22 nt, Human
agagaccuuccugacuccagag

SEQ ID NO: 328819 - RNA, 22 nt, Human
ggagguggagcuggaaguucca

SEQ ID NO: 328820 - RNA, 19 nt, Human
caucuggaugauucuccug

SEQ ID NO: 328821 - RNA, 22 nt, Human
gcuggguggaucggaggcucug

SEQ ID NO: 328822 - RNA, 22 nt, Human
ggagaggggaacuuguugcuug

SEQ ID NO: 328823 - RNA, 22 nt, Human
ugccaggccucaggagucucca

SEQ ID NO: 328824 - RNA, 22 nt, Human
ggccucugccccgcggggcucg

SEQ ID NO: 328825 - RNA, 22 nt, Human
gcccuguuuucuggguuccuug

SEQ ID NO: 328826 - RNA, 22 nt, Human
cuggcaguguccagcucgugau

SEQ ID NO: 328827 - RNA, 22 nt, Human
ccuggccauagggcccaggaaa

SEQ ID NO: 328828 - RNA, 22 nt, Human
agcucagggccaggcgcguuuc

SEQ ID NO: 328829 - RNA, 21 nt, Human
cuuuggcaagggagaagucac

SEQ ID NO: 328830 - RNA, 22 nt, Human
gguguggcaguggaccugugaa

SEQ ID NO: 328831 - RNA, 22 nt, Human
gagguggcugcuugcugggaaa

SEQ ID NO: 328832 - RNA, 20 nt, Human
acagagauccucucuuuauc

SEQ ID NO: 328833 - RNA, 21 nt, Human
caggaacauucuuuacauuua

SEQ ID NO: 328834 - RNA, 22 nt, Human
gugccaccagaugcuguugcua

SEQ ID NO: 328835 - RNA, 22 nt, Human
ggaggaggggugacugaaugcu

SEQ ID NO: 328836 - RNA, 22 nt, Human
gugcugcagagucucgugccgc

SEQ ID NO: 328837 - RNA, 22 nt, Human
uccuggcaaagauguugguguu

SEQ ID NO: 328838 - RNA, 22 nt, Human
cacaucauguuaauucauuaca

SEQ ID NO: 328839 - RNA, 22 nt, Human
agagccuguucggaggcgcccc

SEQ ID NO: 328840 - RNA, 22 nt, Human
aggauugugccuccagucagaa

SEQ ID NO: 328841 - RNA, 22 nt, Human
gugcuggcuggggcaucaggca

SEQ ID NO: 328842 - RNA, 22 nt, Human
gugcaggacagcacaucuccug

SEQ ID NO: 328843 - RNA, 22 nt, Human
gggucugcuccaccugcagccc

SEQ ID NO: 328844 - RNA, 22 nt, Human
aaccauucacugaacaguucaa

SEQ ID NO: 328845 - RNA, 22 nt, Human
ucaggagaguguucaguggagg

SEQ ID NO: 328846 - RNA, 22 nt, Human
uuucugugauaggcugcgacgc

SEQ ID NO: 328847 - RNA, 22 nt, Human
uaggccacagagaggagauuuc

SEQ ID NO: 328848 - RNA, 22 nt, Human
ugucugccugcgggccggcaca

SEQ ID NO: 328849 - RNA, 22 nt, Human
agcuggugauguggucccucac

SEQ ID NO: 328850 - RNA, 22 nt, Human
ugguggggccagacuucagcuc

SEQ ID NO: 328851 - RNA, 22 nt, Human
cggggccuagucuaccucggca

SEQ ID NO: 328852 - RNA, 23 nt, Human
ggaagcucacguaguccugcacu

SEQ ID NO: 328853 - RNA, 22 nt, Human
ugcagguggcagcggggcacca

SEQ ID NO: 328854 - RNA, 22 nt, Human
uuuccagggaggaauguggggu

SEQ ID NO: 328855 - RNA, 22 nt, Human
ccgcguggcacccuccuggagg

SEQ ID NO: 328856 - RNA, 17 nt, Human
uuucugcaugauuggac

SEQ ID NO: 328857 - RNA, 22 nt, Human
ggcuuccuccuuccugcuguca

SEQ ID NO: 328858 - RNA, 22 nt, Human
ggcuuuuguuucagcucugcua

SEQ ID NO: 328859 - RNA, 22 nt, Human
gagcucauccccaugguccguc

SEQ ID NO: 328860 - RNA, 22 nt, Human
agcugggugcccgaagccacgu

SEQ ID NO: 328861 - RNA, 22 nt, Human
ucuggggucaccuggggugcuu

SEQ ID NO: 328862 - RNA, 22 nt, Human
ucccuggcugguguagagggau

SEQ ID NO: 328863 - RNA, 22 nt, Human
caaacuuacuguguuuaaagag

SEQ ID NO: 328864 - RNA, 18 nt, Human
gccagcccuccaaccucc

SEQ ID NO: 328865 - RNA, 22 nt, Human
uggcggugacggcggcgccugg

SEQ ID NO: 328866 - RNA, 22 nt, Human
gaccacaguccagucaucaugg

SEQ ID NO: 328867 - RNA, 22 nt, Human
aguuuccacuggagacacugug

SEQ ID NO: 328868 - RNA, 22 nt, Human
aguuggcauuuuauuuaaguau

SEQ ID NO: 328869 - RNA, 22 nt, Human
ccacagcaugcaggccugacac

SEQ ID NO: 328870 - RNA, 22 nt, Human
ugcugggauuacagucaugagc

SEQ ID NO: 328871 - RNA, 22 nt, Human
uggcaugcaagaggaggcuccc

SEQ ID NO: 328872 - RNA, 22 nt, Human
ccucaaaggccuggcaccagaa

SEQ ID NO: 328873 - RNA, 22 nt, Human
ccagccagcugcccuuggggcc

SEQ ID NO: 328874 - RNA, 22 nt, Human
ccagcugcgggcaucgagaguu

SEQ ID NO: 328875 - RNA, 22 nt, Human
gugggugucaguaucuuuaacg

SEQ ID NO: 328876 - RNA, 22 nt, Human
ugagccuggccugcagagacca

SEQ ID NO: 328877 - RNA, 22 nt, Human
uugcaucagcaggcauaauugg

SEQ ID NO: 328878 - RNA, 22 nt, Human
ugcgccugcgcaaagguuucug

SEQ ID NO: 328879 - RNA, 22 nt, Human
ugcaugguguaauucuaaugcu

SEQ ID NO: 328880 - RNA, 22 nt, Human
gccccucuccuugugcaccugc

SEQ ID NO: 328881 - RNA, 22 nt, Human
ccaucuucucuugaaccuccuu

SEQ ID NO: 328882 - RNA, 22 nt, Human
caggccacagcuaaagaggauu

SEQ ID NO: 328883 - RNA, 22 nt, Human
gcagcagaaggccaaggggagc

SEQ ID NO: 328884 - RNA, 22 nt, Human
gcggggccauguccaacggccu

SEQ ID NO: 328885 - RNA, 21 nt, Human
aggcagcgauuuucauauugc

SEQ ID NO: 328886 - RNA, 22 nt, Human
cgucaggguugagcagguagau

SEQ ID NO: 328887 - RNA, 22 nt, Human
uggccgggaagggacagugugg

SEQ ID NO: 328888 - RNA, 22 nt, Human
guucaaccaugauuaggaacug

SEQ ID NO: 328889 - RNA, 22 nt, Human
gccaggcaggccacgcuguguu

SEQ ID NO: 328890 - RNA, 22 nt, Human
cugaacaucccgcagugcacga

SEQ ID NO: 328891 - RNA, 22 nt, Human
uggccuuggucacaaugcaaac

SEQ ID NO: 328892 - RNA, 22 nt, Human
aagugcaggucucagcuacucu

SEQ ID NO: 328893 - RNA, 22 nt, Human
uguucauaucauuuugaaagcu

SEQ ID NO: 328894 - RNA, 19 nt, Human
acacaccagugccugugac

SEQ ID NO: 328895 - RNA, 22 nt, Human
gccugcacucaaacacucucuu

SEQ ID NO: 328896 - RNA, 22 nt, Human
uuguaagacuguagaaugcaaa

SEQ ID NO: 328897 - RNA, 22 nt, Human
cugguuuuuagugcuuaggagu

SEQ ID NO: 328898 - RNA, 22 nt, Human
gugggggcaggcagugcuagga

SEQ ID NO: 328899 - RNA, 22 nt, Human
gcagggcagggcaagaacuggg

SEQ ID NO: 328900 - RNA, 19 nt, Human
uccugcccaccagccaggg

SEQ ID NO: 328901 - RNA, 22 nt, Human
ugcaucauuaagguacaguugg

SEQ ID NO: 328902 - RNA, 22 nt, Human
cuguggcuaggaagcuguggga

SEQ ID NO: 328903 - RNA, 16 nt, Human
ggcagcagcuccgugc

SEQ ID NO: 328904 - RNA, 22 nt, Human
gguuccaggcauggcaggaugu

SEQ ID NO: 328905 - RNA, 22 nt, Human
guccuggugccaccugcgggau

SEQ ID NO: 328906 - RNA, 22 nt, Human
gagcugcuggccuccugcggga

SEQ ID NO: 328907 - RNA, 22 nt, Human
uugcugugucauuuguuuaauc

SEQ ID NO: 328908 - RNA, 22 nt, Human
ugcagaauauucuggugacaau

SEQ ID NO: 328909 - RNA, 22 nt, Human
agucuuagaacuacagugccua

SEQ ID NO: 328910 - RNA, 22 nt, Human
gugcaggugguuggcccagccg

SEQ ID NO: 328911 - RNA, 22 nt, Human
acugguuuuggaaaucaguaca

SEQ ID NO: 328912 - RNA, 22 nt, Human
uggggugccgacagggagggca

SEQ ID NO: 328913 - RNA, 22 nt, Human
cugcuuuaaaacugauacauga

SEQ ID NO: 328914 - RNA, 22 nt, Human
ccagaacagaccugccugaccu

SEQ ID NO: 328915 - RNA, 22 nt, Human
gcggggggcaggcaguacguug

SEQ ID NO: 328916 - RNA, 22 nt, Human
ccugcagacacuuguccagcaa

SEQ ID NO: 328917 - RNA, 22 nt, Human
ugcauguuuuauaccaaagcuu

SEQ ID NO: 328918 - RNA, 22 nt, Human
gcccuguguguuugcacugauu

SEQ ID NO: 328919 - RNA, 21 nt, Human
acagaagcggcgaguggcccc

SEQ ID NO: 328920 - RNA, 22 nt, Human
gcucaugggcccagagcagccc

SEQ ID NO: 328921 - RNA, 22 nt, Human
uucacagcucauacuguucuca

SEQ ID NO: 328922 - RNA, 22 nt, Human
acuggcccuggcugcuaggcug

SEQ ID NO: 328923 - RNA, 22 nt, Human
cucagaguccauaguuuacagu

SEQ ID NO: 328924 - RNA, 22 nt, Human
ccaggcccugcuccucacacca

SEQ ID NO: 328925 - RNA, 22 nt, Human
uuucucagccuccuugcuggag

SEQ ID NO: 328926 - RNA, 22 nt, Human
ucugccaucaagaugcucuggc

SEQ ID NO: 328927 - RNA, 22 nt, Human
cagcugcuguucaguuuuguuu

SEQ ID NO: 328928 - RNA, 22 nt, Human
cagggccagggcuauggugaag

SEQ ID NO: 328929 - RNA, 22 nt, Human
ggcagguguggugaccagagau

SEQ ID NO: 328930 - RNA, 22 nt, Human
augugagcuggggcccggccag

SEQ ID NO: 328931 - RNA, 22 nt, Human
uggcugcccccucccguggaca

SEQ ID NO: 328932 - RNA, 22 nt, Human
gcagcucucuggccugcccugg

SEQ ID NO: 328933 - RNA, 22 nt, Human
gcccagggcugcaaguggacgc

SEQ ID NO: 328934 - RNA, 19 nt, Human
ugcagcuguaugagcuuaa

SEQ ID NO: 328935 - RNA, 22 nt, Human
ccagagcugcagguaaaaugcu

SEQ ID NO: 328936 - RNA, 22 nt, Human
uggcagcagggccccuggagga

SEQ ID NO: 328937 - RNA, 22 nt, Human
ccugguccccaucggcccagcg

SEQ ID NO: 328938 - RNA, 22 nt, Human
aggaaaauggaccagaguuguu

SEQ ID NO: 328939 - RNA, 20 nt, Human
ugugcccaauguccagguuc

SEQ ID NO: 328940 - RNA, 22 nt, Human
cagaggccccauuggcugugcg

SEQ ID NO: 328941 - RNA, 22 nt, Human
cauagacauugauagguuauau

SEQ ID NO: 328942 - RNA, 22 nt, Human
uggugcugccaccuccucugcu

SEQ ID NO: 328943 - RNA, 22 nt, Human
ccuggccugugaaucugagagc

SEQ ID NO: 328944 - RNA, 17 nt, Human
ccuuucuucccagaggg

SEQ ID NO: 328945 - RNA, 22 nt, Human
cgugcagcggagcuggucacug

SEQ ID NO: 328946 - RNA, 22 nt, Human
agagucaguuaugucaagugcu

SEQ ID NO: 328947 - RNA, 22 nt, Human
aaggaggaauguagccagcucc

SEQ ID NO: 328948 - RNA, 22 nt, Human
ccugaggcccuggcugugcuga

SEQ ID NO: 328949 - RNA, 22 nt, Human
gccagccccagacauccuaucg

SEQ ID NO: 328950 - RNA, 22 nt, Human
gcaggccugucuugcucgcccu

SEQ ID NO: 328951 - RNA, 21 nt, Human
acccugcuuuaugccguccuc

SEQ ID NO: 328952 - RNA, 22 nt, Human
ccagcuugcuccucugcaaugg

SEQ ID NO: 328953 - RNA, 22 nt, Human
ugugugcucgauggcccugcag

SEQ ID NO: 328954 - RNA, 22 nt, Human
ucaggcuagcccagugcuuggg

SEQ ID NO: 328955 - RNA, 22 nt, Human
guugggcugaagugugugcuua

SEQ ID NO: 328956 - RNA, 22 nt, Human
augaacaguacaaagcacagac

SEQ ID NO: 328957 - RNA, 22 nt, Human
aagggccagggcucuagagaua

SEQ ID NO: 328958 - RNA, 22 nt, Human
augucccugagggucucucuga

SEQ ID NO: 328959 - RNA, 22 nt, Human
ucagauggaaugaugccacugc

SEQ ID NO: 328960 - RNA, 19 nt, Human
gcagcugugggaagagcca

SEQ ID NO: 328961 - RNA, 22 nt, Human
gcucccugguauugcugccacu

SEQ ID NO: 328962 - RNA, 22 nt, Human
ugcugcucaagcugcagcaaaa

SEQ ID NO: 328963 - RNA, 22 nt, Human
uuucuacacuucgugguguuuu

SEQ ID NO: 328964 - RNA, 16 nt, Human
gcagguggggcgcgca

SEQ ID NO: 328965 - RNA, 21 nt, Human
ucucuccucaagcucgacccc

SEQ ID NO: 328966 - RNA, 22 nt, Human
ugaagacaguuuuacucaugag

SEQ ID NO: 328967 - RNA, 22 nt, Human
agaggaaguaaucaggaccugc

SEQ ID NO: 328968 - RNA, 22 nt, Human
ggcgcaguugagcgugcuguuc

SEQ ID NO: 328969 - RNA, 18 nt, Human
ggaggcucugugguuucc

SEQ ID NO: 328970 - RNA, 22 nt, Human
ggagcggagggagggccacugu

SEQ ID NO: 328971 - RNA, 22 nt, Human
uauacuacgcaccaaacaaagg

SEQ ID NO: 328972 - RNA, 22 nt, Human
cgcaggugccggcagauggggu

SEQ ID NO: 328973 - RNA, 22 nt, Human
acauuugauauggaguugugua

SEQ ID NO: 328974 - RNA, 22 nt, Human
ucaugcagaguagaaagggcaa

SEQ ID NO: 328975 - RNA, 22 nt, Human
gagcaccgccuccacgaugccc

SEQ ID NO: 328976 - RNA, 22 nt, Human
aagcccagcaucccugcaccag

SEQ ID NO: 328977 - RNA, 22 nt, Human
gccuggcgccgggcugccuguc

SEQ ID NO: 328978 - RNA, 22 nt, Human
uggccuugcccagcgccuaggu

SEQ ID NO: 328979 - RNA, 23 nt, Human
cguuuuuuccucagauguucugg

SEQ ID NO: 328980 - RNA, 22 nt, Human
caggaacagcaccaggagcuag

SEQ ID NO: 328981 - RNA, 22 nt, Human
uggcacguuggauugggaguuc

SEQ ID NO: 328982 - RNA, 19 nt, Human
ggauaagguuggagugauc

SEQ ID NO: 328983 - RNA, 22 nt, Human
gcagcugcgcugguguggggca

SEQ ID NO: 328984 - RNA, 22 nt, Human
cuguccuaugaguacucacuag

SEQ ID NO: 328985 - RNA, 17 nt, Human
agcuuggagcagcauga

SEQ ID NO: 328986 - RNA, 22 nt, Human
cagcccuguugcgcuuccggcg

SEQ ID NO: 328987 - RNA, 22 nt, Human
agcaccaggucgcuggcacgcu

SEQ ID NO: 328988 - RNA, 22 nt, Human
ggugcaauaaaguuguagaacc

SEQ ID NO: 328989 - RNA, 22 nt, Human
ccugcucaacgaauauggcgau

SEQ ID NO: 328990 - RNA, 22 nt, Human
uuccaaguuaggcgagcuggug

SEQ ID NO: 328991 - RNA, 18 nt, Human
ucagggaaucuuggccuu

SEQ ID NO: 328992 - RNA, 22 nt, Human
ccuuuguucacuggagagugga

SEQ ID NO: 328993 - RNA, 22 nt, Human
cgggaagguggagguugcagug

SEQ ID NO: 328994 - RNA, 22 nt, Human
ggaaggggagcuaaaucuacug

SEQ ID NO: 328995 - RNA, 22 nt, Human
uuccaggccgggcaggaaacac

SEQ ID NO: 328996 - RNA, 22 nt, Human
agccucucuguuagucacuggg

SEQ ID NO: 328997 - RNA, 22 nt, Human
uccacagugguggaauuguuca

SEQ ID NO: 328998 - RNA, 17 nt, Human adenovirus C
acccaacauagcuuuag

SEQ ID NO: 328999 - RNA, 22 nt, Human adenovirus C
cacuccaguaggccgucaccgc

SEQ ID NO: 329000 - RNA, 22 nt, Human adenovirus C
cgcccgcgaugccgaagggggc

SEQ ID NO: 329001 - RNA, 22 nt, Human adenovirus C
uuuuccgcuugcuuguauuccc

SEQ ID NO: 329002 - RNA, 22 nt, Human adenovirus C
agguagugccgggcccggcgcc

SEQ ID NO: 329003 - RNA, 22 nt, Human adenovirus C
ggcggacggaagacaacaguag

SEQ ID NO: 329004 - RNA, 22 nt, Human adenovirus C
gcugggcguuaccccgucgcgc

SEQ ID NO: 329005 - RNA, 22 nt, Human adenovirus C
gcauggaucacggcggacggcc

SEQ ID NO: 329006 - RNA, 22 nt, Human adenovirus C
cuguuagagcucuguuccagca

SEQ ID NO: 329007 - RNA, 22 nt, Human adenovirus C
cuccugcuguugcuccuccguc

SEQ ID NO: 329008 - RNA, 22 nt, Human adenovirus C
cuccgggcugcgcgcuggccag

SEQ ID NO: 329009 - RNA, 22 nt, Human adenovirus C
cugaaagcaauguaauuggguc

SEQ ID NO: 329010 - RNA, 22 nt, Human adenovirus C
ugucauaaucaguguggguucu

SEQ ID NO: 329011 - RNA, 22 nt, Human adenovirus C
cauccccgcccuguucgguguc

SEQ ID NO: 329012 - RNA, 22 nt, Human adenovirus C
auuguuccagucccgguucccu

SEQ ID NO: 329013 - RNA, 22 nt, Human adenovirus C
cacuccaguaggccgucaccgc

SEQ ID NO: 329014 - RNA, 22 nt, Human adenovirus C
guacuucccagagacgcccagg

SEQ ID NO: 329015 - RNA, 20 nt, Human adenovirus C
gguugccucggcgguggcag

SEQ ID NO: 329016 - RNA, 22 nt, Human adenovirus C
ggucguccgccaugauacccuu

SEQ ID NO: 329017 - RNA, 22 nt, Human adenovirus C
ucgcgguacagugucagcaagu

SEQ ID NO: 329018 - RNA, 22 nt, Human adenovirus C
ggcgccgggcccggcacuaccu

SEQ ID NO: 329019 - RNA, 22 nt, Human adenovirus C
gcgcguuucucgucgcguccaa

SEQ ID NO: 329020 - RNA, 22 nt, Human adenovirus C
aagcaagggcccgcggcugcug

SEQ ID NO: 329021 - RNA, 22 nt, Human adenovirus C
aaugauaggccuauagaugggg

SEQ ID NO: 329022 - RNA, 21 nt, Human adenovirus C
acauccaacagugcgggaaug

SEQ ID NO: 329023 - RNA, 17 nt, Human adenovirus C
acccaacauagcuuuag

SEQ ID NO: 329024 - RNA, 22 nt, Human adenovirus C
acgcugccacuguccgugaagg

SEQ ID NO: 329025 - RNA, 20 nt, Human adenovirus C
uccacguuggaaauuuugca

SEQ ID NO: 329026 - RNA, 22 nt, Human adenovirus C
uccccgcggcgacggcgcaugg

SEQ ID NO: 329027 - RNA, 22 nt, Human adenovirus C
uccggccguccgccgugaucca

SEQ ID NO: 329028 - RNA, 22 nt, Human adenovirus C
ugcaaaauuccaagguaggaga

SEQ ID NO: 329029 - RNA, 22 nt, Human adenovirus C
ugcagagcuucaugcugcgggg

SEQ ID NO: 329030 - RNA, 22 nt, Human adenovirus C
gaucaugucuaccugcggggcg

SEQ ID NO: 329031 - RNA, 22 nt, Human adenovirus C
gagcggugcggggugcauaggu

SEQ ID NO: 329032 - RNA, 22 nt, Human adenovirus C
cggcacguggagcucaaucucg

SEQ ID NO: 329033 - RNA, 22 nt, Human adenovirus C
cggcagcugcagcuucuuuuug

SEQ ID NO: 329034 - RNA, 22 nt, Human adenovirus C
augcgccaaagggugcgaucgc

SEQ ID NO: 329035 - RNA, 22 nt, Human adenovirus C
augaaaaaauucauagauugga

SEQ ID NO: 329036 - RNA, 22 nt, Human adenovirus C
agguuuuggccagcugguuuag

SEQ ID NO: 329037 - RNA, 22 nt, Human adenovirus C
auaggggcuacgcugguuagca

SEQ ID NO: 329038 - RNA, 22 nt, Human adenovirus C
uuggcacuucgucgagcgaggc

SEQ ID NO: 329039 - RNA, 22 nt, Human adenovirus C
uugccacugccacagagggcau

SEQ ID NO: 329040 - RNA, 22 nt, Human adenovirus C
uugccugggaggagccccacag

SEQ ID NO: 329041 - RNA, 22 nt, Human adenovirus C
gugagugcgcccauggacauaa

SEQ ID NO: 329042 - RNA, 22 nt, Human adenovirus C
guccucgucagcguagucuggg

SEQ ID NO: 329043 - RNA, 22 nt, Human adenovirus C
guggaagccuggaccgauguaa

SEQ ID NO: 329044 - RNA, 22 nt, Human adenovirus C
guugcgcgcggucauguccagc

SEQ ID NO: 329045 - RNA, 22 nt, Human
gcagagcugcagcgaggccugg

SEQ ID NO: 329046 - RNA, 22 nt, Human
aaguaaaauucaaucuucacug

SEQ ID NO: 329047 - RNA, 22 nt, Human
acaaacuuccaucaugaauuuu

SEQ ID NO: 329048 - RNA, 22 nt, Human
agcuccugugugaagccucccu

SEQ ID NO: 329049 - RNA, 22 nt, Human
uguggcacuucucuccuuguaa

SEQ ID NO: 329050 - RNA, 22 nt, Human
gagcugggaggacugggaacuu

SEQ ID NO: 329051 - RNA, 22 nt, Human
ccugcuggccacugcuccaccu

SEQ ID NO: 329052 - RNA, 21 nt, Human
ggcaucccaggccagugacug

SEQ ID NO: 329053 - RNA, 22 nt, Human
uccugguggugccggugcccgg

SEQ ID NO: 329054 - RNA, 22 nt, Human
gcccugugagucaugcggcaga

SEQ ID NO: 329055 - RNA, 22 nt, Human
aaacacaauguuucuuuguucu

SEQ ID NO: 329056 - RNA, 22 nt, Human
gcuggggagcuagaccucagca

SEQ ID NO: 329057 - RNA, 22 nt, Human
agagcuggggcccguaaagcca

SEQ ID NO: 329058 - RNA, 21 nt, Human
gagcugggcgaggcuccgggg

SEQ ID NO: 329059 - RNA, 22 nt, Human
gcuuggggagcucaguguccuu

SEQ ID NO: 329060 - RNA, 22 nt, Human
ggaggccaggaagagccgcccu

SEQ ID NO: 329061 - RNA, 22 nt, Human
agcccugugggccuuguggcac

SEQ ID NO: 329062 - RNA, 22 nt, Human
ucugcaggucacgcuccagccu

SEQ ID NO: 329063 - RNA, 20 nt, Human
agagcugggaagcucccuau

SEQ ID NO: 329064 - RNA, 22 nt, Human
cccgucccuuuugcccgcuggu

SEQ ID NO: 329065 - RNA, 22 nt, Human
gaugcuggaagugcugaucuug

SEQ ID NO: 329066 - RNA, 22 nt, Human
cccugugggaacuccugaguug

SEQ ID NO: 329067 - RNA, 19 nt, Human
ggcagagcuccugcuuucu

SEQ ID NO: 329068 - RNA, 22 nt, Human
auguaaacucacauuuucuuca

SEQ ID NO: 329069 - RNA, 22 nt, Human
cagcuccugcagcuggcuccca

SEQ ID NO: 329070 - RNA, 22 nt, Human
auaugaaaagaagucaccauug

SEQ ID NO: 329071 - RNA, 22 nt, Human
agagcuggggccagagucaagg

SEQ ID NO: 329072 - RNA, 22 nt, Human
ccugcagguugcagaggcggaa

SEQ ID NO: 329073 - RNA, 22 nt, Human
ccaggccccagggcuggcuuuc

SEQ ID NO: 329074 - RNA, 22 nt, Human
augcugggaaguccuaaccaca

SEQ ID NO: 329075 - RNA, 22 nt, Human
gagcuggggcagcuuaggagug

SEQ ID NO: 329076 - RNA, 21 nt, Human
ggugacacguggccccgcucu

SEQ ID NO: 329077 - RNA, 22 nt, Human
ggcaucccuagaauagccaggu

SEQ ID NO: 329078 - RNA, 20 nt, Human
acaaaauagguacuggguag

SEQ ID NO: 329079 - RNA, 22 nt, Human
agcugggguugcacacauuuug

SEQ ID NO: 329080 - RNA, 22 nt, Human
gagcugggucuccaccuuggca

SEQ ID NO: 329081 - RNA, 22 nt, Human
caccaggcuggagugcagaggu

SEQ ID NO: 329082 - RNA, 22 nt, Human
auauaucaugaguaaaacuuga

SEQ ID NO: 329083 - RNA, 22 nt, Human
gagggcacuggguuucaauguc

SEQ ID NO: 329084 - RNA, 19 nt, Human
gcugggagcagacccuccc

SEQ ID NO: 329085 - RNA, 20 nt, Human
ugcuggggacauacagggug

SEQ ID NO: 329086 - RNA, 22 nt, Human
uagucaaaccucagaauacccc

SEQ ID NO: 329087 - RNA, 22 nt, Human
ccagcccucgguagucccauag

SEQ ID NO: 329088 - RNA, 16 nt, Human
gcagagcucagggacu

SEQ ID NO: 329089 - RNA, 22 nt, Human
cagcccucaaaccacuuccagg

SEQ ID NO: 329090 - RNA, 22 nt, Human
cagaugcuuggaggacacuugg

SEQ ID NO: 329091 - RNA, 22 nt, Human
ccugggcagggagaccaggcuc

SEQ ID NO: 329092 - RNA, 22 nt, Human
uaugauaugcacuuuaucagaa

SEQ ID NO: 329093 - RNA, 22 nt, Human
caauacaauuaccaguuaauca

SEQ ID NO: 329094 - RNA, 22 nt, Human
ccuggggucagggacgcugugc

SEQ ID NO: 329095 - RNA, 22 nt, Human
ccuggagcacauggcaggaggc

SEQ ID NO: 329096 - RNA, 22 nt, Human
ggcaccagggcaagggucuuuc

SEQ ID NO: 329097 - RNA, 22 nt, Human
gcccugugccagucacgcugug

SEQ ID NO: 329098 - RNA, 22 nt, Human
agagcuggagcagccccacugg

SEQ ID NO: 329099 - RNA, 22 nt, Human
augccuggucccaccucuaggu

SEQ ID NO: 329100 - RNA, 22 nt, Human
agagcuggguggacuuguaguu

SEQ ID NO: 329101 - RNA, 22 nt, Human
ccugcagguccccggaugcgca

SEQ ID NO: 329102 - RNA, 22 nt, Human
ucccagccuuccagucugguuu

SEQ ID NO: 329103 - RNA, 22 nt, Human
agcaauaacagaaaacuuuccu

SEQ ID NO: 329104 - RNA, 22 nt, Human
gaggccuggaccagccacagag

SEQ ID NO: 329105 - RNA, 22 nt, Human
acauuucaguaaguguuaauuu

SEQ ID NO: 329106 - RNA, 22 nt, Human
cagagcuggagggaacccuggc

SEQ ID NO: 329107 - RNA, 23 nt, Human
agcuggaggcugucuacucccaa

SEQ ID NO: 329108 - RNA, 21 nt, Human
gcagagcuggaaccaggaccc

SEQ ID NO: 329109 - RNA, 22 nt, Human
uucuagauugccuguaaguaaa

SEQ ID NO: 329110 - RNA, 19 nt, Human
agcuggggcgguguguguu

SEQ ID NO: 329111 - RNA, 22 nt, Human
gcccugugcucaugggaacauc

SEQ ID NO: 329112 - RNA, 22 nt, Human
gagcuggggcggauacucagcu

SEQ ID NO: 329113 - RNA, 22 nt, Human
cagggagcuggugccagccgac

SEQ ID NO: 329114 - RNA, 22 nt, Human
aacugguaucucuucaguguaa

SEQ ID NO: 329115 - RNA, 22 nt, Human
gagcugggcgagccggggaagu

SEQ ID NO: 329116 - RNA, 22 nt, Human
agcccuguagauuuaggagagu

SEQ ID NO: 329117 - RNA, 22 nt, Human
gggccccugggaauucugugau

SEQ ID NO: 329118 - RNA, 22 nt, Human
cugggauccacgggcucccaag

SEQ ID NO: 329119 - RNA, 22 nt, Human
ugguauucuuucuguagaucau

SEQ ID NO: 329120 - RNA, 22 nt, Human
uccugcagccauuagaggucaa

SEQ ID NO: 329121 - RNA, 22 nt, Human
cccuguccugcuaggcccuggu

SEQ ID NO: 329122 - RNA, 22 nt, Human
cccugccuuguuggagccuaug

SEQ ID NO: 329123 - RNA, 22 nt, Human
gcccuuggaacagccuccugcu

SEQ ID NO: 329124 - RNA, 22 nt, Human
cagggagcagcgcuggggccuc

SEQ ID NO: 329125 - RNA, 22 nt, Human
ggaggccaccugaccugcuguu

SEQ ID NO: 329126 - RNA, 22 nt, Human
gcccuugggagguuccacuggg

SEQ ID NO: 329127 - RNA, 22 nt, Human
ccuguccagggacugagggaga

SEQ ID NO: 329128 - RNA, 20 nt, Human
ugcagagcugacauuaccug

SEQ ID NO: 329129 - RNA, 18 nt, Human
ugcugggguagaauccac

SEQ ID NO: 329130 - RNA, 22 nt, Human
agcuggggguagugagaaauaa

SEQ ID NO: 329131 - RNA, 22 nt, Human
ucccugucuaauaugccaugaa

SEQ ID NO: 329132 - RNA, 22 nt, Human
agagcuggauggucaagauggc

SEQ ID NO: 329133 - RNA, 18 nt, Human
gcagagcugggauuccca

SEQ ID NO: 329134 - RNA, 22 nt, Human
caugagauaauuuuucuccagu

SEQ ID NO: 329135 - RNA, 22 nt, Human
aacuaaaacugguuuguucucu

SEQ ID NO: 329136 - RNA, 23 nt, Human
uggcaccaggcauucuaggggua

SEQ ID NO: 329137 - RNA, 20 nt, Human
ccuguggagcugccuccucc

SEQ ID NO: 329138 - RNA, 22 nt, Human
cugggcuuguguuagcugacaa

SEQ ID NO: 329139 - RNA, 22 nt, Human
ugcugggggugucucaccaggc

SEQ ID NO: 329140 - RNA, 20 nt, Human
gcugggcuaccacuggcccu

SEQ ID NO: 329141 - RNA, 22 nt, Human
uuucagaucacuuucaggaaag

SEQ ID NO: 329142 - RNA, 22 nt, Human
aagcugggacuuagcgcagaua

SEQ ID NO: 329143 - RNA, 22 nt, Human
gagccuggccuccugccucagc

SEQ ID NO: 329144 - RNA, 22 nt, Human
gagggcacgaaacaaccacuuc

SEQ ID NO: 329145 - RNA, 22 nt, Human
agcuggggcugcagagaacagg

SEQ ID NO: 329146 - RNA, 22 nt, Human
cacuguaauagcauuauaagug

SEQ ID NO: 329147 - RNA, 22 nt, Human
uccugcaggccagaggggugag

SEQ ID NO: 329148 - RNA, 22 nt, Human
gcaugcugcaccagagccucuc

SEQ ID NO: 329149 - RNA, 22 nt, Human
uaguaacccacacaacaguaga

SEQ ID NO: 329150 - RNA, 22 nt, Human
gcugccucaggcaccuccuggc

SEQ ID NO: 329151 - RNA, 22 nt, Human
aaaauaguuaacguucagagua

SEQ ID NO: 329152 - RNA, 22 nt, Human
cugcagaggccucgccuccucu

SEQ ID NO: 329153 - RNA, 21 nt, Human
ccagccucagaucagggagcu

SEQ ID NO: 329154 - RNA, 22 nt, Human
aaauaucauuuauaacuuuuaa

SEQ ID NO: 329155 - RNA, 22 nt, Human
aaauauguauggaguucaugaa

SEQ ID NO: 329156 - RNA, 18 nt, Human
ggagcugggccccacucc

SEQ ID NO: 329157 - RNA, 19 nt, Human
ccuggcccugcugcgcggg

SEQ ID NO: 329158 - RNA, 22 nt, Human
ucugggguuuucacgcugucuc

SEQ ID NO: 329159 - RNA, 22 nt, Human
ggaggccacgguuuagcaccga

SEQ ID NO: 329160 - RNA, 22 nt, Human
cucagccugugaagagcagagg

SEQ ID NO: 329161 - RNA, 22 nt, Human
gagcugggccucagaacacagu

SEQ ID NO: 329162 - RNA, 22 nt, Human
cccugugggguccgccuguccg

SEQ ID NO: 329163 - RNA, 22 nt, Human
ggcaccaggaucagucugucau

SEQ ID NO: 329164 - RNA, 22 nt, Human
cagagcugcaaaugccccuccg

SEQ ID NO: 329165 - RNA, 22 nt, Human
aggcccuggguuagggcccacu

SEQ ID NO: 329166 - RNA, 22 nt, Human
cagggagcucugggccggacuc

SEQ ID NO: 329167 - RNA, 22 nt, Human
uaggacaugcuacauaaauagg

SEQ ID NO: 329168 - RNA, 22 nt, Human
aaugauugucauuccaaaaagu

SEQ ID NO: 329169 - RNA, 22 nt, Human
ccagccucaucgccugccuguc

SEQ ID NO: 329170 - RNA, 22 nt, Human
uucaaaugcaaguuacuacuuu

SEQ ID NO: 329171 - RNA, 22 nt, Human
caccaggcugaaccagagggga

SEQ ID NO: 329172 - RNA, 22 nt, Human
cccagcccacgguccugggugg

SEQ ID NO: 329173 - RNA, 22 nt, Human
guaucacuuuugagagugagaa

SEQ ID NO: 329174 - RNA, 22 nt, Human
caccaggcugcccaggacaggg

SEQ ID NO: 329175 - RNA, 22 nt, Human
uaaauguauaggcacuaaaccu

SEQ ID NO: 329176 - RNA, 22 nt, Human
agagcuggcacugacccucacc

SEQ ID NO: 329177 - RNA, 22 nt, Human
gcugggcuucacagagccuuua

SEQ ID NO: 329178 - RNA, 22 nt, Human
cagaugcuauguauuauguaug

SEQ ID NO: 329179 - RNA, 22 nt, Human
ccauggccaauugcaccuugcu

SEQ ID NO: 329180 - RNA, 22 nt, Human
aagaaaacaugaucuaauuuaa

SEQ ID NO: 329181 - RNA, 19 nt, Human
auccuggguccuccagcug

SEQ ID NO: 329182 - RNA, 22 nt, Human
aguaaaauuguauuggaaaaca

SEQ ID NO: 329183 - RNA, 17 nt, Human
guccuggugugugagga

SEQ ID NO: 329184 - RNA, 22 nt, Human
gagggcacaaaggcaacauuca

SEQ ID NO: 329185 - RNA, 22 nt, Human
ccugggaccucgcgggaagcgg

SEQ ID NO: 329186 - RNA, 18 nt, Human
auccaaaaagauggaagu

SEQ ID NO: 329187 - RNA, 22 nt, Human
uaggacauaaguauucuaacuu

SEQ ID NO: 329188 - RNA, 22 nt, Human
agcuccugcaccaggggccccu

SEQ ID NO: 329189 - RNA, 22 nt, Human
cacagcugaaguagccaugugg

SEQ ID NO: 329190 - RNA, 22 nt, Human
agagcuggagaugcagguuucg

SEQ ID NO: 329191 - RNA, 22 nt, Human
cagccccuuguccgguagccac

SEQ ID NO: 329192 - RNA, 22 nt, Human
cugggcucuaagggagcaccgu

SEQ ID NO: 329193 - RNA, 22 nt, Human
agagcugggacuuggacucaau

SEQ ID NO: 329194 - RNA, 22 nt, Human
ccucagccuuggccccaggcag

SEQ ID NO: 329195 - RNA, 22 nt, Human
ugggcaccugaggccuggcagg

SEQ ID NO: 329196 - RNA, 22 nt, Human
ugagcuggggucagcuccccug

SEQ ID NO: 329197 - RNA, 23 nt, Human
gagcugggauacaggcuuacugc

SEQ ID NO: 329198 - RNA, 22 nt, Human
augcugggacguacuuguucau

SEQ ID NO: 329199 - RNA, 22 nt, Human
ccuggggagccgccugagcccc

SEQ ID NO: 329200 - RNA, 22 nt, Human
ggcaccagcacuugggauggcu

SEQ ID NO: 329201 - RNA, 22 nt, Human
gagcugggagcugggauuugga

SEQ ID NO: 329202 - RNA, 22 nt, Human
ugcaggagcaccagcucacccu

SEQ ID NO: 329203 - RNA, 22 nt, Human
cccugccugugggcaucaacau

SEQ ID NO: 329204 - RNA, 20 nt, Human
aagcuggguaggagaggagc

SEQ ID NO: 329205 - RNA, 17 nt, Human
auguauauuaacucuga

SEQ ID NO: 329206 - RNA, 22 nt, Human
ggcagagcugcaugagcacuca

SEQ ID NO: 329207 - RNA, 22 nt, Human
cccagcccagcguucgaggggu

SEQ ID NO: 329208 - RNA, 17 nt, Human
agcccugugcucuuuuu

SEQ ID NO: 329209 - RNA, 22 nt, Human
uccugaggagaagagugcuagg

SEQ ID NO: 329210 - RNA, 19 nt, Human
uccagccccucugugugug

SEQ ID NO: 329211 - RNA, 22 nt, Human
agcccuguuuaugccacaucau

SEQ ID NO: 329212 - RNA, 22 nt, Human
cauaaucagauguguacauaag

SEQ ID NO: 329213 - RNA, 22 nt, Human
gcugauagacugaauguuggga

SEQ ID NO: 329214 - RNA, 22 nt, Human
cugggcucagaugagaggaagg

SEQ ID NO: 329215 - RNA, 20 nt, Human
cccagcccgggccgcgcucg

SEQ ID NO: 329216 - RNA, 22 nt, Human
cccugccccaggcggcuucacu

SEQ ID NO: 329217 - RNA, 22 nt, Human
agagcugggugaagugccauca

SEQ ID NO: 329218 - RNA, 17 nt, Human
ggcaccagacggagagu

SEQ ID NO: 329219 - RNA, 22 nt, Human
gacacuccagcuuuuggcucaa

SEQ ID NO: 329220 - RNA, 22 nt, Human
cccuguggcaggaggaggagca

SEQ ID NO: 329221 - RNA, 22 nt, Human
gucaaaugcacagaaccauuaa

SEQ ID NO: 329222 - RNA, 22 nt, Human
uccugcagaccucagucagguc

SEQ ID NO: 329223 - RNA, 22 nt, Human
ucccugagcucacauggcagga

SEQ ID NO: 329224 - RNA, 20 nt, Human
agggcagcuugaggagccgg

SEQ ID NO: 329225 - RNA, 17 nt, Human
ggcagagcugacagggc

SEQ ID NO: 329226 - RNA, 22 nt, Human
cugucuccuccacugcauggga

SEQ ID NO: 329227 - RNA, 22 nt, Human
cugucuccagggcaggugcagg

SEQ ID NO: 329228 - RNA, 22 nt, Human
uagcuggguugaggucaucuac

SEQ ID NO: 329229 - RNA, 22 nt, Human
gagcugggcacacgccacuuga

SEQ ID NO: 329230 - RNA, 22 nt, Human
cagcccacugccucugugguag

SEQ ID NO: 329231 - RNA, 22 nt, Human
ggagcuggucagccuugagcau

SEQ ID NO: 329232 - RNA, 22 nt, Human
cugugcccaggccccuggggau

SEQ ID NO: 329233 - RNA, 22 nt, Human
ggcaccaggacaugacucccag

SEQ ID NO: 329234 - RNA, 21 nt, Human
agagcugguagguagguaggu

SEQ ID NO: 329235 - RNA, 22 nt, Human
auauaacauacauacagaaaag

SEQ ID NO: 329236 - RNA, 22 nt, Human
cugguggagaugccuggccccu

SEQ ID NO: 329237 - RNA, 22 nt, Human
gagcugggacuuggaauccaca

SEQ ID NO: 329238 - RNA, 22 nt, Human
cuccaggauguuagacguccag

SEQ ID NO: 329239 - RNA, 21 nt, Human
caggccccaggccuggggugc

SEQ ID NO: 329240 - RNA, 22 nt, Human
ucccugaggaagggguguggug

SEQ ID NO: 329241 - RNA, 22 nt, Human
uccugcagagccgcccucaggu

SEQ ID NO: 329242 - RNA, 22 nt, Human
aagcugggagggagcccagagu

SEQ ID NO: 329243 - RNA, 22 nt, Human
cugcaggagugaaagcaggccu

SEQ ID NO: 329244 - RNA, 22 nt, Human
ccuggugaauguucauggacug

SEQ ID NO: 329245 - RNA, 22 nt, Human
ggcacagggggcugaggacuag

SEQ ID NO: 329246 - RNA, 22 nt, Human
uccacuggcccaccuccucagu

SEQ ID NO: 329247 - RNA, 22 nt, Human
uagcugggucucuguuuucuca

SEQ ID NO: 329248 - RNA, 22 nt, Human
ucucagccucaccucuauggag

SEQ ID NO: 329249 - RNA, 22 nt, Human
gagcugggauucaucuaugucu

SEQ ID NO: 329250 - RNA, 22 nt, Human
gagcuccucccaggguagcacu

SEQ ID NO: 329251 - RNA, 22 nt, Human
cugcagagcagccaguccccca

SEQ ID NO: 329252 - RNA, 19 nt, Human
agcuccuguucagcagcuc

SEQ ID NO: 329253 - RNA, 19 nt, Human
cugcucccuccuucuggca

SEQ ID NO: 329254 - RNA, 22 nt, Human
ccugcaggcugcaggccaguuc

SEQ ID NO: 329255 - RNA, 22 nt, Human
cugggcuagaaggaccaggaug

SEQ ID NO: 329256 - RNA, 22 nt, Human
cugggcucaagaagucuucccu

SEQ ID NO: 329257 - RNA, 22 nt, Human
agaagucauuuauguuagauga

SEQ ID NO: 329258 - RNA, 22 nt, Human
gugcugggcuccaccccagagg

SEQ ID NO: 329259 - RNA, 22 nt, Human
agagcuggcugcugcggugcuu

SEQ ID NO: 329260 - RNA, 22 nt, Human
aaaaugauauccugacuuuuau

SEQ ID NO: 329261 - RNA, 22 nt, Human
gagcugggaagauagcuugagc

SEQ ID NO: 329262 - RNA, 22 nt, Human
uuaugguaauuaaaacauguau

SEQ ID NO: 329263 - RNA, 22 nt, Human
ucagacaaguaaaauaauguaa

SEQ ID NO: 329264 - RNA, 22 nt, Human
gcugggcucuuaucaccuguac

SEQ ID NO: 329265 - RNA, 22 nt, Human
gaccaggcuuccccagaccuca

SEQ ID NO: 329266 - RNA, 22 nt, Human
gcugggcucuuuaccccuguac

SEQ ID NO: 329267 - RNA, 22 nt, Human
ccugguggccuucagcccacaa

SEQ ID NO: 329268 - RNA, 22 nt, Human
ccugguggacagcagccagcag

SEQ ID NO: 329269 - RNA, 22 nt, Human
agagcuggggcauaaaugccac

SEQ ID NO: 329270 - RNA, 22 nt, Human
cugggguuggccagggcccuag

SEQ ID NO: 329271 - RNA, 22 nt, Human
aacuaaaucuggcauuuagagc

SEQ ID NO: 329272 - RNA, 22 nt, Human
gaucucaaagcaguguggguug

SEQ ID NO: 329273 - RNA, 22 nt, Human
cugcaggacgaccgccucaucu

SEQ ID NO: 329274 - RNA, 22 nt, Human
agagcuggcugguagcccugau

SEQ ID NO: 329275 - RNA, 22 nt, Human
acaacaaaaucacuagucuucc

SEQ ID NO: 329276 - RNA, 22 nt, Human
ccagggagcggggcugggucuc

SEQ ID NO: 329277 - RNA, 22 nt, Human
cccuguccuggaugggagcacu

SEQ ID NO: 329278 - RNA, 22 nt, Human
ggcaccagggacaauccucuuc

SEQ ID NO: 329279 - RNA, 22 nt, Human
cagcuccugccugggcagcugu

SEQ ID NO: 329280 - RNA, 22 nt, Human
uaggacauguguuuuauauaug

SEQ ID NO: 329281 - RNA, 22 nt, Human
ccaggcccuugcaagucccacc

SEQ ID NO: 329282 - RNA, 22 nt, Human
uuccugguaaauuauguccagg

SEQ ID NO: 329283 - RNA, 22 nt, Human
cugggugagcuggccagagggu

SEQ ID NO: 329284 - RNA, 22 nt, Human
cccugugguugcuagggcacag

SEQ ID NO: 329285 - RNA, 22 nt, Human
gauaauauuagaagauacaaau

SEQ ID NO: 329286 - RNA, 19 nt, Human
gggcuccuugggccucucu

SEQ ID NO: 329287 - RNA, 22 nt, Human
cugcagaguggagccucggcug

SEQ ID NO: 329288 - RNA, 22 nt, Human
gcagagcugggauaugaaccca

SEQ ID NO: 329289 - RNA, 20 nt, Human
acuuuacugagcuguaauuc

SEQ ID NO: 329290 - RNA, 22 nt, Human
ucagcuucagaucagcuagaga

SEQ ID NO: 329291 - RNA, 22 nt, Human
ggagcuggcagcgcaacccaga

SEQ ID NO: 329292 - RNA, 22 nt, Human
cccuggucagggaaggcgccug

SEQ ID NO: 329293 - RNA, 23 nt, Human
aauuuaguuugagacauuagccu

SEQ ID NO: 329294 - RNA, 22 nt, Human
ccuggggagagaaagcccagcc

SEQ ID NO: 329295 - RNA, 22 nt, Human
agcuccugucucaagggagccu

SEQ ID NO: 329296 - RNA, 22 nt, Human
cugcaggggcaguccacuuccu

SEQ ID NO: 329297 - RNA, 22 nt, Human
ccugggcuuucggcggcuuccu

SEQ ID NO: 329298 - RNA, 23 nt, Human
uccuggugacaugccugagcauc

SEQ ID NO: 329299 - RNA, 22 nt, Human
ccuggagcuuggucacgcugcg

SEQ ID NO: 329300 - RNA, 23 nt, Human
ccugaagggucaggguccucagc

SEQ ID NO: 329301 - RNA, 22 nt, Human
gcugggaggaucucucccuguc

SEQ ID NO: 329302 - RNA, 22 nt, Human
cucucugaggaaggagcaucug

SEQ ID NO: 329303 - RNA, 22 nt, Human
cugucccucaguucugggcaaa

SEQ ID NO: 329304 - RNA, 22 nt, Human
ccccugccagcuaucccugaac

SEQ ID NO: 329305 - RNA, 22 nt, Human
gccccuggcuggccagcuccuc

SEQ ID NO: 329306 - RNA, 19 nt, Human
uguagcuagugucuaucca

SEQ ID NO: 329307 - RNA, 22 nt, Human
agaggacacaucuuuccucaaa

SEQ ID NO: 329308 - RNA, 20 nt, Human
uggcaccaggugguggcccc

SEQ ID NO: 329309 - RNA, 17 nt, Human
uggcacagaggugcuau

SEQ ID NO: 329310 - RNA, 22 nt, Human
ccugacagcgugucccuggccc

SEQ ID NO: 329311 - RNA, 22 nt, Human
uauccaaaguuucucagaaacu

SEQ ID NO: 329312 - RNA, 21 nt, Human
gcaaaugaguuaacuaacuca

SEQ ID NO: 329313 - RNA, 22 nt, Human
gucugggguacuuucaucugau

SEQ ID NO: 329314 - RNA, 22 nt, Human
uagcuggggcuuucauucuugc

SEQ ID NO: 329315 - RNA, 22 nt, Human
ugcuggggcagaagagccaaga

SEQ ID NO: 329316 - RNA, 22 nt, Human
ccugcagguuucccccggacgg

SEQ ID NO: 329317 - RNA, 22 nt, Human
auaaaugauucagcaggaaaua

SEQ ID NO: 329318 - RNA, 22 nt, Human
ugcuggggcucugaccacucca

SEQ ID NO: 329319 - RNA, 22 nt, Human
gugcauccacuagggcucuccc

SEQ ID NO: 329320 - RNA, 22 nt, Human
aaaaguauuuuggaucucagau

SEQ ID NO: 329321 - RNA, 22 nt, Human
agagcuggacgucugagcccua

SEQ ID NO: 329322 - RNA, 22 nt, Human
cccuguggaggcagcauccugc

SEQ ID NO: 329323 - RNA, 18 nt, Human
agcuggggccucuggucc

SEQ ID NO: 329324 - RNA, 22 nt, Human
uccugagggcucggggcucaug

SEQ ID NO: 329325 - RNA, 20 nt, Human
ggcagagcuaugucuguugc

SEQ ID NO: 329326 - RNA, 22 nt, Human
agcuggggguuggauaagggua

SEQ ID NO: 329327 - RNA, 22 nt, Human
gcugggcuugguuucccugcuu

SEQ ID NO: 329328 - RNA, 22 nt, Human
gagguggcgcgccaucccugcc

SEQ ID NO: 329329 - RNA, 22 nt, Human
agacuuuaaugugcaaaugaaa

SEQ ID NO: 329330 - RNA, 22 nt, Human
ccuggagcaaaaaucuaaggag

SEQ ID NO: 329331 - RNA, 22 nt, Human
agcuccugcgcacggugcacac

SEQ ID NO: 329332 - RNA, 22 nt, Human
agguauuauuagcaucucuauu

SEQ ID NO: 329333 - RNA, 22 nt, Human
cugggcucaaauccuggcccug

SEQ ID NO: 329334 - RNA, 22 nt, Human
uuuacugaacugcuaguacagg

SEQ ID NO: 329335 - RNA, 22 nt, Human
cccuguccuuggcugugaggcu

SEQ ID NO: 329336 - RNA, 22 nt, Human
gauguuuuaggucccuguagcu

SEQ ID NO: 329337 - RNA, 22 nt, Human
gagcugggcuggcuuccucccu

SEQ ID NO: 329338 - RNA, 21 nt, Human
agagcuggccugccaggcccu

SEQ ID NO: 329339 - RNA, 22 nt, Human
agagcuggcugugggugacuuu

SEQ ID NO: 329340 - RNA, 19 nt, Human
cagccucaaucccucgggc

SEQ ID NO: 329341 - RNA, 22 nt, Human
agcccugucucucacuccaggu

SEQ ID NO: 329342 - RNA, 22 nt, Human
agagcuggaaucagaccucagg

SEQ ID NO: 329343 - RNA, 20 nt, Human
ucccugccuuuuacugcugg

SEQ ID NO: 329344 - RNA, 22 nt, Human
caggcucagcaggagccugacc

SEQ ID NO: 329345 - RNA, 18 nt, Human
aagcugggaaggagacag

SEQ ID NO: 329346 - RNA, 22 nt, Human
uuucagaucauuuuuuaaguac

SEQ ID NO: 329347 - RNA, 22 nt, Human
agaggaggccaggcccacaccu

SEQ ID NO: 329348 - RNA, 22 nt, Human
ugggcuccggcggccucaggcu

SEQ ID NO: 329349 - RNA, 21 nt, Human
accaggccaggaggcuggcac

SEQ ID NO: 329350 - RNA, 22 nt, Human
gcuuccuggagggagagagcug

SEQ ID NO: 329351 - RNA, 22 nt, Human
ugaguuauaaugaauauuugaa

SEQ ID NO: 329352 - RNA, 22 nt, Human
uccuguggggaaaagccuaucu

SEQ ID NO: 329353 - RNA, 20 nt, Human
agcuccugguauaggugccu

SEQ ID NO: 329354 - RNA, 22 nt, Human
uccugcagagacagaggccuca

SEQ ID NO: 329355 - RNA, 22 nt, Human
agaugguagguggcaggacuga

SEQ ID NO: 329356 - RNA, 22 nt, Human
ccuguggagcuuucagcagcuc

SEQ ID NO: 329357 - RNA, 22 nt, Human
ggcauccugggacuggcuucuu

SEQ ID NO: 329358 - RNA, 22 nt, Human
ccuggcagcaggugggcccgug

SEQ ID NO: 329359 - RNA, 22 nt, Human
ccaggcccugccugugguuccu

SEQ ID NO: 329360 - RNA, 18 nt, Human
gagcugggagaaggaagg

SEQ ID NO: 329361 - RNA, 22 nt, Human
gagcugggacauggguccucuc

SEQ ID NO: 329362 - RNA, 22 nt, Human
gagcugggauuugaaccuggga

SEQ ID NO: 329363 - RNA, 22 nt, Human
ggcagagccuucuggagcucgc

SEQ ID NO: 329364 - RNA, 22 nt, Human
uggcaccaggcgggguggcugu

SEQ ID NO: 329365 - RNA, 22 nt, Human
gagcuggguauauggcuuuaug

SEQ ID NO: 329366 - RNA, 22 nt, Human
uucaguaugauuccuccaguag

SEQ ID NO: 329367 - RNA, 22 nt, Human
agagcuggaaaaguuguuuuaa

SEQ ID NO: 329368 - RNA, 21 nt, Human
ggagcuggggagcuggcccca

SEQ ID NO: 329369 - RNA, 21 nt, Human
cagagcuguccaaacccugac

SEQ ID NO: 329370 - RNA, 22 nt, Human
cccacucccugcacgccugccg

SEQ ID NO: 329371 - RNA, 22 nt, Human
caccagguuccgggcagagcug

SEQ ID NO: 329372 - RNA, 22 nt, Human
agagcuggugcauauucagaaa

SEQ ID NO: 329373 - RNA, 22 nt, Human
cugggcuccuaaccauccaggu

SEQ ID NO: 329374 - RNA, 22 nt, Human
ccagccccuauccucgcuccac

SEQ ID NO: 329375 - RNA, 22 nt, Human
gcaccaggcagcugagcaggcc

SEQ ID NO: 329376 - RNA, 22 nt, Human
gcagagcuucuguccuucagga

SEQ ID NO: 329377 - RNA, 22 nt, Human
ugggcaccuagcaacccuucuc

SEQ ID NO: 329378 - RNA, 22 nt, Human
gcagcaggcuuuucauaccuug

SEQ ID NO: 329379 - RNA, 22 nt, Human
agagcugguuuacucaggaauu

SEQ ID NO: 329380 - RNA, 20 nt, Human
ggcaccaggcuaggauugga

SEQ ID NO: 329381 - RNA, 22 nt, Human
ggcaccagggaaggaaggcugg

SEQ ID NO: 329382 - RNA, 22 nt, Human
cagccccuuccuggcaucugga

SEQ ID NO: 329383 - RNA, 22 nt, Human
gggcccugugauuucuugagga

SEQ ID NO: 329384 - RNA, 17 nt, Human
ccagggaggggccgcgc

SEQ ID NO: 329385 - RNA, 22 nt, Human
ugcagagcuucauugcauaggc

SEQ ID NO: 329386 - RNA, 22 nt, Human
cagagcuguccaaacccugaca

SEQ ID NO: 329387 - RNA, 22 nt, Human
uccugcagccacugcaggcaga

SEQ ID NO: 329388 - RNA, 22 nt, Human
gagggcacucgagacuacggca

SEQ ID NO: 329389 - RNA, 22 nt, Human
gcaccaggcuuagagccccagg

SEQ ID NO: 329390 - RNA, 22 nt, Human
ggagcuggccgccuaugugcag

SEQ ID NO: 329391 - RNA, 22 nt, Human
cugucccucaucaccucugggu

SEQ ID NO: 329392 - RNA, 18 nt, Human
ucuggaacaacuucaugu

SEQ ID NO: 329393 - RNA, 23 nt, Human
ccagcccuccaccagcucuaggc

SEQ ID NO: 329394 - RNA, 22 nt, Human
ccugcagggugcugccacagau

SEQ ID NO: 329395 - RNA, 20 nt, Human
agcccuguuuccuggagaga

SEQ ID NO: 329396 - RNA, 22 nt, Human
ggcaccagcaggcaccgaugcc

SEQ ID NO: 329397 - RNA, 22 nt, Human
cccucagcuccacccucagcag

SEQ ID NO: 329398 - RNA, 22 nt, Human
aaauauguuuuccaguugucau

SEQ ID NO: 329399 - RNA, 22 nt, Human
ucaaaguagccggauggaauuu

SEQ ID NO: 329400 - RNA, 22 nt, Human
uccugaggcuaaagugcagugg

SEQ ID NO: 329401 - RNA, 22 nt, Human
agagcugggaccgucuggaagu

SEQ ID NO: 329402 - RNA, 22 nt, Human
gggcuccuccucugacuguggc

SEQ ID NO: 329403 - RNA, 22 nt, Human
gcccauggcagaacugugagca

SEQ ID NO: 329404 - RNA, 22 nt, Human
ggcaccaggcugggcauaggcc

SEQ ID NO: 329405 - RNA, 19 nt, Human
cagcccucuuaccacugug

SEQ ID NO: 329406 - RNA, 22 nt, Human
uccugaggcacaauccuagaau

SEQ ID NO: 329407 - RNA, 22 nt, Human
gccuguggggcugaggcugccu

SEQ ID NO: 329408 - RNA, 22 nt, Human
ccuggguacccuuggcggccuu

SEQ ID NO: 329409 - RNA, 22 nt, Human
agguggcagagugacaggcuga

SEQ ID NO: 329410 - RNA, 22 nt, Human
gcagagcucaugccugcaccuc

SEQ ID NO: 329411 - RNA, 22 nt, Human
agagcuggccagggaucacucu

SEQ ID NO: 329412 - RNA, 22 nt, Human
gcccagcccugaggucacagcu

SEQ ID NO: 329413 - RNA, 23 nt, Human
uccugaggaauggcaucucacau

SEQ ID NO: 329414 - RNA, 22 nt, Human
cccugcagccuugcaugccuuc

SEQ ID NO: 329415 - RNA, 22 nt, Human
gcaccgagaaggaagcaugccu

SEQ ID NO: 329416 - RNA, 22 nt, Human
agagcuggggcucuggguuuaa

SEQ ID NO: 329417 - RNA, 22 nt, Human
acuuuacuccccaacauaaaug

SEQ ID NO: 329418 - RNA, 22 nt, Human
gagcuggguguuuauuugccaa

SEQ ID NO: 329419 - RNA, 22 nt, Human
gcccaugguuacuuuucuggcu

SEQ ID NO: 329420 - RNA, 21 nt, Human
agagcugggacuugccugaga

SEQ ID NO: 329421 - RNA, 22 nt, Human
ccacucccuuccgguccagggc

SEQ ID NO: 329422 - RNA, 22 nt, Human
gcccuguguguuugcacugauu

SEQ ID NO: 329423 - RNA, 22 nt, Human
uccuguggcguuaucaugugau

SEQ ID NO: 329424 - RNA, 22 nt, Human
cugcagccucaaccuccugagc

SEQ ID NO: 329425 - RNA, 22 nt, Human
gcaggagcugcucuccugacga

SEQ ID NO: 329426 - RNA, 22 nt, Human
agccugggcccugccucuucuc

SEQ ID NO: 329427 - RNA, 22 nt, Human
ccagcccugaacccugcugcau

SEQ ID NO: 329428 - RNA, 22 nt, Human
uccugcaggggcugaggaacca

SEQ ID NO: 329429 - RNA, 20 nt, Human
cugggcucaagugauccucc

SEQ ID NO: 329430 - RNA, 22 nt, Human
uagcugggaauuaucugguugc

SEQ ID NO: 329431 - RNA, 22 nt, Human
aucauccuagaaggaagcuagg

SEQ ID NO: 329432 - RNA, 22 nt, Human
agagcuggcagcagcuucuccu

SEQ ID NO: 329433 - RNA, 22 nt, Human
agagcugggugguggugacuca

SEQ ID NO: 329434 - RNA, 22 nt, Human
agagcuggaagcugcucuuaga

SEQ ID NO: 329435 - RNA, 16 nt, Human
ggcaccagugaacaca

SEQ ID NO: 329436 - RNA, 22 nt, Human
ggcaucccuucuuccaguguca

SEQ ID NO: 329437 - RNA, 22 nt, Human
cuggugcacauucgcucucaua

SEQ ID NO: 329438 - RNA, 22 nt, Human
cacagcugucagcugaccuagg

SEQ ID NO: 329439 - RNA, 22 nt, Human
uuucagaugguauauacaguag

SEQ ID NO: 329440 - RNA, 22 nt, Human
agcuggggcauuuauccacuaa

SEQ ID NO: 329441 - RNA, 22 nt, Human
caccaggcacauaguaggcacu

SEQ ID NO: 329442 - RNA, 22 nt, Human
cugucacccacccagccuguca

SEQ ID NO: 329443 - RNA, 21 nt, Human
ugggcaccaaaaccuaggagu

SEQ ID NO: 329444 - RNA, 22 nt, Human
ccugucaggguuugccucagaa

SEQ ID NO: 329445 - RNA, 22 nt, Human
ugcugggcuggagcugccaggg

SEQ ID NO: 329446 - RNA, 22 nt, Human
gagcugggaguuauagcauguu

SEQ ID NO: 329447 - RNA, 22 nt, Human
ccuggggucacuugcagccgca

SEQ ID NO: 329448 - RNA, 22 nt, Human
ggagcuggagagcuagccuagg

SEQ ID NO: 329449 - RNA, 22 nt, Human
ccugcagggaaucgaggcagaa

SEQ ID NO: 329450 - RNA, 22 nt, Human
ucaaaguauuuuaacuguaucc

SEQ ID NO: 329451 - RNA, 20 nt, Human
cugggcucgguggcccuggc

SEQ ID NO: 329452 - RNA, 22 nt, Human
ccucucccgggugccgcugggc

SEQ ID NO: 329453 - RNA, 20 nt, Human
aggcuccuguaccugaggaa

SEQ ID NO: 329454 - RNA, 22 nt, Human
ggagcugggaacuauguaguau

SEQ ID NO: 329455 - RNA, 22 nt, Human
cugggcucaguggcucauggcu

SEQ ID NO: 329456 - RNA, 22 nt, Human
uccugcaguuacaucccagcca

SEQ ID NO: 329457 - RNA, 22 nt, Human
ugcugaggcccaggagcacuuu

SEQ ID NO: 329458 - RNA, 22 nt, Human
uauaaaugccaggacuuuagau

SEQ ID NO: 329459 - RNA, 22 nt, Human
gugcaccccggggcccugcucc

SEQ ID NO: 329460 - RNA, 22 nt, Human
ugaucaaaacauuacuccacca

SEQ ID NO: 329461 - RNA, 22 nt, Human
gcaggagcucguuuccaggcug

SEQ ID NO: 329462 - RNA, 20 nt, Human
uuucagauuuacagaaaugu

SEQ ID NO: 329463 - RNA, 22 nt, Human
gcagagcuccccaagacaccaa

SEQ ID NO: 329464 - RNA, 22 nt, Human
uccacuggaacaacucugaggc

SEQ ID NO: 329465 - RNA, 22 nt, Human
ccuggagcuuuuccauccugga

SEQ ID NO: 329466 - RNA, 22 nt, Human
caaguaaagaaucacauuucuu

SEQ ID NO: 329467 - RNA, 22 nt, Human
cccugguguccacuggaggaag

SEQ ID NO: 329468 - RNA, 22 nt, Human
uccuguggcucuguggaaccuu

SEQ ID NO: 329469 - RNA, 22 nt, Human
augcugggagugaagccccugg

SEQ ID NO: 329470 - RNA, 22 nt, Human
gcccugugcuuggauggcagau

SEQ ID NO: 329471 - RNA, 22 nt, Human
uugucuaaugagcuccacuuca

SEQ ID NO: 329472 - RNA, 22 nt, Human
ugggggagccuucacaguagcu

SEQ ID NO: 329473 - RNA, 22 nt, Human
cuggagcagcagguggccaggg

SEQ ID NO: 329474 - RNA, 22 nt, Human
guguggucgaaguucucccgga

SEQ ID NO: 329475 - RNA, 22 nt, Human
ucccugccuccuggcagugcca

SEQ ID NO: 329476 - RNA, 22 nt, Human
gcccagcaccucucucaggguu

SEQ ID NO: 329477 - RNA, 22 nt, Human
ggugauuuccuuuugcaaaguc

SEQ ID NO: 329478 - RNA, 22 nt, Human
ccuggagacccacuucugccaa

SEQ ID NO: 329479 - RNA, 22 nt, Human
uuugaaauguaucaguauaggu

SEQ ID NO: 329480 - RNA, 22 nt, Human
ggcucuggcgagcuuuaguaca

SEQ ID NO: 329481 - RNA, 21 nt, Human
gccaucaccaagcucuucccc

SEQ ID NO: 329482 - RNA, 22 nt, Human
gaaggacccucuggggucucag

SEQ ID NO: 329483 - RNA, 22 nt, Human
ccuggggagaagagcuuccccc

SEQ ID NO: 329484 - RNA, 22 nt, Human
aggggagguguccccaaaucuc

SEQ ID NO: 329485 - RNA, 22 nt, Human
gcuugcugaacaggaaccuggc

SEQ ID NO: 329486 - RNA, 20 nt, Human
ugggguccuggaggggaucc

SEQ ID NO: 329487 - RNA, 22 nt, Human
ugugagauuuuauuugauaugc

SEQ ID NO: 329488 - RNA, 22 nt, Human
ggaaggggagcuaaaucuacug

SEQ ID NO: 329489 - RNA, 16 nt, Human
gcagguggggcgcgca

SEQ ID NO: 329490 - RNA, 22 nt, Human
cagugccaaggauggccuggga

SEQ ID NO: 329491 - RNA, 22 nt, Human
ucgggacgguggcauuugugcc

SEQ ID NO: 329492 - RNA, 22 nt, Human
uccaggagggggagccgugccg

SEQ ID NO: 329493 - RNA, 22 nt, Human
gcaugcaggaagggcuugggga

SEQ ID NO: 329494 - RNA, 22 nt, Human
ucccuggcugguguagagggau

SEQ ID NO: 329495 - RNA, 20 nt, Human
guggcagugguggcagcagu

SEQ ID NO: 329496 - RNA, 22 nt, Human
cucugggguggaggaggcugac

SEQ ID NO: 329497 - RNA, 22 nt, Human
gacuguggacucucaugauaga

SEQ ID NO: 329498 - RNA, 22 nt, Human
gagcugcuggccuccugcggga

SEQ ID NO: 329499 - RNA, 23 nt, Human
ugucuugguuucuucacccuagu

SEQ ID NO: 329500 - RNA, 22 nt, Human
ccuggccgacauggugaaacgc

SEQ ID NO: 329501 - RNA, 22 nt, Human
ggcuuuuguuucagcucugcua

SEQ ID NO: 329502 - RNA, 22 nt, Human
caagagcuuuagaaaugcucau

SEQ ID NO: 329503 - RNA, 22 nt, Human
cuggcuuugaucagagugaccu

SEQ ID NO: 329504 - RNA, 22 nt, Human
ugggccagauccauggcaauaa

SEQ ID NO: 329505 - RNA, 22 nt, Human
guuuugaauacuacuagaacuu

SEQ ID NO: 329506 - RNA, 22 nt, Human
cucugccagccaaagucaucac

SEQ ID NO: 329507 - RNA, 22 nt, Human
aaguuugucucauuugaucuuc

SEQ ID NO: 329508 - RNA, 22 nt, Human
gaggcuguaacuugggcacugg

SEQ ID NO: 329509 - RNA, 19 nt, Human
cgcacagccugccaggcgc

SEQ ID NO: 329510 - RNA, 21 nt, Human
gcugcucgagauccagugcuu

SEQ ID NO: 329511 - RNA, 22 nt, Human
ucuccuggcauuugguugagua

SEQ ID NO: 329512 - RNA, 22 nt, Human
agugauguagguggauucuggc

SEQ ID NO: 329513 - RNA, 22 nt, Human
uggcuguagaaucagagacuug

SEQ ID NO: 329514 - RNA, 22 nt, Human
uagcugcuugaccaggcagugg

SEQ ID NO: 329515 - RNA, 22 nt, Human
cugagcagucuagccagguguu

SEQ ID NO: 329516 - RNA, 22 nt, Human
ccugugucaucagcuguggcua

SEQ ID NO: 329517 - RNA, 22 nt, Human
uucuuuuaauuucugucugcag

SEQ ID NO: 329518 - RNA, 22 nt, Human
ucauccugaagaaccugcuucc

SEQ ID NO: 329519 - RNA, 22 nt, Human
gaaaauaguucaucacaaugau

SEQ ID NO: 329520 - RNA, 22 nt, Human
cuucuucagaggccagccucug

SEQ ID NO: 329521 - RNA, 22 nt, Human
agggcuccuaugccccauggac

SEQ ID NO: 329522 - RNA, 22 nt, Human
ccagugugcauuaucauguguc

SEQ ID NO: 329523 - RNA, 22 nt, Human
cucugaauggacacuccagugu

SEQ ID NO: 329524 - RNA, 21 nt, Human
agaugcaguuugcaggugggu

SEQ ID NO: 329525 - RNA, 22 nt, Human
gagcagcagcugggccagguuc

SEQ ID NO: 329526 - RNA, 22 nt, Human
aggcucaguauagcuggcaagu

SEQ ID NO: 329527 - RNA, 18 nt, Human
ucagaggagauaccuaaa

SEQ ID NO: 329528 - RNA, 19 nt, Human
ggcugccuucugcucaucu

SEQ ID NO: 329529 - RNA, 22 nt, Human
ggagaguggauuccagcuguau

SEQ ID NO: 329530 - RNA, 22 nt, Human
gucugcccuuggccugggacuu

SEQ ID NO: 329531 - RNA, 22 nt, Human
agcaccagcucaaggugcaccu

SEQ ID NO: 329532 - RNA, 22 nt, Human
caauuuuuaaacuaugaaguug

SEQ ID NO: 329533 - RNA, 23 nt, Human
gcacagagcaguuaggggaagau

SEQ ID NO: 329534 - RNA, 22 nt, Human
uaagggcugacuuggaacuguc

SEQ ID NO: 329535 - RNA, 22 nt, Human
agucauguguucaucuuucauu

SEQ ID NO: 329536 - RNA, 22 nt, Human
ucaggccaggagaucagauuga

SEQ ID NO: 329537 - RNA, 22 nt, Human
agcgcuugccgcacuccaagca

SEQ ID NO: 329538 - RNA, 22 nt, Human
ggccacuguuuccugggcaguu

SEQ ID NO: 329539 - RNA, 22 nt, Human
cugguuuuccaauguuuugacu

SEQ ID NO: 329540 - RNA, 22 nt, Human
auucccauagccauccggagag

SEQ ID NO: 329541 - RNA, 22 nt, Human
aacccaggaguuggaggcugug

SEQ ID NO: 329542 - RNA, 22 nt, Human
cgccccagccaguugagcggcg

SEQ ID NO: 329543 - RNA, 22 nt, Human
guccacauaggaacccagcuuc

SEQ ID NO: 329544 - RNA, 22 nt, Human
ucuucaugucaugguauauuga

SEQ ID NO: 329545 - RNA, 22 nt, Human
cgggaagguggagguugcagug

SEQ ID NO: 329546 - RNA, 22 nt, Human
gucugcugacagagcauggacc

SEQ ID NO: 329547 - RNA, 22 nt, Human
ugcugcucuucaccauggccuc

SEQ ID NO: 329548 - RNA, 22 nt, Human
cagcugcucugguggucucucc

SEQ ID NO: 329549 - RNA, 22 nt, Human
cuucagagugacucagcaucuu

SEQ ID NO: 329550 - RNA, 22 nt, Human
aggacaggauugagcugaacug

SEQ ID NO: 329551 - RNA, 22 nt, Human
gccccagcguggcuguguuagg

SEQ ID NO: 329552 - RNA, 22 nt, Human
aaacccaggguuuugucuuccc

SEQ ID NO: 329553 - RNA, 22 nt, Human
uuuccaaggaugugucucucua

SEQ ID NO: 329554 - RNA, 22 nt, Human
gucugcccugcagacaugccuc

SEQ ID NO: 329555 - RNA, 22 nt, Human
ucucugagguuguuuccagcac

SEQ ID NO: 329556 - RNA, 22 nt, Human
agugcguggaccccuggcugcu

SEQ ID NO: 329557 - RNA, 22 nt, Human
augcccagaacccccuggaugg

SEQ ID NO: 329558 - RNA, 22 nt, Human
aagcagccagccaucaugcccg

SEQ ID NO: 329559 - RNA, 22 nt, Human
cuggccagccucccagguaccc

SEQ ID NO: 329560 - RNA, 22 nt, Human
cagcuggaggagcagcuuccag

SEQ ID NO: 329561 - RNA, 22 nt, Human
cugggcccaggcggcucucgga

SEQ ID NO: 329562 - RNA, 22 nt, Human
uggaagggguuacgcagcagga

SEQ ID NO: 329563 - RNA, 22 nt, Human
ccauggccugaaggagugcauc

SEQ ID NO: 329564 - RNA, 22 nt, Human
cccaccagaccugcaccggcac

SEQ ID NO: 329565 - RNA, 22 nt, Human
ugaaguuguuaagguugccauu

SEQ ID NO: 329566 - RNA, 22 nt, Human
ccaggcagccugcuccauucug

SEQ ID NO: 329567 - RNA, 22 nt, Human
ugagcucaagcaauucacccgc

SEQ ID NO: 329568 - RNA, 22 nt, Human
uggagccagcaggacucagagg

SEQ ID NO: 329569 - RNA, 22 nt, Human
agccagcauauauauaguugaa

SEQ ID NO: 329570 - RNA, 22 nt, Human
uccuggcucaggccccuggugc

SEQ ID NO: 329571 - RNA, 22 nt, Human
gagagaagggggauaugagccu

SEQ ID NO: 329572 - RNA, 22 nt, Human
uggggcuccuccuggcaggagg

SEQ ID NO: 329573 - RNA, 22 nt, Human
uaauuuugucacagugacaugc

SEQ ID NO: 329574 - RNA, 22 nt, Human
ucacagcucacuguagccucga

SEQ ID NO: 329575 - RNA, 22 nt, Human
cugcucucuguuccccuggauc

SEQ ID NO: 329576 - RNA, 22 nt, Human
aguggcaguagaugagcugguu

SEQ ID NO: 329577 - RNA, 22 nt, Human
auggccagcaagguagggcaau

SEQ ID NO: 329578 - RNA, 22 nt, Human
uuuacuguuuacagcuaaugca

SEQ ID NO: 329579 - RNA, 22 nt, Human
uugcacgcuugcgguuccugcc

SEQ ID NO: 329580 - RNA, 22 nt, Human
cuggccagggugcgaucguggu

SEQ ID NO: 329581 - RNA, 22 nt, Human
agaaaagaggcuuucuaagcau

SEQ ID NO: 329582 - RNA, 22 nt, Human
ugggaagauaugagugaccaac

SEQ ID NO: 329583 - RNA, 22 nt, Human
cucucuccuuagcugcagacca

SEQ ID NO: 329584 - RNA, 22 nt, Human
cgggagccucugggucacacug

SEQ ID NO: 329585 - RNA, 22 nt, Human
cuuuauguuggggugucuuagu

SEQ ID NO: 329586 - RNA, 22 nt, Human
uucugugcucaaaacuuuccaa

SEQ ID NO: 329587 - RNA, 22 nt, Human
cgggcuccgggucuuugcaguc

SEQ ID NO: 329588 - RNA, 22 nt, Human
agcugggcuggagcuccaagcg

SEQ ID NO: 329589 - RNA, 23 nt, Human
agcccagcagagaaccuaggucc

SEQ ID NO: 329590 - RNA, 22 nt, Human
gugauugugaaaacauuaagaa

SEQ ID NO: 329591 - RNA, 22 nt, Human
ugcugguucuuaggagagagau

SEQ ID NO: 329592 - RNA, 18 nt, Human
cuggucucccuucgcuuu

SEQ ID NO: 329593 - RNA, 22 nt, Human
ccggcgucucuuccacuuccua

SEQ ID NO: 329594 - RNA, 20 nt, Human
aggaaggagaaucugagcaa

SEQ ID NO: 329595 - RNA, 22 nt, Human
ugcauguuuuauaccaaagcuu

SEQ ID NO: 329596 - RNA, 22 nt, Human
ugaggccugaagccuggagccu

SEQ ID NO: 329597 - RNA, 22 nt, Human
uguauuucugcuuucucuagua

SEQ ID NO: 329598 - RNA, 22 nt, Human
caggccuugaaggccugcggga

SEQ ID NO: 329599 - RNA, 22 nt, Human
uacuuugagaugaugcugaucg

SEQ ID NO: 329600 - RNA, 22 nt, Human
gagcucagccugaggccuggcu

SEQ ID NO: 329601 - RNA, 22 nt, Human
gucaucaucaggcagaugcugc

SEQ ID NO: 329602 - RNA, 22 nt, Human
uuuguucaccuagcaaacuuuu

SEQ ID NO: 329603 - RNA, 22 nt, Human
guccuguguaaguacuugcuca

SEQ ID NO: 329604 - RNA, 22 nt, Human
gaggggcugggguugacuccaa

SEQ ID NO: 329605 - RNA, 20 nt, Human
uggcccagcacgacgaggac

SEQ ID NO: 329606 - RNA, 22 nt, Human
cugcgggcugucaggcgugcca

SEQ ID NO: 329607 - RNA, 19 nt, Human
gcuuccagcacugcaggag

SEQ ID NO: 329608 - RNA, 22 nt, Human
uuguaagacuguagaaugcaaa

SEQ ID NO: 329609 - RNA, 22 nt, Human
ugggagcaagcuggugcuggag

SEQ ID NO: 329610 - RNA, 22 nt, Human
ugcccugcagacccugcagugu

SEQ ID NO: 329611 - RNA, 22 nt, Human
cgaggaggaaacgcggagaacu

SEQ ID NO: 329612 - RNA, 22 nt, Human
cuugccaguguugcagaagcuc

SEQ ID NO: 329613 - RNA, 22 nt, Human
cuggagaggcugggaacagguu

SEQ ID NO: 329614 - RNA, 22 nt, Human
cagggcuccccagagagccucu

SEQ ID NO: 329615 - RNA, 22 nt, Human
gaccugguccuuguacuuugaa

SEQ ID NO: 329616 - RNA, 22 nt, Human
caagggcagcagccucaagcgg

SEQ ID NO: 329617 - RNA, 22 nt, Human
auuuccagcagcauauuugucu

SEQ ID NO: 329618 - RNA, 22 nt, Human
guaugucaugagccuugugcgu

SEQ ID NO: 329619 - RNA, 20 nt, Human
cugaccagcagccugucucc

SEQ ID NO: 329620 - RNA, 23 nt, Human
cagcugguugugggaguggcugc

SEQ ID NO: 329621 - RNA, 22 nt, Human
ucagcacaggucuugcaaaaca

SEQ ID NO: 329622 - RNA, 22 nt, Human
cugggccacaagccugugugau

SEQ ID NO: 329623 - RNA, 22 nt, Human
uuuggagagaugaaguucugug

SEQ ID NO: 329624 - RNA, 22 nt, Human
uugagacugagucucgcccugu

SEQ ID NO: 329625 - RNA, 22 nt, Human
uuccaggaagcucucggccucu

SEQ ID NO: 329626 - RNA, 22 nt, Human
accagagcuggcagaguaucaa

SEQ ID NO: 329627 - RNA, 22 nt, Human
gcucuaugaaccugaaucucac

SEQ ID NO: 329628 - RNA, 22 nt, Human
cggcuggagcugagaaaggagc

SEQ ID NO: 329629 - RNA, 22 nt, Human
ugguccugagcaccagccugac

SEQ ID NO: 329630 - RNA, 22 nt, Human
agccaccaccacugaaagguua

SEQ ID NO: 329631 - RNA, 23 nt, Human
gguucugccgcuuacugcugugc

SEQ ID NO: 329632 - RNA, 22 nt, Human
agcaggaggagagccuggcggu

SEQ ID NO: 329633 - RNA, 19 nt, Human
ugguggaggugcaccugac

SEQ ID NO: 329634 - RNA, 22 nt, Human
ugcccucagcagcagcuccugc

SEQ ID NO: 329635 - RNA, 22 nt, Human
uaaccaagcaaacuuucauugu

SEQ ID NO: 329636 - RNA, 22 nt, Human
cugaaggacacgugaggagcca

SEQ ID NO: 329637 - RNA, 19 nt, Human
ccuggcccugcugcgcggg

SEQ ID NO: 329638 - RNA, 22 nt, Human
gcugccuggaauaacggcuggc

SEQ ID NO: 329639 - RNA, 23 nt, Human
gcauccagagcucaguccccuuu

SEQ ID NO: 329640 - RNA, 22 nt, Human
gggcuccagccaggugucccca

SEQ ID NO: 329641 - RNA, 22 nt, Human
cuggagcucuccagagccccgu

SEQ ID NO: 329642 - RNA, 22 nt, Human
ccagcugcugcaccgugcaugg

SEQ ID NO: 329643 - RNA, 22 nt, Human
uuuuccuucugauacuccauuu

SEQ ID NO: 329644 - RNA, 22 nt, Human
cggcagagcccugagucagccu

SEQ ID NO: 329645 - RNA, 20 nt, Human
cucaccagguguaggcugag

SEQ ID NO: 329646 - RNA, 22 nt, Human
uggcuccguuguacaggcugga

SEQ ID NO: 329647 - RNA, 22 nt, Human
ccucuggccuaggccgggagag

SEQ ID NO: 329648 - RNA, 22 nt, Human
ugggucagauugagccccuggu

SEQ ID NO: 329649 - RNA, 22 nt, Human
cuaguuuuaagcuccuugaggu

SEQ ID NO: 329650 - RNA, 20 nt, Human
ucacuguaauugccuacauu

SEQ ID NO: 329651 - RNA, 22 nt, Human
uauagcagcaugauuuauaguc

SEQ ID NO: 329652 - RNA, 22 nt, Human
cuugccagggacucagucaggg

SEQ ID NO: 329653 - RNA, 22 nt, Human
cacagaaucugugacuccaaga

SEQ ID NO: 329654 - RNA, 22 nt, Human
cugaagcugggcacuuccuuuu

SEQ ID NO: 329655 - RNA, 22 nt, Human
uggcugggagcuggaacugggc

SEQ ID NO: 329656 - RNA, 18 nt, Human
uggguggcuagggaguuu

SEQ ID NO: 329657 - RNA, 22 nt, Human
gugcagcugguggagucugggg

SEQ ID NO: 329658 - RNA, 21 nt, Human
ucagcuugcuucauuauuaug

SEQ ID NO: 329659 - RNA, 22 nt, Human
ggcggcgcguagccggagacuu

SEQ ID NO: 329660 - RNA, 22 nt, Human
agagacuguaaugagagguaca

SEQ ID NO: 329661 - RNA, 22 nt, Human
ggcagguguuuuuauauuaaag

SEQ ID NO: 329662 - RNA, 22 nt, Human
cugguggaauggcagagggaac

SEQ ID NO: 329663 - RNA, 22 nt, Human
gguuuguugggguccaggccca

SEQ ID NO: 329664 - RNA, 17 nt, Human
agcagcuggguugaucu

SEQ ID NO: 329665 - RNA, 22 nt, Human
uccguggggccuguggcuuccg

SEQ ID NO: 329666 - RNA, 22 nt, Human
uuccagaacaauguggacguau

SEQ ID NO: 329667 - RNA, 22 nt, Human
gagguccacugaggcaacaggg

SEQ ID NO: 329668 - RNA, 21 nt, Human
ugcaaugcauugacagcagca

SEQ ID NO: 329669 - RNA, 22 nt, Human
guccuggugccaccugcgggau

SEQ ID NO: 329670 - RNA, 17 nt, Human
ucuggaugucauggaag

SEQ ID NO: 329671 - RNA, 22 nt, Human
ccgcgagguggagguugcagug

SEQ ID NO: 329672 - RNA, 18 nt, Human
ucuuccaacacugacacc

SEQ ID NO: 329673 - RNA, 22 nt, Human
gccccacuguggaaccuaaguc

SEQ ID NO: 329674 - RNA, 22 nt, Human
ccagcuggcccagcugugcucc

SEQ ID NO: 329675 - RNA, 22 nt, Human
ugcuggccucggcgcugggccu

SEQ ID NO: 329676 - RNA, 22 nt, Human
accauccaaacugcuuucugug

SEQ ID NO: 329677 - RNA, 22 nt, Human
uggcuccuuccgcagcaugccu

SEQ ID NO: 329678 - RNA, 22 nt, Human
uuuggcgucucucaggagcuca

SEQ ID NO: 329679 - RNA, 18 nt, Human
gagagcccagcagguggu

SEQ ID NO: 329680 - RNA, 22 nt, Human
gcggggggcagcagucgcucag

SEQ ID NO: 329681 - RNA, 21 nt, Human
ggcagcucagcagauggggac

SEQ ID NO: 329682 - RNA, 22 nt, Human
cagcagcaggcgcacggccguc

SEQ ID NO: 329683 - RNA, 22 nt, Human
cucagcaacccacacacggucu

SEQ ID NO: 329684 - RNA, 22 nt, Human
cgcgcugcagacagcggaggcc

SEQ ID NO: 329685 - RNA, 22 nt, Human
gcaggccugucuugcucgcccu

SEQ ID NO: 329686 - RNA, 22 nt, Human
ucaugcagaguagaaagggcaa

SEQ ID NO: 329687 - RNA, 22 nt, Human
auggcuguguuguuccucugaa

SEQ ID NO: 329688 - RNA, 22 nt, Human
cuggcaguguccagcucgugau

SEQ ID NO: 329689 - RNA, 22 nt, Human
ucacccagacugucugacucuu

SEQ ID NO: 329690 - RNA, 22 nt, Human
gccuggcgccgggcugccuguc

SEQ ID NO: 329691 - RNA, 22 nt, Human
ucugcuguuuacugugugauau

SEQ ID NO: 329692 - RNA, 22 nt, Human
uggcacguuggauugggaguuc

SEQ ID NO: 329693 - RNA, 22 nt, Human
ggacauggaaguauggagugga

SEQ ID NO: 329694 - RNA, 22 nt, Human
gcugaaguugccuauuuuaaua

SEQ ID NO: 329695 - RNA, 22 nt, Human
ggcuagcuuagagucaugcuag

SEQ ID NO: 329696 - RNA, 19 nt, Human
uccugcccaccagccaggg

SEQ ID NO: 329697 - RNA, 22 nt, Human
ggagccaguuuagaccucaguu

SEQ ID NO: 329698 - RNA, 22 nt, Human
agaguguggaaauguucagagu

SEQ ID NO: 329699 - RNA, 22 nt, Human
caucaguuccugccccugcccc

SEQ ID NO: 329700 - RNA, 22 nt, Human
aaggcagcaugaaucccuguac

SEQ ID NO: 329701 - RNA, 22 nt, Human
gcuuccaaugcuucuaucacau

SEQ ID NO: 329702 - RNA, 22 nt, Human
ugucauauagaauguucuauga

SEQ ID NO: 329703 - RNA, 22 nt, Human
cccaggaggcagaaguugcagu

SEQ ID NO: 329704 - RNA, 22 nt, Human
uuugcuggagaugagcgugggu

SEQ ID NO: 329705 - RNA, 22 nt, Human
cucuccaggcgagguccuacug

SEQ ID NO: 329706 - RNA, 21 nt, Human
acccugcuuuaugccguccuc

SEQ ID NO: 329707 - RNA, 22 nt, Human
gugcagcugugguggagccagg

SEQ ID NO: 329708 - RNA, 22 nt, Human
ggggaggaagcuggaacacggg

SEQ ID NO: 329709 - RNA, 22 nt, Human
ucucugccacagcuucugccuu

SEQ ID NO: 329710 - RNA, 22 nt, Human
uccuggguccauggcagccgaa

SEQ ID NO: 329711 - RNA, 22 nt, Human
acucgcggcggacggcggccag

SEQ ID NO: 329712 - RNA, 22 nt, Human
acuguucacccagcacuagcag

SEQ ID NO: 329713 - RNA, 18 nt, Human
aggagcggcugcggcugc

SEQ ID NO: 329714 - RNA, 22 nt, Human
agccccaggcccggacgccucu

SEQ ID NO: 329715 - RNA, 21 nt, Human
uuccuccucuggagaagaaga

SEQ ID NO: 329716 - RNA, 22 nt, Human
uugaugcugucuuucagaauca

SEQ ID NO: 329717 - RNA, 22 nt, Human
gccagugccugcugcucagggc

SEQ ID NO: 329718 - RNA, 22 nt, Human
cggcagcgguuggagguuguag

SEQ ID NO: 329719 - RNA, 22 nt, Human
agcuuuggcaucugacuagccg

SEQ ID NO: 329720 - RNA, 22 nt, Human
ccagcagcucccucaggguccg

SEQ ID NO: 329721 - RNA, 22 nt, Human
ccugcgggcugugcugaagccu

SEQ ID NO: 329722 - RNA, 22 nt, Human
ucugcucagccgaucugcuccg

SEQ ID NO: 329723 - RNA, 22 nt, Human
ugggugccaaccucugguggcc

SEQ ID NO: 329724 - RNA, 22 nt, Human
acgugcuggagaagagcucgcc

SEQ ID NO: 329725 - RNA, 22 nt, Human
aggcagaugggagcuggaaguu

SEQ ID NO: 329726 - RNA, 22 nt, Human
uugucucuacagagaguaguag

SEQ ID NO: 329727 - RNA, 22 nt, Human
gggccccaagaaccuccuccug

SEQ ID NO: 329728 - RNA, 22 nt, Human
ugcagcugccuagggcuggcuu

SEQ ID NO: 329729 - RNA, 22 nt, Human
ugggcugcuucuauuggugguc

SEQ ID NO: 329730 - RNA, 22 nt, Human
aaagcagcagcacguggaagag

SEQ ID NO: 329731 - RNA, 22 nt, Human
uccagcucugcugugcgccggu

SEQ ID NO: 329732 - RNA, 22 nt, Human
gcucaugggcccagagcagccc

SEQ ID NO: 329733 - RNA, 22 nt, Human
uccggcggccggccugagcccg

SEQ ID NO: 329734 - RNA, 22 nt, Human
ugcugugcuggcggcagaggcc

SEQ ID NO: 329735 - RNA, 22 nt, Human
agaugacuaacauaguauugcu

SEQ ID NO: 329736 - RNA, 22 nt, Human
caaaauuguugaugcugcuuug

SEQ ID NO: 329737 - RNA, 22 nt, Human
caugcuggucagccaguggaug

SEQ ID NO: 329738 - RNA, 22 nt, Human
gugugcgccgacacagccaggu

SEQ ID NO: 329739 - RNA, 22 nt, Human
caggccacacggcggcucccug

SEQ ID NO: 329740 - RNA, 18 nt, Human
ucugaaggaaugauucca

SEQ ID NO: 329741 - RNA, 22 nt, Human
uugaagcauuugcuauagcauu

SEQ ID NO: 329742 - RNA, 22 nt, Human
uaggauaugcauuuuuauacau

SEQ ID NO: 329743 - RNA, 22 nt, Human
aacaugaugacauuguaagcuu

SEQ ID NO: 329744 - RNA, 22 nt, Human
gcccagcugcacccuggugggu

SEQ ID NO: 329745 - RNA, 22 nt, Human
aaugagauggaggacucuuaau

SEQ ID NO: 329746 - RNA, 22 nt, Human
ugcuggaagggucggcgugggc

SEQ ID NO: 329747 - RNA, 22 nt, Human
gcagggcagggcaagaacuggg

SEQ ID NO: 329748 - RNA, 22 nt, Human
cauccauagauugagagauggu

SEQ ID NO: 329749 - RNA, 22 nt, Human
cugaacaucccgcagugcacga

SEQ ID NO: 329750 - RNA, 22 nt, Human
uugccaggggacaucuggagcc

SEQ ID NO: 329751 - RNA, 22 nt, Human
cucaugucggcaggacucgccc

SEQ ID NO: 329752 - RNA, 22 nt, Human
uccgcgcucucacccgcucccg

SEQ ID NO: 329753 - RNA, 21 nt, Human
gcuggcugucucuuacacggu

SEQ ID NO: 329754 - RNA, 22 nt, Human
uggccgggaagggacagugugg

SEQ ID NO: 329755 - RNA, 22 nt, Human
cugugcuggcagaccuggaguu

SEQ ID NO: 329756 - RNA, 22 nt, Human
aaggaucauguauauguuuaag

SEQ ID NO: 329757 - RNA, 22 nt, Human
caaaugaugcauggcuagugag

SEQ ID NO: 329758 - RNA, 22 nt, Human
agcuggugugccaguuccaguu

SEQ ID NO: 329759 - RNA, 22 nt, Human
ggagguggagcuggaaguucca

SEQ ID NO: 329760 - RNA, 22 nt, Human
gugcuggcuggggcaucaggca

SEQ ID NO: 329761 - RNA, 22 nt, Human
cucugcaggcacccaggguggg

SEQ ID NO: 329762 - RNA, 19 nt, Human
ucuggcugccaaggauuga

SEQ ID NO: 329763 - RNA, 22 nt, Human
aacccuggggcugcucugccug

SEQ ID NO: 329764 - RNA, 22 nt, Human
ugggaagaguuagagacagcug

SEQ ID NO: 329765 - RNA, 21 nt, Human
gcuccuggugcugcguggcgc

SEQ ID NO: 329766 - RNA, 22 nt, Human
gcugcaagugcauguugcaacu

SEQ ID NO: 329767 - RNA, 22 nt, Human
gcagaagcugggcagcgaggug

SEQ ID NO: 329768 - RNA, 22 nt, Human
uuuacuuuugguaaggucauuu

SEQ ID NO: 329769 - RNA, 22 nt, Human
gcugcaggcucugcaggaauug

SEQ ID NO: 329770 - RNA, 22 nt, Human
auggguggccccgugugcaguc

SEQ ID NO: 329771 - RNA, 22 nt, Human
cagggagcuggugccagccgac

SEQ ID NO: 329772 - RNA, 21 nt, Human
caggccaaaagguucaacauu

SEQ ID NO: 329773 - RNA, 22 nt, Human
ccaggcccugccugugguuccu

SEQ ID NO: 329774 - RNA, 22 nt, Human
uugcaaauaauagccugaaacu

SEQ ID NO: 329775 - RNA, 22 nt, Human
ugaguggacgugaggcugagua

SEQ ID NO: 329776 - RNA, 22 nt, Human
augcaguggcagcuccuggugu

SEQ ID NO: 329777 - RNA, 22 nt, Human
gcagcucacagucuccgccauc

SEQ ID NO: 329778 - RNA, 22 nt, Human
gcggcccgagcaggacgggugg

SEQ ID NO: 329779 - RNA, 22 nt, Human
caagggcagaggcagggccccg

SEQ ID NO: 329780 - RNA, 19 nt, Human
auagaguagaguaucuguu

SEQ ID NO: 329781 - RNA, 22 nt, Human
cugggaagggacgccagugccu

SEQ ID NO: 329782 - RNA, 22 nt, Human
uccaggaguccuggguggcccc

SEQ ID NO: 329783 - RNA, 22 nt, Human
aagggccagggcucuagagaua

SEQ ID NO: 329784 - RNA, 22 nt, Human
cgugcggccucggggcccggcu

SEQ ID NO: 329785 - RNA, 20 nt, Human
ccuguucacugcgcaguuuc

SEQ ID NO: 329786 - RNA, 22 nt, Human
guugggcugaagugugugcuua

SEQ ID NO: 329787 - RNA, 22 nt, Human
aggugcugccccgagaaggaug

SEQ ID NO: 329788 - RNA, 22 nt, Human
ggcaguggcuccucucuacucc

SEQ ID NO: 329789 - RNA, 22 nt, Human
cuaggugauccacugcucucuu

SEQ ID NO: 329790 - RNA, 21 nt, Human
uugauuuagcagaucuagcug

SEQ ID NO: 329791 - RNA, 22 nt, Human
aagcagcauaugacagcaucca

SEQ ID NO: 329792 - RNA, 22 nt, Human
uguggagcccccaggagugggg

SEQ ID NO: 329793 - RNA, 21 nt, Human
ucaggaagagccaguucaugc

SEQ ID NO: 329794 - RNA, 22 nt, Human
gcucccugguauugcugccacu

SEQ ID NO: 329795 - RNA, 22 nt, Human
ccaggcaaagcccaugcaagag

SEQ ID NO: 329796 - RNA, 22 nt, Human
uggugcaggccaagcugcgagc

SEQ ID NO: 329797 - RNA, 22 nt, Human
aggggaauggguagacuguuga

SEQ ID NO: 329798 - RNA, 22 nt, Human
cggagcagagccacucgggccg

SEQ ID NO: 329799 - RNA, 22 nt, Human
auucuugauauagauaguuaau

SEQ ID NO: 329800 - RNA, 22 nt, Human
agccucucuguuagucacuggg

SEQ ID NO: 329801 - RNA, 22 nt, Human
aagcuggccuguaccugcugag

SEQ ID NO: 329802 - RNA, 22 nt, Human
agcuuugggcagaagaggauuc

SEQ ID NO: 329803 - RNA, 22 nt, Human
guucaaccaugauuaggaacug

SEQ ID NO: 329804 - RNA, 18 nt, Human
cagaaaguuauuuacucu

SEQ ID NO: 329805 - RNA, 22 nt, Human
cagcuccagcccaggcagcucc

SEQ ID NO: 329806 - RNA, 22 nt, Human
caggccugugacaccgugucug

SEQ ID NO: 329807 - RNA, 22 nt, Human
augggaggcagacacuaaguuc

SEQ ID NO: 329808 - RNA, 22 nt, Human
gccagcuagaggcugcagugca

SEQ ID NO: 329809 - RNA, 22 nt, Human
ccagcuugcuccucugcaaugg

SEQ ID NO: 329810 - RNA, 22 nt, Human
cccaggaacagcacagaacagc

SEQ ID NO: 329811 - RNA, 22 nt, Human
gauauucauaggcagguauuua

SEQ ID NO: 329812 - RNA, 22 nt, Human
ugagcauuaccugaggccacug

SEQ ID NO: 329813 - RNA, 22 nt, Human
uccuggccaaguagauguggcg

SEQ ID NO: 329814 - RNA, 22 nt, Human
uuguuuguaaggcucuuagaau

SEQ ID NO: 329815 - RNA, 22 nt, Human
ugggaugagcuauauagaaagu

SEQ ID NO: 329816 - RNA, 22 nt, Human
gcccagcgagcagagguggacg

SEQ ID NO: 329817 - RNA, 22 nt, Human
agggggcuccuuggugugcaga

SEQ ID NO: 329818 - RNA, 22 nt, Human
gcagaagcccggucagcgcacg

SEQ ID NO: 329819 - RNA, 22 nt, Human
caugagaucugcagggaugggc

SEQ ID NO: 329820 - RNA, 22 nt, Human
agcucaguggcuggggcgcugc

SEQ ID NO: 329821 - RNA, 22 nt, Human
aaugcuuuuugcgaaaugugca

SEQ ID NO: 329822 - RNA, 22 nt, Human
cugcugagguggagauugcagu

SEQ ID NO: 329823 - RNA, 22 nt, Human
uguuggcagugcuacagucagu

SEQ ID NO: 329824 - RNA, 22 nt, Human
uccucuccaggugagccgaaau

SEQ ID NO: 329825 - RNA, 22 nt, Human
gaggagaggcuggacgcgguga

SEQ ID NO: 329826 - RNA, 22 nt, Human
guucugucugagcaccacagga

SEQ ID NO: 329827 - RNA, 22 nt, Human
ggcggugguugagaggacggcg

SEQ ID NO: 329828 - RNA, 22 nt, Human
cagggugacugcccuggccacu

SEQ ID NO: 329829 - RNA, 22 nt, Human
caccugagcaacccugugcggg

SEQ ID NO: 329830 - RNA, 22 nt, Human
caacauggcgaaaccccaucuc

SEQ ID NO: 329831 - RNA, 22 nt, Human
ccauccaugguguugguuguau

SEQ ID NO: 329832 - RNA, 22 nt, Human
uggccuuggucacaaugcaaac

SEQ ID NO: 329833 - RNA, 22 nt, Human
caggaagucgcagagcuggggg

SEQ ID NO: 329834 - RNA, 22 nt, Human
ccacuuugagaagcugaugaaa

SEQ ID NO: 329835 - RNA, 22 nt, Human
ggcagcaggguagccauuucuc

SEQ ID NO: 329836 - RNA, 22 nt, Human
ggcugcccucggggucgcaggc

SEQ ID NO: 329837 - RNA, 22 nt, Human
aggagcagaacuguuguggagg

SEQ ID NO: 329838 - RNA, 22 nt, Human
uaacuucucugagccucauucc

SEQ ID NO: 329839 - RNA, 22 nt, Human
uggcucaggccuacgacgccuu

SEQ ID NO: 329840 - RNA, 23 nt, Human
ggaggcacuuaggcagagcagag

SEQ ID NO: 329841 - RNA, 22 nt, Human
uggcuccaggggacacgcagua

SEQ ID NO: 329842 - RNA, 22 nt, Human
uggcugaguuacgaacagagca

SEQ ID NO: 329843 - RNA, 22 nt, Human
gcuggguggaucggaggcucug

SEQ ID NO: 329844 - RNA, 22 nt, Human
uccuggggaggucgaggcugag

SEQ ID NO: 329845 - RNA, 22 nt, Human
gaaaccuuugccgauggggucc

SEQ ID NO: 329846 - RNA, 23 nt, Human
cauuugauccucacaauaaaugg

SEQ ID NO: 329847 - RNA, 22 nt, Human
ucagugcagggugggagagaga

SEQ ID NO: 329848 - RNA, 22 nt, Human
agcaccaggucgcuggcacgcu

SEQ ID NO: 329849 - RNA, 22 nt, Human
ccugcucaacgaauauggcgau

SEQ ID NO: 329850 - RNA, 23 nt, Human
guguggccccagggccuccucgc

SEQ ID NO: 329851 - RNA, 22 nt, Human
gugcuccaggucgcucagagag

SEQ ID NO: 329852 - RNA, 22 nt, Human
uagcagcacuauuuguuguagu

SEQ ID NO: 329853 - RNA, 22 nt, Human
cuggugcuguagccugauugag

SEQ ID NO: 329854 - RNA, 22 nt, Human
uuuccacacucacugcacucau

SEQ ID NO: 329855 - RNA, 22 nt, Human
ggcggcacgcaggcugcugucg

SEQ ID NO: 329856 - RNA, 22 nt, Human
gaaggcaagugagccaagagaa

SEQ ID NO: 329857 - RNA, 22 nt, Human
ccuggaaaaugccacuuucaca

SEQ ID NO: 329858 - RNA, 22 nt, Human
aagugacuuaaucuccucucag

SEQ ID NO: 329859 - RNA, 21 nt, Human
gugugucuaauguaguggaaa

SEQ ID NO: 329860 - RNA, 22 nt, Human
ccaggccuguguuguguggagg

SEQ ID NO: 329861 - RNA, 22 nt, Human
gucugugcaguuacuagcuggu

SEQ ID NO: 329862 - RNA, 22 nt, Human
cccucuggcucuucucaggccg

SEQ ID NO: 329863 - RNA, 22 nt, Human
gauggaggagauggcagggugc

SEQ ID NO: 329864 - RNA, 20 nt, Human
cagcucugggcaggucgagg

SEQ ID NO: 329865 - RNA, 22 nt, Human
cacggccacugcagcaccccag

SEQ ID NO: 329866 - RNA, 22 nt, Human
uaacauuucggugacaguggga

SEQ ID NO: 329867 - RNA, 22 nt, Human
aucauuuaguggggcauuggaa

SEQ ID NO: 329868 - RNA, 22 nt, Human
gggcuguaggagcuggaauggg

SEQ ID NO: 329869 - RNA, 22 nt, Human
agcacguucuucauuacuucac

SEQ ID NO: 329870 - RNA, 22 nt, Human
ccagcagccaccuucucgaaau

SEQ ID NO: 329871 - RNA, 22 nt, Human
aagcagcacagcaaugacucua

SEQ ID NO: 329872 - RNA, 22 nt, Human
uccaggcuccccugcgugcucc

SEQ ID NO: 329873 - RNA, 20 nt, Human
ucagugggaaagugagagug

SEQ ID NO: 329874 - RNA, 22 nt, Human
cagugcagccaaggacaggcac

SEQ ID NO: 329875 - RNA, 22 nt, Human
auagucuuagaaucuugagugu

SEQ ID NO: 329876 - RNA, 22 nt, Human
cauugggcggggaccucggcug

SEQ ID NO: 329877 - RNA, 22 nt, Human
cagagcugucauuugccaguga

SEQ ID NO: 329878 - RNA, 22 nt, Human
ugaaaacacuuuaguuuagguc

SEQ ID NO: 329879 - RNA, 22 nt, Human
ucgcagcacuagcccugcauug

SEQ ID NO: 329880 - RNA, 22 nt, Human
aagugauuucugccugcauguu

SEQ ID NO: 329881 - RNA, 22 nt, Human
ggcuggccuguguggccgccac

SEQ ID NO: 329882 - RNA, 21 nt, Human
gcccacagugaggaggauccc

SEQ ID NO: 329883 - RNA, 22 nt, Human
ggcucacgcaauuaucccggcc

SEQ ID NO: 329884 - RNA, 22 nt, Human
gagaugaagaggcccuuggagu

SEQ ID NO: 329885 - RNA, 22 nt, Human
gucauggaggauugugaguggu

SEQ ID NO: 329886 - RNA, 22 nt, Human
ggccuuggaguccuccacugga

SEQ ID NO: 329887 - RNA, 22 nt, Human
gaggugggaugugugugcuacu

SEQ ID NO: 329888 - RNA, 18 nt, Human
uggcagccagcugcuccu

SEQ ID NO: 329889 - RNA, 20 nt, Human
cuguuugcuaucaugagcug

SEQ ID NO: 329890 - RNA, 22 nt, Human
agcuccagggaaagaguggauc

SEQ ID NO: 329891 - RNA, 22 nt, Human
ccugugggagggagcggcugga

SEQ ID NO: 329892 - RNA, 22 nt, Human
cugcuguguggauucaauggcu

SEQ ID NO: 329893 - RNA, 22 nt, Human
ugcugggauuacagucaugagc

SEQ ID NO: 329894 - RNA, 22 nt, Human
ggacagacuuuacagccccggg

SEQ ID NO: 329895 - RNA, 22 nt, Human
ugcugugagaccauuuguugag

SEQ ID NO: 329896 - RNA, 22 nt, Human
accccagaggcggaggcugcag

SEQ ID NO: 329897 - RNA, 22 nt, Human
augaggagucaaggagucggag

SEQ ID NO: 329898 - RNA, 22 nt, Human
ugcuggcugggcugcuggagac

SEQ ID NO: 329899 - RNA, 22 nt, Human
ccucuucuaggacguccuugug

SEQ ID NO: 329900 - RNA, 22 nt, Human
ucuccucuauuucuguauguau

SEQ ID NO: 329901 - RNA, 22 nt, Human
gcgacgcaggcacgacguguug

SEQ ID NO: 329902 - RNA, 22 nt, Human
gggcagagguucaacuucaaca

SEQ ID NO: 329903 - RNA, 18 nt, Human
gggguagaguguccuauu

SEQ ID NO: 329904 - RNA, 22 nt, Human
ucuuccagauacuuccugacuu

SEQ ID NO: 329905 - RNA, 22 nt, Human
cucaggucuuaguucugucauc

SEQ ID NO: 329906 - RNA, 22 nt, Human
gccaggucgucuccauguccaa

SEQ ID NO: 329907 - RNA, 22 nt, Human
gaguggggcccacugcugggug

SEQ ID NO: 329908 - RNA, 22 nt, Human
cuccaggacaugacuuucuugc

SEQ ID NO: 329909 - RNA, 22 nt, Human
ccgcguggcacccuccuggagg

SEQ ID NO: 329910 - RNA, 21 nt, Human
gcagcaugagaaagccccaaa

SEQ ID NO: 329911 - RNA, 22 nt, Human
uggauaaaaugacauuaccuga

SEQ ID NO: 329912 - RNA, 22 nt, Human
gguggcugugagcauuauguga

SEQ ID NO: 329913 - RNA, 22 nt, Human
cugcagggcccaaggucaacgg

SEQ ID NO: 329914 - RNA, 22 nt, Human
accuggaggcagagguugcagu

SEQ ID NO: 329915 - RNA, 18 nt, Human
cuuuagcugucaucuuug

SEQ ID NO: 329916 - RNA, 22 nt, Human
gggagccccaccucggugcccg

SEQ ID NO: 329917 - RNA, 22 nt, Human
uuuccuacugcccuauacacac

SEQ ID NO: 329918 - RNA, 22 nt, Human
ugggcaaggcuggagccugcag

SEQ ID NO: 329919 - RNA, 22 nt, Human
ucugggagaguagauaaaggaa

SEQ ID NO: 329920 - RNA, 22 nt, Human
auucuggacaaggcaagcuccu

SEQ ID NO: 329921 - RNA, 22 nt, Human
aucugguuuggggauccuugug

SEQ ID NO: 329922 - RNA, 22 nt, Human
gcuggccugaccugaggcuggg

SEQ ID NO: 329923 - RNA, 22 nt, Human
acagugugcaagaaauggggga

SEQ ID NO: 329924 - RNA, 22 nt, Human
acacauggucuacuucuucuca

SEQ ID NO: 329925 - RNA, 22 nt, Human
ugccagagaggagaaagcauuu

SEQ ID NO: 329926 - RNA, 22 nt, Human
uuugucaccaguggcuuuggua

SEQ ID NO: 329927 - RNA, 22 nt, Human
ccccagugguugcaacagcaga

SEQ ID NO: 329928 - RNA, 22 nt, Human
uggcuacauuuauacucucauu

SEQ ID NO: 329929 - RNA, 22 nt, Human
gccccuucguggaagugcauuc

SEQ ID NO: 329930 - RNA, 22 nt, Human
gggcaugguggcaggcaccugu

SEQ ID NO: 329931 - RNA, 22 nt, Human
agcaauguuggccuauauaccu

SEQ ID NO: 329932 - RNA, 22 nt, Human
aucuucaaagcacaucguuugu

SEQ ID NO: 329933 - RNA, 22 nt, Human
ucugggugucacuccugccugc

SEQ ID NO: 329934 - RNA, 22 nt, Human
ucuguggcaaacacagugacca

SEQ ID NO: 329935 - RNA, 22 nt, Human
acggagcccgugucagguggga

SEQ ID NO: 329936 - RNA, 22 nt, Human
agcagggagaccaucucuuccu

SEQ ID NO: 329937 - RNA, 22 nt, Human
caggacccaaccucccugcucu

SEQ ID NO: 329938 - RNA, 22 nt, Human
uuugggcaggcuuuucccuaga

SEQ ID NO: 329939 - RNA, 22 nt, Human
uuccugcaggccauagagccug

SEQ ID NO: 329940 - RNA, 20 nt, Human
ucauccaggacaggaguggc

SEQ ID NO: 329941 - RNA, 21 nt, Human
uugcuguuuucccaaugcagu

SEQ ID NO: 329942 - RNA, 22 nt, Human
gaacuuuaauuagcuuuugucu

SEQ ID NO: 329943 - RNA, 22 nt, Human
agcgggucugcaagccuucccu

SEQ ID NO: 329944 - RNA, 19 nt, Human
gcagcugugggaagagcca

SEQ ID NO: 329945 - RNA, 22 nt, Human
ccagagacaaggagcuggaguc

SEQ ID NO: 329946 - RNA, 22 nt, Human
ggcaccuuucaucccaucuaga

SEQ ID NO: 329947 - RNA, 22 nt, Human
gagcaccgccuccacgaugccc

SEQ ID NO: 329948 - RNA, 22 nt, Human
agggcacucugcagggaccacc

SEQ ID NO: 329949 - RNA, 22 nt, Human
ugucauuggugaucugaugccu

SEQ ID NO: 329950 - RNA, 22 nt, Human
uuugccaguauuuuauugauga

SEQ ID NO: 329951 - RNA, 22 nt, Human
agcuccugaaaauccagacugg

SEQ ID NO: 329952 - RNA, 22 nt, Human
gccuggcuaagcagaaggaccc

SEQ ID NO: 329953 - RNA, 22 nt, Human
ccacugcuaacuugcugcagcu

SEQ ID NO: 329954 - RNA, 22 nt, Human
ccauggccaggaaagccaaggu

SEQ ID NO: 329955 - RNA, 22 nt, Human
accagagucaauuauuuugcca

SEQ ID NO: 329956 - RNA, 22 nt, Human
ggaagcaaauuccagaaccaca

SEQ ID NO: 329957 - RNA, 22 nt, Human
ucucgugcaggccuugcucgga

SEQ ID NO: 329958 - RNA, 22 nt, Human
cugcagggcagggccuccuggc

SEQ ID NO: 329959 - RNA, 22 nt, Human
gcucguugaaccuguccccgag

SEQ ID NO: 329960 - RNA, 22 nt, Human
aacuuucagaauccuaugcauu

SEQ ID NO: 329961 - RNA, 22 nt, Human
guugcagcaucacugcugagug

SEQ ID NO: 329962 - RNA, 22 nt, Human
agcugcugcaaguggugcuaac

SEQ ID NO: 329963 - RNA, 22 nt, Human
ccaggugugcucugcaguggau

SEQ ID NO: 329964 - RNA, 22 nt, Human
uuuuggcucugcagguuugcac

SEQ ID NO: 329965 - RNA, 22 nt, Human
cuggucaauaaucauguaguac

SEQ ID NO: 329966 - RNA, 22 nt, Human
cccugauguuuucucugccuuu

SEQ ID NO: 329967 - RNA, 19 nt, Human
ugcucucuggugcuucaug

SEQ ID NO: 329968 - RNA, 20 nt, Human
uccugggguaagccaugguc

SEQ ID NO: 329969 - RNA, 22 nt, Human
gcccucugccacaggacgccag

SEQ ID NO: 329970 - RNA, 22 nt, Human
aggagcggauguguccugccag

SEQ ID NO: 329971 - RNA, 22 nt, Human
gccaaaguccuccagccaugca

SEQ ID NO: 329972 - RNA, 22 nt, Human
acaaguuucauuguuuagaacc

SEQ ID NO: 329973 - RNA, 22 nt, Human
acagaguaucuaucaggaguau

SEQ ID NO: 329974 - RNA, 22 nt, Human
uggcuggcuguccagcugggca

SEQ ID NO: 329975 - RNA, 22 nt, Human
gagcucauccccaugguccguc

SEQ ID NO: 329976 - RNA, 22 nt, Human
ggcaagaaccucaauuaccuuu

SEQ ID NO: 329977 - RNA, 22 nt, Human
ccagcagcgauagggugagugc

SEQ ID NO: 329978 - RNA, 22 nt, Human
caccucucauuucuacagauuc

SEQ ID NO: 329979 - RNA, 22 nt, Human
cugggcuguuuguucuggucuc

SEQ ID NO: 329980 - RNA, 22 nt, Human
ccaggagaaugggauuacccua

SEQ ID NO: 329981 - RNA, 22 nt, Human
gcugcagggagcuggaaggcuc

SEQ ID NO: 329982 - RNA, 22 nt, Human
guggcccaggcuuggcgcuggc

SEQ ID NO: 329983 - RNA, 22 nt, Human
gacaggugcuaagggaccuggc

SEQ ID NO: 329984 - RNA, 22 nt, Human
agccagcuaccggggcuccugg

SEQ ID NO: 329985 - RNA, 22 nt, Human
cugagcugcucccgcugcagcg

SEQ ID NO: 329986 - RNA, 22 nt, Human
aggggcagccucacaauccucu

SEQ ID NO: 329987 - RNA, 21 nt, Human
uggcccuggccacggcugcca

SEQ ID NO: 329988 - RNA, 22 nt, Human
uucuucauucccuuacuuccga

SEQ ID NO: 329989 - RNA, 22 nt, Human
agagaccuuuugccuucuaguu

SEQ ID NO: 329990 - RNA, 22 nt, Human
acccggagucggagguugcagu

SEQ ID NO: 329991 - RNA, 22 nt, Human
acagugcuaucaauagcuagaa

SEQ ID NO: 329992 - RNA, 20 nt, Human
ucuuuuauuggcagauccug

SEQ ID NO: 329993 - RNA, 22 nt, Human
cuggcuuuuggaggagggucag

SEQ ID NO: 329994 - RNA, 22 nt, Human
gccuggcucugaguuucucucc

SEQ ID NO: 329995 - RNA, 22 nt, Human
auuugugggacuauaaugcagg

SEQ ID NO: 329996 - RNA, 22 nt, Human
agaauccuggagaagcuguacc

SEQ ID NO: 329997 - RNA, 22 nt, Human
uccucauucuuggugcaucaaa

SEQ ID NO: 329998 - RNA, 22 nt, Human
uaguggauguucagagauuuga

SEQ ID NO: 329999 - RNA, 22 nt, Human
ccaugcccuugucaucuccagg

SEQ ID NO: 330000 - RNA, 22 nt, Human
aaggagcuuucauuacagccuu

SEQ ID NO: 330001 - RNA, 22 nt, Human
uguguccuucugggagucccag

SEQ ID NO: 330002 - RNA, 22 nt, Human
gcagcagaaggccaaggggagc

SEQ ID NO: 330003 - RNA, 22 nt, Human
uccucuucaaaauagcucugaa

SEQ ID NO: 330004 - RNA, 21 nt, Human
uccuccuguagaggguccugg

SEQ ID NO: 330005 - RNA, 21 nt, Human
uaaaagaugacaagacagcuc

SEQ ID NO: 330006 - RNA, 22 nt, Human
ccucccugccggcuggacuagu

SEQ ID NO: 330007 - RNA, 22 nt, Human
ucuuuuaucuguuguguaacaa

SEQ ID NO: 330008 - RNA, 22 nt, Human
cagcuggcgacucuccucgaug

SEQ ID NO: 330009 - RNA, 22 nt, Human
gcggagaggcagagacuccgcg

SEQ ID NO: 330010 - RNA, 22 nt, Human
acagcuggccgaggcucaggga

SEQ ID NO: 330011 - RNA, 22 nt, Human
cacccugaggccacccagaccu

SEQ ID NO: 330012 - RNA, 22 nt, Human
ucauccagccucaucaggagcu

SEQ ID NO: 330013 - RNA, 22 nt, Human
gcuucuggugaggccucaggaa

SEQ ID NO: 330014 - RNA, 22 nt, Human
gugcugauugggagcugggauu

SEQ ID NO: 330015 - RNA, 22 nt, Human
caugaccagagaggacggccag

SEQ ID NO: 330016 - RNA, 22 nt, Human
auggccugcagugcugccacag

SEQ ID NO: 330017 - RNA, 22 nt, Human
acugugugccaggcgcuggucu

SEQ ID NO: 330018 - RNA, 22 nt, Human
aaccccgcucaggcugggugag

SEQ ID NO: 330019 - RNA, 20 nt, Human
agugauuuguuaguacauug

SEQ ID NO: 330020 - RNA, 20 nt, Human
gcugugccaugacccucgag

SEQ ID NO: 330021 - RNA, 22 nt, Human
cgcacuggagcuggaacgaguc

SEQ ID NO: 330022 - RNA, 22 nt, Human
aguguguccaggaagcagaugg

SEQ ID NO: 330023 - RNA, 22 nt, Human
agcaugucuaacucuucagggu

SEQ ID NO: 330024 - RNA, 22 nt, Human
cuugaaagucagcagaguggau

SEQ ID NO: 330025 - RNA, 22 nt, Human
uggaagggagcuggaauuugga

SEQ ID NO: 330026 - RNA, 22 nt, Human
gcucuagcuggcgcugaccugg

SEQ ID NO: 330027 - RNA, 22 nt, Human
agaggaaguaaucaggaccugc

SEQ ID NO: 330028 - RNA, 22 nt, Human
caugggaauaaaguuauuucaa

SEQ ID NO: 330029 - RNA, 22 nt, Human
aguggguguagucuuccuccug

SEQ ID NO: 330030 - RNA, 22 nt, Human
gcagcccucuuggucacuaggc

SEQ ID NO: 330031 - RNA, 21 nt, Human
gcacuucugcagggcugcugg

SEQ ID NO: 330032 - RNA, 22 nt, Human
ugcauggacgugacuuggccaa

SEQ ID NO: 330033 - RNA, 22 nt, Human
cuccaggacugaggacagagcu

SEQ ID NO: 330034 - RNA, 19 nt, Human
gaacugaggucugaggcuu

SEQ ID NO: 330035 - RNA, 22 nt, Human
cagggcucacucggcuggcguc

SEQ ID NO: 330036 - RNA, 22 nt, Human
cacuguugaagauacuuccucu

SEQ ID NO: 330037 - RNA, 22 nt, Human
cucgcggcgcccgaagcccuug

SEQ ID NO: 330038 - RNA, 22 nt, Human
ugcucccaggcauucucuguug

SEQ ID NO: 330039 - RNA, 22 nt, Human
aggcccugcugaggccucccuc

SEQ ID NO: 330040 - RNA, 19 nt, Human
gggugaggaagagcguugc

SEQ ID NO: 330041 - RNA, 22 nt, Human
ugagcugcuucuuauaaugugu

SEQ ID NO: 330042 - RNA, 22 nt, Human
uugcaggguugacacugccugc

SEQ ID NO: 330043 - RNA, 22 nt, Human
cugcugucuuuauuucacugcu

SEQ ID NO: 330044 - RNA, 22 nt, Human
cgcaggugccggcagauggggu

SEQ ID NO: 330045 - RNA, 22 nt, Human
ugcagggcagcuagggagcuuu

SEQ ID NO: 330046 - RNA, 22 nt, Human
auggagcagcagaaggggcuug

SEQ ID NO: 330047 - RNA, 20 nt, Human
acguggccaccaguggcuua

SEQ ID NO: 330048 - RNA, 22 nt, Human
ccagcuggaacggcagcccagc

SEQ ID NO: 330049 - RNA, 22 nt, Human
uggagugcaguugggaggacac

SEQ ID NO: 330050 - RNA, 22 nt, Human
uuugagugcccauguuucccag

SEQ ID NO: 330051 - RNA, 22 nt, Human
ggcagagcuugcagugagccga

SEQ ID NO: 330052 - RNA, 22 nt, Human
cagcuccagccaccggggggug

SEQ ID NO: 330053 - RNA, 22 nt, Human
cccagagcaugugcugccuuug

SEQ ID NO: 330054 - RNA, 22 nt, Human
cccaugcacccucuaagaagga

SEQ ID NO: 330055 - RNA, 22 nt, Human
gcagcagcggggccccugcgcg

SEQ ID NO: 330056 - RNA, 22 nt, Human
accacaucgggcggacacuggg

SEQ ID NO: 330057 - RNA, 22 nt, Human
ccugaccaacguggugaaaccc

SEQ ID NO: 330058 - RNA, 22 nt, Human
gcggcgccugggacccgccagc

SEQ ID NO: 330059 - RNA, 22 nt, Human
aggccagaacagcucugcacca

SEQ ID NO: 330060 - RNA, 21 nt, Human
ggucaggcaugugcccugagc

SEQ ID NO: 330061 - RNA, 22 nt, Human
agugugaguuacaaagugugaa

SEQ ID NO: 330062 - RNA, 18 nt, Human
cugccagugugcucuccg

SEQ ID NO: 330063 - RNA, 19 nt, Human
ugguucuccuuccacaguc

SEQ ID NO: 330064 - RNA, 22 nt, Human
uccagcuccugaguucacugcu

SEQ ID NO: 330065 - RNA, 22 nt, Human
accuggccaguggggccgcgcu

SEQ ID NO: 330066 - RNA, 22 nt, Human
uacaucucaucugugcucuccg

SEQ ID NO: 330067 - RNA, 22 nt, Human
ucacacuuuauuuauuucaugc

SEQ ID NO: 330068 - RNA, 22 nt, Human
ccuuuuaagggagacuagagau

SEQ ID NO: 330069 - RNA, 22 nt, Human
ggcagguguggugaccagagau

SEQ ID NO: 330070 - RNA, 22 nt, Human
caucucccacuuccuugggggu

SEQ ID NO: 330071 - RNA, 22 nt, Human
uguucugcaaugcugccuccuu

SEQ ID NO: 330072 - RNA, 22 nt, Human
agcuuucuauauaugaguugcu

SEQ ID NO: 330073 - RNA, 22 nt, Human
ugcagcaccuauggacacuugu

SEQ ID NO: 330074 - RNA, 22 nt, Human
guccaucuaaguauccagccug

SEQ ID NO: 330075 - RNA, 22 nt, Human
uuccaggcgcacgucggccuua

SEQ ID NO: 330076 - RNA, 22 nt, Human
uagauacauacauuuuaaaaug

SEQ ID NO: 330077 - RNA, 22 nt, Human
ccaccagaccaccaagagcaac

SEQ ID NO: 330078 - RNA, 22 nt, Human
uucuccagcucaucagggaggg

SEQ ID NO: 330079 - RNA, 22 nt, Human
ggaaccuuaguguucuuuuacc

SEQ ID NO: 330080 - RNA, 22 nt, Human
cucacagcugcuucaggaucca

SEQ ID NO: 330081 - RNA, 20 nt, Human
ggccggggagcucuccaggg

SEQ ID NO: 330082 - RNA, 22 nt, Human
gcagacccugaacugggcaugg

SEQ ID NO: 330083 - RNA, 22 nt, Human
gcugggcaggccucgugagggc

SEQ ID NO: 330084 - RNA, 17 nt, Human
gcccgugggcuacggua

SEQ ID NO: 330085 - RNA, 19 nt, Human
agcagggagugguuguggg

SEQ ID NO: 330086 - RNA, 19 nt, Human
ucuuucauuucuagcucug

SEQ ID NO: 330087 - RNA, 22 nt, Human
gaggggccuggcgaggacaugu

SEQ ID NO: 330088 - RNA, 22 nt, Human
agcaaggcagcuuucacugcuu

SEQ ID NO: 330089 - RNA, 22 nt, Human
uguccagaucaaugcccacaug

SEQ ID NO: 330090 - RNA, 22 nt, Human
caaugggccuggagagagcugg

SEQ ID NO: 330091 - RNA, 22 nt, Human
guccuaaauauagugauucaug

SEQ ID NO: 330092 - RNA, 22 nt, Human
ucuggauggucagcucuuccug

SEQ ID NO: 330093 - RNA, 22 nt, Human
uucaccugugacagguagaguu

SEQ ID NO: 330094 - RNA, 23 nt, Human
auagaccauugucucacacuuca

SEQ ID NO: 330095 - RNA, 22 nt, Human
uugggugcugucauggggcacg

SEQ ID NO: 330096 - RNA, 21 nt, Human
ccaccaggucuucugcucggg

SEQ ID NO: 330097 - RNA, 22 nt, Human
caacagcuggaggcuuggcccg

SEQ ID NO: 330098 - RNA, 22 nt, Human
ggagcgugcacuccaggcccuu

SEQ ID NO: 330099 - RNA, 22 nt, Human
uggccucuccuggcagcaucca

SEQ ID NO: 330100 - RNA, 22 nt, Human
gcagcucucuggccugcccugg

SEQ ID NO: 330101 - RNA, 19 nt, Human
ugcagcuguaugagcuuaa

SEQ ID NO: 330102 - RNA, 22 nt, Human
acagcugugggcucugcauaua

SEQ ID NO: 330103 - RNA, 22 nt, Human
uggcugaggagagggcggaagu

SEQ ID NO: 330104 - RNA, 22 nt, Human
ccugcugaggucagccacccaa

SEQ ID NO: 330105 - RNA, 22 nt, Human
gcugucugcugggucgcucagg

SEQ ID NO: 330106 - RNA, 22 nt, Human
cugggccucacccuagaccaau

SEQ ID NO: 330107 - RNA, 22 nt, Human
gggcagcaaaucugagucuggu

SEQ ID NO: 330108 - RNA, 22 nt, Human
cacuuuuaacaggagaauuccc

SEQ ID NO: 330109 - RNA, 23 nt, Human
ucuggcugcuccuuucaaugcuc

SEQ ID NO: 330110 - RNA, 22 nt, Human
cucuggucaagcaaagagguuu

SEQ ID NO: 330111 - RNA, 19 nt, Human
aggaaggcggcggcugccc

SEQ ID NO: 330112 - RNA, 22 nt, Human
cagugacguaaacugcaugugc

SEQ ID NO: 330113 - RNA, 22 nt, Human
ggcuggaaggcccuuuguugau

SEQ ID NO: 330114 - RNA, 23 nt, Human
cucaacccuaguaagggaguagg

SEQ ID NO: 330115 - RNA, 22 nt, Human
gcuguggcuccaauggugagcc

SEQ ID NO: 330116 - RNA, 22 nt, Human
ugggcacacugaaucugcuauu

SEQ ID NO: 330117 - RNA, 22 nt, Human
ccacccagccagaugcaggaag

SEQ ID NO: 330118 - RNA, 22 nt, Human
uuugacucugggugcuuuuucg

SEQ ID NO: 330119 - RNA, 22 nt, Human
uucugauugcugaugaggccca

SEQ ID NO: 330120 - RNA, 22 nt, Human
agauaaaguccaaacuguguag

SEQ ID NO: 330121 - RNA, 22 nt, Human
uuugcaaaguccauugaaguua

SEQ ID NO: 330122 - RNA, 22 nt, Human
gccagcuggcugcaggucccag

SEQ ID NO: 330123 - RNA, 22 nt, Human
gcagauggauguggacggcgcc

SEQ ID NO: 330124 - RNA, 22 nt, Human
augaugaagcaugguuacacug

SEQ ID NO: 330125 - RNA, 22 nt, Human
gcucugagucacacugcccugu

SEQ ID NO: 330126 - RNA, 22 nt, Human
gcugggagucgcgucuguggcc

SEQ ID NO: 330127 - RNA, 22 nt, Human
gagcacucuggcauguaaccuu

SEQ ID NO: 330128 - RNA, 22 nt, Human
aggccgugugagcaugugugag

SEQ ID NO: 330129 - RNA, 22 nt, Human
cagaguccugcaccagcuccag

SEQ ID NO: 330130 - RNA, 22 nt, Human
ugcauuucccauuguguggcuc

SEQ ID NO: 330131 - RNA, 23 nt, Human
gggcugcuccaggccaaggcugg

SEQ ID NO: 330132 - RNA, 22 nt, Human
gcagagcugucuaagucacuuc

SEQ ID NO: 330133 - RNA, 22 nt, Human
aggcagccuauggggagcucag

SEQ ID NO: 330134 - RNA, 22 nt, Human
ugagaauacugcauuguuagga

SEQ ID NO: 330135 - RNA, 22 nt, Human
uuugacaugugcuuauaacuuu

SEQ ID NO: 330136 - RNA, 17 nt, Human
cucugggucuccugcuu

SEQ ID NO: 330137 - RNA, 22 nt, Human
uugcuggaagguggcuggaauc

SEQ ID NO: 330138 - RNA, 22 nt, Human
cugucuggaaugcaguacauag

SEQ ID NO: 330139 - RNA, 22 nt, Human
ggugaccucaccuggucccacc

SEQ ID NO: 330140 - RNA, 22 nt, Human
ccaguucuuucugugugcaaca

SEQ ID NO: 330141 - RNA, 21 nt, Human
ugucagcaacaauacuuucuc

SEQ ID NO: 330142 - RNA, 22 nt, Human
agcagcaggagccgugggguga

SEQ ID NO: 330143 - RNA, 22 nt, Human
aggcaguggcuuuuguuguguu

SEQ ID NO: 330144 - RNA, 22 nt, Human
ucagcccggguucgcaaacacu

SEQ ID NO: 330145 - RNA, 22 nt, Human
uuucuuggucuucccgaccugg

SEQ ID NO: 330146 - RNA, 22 nt, Human
uggcacaguuaaaguuguagaa

SEQ ID NO: 330147 - RNA, 22 nt, Human
aaggaggaauguagccagcucc

SEQ ID NO: 330148 - RNA, 22 nt, Human
uggcagcagggccccuggagga

SEQ ID NO: 330149 - RNA, 22 nt, Human
ccaucgcuucaaaucucagacu

SEQ ID NO: 330150 - RNA, 22 nt, Human
uuuguguuguacuucugugcau

SEQ ID NO: 330151 - RNA, 22 nt, Human
ugcaggcuggaggagggacuaa

SEQ ID NO: 330152 - RNA, 22 nt, Human
ucuugccgcgcaggcgcaguuc

SEQ ID NO: 330153 - RNA, 21 nt, Human
uccugccuuaguccagagcag

SEQ ID NO: 330154 - RNA, 22 nt, Human
ggucuggccuccgggcaggugg

SEQ ID NO: 330155 - RNA, 22 nt, Human
aggcuguagaucuagacaugua

SEQ ID NO: 330156 - RNA, 22 nt, Human
gagaagguggaccugaaggagc

SEQ ID NO: 330157 - RNA, 22 nt, Human
agggaagcagcagccgccuguc

SEQ ID NO: 330158 - RNA, 22 nt, Human
ugcugaggagguggcugugcuu

SEQ ID NO: 330159 - RNA, 22 nt, Human
gcacccagggcaggaagugagg

SEQ ID NO: 330160 - RNA, 22 nt, Human
ggccauggcgggagccggcguc

SEQ ID NO: 330161 - RNA, 22 nt, Human
gugcaggacagcacaucuccug

SEQ ID NO: 330162 - RNA, 22 nt, Human
guccuggugcuggucauugucg

SEQ ID NO: 330163 - RNA, 22 nt, Human
ugucuuuagccacuugccucuu

SEQ ID NO: 330164 - RNA, 22 nt, Human
caggcccuuuccugggcauagg

SEQ ID NO: 330165 - RNA, 22 nt, Human
cgcugccuucaucccacgccua

SEQ ID NO: 330166 - RNA, 22 nt, Human
ucccuggcacaagaaggcuguc

SEQ ID NO: 330167 - RNA, 17 nt, Human
ugagcaguagaagaugc

SEQ ID NO: 330168 - RNA, 22 nt, Human
gcucugugcaguucagggacac

SEQ ID NO: 330169 - RNA, 22 nt, Human
gccaaaguaccuagcccucugc

SEQ ID NO: 330170 - RNA, 22 nt, Human
aaaggugccucuuacaaggcuu

SEQ ID NO: 330171 - RNA, 22 nt, Human
gcaggggcugagcaccagcggg

SEQ ID NO: 330172 - RNA, 22 nt, Human
aagcccgguugggaacguggug

SEQ ID NO: 330173 - RNA, 22 nt, Human
cccugcacagccuggcucucuu

SEQ ID NO: 330174 - RNA, 22 nt, Human
gcaguggccacauggaggagga

SEQ ID NO: 330175 - RNA, 20 nt, Human
ucugccacuuuuucugucac

SEQ ID NO: 330176 - RNA, 22 nt, Human
aguguccaacucagcuugucaa

SEQ ID NO: 330177 - RNA, 17 nt, Human
gugcuggccuggggcuc

SEQ ID NO: 330178 - RNA, 22 nt, Human
agggcagagauuaauuaagaca

SEQ ID NO: 330179 - RNA, 20 nt, Human
ugcuggaggcgccggcgcuc

SEQ ID NO: 330180 - RNA, 22 nt, Human
gugccuccaggcucgacuaguc

SEQ ID NO: 330181 - RNA, 22 nt, Human
gcuucuggaagcauaugcaaga

SEQ ID NO: 330182 - RNA, 22 nt, Human
ucuuugcagaauuuaacuuugc

SEQ ID NO: 330183 - RNA, 22 nt, Human
ggagaggguagggguccugccc

SEQ ID NO: 330184 - RNA, 22 nt, Human
gccaggaccucagaugcagggc

SEQ ID NO: 330185 - RNA, 22 nt, Human
uuuugucagugagaacagaguu

SEQ ID NO: 330186 - RNA, 22 nt, Human
cuggccgcaguguggaguugug

SEQ ID NO: 330187 - RNA, 22 nt, Human
aaucuguuuuaaaguuugugcc

SEQ ID NO: 330188 - RNA, 22 nt, Human
ggcucuccacuauggaugagaa

SEQ ID NO: 330189 - RNA, 22 nt, Human
agccccaguucccuggaagucu

SEQ ID NO: 330190 - RNA, 22 nt, Human
gugcugccuccauauccgucag

SEQ ID NO: 330191 - RNA, 22 nt, Human
ucugcuggaaaaccagggaauu

SEQ ID NO: 330192 - RNA, 22 nt, Human
uguggugccgagagucuggacg

SEQ ID NO: 330193 - RNA, 22 nt, Human
gugggggcaggcagugcuagga

SEQ ID NO: 330194 - RNA, 22 nt, Human
ggugugucugccaggaacugca

SEQ ID NO: 330195 - RNA, 22 nt, Human
aucauuaacccuugaugcuggg

SEQ ID NO: 330196 - RNA, 22 nt, Human
ugggcugcuuccucagcugaga

SEQ ID NO: 330197 - RNA, 20 nt, Human
cagugcccguggaaaagaug

SEQ ID NO: 330198 - RNA, 22 nt, Human
ggagaggggaacuuguugcuug

SEQ ID NO: 330199 - RNA, 22 nt, Human
acaugggcaucuaugaggcucu

SEQ ID NO: 330200 - RNA, 22 nt, Human
cuccugcagcccucagcagcca

SEQ ID NO: 330201 - RNA, 22 nt, Human
ugaggagcaggguggcuuacuc

SEQ ID NO: 330202 - RNA, 22 nt, Human
ccagcagaagcucccgcugggu

SEQ ID NO: 330203 - RNA, 22 nt, Human
ggcugcugcccaccccugcaug

SEQ ID NO: 330204 - RNA, 23 nt, Human
cagcacaguacauuuccugucuc

SEQ ID NO: 330205 - RNA, 22 nt, Human
caagagcuggguggcaagcuag

SEQ ID NO: 330206 - RNA, 22 nt, Human
ugucccuggacuccaggagcca

SEQ ID NO: 330207 - RNA, 22 nt, Human
gccuggcuucccuuggagcauu

SEQ ID NO: 330208 - RNA, 22 nt, Human
uuccagcuaacucacaucccuu

SEQ ID NO: 330209 - RNA, 22 nt, Human
gggagccagcagggcauggagc

SEQ ID NO: 330210 - RNA, 22 nt, Human
gugagcugggugaaugguaggg

SEQ ID NO: 330211 - RNA, 22 nt, Human
ggagugggaacaaugacauggu

SEQ ID NO: 330212 - RNA, 22 nt, Human
caugcagugcuuugcgccgggc

SEQ ID NO: 330213 - RNA, 22 nt, Human
gcagagcacccugcagugguau

SEQ ID NO: 330214 - RNA, 22 nt, Human
gccugcacucaaacacucucuu

SEQ ID NO: 330215 - RNA, 21 nt, Human
agggccucuguguacuggggg

SEQ ID NO: 330216 - RNA, 22 nt, Human
gcugcucucucccuaaguuggg

SEQ ID NO: 330217 - RNA, 22 nt, Human
ggccaaggcucuugagggcuga

SEQ ID NO: 330218 - RNA, 22 nt, Human
agcagugugggcugcacgcugg

SEQ ID NO: 330219 - RNA, 22 nt, Human
ugcuugcugaaaggcauuuaga

SEQ ID NO: 330220 - RNA, 22 nt, Human
uggcaugcaagaggaggcuccc

SEQ ID NO: 330221 - RNA, 22 nt, Human
uucuguuuauaauuugcaguug

SEQ ID NO: 330222 - RNA, 22 nt, Human
cuguccauggcaaugaugcaga

SEQ ID NO: 330223 - RNA, 22 nt, Human
ugugcccuccugccaggggcug

SEQ ID NO: 330224 - RNA, 22 nt, Human
cagggccugccugguuccugga

SEQ ID NO: 330225 - RNA, 21 nt, Human
uagaccagcugugcuccucgg

SEQ ID NO: 330226 - RNA, 22 nt, Human
uucuccucagcaaggcagcuuu

SEQ ID NO: 330227 - RNA, 22 nt, Human
gucccaggggagcucucugauu

SEQ ID NO: 330228 - RNA, 19 nt, Human
agcucaggcccaucguccc

SEQ ID NO: 330229 - RNA, 22 nt, Human
agcuggugauguggucccucac

SEQ ID NO: 330230 - RNA, 22 nt, Human
cagggacucgcuggacauaccg

SEQ ID NO: 330231 - RNA, 22 nt, Human
acagccaggaauucuggagaag

SEQ ID NO: 330232 - RNA, 22 nt, Human
cuuugcagagggggugggagcu

SEQ ID NO: 330233 - RNA, 22 nt, Human
gacggagcugguugcugcggcu

SEQ ID NO: 330234 - RNA, 22 nt, Human
ccaugcagugcuggagcugauu

SEQ ID NO: 330235 - RNA, 22 nt, Human
guggcagagagcaagugucuga

SEQ ID NO: 330236 - RNA, 22 nt, Human
ugcccuggcuccucccacgcug

SEQ ID NO: 330237 - RNA, 22 nt, Human
cuccccacgccuggacuaagag

SEQ ID NO: 330238 - RNA, 19 nt, Human
auucuucucuuccugcugu

SEQ ID NO: 330239 - RNA, 22 nt, Human
auguaugagagauucuuuuauu

SEQ ID NO: 330240 - RNA, 23 nt, Human
acugccugugccgaucucucuca

SEQ ID NO: 330241 - RNA, 22 nt, Human
uggcagugugggaggaagguac

SEQ ID NO: 330242 - RNA, 22 nt, Human
cuuuacagauggauaauuguuu

SEQ ID NO: 330243 - RNA, 20 nt, Human
ccacaguggagacuggagac

SEQ ID NO: 330244 - RNA, 22 nt, Human
uggcuccacaggccagggugug

SEQ ID NO: 330245 - RNA, 22 nt, Human
ggaaggggagcuggaaagggua

SEQ ID NO: 330246 - RNA, 22 nt, Human
ucuucaugaaauugauugcuua

SEQ ID NO: 330247 - RNA, 22 nt, Human
ggcggccugugggucggccuca

SEQ ID NO: 330248 - RNA, 22 nt, Human
cagcccaggacugcagguguuu

SEQ ID NO: 330249 - RNA, 22 nt, Human
ucuggaaggggaucugugguca

SEQ ID NO: 330250 - RNA, 22 nt, Human
ugugucuuuggcgaugucugga

SEQ ID NO: 330251 - RNA, 22 nt, Human
ggugagaggcagugcuguggaa

SEQ ID NO: 330252 - RNA, 22 nt, Human
aucaugcagcaacaagcaaggc

SEQ ID NO: 330253 - RNA, 20 nt, Human
gcuccccuucucugggccuc

SEQ ID NO: 330254 - RNA, 22 nt, Human
auuucagaguagaucguuauuu

SEQ ID NO: 330255 - RNA, 17 nt, Human
auucaugaacauguccu

SEQ ID NO: 330256 - RNA, 20 nt, Human
cgggacacucaagcucuggg

SEQ ID NO: 330257 - RNA, 22 nt, Human
gcauaaaggacuauaaggauca

SEQ ID NO: 330258 - RNA, 22 nt, Human
aaugauguuuuuaaagaacaua

SEQ ID NO: 330259 - RNA, 22 nt, Human
ugggaugggaucucgcuguguc

SEQ ID NO: 330260 - RNA, 22 nt, Human
cccucucgcggggcagcggagg

SEQ ID NO: 330261 - RNA, 22 nt, Human
aacaucuagguucucaucgaua

SEQ ID NO: 330262 - RNA, 22 nt, Human
ccuccugggccuugcucuguga

SEQ ID NO: 330263 - RNA, 22 nt, Human
cugaccaguccuuagcaccugg

SEQ ID NO: 330264 - RNA, 22 nt, Human
ggcuggcuggcuuagcagagga

SEQ ID NO: 330265 - RNA, 22 nt, Human
augaacugcaguauaaacuugg

SEQ ID NO: 330266 - RNA, 22 nt, Human
ugcucgagguccccaccggcuc

SEQ ID NO: 330267 - RNA, 22 nt, Human
ccaggcccugcuccucacacca

SEQ ID NO: 330268 - RNA, 22 nt, Human
gucuguggaguugcuugcugga

SEQ ID NO: 330269 - RNA, 22 nt, Human
uugggauacaucuugcugagcc

SEQ ID NO: 330270 - RNA, 22 nt, Human
cccuggcucaggcagcuuuguu

SEQ ID NO: 330271 - RNA, 22 nt, Human
ugucauggacuggauuucugcu

SEQ ID NO: 330272 - RNA, 22 nt, Human
auuucagcagcccauguuugga

SEQ ID NO: 330273 - RNA, 22 nt, Human
agguggucuuguggaugccgca

SEQ ID NO: 330274 - RNA, 22 nt, Human
cugaugcucuggauguagucaa

SEQ ID NO: 330275 - RNA, 22 nt, Human
cacugcccuggggguugccauc

SEQ ID NO: 330276 - RNA, 22 nt, Human
ugcccuccacaguggcuccacc

SEQ ID NO: 330277 - RNA, 22 nt, Human
accagaagcuggagcacaagga

SEQ ID NO: 330278 - RNA, 22 nt, Human
acugggcaaggauaugaugggu

SEQ ID NO: 330279 - RNA, 22 nt, Human
uucugggcacacaggcccuggu

SEQ ID NO: 330280 - RNA, 22 nt, Human
gggcucggcaucuguggacucu

SEQ ID NO: 330281 - RNA, 22 nt, Human
gaugucuggcuaccacucgcac

SEQ ID NO: 330282 - RNA, 22 nt, Human
gugcugcagagucucgugccgc

SEQ ID NO: 330283 - RNA, 22 nt, Human
cuggcuaaagagcaagaagaug

SEQ ID NO: 330284 - RNA, 22 nt, Human
uggaaggggagcuggaaagggg

SEQ ID NO: 330285 - RNA, 22 nt, Human
augccaucaaugacagaguuag

SEQ ID NO: 330286 - RNA, 22 nt, Human
cuggccuggcaggggaccucua

SEQ ID NO: 330287 - RNA, 22 nt, Human
gcugugaaagcugccacacugu

SEQ ID NO: 330288 - RNA, 22 nt, Human
gcagacaucaagcacaggccca

SEQ ID NO: 330289 - RNA, 22 nt, Human
gcucccuggaauguuggcugcc

SEQ ID NO: 330290 - RNA, 22 nt, Human
ugucuuggccacuaggagugcc

SEQ ID NO: 330291 - RNA, 19 nt, Human
cucugccucuggcuguggc

SEQ ID NO: 330292 - RNA, 22 nt, Human
augacuuaaucauacuugcauu

SEQ ID NO: 330293 - RNA, 22 nt, Human
caguggguccugcgucugccag

SEQ ID NO: 330294 - RNA, 22 nt, Human
ugcugcuuguuuuguaaauaaa

SEQ ID NO: 330295 - RNA, 22 nt, Human
agcugccgaugcccagcugcau

SEQ ID NO: 330296 - RNA, 22 nt, Human
ggcaucagcccgguccugggcu

SEQ ID NO: 330297 - RNA, 22 nt, Human
caggcucgguccaguggcaccc

SEQ ID NO: 330298 - RNA, 22 nt, Human
augccuguuugaaauuggaccu

SEQ ID NO: 330299 - RNA, 20 nt, Human
gggugugggcccggccaggc

SEQ ID NO: 330300 - RNA, 22 nt, Human
cuugggcaggggaaacagcugc

SEQ ID NO: 330301 - RNA, 22 nt, Human
cagagcagcagagcuuccaugg

SEQ ID NO: 330302 - RNA, 22 nt, Human
cugggaccugugugccugggcc

SEQ ID NO: 330303 - RNA, 22 nt, Human
ucccagaacccugccagguccu

SEQ ID NO: 330304 - RNA, 22 nt, Human
ggccucugccccgcggggcucg

SEQ ID NO: 330305 - RNA, 20 nt, Human
agcuggcccccgguggccug

SEQ ID NO: 330306 - RNA, 22 nt, Human
ccugggugaugugcugcccucg

SEQ ID NO: 330307 - RNA, 22 nt, Human
ggcuguggucauuaggagguug

SEQ ID NO: 330308 - RNA, 22 nt, Human
cugggguuggccagggcccuag

SEQ ID NO: 330309 - RNA, 22 nt, Human
acagugcaaauaggacugucuu

SEQ ID NO: 330310 - RNA, 22 nt, Human
ccaggaggaaagaccagcccau

SEQ ID NO: 330311 - RNA, 22 nt, Human
ugcauguuucuguauguuaaug

SEQ ID NO: 330312 - RNA, 22 nt, Human
gcuuucagggucacugucaaca

SEQ ID NO: 330313 - RNA, 22 nt, Human
gagcacugagcuggaauuggag

SEQ ID NO: 330314 - RNA, 22 nt, Human
gcuucugcagagccguccugag

SEQ ID NO: 330315 - RNA, 22 nt, Human
uacaaagugauuuuggaauuga

SEQ ID NO: 330316 - RNA, 22 nt, Human
ccagcaggaaagugacguuuga

SEQ ID NO: 330317 - RNA, 22 nt, Human
cugagguagggacgugccguag

SEQ ID NO: 330318 - RNA, 22 nt, Human
caaagccaggcuuucuaaugua

SEQ ID NO: 330319 - RNA, 22 nt, Human
gcgcuccucccggcccuggugg

SEQ ID NO: 330320 - RNA, 22 nt, Human
ccacugcuguuacuuacgcaaa

SEQ ID NO: 330321 - RNA, 22 nt, Human
uuccuggugguggugacagcac

SEQ ID NO: 330322 - RNA, 22 nt, Human
augcuugaaaguuauuucauuu

SEQ ID NO: 330323 - RNA, 22 nt, Human
uguggccaccagagcugcuauu

SEQ ID NO: 330324 - RNA, 19 nt, Human
agcaguggagccaugccug

SEQ ID NO: 330325 - RNA, 22 nt, Human
uggugaagucagcggagcccgg

SEQ ID NO: 330326 - RNA, 22 nt, Human
gugccugguuuggggaauguuc

SEQ ID NO: 330327 - RNA, 22 nt, Human
caucaggaauaaaugaggcugu

SEQ ID NO: 330328 - RNA, 22 nt, Human
gaguguuccagaaacuggcccu

SEQ ID NO: 330329 - RNA, 22 nt, Human
gcugguggcagagcuccgcggc

SEQ ID NO: 330330 - RNA, 23 nt, Human
ggucccaguggagaggccucacc

SEQ ID NO: 330331 - RNA, 22 nt, Human
cccuggaacccauggccagugu

SEQ ID NO: 330332 - RNA, 22 nt, Human
cccaggucgucagcaguguggu

SEQ ID NO: 330333 - RNA, 22 nt, Human
ggggucccugcaccagcauguc

SEQ ID NO: 330334 - RNA, 22 nt, Human
cuggcuuuuuucccauuaugca

SEQ ID NO: 330335 - RNA, 22 nt, Human
ggcuuccuccuuccugcuguca

SEQ ID NO: 330336 - RNA, 22 nt, Human
ucauggaugauagcuucauugc

SEQ ID NO: 330337 - RNA, 22 nt, Human
acaaagugaaaagcaucgaauu

SEQ ID NO: 330338 - RNA, 18 nt, Human
ugugccucugcaggacgu

SEQ ID NO: 330339 - RNA, 22 nt, Human
gucacccguuugacuauccacc

SEQ ID NO: 330340 - RNA, 22 nt, Human
gaggcagagacuccaccuucag

SEQ ID NO: 330341 - RNA, 22 nt, Human
ggcucugcugguaagaugccuc

SEQ ID NO: 330342 - RNA, 22 nt, Human
gggcuggagagucccacguggg

SEQ ID NO: 330343 - RNA, 22 nt, Human
cagcugccuaugaccuagccuc

SEQ ID NO: 330344 - RNA, 22 nt, Human
agguggagaagagaugggcagu

SEQ ID NO: 330345 - RNA, 18 nt, Human
guagauccuugagcuacc

SEQ ID NO: 330346 - RNA, 22 nt, Human
gggcucaucaagccucuccgcc

SEQ ID NO: 330347 - RNA, 22 nt, Human
aggucccugcagcagacugcca

SEQ ID NO: 330348 - RNA, 22 nt, Human
ccaggagcccugccacaauggu

SEQ ID NO: 330349 - RNA, 20 nt, Human
cagagcagugcccaggcggc

SEQ ID NO: 330350 - RNA, 22 nt, Human
uuauugagcacauaguaugugg

SEQ ID NO: 330351 - RNA, 22 nt, Human
gcucuggcuacuguggcuaccg

SEQ ID NO: 330352 - RNA, 22 nt, Human
uggaucugcucuaugaacugcu

SEQ ID NO: 330353 - RNA, 22 nt, Human
agcuccacucccugccuguuuc

SEQ ID NO: 330354 - RNA, 22 nt, Human
ugaacaugcuguugauggccug

SEQ ID NO: 330355 - RNA, 22 nt, Human
gggcuuuaggggccagugacca

SEQ ID NO: 330356 - RNA, 22 nt, Human
aggcagugguguuugcuggugg

SEQ ID NO: 330357 - RNA, 22 nt, Human
cugcaccgugucucgggcugcc

SEQ ID NO: 330358 - RNA, 18 nt, Human
cccacggugcuguagggc

SEQ ID NO: 330359 - RNA, 19 nt, Human
caucuggaugauucuccug

SEQ ID NO: 330360 - RNA, 15 nt, Human
uggugguguugagac

SEQ ID NO: 330361 - RNA, 22 nt, Human
agcgcuggugaucucuauuuug

SEQ ID NO: 330362 - RNA, 22 nt, Human
uuuguaguuguggaugcugaag

SEQ ID NO: 330363 - RNA, 22 nt, Human
uccagcugugcuccaggaggug

SEQ ID NO: 330364 - RNA, 23 nt, Human
agugaugucacccacagacaagg

SEQ ID NO: 330365 - RNA, 22 nt, Human
acuggaaaguauucuuucacug

SEQ ID NO: 330366 - RNA, 22 nt, Human
gaccaggagauuugagcuaggc

SEQ ID NO: 330367 - RNA, 22 nt, Human
ggcuagcuccuccgcgcaucca

SEQ ID NO: 330368 - RNA, 22 nt, Human
ugggguccucucacuuggaggg

SEQ ID NO: 330369 - RNA, 22 nt, Human
cuucuccgacaaccgacgccgg

SEQ ID NO: 330370 - RNA, 22 nt, Human
agugaaauaugcccauugcugu

SEQ ID NO: 330371 - RNA, 22 nt, Human
gggaggugauuaggaccaugua

SEQ ID NO: 330372 - RNA, 22 nt, Human
acauccaguaucagaagcauca

SEQ ID NO: 330373 - RNA, 22 nt, Human
uuuggcaagcgaguacuuucug

SEQ ID NO: 330374 - RNA, 20 nt, Human
gcagcagacagacaggggac

SEQ ID NO: 330375 - RNA, 22 nt, Human
ccugggacuuggucugggguuu

SEQ ID NO: 330376 - RNA, 22 nt, Human
cucucugggcccaguuggcacc

SEQ ID NO: 330377 - RNA, 22 nt, Human
guuuauuggguauuguggagcc

SEQ ID NO: 330378 - RNA, 22 nt, Human
ugacagcuuggacaggucccuc

SEQ ID NO: 330379 - RNA, 22 nt, Human
ugcugcgggacccacugugggc

SEQ ID NO: 330380 - RNA, 21 nt, Human
ccaugucagaugugggcugug

SEQ ID NO: 330381 - RNA, 19 nt, Human
uugcuucaugucuuuugcu

SEQ ID NO: 330382 - RNA, 22 nt, Human
ucuccagaguaaccuuggagca

SEQ ID NO: 330383 - RNA, 22 nt, Human
cucaggcuaagaaggccaagug

SEQ ID NO: 330384 - RNA, 22 nt, Human
uuguccagcgaccaggcucugu

SEQ ID NO: 330385 - RNA, 22 nt, Human
agccaggucaggaaagguccca

SEQ ID NO: 330386 - RNA, 22 nt, Human
cuccuuccugguuagcaccuua

SEQ ID NO: 330387 - RNA, 22 nt, Human
auuuuguaucuuacggggacua

SEQ ID NO: 330388 - RNA, 22 nt, Human
ggccgggcuguggagaaggggu

SEQ ID NO: 330389 - RNA, 22 nt, Human
aaggagucugggccauucagag

SEQ ID NO: 330390 - RNA, 22 nt, Human
guucucugccggcaccuacccg

SEQ ID NO: 330391 - RNA, 22 nt, Human
ggagaagggaacugaguuuuug

SEQ ID NO: 330392 - RNA, 22 nt, Human
acggccgaugacuccagcaugg

SEQ ID NO: 330393 - RNA, 22 nt, Human
ugaggaggugggcacacagagu

SEQ ID NO: 330394 - RNA, 22 nt, Human
agcggcgccggagggaggugcg

SEQ ID NO: 330395 - RNA, 22 nt, Human
aggagccauugcaggauggcag

SEQ ID NO: 330396 - RNA, 22 nt, Human
gacggggcagccagcugguggc

SEQ ID NO: 330397 - RNA, 22 nt, Human
ugcagcaucuccuugugccaug

SEQ ID NO: 330398 - RNA, 22 nt, Human
cugggaguugacgaggcuugua

SEQ ID NO: 330399 - RNA, 22 nt, Human
ccagucagccaagcugcagcgg

SEQ ID NO: 330400 - RNA, 21 nt, Human
uccagcacagaugaccucccc

SEQ ID NO: 330401 - RNA, 22 nt, Human
ugcuggaguggcacuguguggc

SEQ ID NO: 330402 - RNA, 22 nt, Human
ugggcacagugaguugccuuua

SEQ ID NO: 330403 - RNA, 22 nt, Human
uugcaguugcuguauuuaagga

SEQ ID NO: 330404 - RNA, 22 nt, Human
caaucaaugcugcuaguuccuu

SEQ ID NO: 330405 - RNA, 22 nt, Human
uggcugaggcacagcugccgcc

SEQ ID NO: 330406 - RNA, 17 nt, Human
uguguaaguugcauaga

SEQ ID NO: 330407 - RNA, 22 nt, Human
aggagacaguuuggacguguag

SEQ ID NO: 330408 - RNA, 22 nt, Human
cucguugcugaagccaaaguca

SEQ ID NO: 330409 - RNA, 18 nt, Human
agguguguuucuaggagc

SEQ ID NO: 330410 - RNA, 23 nt, Human
augcaacauugccaguaugggca

SEQ ID NO: 330411 - RNA, 20 nt, Human
agcuuugguuaagccagugg

SEQ ID NO: 330412 - RNA, 21 nt, Human
aaacugaccuugccugagaca

SEQ ID NO: 330413 - RNA, 22 nt, Human
uagugucucuuccuguuugaaa

SEQ ID NO: 330414 - RNA, 22 nt, Human
cggucaggugcagcguuggcac

SEQ ID NO: 330415 - RNA, 22 nt, Human
auuuccuguaggggcuugcgaa

SEQ ID NO: 330416 - RNA, 22 nt, Human
gguguggcaguggaccugugaa

SEQ ID NO: 330417 - RNA, 22 nt, Human
caaauguuugguggcauuuugu

SEQ ID NO: 330418 - RNA, 18 nt, Human
ucaugcaaacgcuucaua

SEQ ID NO: 330419 - RNA, 22 nt, Human
cuguggcuaggaagcuguggga

SEQ ID NO: 330420 - RNA, 22 nt, Human
ggugcccaaggaagguugccgu

SEQ ID NO: 330421 - RNA, 22 nt, Human
cagcaugaauguguucguaggg

SEQ ID NO: 330422 - RNA, 21 nt, Human
agagacugucacugcaguacc

SEQ ID NO: 330423 - RNA, 22 nt, Human
ccagcugggucccugcuggggc

SEQ ID NO: 330424 - RNA, 22 nt, Human
cuucuggcguuggaggucugag

SEQ ID NO: 330425 - RNA, 22 nt, Human
gaagcgcggcgucggcgugggu

SEQ ID NO: 330426 - RNA, 22 nt, Human
agugccucugcagguccgaguu

SEQ ID NO: 330427 - RNA, 22 nt, Human
ucugcuugugucuguccagccu

SEQ ID NO: 330428 - RNA, 22 nt, Human
aggcuccaugguucucccucag

SEQ ID NO: 330429 - RNA, 22 nt, Human
ucagucucuggggcuucuguuu

SEQ ID NO: 330430 - RNA, 19 nt, Human
uccagaacugcccuggccu

SEQ ID NO: 330431 - RNA, 22 nt, Human
caggguggcaggcaccauggcc

SEQ ID NO: 330432 - RNA, 22 nt, Human
gagccauacaaccuauaaagug

SEQ ID NO: 330433 - RNA, 22 nt, Human
gugcucuggccaagcgcgugcg

SEQ ID NO: 330434 - RNA, 19 nt, Human
uggcagcauugguaccuug

SEQ ID NO: 330435 - RNA, 22 nt, Human
ugagaugaagugauguaaaaca

SEQ ID NO: 330436 - RNA, 22 nt, Human
agagcgagucuggggcucggau

SEQ ID NO: 330437 - RNA, 22 nt, Human
gucuccugaggcauccauugaa

SEQ ID NO: 330438 - RNA, 22 nt, Human
augcccugggagugcuguacca

SEQ ID NO: 330439 - RNA, 22 nt, Human
cauaaauuguacccauuccaac

SEQ ID NO: 330440 - RNA, 22 nt, Human
gguuccaggcauggcaggaugu

SEQ ID NO: 330441 - RNA, 22 nt, Human
gugcaggugguuggcccagccg

SEQ ID NO: 330442 - RNA, 22 nt, Human
gcggcuccgaagccaggccgcg

SEQ ID NO: 330443 - RNA, 22 nt, Human
ucaccggugacccucggcucgc

SEQ ID NO: 330444 - RNA, 22 nt, Human
cagagcagaaaccugggugauu

SEQ ID NO: 330445 - RNA, 22 nt, Human
aucucccaaauuagccucuuga

SEQ ID NO: 330446 - RNA, 23 nt, Human
uggcucugagcuuccugguggcc

SEQ ID NO: 330447 - RNA, 22 nt, Human
cagugcccuuccaggacugcag

SEQ ID NO: 330448 - RNA, 22 nt, Human
ucggagcgucacuggcuggagg

SEQ ID NO: 330449 - RNA, 22 nt, Human
uguguuuuggaaggaacaugca

SEQ ID NO: 330450 - RNA, 22 nt, Human
ugguggggccagacuucagcuc

SEQ ID NO: 330451 - RNA, 22 nt, Human
cccucucccugcagaauguggc

SEQ ID NO: 330452 - RNA, 22 nt, Human
cuucuggguauuccagauaccu

SEQ ID NO: 330453 - RNA, 22 nt, Human
gagguuggagggcuggccugca

SEQ ID NO: 330454 - RNA, 22 nt, Human
agggcacuuccucugggucccu

SEQ ID NO: 330455 - RNA, 22 nt, Human
gugauuuucuccuccuagaagu

SEQ ID NO: 330456 - RNA, 22 nt, Human
gccugagccgccugagcggcgg

SEQ ID NO: 330457 - RNA, 22 nt, Human
acauuguugagccucuuguuca

SEQ ID NO: 330458 - RNA, 22 nt, Human
gcuguccugggaacaggcacua

SEQ ID NO: 330459 - RNA, 20 nt, Human
auuagcuuggagacaguggc

SEQ ID NO: 330460 - RNA, 22 nt, Human
gcgagucgccgcugcagcccua

SEQ ID NO: 330461 - RNA, 22 nt, Human
cuuuacagugaacuugcuuguc

SEQ ID NO: 330462 - RNA, 19 nt, Human
agcagccaucgaccaugga

SEQ ID NO: 330463 - RNA, 22 nt, Human
cauggccagauucuuucuucuc

SEQ ID NO: 330464 - RNA, 22 nt, Human
gcaagcagcccagaacagcucu

SEQ ID NO: 330465 - RNA, 22 nt, Human
aaggggggcaccugcaugcccg

SEQ ID NO: 330466 - RNA, 22 nt, Human
ggggagaguauuuuauucaagu

SEQ ID NO: 330467 - RNA, 17 nt, Human
gcuccagaauucuaguc

SEQ ID NO: 330468 - RNA, 22 nt, Human
agcagcaggugaccucgaugcc

SEQ ID NO: 330469 - RNA, 17 nt, Human
aguuuuuggaccugugu

SEQ ID NO: 330470 - RNA, 22 nt, Human
ugccgcugucgccaccauggcu

SEQ ID NO: 330471 - RNA, 22 nt, Human
aggcucugucaggcggagcagc

SEQ ID NO: 330472 - RNA, 22 nt, Human
ccaggagagcucucguucagug

SEQ ID NO: 330473 - RNA, 19 nt, Human
ccauucugucucugccaca

SEQ ID NO: 330474 - RNA, 22 nt, Human
ucuggcuucaacuuuacugaaa

SEQ ID NO: 330475 - RNA, 22 nt, Human
uuuauucucuaguuggucagau

SEQ ID NO: 330476 - RNA, 22 nt, Human
cugcaucacagcaggaggcaca

SEQ ID NO: 330477 - RNA, 22 nt, Human
uggauguuugaaguugcaugug

SEQ ID NO: 330478 - RNA, 22 nt, Human
accaggcccuccagcugcgugg

SEQ ID NO: 330479 - RNA, 22 nt, Human
ggcuggaacuucuucuggcauu

SEQ ID NO: 330480 - RNA, 22 nt, Human
acagagacaauauuuguaaagu

SEQ ID NO: 330481 - RNA, 22 nt, Human
guugaguguugugcaugcacca

SEQ ID NO: 330482 - RNA, 22 nt, Human
uggugcugccaccuccucugcu

SEQ ID NO: 330483 - RNA, 22 nt, Human
uccucacagcugguucauucag

SEQ ID NO: 330484 - RNA, 22 nt, Human
gugauuucagguuuuucauacu

SEQ ID NO: 330485 - RNA, 17 nt, Human
ggugaguguccaggugg

SEQ ID NO: 330486 - RNA, 22 nt, Human
ccccaacccugguuccguggcg

SEQ ID NO: 330487 - RNA, 17 nt, Human
gccuggcccagccuggc

SEQ ID NO: 330488 - RNA, 22 nt, Human
gcucugugccccugccguggac

SEQ ID NO: 330489 - RNA, 22 nt, Human
gagcuccuauggucgguggcuc

SEQ ID NO: 330490 - RNA, 22 nt, Human
cagcagcucaggcuccuuccca

SEQ ID NO: 330491 - RNA, 22 nt, Human
ccaggacacgauuuuuagucug

SEQ ID NO: 330492 - RNA, 22 nt, Human
cgcagcugcugcucugaaacag

SEQ ID NO: 330493 - RNA, 22 nt, Human
ugcuccaggcugcugaagaucu

SEQ ID NO: 330494 - RNA, 22 nt, Human
uuuggucuggaaucuucagggu

SEQ ID NO: 330495 - RNA, 22 nt, Human
guuuuguucaugaacauugggu

SEQ ID NO: 330496 - RNA, 22 nt, Human
uggcagcauuuuuuccagaaca

SEQ ID NO: 330497 - RNA, 22 nt, Human
acaugcuuucuagguccuucug

SEQ ID NO: 330498 - RNA, 22 nt, Human
aggguugaagucugguccucau

SEQ ID NO: 330499 - RNA, 22 nt, Human
caggaugccuuugaacucugga

SEQ ID NO: 330500 - RNA, 22 nt, Human
ucugcgcccugucgccugcucc

SEQ ID NO: 330501 - RNA, 22 nt, Human
cccaggacucugacacccccaa

SEQ ID NO: 330502 - RNA, 22 nt, Human
gcggggacagaaggcgguucuc

SEQ ID NO: 330503 - RNA, 22 nt, Human
ccugugggcgcagcuggaguca

SEQ ID NO: 330504 - RNA, 18 nt, Human
uccaccgcgugcaccucu

SEQ ID NO: 330505 - RNA, 22 nt, Human
uccugggcccuccggaucaggu

SEQ ID NO: 330506 - RNA, 16 nt, Human
ucucuggguugcacag

SEQ ID NO: 330507 - RNA, 22 nt, Human
ucgggcugcucgcugcggaacu

SEQ ID NO: 330508 - RNA, 22 nt, Human
aaagagcucggaaaguguugaa

SEQ ID NO: 330509 - RNA, 22 nt, Human
gccugaucagguccucggcaua

SEQ ID NO: 330510 - RNA, 19 nt, Human
gagcagcuuccuaucuggu

SEQ ID NO: 330511 - RNA, 22 nt, Human
uaugcuagauggaaaaauauug

SEQ ID NO: 330512 - RNA, 22 nt, Human
gcuuuugagguccugcucagcc

SEQ ID NO: 330513 - RNA, 15 nt, Human
gccccaggaaucaaa

SEQ ID NO: 330514 - RNA, 22 nt, Human
aaggugccacuucccucagacu

SEQ ID NO: 330515 - RNA, 22 nt, Human
cuggcagcugcccgagaugccc

SEQ ID NO: 330516 - RNA, 22 nt, Human
cacaucauguuaauucauuaca

SEQ ID NO: 330517 - RNA, 22 nt, Human
ucagguccaagauggccaucca

SEQ ID NO: 330518 - RNA, 22 nt, Human
agccccaguccgcugcgggcgg

SEQ ID NO: 330519 - RNA, 22 nt, Human
gguuguaguuggagguuguaua

SEQ ID NO: 330520 - RNA, 22 nt, Human
gcuggccugcgagggcaggcug

SEQ ID NO: 330521 - RNA, 22 nt, Human
gagugugucggucagcguggcg

SEQ ID NO: 330522 - RNA, 22 nt, Human
ccuggguccaauucuggcuugu

SEQ ID NO: 330523 - RNA, 22 nt, Human
uacauguacaugcauagguaga

SEQ ID NO: 330524 - RNA, 22 nt, Human
cugcugccuuccaaaggccagg

SEQ ID NO: 330525 - RNA, 22 nt, Human
cccaccacgugcuuugcuggag

SEQ ID NO: 330526 - RNA, 22 nt, Human
agggcccaccuuggugcugagg

SEQ ID NO: 330527 - RNA, 22 nt, Human
aucauccauggcugaucauaaa

SEQ ID NO: 330528 - RNA, 22 nt, Human
ugcgccugcgcaaagguuucug

SEQ ID NO: 330529 - RNA, 19 nt, Human
ccugugucccacguagaug

SEQ ID NO: 330530 - RNA, 22 nt, Human
cacagcuucuccccgcugcggc

SEQ ID NO: 330531 - RNA, 22 nt, Human
aggacagagggaccagagccca

SEQ ID NO: 330532 - RNA, 22 nt, Human
ucaccggcagacguggccugau

SEQ ID NO: 330533 - RNA, 22 nt, Human
aguggcugugaaauacauggga

SEQ ID NO: 330534 - RNA, 22 nt, Human
gaggcucagagggacuuucaag

SEQ ID NO: 330535 - RNA, 22 nt, Human
agccaugcaccuuacucuugcu

SEQ ID NO: 330536 - RNA, 22 nt, Human
aaucuguugucaggaauccaca

SEQ ID NO: 330537 - RNA, 22 nt, Human
ucuguggcauguugcacuugua

SEQ ID NO: 330538 - RNA, 22 nt, Human
augcaguuagguaauagucuca

SEQ ID NO: 330539 - RNA, 22 nt, Human
gguggcaccuuacccugcgcag

SEQ ID NO: 330540 - RNA, 18 nt, Human
gacaaaaguacagacaga

SEQ ID NO: 330541 - RNA, 22 nt, Human
agcccuugguauuuuccgaucc

SEQ ID NO: 330542 - RNA, 19 nt, Human
cuucuggauccgcagggcc

SEQ ID NO: 330543 - RNA, 22 nt, Human
ucccgggcaggucgagcgagcc

SEQ ID NO: 330544 - RNA, 22 nt, Human
ggccgcggauuuucccgcuggc

SEQ ID NO: 330545 - RNA, 22 nt, Human
uccugagauaggaguugaaggc

SEQ ID NO: 330546 - RNA, 22 nt, Human
acuucacagauauuuauuuggu

SEQ ID NO: 330547 - RNA, 22 nt, Human
cccugccuacaggguuuucuuu

SEQ ID NO: 330548 - RNA, 22 nt, Human
ucagaggagcaaaagaggggau

SEQ ID NO: 330549 - RNA, 22 nt, Human
aggccugggacgggagccguga

SEQ ID NO: 330550 - RNA, 22 nt, Human
gggcagcaucaggaggggcuuu

SEQ ID NO: 330551 - RNA, 22 nt, Human
ggcuggacuugguccuguuuug

SEQ ID NO: 330552 - RNA, 16 nt, Human
ggcagcagcuccgugc

SEQ ID NO: 330553 - RNA, 22 nt, Human
cgcugggcgcgcuccgaacccg

SEQ ID NO: 330554 - RNA, 22 nt, Human
agcagcaccuguccucgcugcu

SEQ ID NO: 330555 - RNA, 22 nt, Human
ugcuucucaaaaggagguaggu

SEQ ID NO: 330556 - RNA, 22 nt, Human
aggaagagcuggaccagaggac

SEQ ID NO: 330557 - RNA, 22 nt, Human
agguucccagagauagagcugu

SEQ ID NO: 330558 - RNA, 20 nt, Human
caucaacaccuugucagccu

SEQ ID NO: 330559 - RNA, 22 nt, Human
cacgccuggacggcggagggug

SEQ ID NO: 330560 - RNA, 22 nt, Human
ggaggaggggugacugaaugcu

SEQ ID NO: 330561 - RNA, 22 nt, Human
uuauuccauagaagucaaggaa

SEQ ID NO: 330562 - RNA, 22 nt, Human
ugcccuguuccugccuccagcu

SEQ ID NO: 330563 - RNA, 22 nt, Human
aagagcuggcucuugcagcagc

SEQ ID NO: 330564 - RNA, 21 nt, Human
ucauccagguccugcuucuuc

SEQ ID NO: 330565 - RNA, 22 nt, Human
guuugcaaauuguguuaaagcu

SEQ ID NO: 330566 - RNA, 22 nt, Human
agucacuguuuaaucuagcuaa

SEQ ID NO: 330567 - RNA, 18 nt, Human
gggcuuuacagaguggag

SEQ ID NO: 330568 - RNA, 22 nt, Human
gccuggggaacuugauccuguc

SEQ ID NO: 330569 - RNA, 20 nt, Human
ucauccaguugguuuauggu

SEQ ID NO: 330570 - RNA, 22 nt, Human
cagcuuuugcagacuucuugcc

SEQ ID NO: 330571 - RNA, 22 nt, Human
gcaucugauccaauagauauau

SEQ ID NO: 330572 - RNA, 22 nt, Human
ccugucugaaggcagggggaug

SEQ ID NO: 330573 - RNA, 22 nt, Human
ggugaccagggucaguagcuuu

SEQ ID NO: 330574 - RNA, 22 nt, Human
cuuucuuucgaagacgugauua

SEQ ID NO: 330575 - RNA, 22 nt, Human
ugcuccugaacacagcccuaug

SEQ ID NO: 330576 - RNA, 22 nt, Human
cccuggcucugccucagagccc

SEQ ID NO: 330577 - RNA, 22 nt, Human
ccagcugcgggcaucgagaguu

SEQ ID NO: 330578 - RNA, 22 nt, Human
ucucucugcagcccgggacacu

SEQ ID NO: 330579 - RNA, 22 nt, Human
ucucaucugccauuugcaggag

SEQ ID NO: 330580 - RNA, 22 nt, Human
guggccuccuccguccgccucu

SEQ ID NO: 330581 - RNA, 15 nt, Human
gccuugaaugugaau

SEQ ID NO: 330582 - RNA, 22 nt, Human
ucaucuccauacggucucgcag

SEQ ID NO: 330583 - RNA, 22 nt, Human
ugcgcaugcguggcucuccggc

SEQ ID NO: 330584 - RNA, 22 nt, Human
acccaggucucucgacuucugg

SEQ ID NO: 330585 - RNA, 22 nt, Human
agugggagcggcagucggggac

SEQ ID NO: 330586 - RNA, 22 nt, Human
gccgugcgugcgcaggugcugu

SEQ ID NO: 330587 - RNA, 22 nt, Human
cauggaaggcaaaagacacaga

SEQ ID NO: 330588 - RNA, 22 nt, Human
gagcuguguaugcaucauucug

SEQ ID NO: 330589 - RNA, 22 nt, Human
cucugguuucgcaggaaauaga

SEQ ID NO: 330590 - RNA, 21 nt, Human
uccugcugagaaacagauggu

SEQ ID NO: 330591 - RNA, 22 nt, Human
ucauacauguuguguucaaaug

SEQ ID NO: 330592 - RNA, 22 nt, Human
ccugcgcgucugggucugucuc

SEQ ID NO: 330593 - RNA, 22 nt, Human
uguuugcucugacuaucuugcg

SEQ ID NO: 330594 - RNA, 22 nt, Human
ugaaggccagggauuugcagcc

SEQ ID NO: 330595 - RNA, 22 nt, Human
ggcgaggugucugccaucaagc

SEQ ID NO: 330596 - RNA, 22 nt, Human
agccacccuaccagcccugaaa

SEQ ID NO: 330597 - RNA, 22 nt, Human
cagugcugcaggcgccugcggu

SEQ ID NO: 330598 - RNA, 22 nt, Human
cuguuccuccaccucaacaaac

SEQ ID NO: 330599 - RNA, 22 nt, Human
uguccagcugaaggcagccuca

SEQ ID NO: 330600 - RNA, 22 nt, Human
aggcggguuuaggacaaugcuu

SEQ ID NO: 330601 - RNA, 20 nt, Human
uccagccacuuccgcugguc

SEQ ID NO: 330602 - RNA, 22 nt, Human
uuuuucaagacaaccugcaugu

SEQ ID NO: 330603 - RNA, 22 nt, Human
cccccagcucugcugggucccg

SEQ ID NO: 330604 - RNA, 22 nt, Human
auggcugugguaucagacgcag

SEQ ID NO: 330605 - RNA, 19 nt, Human
ccugcugaagugaugcagc

SEQ ID NO: 330606 - RNA, 18 nt, Human
augggcagguaagaucca

SEQ ID NO: 330607 - RNA, 22 nt, Human
gcuagagaccagaggccuugaa

SEQ ID NO: 330608 - RNA, 22 nt, Human
gcccagcugagaagcgcggggc

SEQ ID NO: 330609 - RNA, 22 nt, Human
cagggccucugugggcucucuc

SEQ ID NO: 330610 - RNA, 20 nt, Human
gugugaccuccuguggaugc

SEQ ID NO: 330611 - RNA, 22 nt, Human
auggaguugagcucuguugucc

SEQ ID NO: 330612 - RNA, 22 nt, Human
gagcagcaggccagguugcagg

SEQ ID NO: 330613 - RNA, 22 nt, Human
gucuugcacuuaccuaagaacu

SEQ ID NO: 330614 - RNA, 22 nt, Human
ggcgcggugacucagccucgcu

SEQ ID NO: 330615 - RNA, 22 nt, Human
ucaggaugagucaucaagcugc

SEQ ID NO: 330616 - RNA, 22 nt, Human
ccaggcagccaagugugugugu

SEQ ID NO: 330617 - RNA, 22 nt, Human
gagggccaaugugucccugagc

SEQ ID NO: 330618 - RNA, 22 nt, Human
ggcaguggugggaggcucgcuc

SEQ ID NO: 330619 - RNA, 22 nt, Human
cuccagaggcgacuugcaucac

SEQ ID NO: 330620 - RNA, 22 nt, Human
cucucuguuaugcuuucaugaa

SEQ ID NO: 330621 - RNA, 20 nt, Human
ccagagcugauggcugcccg

SEQ ID NO: 330622 - RNA, 22 nt, Human
guuaaaugcagauucugacuca

SEQ ID NO: 330623 - RNA, 22 nt, Human
aggaggguggggucugccuguc

SEQ ID NO: 330624 - RNA, 22 nt, Human
cagugccagcugcuuggccuac

SEQ ID NO: 330625 - RNA, 22 nt, Human
ggccagccuggggcucccagac

SEQ ID NO: 330626 - RNA, 22 nt, Human
ccgcuguccuggagcugcugcu

SEQ ID NO: 330627 - RNA, 22 nt, Human
ccucuuccuucucacuguggaa

SEQ ID NO: 330628 - RNA, 19 nt, Human
gaugcucauucagguggaa

SEQ ID NO: 330629 - RNA, 22 nt, Human
cugugaauguuauaucucaaug

SEQ ID NO: 330630 - RNA, 22 nt, Human
cacauuuaaagguugaagcuga

SEQ ID NO: 330631 - RNA, 22 nt, Human
ccugugcuucacucaacaagcc

SEQ ID NO: 330632 - RNA, 22 nt, Human
uccaggaggacugagggggcug

SEQ ID NO: 330633 - RNA, 22 nt, Human
ucccggcgcugggagguggguc

SEQ ID NO: 330634 - RNA, 22 nt, Human
guggauggagcuggaagccauu

SEQ ID NO: 330635 - RNA, 22 nt, Human
agcugugaccuucaagagcuac

SEQ ID NO: 330636 - RNA, 22 nt, Human
aggggagguggcagaaaugugc

SEQ ID NO: 330637 - RNA, 22 nt, Human
uccuggccucugagucaagaac

SEQ ID NO: 330638 - RNA, 22 nt, Human
ugcuuucaaugaauuguauacu

SEQ ID NO: 330639 - RNA, 22 nt, Human
acauuuuuggguugaugucuga

SEQ ID NO: 330640 - RNA, 22 nt, Human
gagggugguggcuuaaggugcu

SEQ ID NO: 330641 - RNA, 22 nt, Human
cagcgguggcaaggugacugug

SEQ ID NO: 330642 - RNA, 22 nt, Human
auggccuuucucaguggugcuu

SEQ ID NO: 330643 - RNA, 22 nt, Human
ucacauguguggcagugcaagu

SEQ ID NO: 330644 - RNA, 22 nt, Human
gugagguccucccugcugggag

SEQ ID NO: 330645 - RNA, 22 nt, Human
guggccaucuuuggcccugacu

SEQ ID NO: 330646 - RNA, 22 nt, Human
ucagagacaucagguuguagca

SEQ ID NO: 330647 - RNA, 22 nt, Human
gcugggcccugggugcccuagc

SEQ ID NO: 330648 - RNA, 22 nt, Human
ugccuggcugggcugcucaugg

SEQ ID NO: 330649 - RNA, 23 nt, Human
acucugacuuaguuauagcuauu

SEQ ID NO: 330650 - RNA, 22 nt, Human
aagauuuaccacuuuauucaag

SEQ ID NO: 330651 - RNA, 22 nt, Human
uucaguuuugcuuuuaaucaug

SEQ ID NO: 330652 - RNA, 22 nt, Human
gacgugggucgccaucgauaug

SEQ ID NO: 330653 - RNA, 20 nt, Human
ucucccugcccaucucagau

SEQ ID NO: 330654 - RNA, 22 nt, Human
gucccugauaagagccaucgau

SEQ ID NO: 330655 - RNA, 22 nt, Human
uaaagugaaguucagaauggcu

SEQ ID NO: 330656 - RNA, 22 nt, Human
cccaggcacacugaagugacau

SEQ ID NO: 330657 - RNA, 17 nt, Human
ggccugcaccuccugcu

SEQ ID NO: 330658 - RNA, 22 nt, Human
caaagaagagauuuacagagcu

SEQ ID NO: 330659 - RNA, 22 nt, Human
gcuccugggcccugggcuaacu

SEQ ID NO: 330660 - RNA, 22 nt, Human
uggccuugcccagcgccuaggu

SEQ ID NO: 330661 - RNA, 22 nt, Human
cucgccccggcacaguguccgu

SEQ ID NO: 330662 - RNA, 22 nt, Human
accuccuccaaggagccauagg

SEQ ID NO: 330663 - RNA, 22 nt, Human
acaugaggaacucaggagucac

SEQ ID NO: 330664 - RNA, 22 nt, Human
augauuuguuaacagacuuaau

SEQ ID NO: 330665 - RNA, 20 nt, Human
gggugugugcagggccuggu

SEQ ID NO: 330666 - RNA, 22 nt, Human
gagcugagggucuaggaggguu

SEQ ID NO: 330667 - RNA, 18 nt, Human
gccuggcuucggagccgc

SEQ ID NO: 330668 - RNA, 22 nt, Human
uccagguccuacuggcccauag

SEQ ID NO: 330669 - RNA, 22 nt, Human
gccagcagcucuugggcgggca

SEQ ID NO: 330670 - RNA, 22 nt, Human
gguggcagaggugcaucagccc

SEQ ID NO: 330671 - RNA, 22 nt, Human
cuguggguggcugugccccagg

SEQ ID NO: 330672 - RNA, 22 nt, Human
auaucuaggcugaauguaaaau

SEQ ID NO: 330673 - RNA, 22 nt, Human
aaguuacacauuuucauuguaa

SEQ ID NO: 330674 - RNA, 22 nt, Human
caggcuacauuugcucugagaa

SEQ ID NO: 330675 - RNA, 22 nt, Human
uuuuguguugccauguuaagca

SEQ ID NO: 330676 - RNA, 22 nt, Human
gggugcaaacccguucugcacc

SEQ ID NO: 330677 - RNA, 22 nt, Human
cagguuccaguugcagggacuu

SEQ ID NO: 330678 - RNA, 19 nt, Human
cucugccauuugcugccug

SEQ ID NO: 330679 - RNA, 22 nt, Human
gcugcccauugcucucccacuc

SEQ ID NO: 330680 - RNA, 22 nt, Human
uggcauuuuguagcuguguauc

SEQ ID NO: 330681 - RNA, 22 nt, Human
agccagucggggccaugcuggg

SEQ ID NO: 330682 - RNA, 22 nt, Human
uuugacuccuguguuucuggaa

SEQ ID NO: 330683 - RNA, 22 nt, Human
gcgcugccucugcucuccccac

SEQ ID NO: 330684 - RNA, 22 nt, Human
aggugccugucgucucugguua

SEQ ID NO: 330685 - RNA, 22 nt, Human
agcaggccugccaccucggggu

SEQ ID NO: 330686 - RNA, 22 nt, Human
ggccuugggauguggcugcagc

SEQ ID NO: 330687 - RNA, 22 nt, Human
aaguuacaggagaaagagauca

SEQ ID NO: 330688 - RNA, 22 nt, Human
ugaguccagaugggccagcagg

SEQ ID NO: 330689 - RNA, 22 nt, Human
gccagcagcgagaguuuaaccu

SEQ ID NO: 330690 - RNA, 22 nt, Human
ucagccaggccaggcauucaca

SEQ ID NO: 330691 - RNA, 22 nt, Human
ccucguccacaauccuugcaca

SEQ ID NO: 330692 - RNA, 18 nt, Human
aaacauggcuuaaaggcu

SEQ ID NO: 330693 - RNA, 22 nt, Human
cagcaguacuucucagagguau

SEQ ID NO: 330694 - RNA, 22 nt, Human
cagggagaucuuggcuccuggu

SEQ ID NO: 330695 - RNA, 20 nt, Human
aggcccuccccacuguugcu

SEQ ID NO: 330696 - RNA, 22 nt, Human
agggccacgugcaccgcggucu

SEQ ID NO: 330697 - RNA, 22 nt, Human
cgucaggguugagcagguagau

SEQ ID NO: 330698 - RNA, 22 nt, Human
gagaggaagccuucuguacuug

SEQ ID NO: 330699 - RNA, 22 nt, Human
ccagcaggagacuagcaacaua

SEQ ID NO: 330700 - RNA, 22 nt, Human
gcggggccauguccaacggccu

SEQ ID NO: 330701 - RNA, 19 nt, Human
acugcagggaggaggugug

SEQ ID NO: 330702 - RNA, 22 nt, Human
uccagcaguccaugugagacac

SEQ ID NO: 330703 - RNA, 22 nt, Human
gcugucccgaaccccugguaau

SEQ ID NO: 330704 - RNA, 22 nt, Human
ggucuccugaccuuuagucccu

SEQ ID NO: 330705 - RNA, 22 nt, Human
ggcagcagaacuggcccuguau

SEQ ID NO: 330706 - RNA, 22 nt, Human
uacuguauacuacugcuguucu

SEQ ID NO: 330707 - RNA, 22 nt, Human
gcacguguucuguggcaugggu

SEQ ID NO: 330708 - RNA, 22 nt, Human
gcccagccccuggguggacgug

SEQ ID NO: 330709 - RNA, 22 nt, Human
cccuucagcugagugggacagc

SEQ ID NO: 330710 - RNA, 22 nt, Human
caagccaggaaggauccagcac

SEQ ID NO: 330711 - RNA, 22 nt, Human
caggccagcagggccuccgugg

SEQ ID NO: 330712 - RNA, 22 nt, Human
acgcggugcggcaaguucaugg

SEQ ID NO: 330713 - RNA, 22 nt, Human
aggcaguguggagggcuguugc

SEQ ID NO: 330714 - RNA, 22 nt, Human
gcaccgagaaggaagcaugccu

SEQ ID NO: 330715 - RNA, 22 nt, Human
aaagaggcucaaggugggccag

SEQ ID NO: 330716 - RNA, 22 nt, Human
cuucaugcugauauccucgaug

SEQ ID NO: 330717 - RNA, 22 nt, Human
aucuaugugggaaucauaauag

SEQ ID NO: 330718 - RNA, 22 nt, Human
ggcgagcaugagucacucuggg

SEQ ID NO: 330719 - RNA, 21 nt, Human
ucuccucccggggagaggccg

SEQ ID NO: 330720 - RNA, 22 nt, Human
ugaggccaagccuccucugcca

SEQ ID NO: 330721 - RNA, 22 nt, Human
agaguggcaccuuaccugagac

SEQ ID NO: 330722 - RNA, 20 nt, Human
acacugugcuaaggauuuuc

SEQ ID NO: 330723 - RNA, 22 nt, Human
gcugucaggaacaugccuuggu

SEQ ID NO: 330724 - RNA, 22 nt, Human
cagggcucgcucgcucgcucgc

SEQ ID NO: 330725 - RNA, 22 nt, Human
ucuccucuccuuucauguuguu

SEQ ID NO: 330726 - RNA, 22 nt, Human
augcuuucucuuaguucauuga

SEQ ID NO: 330727 - RNA, 22 nt, Human
ccggcucggcgaccaggcugaa

SEQ ID NO: 330728 - RNA, 22 nt, Human
cccagcugaacuugcauuccaa

SEQ ID NO: 330729 - RNA, 22 nt, Human
uggaaauacaagaaguauguca

SEQ ID NO: 330730 - RNA, 22 nt, Human
cgugcagcggagcuggucacug

SEQ ID NO: 330731 - RNA, 22 nt, Human
ugguuacccagucgcuggaguu

SEQ ID NO: 330732 - RNA, 21 nt, Human
ucugugcuuuuuuggcuccua

SEQ ID NO: 330733 - RNA, 22 nt, Human
uuucuucucacccaggacagag

SEQ ID NO: 330734 - RNA, 22 nt, Human
caggacccaucagccaggcacu

SEQ ID NO: 330735 - RNA, 22 nt, Human
agugaauuagccuauuuguaaa

SEQ ID NO: 330736 - RNA, 19 nt, Human
ugccuggcaccagcuccac

SEQ ID NO: 330737 - RNA, 18 nt, Human
accugauuggcgcagccc

SEQ ID NO: 330738 - RNA, 22 nt, Human
ucuuucagaaacuuugucugcg

SEQ ID NO: 330739 - RNA, 22 nt, Human
aggcucccaagcacugacccca

SEQ ID NO: 330740 - RNA, 22 nt, Human
gccaaucaggaggcuguacauc

SEQ ID NO: 330741 - RNA, 22 nt, Human
ugccucugcugcauauucaccu

SEQ ID NO: 330742 - RNA, 19 nt, Human
aggugaugugacucuagaa

SEQ ID NO: 330743 - RNA, 22 nt, Human
ugucuucauuccccaugaaguc

SEQ ID NO: 330744 - RNA, 22 nt, Human
ugcugcucaagcugcagcaaaa

SEQ ID NO: 330745 - RNA, 22 nt, Human
guauuaugaaugccgaggcggc

SEQ ID NO: 330746 - RNA, 22 nt, Human
ucaccgccuugcccggccgggc

SEQ ID NO: 330747 - RNA, 22 nt, Human
uacugcugagcuggguagaagg

SEQ ID NO: 330748 - RNA, 22 nt, Human
accagucauagaaagcaguggu

SEQ ID NO: 330749 - RNA, 22 nt, Human
gccacccuggacgcacuguucg

SEQ ID NO: 330750 - RNA, 22 nt, Human
ugccuggauggcucugagcagg

SEQ ID NO: 330751 - RNA, 22 nt, Human
uggaaggggccaggcgcggagu

SEQ ID NO: 330752 - RNA, 18 nt, Human
ggaaggugcuggagugca

SEQ ID NO: 330753 - RNA, 21 nt, Human
ugcuccaggagggggcagucc

SEQ ID NO: 330754 - RNA, 22 nt, Human
uguagcucuccagccagcaagg

SEQ ID NO: 330755 - RNA, 22 nt, Human
gggcucuguuuagaccagagau

SEQ ID NO: 330756 - RNA, 22 nt, Human
uucaaugcaagggaggucugaa

SEQ ID NO: 330757 - RNA, 22 nt, Human
ccucuuccacugggccccaucc

SEQ ID NO: 330758 - RNA, 22 nt, Human
uggccccugaggagcgucagcc

SEQ ID NO: 330759 - RNA, 22 nt, Human
cugggauccacgggcucccaag

SEQ ID NO: 330760 - RNA, 17 nt, Human
gcguguccccgcgucuc

SEQ ID NO: 330761 - RNA, 22 nt, Human
agcuggguguagggcuggacaa

SEQ ID NO: 330762 - RNA, 22 nt, Human
agaagcagaaggaagcagggcc

SEQ ID NO: 330763 - RNA, 22 nt, Human
ugggcagggagcuggaaccaca

SEQ ID NO: 330764 - RNA, 22 nt, Human
cgccaguggcagcuggaacagg

SEQ ID NO: 330765 - RNA, 22 nt, Human
caggagcucaagaccacccugg

SEQ ID NO: 330766 - RNA, 22 nt, Human
cugucaaauggaaacuuauccu

SEQ ID NO: 330767 - RNA, 22 nt, Human
cugaauucugccuugaggccuu

SEQ ID NO: 330768 - RNA, 22 nt, Human
ccaggacaagccagagggacag

SEQ ID NO: 330769 - RNA, 22 nt, Human
gagaguuaguugagcagucuga

SEQ ID NO: 330770 - RNA, 22 nt, Human
augcuuuauuggagacagucau

SEQ ID NO: 330771 - RNA, 22 nt, Human
aauggcuguucucugugauugg

SEQ ID NO: 330772 - RNA, 22 nt, Human
ucugcacccugugguccucuag

SEQ ID NO: 330773 - RNA, 22 nt, Human
gggcagcaggcuccacguuccu

SEQ ID NO: 330774 - RNA, 21 nt, Human
gggcuggauauuggaaagagg

SEQ ID NO: 330775 - RNA, 20 nt, Human
augcacccucagggucccug

SEQ ID NO: 330776 - RNA, 22 nt, Human
cgcccacgaaguagguggcauu

SEQ ID NO: 330777 - RNA, 22 nt, Human
gcucagugaagggugccaagua

SEQ ID NO: 330778 - RNA, 21 nt, Human
uuuguucaggggcaaaguuaa

SEQ ID NO: 330779 - RNA, 22 nt, Human
acauuugauauggaguugugua

SEQ ID NO: 330780 - RNA, 22 nt, Human
gcagcugcgaagaagucuaucu

SEQ ID NO: 330781 - RNA, 17 nt, Human
ucugcagggggccgugu

SEQ ID NO: 330782 - RNA, 22 nt, Human
gggcuucuugagcugccggccc

SEQ ID NO: 330783 - RNA, 22 nt, Human
agcuccugaaaagcgcuugcuu

SEQ ID NO: 330784 - RNA, 18 nt, Human
auuugcaggcaugcaggc

SEQ ID NO: 330785 - RNA, 22 nt, Human
cagacaggguccuguccgucac

SEQ ID NO: 330786 - RNA, 22 nt, Human
agcggcgccgagcuuggccagg

SEQ ID NO: 330787 - RNA, 22 nt, Human
ccucucauagucuguauccuuu

SEQ ID NO: 330788 - RNA, 22 nt, Human
gccuguuucuccuccuuggccc

SEQ ID NO: 330789 - RNA, 21 nt, Human
ugcuggguuugcccaucaggc

SEQ ID NO: 330790 - RNA, 17 nt, Human
gagguaggaagugaguc

SEQ ID NO: 330791 - RNA, 19 nt, Human
ugcuccaggccuugccgca

SEQ ID NO: 330792 - RNA, 22 nt, Human
uucuuugcccauguuuccuaag

SEQ ID NO: 330793 - RNA, 22 nt, Human
ugaugggaggugcugcaggacc

SEQ ID NO: 330794 - RNA, 22 nt, Human
aagguggcggcugccagguccu

SEQ ID NO: 330795 - RNA, 22 nt, Human
gccuggaaugcaaugugacgaa

SEQ ID NO: 330796 - RNA, 22 nt, Human
cauagacauugauagguuauau

SEQ ID NO: 330797 - RNA, 22 nt, Human
ggggaagaaauagaacauuuug

SEQ ID NO: 330798 - RNA, 22 nt, Human
ucgccccgaggcagcccuaugc

SEQ ID NO: 330799 - RNA, 22 nt, Human
gcagcagcaggcgcucggccgu

SEQ ID NO: 330800 - RNA, 22 nt, Human
ccugggcaaaugccagagacaa

SEQ ID NO: 330801 - RNA, 22 nt, Human
ggucagugccuaucaugugggc

SEQ ID NO: 330802 - RNA, 22 nt, Human
gggcuccagaggcucacccugg

SEQ ID NO: 330803 - RNA, 22 nt, Human
acauucaugcaccuuccuaucc

SEQ ID NO: 330804 - RNA, 22 nt, Human
aagggccacaugccauuuaaaa

SEQ ID NO: 330805 - RNA, 22 nt, Human
gccccagcagcaaugcgguuga

SEQ ID NO: 330806 - RNA, 22 nt, Human
guggcgcagaggguggcagaga

SEQ ID NO: 330807 - RNA, 22 nt, Human
caugcaugccgggcugacagag

SEQ ID NO: 330808 - RNA, 22 nt, Human
gacuuugccacugaccuccaac

SEQ ID NO: 330809 - RNA, 22 nt, Human
cuggaagcgucggaggaagggc

SEQ ID NO: 330810 - RNA, 22 nt, Human
ccaagcuggacagcagcaagga

SEQ ID NO: 330811 - RNA, 22 nt, Human
gcugauggcuugcuggcugaca

SEQ ID NO: 330812 - RNA, 19 nt, Human
ggaggcuucuuggggucgg

SEQ ID NO: 330813 - RNA, 22 nt, Human
auuccaaagccugaauaaugga

SEQ ID NO: 330814 - RNA, 22 nt, Human
ucagagccccuccgcuguccca

SEQ ID NO: 330815 - RNA, 22 nt, Human
auggcucugcugggcaaagcaa

SEQ ID NO: 330816 - RNA, 22 nt, Human
caugugaauuccaaagcuaggu

SEQ ID NO: 330817 - RNA, 22 nt, Human
cugcccaucuggccacacacag

SEQ ID NO: 330818 - RNA, 23 nt, Human
ugggcagcuucugcaugcccacc

SEQ ID NO: 330819 - RNA, 22 nt, Human
uugcaggucuggggguccuggu

SEQ ID NO: 330820 - RNA, 23 nt, Human
uggugggcccugcuugcucacug

SEQ ID NO: 330821 - RNA, 22 nt, Human
accaggaguuuugaccaggggc

SEQ ID NO: 330822 - RNA, 22 nt, Human
gcggccugcgcugcucccgacg

SEQ ID NO: 330823 - RNA, 19 nt, Human
agcagagcagggccguggg

SEQ ID NO: 330824 - RNA, 22 nt, Human
ugggugguugcugaggcuccuu

SEQ ID NO: 330825 - RNA, 22 nt, Human
cagggccagggcuauggugaag

SEQ ID NO: 330826 - RNA, 22 nt, Human
ugcccagucuccgggccagccc

SEQ ID NO: 330827 - RNA, 22 nt, Human
ugccgcgcgcccagguuaggug

SEQ ID NO: 330828 - RNA, 22 nt, Human
uggcugagugaacauguccauu

SEQ ID NO: 330829 - RNA, 22 nt, Human
cccaggcuggggcuccuccagc

SEQ ID NO: 330830 - RNA, 21 nt, Human
ucgaccugcugggcucgggcu

SEQ ID NO: 330831 - RNA, 22 nt, Human
cuggcuccucaggacugcggga

SEQ ID NO: 330832 - RNA, 22 nt, Human
ugggagagauaggcuucuggac

SEQ ID NO: 330833 - RNA, 22 nt, Human
cugcacagucauuuccucucaa

SEQ ID NO: 330834 - RNA, 22 nt, Human
uuucacauacaguguauaguag

SEQ ID NO: 330835 - RNA, 22 nt, Human
uccuugcagcaggaacccacuu

SEQ ID NO: 330836 - RNA, 23 nt, Human
gggugcugccuguagucaugcug

SEQ ID NO: 330837 - RNA, 22 nt, Human
agaagagccacuguugacggca

SEQ ID NO: 330838 - RNA, 22 nt, Human
auccugggaaguggccuccucc

SEQ ID NO: 330839 - RNA, 22 nt, Human
cugggugagcuggccagagggu

SEQ ID NO: 330840 - RNA, 22 nt, Human
uucucaaagugugcucccugga

SEQ ID NO: 330841 - RNA, 22 nt, Human
cuccguggcuguggacgcagcc

SEQ ID NO: 330842 - RNA, 22 nt, Human
gugcaugucuuuggaggccucc

SEQ ID NO: 330843 - RNA, 22 nt, Human
ugugaacuggcagguggacggg

SEQ ID NO: 330844 - RNA, 22 nt, Human
uggcaaggccacaggugcaguu

SEQ ID NO: 330845 - RNA, 22 nt, Human
gcggccuuguggcggagcaggc

SEQ ID NO: 330846 - RNA, 22 nt, Human
gaggaggcuuccgggaggcacg

SEQ ID NO: 330847 - RNA, 22 nt, Human
ugcugcacuuauggcucugagg

SEQ ID NO: 330848 - RNA, 22 nt, Human
gcaccagccugagccucuugca

SEQ ID NO: 330849 - RNA, 22 nt, Human
aucuguucuucaaaauauuaca

SEQ ID NO: 330850 - RNA, 22 nt, Human
uguucuggugaggccauggggu

SEQ ID NO: 330851 - RNA, 19 nt, Human
uggugcgcuguuccugagc

SEQ ID NO: 330852 - RNA, 22 nt, Human
cccaggaguaagugacauuguu

SEQ ID NO: 330853 - RNA, 22 nt, Human
cacaccuuaggccugagcgcuu

SEQ ID NO: 330854 - RNA, 22 nt, Human
gcuugcuuuguaaauaucugug

SEQ ID NO: 330855 - RNA, 22 nt, Human
ucaggccccaucccagacuuau

SEQ ID NO: 330856 - RNA, 22 nt, Human
cuccagcagaaagggcgagugg

SEQ ID NO: 330857 - RNA, 20 nt, Human
ccacccuguccggggcggag

SEQ ID NO: 330858 - RNA, 22 nt, Human
cuggagggcugcagcgaggcug

SEQ ID NO: 330859 - RNA, 22 nt, Human
gggaccuggacaugugugugcu

SEQ ID NO: 330860 - RNA, 22 nt, Human
ucuggcccaucuucugccacca

SEQ ID NO: 330861 - RNA, 22 nt, Human
cuggcuuucauggcgcaguuga

SEQ ID NO: 330862 - RNA, 22 nt, Human
ucaucaucauucucccccacuu

SEQ ID NO: 330863 - RNA, 22 nt, Human
ggcgcucaguguugccccagag

SEQ ID NO: 330864 - RNA, 22 nt, Human
agguggaguuaagugugaacug

SEQ ID NO: 330865 - RNA, 22 nt, Human
uccuggcccuguggccugcagu

SEQ ID NO: 330866 - RNA, 22 nt, Human
ucaaagaucagaugguuguagg

SEQ ID NO: 330867 - RNA, 22 nt, Human
cuucucaaaguugugaaucagg

SEQ ID NO: 330868 - RNA, 22 nt, Human
ccaucuucucuugaaccuccuu

SEQ ID NO: 330869 - RNA, 22 nt, Human
ggccccagggauuaggccaacc

SEQ ID NO: 330870 - RNA, 22 nt, Human
guugcaaaugggaagaugguua

SEQ ID NO: 330871 - RNA, 22 nt, Human
cugucaccucugcccuuugccc

SEQ ID NO: 330872 - RNA, 20 nt, Human
cugcuccacccggcucucag

SEQ ID NO: 330873 - RNA, 22 nt, Human
gcacugccugugagcccugguu

SEQ ID NO: 330874 - RNA, 22 nt, Human
cagagccacugucugccaggca

SEQ ID NO: 330875 - RNA, 20 nt, Human
guccugggagccacagcaca

SEQ ID NO: 330876 - RNA, 22 nt, Human
gggaugagagcugggacagaag

SEQ ID NO: 330877 - RNA, 22 nt, Human
uuucuggcagcgggacaggggu

SEQ ID NO: 330878 - RNA, 22 nt, Human
cucccucaggccuuagcccugc

SEQ ID NO: 330879 - RNA, 22 nt, Human
cucuguccugguuuauacuggc

SEQ ID NO: 330880 - RNA, 22 nt, Human
gagugggugaaugugcucauaa

SEQ ID NO: 330881 - RNA, 22 nt, Human
cugucucugauaagcucgaggg

SEQ ID NO: 330882 - RNA, 22 nt, Human
gcggcccggguccccagcagca

SEQ ID NO: 330883 - RNA, 22 nt, Human
uugggucaugggaucccagcau

SEQ ID NO: 330884 - RNA, 22 nt, Human
gggacagcuguagugcuuggcu

SEQ ID NO: 330885 - RNA, 22 nt, Human
cagggucuuggcgccaucaccc

SEQ ID NO: 330886 - RNA, 22 nt, Human
ucugggaguuucugugggagcu

SEQ ID NO: 330887 - RNA, 22 nt, Human
aaggccaucuacuuacggaauu

SEQ ID NO: 330888 - RNA, 19 nt, Human
uccuggggaggggcauggc

SEQ ID NO: 330889 - RNA, 22 nt, Human
gugcugucguggaacugggcug

SEQ ID NO: 330890 - RNA, 22 nt, Human
cugggcuccuaaccauccaggu

SEQ ID NO: 330891 - RNA, 23 nt, Human
cguuuuuuccucagauguucugg

SEQ ID NO: 330892 - RNA, 22 nt, Human
gcagcccaggaggcgggagccc

SEQ ID NO: 330893 - RNA, 22 nt, Human
uugcuggaguagaaaacuuaac

SEQ ID NO: 330894 - RNA, 17 nt, Human
gcaggcacugcugccug

SEQ ID NO: 330895 - RNA, 22 nt, Human
cacugggagcagcuccaacauu

SEQ ID NO: 330896 - RNA, 22 nt, Human
ggcagccagagggcagcuggau

SEQ ID NO: 330897 - RNA, 22 nt, Human
uaccugggcccaccagugccug

SEQ ID NO: 330898 - RNA, 22 nt, Human
ccaggcuccccaggaggcccuu

SEQ ID NO: 330899 - RNA, 20 nt, Human
ggucacuguggcugcaggau

SEQ ID NO: 330900 - RNA, 22 nt, Human
ccgaggcuggccucagggcugu

SEQ ID NO: 330901 - RNA, 23 nt, Human
uggggcugauggagacggaccag

SEQ ID NO: 330902 - RNA, 22 nt, Human
aaagugacaaccauuuauuaag

SEQ ID NO: 330903 - RNA, 22 nt, Human
ucaggggacagccagcuggagg

SEQ ID NO: 330904 - RNA, 22 nt, Human
ugcacaguuggcuacaucgugg

SEQ ID NO: 330905 - RNA, 22 nt, Human
gagguggcugcuugcugggaaa

SEQ ID NO: 330906 - RNA, 22 nt, Human
ugcucuguucaguguaucuugu

SEQ ID NO: 330907 - RNA, 22 nt, Human
ugcagguggcagcggggcacca

SEQ ID NO: 330908 - RNA, 22 nt, Human
ucuuggcaguucuugugcuuuu

SEQ ID NO: 330909 - RNA, 22 nt, Human
cugacucccaaagaggacgcgu

SEQ ID NO: 330910 - RNA, 23 nt, Human
ggaagcucacguaguccugcacu

SEQ ID NO: 330911 - RNA, 22 nt, Human
gagcagcaucuccggcuuaaag

SEQ ID NO: 330912 - RNA, 22 nt, Human
aucugucccuccucacagccuc

SEQ ID NO: 330913 - RNA, 22 nt, Human
ggugcggagacuccaugaggcc

SEQ ID NO: 330914 - RNA, 22 nt, Human
ucaguguagcagacuuguagcc

SEQ ID NO: 330915 - RNA, 22 nt, Human
guugugcaaacacuggggucug

SEQ ID NO: 330916 - RNA, 18 nt, Human
ggccucagccuggccgga

SEQ ID NO: 330917 - RNA, 22 nt, Human
aaauugcaaaaguacuuuuagg

SEQ ID NO: 330918 - RNA, 22 nt, Human
auuuccuggaggaauggaagca

SEQ ID NO: 330919 - RNA, 20 nt, Human
gugcuaaguacugugaaggg

SEQ ID NO: 330920 - RNA, 22 nt, Human
caaagaugccaaaaggaagaca

SEQ ID NO: 330921 - RNA, 22 nt, Human
gccaccagccccaugcgcugug

SEQ ID NO: 330922 - RNA, 23 nt, Human
aaugaguugggcagcauacaggc

SEQ ID NO: 330923 - RNA, 22 nt, Human
uuuuaauccucuugguaucuua

SEQ ID NO: 330924 - RNA, 23 nt, Human
aaacuacauuuauaguuuuucuc

SEQ ID NO: 330925 - RNA, 22 nt, Human
ggaaacugcuuacacuagaggg

SEQ ID NO: 330926 - RNA, 22 nt, Human
aguucugggaggugcacgucca

SEQ ID NO: 330927 - RNA, 22 nt, Human
cucagcucauuguggauccggu

SEQ ID NO: 330928 - RNA, 22 nt, Human
ucucaggcuuccuggugcugug

SEQ ID NO: 330929 - RNA, 22 nt, Human
ugcccauggcaggauuucugaa

SEQ ID NO: 330930 - RNA, 22 nt, Human
ucgggguagacgccagcucgga

SEQ ID NO: 330931 - RNA, 22 nt, Human
ggugggugagcccugggagcug

SEQ ID NO: 330932 - RNA, 17 nt, Human
gugagcugagucaggac

SEQ ID NO: 330933 - RNA, 20 nt, Human
gcucagggccugggucugga

SEQ ID NO: 330934 - RNA, 22 nt, Human
cuccagcucgcgagcucugcuc

SEQ ID NO: 330935 - RNA, 22 nt, Human
gcagcccaggcucgcucacugc

SEQ ID NO: 330936 - RNA, 22 nt, Human
ugucugccugcgggccggcaca

SEQ ID NO: 330937 - RNA, 22 nt, Human
gcagcugccgugagcucacgcc

SEQ ID NO: 330938 - RNA, 22 nt, Human
uugccaggagacaucuggagcc

SEQ ID NO: 330939 - RNA, 22 nt, Human
agcacuggaaaguuaagaguuu

SEQ ID NO: 330940 - RNA, 22 nt, Human
uugacguccucgauggggaacu

SEQ ID NO: 330941 - RNA, 22 nt, Human
cugggagaugacucagagcagg

SEQ ID NO: 330942 - RNA, 22 nt, Human
ggagcggagggagggccacugu

SEQ ID NO: 330943 - RNA, 22 nt, Human
ccugugcaugccaggguacacc

SEQ ID NO: 330944 - RNA, 22 nt, Human
uaguggguuuauacaauuuaaa

SEQ ID NO: 330945 - RNA, 22 nt, Human
uuggauggagguucaagcacua

SEQ ID NO: 330946 - RNA, 22 nt, Human
cuuccucuguggccagagugua

SEQ ID NO: 330947 - RNA, 22 nt, Human
ccaggcuaggaccgauuucccu

SEQ ID NO: 330948 - RNA, 22 nt, Human
gugcuggggagauaggaagaga

SEQ ID NO: 330949 - RNA, 22 nt, Human
uuaagguucagaaaucaauacc

SEQ ID NO: 330950 - RNA, 22 nt, Human
agccagugucgugugacaugag

SEQ ID NO: 330951 - RNA, 22 nt, Human
gggucugcuccaccugcagccc

SEQ ID NO: 330952 - RNA, 22 nt, Human
acccagcucuuugauggucuug

SEQ ID NO: 330953 - RNA, 22 nt, Human
cggcgcaggcagaccgcgggcu

SEQ ID NO: 330954 - RNA, 22 nt, Human
agguagcuggugcugggcuccu

SEQ ID NO: 330955 - RNA, 22 nt, Human
aaagaugucauacacauuaaga

SEQ ID NO: 330956 - RNA, 22 nt, Human
gccugugcuuaacugacgugag

SEQ ID NO: 330957 - RNA, 22 nt, Human
cccagccuuugcuuccugguuc

SEQ ID NO: 330958 - RNA, 22 nt, Human
ucaucuguuaugggaguuuuug

SEQ ID NO: 330959 - RNA, 21 nt, Human
uggagagugauuucagugugg

SEQ ID NO: 330960 - RNA, 22 nt, Human
gcucguacaccagcguggaggu

SEQ ID NO: 330961 - RNA, 22 nt, Human
guggcagcggcccaggccgucu

SEQ ID NO: 330962 - RNA, 22 nt, Human
cccagguaaggaugcuccucau

SEQ ID NO: 330963 - RNA, 22 nt, Human
cugcaucaguggauaugauggu

SEQ ID NO: 330964 - RNA, 22 nt, Human
uggcccagaucucugaccuuga

SEQ ID NO: 330965 - RNA, 22 nt, Human
cccagccucuggguucugccgg

SEQ ID NO: 330966 - RNA, 22 nt, Human
ccugcacuaccuggggcugcug

SEQ ID NO: 330967 - RNA, 22 nt, Human
uggaucuugaugcuccaagagu

SEQ ID NO: 330968 - RNA, 22 nt, Human
ggagcagggaauuacagcgcag

SEQ ID NO: 330969 - RNA, 22 nt, Human
gccggucuuaagcugacuguga

SEQ ID NO: 330970 - RNA, 22 nt, Human
agaguguguggggcugagguca

SEQ ID NO: 330971 - RNA, 22 nt, Human
ggaagaggcugaggccaugcug

SEQ ID NO: 330972 - RNA, 22 nt, Human
uucucuucacagggaucauccu

SEQ ID NO: 330973 - RNA, 22 nt, Human
cagcugccuguauuguccucau

SEQ ID NO: 330974 - RNA, 22 nt, Human
acugauuucagggaugagaaga

SEQ ID NO: 330975 - RNA, 22 nt, Human
agcagccuugugacuccggggu

SEQ ID NO: 330976 - RNA, 22 nt, Human
cauguguauuauucuuguggaa

SEQ ID NO: 330977 - RNA, 22 nt, Human
caugggcucuucuggacugcac

SEQ ID NO: 330978 - RNA, 22 nt, Human
auuuugacauugcggcauugcu

SEQ ID NO: 330979 - RNA, 18 nt, Human
ccucuggguuuuguuccc

SEQ ID NO: 330980 - RNA, 22 nt, Human
gggagcugaaggagccggcggg

SEQ ID NO: 330981 - RNA, 22 nt, Human
gcagcugcgcugguguggggca

SEQ ID NO: 330982 - RNA, 22 nt, Human
gcagggcugauggcuucccuca

SEQ ID NO: 330983 - RNA, 22 nt, Human
ucuccaggggcagggucuggag

SEQ ID NO: 330984 - RNA, 22 nt, Human
cugcggcuggggacagcuguug

SEQ ID NO: 330985 - RNA, 22 nt, Human
uuccuucuucauuguguuacag

SEQ ID NO: 330986 - RNA, 22 nt, Human
acuuggucguggugcagcaugg

SEQ ID NO: 330987 - RNA, 18 nt, Human
gguccugggccuggcuca

SEQ ID NO: 330988 - RNA, 22 nt, Human
gcccagggcugcaaguggacgc

SEQ ID NO: 330989 - RNA, 21 nt, Human
ccuguggugccagaucgccag

SEQ ID NO: 330990 - RNA, 22 nt, Human
gcucuccacugaccacggggca

SEQ ID NO: 330991 - RNA, 22 nt, Human
cugugugcagggcacaauggaa

SEQ ID NO: 330992 - RNA, 18 nt, Human
uccauccucugcucuuca

SEQ ID NO: 330993 - RNA, 22 nt, Human
gugcucacugugagacguccug

SEQ ID NO: 330994 - RNA, 22 nt, Human
uugcuucacuacuucuaggcuc

SEQ ID NO: 330995 - RNA, 22 nt, Human
aagcugccugggaggaagggcu

SEQ ID NO: 330996 - RNA, 22 nt, Human
aaaguaauugugguucuugcca

SEQ ID NO: 330997 - RNA, 22 nt, Human
gcugcuggcuuccugcuguuuu

SEQ ID NO: 330998 - RNA, 22 nt, Human
acuugcaucuuagagacucacc

SEQ ID NO: 330999 - RNA, 22 nt, Human
gcugcugcuugaaggcucggag

SEQ ID NO: 331000 - RNA, 18 nt, Human
ucagacaaguuagacagg

SEQ ID NO: 331001 - RNA, 22 nt, Human
caggcacaaugagcgccaucuu

SEQ ID NO: 331002 - RNA, 22 nt, Human
gagcugcagcggcugacgcaac

SEQ ID NO: 331003 - RNA, 22 nt, Human
cuucauuucaggcugaagaaua

SEQ ID NO: 331004 - RNA, 22 nt, Human
gcagagcugguacuugagccug

SEQ ID NO: 331005 - RNA, 22 nt, Human
ccugugguuuacucuguggcua

SEQ ID NO: 331006 - RNA, 22 nt, Human
cucccugggccucaguuucucu

SEQ ID NO: 331007 - RNA, 22 nt, Human
gcugcuccgcagagugugugug

SEQ ID NO: 331008 - RNA, 22 nt, Human
aggcucgcaugcccugcaccac

SEQ ID NO: 331009 - RNA, 22 nt, Human
aagcccagcaucccugcaccag

SEQ ID NO: 331010 - RNA, 22 nt, Human
uuuucaguugugcucucuaguu

SEQ ID NO: 331011 - RNA, 22 nt, Human
gugaccagacagagucuagccc

SEQ ID NO: 331012 - RNA, 22 nt, Human
acccggaggcgggggaugcagu

SEQ ID NO: 331013 - RNA, 22 nt, Human
ggugggucuuguggggcagcuu

SEQ ID NO: 331014 - RNA, 22 nt, Human
uaucuguuuuuacagugucuuu

SEQ ID NO: 331015 - RNA, 22 nt, Human
aaaccggguccagaucuucagg

SEQ ID NO: 331016 - RNA, 22 nt, Human
ucauggcucuaaagacauagau

SEQ ID NO: 331017 - RNA, 22 nt, Human
uggccuuggcagugagaagagu

SEQ ID NO: 331018 - RNA, 22 nt, Human
gggaagugcccucuucaggaga

SEQ ID NO: 331019 - RNA, 22 nt, Human
cugcauaucaaauuacuccugg

SEQ ID NO: 331020 - RNA, 22 nt, Human
cugggaggcagucucucuagaa

SEQ ID NO: 331021 - RNA, 22 nt, Human
gucugcacgugccagggagggg

SEQ ID NO: 331022 - RNA, 23 nt, Human
uggccucuccccaccuggcagaa

SEQ ID NO: 331023 - RNA, 22 nt, Human
ugugcugcucucagugacagcc

SEQ ID NO: 331024 - RNA, 22 nt, Human
ccagcaugcucagucuaaauug

SEQ ID NO: 331025 - RNA, 22 nt, Human
augcaggaagagcccuggagcu

SEQ ID NO: 331026 - RNA, 22 nt, Human
guggccuuuucaaguaggguau

SEQ ID NO: 331027 - RNA, 20 nt, Human
aaagauacuuuuuguaaugg

SEQ ID NO: 331028 - RNA, 22 nt, Human
uugaacaguuuugucagguuca

SEQ ID NO: 331029 - RNA, 22 nt, Human
ggcucuguaaguguugcaggua

SEQ ID NO: 331030 - RNA, 22 nt, Human
cagcagcaacaacggaagccuu

SEQ ID NO: 331031 - RNA, 22 nt, Human
uccaggagcucauccacgucaa

SEQ ID NO: 331032 - RNA, 22 nt, Human
uggccaggcagguagaacggcc

SEQ ID NO: 331033 - RNA, 22 nt, Human
uuuugaauaauucagaaacagc

SEQ ID NO: 331034 - RNA, 22 nt, Human
uugcugccagcgcccugcaggg

SEQ ID NO: 331035 - RNA, 22 nt, Human
cuuggcugaacuccaggaugca

SEQ ID NO: 331036 - RNA, 22 nt, Human
auggugguagaagcacuaugug

SEQ ID NO: 331037 - RNA, 22 nt, Human
ucaggggcuugaggugcauguc

SEQ ID NO: 331038 - RNA, 22 nt, Human
ucuccaggcuuaaucucagcuu

SEQ ID NO: 331039 - RNA, 20 nt, Human
cuuguuaaauaugcagguag

SEQ ID NO: 331040 - RNA, 22 nt, Human
cuguguacccacgugggcaccc

SEQ ID NO: 331041 - RNA, 22 nt, Human
augaaaacggaccagagcuauu

SEQ ID NO: 331042 - RNA, 22 nt, Human
uggcggugacggcggcgccugg

SEQ ID NO: 331043 - RNA, 22 nt, Human
agcaggugucacuuucacucca

SEQ ID NO: 331044 - RNA, 21 nt, Human
gcaggguuugugcugugaguu

SEQ ID NO: 331045 - RNA, 22 nt, Human
cagcugcuguucaguuuuguuu

SEQ ID NO: 331046 - RNA, 22 nt, Human
cacccucaagcaguggcacgug

SEQ ID NO: 331047 - RNA, 22 nt, Human
agacugugagaagauggcugcg

SEQ ID NO: 331048 - RNA, 22 nt, Human
gagcuccugaaacguuccugcc

SEQ ID NO: 331049 - RNA, 21 nt, Human
agaugaggauacugaggccua

SEQ ID NO: 331050 - RNA, 22 nt, Human
ugcccguggccuggggcagcuu

SEQ ID NO: 331051 - RNA, 18 nt, Human
ggugagggagcuggaagc

SEQ ID NO: 331052 - RNA, 22 nt, Human
gggccuuggcgaaguguggugg

SEQ ID NO: 331053 - RNA, 22 nt, Human
ucgcuugaacccaggaagugga

SEQ ID NO: 331054 - RNA, 22 nt, Human
acuuugccuucuuacuguguug

SEQ ID NO: 331055 - RNA, 23 nt, Human
gccagagcugccugcccuugcug

SEQ ID NO: 331056 - RNA, 22 nt, Human
uugcugugucauuuguuuaauc

SEQ ID NO: 331057 - RNA, 18 nt, Human
gccugccagccgagggac

SEQ ID NO: 331058 - RNA, 22 nt, Human
cucccagccuucgccagucuga

SEQ ID NO: 331059 - RNA, 22 nt, Human
aggcagagaaaaaccagauaug

SEQ ID NO: 331060 - RNA, 22 nt, Human
cuggaaggagcccgggcggauc

SEQ ID NO: 331061 - RNA, 22 nt, Human
gggcugacaccacccaggcgca

SEQ ID NO: 331062 - RNA, 22 nt, Human
ugguggcacugacaucagacac

SEQ ID NO: 331063 - RNA, 22 nt, Human
ugggcagacgggagcuugccuu

SEQ ID NO: 331064 - RNA, 22 nt, Human
agcuuuauuugucauucacggc

SEQ ID NO: 331065 - RNA, 22 nt, Human
agcaggggcaggguuuugugcu

SEQ ID NO: 331066 - RNA, 22 nt, Human
aguccggggucuggacaccugg

SEQ ID NO: 331067 - RNA, 22 nt, Human
ugauauccuuuaaccuggaccg

SEQ ID NO: 331068 - RNA, 22 nt, Human
uuucugcagcagacucagugug

SEQ ID NO: 331069 - RNA, 22 nt, Human
gauguaucugagcugcuuaggu

SEQ ID NO: 331070 - RNA, 22 nt, Human
cucccagggucuaggcugcugg

SEQ ID NO: 331071 - RNA, 22 nt, Human
gcccaguggcaucuucacugcu

SEQ ID NO: 331072 - RNA, 22 nt, Human
cugcaguucuucuccucaaggc

SEQ ID NO: 331073 - RNA, 22 nt, Human
gggacuggaguagaggccggug

SEQ ID NO: 331074 - RNA, 22 nt, Human
gcucagguagaugggguugucc

SEQ ID NO: 331075 - RNA, 22 nt, Human
gggcggggcuuccguccuccac

SEQ ID NO: 331076 - RNA, 22 nt, Human
uccagcagguccgagacaaguu

SEQ ID NO: 331077 - RNA, 22 nt, Human
ggcuaaggacgggcaaguccca

SEQ ID NO: 331078 - RNA, 22 nt, Human
uuuccaguuguucuagaaagcu

SEQ ID NO: 331079 - RNA, 22 nt, Human
gugguuguuuccagguuugaaa

SEQ ID NO: 331080 - RNA, 22 nt, Human
agaaacaucgcuuaguccucau

SEQ ID NO: 331081 - RNA, 22 nt, Human
aagcccucagagccucuuugac

SEQ ID NO: 331082 - RNA, 22 nt, Human
ucuuugcauggacauguguuuu

SEQ ID NO: 331083 - RNA, 22 nt, Human
uuggcugacaaauggaaucucu

SEQ ID NO: 331084 - RNA, 21 nt, Human
cccgugccuucagcaguccug

SEQ ID NO: 331085 - RNA, 22 nt, Human
gccauguucuugaaucuggguc

SEQ ID NO: 331086 - RNA, 22 nt, Human
aggcucucucugccagccgugc

SEQ ID NO: 331087 - RNA, 22 nt, Human adenovirus D
ccguggccucuucgcccgaccg

SEQ ID NO: 331088 - RNA, 22 nt, Human adenovirus D
uuggcggcacgcuccugcugcu

SEQ ID NO: 331089 - RNA, 22 nt, Human adenovirus D
aguugcaggaugcgcugcucgg

SEQ ID NO: 331090 - RNA, 22 nt, Human adenovirus D
guuggacugcacguuugugcug

SEQ ID NO: 331091 - RNA, 22 nt, Human adenovirus D
accaacuaaaguuacguuugac

SEQ ID NO: 331092 - RNA, 22 nt, Human adenovirus D
acauguaacuuagucguagggc

SEQ ID NO: 331093 - RNA, 22 nt, Human adenovirus D
ugagaggagugugauaugcaca

SEQ ID NO: 331094 - RNA, 22 nt, Human adenovirus D
ucaggaaguugcuguggucguu

SEQ ID NO: 331095 - RNA, 22 nt, Human adenovirus D
gaggaugagggacuggcgcugc

SEQ ID NO: 331096 - RNA, 18 nt, Human adenovirus D
gacuggugcugcgcgcgc

SEQ ID NO: 331097 - RNA, 22 nt, Human adenovirus D
gacugcgauuggcuagacgcuu

SEQ ID NO: 331098 - RNA, 23 nt, Human adenovirus D
cgucacgacgcacggcuaacggu

SEQ ID NO: 331099 - RNA, 22 nt, Human adenovirus D
gauuggccgagaaacguugaug

SEQ ID NO: 331100 - RNA, 22 nt, Human adenovirus D
cgggguuguggacuuccgcgua

SEQ ID NO: 331101 - RNA, 22 nt, Human adenovirus D
cagcagggcguuguacacuagc

SEQ ID NO: 331102 - RNA, 22 nt, Human adenovirus D
ccaguucugggccuggcggcgg

SEQ ID NO: 331103 - RNA, 22 nt, Human adenovirus D
ucggccagguccgaggcgacgg

SEQ ID NO: 331104 - RNA, 22 nt, Human adenovirus D
gucagguguguuuggcuuuagu

SEQ ID NO: 331105 - RNA, 22 nt, Human adenovirus D
ggagggcauaucaauuuucucc

SEQ ID NO: 331106 - RNA, 22 nt, Human adenovirus D
aagauucuccgauccggucgau

SEQ ID NO: 331107 - RNA, 20 nt, Human adenovirus D
aaggcggcucguccaccugc

SEQ ID NO: 331108 - RNA, 22 nt, Human adenovirus D
cgcaccgcggcacggucguggc

SEQ ID NO: 331109 - RNA, 20 nt, Human adenovirus D
agaaauuccauauguccgcc

SEQ ID NO: 331110 - RNA, 22 nt, Human adenovirus D
agcgauguccgccgacuuguug

SEQ ID NO: 331111 - RNA, 22 nt, Human adenovirus D
agcgccagucccucauccuccg

SEQ ID NO: 331112 - RNA, 22 nt, Human adenovirus D
agcgucugccucaggcgcucgg

SEQ ID NO: 331113 - RNA, 21 nt, Human adenovirus D
gggccugcaaacggugaaccu

SEQ ID NO: 331114 - RNA, 22 nt, Human adenovirus D
cucccaggcccacaauacugug

SEQ ID NO: 331115 - RNA, 22 nt, Human adenovirus D
gcagcacauccuccucuccucc

SEQ ID NO: 331116 - RNA, 22 nt, Human adenovirus D
gcuggcuggugccgaucucguu

SEQ ID NO: 331117 - RNA, 22 nt, Human adenovirus D
gcgucugcagcauugucugccu

SEQ ID NO: 331118 - RNA, 22 nt, Human adenovirus D
gcguggugggcaugccggccuu

SEQ ID NO: 331119 - RNA, 20 nt, Human adenovirus D
gggaauccucgaucguccgc

SEQ ID NO: 331120 - RNA, 22 nt, Human
gggcccugugauuucuugagga

SEQ ID NO: 331121 - RNA, 19 nt, Human
cagcccucuuaccacugug

SEQ ID NO: 331122 - RNA, 22 nt, Human
augcugggagugaagccccugg

SEQ ID NO: 331123 - RNA, 22 nt, Human
aaauauguauggaguucaugaa

SEQ ID NO: 331124 - RNA, 22 nt, Human
gcccuuggaacagccuccugcu

SEQ ID NO: 331125 - RNA, 20 nt, Human
agagcugggaagcucccuau

SEQ ID NO: 331126 - RNA, 23 nt, Human
ccagcccuccaccagcucuaggc

SEQ ID NO: 331127 - RNA, 22 nt, Human
gugcaccccggggcccugcucc

SEQ ID NO: 331128 - RNA, 22 nt, Human
cagcuccugcagcuggcuccca

SEQ ID NO: 331129 - RNA, 22 nt, Human
cugucccucaucaccucugggu

SEQ ID NO: 331130 - RNA, 22 nt, Human
cugggcucaguggcucauggcu

SEQ ID NO: 331131 - RNA, 22 nt, Human
agcuggggcauuuauccacuaa

SEQ ID NO: 331132 - RNA, 22 nt, Human
cauaaucagauguguacauaag

SEQ ID NO: 331133 - RNA, 22 nt, Human
ccuggugaauguucauggacug

SEQ ID NO: 331134 - RNA, 22 nt, Human
gagcugggaggacugggaacuu

SEQ ID NO: 331135 - RNA, 21 nt, Human
cagagcuguccaaacccugac

SEQ ID NO: 331136 - RNA, 22 nt, Human
gcccugugagucaugcggcaga

SEQ ID NO: 331137 - RNA, 22 nt, Human
cugcagaggccucgccuccucu

SEQ ID NO: 331138 - RNA, 21 nt, Human
ccagccucagaucagggagcu

SEQ ID NO: 331139 - RNA, 22 nt, Human
auauaucaugaguaaaacuuga

SEQ ID NO: 331140 - RNA, 22 nt, Human
cugggcucaaauccuggcccug

SEQ ID NO: 331141 - RNA, 22 nt, Human
gagcugggcuggcuuccucccu

SEQ ID NO: 331142 - RNA, 22 nt, Human
ccaggcccugccugugguuccu

SEQ ID NO: 331143 - RNA, 22 nt, Human
cagccccuuccuggcaucugga

SEQ ID NO: 331144 - RNA, 23 nt, Human
agcuggaggcugucuacucccaa

SEQ ID NO: 331145 - RNA, 22 nt, Human
gagcuggggcggauacucagcu

SEQ ID NO: 331146 - RNA, 22 nt, Human
ggcagagcugcaugagcacuca

SEQ ID NO: 331147 - RNA, 22 nt, Human
ggaggccacgguuuagcaccga

SEQ ID NO: 331148 - RNA, 22 nt, Human
ugcuggggcucugaccacucca

SEQ ID NO: 331149 - RNA, 22 nt, Human
ggcaccagggacaauccucuuc

SEQ ID NO: 331150 - RNA, 22 nt, Human
uauccaaaguuucucagaaacu

SEQ ID NO: 331151 - RNA, 22 nt, Human
gcccugugcucaugggaacauc

SEQ ID NO: 331152 - RNA, 22 nt, Human
gcuuggggagcucaguguccuu

SEQ ID NO: 331153 - RNA, 22 nt, Human
ccugcagggugcugccacagau

SEQ ID NO: 331154 - RNA, 22 nt, Human
cagagcuggagggaacccuggc

SEQ ID NO: 331155 - RNA, 22 nt, Human
gagcuccucccaggguagcacu

SEQ ID NO: 331156 - RNA, 20 nt, Human
cccagcccgggccgcgcucg

SEQ ID NO: 331157 - RNA, 22 nt, Human
cugggauccacgggcucccaag

SEQ ID NO: 331158 - RNA, 20 nt, Human
agcuccugguauaggugccu

SEQ ID NO: 331159 - RNA, 22 nt, Human
ggcaucccuucuuccaguguca

SEQ ID NO: 331160 - RNA, 19 nt, Human
cagccucaaucccucgggc

SEQ ID NO: 331161 - RNA, 22 nt, Human
agagcuggaaaaguuguuuuaa

SEQ ID NO: 331162 - RNA, 22 nt, Human
ccucagccuuggccccaggcag

SEQ ID NO: 331163 - RNA, 19 nt, Human
uccagccccucugugugug

SEQ ID NO: 331164 - RNA, 22 nt, Human
caggcucagcaggagccugacc

SEQ ID NO: 331165 - RNA, 22 nt, Human
caccagguuccgggcagagcug

SEQ ID NO: 331166 - RNA, 22 nt, Human
cccucagcuccacccucagcag

SEQ ID NO: 331167 - RNA, 19 nt, Human
ggcagagcuccugcuuucu

SEQ ID NO: 331168 - RNA, 22 nt, Human
cccagcccacgguccugggugg

SEQ ID NO: 331169 - RNA, 22 nt, Human
ccuggggucacuugcagccgca

SEQ ID NO: 331170 - RNA, 22 nt, Human
cccugcagccuugcaugccuuc

SEQ ID NO: 331171 - RNA, 22 nt, Human
agcuggggcugcagagaacagg

SEQ ID NO: 331172 - RNA, 22 nt, Human
gcugggcucuuaucaccuguac

SEQ ID NO: 331173 - RNA, 22 nt, Human
ggagcuggagagcuagccuagg

SEQ ID NO: 331174 - RNA, 22 nt, Human
ccugggcagggagaccaggcuc

SEQ ID NO: 331175 - RNA, 20 nt, Human
aagcuggguaggagaggagc

SEQ ID NO: 331176 - RNA, 22 nt, Human
gaugcuggaagugcugaucuug

SEQ ID NO: 331177 - RNA, 22 nt, Human
cccacucccugcacgccugccg

SEQ ID NO: 331178 - RNA, 22 nt, Human
cugggugagcuggccagagggu

SEQ ID NO: 331179 - RNA, 22 nt, Human
uugucuaaugagcuccacuuca

SEQ ID NO: 331180 - RNA, 20 nt, Human
aggcuccuguaccugaggaa

SEQ ID NO: 331181 - RNA, 22 nt, Human
cugucuccagggcaggugcagg

SEQ ID NO: 331182 - RNA, 17 nt, Human
ggcaccagacggagagu

SEQ ID NO: 331183 - RNA, 22 nt, Human
ccugcuggccacugcuccaccu

SEQ ID NO: 331184 - RNA, 16 nt, Human
ggcaccagugaacaca

SEQ ID NO: 331185 - RNA, 22 nt, Human
ucccugaggaagggguguggug

SEQ ID NO: 331186 - RNA, 22 nt, Human
agagcugggaccgucuggaagu

SEQ ID NO: 331187 - RNA, 22 nt, Human
aaauaucauuuauaacuuuuaa

SEQ ID NO: 331188 - RNA, 17 nt, Human
ccagggaggggccgcgc

SEQ ID NO: 331189 - RNA, 22 nt, Human
uccuguggcucuguggaaccuu

SEQ ID NO: 331190 - RNA, 22 nt, Human
gagcugggagcugggauuugga

SEQ ID NO: 331191 - RNA, 20 nt, Human
acaaaauagguacuggguag

SEQ ID NO: 331192 - RNA, 22 nt, Human
agaggacacaucuuuccucaaa

SEQ ID NO: 331193 - RNA, 22 nt, Human
cugucuccuccacugcauggga

SEQ ID NO: 331194 - RNA, 22 nt, Human
agcccugucucucacuccaggu

SEQ ID NO: 331195 - RNA, 20 nt, Human
ggcaccaggcuaggauugga

SEQ ID NO: 331196 - RNA, 19 nt, Human
gggcuccuugggccucucu

SEQ ID NO: 331197 - RNA, 22 nt, Human
aagcugggagggagcccagagu

SEQ ID NO: 331198 - RNA, 22 nt, Human
ggaggccaggaagagccgcccu

SEQ ID NO: 331199 - RNA, 22 nt, Human
gcaugcugcaccagagccucuc

SEQ ID NO: 331200 - RNA, 22 nt, Human
gggccccugggaauucugugau

SEQ ID NO: 331201 - RNA, 22 nt, Human
agagcuggauggucaagauggc

SEQ ID NO: 331202 - RNA, 23 nt, Human
ccugaagggucaggguccucagc

SEQ ID NO: 331203 - RNA, 22 nt, Human
ccugucaggguuugccucagaa

SEQ ID NO: 331204 - RNA, 22 nt, Human
gcugggcuucacagagccuuua

SEQ ID NO: 331205 - RNA, 22 nt, Human
cccugugggaacuccugaguug

SEQ ID NO: 331206 - RNA, 22 nt, Human
gagcugggaguuauagcauguu

SEQ ID NO: 331207 - RNA, 22 nt, Human
uuuacugaacugcuaguacagg

SEQ ID NO: 331208 - RNA, 22 nt, Human
gagcugggcacacgccacuuga

SEQ ID NO: 331209 - RNA, 22 nt, Human
aacuaaaucuggcauuuagagc

SEQ ID NO: 331210 - RNA, 22 nt, Human
gagccuggccuccugccucagc

SEQ ID NO: 331211 - RNA, 22 nt, Human
ggagcugggaacuauguaguau

SEQ ID NO: 331212 - RNA, 22 nt, Human
gcaccaggcagcugagcaggcc

SEQ ID NO: 331213 - RNA, 22 nt, Human
ucugggguuuucacgcugucuc

SEQ ID NO: 331214 - RNA, 22 nt, Human
cagaugcuuggaggacacuugg

SEQ ID NO: 331215 - RNA, 22 nt, Human
ccuggggucagggacgcugugc

SEQ ID NO: 331216 - RNA, 22 nt, Human
uauaaaugccaggacuuuagau

SEQ ID NO: 331217 - RNA, 22 nt, Human
ugcuggggcagaagagccaaga

SEQ ID NO: 331218 - RNA, 18 nt, Human
ugcugggguagaauccac

SEQ ID NO: 331219 - RNA, 22 nt, Human
cagagcugcaaaugccccuccg

SEQ ID NO: 331220 - RNA, 22 nt, Human
cugcagagcagccaguccccca

SEQ ID NO: 331221 - RNA, 22 nt, Human
ccugcagguccccggaugcgca

SEQ ID NO: 331222 - RNA, 22 nt, Human
gcccugugccagucacgcugug

SEQ ID NO: 331223 - RNA, 22 nt, Human
aaaauaguuaacguucagagua

SEQ ID NO: 331224 - RNA, 22 nt, Human
ugaucaaaacauuacuccacca

SEQ ID NO: 331225 - RNA, 22 nt, Human
caccaggcacauaguaggcacu

SEQ ID NO: 331226 - RNA, 17 nt, Human
uggcacagaggugcuau

SEQ ID NO: 331227 - RNA, 22 nt, Human
agcuccugcgcacggugcacac

SEQ ID NO: 331228 - RNA, 20 nt, Human
acuuuacugagcuguaauuc

SEQ ID NO: 331229 - RNA, 22 nt, Human
gcccugugcuuggauggcagau

SEQ ID NO: 331230 - RNA, 22 nt, Human
uagcugggaauuaucugguugc

SEQ ID NO: 331231 - RNA, 22 nt, Human
ccugggaccucgcgggaagcgg

SEQ ID NO: 331232 - RNA, 22 nt, Human
agcuggggguagugagaaauaa

SEQ ID NO: 331233 - RNA, 22 nt, Human
ccugcagguugcagaggcggaa

SEQ ID NO: 331234 - RNA, 22 nt, Human
ggcaucccuagaauagccaggu

SEQ ID NO: 331235 - RNA, 22 nt, Human
gcccauggcagaacugugagca

SEQ ID NO: 331236 - RNA, 22 nt, Human
ggcagagccuucuggagcucgc

SEQ ID NO: 331237 - RNA, 22 nt, Human
agcccuguuuaugccacaucau

SEQ ID NO: 331238 - RNA, 22 nt, Human
ucagcuucagaucagcuagaga

SEQ ID NO: 331239 - RNA, 22 nt, Human
aagaaaacaugaucuaauuuaa

SEQ ID NO: 331240 - RNA, 22 nt, Human
cugucacccacccagccuguca

SEQ ID NO: 331241 - RNA, 22 nt, Human
gcugauagacugaauguuggga

SEQ ID NO: 331242 - RNA, 22 nt, Human
ccuggagcuuggucacgcugcg

SEQ ID NO: 331243 - RNA, 22 nt, Human
agcuccugucucaagggagccu

SEQ ID NO: 331244 - RNA, 22 nt, Human
agacuuuaaugugcaaaugaaa

SEQ ID NO: 331245 - RNA, 22 nt, Human
cccugugguugcuagggcacag

SEQ ID NO: 331246 - RNA, 22 nt, Human
cccuguggaggcagcauccugc

SEQ ID NO: 331247 - RNA, 20 nt, Human
ugcuggggacauacagggug

SEQ ID NO: 331248 - RNA, 22 nt, Human
cccuggucagggaaggcgccug

SEQ ID NO: 331249 - RNA, 22 nt, Human
uggcaccaggcgggguggcugu

SEQ ID NO: 331250 - RNA, 22 nt, Human
ccagccccuauccucgcuccac

SEQ ID NO: 331251 - RNA, 22 nt, Human
ucccagccuuccagucugguuu

SEQ ID NO: 331252 - RNA, 22 nt, Human
ccucucccgggugccgcugggc

SEQ ID NO: 331253 - RNA, 19 nt, Human
agcuggggcgguguguguu

SEQ ID NO: 331254 - RNA, 22 nt, Human
ugguauucuuucuguagaucau

SEQ ID NO: 331255 - RNA, 22 nt, Human
ccagccucaucgccugccuguc

SEQ ID NO: 331256 - RNA, 22 nt, Human
cugguggagaugccuggccccu

SEQ ID NO: 331257 - RNA, 22 nt, Human
augcugggaaguccuaaccaca

SEQ ID NO: 331258 - RNA, 22 nt, Human
agcccugugggccuuguggcac

SEQ ID NO: 331259 - RNA, 19 nt, Human
cugcucccuccuucuggca

SEQ ID NO: 331260 - RNA, 22 nt, Human
gagggcacaaaggcaacauuca

SEQ ID NO: 331261 - RNA, 19 nt, Human
ccuggcccugcugcgcggg

SEQ ID NO: 331262 - RNA, 22 nt, Human
ggcaccagcacuugggauggcu

SEQ ID NO: 331263 - RNA, 20 nt, Human
ggcagagcuaugucuguugc

SEQ ID NO: 331264 - RNA, 22 nt, Human
cuggugcacauucgcucucaua

SEQ ID NO: 331265 - RNA, 22 nt, Human
gcccagcccugaggucacagcu

SEQ ID NO: 331266 - RNA, 22 nt, Human
cugcaggggcaguccacuuccu

SEQ ID NO: 331267 - RNA, 22 nt, Human
uaggacauaaguauucuaacuu

SEQ ID NO: 331268 - RNA, 22 nt, Human
caaguaaagaaucacauuucuu

SEQ ID NO: 331269 - RNA, 22 nt, Human
ccuggagcuuuuccauccugga

SEQ ID NO: 331270 - RNA, 22 nt, Human
ggcauccugggacuggcuucuu

SEQ ID NO: 331271 - RNA, 22 nt, Human
cugggcucaagaagucuucccu

SEQ ID NO: 331272 - RNA, 22 nt, Human
gucaaaugcacagaaccauuaa

SEQ ID NO: 331273 - RNA, 22 nt, Human
agagcugguuuacucaggaauu

SEQ ID NO: 331274 - RNA, 22 nt, Human
agaagucauuuauguuagauga

SEQ ID NO: 331275 - RNA, 22 nt, Human
ccuggagcaaaaaucuaaggag

SEQ ID NO: 331276 - RNA, 22 nt, Human
agagcuggaaucagaccucagg

SEQ ID NO: 331277 - RNA, 22 nt, Human
gagggcacuggguuucaauguc

SEQ ID NO: 331278 - RNA, 22 nt, Human
ccugcagggaaucgaggcagaa

SEQ ID NO: 331279 - RNA, 22 nt, Human
ccaggcccuugcaagucccacc

SEQ ID NO: 331280 - RNA, 22 nt, Human
gggcuccuccucugacuguggc

SEQ ID NO: 331281 - RNA, 22 nt, Human
uccugcagaccucagucagguc

SEQ ID NO: 331282 - RNA, 22 nt, Human
gagcugggacuuggaauccaca

SEQ ID NO: 331283 - RNA, 22 nt, Human
acauuucaguaaguguuaauuu

SEQ ID NO: 331284 - RNA, 22 nt, Human
ggagcuggccgccuaugugcag

SEQ ID NO: 331285 - RNA, 20 nt, Human
agggcagcuugaggagccgg

SEQ ID NO: 331286 - RNA, 22 nt, Human
ugggcaccuagcaacccuucuc

SEQ ID NO: 331287 - RNA, 22 nt, Human
ggaggccaccugaccugcuguu

SEQ ID NO: 331288 - RNA, 22 nt, Human
uagcuggguugaggucaucuac

SEQ ID NO: 331289 - RNA, 22 nt, Human
agagcuggguggacuuguaguu

SEQ ID NO: 331290 - RNA, 22 nt, Human
uuccugguaaauuauguccagg

SEQ ID NO: 331291 - RNA, 22 nt, Human
gagcugggcgagccggggaagu

SEQ ID NO: 331292 - RNA, 22 nt, Human
agguggcagagugacaggcuga

SEQ ID NO: 331293 - RNA, 22 nt, Human
uccugaggcuaaagugcagugg

SEQ ID NO: 331294 - RNA, 22 nt, Human
ugcagagcuucauugcauaggc

SEQ ID NO: 331295 - RNA, 22 nt, Human
uaguaacccacacaacaguaga

SEQ ID NO: 331296 - RNA, 22 nt, Human
auguaaacucacauuuucuuca

SEQ ID NO: 331297 - RNA, 22 nt, Human
caccaggcugcccaggacaggg

SEQ ID NO: 331298 - RNA, 18 nt, Human
gagcugggagaaggaagg

SEQ ID NO: 331299 - RNA, 22 nt, Human
cagccccuuguccgguagccac

SEQ ID NO: 331300 - RNA, 22 nt, Human
cagcccacugccucugugguag

SEQ ID NO: 331301 - RNA, 22 nt, Human
ggagcuggucagccuugagcau

SEQ ID NO: 331302 - RNA, 21 nt, Human
ggagcuggggagcuggcccca

SEQ ID NO: 331303 - RNA, 22 nt, Human
agaugguagguggcaggacuga

SEQ ID NO: 331304 - RNA, 22 nt, Human
aaacacaauguuucuuuguucu

SEQ ID NO: 331305 - RNA, 21 nt, Human
agagcugguagguagguaggu

SEQ ID NO: 331306 - RNA, 20 nt, Human
ucccugccuuuuacugcugg

SEQ ID NO: 331307 - RNA, 22 nt, Human
cacagcugaaguagccaugugg

SEQ ID NO: 331308 - RNA, 22 nt, Human
gaucucaaagcaguguggguug

SEQ ID NO: 331309 - RNA, 22 nt, Human
uccugcaggccagaggggugag

SEQ ID NO: 331310 - RNA, 22 nt, Human
ggcaccagcaggcaccgaugcc

SEQ ID NO: 331311 - RNA, 22 nt, Human
caccaggcugaaccagagggga

SEQ ID NO: 331312 - RNA, 22 nt, Human
gagcuggggcagcuuaggagug

SEQ ID NO: 331313 - RNA, 21 nt, Human
caggccccaggccuggggugc

SEQ ID NO: 331314 - RNA, 22 nt, Human
agagcugggacuuggacucaau

SEQ ID NO: 331315 - RNA, 22 nt, Human
ucccugucuaauaugccaugaa

SEQ ID NO: 331316 - RNA, 22 nt, Human
auauaacauacauacagaaaag

SEQ ID NO: 331317 - RNA, 21 nt, Human
gagcugggcgaggcuccgggg

SEQ ID NO: 331318 - RNA, 22 nt, Human
ggcaccaggaucagucugucau

SEQ ID NO: 331319 - RNA, 20 nt, Human
ccuguggagcugccuccucc

SEQ ID NO: 331320 - RNA, 22 nt, Human
ugcugaggcccaggagcacuuu

SEQ ID NO: 331321 - RNA, 22 nt, Human
gacacuccagcuuuuggcucaa

SEQ ID NO: 331322 - RNA, 22 nt, Human
gagcugggucuccaccuuggca

SEQ ID NO: 331323 - RNA, 22 nt, Human
gagcugggacauggguccucuc

SEQ ID NO: 331324 - RNA, 22 nt, Human
ugggcuccggcggccucaggcu

SEQ ID NO: 331325 - RNA, 22 nt, Human
gcagagcugcagcgaggccugg

SEQ ID NO: 331326 - RNA, 22 nt, Human
cugugcccaggccccuggggau

SEQ ID NO: 331327 - RNA, 22 nt, Human
gcccaugguuacuuuucuggcu

SEQ ID NO: 331328 - RNA, 22 nt, Human
cagggagcagcgcuggggccuc

SEQ ID NO: 331329 - RNA, 22 nt, Human
ccuguccagggacugagggaga

SEQ ID NO: 331330 - RNA, 22 nt, Human
gcagagcuucuguccuucagga

SEQ ID NO: 331331 - RNA, 19 nt, Human
uguagcuagugucuaucca

SEQ ID NO: 331332 - RNA, 22 nt, Human
agagcuggcugcugcggugcuu

SEQ ID NO: 331333 - RNA, 22 nt, Human
cugcaggacgaccgccucaucu

SEQ ID NO: 331334 - RNA, 22 nt, Human
gcccuugggagguuccacuggg

SEQ ID NO: 331335 - RNA, 22 nt, Human
gcagagcucaugccugcaccuc

SEQ ID NO: 331336 - RNA, 22 nt, Human
agcccuguagauuuaggagagu

SEQ ID NO: 331337 - RNA, 22 nt, Human
cccgucccuuuugcccgcuggu

SEQ ID NO: 331338 - RNA, 22 nt, Human
uccacuggaacaacucugaggc

SEQ ID NO: 331339 - RNA, 22 nt, Human
uccugcaggggcugaggaacca

SEQ ID NO: 331340 - RNA, 22 nt, Human
ucaaaguagccggauggaauuu

SEQ ID NO: 331341 - RNA, 22 nt, Human
cccuguccuggaugggagcacu

SEQ ID NO: 331342 - RNA, 22 nt, Human
uaggacaugcuacauaaauagg

SEQ ID NO: 331343 - RNA, 22 nt, Human
uccuguggggaaaagccuaucu

SEQ ID NO: 331344 - RNA, 22 nt, Human
uccugcagagccgcccucaggu

SEQ ID NO: 331345 - RNA, 22 nt, Human
cccugccccaggcggcuucacu

SEQ ID NO: 331346 - RNA, 22 nt, Human
ggagcuggcagcgcaacccaga

SEQ ID NO: 331347 - RNA, 22 nt, Human
ccuggggagagaaagcccagcc

SEQ ID NO: 331348 - RNA, 22 nt, Human
gagguggcgcgccaucccugcc

SEQ ID NO: 331349 - RNA, 22 nt, Human
agagcuggacgucugagcccua

SEQ ID NO: 331350 - RNA, 22 nt, Human
ccauggccaauugcaccuugcu

SEQ ID NO: 331351 - RNA, 22 nt, Human
uagcugggucucuguuuucuca

SEQ ID NO: 331352 - RNA, 17 nt, Human
ggcagagcugacagggc

SEQ ID NO: 331353 - RNA, 22 nt, Human
gagggcacgaaacaaccacuuc

SEQ ID NO: 331354 - RNA, 22 nt, Human
agagcuggggcccguaaagcca

SEQ ID NO: 331355 - RNA, 22 nt, Human
gcugggaggaucucucccuguc

SEQ ID NO: 331356 - RNA, 22 nt, Human
agagcuggugcauauucagaaa

SEQ ID NO: 331357 - RNA, 22 nt, Human
agcuggggguuggauaagggua

SEQ ID NO: 331358 - RNA, 22 nt, Human
aggcccuggguuagggcccacu

SEQ ID NO: 331359 - RNA, 22 nt, Human
cugcagccucaaccuccugagc

SEQ ID NO: 331360 - RNA, 22 nt, Human
gagggcacucgagacuacggca

SEQ ID NO: 331361 - RNA, 21 nt, Human
ugggcaccaaaaccuaggagu

SEQ ID NO: 331362 - RNA, 22 nt, Human
agagcuggaagcugcucuuaga

SEQ ID NO: 331363 - RNA, 21 nt, Human
ggugacacguggccccgcucu

SEQ ID NO: 331364 - RNA, 22 nt, Human
ucugcaggucacgcuccagccu

SEQ ID NO: 331365 - RNA, 22 nt, Human
aaaaguauuuuggaucucagau

SEQ ID NO: 331366 - RNA, 22 nt, Human
ugcugggggugucucaccaggc

SEQ ID NO: 331367 - RNA, 22 nt, Human
cccuguccuuggcugugaggcu

SEQ ID NO: 331368 - RNA, 22 nt, Human
gccccuggcuggccagcuccuc

SEQ ID NO: 331369 - RNA, 22 nt, Human
ccacucccuuccgguccagggc

SEQ ID NO: 331370 - RNA, 22 nt, Human
gcuggggagcuagaccucagca

SEQ ID NO: 331371 - RNA, 22 nt, Human
gcccuguguguuugcacugauu

SEQ ID NO: 331372 - RNA, 22 nt, Human
gaccaggcuuccccagaccuca

SEQ ID NO: 331373 - RNA, 22 nt, Human
ccuggcagcaggugggcccgug

SEQ ID NO: 331374 - RNA, 22 nt, Human
cugggcucagaugagaggaagg

SEQ ID NO: 331375 - RNA, 22 nt, Human
cucucugaggaaggagcaucug

SEQ ID NO: 331376 - RNA, 22 nt, Human
gagcugggccucagaacacagu

SEQ ID NO: 331377 - RNA, 16 nt, Human
gcagagcucagggacu

SEQ ID NO: 331378 - RNA, 22 nt, Human
aaugauugucauuccaaaaagu

SEQ ID NO: 331379 - RNA, 22 nt, Human
cuccaggauguuagacguccag

SEQ ID NO: 331380 - RNA, 22 nt, Human
aacuaaaacugguuuguucucu

SEQ ID NO: 331381 - RNA, 22 nt, Human
agcugggguugcacacauuuug

SEQ ID NO: 331382 - RNA, 22 nt, Human
agaggaggccaggcccacaccu

SEQ ID NO: 331383 - RNA, 19 nt, Human
gcugggagcagacccuccc

SEQ ID NO: 331384 - RNA, 22 nt, Human
augcugggacguacuuguucau

SEQ ID NO: 331385 - RNA, 22 nt, Human
aaguaaaauucaaucuucacug

SEQ ID NO: 331386 - RNA, 22 nt, Human
gcaggagcugcucuccugacga

SEQ ID NO: 331387 - RNA, 22 nt, Human
agagcuggcacugacccucacc

SEQ ID NO: 331388 - RNA, 22 nt, Human
ccugcagguuucccccggacgg

SEQ ID NO: 331389 - RNA, 22 nt, Human
ccccugccagcuaucccugaac

SEQ ID NO: 331390 - RNA, 22 nt, Human
ucucagccucaccucuauggag

SEQ ID NO: 331391 - RNA, 22 nt, Human
ccaggccccagggcuggcuuuc

SEQ ID NO: 331392 - RNA, 22 nt, Human
ggcaccagggcaagggucuuuc

SEQ ID NO: 331393 - RNA, 22 nt, Human
ugggcaccugaggccuggcagg

SEQ ID NO: 331394 - RNA, 23 nt, Human
gagcugggauacaggcuuacugc

SEQ ID NO: 331395 - RNA, 22 nt, Human
ucaaaguauuuuaacuguaucc

SEQ ID NO: 331396 - RNA, 22 nt, Human
cagcccucaaaccacuuccagg

SEQ ID NO: 331397 - RNA, 22 nt, Human
agagcugggugguggugacuca

SEQ ID NO: 331398 - RNA, 22 nt, Human
cugggcuuguguuagcugacaa

SEQ ID NO: 331399 - RNA, 20 nt, Human
cugggcucaagugauccucc

SEQ ID NO: 331400 - RNA, 22 nt, Human
aguaaaauuguauuggaaaaca

SEQ ID NO: 331401 - RNA, 22 nt, Human
acuuuacuccccaacauaaaug

SEQ ID NO: 331402 - RNA, 18 nt, Human
ggagcugggccccacucc

SEQ ID NO: 331403 - RNA, 22 nt, Human
agcuccugcaccaggggccccu

SEQ ID NO: 331404 - RNA, 22 nt, Human
agguauuauuagcaucucuauu

SEQ ID NO: 331405 - RNA, 22 nt, Human
cagaugcuauguauuauguaug

SEQ ID NO: 331406 - RNA, 22 nt, Human
gcaggagcucguuuccaggcug

SEQ ID NO: 331407 - RNA, 22 nt, Human
gagcuggguguuuauuugccaa

SEQ ID NO: 331408 - RNA, 22 nt, Human
acaaacuuccaucaugaauuuu

SEQ ID NO: 331409 - RNA, 22 nt, Human
ccuggagcacauggcaggaggc

SEQ ID NO: 331410 - RNA, 22 nt, Human
caauacaauuaccaguuaauca

SEQ ID NO: 331411 - RNA, 20 nt, Human
agcccuguuuccuggagaga

SEQ ID NO: 331412 - RNA, 22 nt, Human
uccugcagccacugcaggcaga

SEQ ID NO: 331413 - RNA, 22 nt, Human
cugggcuagaaggaccaggaug

SEQ ID NO: 331414 - RNA, 22 nt, Human
ccugggcuuucggcggcuuccu

SEQ ID NO: 331415 - RNA, 22 nt, Human
ucccugagcucacauggcagga

SEQ ID NO: 331416 - RNA, 22 nt, Human
cucagccugugaagagcagagg

SEQ ID NO: 331417 - RNA, 21 nt, Human
agagcuggccugccaggcccu

SEQ ID NO: 331418 - RNA, 22 nt, Human
gcaccaggcuuagagccccagg

SEQ ID NO: 331419 - RNA, 22 nt, Human
gcugccucaggcaccuccuggc

SEQ ID NO: 331420 - RNA, 19 nt, Human
agcuccuguucagcagcuc

SEQ ID NO: 331421 - RNA, 22 nt, Human
ggcaccagggaaggaaggcugg

SEQ ID NO: 331422 - RNA, 22 nt, Human
uagcuggggcuuucauucuugc

SEQ ID NO: 331423 - RNA, 22 nt, Human
agagcuggagaugcagguuucg

SEQ ID NO: 331424 - RNA, 22 nt, Human
ggcaccaggcugggcauaggcc

SEQ ID NO: 331425 - RNA, 20 nt, Human
ugcagagcugacauuaccug

SEQ ID NO: 331426 - RNA, 22 nt, Human
ccugcaggcugcaggccaguuc

SEQ ID NO: 331427 - RNA, 22 nt, Human
uguggcacuucucuccuuguaa

SEQ ID NO: 331428 - RNA, 22 nt, Human
agcaauaacagaaaacuuuccu

SEQ ID NO: 331429 - RNA, 22 nt, Human
ccagcccucgguagucccauag

SEQ ID NO: 331430 - RNA, 22 nt, Human
ggcaccaggacaugacucccag

SEQ ID NO: 331431 - RNA, 22 nt, Human
uagucaaaccucagaauacccc

SEQ ID NO: 331432 - RNA, 23 nt, Human
uccuggugacaugccugagcauc

SEQ ID NO: 331433 - RNA, 20 nt, Human
gcugggcuaccacuggcccu

SEQ ID NO: 331434 - RNA, 22 nt, Human
cugcaggagugaaagcaggccu

SEQ ID NO: 331435 - RNA, 22 nt, Human
augccuggucccaccucuaggu

SEQ ID NO: 331436 - RNA, 22 nt, Human
cccugugggguccgccuguccg

SEQ ID NO: 331437 - RNA, 22 nt, Human
uucaaaugcaaguuacuacuuu

SEQ ID NO: 331438 - RNA, 22 nt, Human
agagcuggcagcagcuucuccu

SEQ ID NO: 331439 - RNA, 22 nt, Human
uccugaggagaagagugcuagg

SEQ ID NO: 331440 - RNA, 22 nt, Human
uccugagggcucggggcucaug

SEQ ID NO: 331441 - RNA, 22 nt, Human
aacugguaucucuucaguguaa

SEQ ID NO: 331442 - RNA, 22 nt, Human
cagggagcucugggccggacuc

SEQ ID NO: 331443 - RNA, 22 nt, Human
uuucagaugguauauacaguag

SEQ ID NO: 331444 - RNA, 22 nt, Human
ccugacagcgugucccuggccc

SEQ ID NO: 331445 - RNA, 22 nt, Human
cccuguccugcuaggcccuggu

SEQ ID NO: 331446 - RNA, 22 nt, Human
ucagacaaguaaaauaauguaa

SEQ ID NO: 331447 - RNA, 22 nt, Human
uucaguaugauuccuccaguag

SEQ ID NO: 331448 - RNA, 22 nt, Human
agagcugggugaagugccauca

SEQ ID NO: 331449 - RNA, 22 nt, Human
ugaguuauaaugaauauuugaa

SEQ ID NO: 331450 - RNA, 22 nt, Human
gcuuccuggagggagagagcug

SEQ ID NO: 331451 - RNA, 21 nt, Human
accaggccaggaggcuggcac

SEQ ID NO: 331452 - RNA, 22 nt, Human
cccugccuuguuggagccuaug

SEQ ID NO: 331453 - RNA, 22 nt, Human
uccugaggcacaauccuagaau

SEQ ID NO: 331454 - RNA, 23 nt, Human
uggcaccaggcauucuaggggua

SEQ ID NO: 331455 - RNA, 22 nt, Human
uccugcaguuacaucccagcca

SEQ ID NO: 331456 - RNA, 22 nt, Human
aucauccuagaaggaagcuagg

SEQ ID NO: 331457 - RNA, 22 nt, Human
ugcaggagcaccagcucacccu

SEQ ID NO: 331458 - RNA, 21 nt, Human
ggcaucccaggccagugacug

SEQ ID NO: 331459 - RNA, 22 nt, Human
gugcauccacuagggcucuccc

SEQ ID NO: 331460 - RNA, 22 nt, Human
cagcuccugccugggcagcugu

SEQ ID NO: 331461 - RNA, 18 nt, Human
aagcugggaaggagacag

SEQ ID NO: 331462 - RNA, 22 nt, Human
gagcuggguauauggcuuuaug

SEQ ID NO: 331463 - RNA, 20 nt, Human
cugggcucgguggcccuggc

SEQ ID NO: 331464 - RNA, 21 nt, Human
gcaaaugaguuaacuaacuca

SEQ ID NO: 331465 - RNA, 22 nt, Human
gucugggguacuuucaucugau

SEQ ID NO: 331466 - RNA, 22 nt, Human
aagcugggacuuagcgcagaua

SEQ ID NO: 331467 - RNA, 22 nt, Human
gcaccgagaaggaagcaugccu

SEQ ID NO: 331468 - RNA, 22 nt, Human
ccuguggagcuuucagcagcuc

SEQ ID NO: 331469 - RNA, 22 nt, Human
caugagauaauuuuucuccagu

SEQ ID NO: 331470 - RNA, 22 nt, Human
cugggcucuaagggagcaccgu

SEQ ID NO: 331471 - RNA, 18 nt, Human
agcuggggccucuggucc

SEQ ID NO: 331472 - RNA, 22 nt, Human
ugagcuggggucagcuccccug

SEQ ID NO: 331473 - RNA, 23 nt, Human
uccugaggaauggcaucucacau

SEQ ID NO: 331474 - RNA, 22 nt, Human
cacagcugucagcugaccuagg

SEQ ID NO: 331475 - RNA, 22 nt, Human
uuucagaucacuuucaggaaag

SEQ ID NO: 331476 - RNA, 22 nt, Human
aaaaugauauccugacuuuuau

SEQ ID NO: 331477 - RNA, 22 nt, Human
gauguuuuaggucccuguagcu

SEQ ID NO: 331478 - RNA, 22 nt, Human
cccugccugugggcaucaacau

SEQ ID NO: 331479 - RNA, 22 nt, Human
uccacuggcccaccuccucagu

SEQ ID NO: 331480 - RNA, 22 nt, Human
gcugggcucuuuaccccuguac

SEQ ID NO: 331481 - RNA, 18 nt, Human
auccaaaaagauggaagu

SEQ ID NO: 331482 - RNA, 22 nt, Human
uaggacauguguuuuauauaug

SEQ ID NO: 331483 - RNA, 22 nt, Human
agagcuggccagggaucacucu

SEQ ID NO: 331484 - RNA, 22 nt, Human
gcagagcuccccaagacaccaa

SEQ ID NO: 331485 - RNA, 21 nt, Human
gcagagcuggaaccaggaccc

SEQ ID NO: 331486 - RNA, 22 nt, Human
cagggagcuggugccagccgac

SEQ ID NO: 331487 - RNA, 22 nt, Human
uccugcagccauuagaggucaa

SEQ ID NO: 331488 - RNA, 22 nt, Human
agagcuggggcucuggguuuaa

SEQ ID NO: 331489 - RNA, 22 nt, Human
agccugggcccugccucuucuc

SEQ ID NO: 331490 - RNA, 22 nt, Human
ggcacagggggcugaggacuag

SEQ ID NO: 331491 - RNA, 22 nt, Human
uccugcagagacagaggccuca

SEQ ID NO: 331492 - RNA, 22 nt, Human
caccaggcuggagugcagaggu

SEQ ID NO: 331493 - RNA, 22 nt, Human
aaauauguuuuccaguugucau

SEQ ID NO: 331494 - RNA, 22 nt, Human
uuucagaucauuuuuuaaguac

SEQ ID NO: 331495 - RNA, 22 nt, Human
cugggcuccuaaccauccaggu

SEQ ID NO: 331496 - RNA, 22 nt, Human
uccugguggugccggugcccgg

SEQ ID NO: 331497 - RNA, 22 nt, Human
cccugguguccacuggaggaag

SEQ ID NO: 331498 - RNA, 22 nt, Human
ugcugggcuggagcugccaggg

SEQ ID NO: 331499 - RNA, 22 nt, Human
ccuggguacccuuggcggccuu

SEQ ID NO: 331500 - RNA, 22 nt, Human
cccuguggcaggaggaggagca

SEQ ID NO: 331501 - RNA, 22 nt, Human
uucuagauugccuguaaguaaa

SEQ ID NO: 331502 - RNA, 22 nt, Human
uaaauguauaggcacuaaaccu

SEQ ID NO: 331503 - RNA, 22 nt, Human
cccagcccagcguucgaggggu

SEQ ID NO: 331504 - RNA, 23 nt, Human
aauuuaguuugagacauuagccu

SEQ ID NO: 331505 - RNA, 22 nt, Human
auaaaugauucagcaggaaaua

SEQ ID NO: 331506 - RNA, 22 nt, Human
cugggguuggccagggcccuag

SEQ ID NO: 331507 - RNA, 22 nt, Human
cugucccucaguucugggcaaa

SEQ ID NO: 331508 - RNA, 22 nt, Human
gaggccuggaccagccacagag

SEQ ID NO: 331509 - RNA, 22 nt, Human
gagcugggauucaucuaugucu

SEQ ID NO: 331510 - RNA, 22 nt, Human
ccugguggacagcagccagcag

SEQ ID NO: 331511 - RNA, 22 nt, Human
gccuguggggcugaggcugccu

SEQ ID NO: 331512 - RNA, 22 nt, Human
gauaauauuagaagauacaaau

SEQ ID NO: 331513 - RNA, 22 nt, Human
gugcugggcuccaccccagagg

SEQ ID NO: 331514 - RNA, 22 nt, Human
ccagggagcggggcugggucuc

SEQ ID NO: 331515 - RNA, 22 nt, Human
ccagcccugaacccugcugcau

SEQ ID NO: 331516 - RNA, 17 nt, Human
auguauauuaacucuga

SEQ ID NO: 331517 - RNA, 22 nt, Human
gcagcaggcuuuucauaccuug

SEQ ID NO: 331518 - RNA, 17 nt, Human
agcccugugcucuuuuu

SEQ ID NO: 331519 - RNA, 22 nt, Human
ccugguggccuucagcccacaa

SEQ ID NO: 331520 - RNA, 22 nt, Human
agagcuggcugguagcccugau

SEQ ID NO: 331521 - RNA, 22 nt, Human
agagcuggcugugggugacuuu

SEQ ID NO: 331522 - RNA, 20 nt, Human
uggcaccaggugguggcccc

SEQ ID NO: 331523 - RNA, 22 nt, Human
uuaugguaauuaaaacauguau

SEQ ID NO: 331524 - RNA, 19 nt, Human
auccuggguccuccagcug

SEQ ID NO: 331525 - RNA, 21 nt, Human
agagcugggacuugccugaga

SEQ ID NO: 331526 - RNA, 22 nt, Human
guaucacuuuugagagugagaa

SEQ ID NO: 331527 - RNA, 22 nt, Human
uaugauaugcacuuuaucagaa

SEQ ID NO: 331528 - RNA, 17 nt, Human
guccuggugugugagga

SEQ ID NO: 331529 - RNA, 22 nt, Human
cacuguaauagcauuauaagug

SEQ ID NO: 331530 - RNA, 22 nt, Human
cugcagaguggagccucggcug

SEQ ID NO: 331531 - RNA, 22 nt, Human
gcagagcugggauaugaaccca

SEQ ID NO: 331532 - RNA, 22 nt, Human
agagcuggggccagagucaagg

SEQ ID NO: 331533 - RNA, 22 nt, Human
acaacaaaaucacuagucuucc

SEQ ID NO: 331534 - RNA, 22 nt, Human
uccuguggcguuaucaugugau

SEQ ID NO: 331535 - RNA, 22 nt, Human
ccuggggagccgccugagcccc

SEQ ID NO: 331536 - RNA, 22 nt, Human
auaugaaaagaagucaccauug

SEQ ID NO: 331537 - RNA, 22 nt, Human
gagcugggauuugaaccuggga

SEQ ID NO: 331538 - RNA, 22 nt, Human
cagagcuguccaaacccugaca

SEQ ID NO: 331539 - RNA, 18 nt, Human
ucuggaacaacuucaugu

SEQ ID NO: 331540 - RNA, 18 nt, Human
gcagagcugggauuccca

SEQ ID NO: 331541 - RNA, 20 nt, Human
uuucagauuuacagaaaugu

SEQ ID NO: 331542 - RNA, 22 nt, Human
agagcuggagcagccccacugg

SEQ ID NO: 331543 - RNA, 22 nt, Human
agcuccugugugaagccucccu

SEQ ID NO: 331544 - RNA, 22 nt, Human
gagcugggaagauagcuugagc

SEQ ID NO: 331545 - RNA, 22 nt, Human
agagcuggggcauaaaugccac

SEQ ID NO: 331546 - RNA, 22 nt, Human
gcugggcuugguuucccugcuu

SEQ ID NO: 331547 - RNA, 22 nt, Human
cagcuauuguucuguauaauga

SEQ ID NO: 331548 - RNA, 22 nt, Human
guggcagcggcccaggccgucu

SEQ ID NO: 331549 - RNA, 21 nt, Human
uccugccuuaguccagagcag

SEQ ID NO: 331550 - RNA, 22 nt, Human
ggaagaggcugaggccaugcug

SEQ ID NO: 331551 - RNA, 22 nt, Human
caggguggcaggcaccauggcc

SEQ ID NO: 331552 - RNA, 22 nt, Human
gugcaugucuuuggaggccucc

SEQ ID NO: 331553 - RNA, 22 nt, Human
uuuggcgucucucaggagcuca

SEQ ID NO: 331554 - RNA, 22 nt, Human
cucauagguuuggaaccaggua

SEQ ID NO: 331555 - RNA, 23 nt, Human
ggaagcucacguaguccugcacu

SEQ ID NO: 331556 - RNA, 22 nt, Human
gcggggggcagcagucgcucag

SEQ ID NO: 331557 - RNA, 22 nt, Human
uguccagcugaaggcagccuca

SEQ ID NO: 331558 - RNA, 21 nt, Human
cuguccccagugagcaccccc

SEQ ID NO: 331559 - RNA, 22 nt, Human
cuccacagccccuccaguggca

SEQ ID NO: 331560 - RNA, 22 nt, Human
ggagccaguuuagaccucaguu

SEQ ID NO: 331561 - RNA, 19 nt, Human
cucuggcuccugggcugcc

SEQ ID NO: 331562 - RNA, 22 nt, Human
gccagccccagacauccuaucg

SEQ ID NO: 331563 - RNA, 22 nt, Human
gaugcgggcccgcuccacugcc

SEQ ID NO: 331564 - RNA, 22 nt, Human
cccacucccugcacgccugccg

SEQ ID NO: 331565 - RNA, 22 nt, Human
ccuguacuuguauuaaaggucc

SEQ ID NO: 331566 - RNA, 22 nt, Human
uggcccagcucagggugggcgg

SEQ ID NO: 331567 - RNA, 22 nt, Human
agcuccagggaaagaguggauc

SEQ ID NO: 331568 - RNA, 22 nt, Human
accuggaggcagagguugcagu

SEQ ID NO: 331569 - RNA, 22 nt, Human
cccuugagccuggaggagcucu

SEQ ID NO: 331570 - RNA, 22 nt, Human
ugacaggcuugcuaagacauag

SEQ ID NO: 331571 - RNA, 22 nt, Human
gcuugcugaacaggaaccuggc

SEQ ID NO: 331572 - RNA, 22 nt, Human
ugacucauauuucauggauacg

SEQ ID NO: 331573 - RNA, 22 nt, Human
accaggcccuccagcugcgugg

SEQ ID NO: 331574 - RNA, 22 nt, Human
gcuggccugaccugaggcuggg

SEQ ID NO: 331575 - RNA, 22 nt, Human
gcgcuccucccggcccuggugg

SEQ ID NO: 331576 - RNA, 22 nt, Human
cgcccacgaaguagguggcauu

SEQ ID NO: 331577 - RNA, 22 nt, Human
ggcuggccuguguggccgccac

SEQ ID NO: 331578 - RNA, 22 nt, Human
agcuauggguguggguuccauu

SEQ ID NO: 331579 - RNA, 22 nt, Human
uggcucaggccuacgacgccuu

SEQ ID NO: 331580 - RNA, 22 nt, Human
gccagguugcugacgacgaucu

SEQ ID NO: 331581 - RNA, 21 nt, Human
ucuccucccggggagaggccg

SEQ ID NO: 331582 - RNA, 22 nt, Human
uucucugaguacguuucagugu

SEQ ID NO: 331583 - RNA, 22 nt, Human
guguggcuaggauggcuuugcu

SEQ ID NO: 331584 - RNA, 22 nt, Human
gucuugcacuuaccuaagaacu

SEQ ID NO: 331585 - RNA, 22 nt, Human
ggacuggucugagagggauuca

SEQ ID NO: 331586 - RNA, 22 nt, Human
ccaggagcccugccacaauggu

SEQ ID NO: 331587 - RNA, 22 nt, Human
aaccauggauuucaguucaccu

SEQ ID NO: 331588 - RNA, 22 nt, Human
uguuccucugaacuucuuccaa

SEQ ID NO: 331589 - RNA, 19 nt, Human
ugcuccaggccuugccgca

SEQ ID NO: 331590 - RNA, 22 nt, Human
cuaguauuaagugugaguaaaa

SEQ ID NO: 331591 - RNA, 19 nt, Human
gaugcucauucagguggaa

SEQ ID NO: 331592 - RNA, 22 nt, Human
augcccucuguuucccaaggcc

SEQ ID NO: 331593 - RNA, 21 nt, Human
gccaucaccaagcucuucccc

SEQ ID NO: 331594 - RNA, 20 nt, Human
gucagaggacccuagagcga

SEQ ID NO: 331595 - RNA, 17 nt, Human
uuucugcaugauuggac

SEQ ID NO: 331596 - RNA, 22 nt, Human
gcccagccccuggguggacgug

SEQ ID NO: 331597 - RNA, 22 nt, Human
cugagcacguaguuagggucca

SEQ ID NO: 331598 - RNA, 22 nt, Human
cucccagccuucgccagucuga

SEQ ID NO: 331599 - RNA, 20 nt, Human
gcugugccaugacccucgag

SEQ ID NO: 331600 - RNA, 19 nt, Human
ccuggcccugcugcgcggg

SEQ ID NO: 331601 - RNA, 22 nt, Human
cuggcccugucagcacagaauc

SEQ ID NO: 331602 - RNA, 22 nt, Human
ccagcugggucccugcuggggc

SEQ ID NO: 331603 - RNA, 22 nt, Human
ggcuggacuugguccuguuuug

SEQ ID NO: 331604 - RNA, 22 nt, Human
accuggccaguggggccgcgcu

SEQ ID NO: 331605 - RNA, 22 nt, Human
cugugcuggcagaccuggaguu

SEQ ID NO: 331606 - RNA, 22 nt, Human
auguggcuuucugcguuuucuc

SEQ ID NO: 331607 - RNA, 22 nt, Human
gugcugagugcagagugcagag

SEQ ID NO: 331608 - RNA, 22 nt, Human
aagcagcauaugacagcaucca

SEQ ID NO: 331609 - RNA, 22 nt, Human
uuugcuggagaugagcgugggu

SEQ ID NO: 331610 - RNA, 22 nt, Human
gucaggaugagggaugaggagu

SEQ ID NO: 331611 - RNA, 22 nt, Human
cccagguaaggaugcuccucau

SEQ ID NO: 331612 - RNA, 21 nt, Human
uuccuccucuggagaagaaga

SEQ ID NO: 331613 - RNA, 21 nt, Human
cugugauguugccgggguagg

SEQ ID NO: 331614 - RNA, 22 nt, Human
gccagcuggcugcaggucccag

SEQ ID NO: 331615 - RNA, 22 nt, Human
ugccgcgcgcccagguuaggug

SEQ ID NO: 331616 - RNA, 22 nt, Human
aggugggacccguggggugcga

SEQ ID NO: 331617 - RNA, 21 nt, Human
ccaccaggucuucugcucggg

SEQ ID NO: 331618 - RNA, 22 nt, Human
ugaucagcaucuucccagcucg

SEQ ID NO: 331619 - RNA, 22 nt, Human
ggcugcugcccaccccugcaug

SEQ ID NO: 331620 - RNA, 22 nt, Human
guagcagagggcccagguaacu

SEQ ID NO: 331621 - RNA, 22 nt, Human
ugaggaggugggcacacagagu

SEQ ID NO: 331622 - RNA, 22 nt, Human
acggugcuggguauugggguuc

SEQ ID NO: 331623 - RNA, 22 nt, Human
ggggaggaagcuggaacacggg

SEQ ID NO: 331624 - RNA, 22 nt, Human
gccuggcgccgggcugccuguc

SEQ ID NO: 331625 - RNA, 22 nt, Human
aucugccuggcuccaggugagc

SEQ ID NO: 331626 - RNA, 22 nt, Human
gccugccuucggugcgcagcgg

SEQ ID NO: 331627 - RNA, 21 nt, Human
ugcuuugcagguggauuuagu

SEQ ID NO: 331628 - RNA, 22 nt, Human
uugccaggagacaucuggagcc

SEQ ID NO: 331629 - RNA, 22 nt, Human
guccacauaggaacccagcuuc

SEQ ID NO: 331630 - RNA, 22 nt, Human
cgggaagguggagguugcagug

SEQ ID NO: 331631 - RNA, 22 nt, Human
gccugagccgccugagcggcgg

SEQ ID NO: 331632 - RNA, 21 nt, Human
ccuguggugccagaucgccag

SEQ ID NO: 331633 - RNA, 22 nt, Human
ccagucagccaagcugcagcgg

SEQ ID NO: 331634 - RNA, 22 nt, Human
gagcuguucugugauugaucua

SEQ ID NO: 331635 - RNA, 22 nt, Human
aagcccagcaucccugcaccag

SEQ ID NO: 331636 - RNA, 22 nt, Human
ggccucugccccgcggggcucg

SEQ ID NO: 331637 - RNA, 22 nt, Human
gcugcaagugcauguugcaacu

SEQ ID NO: 331638 - RNA, 18 nt, Human
guagauccuugagcuacc

SEQ ID NO: 331639 - RNA, 22 nt, Human
ccucuuccuucucacuguggaa

SEQ ID NO: 331640 - RNA, 22 nt, Human
ugcccacaggaagacaccagcg

SEQ ID NO: 331641 - RNA, 22 nt, Human
uccuggguccauggcagccgaa

SEQ ID NO: 331642 - RNA, 22 nt, Human
cuggcccagguggucguugagg

SEQ ID NO: 331643 - RNA, 19 nt, Human
ucuggcugccaaggauuga

SEQ ID NO: 331644 - RNA, 22 nt, Human
gucuguggaguugcuugcugga

SEQ ID NO: 331645 - RNA, 22 nt, Human
aaauguucccaauaugaagcug

SEQ ID NO: 331646 - RNA, 22 nt, Human
gugaccagacagagucuagccc

SEQ ID NO: 331647 - RNA, 22 nt, Human
gcucgguggccagccugaggcc

SEQ ID NO: 331648 - RNA, 22 nt, Human
ugcuugucacccugccugagug

SEQ ID NO: 331649 - RNA, 22 nt, Human
uccuggccucugagucaagaac

SEQ ID NO: 331650 - RNA, 22 nt, Human
cugagcaggacagugggagacc

SEQ ID NO: 331651 - RNA, 22 nt, Human
ugugugcucgauggcccugcag

SEQ ID NO: 331652 - RNA, 22 nt, Human
ccugugcuucacucaacaagcc

SEQ ID NO: 331653 - RNA, 18 nt, Human
auggcuccagugucuucc

SEQ ID NO: 331654 - RNA, 21 nt, Human
uggcccuggccacggcugcca

SEQ ID NO: 331655 - RNA, 22 nt, Human
cccugcacagccuggcucucuu

SEQ ID NO: 331656 - RNA, 22 nt, Human
ggcuggaacuucuucuggcauu

SEQ ID NO: 331657 - RNA, 22 nt, Human
cggcagcgguuggagguuguag

SEQ ID NO: 331658 - RNA, 22 nt, Human
agccugugaaaucucugccacu

SEQ ID NO: 331659 - RNA, 22 nt, Human
ggggaccuggccacccauccuu

SEQ ID NO: 331660 - RNA, 22 nt, Human
ggcagguguggugaccagagau

SEQ ID NO: 331661 - RNA, 22 nt, Human
ggagcagggaauuacagcgcag

SEQ ID NO: 331662 - RNA, 22 nt, Human
agggccacgugcaccgcggucu

SEQ ID NO: 331663 - RNA, 22 nt, Human
ccggcucggcgaccaggcugaa

SEQ ID NO: 331664 - RNA, 19 nt, Human
uugcuucaugucuuuugcu

SEQ ID NO: 331665 - RNA, 22 nt, Human
uuccaggcgcacgucggccuua

SEQ ID NO: 331666 - RNA, 22 nt, Human
ccaucuucucuugaaccuccuu

SEQ ID NO: 331667 - RNA, 22 nt, Human
ccucuuccacugggccccaucc

SEQ ID NO: 331668 - RNA, 22 nt, Human
gaaaugucaagauauguuugga

SEQ ID NO: 331669 - RNA, 17 nt, Human
ccuuucuucccagaggg

SEQ ID NO: 331670 - RNA, 22 nt, Human
cccugacccuaucagagggcca

SEQ ID NO: 331671 - RNA, 22 nt, Human
aagucuucagacuggagagauu

SEQ ID NO: 331672 - RNA, 22 nt, Human
cagcgguggcaaggugacugug

SEQ ID NO: 331673 - RNA, 22 nt, Human
gcuccugggcccugggcuaacu

SEQ ID NO: 331674 - RNA, 22 nt, Human
aggcggcuccgggagugugggc

SEQ ID NO: 331675 - RNA, 22 nt, Human
ggaccugcucucccaguucucu

SEQ ID NO: 331676 - RNA, 22 nt, Human
acaugcuuucuagguccuucug

SEQ ID NO: 331677 - RNA, 22 nt, Human
ucaagcggacugagauacucug

SEQ ID NO: 331678 - RNA, 22 nt, Human
gccccgucguggggccagggau

SEQ ID NO: 331679 - RNA, 22 nt, Human
gggauaagagaguauuuaugca

SEQ ID NO: 331680 - RNA, 23 nt, Human
gcacagagcaguuaggggaagau

SEQ ID NO: 331681 - RNA, 22 nt, Human
uugcaucagcaggcauaauugg

SEQ ID NO: 331682 - RNA, 22 nt, Human
uggcccagaucucugaccuuga

SEQ ID NO: 331683 - RNA, 22 nt, Human
gccucugcaccaguacugugcc

SEQ ID NO: 331684 - RNA, 22 nt, Human
cgcagcugcugcucugaaacag

SEQ ID NO: 331685 - RNA, 22 nt, Human
cgccaguggcagcuggaacagg

SEQ ID NO: 331686 - RNA, 22 nt, Human
caugcaugccgggcugacagag

SEQ ID NO: 331687 - RNA, 22 nt, Human
gacggggcagccagcugguggc

SEQ ID NO: 331688 - RNA, 22 nt, Human
ugaggagcaggguggcuuacuc

SEQ ID NO: 331689 - RNA, 22 nt, Human
gagugugucggucagcguggcg

SEQ ID NO: 331690 - RNA, 22 nt, Human
auagcaaaggacaauagucagu

SEQ ID NO: 331691 - RNA, 22 nt, Human
cugggcccacgagggcucuggg

SEQ ID NO: 331692 - RNA, 18 nt, Human
ggaaggugcuggagugca

SEQ ID NO: 331693 - RNA, 22 nt, Human
cccaccacgugcuuugcuggag

SEQ ID NO: 331694 - RNA, 22 nt, Human
uucaguuuugcuuuuaaucaug

SEQ ID NO: 331695 - RNA, 22 nt, Human
gcccucugguggccgccucggc

SEQ ID NO: 331696 - RNA, 22 nt, Human
cuggagcucuccagagccccgu

SEQ ID NO: 331697 - RNA, 21 nt, Human
uccaggagcacgggacuagga

SEQ ID NO: 331698 - RNA, 22 nt, Human
cugggcccaggcggcucucgga

SEQ ID NO: 331699 - RNA, 22 nt, Human
gugcugauugggagcugggauu

SEQ ID NO: 331700 - RNA, 22 nt, Human
gguuauuguggagaaguuccgg

SEQ ID NO: 331701 - RNA, 22 nt, Human
uucugagguccaugcaguacug

SEQ ID NO: 331702 - RNA, 22 nt, Human
agcugcaccggcuggaccacug

SEQ ID NO: 331703 - RNA, 20 nt, Human
gggcucugcauccaucagcc

SEQ ID NO: 331704 - RNA, 22 nt, Human
cugcugccuuccaaaggccagg

SEQ ID NO: 331705 - RNA, 22 nt, Human
gcagccuccgcacugcgagucc

SEQ ID NO: 331706 - RNA, 22 nt, Human
cagaguggugcaagggcagugu

SEQ ID NO: 331707 - RNA, 22 nt, Human
ggcgaggugucugccaucaagc

SEQ ID NO: 331708 - RNA, 19 nt, Human
cgcacagccugccaggcgc

SEQ ID NO: 331709 - RNA, 22 nt, Human
guccaucuaaguauccagccug

SEQ ID NO: 331710 - RNA, 22 nt, Human
ucccagucuagagccggauugg

SEQ ID NO: 331711 - RNA, 22 nt, Human
cagcaguguacaaggugucaga

SEQ ID NO: 331712 - RNA, 22 nt, Human
acuugguggcgaacgaggguca

SEQ ID NO: 331713 - RNA, 22 nt, Human
uugccaggggacaucuggagcc

SEQ ID NO: 331714 - RNA, 22 nt, Human
aguaacagguguacagacuauc

SEQ ID NO: 331715 - RNA, 22 nt, Human
aggcugagccugggcguggugg

SEQ ID NO: 331716 - RNA, 22 nt, Human
cagcuggacugggauguagcga

SEQ ID NO: 331717 - RNA, 22 nt, Human
ucaccgccuugcccggccgggc

SEQ ID NO: 331718 - RNA, 20 nt, Human
aggggcaccugcgacggggc

SEQ ID NO: 331719 - RNA, 22 nt, Human
gggcucggcaucuguggacucu

SEQ ID NO: 331720 - RNA, 22 nt, Human
cugaaacuauggggaggggagc

SEQ ID NO: 331721 - RNA, 22 nt, Human
aagccuuccugagugcaaggcc

SEQ ID NO: 331722 - RNA, 22 nt, Human
uggcaggaaaaagggccagagg

SEQ ID NO: 331723 - RNA, 22 nt, Human
caggacccaucagccaggcacu

SEQ ID NO: 331724 - RNA, 22 nt, Human
acagcagguuauuguuauggca

SEQ ID NO: 331725 - RNA, 22 nt, Human
ggagcugcucagagccaguccc

SEQ ID NO: 331726 - RNA, 22 nt, Human
gaaaccuuugccgauggggucc

SEQ ID NO: 331727 - RNA, 22 nt, Human
aagguggcggcugccagguccu

SEQ ID NO: 331728 - RNA, 22 nt, Human
guggccuccuccguccgccucu

SEQ ID NO: 331729 - RNA, 22 nt, Human
gcccagggcugcaaguggacgc

SEQ ID NO: 331730 - RNA, 22 nt, Human
uuccaaggagagcucgaccuca

SEQ ID NO: 331731 - RNA, 22 nt, Human
ugcaggccuggacugauguggu

SEQ ID NO: 331732 - RNA, 22 nt, Human
gcagcugcgcugguguggggca

SEQ ID NO: 331733 - RNA, 22 nt, Human
cgccccagccaguugagcggcg

SEQ ID NO: 331734 - RNA, 18 nt, Human
gaucgggggcgccccaag

SEQ ID NO: 331735 - RNA, 18 nt, Human
gccagcccuccaaccucc

SEQ ID NO: 331736 - RNA, 22 nt, Human
gggcagcaggcuccacguuccu

SEQ ID NO: 331737 - RNA, 22 nt, Human
auggccugcagugcugccacag

SEQ ID NO: 331738 - RNA, 22 nt, Human
gcagacccugaacugggcaugg

SEQ ID NO: 331739 - RNA, 22 nt, Human
caguggguccugcgucugccag

SEQ ID NO: 331740 - RNA, 22 nt, Human
agaggaaguaaucaggaccugc

SEQ ID NO: 331741 - RNA, 22 nt, Human
guugggcugaagugugugcuua

SEQ ID NO: 331742 - RNA, 22 nt, Human
ugccuggauggcucugagcagg

SEQ ID NO: 331743 - RNA, 22 nt, Human
uacugcugagcuggguagaagg

SEQ ID NO: 331744 - RNA, 22 nt, Human
guggcagagagcaagugucuga

SEQ ID NO: 331745 - RNA, 23 nt, Human
gggugcugccuguagucaugcug

SEQ ID NO: 331746 - RNA, 22 nt, Human
cugcagggcagggccuccuggc

SEQ ID NO: 331747 - RNA, 22 nt, Human
ggcuagggagacagagggcaug

SEQ ID NO: 331748 - RNA, 22 nt, Human
gcugcugcuugaaggcucggag

SEQ ID NO: 331749 - RNA, 22 nt, Human
gcagagcacccugcagugguau

SEQ ID NO: 331750 - RNA, 22 nt, Human
uuugaagauaaauauggagaaa

SEQ ID NO: 331751 - RNA, 22 nt, Human
agucaggaagcuggagcugggg

SEQ ID NO: 331752 - RNA, 22 nt, Human
cuugcuuuaucugguuucucau

SEQ ID NO: 331753 - RNA, 19 nt, Human
caucuggaugauucuccug

SEQ ID NO: 331754 - RNA, 23 nt, Human
acugccugugccgaucucucuca

SEQ ID NO: 331755 - RNA, 22 nt, Human
ccuggccgacauggugaaacgc

SEQ ID NO: 331756 - RNA, 22 nt, Human
cgucaggguugagcagguagau

SEQ ID NO: 331757 - RNA, 22 nt, Human
ccagguaggagagucaacaugu

SEQ ID NO: 331758 - RNA, 22 nt, Human
gggcugcacuagggcaagguga

SEQ ID NO: 331759 - RNA, 19 nt, Human
ugccuggcaccagcuccac

SEQ ID NO: 331760 - RNA, 22 nt, Human
ccaggcccugcuccucacacca

SEQ ID NO: 331761 - RNA, 22 nt, Human
caggaagucgcagagcuggggg

SEQ ID NO: 331762 - RNA, 19 nt, Human
ggcugccuucugcucaucu

SEQ ID NO: 331763 - RNA, 22 nt, Human
ucuccaggcuuaaucucagcuu

SEQ ID NO: 331764 - RNA, 22 nt, Human
gguguggcaguggaccugugaa

SEQ ID NO: 331765 - RNA, 22 nt, Human
cugcucaauuccggcacgcugg

SEQ ID NO: 331766 - RNA, 22 nt, Human
cccagccucuggguucugccgg

SEQ ID NO: 331767 - RNA, 22 nt, Human
gcacaaaagguacuucauguag

SEQ ID NO: 331768 - RNA, 22 nt, Human
gggcuuuaggggccagugacca

SEQ ID NO: 331769 - RNA, 22 nt, Human
aagcagggugucuugacccaug

SEQ ID NO: 331770 - RNA, 22 nt, Human
cugcaccgugucucgggcugcc

SEQ ID NO: 331771 - RNA, 20 nt, Human
uccagccacuuccgcugguc

SEQ ID NO: 331772 - RNA, 22 nt, Human
gcucagguagaugggguugucc

SEQ ID NO: 331773 - RNA, 22 nt, Human
ucugagagccacugaacagcaa

SEQ ID NO: 331774 - RNA, 22 nt, Human
uucagcacuggacagcgagucu

SEQ ID NO: 331775 - RNA, 19 nt, Human
aacuacagcgcacuguccu

SEQ ID NO: 331776 - RNA, 22 nt, Human
uccucuucaaaauagcucugaa

SEQ ID NO: 331777 - RNA, 22 nt, Human
ccagcuggcccagcugugcucc

SEQ ID NO: 331778 - RNA, 22 nt, Human
aggggcacgaguagagcucuag

SEQ ID NO: 331779 - RNA, 21 nt, Human
ugagcaccagcugcaugcccc

SEQ ID NO: 331780 - RNA, 22 nt, Human
gagcaacacauugaaugaggau

SEQ ID NO: 331781 - RNA, 22 nt, Human
ggcugagucugugacccaugcg

SEQ ID NO: 331782 - RNA, 23 nt, Human
gguucugccgcuuacugcugugc

SEQ ID NO: 331783 - RNA, 22 nt, Human
ucauuguuucugcuuuucauga

SEQ ID NO: 331784 - RNA, 22 nt, Human
cugauccagagccaaccaaggc

SEQ ID NO: 331785 - RNA, 20 nt, Human
gcuccccuucucugggccuc

SEQ ID NO: 331786 - RNA, 22 nt, Human
gcucugagucacacugcccugu

SEQ ID NO: 331787 - RNA, 18 nt, Human
aggagcggcugcggcugc

SEQ ID NO: 331788 - RNA, 22 nt, Human
acugauuucagggaugagaaga

SEQ ID NO: 331789 - RNA, 20 nt, Human
gcagcagacagacaggggac

SEQ ID NO: 331790 - RNA, 22 nt, Human
caggguggaacaggcaauacuu

SEQ ID NO: 331791 - RNA, 22 nt, Human
gcagcugccgugagcucacgcc

SEQ ID NO: 331792 - RNA, 22 nt, Human
uccuggccaaguagauguggcg

SEQ ID NO: 331793 - RNA, 22 nt, Human
ucucaagaucucaagauggccc

SEQ ID NO: 331794 - RNA, 18 nt, Human
ucugugggaucagugagg

SEQ ID NO: 331795 - RNA, 22 nt, Human
ccaggcuccccaggaggcccuu

SEQ ID NO: 331796 - RNA, 22 nt, Human
uggccaggcagguagaacggcc

SEQ ID NO: 331797 - RNA, 22 nt, Human
cugcugagguggagauugcagu

SEQ ID NO: 331798 - RNA, 22 nt, Human
ucuccaggggcagggucuggag

SEQ ID NO: 331799 - RNA, 22 nt, Human
ugcagcaccuauggacacuugu

SEQ ID NO: 331800 - RNA, 22 nt, Human
guggauggagcuggaagccauu

SEQ ID NO: 331801 - RNA, 22 nt, Human
aggcccugcugaggccucccuc

SEQ ID NO: 331802 - RNA, 21 nt, Human
aaagugguaaggauuauuuug

SEQ ID NO: 331803 - RNA, 22 nt, Human
ggugcccaaggaagguugccgu

SEQ ID NO: 331804 - RNA, 22 nt, Human
ugugaggaccucagcagagucu

SEQ ID NO: 331805 - RNA, 20 nt, Human
gacuucaauuucuaucuuuu

SEQ ID NO: 331806 - RNA, 22 nt, Human
gccccuucguggaagugcauuc

SEQ ID NO: 331807 - RNA, 21 nt, Human
cuggagcuuggugagaagugu

SEQ ID NO: 331808 - RNA, 22 nt, Human
ugcugcacuuauggcucugagg

SEQ ID NO: 331809 - RNA, 22 nt, Human
agcugcugcaaguggugcuaac

SEQ ID NO: 331810 - RNA, 22 nt, Human
cacgcacgcuggguggaggcgc

SEQ ID NO: 331811 - RNA, 22 nt, Human
ucuguccauucagaauggcccu

SEQ ID NO: 331812 - RNA, 22 nt, Human
gccggucuuaagcugacuguga

SEQ ID NO: 331813 - RNA, 22 nt, Human
acgugcaggaucugguuggcga

SEQ ID NO: 331814 - RNA, 22 nt, Human
gggcuguaggagcuggaauggg

SEQ ID NO: 331815 - RNA, 21 nt, Human
gccaccucaaucuucuagcgc

SEQ ID NO: 331816 - RNA, 17 nt, Human
gagguaggaagugaguc

SEQ ID NO: 331817 - RNA, 22 nt, Human
agccaggucaggaaagguccca

SEQ ID NO: 331818 - RNA, 22 nt, Human
gaauucggguacucuaggccag

SEQ ID NO: 331819 - RNA, 19 nt, Human
cucugccucuggcuguggc

SEQ ID NO: 331820 - RNA, 22 nt, Human
ccugggugaugugcugcccucg

SEQ ID NO: 331821 - RNA, 22 nt, Human
gaagcgcggcgucggcgugggu

SEQ ID NO: 331822 - RNA, 22 nt, Human
uacagcuugauguuuguguguu

SEQ ID NO: 331823 - RNA, 22 nt, Human
accuccuccaaggagccauagg

SEQ ID NO: 331824 - RNA, 22 nt, Human
ugcccuguuccugccuccagcu

SEQ ID NO: 331825 - RNA, 19 nt, Human
ugguggaggccccauguuc

SEQ ID NO: 331826 - RNA, 22 nt, Human
uccacagguccucuuugcaaag

SEQ ID NO: 331827 - RNA, 22 nt, Human
cugcuucacccugccugagaac

SEQ ID NO: 331828 - RNA, 22 nt, Human
acacaucagaaauaugaaugag

SEQ ID NO: 331829 - RNA, 22 nt, Human
ucuaugaaccucugcaaugaca

SEQ ID NO: 331830 - RNA, 22 nt, Human
ggcuuccuccuuccugcuguca

SEQ ID NO: 331831 - RNA, 22 nt, Human
gguguuguacauucuguggauu

SEQ ID NO: 331832 - RNA, 22 nt, Human
cccuggaacccauggccagugu

SEQ ID NO: 331833 - RNA, 22 nt, Human
ucggggauggugucugagggag

SEQ ID NO: 331834 - RNA, 22 nt, Human
gagcugcuggccuccugcggga

SEQ ID NO: 331835 - RNA, 22 nt, Human
agcgcuugccgcacuccaagca

SEQ ID NO: 331836 - RNA, 22 nt, Human
uguggugccgagagucuggacg

SEQ ID NO: 331837 - RNA, 20 nt, Human
uccuccuugcagagcccaga

SEQ ID NO: 331838 - RNA, 22 nt, Human
agcagcaccuguccucgcugcu

SEQ ID NO: 331839 - RNA, 22 nt, Human
cugcaucacagcaggaggcaca

SEQ ID NO: 331840 - RNA, 21 nt, Human
ucucuccucaagcucgacccc

SEQ ID NO: 331841 - RNA, 22 nt, Human
cuugggcaggggaaacagcugc

SEQ ID NO: 331842 - RNA, 22 nt, Human
uguaucauauggggaagcuuca

SEQ ID NO: 331843 - RNA, 22 nt, Human
ugcaaggcacccacucugcuuu

SEQ ID NO: 331844 - RNA, 22 nt, Human
aggggagccagggcugcgaguu

SEQ ID NO: 331845 - RNA, 23 nt, Human
uccugcagauaagcugguugaca

SEQ ID NO: 331846 - RNA, 22 nt, Human
aguguauucugcaugggagacu

SEQ ID NO: 331847 - RNA, 22 nt, Human
gcugauggcuugcuggcugaca

SEQ ID NO: 331848 - RNA, 22 nt, Human
aaaagagccacuuaugaccuca

SEQ ID NO: 331849 - RNA, 22 nt, Human
cccagccuuugcuuccugguuc

SEQ ID NO: 331850 - RNA, 22 nt, Human
agcuccugaaaagcgcuugcuu

SEQ ID NO: 331851 - RNA, 22 nt, Human
cuggagaggcugggaacagguu

SEQ ID NO: 331852 - RNA, 22 nt, Human
cuggagcagcagguggccaggg

SEQ ID NO: 331853 - RNA, 22 nt, Human
ggaggugacuggaucaugggca

SEQ ID NO: 331854 - RNA, 22 nt, Human
ggugagaggcagugcuguggaa

SEQ ID NO: 331855 - RNA, 22 nt, Human
uguuggcagugcuacagucagu

SEQ ID NO: 331856 - RNA, 22 nt, Human
aguggcaguagaugagcugguu

SEQ ID NO: 331857 - RNA, 22 nt, Human
ggcuagcuccuccgcgcaucca

SEQ ID NO: 331858 - RNA, 21 nt, Human
uccaaaggagacugagugugu

SEQ ID NO: 331859 - RNA, 22 nt, Human
aucucuguaaaccauaaauuga

SEQ ID NO: 331860 - RNA, 21 nt, Human
gcugcucgagauccagugcuu

SEQ ID NO: 331861 - RNA, 22 nt, Human
aagaugauuauguagauuggga

SEQ ID NO: 331862 - RNA, 22 nt, Human
cccucucgcggggcagcggagg

SEQ ID NO: 331863 - RNA, 22 nt, Human
auggcuccagcuuggcuucacc

SEQ ID NO: 331864 - RNA, 22 nt, Human
aggcaguguggagggcuguugc

SEQ ID NO: 331865 - RNA, 22 nt, Human
cgaggaggaaacgcggagaacu

SEQ ID NO: 331866 - RNA, 22 nt, Human
uugauggacagggaccacuguc

SEQ ID NO: 331867 - RNA, 22 nt, Human
aggcugcagaggugcugccaga

SEQ ID NO: 331868 - RNA, 22 nt, Human
cuuccagcugauuggcauccag

SEQ ID NO: 331869 - RNA, 22 nt, Human
augaagcauuacaggaugacag

SEQ ID NO: 331870 - RNA, 23 nt, Human
aucuguguguggguagggaugau

SEQ ID NO: 331871 - RNA, 20 nt, Human
ugagccugcuguaggaggcc

SEQ ID NO: 331872 - RNA, 22 nt, Human
ucuuucagaaacuuugucugcg

SEQ ID NO: 331873 - RNA, 16 nt, Human
gcagguggggcgcgca

SEQ ID NO: 331874 - RNA, 22 nt, Human
uucuucauucccuuacuuccga

SEQ ID NO: 331875 - RNA, 22 nt, Human
ucauccagccucaucaggagcu

SEQ ID NO: 331876 - RNA, 21 nt, Human
cagggcacacagaggauggua

SEQ ID NO: 331877 - RNA, 22 nt, Human
ucaaagaucagaugguuguagg

SEQ ID NO: 331878 - RNA, 19 nt, Human
ucuuucauuucuagcucug

SEQ ID NO: 331879 - RNA, 22 nt, Human
gaugaguucuuucuauucuauu

SEQ ID NO: 331880 - RNA, 22 nt, Human
gaggagcuucagaggaaucuua

SEQ ID NO: 331881 - RNA, 22 nt, Human
agaaggcaucagaaguguguag

SEQ ID NO: 331882 - RNA, 22 nt, Human
gaggugggaugugugugcuacu

SEQ ID NO: 331883 - RNA, 22 nt, Human
ccgcguggcacccuccuggagg

SEQ ID NO: 331884 - RNA, 21 nt, Human
ggucaggcaugugcccugagc

SEQ ID NO: 331885 - RNA, 22 nt, Human
gagcugcagcggcugacgcaac

SEQ ID NO: 331886 - RNA, 22 nt, Human
ugugcugcucucagugacagcc

SEQ ID NO: 331887 - RNA, 22 nt, Human
gggggcuggacuuucccacaca

SEQ ID NO: 331888 - RNA, 22 nt, Human
acagcuggaggucugugagcac

SEQ ID NO: 331889 - RNA, 22 nt, Human
ucaccggcagacguggccugau

SEQ ID NO: 331890 - RNA, 22 nt, Human
cucagcacauuccuaagggaug

SEQ ID NO: 331891 - RNA, 22 nt, Human
caggcacaaugagcgccaucuu

SEQ ID NO: 331892 - RNA, 22 nt, Human
cucagucucuugggcugugaag

SEQ ID NO: 331893 - RNA, 22 nt, Human
uccugugccuccaccugcuccg

SEQ ID NO: 331894 - RNA, 22 nt, Human
ccgugugcacgcgccggugcug

SEQ ID NO: 331895 - RNA, 22 nt, Human
uggcccaggugcacccagaggc

SEQ ID NO: 331896 - RNA, 22 nt, Human
gggcccugcgacucgcggcgga

SEQ ID NO: 331897 - RNA, 22 nt, Human
cacuguugaagauacuuccucu

SEQ ID NO: 331898 - RNA, 22 nt, Human
cccacaggcaggugcaugggcu

SEQ ID NO: 331899 - RNA, 21 nt, Human
uccagcacagaugaccucccc

SEQ ID NO: 331900 - RNA, 22 nt, Human
uccaggagcucauccacgucaa

SEQ ID NO: 331901 - RNA, 22 nt, Human
gugcagcugugguggagccagg

SEQ ID NO: 331902 - RNA, 22 nt, Human
uuccugagucgccgagucuaug

SEQ ID NO: 331903 - RNA, 22 nt, Human
uguggguccuccugugugcccg

SEQ ID NO: 331904 - RNA, 22 nt, Human
cauugcaacuucaaacuccugg

SEQ ID NO: 331905 - RNA, 22 nt, Human
aauggcugccagggcaggaggu

SEQ ID NO: 331906 - RNA, 22 nt, Human
uuuuuugucuugaagaaauggu

SEQ ID NO: 331907 - RNA, 22 nt, Human
cuuugggcacugaaguaugggu

SEQ ID NO: 331908 - RNA, 22 nt, Human
uuccaggaagcucucggccucu

SEQ ID NO: 331909 - RNA, 22 nt, Human
uugcugccagcgcccugcaggg

SEQ ID NO: 331910 - RNA, 22 nt, Human
cucacagcugcuucaggaucca

SEQ ID NO: 331911 - RNA, 22 nt, Human
ugcaucauuaagguacaguugg

SEQ ID NO: 331912 - RNA, 22 nt, Human
gcccucugccacaggacgccag

SEQ ID NO: 331913 - RNA, 22 nt, Human
caugugguauugugagauccac

SEQ ID NO: 331914 - RNA, 22 nt, Human
cgugcagcggagcuggucacug

SEQ ID NO: 331915 - RNA, 22 nt, Human
gcagcagcggggccccugcgcg

SEQ ID NO: 331916 - RNA, 22 nt, Human
cagggcuccccagagagccucu

SEQ ID NO: 331917 - RNA, 22 nt, Human
acacuggacucagaggccagaa

SEQ ID NO: 331918 - RNA, 22 nt, Human
cuguggcugcgcccugggggag

SEQ ID NO: 331919 - RNA, 22 nt, Human
ugaacaugcuguugauggccug

SEQ ID NO: 331920 - RNA, 22 nt, Human
cccaggaguuagagguuguggu

SEQ ID NO: 331921 - RNA, 22 nt, Human
ggugggugagcccugggagcug

SEQ ID NO: 331922 - RNA, 22 nt, Human
ugcucgagguccccaccggcuc

SEQ ID NO: 331923 - RNA, 22 nt, Human
ugccuggcugggcugcucaugg

SEQ ID NO: 331924 - RNA, 22 nt, Human
agcuuugcugcuggagaagggu

SEQ ID NO: 331925 - RNA, 22 nt, Human
gcaugcaggaagggcuugggga

SEQ ID NO: 331926 - RNA, 21 nt, Human
uaaaagaugacaagacagcuc

SEQ ID NO: 331927 - RNA, 22 nt, Human
accagagcuggcagaguaucaa

SEQ ID NO: 331928 - RNA, 22 nt, Human
guggcuaggcccaacggcagga

SEQ ID NO: 331929 - RNA, 22 nt, Human
cagcuggcgacucuccucgaug

SEQ ID NO: 331930 - RNA, 22 nt, Human
agcagggagaccaucucuuccu

SEQ ID NO: 331931 - RNA, 22 nt, Human
guaugugucuuagaacuuggga

SEQ ID NO: 331932 - RNA, 22 nt, Human
augcuuccagauugguaggggu

SEQ ID NO: 331933 - RNA, 22 nt, Human
cagggcucacucggcuggcguc

SEQ ID NO: 331934 - RNA, 22 nt, Human
agcuccugaaaauccagacugg

SEQ ID NO: 331935 - RNA, 22 nt, Human
auggcuguguuguuccucugaa

SEQ ID NO: 331936 - RNA, 22 nt, Human
guccuaaauauagugauucaug

SEQ ID NO: 331937 - RNA, 22 nt, Human
ggcggugguugagaggacggcg

SEQ ID NO: 331938 - RNA, 22 nt, Human
augcacacguacccuacaaggc

SEQ ID NO: 331939 - RNA, 22 nt, Human
aguucaauuguuuuguaaaagu

SEQ ID NO: 331940 - RNA, 22 nt, Human
cagagccaaaccucagggcccg

SEQ ID NO: 331941 - RNA, 22 nt, Human
gcugcaggcucugcaggaauug

SEQ ID NO: 331942 - RNA, 22 nt, Human
cuguggguggcugugccccagg

SEQ ID NO: 331943 - RNA, 22 nt, Human
uggugcaggccaagcugcgagc

SEQ ID NO: 331944 - RNA, 22 nt, Human
cuauuuucccauaugguugaca

SEQ ID NO: 331945 - RNA, 19 nt, Human
auucuucucuuccugcugu

SEQ ID NO: 331946 - RNA, 19 nt, Human
agcagagcagggccguggg

SEQ ID NO: 331947 - RNA, 22 nt, Human
gaaggacccucuggggucucag

SEQ ID NO: 331948 - RNA, 22 nt, Human
gcuuucuuuucaagaauguauu

SEQ ID NO: 331949 - RNA, 22 nt, Human
uggcugggagcuggaacugggc

SEQ ID NO: 331950 - RNA, 22 nt, Human
cccaggcuggggcuccuccagc

SEQ ID NO: 331951 - RNA, 18 nt, Human
ggcggguguuuuauucac

SEQ ID NO: 331952 - RNA, 22 nt, Human
ugagcagacuugaugaggcagc

SEQ ID NO: 331953 - RNA, 22 nt, Human
cagcugcucugguggucucucc

SEQ ID NO: 331954 - RNA, 22 nt, Human
gcggccugcgcugcucccgacg

SEQ ID NO: 331955 - RNA, 22 nt, Human
acagcugggaacucacacagca

SEQ ID NO: 331956 - RNA, 22 nt, Human
gccuggaaugcaaugugacgaa

SEQ ID NO: 331957 - RNA, 18 nt, Human
ucuuccaacacugacacc

SEQ ID NO: 331958 - RNA, 22 nt, Human
agcuggguguagggcuggacaa

SEQ ID NO: 331959 - RNA, 20 nt, Human
aaaaacaguaaugcugaaga

SEQ ID NO: 331960 - RNA, 22 nt, Human
gcucugugccccugccguggac

SEQ ID NO: 331961 - RNA, 22 nt, Human
uuuacuguuuacagcuaaugca

SEQ ID NO: 331962 - RNA, 22 nt, Human
auugaagacuugguauccgugg

SEQ ID NO: 331963 - RNA, 22 nt, Human
uggugcugccaccuccucugcu

SEQ ID NO: 331964 - RNA, 22 nt, Human
gagaugggcgagaagguggacu

SEQ ID NO: 331965 - RNA, 22 nt, Human
ggagaggguguggaaaguuauc

SEQ ID NO: 331966 - RNA, 22 nt, Human
cccagcauuucugggcugcacu

SEQ ID NO: 331967 - RNA, 22 nt, Human
ggcagccagagggcagcuggau

SEQ ID NO: 331968 - RNA, 22 nt, Human
agguuuggguucauugcuggcu

SEQ ID NO: 331969 - RNA, 22 nt, Human
ggcagagcuugcagugagccga

SEQ ID NO: 331970 - RNA, 22 nt, Human
ugaaaugccuaugaagucagga

SEQ ID NO: 331971 - RNA, 21 nt, Human
aaacugaccuugccugagaca

SEQ ID NO: 331972 - RNA, 22 nt, Human
ccucuucuaggacguccuugug

SEQ ID NO: 331973 - RNA, 22 nt, Human
gcagcagcaggcgcucggccgu

SEQ ID NO: 331974 - RNA, 22 nt, Human
agggggcuccuuggugugcaga

SEQ ID NO: 331975 - RNA, 22 nt, Human
uccagcuccugaguucacugcu

SEQ ID NO: 331976 - RNA, 22 nt, Human
uuugaacuucuaccugucauau

SEQ ID NO: 331977 - RNA, 22 nt, Human
ggagggaaccuuggcuggauug

SEQ ID NO: 331978 - RNA, 22 nt, Human
cugcacagccugucugggggcc

SEQ ID NO: 331979 - RNA, 22 nt, Human
auggaggaugugcagcaugggc

SEQ ID NO: 331980 - RNA, 22 nt, Human
cccaggacucugacacccccaa

SEQ ID NO: 331981 - RNA, 22 nt, Human
accacaucgggcggacacuggg

SEQ ID NO: 331982 - RNA, 22 nt, Human
gaagagguucaacguggucauc

SEQ ID NO: 331983 - RNA, 22 nt, Human
ccagcugcugcaccgugcaugg

SEQ ID NO: 331984 - RNA, 22 nt, Human
gggcagcaaaucugagucuggu

SEQ ID NO: 331985 - RNA, 22 nt, Human
cggcagagcccugagucagccu

SEQ ID NO: 331986 - RNA, 22 nt, Human
cgcaggugccggcagauggggu

SEQ ID NO: 331987 - RNA, 22 nt, Human
ggaaacuuggaugccagcacuc

SEQ ID NO: 331988 - RNA, 22 nt, Human
aacugguucuggaggcugcagg

SEQ ID NO: 331989 - RNA, 22 nt, Human
aauagcaaaugcucauuugaaa

SEQ ID NO: 331990 - RNA, 22 nt, Human
agcggcgccggagggaggugcg

SEQ ID NO: 331991 - RNA, 22 nt, Human
gaccuccguguacaccucccag

SEQ ID NO: 331992 - RNA, 22 nt, Human
ugccuguguccccuucuuggca

SEQ ID NO: 331993 - RNA, 22 nt, Human
ugcccguggccuggggcagcuu

SEQ ID NO: 331994 - RNA, 23 nt, Human
gcauccagagcucaguccccuuu

SEQ ID NO: 331995 - RNA, 22 nt, Human
cuccaggacaugacuuucuugc

SEQ ID NO: 331996 - RNA, 22 nt, Human
agagcaccaaggugguuuggac

SEQ ID NO: 331997 - RNA, 22 nt, Human
gcaccagccugagccucuugca

SEQ ID NO: 331998 - RNA, 20 nt, Human
cucaccagguguaggcugag

SEQ ID NO: 331999 - RNA, 22 nt, Human
ugcagguggcagcggggcacca

SEQ ID NO: 332000 - RNA, 20 nt, Human
uucuccacaggguggaggag

SEQ ID NO: 332001 - RNA, 22 nt, Human
ucgccccgaggcagcccuaugc

SEQ ID NO: 332002 - RNA, 22 nt, Human
agccagugucgugugacaugag

SEQ ID NO: 332003 - RNA, 22 nt, Human
caggccacacggcggcucccug

SEQ ID NO: 332004 - RNA, 22 nt, Human
ccucagucuauuuccagcaggu

SEQ ID NO: 332005 - RNA, 19 nt, Human
cucucagccugucuccuug

SEQ ID NO: 332006 - RNA, 22 nt, Human
uuccuccagccuggagcacuuc

SEQ ID NO: 332007 - RNA, 22 nt, Human
gcgcugccucugcucuccccac

SEQ ID NO: 332008 - RNA, 22 nt, Human
agcaggccugccaccucggggu

SEQ ID NO: 332009 - RNA, 23 nt, Human
gggcugcuccaggccaaggcugg

SEQ ID NO: 332010 - RNA, 22 nt, Human
ccuggaaaaugccacuuucaca

SEQ ID NO: 332011 - RNA, 22 nt, Human
aggcagccuauggggagcucag

SEQ ID NO: 332012 - RNA, 22 nt, Human
uaaaugaaaggguuuaauuuau

SEQ ID NO: 332013 - RNA, 22 nt, Human
ucuuccagauacuuccugacuu

SEQ ID NO: 332014 - RNA, 22 nt, Human
cccaggagacugagcuguaacc

SEQ ID NO: 332015 - RNA, 23 nt, Human
cagcugguugugggaguggcugc

SEQ ID NO: 332016 - RNA, 22 nt, Human
ucaugucccguugcuggcugcc

SEQ ID NO: 332017 - RNA, 18 nt, Human
uccauccucugcucuuca

SEQ ID NO: 332018 - RNA, 22 nt, Human
agagcagaggcauggccguggg

SEQ ID NO: 332019 - RNA, 22 nt, Human
ugaggcuggaugggaugccucc

SEQ ID NO: 332020 - RNA, 22 nt, Human
cucgcggcgcccgaagcccuug

SEQ ID NO: 332021 - RNA, 22 nt, Human
cuuuauguuggggugucuuagu

SEQ ID NO: 332022 - RNA, 22 nt, Human
guguguggaaugcucauuuauu

SEQ ID NO: 332023 - RNA, 19 nt, Human
cucugccauuugcugccug

SEQ ID NO: 332024 - RNA, 22 nt, Human
gcugcuggcuuccugcuguuuu

SEQ ID NO: 332025 - RNA, 22 nt, Human
ccucccugccggcuggacuagu

SEQ ID NO: 332026 - RNA, 22 nt, Human
agggcuccuaugccccauggac

SEQ ID NO: 332027 - RNA, 22 nt, Human
cucgccccggcacaguguccgu

SEQ ID NO: 332028 - RNA, 22 nt, Human
ugcugugcuggcggcagaggcc

SEQ ID NO: 332029 - RNA, 22 nt, Human
ggccgggcuguggagaaggggu

SEQ ID NO: 332030 - RNA, 22 nt, Human
gggaggugauuaggaccaugua

SEQ ID NO: 332031 - RNA, 22 nt, Human
auguaugagagauucuuuuauu

SEQ ID NO: 332032 - RNA, 22 nt, Human
cggagaggugggggcagcaucu

SEQ ID NO: 332033 - RNA, 22 nt, Human
ucugcacccugugguccucuag

SEQ ID NO: 332034 - RNA, 22 nt, Human
aggugcugccccgagaaggaug

SEQ ID NO: 332035 - RNA, 22 nt, Human
cugaggaucuaauuauuggguc

SEQ ID NO: 332036 - RNA, 21 nt, Human
ucugugcuuuuuuggcuccua

SEQ ID NO: 332037 - RNA, 22 nt, Human
ggcucucuuaacuggccauccu

SEQ ID NO: 332038 - RNA, 22 nt, Human
ucuggaaggggaucugugguca

SEQ ID NO: 332039 - RNA, 22 nt, Human
gcaguccuuaggagaggaagua

SEQ ID NO: 332040 - RNA, 20 nt, Human
cuuguuaaauaugcagguag

SEQ ID NO: 332041 - RNA, 22 nt, Human
gccucugcacuguggcacacca

SEQ ID NO: 332042 - RNA, 22 nt, Human
gcugucucauacaaggcccugc

SEQ ID NO: 332043 - RNA, 22 nt, Human
ggggucccugcaccagcauguc

SEQ ID NO: 332044 - RNA, 22 nt, Human
uccucauucuuggugcaucaaa

SEQ ID NO: 332045 - RNA, 22 nt, Human
caggccugugacaccgugucug

SEQ ID NO: 332046 - RNA, 22 nt, Human
cuagcagaagcuccuugagggu

SEQ ID NO: 332047 - RNA, 22 nt, Human
uagauacauacauuuuaaaaug

SEQ ID NO: 332048 - RNA, 22 nt, Human
gccgugcgugcgcaggugcugu

SEQ ID NO: 332049 - RNA, 22 nt, Human
gccugugcuuaacugacgugag

SEQ ID NO: 332050 - RNA, 21 nt, Human
ucgaccugcugggcucgggcu

SEQ ID NO: 332051 - RNA, 22 nt, Human
ggccugcuucucugggcuuucu

SEQ ID NO: 332052 - RNA, 22 nt, Human
gggugcaaacccguucugcacc

SEQ ID NO: 332053 - RNA, 22 nt, Human
cucucuccuuagcugcagacca

SEQ ID NO: 332054 - RNA, 22 nt, Human
gucuguccacuuggaagcuccc

SEQ ID NO: 332055 - RNA, 22 nt, Human
ucacccagacugucugacucuu

SEQ ID NO: 332056 - RNA, 19 nt, Human
augagcuggcauuucaggu

SEQ ID NO: 332057 - RNA, 22 nt, Human
agaggagguccuuuucugaugu

SEQ ID NO: 332058 - RNA, 22 nt, Human
ugggccaggauuucaagacccu

SEQ ID NO: 332059 - RNA, 22 nt, Human
cgggcagugcccagcggggcag

SEQ ID NO: 332060 - RNA, 22 nt, Human
auguccagaguaaagcacauuc

SEQ ID NO: 332061 - RNA, 23 nt, Human
agguggagcugugcagccggggc

SEQ ID NO: 332062 - RNA, 22 nt, Human
cuggagcucuguguguuccuga

SEQ ID NO: 332063 - RNA, 22 nt, Human
ccugcagacacuuguccagcaa

SEQ ID NO: 332064 - RNA, 22 nt, Human
gagugggugaaugugcucauaa

SEQ ID NO: 332065 - RNA, 22 nt, Human
uuggaggacuaguuaagagacc

SEQ ID NO: 332066 - RNA, 22 nt, Human
cauuuugugcuagacacuaugg

SEQ ID NO: 332067 - RNA, 22 nt, Human
gggcccuggacguggcggcaga

SEQ ID NO: 332068 - RNA, 22 nt, Human
agagaugcuguggguagaggca

SEQ ID NO: 332069 - RNA, 22 nt, Human
agguggagaagagaugggcagu

SEQ ID NO: 332070 - RNA, 22 nt, Human
gcggggacagaaggcgguucuc

SEQ ID NO: 332071 - RNA, 22 nt, Human
uugcuggaagguggcuggaauc

SEQ ID NO: 332072 - RNA, 22 nt, Human
aguguccaacucagcuugucaa

SEQ ID NO: 332073 - RNA, 22 nt, Human
caggaggaaaguuccacucaac

SEQ ID NO: 332074 - RNA, 22 nt, Human
guccuguguaaguacuugcuca

SEQ ID NO: 332075 - RNA, 22 nt, Human
aagcagaaaaacugagcuccaa

SEQ ID NO: 332076 - RNA, 22 nt, Human
cagggagccccaauuccaugcc

SEQ ID NO: 332077 - RNA, 22 nt, Human
gcuggccugcgagggcaggcug

SEQ ID NO: 332078 - RNA, 22 nt, Human
ugcugugagaccauuuguugag

SEQ ID NO: 332079 - RNA, 22 nt, Human
gucccugauaagagccaucgau

SEQ ID NO: 332080 - RNA, 23 nt, Human
ucuggcugcuccuuucaaugcuc

SEQ ID NO: 332081 - RNA, 22 nt, Human
uaccugagaagaaacccguguu

SEQ ID NO: 332082 - RNA, 22 nt, Human
agcuggugugccaguuccaguu

SEQ ID NO: 332083 - RNA, 22 nt, Human
ugccauagcaaugguaagcuga

SEQ ID NO: 332084 - RNA, 22 nt, Human
aggccagggcacugcucuuuag

SEQ ID NO: 332085 - RNA, 22 nt, Human
uuguaacaguagcugucagcuc

SEQ ID NO: 332086 - RNA, 22 nt, Human
ugcgccugcgcaaagguuucug

SEQ ID NO: 332087 - RNA, 22 nt, Human
ugcuccaggcugcugaagaucu

SEQ ID NO: 332088 - RNA, 22 nt, Human
gcugcccauugcucucccacuc

SEQ ID NO: 332089 - RNA, 22 nt, Human
ggggucugggcuuagcuggaau

SEQ ID NO: 332090 - RNA, 22 nt, Human
ugccugugggugaugauuugau

SEQ ID NO: 332091 - RNA, 22 nt, Human
aagggugguguaggagaucaaa

SEQ ID NO: 332092 - RNA, 19 nt, Human
uccuggggaggggcauggc

SEQ ID NO: 332093 - RNA, 22 nt, Human
ggagggaguuucauuccugccc

SEQ ID NO: 332094 - RNA, 22 nt, Human
aagcaaaagguuacacuucugg

SEQ ID NO: 332095 - RNA, 22 nt, Human
ccccaacccugguuccguggcg

SEQ ID NO: 332096 - RNA, 22 nt, Human
gcugucccgaaccccugguaau

SEQ ID NO: 332097 - RNA, 20 nt, Human
uugagcagcagugcuguguc

SEQ ID NO: 332098 - RNA, 22 nt, Human
cuugaugaaugaccuggguggu

SEQ ID NO: 332099 - RNA, 22 nt, Human
ugggcagggagcuggaaccaca

SEQ ID NO: 332100 - RNA, 22 nt, Human
ucggagcgucacuggcuggagg

SEQ ID NO: 332101 - RNA, 22 nt, Human
ucagguccaagauggccaucca

SEQ ID NO: 332102 - RNA, 18 nt, Human
uggggggcuugucugaag

SEQ ID NO: 332103 - RNA, 22 nt, Human
gcccuguuuucuggguuccuug

SEQ ID NO: 332104 - RNA, 22 nt, Human
uucugauugcugaugaggccca

SEQ ID NO: 332105 - RNA, 22 nt, Human
ucucuccuccacaccgggugcu

SEQ ID NO: 332106 - RNA, 22 nt, Human
gccagguaugaauuacgcacga

SEQ ID NO: 332107 - RNA, 22 nt, Human
ccagcagcucccucaggguccg

SEQ ID NO: 332108 - RNA, 22 nt, Human
agguggaguuaagugugaacug

SEQ ID NO: 332109 - RNA, 22 nt, Human
aggcuuucgaugaacgcuugcu

SEQ ID NO: 332110 - RNA, 22 nt, Human
ugccuaggcuggaaugcagugg

SEQ ID NO: 332111 - RNA, 22 nt, Human
gccuggagcucggcugagggcg

SEQ ID NO: 332112 - RNA, 22 nt, Human
aaucuucaggguccuggggcuc

SEQ ID NO: 332113 - RNA, 22 nt, Human
auugcacaucugcacuacagcc

SEQ ID NO: 332114 - RNA, 22 nt, Human
ggccuugggauguggcugcagc

SEQ ID NO: 332115 - RNA, 22 nt, Human
augccccagugugugcuuccuu

SEQ ID NO: 332116 - RNA, 22 nt, Human
cgcggucucuuuaaggcggguc

SEQ ID NO: 332117 - RNA, 22 nt, Human
gugcuggggagauaggaagaga

SEQ ID NO: 332118 - RNA, 22 nt, Human
agccaccaccacugaaagguua

SEQ ID NO: 332119 - RNA, 22 nt, Human
aguacuuuuuguucaauugugc

SEQ ID NO: 332120 - RNA, 22 nt, Human
gcucccugguauugcugccacu

SEQ ID NO: 332121 - RNA, 22 nt, Human
ucaucuccauacggucucgcag

SEQ ID NO: 332122 - RNA, 22 nt, Human
auuucagcagcccauguuugga

SEQ ID NO: 332123 - RNA, 22 nt, Human
aucaugugacuagguuuggcca

SEQ ID NO: 332124 - RNA, 22 nt, Human
caggccgggcacugcgcuaggu

SEQ ID NO: 332125 - RNA, 21 nt, Human
cccgugccuucagcaguccug

SEQ ID NO: 332126 - RNA, 18 nt, Human
cugccuguugcugagagg

SEQ ID NO: 332127 - RNA, 22 nt, Human
ggugucagugaagguagaguuu

SEQ ID NO: 332128 - RNA, 22 nt, Human
cuucuccgacaaccgacgccgg

SEQ ID NO: 332129 - RNA, 22 nt, Human
uuuuguguugccauguuaagca

SEQ ID NO: 332130 - RNA, 22 nt, Human
cagcuccagcccaggcagcucc

SEQ ID NO: 332131 - RNA, 22 nt, Human
cagcagcucaggcuccuuccca

SEQ ID NO: 332132 - RNA, 22 nt, Human
ucuguggcaugguaucuggagg

SEQ ID NO: 332133 - RNA, 22 nt, Human
cagggcacaguuauggaggugg

SEQ ID NO: 332134 - RNA, 22 nt, Human
gagcagcaucuccggcuuaaag

SEQ ID NO: 332135 - RNA, 22 nt, Human
ggccgugcuccaaagucaucgu

SEQ ID NO: 332136 - RNA, 22 nt, Human
ggggucacacuguggugacugg

SEQ ID NO: 332137 - RNA, 22 nt, Human
cccuguccugcuaggcccuggu

SEQ ID NO: 332138 - RNA, 22 nt, Human
ugcauuugcaauggguacacaa

SEQ ID NO: 332139 - RNA, 22 nt, Human
agguggcagacuaacagaagga

SEQ ID NO: 332140 - RNA, 19 nt, Human
ccugcugaagugaugcagc

SEQ ID NO: 332141 - RNA, 22 nt, Human
cccaggucgucagcaguguggu

SEQ ID NO: 332142 - RNA, 22 nt, Human
gggcucuguuuagaccagagau

SEQ ID NO: 332143 - RNA, 22 nt, Human
cuggaagcgucggaggaagggc

SEQ ID NO: 332144 - RNA, 22 nt, Human
cugcgggcugucaggcgugcca

SEQ ID NO: 332145 - RNA, 22 nt, Human
cuggcuccucaggacugcggga

SEQ ID NO: 332146 - RNA, 22 nt, Human
cuuguauuaggaagaaugcuuu

SEQ ID NO: 332147 - RNA, 22 nt, Human
ugcuggcugggcugcuggagac

SEQ ID NO: 332148 - RNA, 22 nt, Human
cugagggccuucuaugcugagc

SEQ ID NO: 332149 - RNA, 21 nt, Human
ggcagcucagcagauggggac

SEQ ID NO: 332150 - RNA, 22 nt, Human
caucagucugaaagccagggag

SEQ ID NO: 332151 - RNA, 22 nt, Human
gccaggaccucagaugcagggc

SEQ ID NO: 332152 - RNA, 22 nt, Human
ccaggacaagccagagggacag

SEQ ID NO: 332153 - RNA, 22 nt, Human
ucaggggcuugaggugcauguc

SEQ ID NO: 332154 - RNA, 22 nt, Human
gaugcugauuuuacuguuuucu

SEQ ID NO: 332155 - RNA, 22 nt, Human
agcugccgaugcccagcugcau

SEQ ID NO: 332156 - RNA, 22 nt, Human
ucuccacaccagaaggagcuga

SEQ ID NO: 332157 - RNA, 22 nt, Human
gcagcucacagucuccgccauc

SEQ ID NO: 332158 - RNA, 22 nt, Human
cggcgcaggcagaccgcgggcu

SEQ ID NO: 332159 - RNA, 22 nt, Human
cccgaccucgcaaagcgcacuc

SEQ ID NO: 332160 - RNA, 22 nt, Human
gcugggagucgcgucuguggcc

SEQ ID NO: 332161 - RNA, 22 nt, Human
guccuggggauuauagaguguu

SEQ ID NO: 332162 - RNA, 19 nt, Human
agcucaggcccaucguccc

SEQ ID NO: 332163 - RNA, 22 nt, Human
caccugagcaacccugugcggg

SEQ ID NO: 332164 - RNA, 18 nt, Human
ucugagggugcgggagcu

SEQ ID NO: 332165 - RNA, 22 nt, Human
ucugcucagccgaucugcuccg

SEQ ID NO: 332166 - RNA, 22 nt, Human
acaugggcaucuaugaggcucu

SEQ ID NO: 332167 - RNA, 22 nt, Human
aaagcagaacugagagagcugg

SEQ ID NO: 332168 - RNA, 22 nt, Human
gcugggcugcgucggggaagcc

SEQ ID NO: 332169 - RNA, 22 nt, Human
agcacauucccaccuguacuuc

SEQ ID NO: 332170 - RNA, 22 nt, Human
uggcugcccccucccguggaca

SEQ ID NO: 332171 - RNA, 22 nt, Human
ccugaggcccuggcugugcuga

SEQ ID NO: 332172 - RNA, 22 nt, Human
gccaagaaugcgacagccguca

SEQ ID NO: 332173 - RNA, 22 nt, Human
guagagcagggagcaggaagcu

SEQ ID NO: 332174 - RNA, 22 nt, Human
caaaugaugcauggcuagugag

SEQ ID NO: 332175 - RNA, 22 nt, Human
ggcgcggugacucagccucgcu

SEQ ID NO: 332176 - RNA, 22 nt, Human
gcaguggccacauggaggagga

SEQ ID NO: 332177 - RNA, 20 nt, Human
uggcccagcacgacgaggac

SEQ ID NO: 332178 - RNA, 22 nt, Human
cuccguggcuguggacgcagcc

SEQ ID NO: 332179 - RNA, 20 nt, Human
ugcuggaggcgccggcgcuc

SEQ ID NO: 332180 - RNA, 22 nt, Human
gucugcacgugccagggagggg

SEQ ID NO: 332181 - RNA, 22 nt, Human
gguggcaccuuacccugcgcag

SEQ ID NO: 332182 - RNA, 22 nt, Human
uugcuucacuacuucuaggcuc

SEQ ID NO: 332183 - RNA, 22 nt, Human
acagagguuaggauggguugua

SEQ ID NO: 332184 - RNA, 22 nt, Human
cuucucggccguguggaugcgc

SEQ ID NO: 332185 - RNA, 22 nt, Human
augaacugcaguauaaacuugg

SEQ ID NO: 332186 - RNA, 22 nt, Human
cccccagcucugcugggucccg

SEQ ID NO: 332187 - RNA, 22 nt, Human
uccaagaagcuuacaaucuaau

SEQ ID NO: 332188 - RNA, 22 nt, Human
augcugccuccucuucagccgc

SEQ ID NO: 332189 - RNA, 20 nt, Human
ugugugaauuagggcauguu

SEQ ID NO: 332190 - RNA, 22 nt, Human
cucgagagauccucuugccacc

SEQ ID NO: 332191 - RNA, 22 nt, Human
aggagcggauguguccugccag

SEQ ID NO: 332192 - RNA, 22 nt, Human
aaccccgcucaggcugggugag

SEQ ID NO: 332193 - RNA, 22 nt, Human
uccuggcccuguggccugcagu

SEQ ID NO: 332194 - RNA, 22 nt, Human
gagccugagcaaugugauguuu

SEQ ID NO: 332195 - RNA, 22 nt, Human
ggcugcccucggggucgcaggc

SEQ ID NO: 332196 - RNA, 22 nt, Human
cuccagagagaaaggaggccgc

SEQ ID NO: 332197 - RNA, 22 nt, Human
cccaggaggcagaaguugcagu

SEQ ID NO: 332198 - RNA, 21 nt, Human
gugugucuaauguaguggaaa

SEQ ID NO: 332199 - RNA, 22 nt, Human
cuuccugcaacaccuguguugc

SEQ ID NO: 332200 - RNA, 20 nt, Human
gccaagaauaugcccgacuc

SEQ ID NO: 332201 - RNA, 22 nt, Human
cagggugacugcccuggccacu

SEQ ID NO: 332202 - RNA, 22 nt, Human
gccaggucgucuccauguccaa

SEQ ID NO: 332203 - RNA, 23 nt, Human
aaauugucguaagguggagaugu

SEQ ID NO: 332204 - RNA, 20 nt, Human
guggcagugguggcagcagu

SEQ ID NO: 332205 - RNA, 22 nt, Human
ggcucugcugguaagaugccuc

SEQ ID NO: 332206 - RNA, 22 nt, Human
augaaacucuagcuuucagcac

SEQ ID NO: 332207 - RNA, 22 nt, Human
auccugggaaguggccuccucc

SEQ ID NO: 332208 - RNA, 22 nt, Human
gacuuugguucagggcucagag

SEQ ID NO: 332209 - RNA, 22 nt, Human
uccaggaguccuggguggcccc

SEQ ID NO: 332210 - RNA, 22 nt, Human
gggacuggaguagaggccggug

SEQ ID NO: 332211 - RNA, 18 nt, Human
cccacggugcuguagggc

SEQ ID NO: 332212 - RNA, 22 nt, Human
gcugggucucucccugguccug

SEQ ID NO: 332213 - RNA, 22 nt, Human
uggcggugacggcggcgccugg

SEQ ID NO: 332214 - RNA, 22 nt, Human
cagacaggguccuguccgucac

SEQ ID NO: 332215 - RNA, 22 nt, Human
ugcuggccucggcgcugggccu

SEQ ID NO: 332216 - RNA, 22 nt, Human
cuguccagcgacuaggggaugg

SEQ ID NO: 332217 - RNA, 22 nt, Human
uccaggagggggagccgugccg

SEQ ID NO: 332218 - RNA, 22 nt, Human
ggaguucaaaucuuuuggaucu

SEQ ID NO: 332219 - RNA, 22 nt, Human
ggagcugugcugggugaucagg

SEQ ID NO: 332220 - RNA, 22 nt, Human
ccagagacaaggagcuggaguc

SEQ ID NO: 332221 - RNA, 22 nt, Human
ccucguccacaauccuugcaca

SEQ ID NO: 332222 - RNA, 22 nt, Human
ugcaagagcccaaacuauauac

SEQ ID NO: 332223 - RNA, 22 nt, Human
cgggcuccgggucuuugcaguc

SEQ ID NO: 332224 - RNA, 22 nt, Human
aggcuguagaucuagacaugua

SEQ ID NO: 332225 - RNA, 22 nt, Human
ucccuggcacaagaaggcuguc

SEQ ID NO: 332226 - RNA, 22 nt, Human
uuuauucucuaguuggucagau

SEQ ID NO: 332227 - RNA, 22 nt, Human
cccgggaggaggaaguugcagu

SEQ ID NO: 332228 - RNA, 22 nt, Human
agaaagcacccugcacuuucug

SEQ ID NO: 332229 - RNA, 22 nt, Human
gccagaggggcucgaaggcgcg

SEQ ID NO: 332230 - RNA, 22 nt, Human
uccguggggccuguggcuuccg

SEQ ID NO: 332231 - RNA, 23 nt, Human
uggcucuguggaucccucaggag

SEQ ID NO: 332232 - RNA, 22 nt, Human
cagggagcuggugccagccgac

SEQ ID NO: 332233 - RNA, 22 nt, Human
cccaccagaccugcaccggcac

SEQ ID NO: 332234 - RNA, 22 nt, Human
cucagcugucucaugggucugu

SEQ ID NO: 332235 - RNA, 22 nt, Human
cccagcugaacuugcauuccaa

SEQ ID NO: 332236 - RNA, 22 nt, Human
cauuucaaacaguuacagcugc

SEQ ID NO: 332237 - RNA, 22 nt, Human
cuccuuccugguuagcaccuua

SEQ ID NO: 332238 - RNA, 22 nt, Human
acccggaggcgggggaugcagu

SEQ ID NO: 332239 - RNA, 22 nt, Human
acccggagucggagguugcagu

SEQ ID NO: 332240 - RNA, 22 nt, Human
uggccccugaggagcgucagcc

SEQ ID NO: 332241 - RNA, 22 nt, Human
cuggccgcaguguggaguugug

SEQ ID NO: 332242 - RNA, 20 nt, Human
ggccugagcauggcuggcag

SEQ ID NO: 332243 - RNA, 22 nt, Human
augcaggaagagcccuggagcu

SEQ ID NO: 332244 - RNA, 22 nt, Human
uugcacgcuugcgguuccugcc

SEQ ID NO: 332245 - RNA, 22 nt, Human
gccacguagaagugccgcgaga

SEQ ID NO: 332246 - RNA, 22 nt, Human
ggcuguggucauuaggagguug

SEQ ID NO: 332247 - RNA, 22 nt, Human
ccucugcccuuuuccuguauca

SEQ ID NO: 332248 - RNA, 22 nt, Human
cagaugaggcaaccucauugcu

SEQ ID NO: 332249 - RNA, 22 nt, Human
cuccuucacgcaggcugccaug

SEQ ID NO: 332250 - RNA, 22 nt, Human
gagguuggagggcuggccugca

SEQ ID NO: 332251 - RNA, 22 nt, Human
gcuaugggaugugcuguggaug

SEQ ID NO: 332252 - RNA, 22 nt, Human
ccugcgggcugugcugaagccu

SEQ ID NO: 332253 - RNA, 20 nt, Human
cugggcagguguuugaucuc

SEQ ID NO: 332254 - RNA, 22 nt, Human
gcucguacaccagcguggaggu

SEQ ID NO: 332255 - RNA, 21 nt, Human
agagacugucacugcaguacc

SEQ ID NO: 332256 - RNA, 22 nt, Human
ucacauguguggcagugcaagu

SEQ ID NO: 332257 - RNA, 21 nt, Human
cccagaaguuccauggggggc

SEQ ID NO: 332258 - RNA, 21 nt, Human
agaaggcaaaagcagacaucu

SEQ ID NO: 332259 - RNA, 20 nt, Human
ccagguggugccuggagagg

SEQ ID NO: 332260 - RNA, 22 nt, Human
gcugccuggaauaacggcuggc

SEQ ID NO: 332261 - RNA, 22 nt, Human
gucacccguuugacuauccacc

SEQ ID NO: 332262 - RNA, 22 nt, Human
ucacaugcucaccuaagccaca

SEQ ID NO: 332263 - RNA, 22 nt, Human
gcugucugcugggucgcucagg

SEQ ID NO: 332264 - RNA, 22 nt, Human
caucucccacuuccuugggggu

SEQ ID NO: 332265 - RNA, 22 nt, Human
uaaagcaaugaaaguuuugcag

SEQ ID NO: 332266 - RNA, 22 nt, Human
cuucaugcugauauccucgaug

SEQ ID NO: 332267 - RNA, 22 nt, Human
cagucucuggugaguugacagu

SEQ ID NO: 332268 - RNA, 22 nt, Human
uuugagaagcauggcuguauuc

SEQ ID NO: 332269 - RNA, 22 nt, Human
ggagugggaacaaugacauggu

SEQ ID NO: 332270 - RNA, 22 nt, Human
cugcccugcagcuccacggacu

SEQ ID NO: 332271 - RNA, 22 nt, Human
gugcaggacagcacaucuccug

SEQ ID NO: 332272 - RNA, 17 nt, Human
ucugcagggggccgugu

SEQ ID NO: 332273 - RNA, 22 nt, Human
gagcagcaggccagguugcagg

SEQ ID NO: 332274 - RNA, 19 nt, Human
ugguggaggugcaccugac

SEQ ID NO: 332275 - RNA, 22 nt, Human
auccucagagaacgaacacaau

SEQ ID NO: 332276 - RNA, 22 nt, Human
agacacauuuucagcucugcca

SEQ ID NO: 332277 - RNA, 22 nt, Human
ggccuugguaaauuggcauuug

SEQ ID NO: 332278 - RNA, 22 nt, Human
ccacuuugagaagcugaugaaa

SEQ ID NO: 332279 - RNA, 18 nt, Human
ggccucagccuggccgga

SEQ ID NO: 332280 - RNA, 22 nt, Human
ugauuuacaguagugucuaaac

SEQ ID NO: 332281 - RNA, 22 nt, Human
caguauuucauucagaauuguu

SEQ ID NO: 332282 - RNA, 19 nt, Human
ugcagcuguaugagcuuaa

SEQ ID NO: 332283 - RNA, 22 nt, Human
gaacugcauugugguauauguu

SEQ ID NO: 332284 - RNA, 22 nt, Human
ccauggccaggaaagccaaggu

SEQ ID NO: 332285 - RNA, 22 nt, Human
gcagggcagggcaagaacuggg

SEQ ID NO: 332286 - RNA, 19 nt, Human
uggcucugucgaaggcaca

SEQ ID NO: 332287 - RNA, 22 nt, Human
cuguggcuaggaagcuguggga

SEQ ID NO: 332288 - RNA, 22 nt, Human
uggcacguuggauugggaguuc

SEQ ID NO: 332289 - RNA, 22 nt, Human
cgcugccuucaucccacgccua

SEQ ID NO: 332290 - RNA, 22 nt, Human
ugucauuggugaucugaugccu

SEQ ID NO: 332291 - RNA, 22 nt, Human
aaauugcauuuuaaagguagau

SEQ ID NO: 332292 - RNA, 22 nt, Human
auugagaaaauucgagcaaguu

SEQ ID NO: 332293 - RNA, 22 nt, Human
aaaauuaagugucugggaagcc

SEQ ID NO: 332294 - RNA, 20 nt, Human
ggccggggagcucuccaggg

SEQ ID NO: 332295 - RNA, 22 nt, Human
ccaggugugcucugcaguggau

SEQ ID NO: 332296 - RNA, 17 nt, Human
uccuggccuggugugug

SEQ ID NO: 332297 - RNA, 22 nt, Human
uccaggaggacugagggggcug

SEQ ID NO: 332298 - RNA, 22 nt, Human
uagcugucagcaaucaaguggu

SEQ ID NO: 332299 - RNA, 22 nt, Human
gcaggccuccccugcuggagcu

SEQ ID NO: 332300 - RNA, 22 nt, Human
gauccacaggaaccaaaacgca

SEQ ID NO: 332301 - RNA, 22 nt, Human
gggagcugaaggagccggcggg

SEQ ID NO: 332302 - RNA, 22 nt, Human
ucaggccccaucccagacuuau

SEQ ID NO: 332303 - RNA, 22 nt, Human
agcugggcuggagcuccaagcg

SEQ ID NO: 332304 - RNA, 22 nt, Human
uaaaacuagugguugggacuaa

SEQ ID NO: 332305 - RNA, 22 nt, Human
uccagcucugcugugcgccggu

SEQ ID NO: 332306 - RNA, 22 nt, Human
agcagcaggugaccucgaugcc

SEQ ID NO: 332307 - RNA, 22 nt, Human
uguaagcuucaaauaucuguga

SEQ ID NO: 332308 - RNA, 22 nt, Human
cugcugucuuuauuucacugcu

SEQ ID NO: 332309 - RNA, 18 nt, Human
agcugaggggacugaaga

SEQ ID NO: 332310 - RNA, 22 nt, Human
auuuugacauugcggcauugcu

SEQ ID NO: 332311 - RNA, 22 nt, Human
cagagcagcagagcuuccaugg

SEQ ID NO: 332312 - RNA, 23 nt, Human
ccacuggagaaaguggcaggugg

SEQ ID NO: 332313 - RNA, 22 nt, Human
cugcggcuggggacagcuguug

SEQ ID NO: 332314 - RNA, 22 nt, Human
uuggaggaagcucaugggggau

SEQ ID NO: 332315 - RNA, 22 nt, Human
ucugcgcccugucgccugcucc

SEQ ID NO: 332316 - RNA, 22 nt, Human
ugcgcaugcguggcucuccggc

SEQ ID NO: 332317 - RNA, 20 nt, Human
ucugugugccaucaccuaac

SEQ ID NO: 332318 - RNA, 17 nt, Human
ggccugcaccuccugcu

SEQ ID NO: 332319 - RNA, 21 nt, Human
gccugggaagagaaagguaag

SEQ ID NO: 332320 - RNA, 22 nt, Human
uuuucuaacaucuaguaauuug

SEQ ID NO: 332321 - RNA, 22 nt, Human
uccagcagguccgagacaaguu

SEQ ID NO: 332322 - RNA, 22 nt, Human
uccuucagaggacggcagccag

SEQ ID NO: 332323 - RNA, 22 nt, Human
ugggggagccuucacaguagcu

SEQ ID NO: 332324 - RNA, 22 nt, Human
ucuguggcuuucguguaagaug

SEQ ID NO: 332325 - RNA, 22 nt, Human
ggguggaaaguauuuggggacc

SEQ ID NO: 332326 - RNA, 22 nt, Human
caaagcccagaggccucacuuu

SEQ ID NO: 332327 - RNA, 22 nt, Human
caggccagcagggccuccgugg

SEQ ID NO: 332328 - RNA, 22 nt, Human
gucugcugacagagcauggacc

SEQ ID NO: 332329 - RNA, 22 nt, Human
acguagcacugagagaugcagg

SEQ ID NO: 332330 - RNA, 22 nt, Human
cuccagcucgcgagcucugcuc

SEQ ID NO: 332331 - RNA, 22 nt, Human
uuuggauugcuuggaugcuucg

SEQ ID NO: 332332 - RNA, 22 nt, Human
uuuuuggguccaggcuguaucu

SEQ ID NO: 332333 - RNA, 22 nt, Human
gcuggguggaucggaggcucug

SEQ ID NO: 332334 - RNA, 22 nt, Human
uugggauuacagguguaagcca

SEQ ID NO: 332335 - RNA, 22 nt, Human
auggguggccccgugugcaguc

SEQ ID NO: 332336 - RNA, 22 nt, Human
gcggagaggcagagacuccgcg

SEQ ID NO: 332337 - RNA, 22 nt, Human
gcugcagggagcuggaaggcuc

SEQ ID NO: 332338 - RNA, 21 nt, Human
agaugaggauacugaggccua

SEQ ID NO: 332339 - RNA, 22 nt, Human
agcuggugauguggucccucac

SEQ ID NO: 332340 - RNA, 22 nt, Human
ccagcaggagacuagcaacaua

SEQ ID NO: 332341 - RNA, 22 nt, Human
ugguccugagcaccagccugac

SEQ ID NO: 332342 - RNA, 22 nt, Human
gcacugggggcagcagugaggg

SEQ ID NO: 332343 - RNA, 22 nt, Human
cagcugccuguauuguccucau

SEQ ID NO: 332344 - RNA, 21 nt, Human
uuggccgugcagaugaacagc

SEQ ID NO: 332345 - RNA, 22 nt, Human
gagcugcauagcugggauccuc

SEQ ID NO: 332346 - RNA, 22 nt, Human
cuggagcucagcccagguucca

SEQ ID NO: 332347 - RNA, 22 nt, Human
uugcugccuuuguacucugaug

SEQ ID NO: 332348 - RNA, 22 nt, Human
gagggugguggcuuaaggugcu

SEQ ID NO: 332349 - RNA, 22 nt, Human
uggccuugcccagcgccuaggu

SEQ ID NO: 332350 - RNA, 22 nt, Human
ccaccacugaggcacaggagcc

SEQ ID NO: 332351 - RNA, 22 nt, Human
uggcugaggcacagcugccgcc

SEQ ID NO: 332352 - RNA, 17 nt, Human
gcuccagaauucuaguc

SEQ ID NO: 332353 - RNA, 22 nt, Human
uccacagggaugccugcggcuu

SEQ ID NO: 332354 - RNA, 22 nt, Human
acgggcugggacggggaagcuc

SEQ ID NO: 332355 - RNA, 22 nt, Human
ugccgcugucgccaccauggcu

SEQ ID NO: 332356 - RNA, 21 nt, Human
gcuccuggugcugcguggcgc

SEQ ID NO: 332357 - RNA, 22 nt, Human
agccccaggcccggacgccucu

SEQ ID NO: 332358 - RNA, 22 nt, Human
accagaagcuggagcacaagga

SEQ ID NO: 332359 - RNA, 22 nt, Human
ggcagaggaagcuggaaguggg

SEQ ID NO: 332360 - RNA, 22 nt, Human
ugcugcuuguuuuguaaauaaa

SEQ ID NO: 332361 - RNA, 22 nt, Human
gcgagucgccgcugcagcccua

SEQ ID NO: 332362 - RNA, 22 nt, Human
agcaaggcagcuuucacugcuu

SEQ ID NO: 332363 - RNA, 22 nt, Human
gggacagcuguagugcuuggcu

SEQ ID NO: 332364 - RNA, 22 nt, Human
ccagcagccaccuucucgaaau

SEQ ID NO: 332365 - RNA, 22 nt, Human
auggugguagaagcacuaugug

SEQ ID NO: 332366 - RNA, 18 nt, Human
gagaggagccagaauuuu

SEQ ID NO: 332367 - RNA, 22 nt, Human
cuccagcagaaagggcgagugg

SEQ ID NO: 332368 - RNA, 22 nt, Human
uccuccuuuccccgcuggagcc

SEQ ID NO: 332369 - RNA, 22 nt, Human
cuggagggcugcagcgaggcug

SEQ ID NO: 332370 - RNA, 22 nt, Human
uccagcugugcuccaggaggug

SEQ ID NO: 332371 - RNA, 22 nt, Human
gcggggccauguccaacggccu

SEQ ID NO: 332372 - RNA, 22 nt, Human
ccagguggacggcgaguacagg

SEQ ID NO: 332373 - RNA, 20 nt, Human
cugcuccacccggcucucag

SEQ ID NO: 332374 - RNA, 22 nt, Human
gaggagaggcuggacgcgguga

SEQ ID NO: 332375 - RNA, 22 nt, Human
gcggcccgagcaggacgggugg

SEQ ID NO: 332376 - RNA, 22 nt, Human
uaaaaucaugacagauugacau

SEQ ID NO: 332377 - RNA, 22 nt, Human
aguuauugagugcagagcaggg

SEQ ID NO: 332378 - RNA, 22 nt, Human
ggccauggcgggagccggcguc

SEQ ID NO: 332379 - RNA, 22 nt, Human
cugggaggcagucucucuagaa

SEQ ID NO: 332380 - RNA, 22 nt, Human
agccagggacgcugcaggcuac

SEQ ID NO: 332381 - RNA, 22 nt, Human
ugguggggccagacuucagcuc

SEQ ID NO: 332382 - RNA, 22 nt, Human
agucagcuugucucuaggguug

SEQ ID NO: 332383 - RNA, 22 nt, Human
guggcaggagggcaucacuugg

SEQ ID NO: 332384 - RNA, 20 nt, Human
gggugugggcccggccaggc

SEQ ID NO: 332385 - RNA, 22 nt, Human
ccaugcccuugucaucuccagg

SEQ ID NO: 332386 - RNA, 22 nt, Human
ggcuggaaggcccuuuguugau

SEQ ID NO: 332387 - RNA, 22 nt, Human
ggaggaggggugacugaaugcu

SEQ ID NO: 332388 - RNA, 22 nt, Human
uguuugcucugacuaucuugcg

SEQ ID NO: 332389 - RNA, 22 nt, Human
ggagaggguagggguccugccc

SEQ ID NO: 332390 - RNA, 22 nt, Human
cuucauuucaggcugaagaaua

SEQ ID NO: 332391 - RNA, 22 nt, Human
cagaggauauaugguuuguaug

SEQ ID NO: 332392 - RNA, 22 nt, Human
acucgcggcggacggcggccag

SEQ ID NO: 332393 - RNA, 22 nt, Human
cggagcagagccacucgggccg

SEQ ID NO: 332394 - RNA, 22 nt, Human
gggagggucugagagcugcacc

SEQ ID NO: 332395 - RNA, 22 nt, Human
aagccuucaguccguugcagag

SEQ ID NO: 332396 - RNA, 22 nt, Human
acgugcuggagaagagcucgcc

SEQ ID NO: 332397 - RNA, 22 nt, Human
accaggaguuuugaccaggggc

SEQ ID NO: 332398 - RNA, 23 nt, Human
ugggcagcuucugcaugcccacc

SEQ ID NO: 332399 - RNA, 22 nt, Human
ccccagcagacucagggcaggu

SEQ ID NO: 332400 - RNA, 22 nt, Human
uaguauuuccuguaagcuauag

SEQ ID NO: 332401 - RNA, 22 nt, Human
ugggcugcuucuauuggugguc

SEQ ID NO: 332402 - RNA, 22 nt, Human
ggcggcacgcaggcugcugucg

SEQ ID NO: 332403 - RNA, 22 nt, Human
ucugcuguuuacugugugauau

SEQ ID NO: 332404 - RNA, 22 nt, Human
agccagcuaccggggcuccugg

SEQ ID NO: 332405 - RNA, 22 nt, Human
gcgguauuugugugggugucga

SEQ ID NO: 332406 - RNA, 22 nt, Human
gugguuguuuccagguuugaaa

SEQ ID NO: 332407 - RNA, 15 nt, Human
uggugguguugagac

SEQ ID NO: 332408 - RNA, 22 nt, Human
acgucuucguuggcagagauuu

SEQ ID NO: 332409 - RNA, 22 nt, Human
ggcucacgcaauuaucccggcc

SEQ ID NO: 332410 - RNA, 22 nt, Human
uuccuggcagaggccccgacag

SEQ ID NO: 332411 - RNA, 22 nt, Human
uguaccgccuugugggguuggg

SEQ ID NO: 332412 - RNA, 22 nt, Human
ugaaguuguuaagguugccauu

SEQ ID NO: 332413 - RNA, 22 nt, Human
ccagcuggaacggcagcccagc

SEQ ID NO: 332414 - RNA, 22 nt, Human
ggcaguggugggaggcucgcuc

SEQ ID NO: 332415 - RNA, 22 nt, Human
ccggcgucucuuccacuuccua

SEQ ID NO: 332416 - RNA, 17 nt, Human
gugcuggccuggggcuc

SEQ ID NO: 332417 - RNA, 18 nt, Human
uggcagccagcugcuccu

SEQ ID NO: 332418 - RNA, 22 nt, Human
uguguggcaagcuguaugcuag

SEQ ID NO: 332419 - RNA, 19 nt, Human
agcaguggagccaugccug

SEQ ID NO: 332420 - RNA, 22 nt, Human
ccaguucuuucugugugcaaca

SEQ ID NO: 332421 - RNA, 22 nt, Human
agguagcuggugcugggcuccu

SEQ ID NO: 332422 - RNA, 22 nt, Human
gugugcgccgacacagccaggu

SEQ ID NO: 332423 - RNA, 20 nt, Human
ccacccuguccggggcggag

SEQ ID NO: 332424 - RNA, 22 nt, Human
ugcugcucuucaccauggccuc

SEQ ID NO: 332425 - RNA, 22 nt, Human
uccagcaguccaugugagacac

SEQ ID NO: 332426 - RNA, 22 nt, Human
uucugggcacacaggcccuggu

SEQ ID NO: 332427 - RNA, 22 nt, Human
ucugcccaggaggucccauggg

SEQ ID NO: 332428 - RNA, 21 nt, Human
agaugcagugacccacugggg

SEQ ID NO: 332429 - RNA, 22 nt, Human
augauccagauuuugggcaguu

SEQ ID NO: 332430 - RNA, 22 nt, Human
ugagcaccaggcaccacagcuc

SEQ ID NO: 332431 - RNA, 22 nt, Human
aaggcccacagaacugucucca

SEQ ID NO: 332432 - RNA, 22 nt, Human
gccccucuccuugugcaccugc

SEQ ID NO: 332433 - RNA, 22 nt, Human
gcggcccggguccccagcagca

SEQ ID NO: 332434 - RNA, 22 nt, Human
ucuccucuauuucuguauguau

SEQ ID NO: 332435 - RNA, 22 nt, Human
cugagcugguucucuugugaaa

SEQ ID NO: 332436 - RNA, 17 nt, Human
aguuggcagccguugcu

SEQ ID NO: 332437 - RNA, 22 nt, Human
ugcugcucaagcugcagcaaaa

SEQ ID NO: 332438 - RNA, 22 nt, Human
augcugagugagugaaacccag

SEQ ID NO: 332439 - RNA, 22 nt, Human
cugcaucaguggauaugauggu

SEQ ID NO: 332440 - RNA, 22 nt, Human
ccugcgcgucugggucugucuc

SEQ ID NO: 332441 - RNA, 22 nt, Human
ucugagggauuugucccuuauc

SEQ ID NO: 332442 - RNA, 22 nt, Human
uaucuguauucugacagucacu

SEQ ID NO: 332443 - RNA, 22 nt, Human
guucucugccggcaccuacccg

SEQ ID NO: 332444 - RNA, 22 nt, Human
ugcugcgggacccacugugggc

SEQ ID NO: 332445 - RNA, 22 nt, Human
gcacugggagucuguggggguu

SEQ ID NO: 332446 - RNA, 22 nt, Human
agcggcgccgagcuuggccagg

SEQ ID NO: 332447 - RNA, 22 nt, Human
ccagcugcgggcaucgagaguu

SEQ ID NO: 332448 - RNA, 22 nt, Human
cugagggagcugcuggccuugg

SEQ ID NO: 332449 - RNA, 22 nt, Human
uugcuggaguagaaaacuuaac

SEQ ID NO: 332450 - RNA, 23 nt, Human
agcccagcagagaaccuaggucc

SEQ ID NO: 332451 - RNA, 22 nt, Human
gcuucugcagagccguccugag

SEQ ID NO: 332452 - RNA, 22 nt, Human
gcagaagcccggucagcgcacg

SEQ ID NO: 332453 - RNA, 22 nt, Human
ggagguggagcuggaaguucca

SEQ ID NO: 332454 - RNA, 22 nt, Human
gcucaugggcccagagcagccc

SEQ ID NO: 332455 - RNA, 22 nt, Human
guggcauugccuucugcaggaa

SEQ ID NO: 332456 - RNA, 22 nt, Human
cagcugccuaugaccuagccuc

SEQ ID NO: 332457 - RNA, 22 nt, Human
gccaugaacucgggcauggaga

SEQ ID NO: 332458 - RNA, 22 nt, Human
cucagcucauuguggauccggu

SEQ ID NO: 332459 - RNA, 22 nt, Human
gcaggggcugagcaccagcggg

SEQ ID NO: 332460 - RNA, 22 nt, Human
agccacccuaccagcccugaaa

SEQ ID NO: 332461 - RNA, 22 nt, Human
ucuggcccaucuucugccacca

SEQ ID NO: 332462 - RNA, 22 nt, Human
ugguccagacuuugaccucuca

SEQ ID NO: 332463 - RNA, 22 nt, Human
gauggugcaggugaagugcugg

SEQ ID NO: 332464 - RNA, 22 nt, Human
gugcaggugguuggcccagccg

SEQ ID NO: 332465 - RNA, 22 nt, Human
cugagcugcucccgcugcagcg

SEQ ID NO: 332466 - RNA, 22 nt, Human
ugagcucaagcaauucacccgc

SEQ ID NO: 332467 - RNA, 22 nt, Human
uugaacaguuuugucagguuca

SEQ ID NO: 332468 - RNA, 22 nt, Human
aggccugggacgggagccguga

SEQ ID NO: 332469 - RNA, 22 nt, Human
gggucugcuccaccugcagccc

SEQ ID NO: 332470 - RNA, 22 nt, Human
ugcagcugccuagggcuggcuu

SEQ ID NO: 332471 - RNA, 18 nt, Human
gguccugggccuggcuca

SEQ ID NO: 332472 - RNA, 22 nt, Human
ccuaggccgcccggugcguggg

SEQ ID NO: 332473 - RNA, 22 nt, Human
cuggaaggagcccgggcggauc

SEQ ID NO: 332474 - RNA, 21 nt, Human
gggcuggauauuggaaagagg

SEQ ID NO: 332475 - RNA, 22 nt, Human
ggcaguggcuccucucuacucc

SEQ ID NO: 332476 - RNA, 22 nt, Human
uugaguuuccugacagcgaagg

SEQ ID NO: 332477 - RNA, 22 nt, Human
augcccugggagugcuguacca

SEQ ID NO: 332478 - RNA, 23 nt, Human
uggcucugagcuuccugguggcc

SEQ ID NO: 332479 - RNA, 22 nt, Human
gaggcaaagcauguggcucagg

SEQ ID NO: 332480 - RNA, 22 nt, Human
uggggcuccuccuggcaggagg

SEQ ID NO: 332481 - RNA, 22 nt, Human
aggcggguuuaggacaaugcuu

SEQ ID NO: 332482 - RNA, 22 nt, Human
gggcugagggguaucucauggg

SEQ ID NO: 332483 - RNA, 22 nt, Human
gggcucaucaagccucuccgcc

SEQ ID NO: 332484 - RNA, 22 nt, Human
ccuggagacccacuucugccaa

SEQ ID NO: 332485 - RNA, 22 nt, Human
acagcaucccugaagauaacca

SEQ ID NO: 332486 - RNA, 22 nt, Human
uugaugagaccauugccgcguc

SEQ ID NO: 332487 - RNA, 22 nt, Human
uugcaggucuggggguccuggu

SEQ ID NO: 332488 - RNA, 22 nt, Human
cagugcagccaaggacaggcac

SEQ ID NO: 332489 - RNA, 22 nt, Human
gggcggggcuuccguccuccac

SEQ ID NO: 332490 - RNA, 22 nt, Human
uggaucugcucuaugaacugcu

SEQ ID NO: 332491 - RNA, 22 nt, Human
ucucgugcaggccuugcucgga

SEQ ID NO: 332492 - RNA, 22 nt, Human
gagaugugucagguccuggggg

SEQ ID NO: 332493 - RNA, 22 nt, Human
ugccaggcugcccuccagucug

SEQ ID NO: 332494 - RNA, 22 nt, Human
cggggccuagucuaccucggca

SEQ ID NO: 332495 - RNA, 20 nt, Human
ucagugggaaagugagagug

SEQ ID NO: 332496 - RNA, 22 nt, Human
uuguugcugcucaaccucuaua

SEQ ID NO: 332497 - RNA, 22 nt, Human
ccagcagcgauagggugagugc

SEQ ID NO: 332498 - RNA, 22 nt, Human
uuucugugauaggcugcgacgc

SEQ ID NO: 332499 - RNA, 22 nt, Human
ucugcuggaaaaccagggaauu

SEQ ID NO: 332500 - RNA, 22 nt, Human
cugggcuguuuguucuggucuc

SEQ ID NO: 332501 - RNA, 22 nt, Human
gcagauggauguggacggcgcc

SEQ ID NO: 332502 - RNA, 22 nt, Human
agcaccaggucgcuggcacgcu

SEQ ID NO: 332503 - RNA, 22 nt, Human
gugcugccuccauauccgucag

SEQ ID NO: 332504 - RNA, 22 nt, Human
ugccuguggaaaggcuggugcu

SEQ ID NO: 332505 - RNA, 22 nt, Human
ccuggguccaauucuggcuugu

SEQ ID NO: 332506 - RNA, 22 nt, Human
gucuggagccacugcugcugcu

SEQ ID NO: 332507 - RNA, 22 nt, Human
aaauugcaaaaguacuuuuagg

SEQ ID NO: 332508 - RNA, 19 nt, Human
cuccacagggauugugauu

SEQ ID NO: 332509 - RNA, 21 nt, Human
gcaggguuugugcugugaguu

SEQ ID NO: 332510 - RNA, 22 nt, Human
gugggggcaggcagugcuagga

SEQ ID NO: 332511 - RNA, 22 nt, Human
uccugcagccauuagaggucaa

SEQ ID NO: 332512 - RNA, 22 nt, Human
uguucauucugugaccugguuc

SEQ ID NO: 332513 - RNA, 22 nt, Human
cuggccagccucccagguaccc

SEQ ID NO: 332514 - RNA, 22 nt, Human
gauugcugccagcguguccgug

SEQ ID NO: 332515 - RNA, 22 nt, Human
caauuaccaguaauugagguuu

SEQ ID NO: 332516 - RNA, 22 nt, Human
ggagaguggauuccagcuguau

SEQ ID NO: 332517 - RNA, 22 nt, Human
cugcuguguggauucaauggcu

SEQ ID NO: 332518 - RNA, 22 nt, Human
ggagaugccuuguuucaggaac

SEQ ID NO: 332519 - RNA, 22 nt, Human
aggcugcugccuuggagagugu

SEQ ID NO: 332520 - RNA, 19 nt, Human
uccugcccaccagccaggg

SEQ ID NO: 332521 - RNA, 22 nt, Human
gagcuccugaaacguuccugcc

SEQ ID NO: 332522 - RNA, 22 nt, Human
gcuuccuucuaccacaucaugc

SEQ ID NO: 332523 - RNA, 22 nt, Human
gacggagcugguugcugcggcu

SEQ ID NO: 332524 - RNA, 22 nt, Human
gcagcucucuggccugcccugg

SEQ ID NO: 332525 - RNA, 22 nt, Human
ucaggaugagucaucaagcugc

SEQ ID NO: 332526 - RNA, 22 nt, Human
ucccagugggaagcagcacgcu

SEQ ID NO: 332527 - RNA, 22 nt, Human
ucugccaucaagaugcucuggc

SEQ ID NO: 332528 - RNA, 22 nt, Human
gcccagcugcacccuggugggu

SEQ ID NO: 332529 - RNA, 22 nt, Human
uggguguguccauauuuugacu

SEQ ID NO: 332530 - RNA, 22 nt, Human
uauuuguuucuaguggcagcaa

SEQ ID NO: 332531 - RNA, 20 nt, Human
cgggacacucaagcucuggg

SEQ ID NO: 332532 - RNA, 22 nt, Human
gcugcuccgcagagugugugug

SEQ ID NO: 332533 - RNA, 17 nt, Human
gccuggcccagccuggc

SEQ ID NO: 332534 - RNA, 22 nt, Human
gcggggggcaggcaguacguug

SEQ ID NO: 332535 - RNA, 22 nt, Human
uggcccugccgccacgacgucu

SEQ ID NO: 332536 - RNA, 22 nt, Human
uggcuggcuguccagcugggca

SEQ ID NO: 332537 - RNA, 22 nt, Human
cuagcagcauucuucuaguuag

SEQ ID NO: 332538 - RNA, 22 nt, Human
auggauggaacucugcuguggu

SEQ ID NO: 332539 - RNA, 22 nt, Human
ucccgggcaggucgagcgagcc

SEQ ID NO: 332540 - RNA, 23 nt, Human
guguggccccagggccuccucgc

SEQ ID NO: 332541 - RNA, 22 nt, Human
acugagggacucccaccuggca

SEQ ID NO: 332542 - RNA, 22 nt, Human
cauagacauugauagguuauau

SEQ ID NO: 332543 - RNA, 22 nt, Human
uggcuggggccugaauccugca

SEQ ID NO: 332544 - RNA, 20 nt, Human
cagagccaggguuuuguuuu

SEQ ID NO: 332545 - RNA, 19 nt, Human
gggugaggaagagcguugc

SEQ ID NO: 332546 - RNA, 22 nt, Human
ccugguccccaucggcccagcg

SEQ ID NO: 332547 - RNA, 22 nt, Human
uucuccucagcaaggcagcuuu

SEQ ID NO: 332548 - RNA, 21 nt, Human
acauguccccuaugcuuaagg

SEQ ID NO: 332549 - RNA, 22 nt, Human
gcugaagagagaugcguccagc

SEQ ID NO: 332550 - RNA, 22 nt, Human
caugggcucuucuggacugcac

SEQ ID NO: 332551 - RNA, 22 nt, Human
acaaagugaaaagcaucgaauu

SEQ ID NO: 332552 - RNA, 22 nt, Human
caguauuuaggauuaggagaga

SEQ ID NO: 332553 - RNA, 22 nt, Human
gaggugaguggggucuccaggg

SEQ ID NO: 332554 - RNA, 22 nt, Human
aguccagggcuuagucagcggg

SEQ ID NO: 332555 - RNA, 22 nt, Human
gggagcuggagcuggaagacuc

SEQ ID NO: 332556 - RNA, 17 nt, Human
ucugccaguuuuagaau

SEQ ID NO: 332557 - RNA, 22 nt, Human
ggcuuucugucugcgucugugu

SEQ ID NO: 332558 - RNA, 22 nt, Human
gagguggcugcuugcugggaaa

SEQ ID NO: 332559 - RNA, 22 nt, Human
acaggcgcacaugagggccgug

SEQ ID NO: 332560 - RNA, 22 nt, Human
gcaggccugucuugcucgcccu

SEQ ID NO: 332561 - RNA, 22 nt, Human
gguuccaggcauggcaggaugu

SEQ ID NO: 332562 - RNA, 22 nt, Human
uuucuuggucuucccgaccugg

SEQ ID NO: 332563 - RNA, 22 nt, Human
aggccagaacagcucugcacca

SEQ ID NO: 332564 - RNA, 22 nt, Human
cgugcggccucggggcccggcu

SEQ ID NO: 332565 - RNA, 22 nt, Human
uguccuguccuuccuggaaguc

SEQ ID NO: 332566 - RNA, 22 nt, Human
ggcgcucaguguugccccagag

SEQ ID NO: 332567 - RNA, 22 nt, Human
aggagccauugcaggauggcag

SEQ ID NO: 332568 - RNA, 22 nt, Human
cagugcugcaggcgccugcggu

SEQ ID NO: 332569 - RNA, 22 nt, Human
cgcgcugcagacagcggaggcc

SEQ ID NO: 332570 - RNA, 19 nt, Human
cccagaggaaugccuggaa

SEQ ID NO: 332571 - RNA, 22 nt, Human
augguuuuguccucuuugguuc

SEQ ID NO: 332572 - RNA, 22 nt, Human
ucccacagcuucgugcuucccc

SEQ ID NO: 332573 - RNA, 22 nt, Human
aggacagcagugcuggcacuug

SEQ ID NO: 332574 - RNA, 22 nt, Human
ccagcuugcuccucugcaaugg

SEQ ID NO: 332575 - RNA, 22 nt, Human
caggugggagccacagcguaca

SEQ ID NO: 332576 - RNA, 22 nt, Human
cccaggaguaagugacauuguu

SEQ ID NO: 332577 - RNA, 22 nt, Human
cauggccagauucuuucuucuc

SEQ ID NO: 332578 - RNA, 22 nt, Human
acuguagucuaaauauagucuu

SEQ ID NO: 332579 - RNA, 22 nt, Human
cugggaggcggagguuguagug

SEQ ID NO: 332580 - RNA, 22 nt, Human
gugcuuccuguauugauuccau

SEQ ID NO: 332581 - RNA, 22 nt, Human
uggagugcaguugggaggacac

SEQ ID NO: 332582 - RNA, 22 nt, Human
cucuccaggcgagguccuacug

SEQ ID NO: 332583 - RNA, 22 nt, Human
ccuugcagcauauagagucccu

SEQ ID NO: 332584 - RNA, 20 nt, Human
gcucagggccugggucugga

SEQ ID NO: 332585 - RNA, 22 nt, Human
cuccaggacugaggacagagcu

SEQ ID NO: 332586 - RNA, 22 nt, Human
uguucugcaaugcugccuccuu

SEQ ID NO: 332587 - RNA, 17 nt, Human
ggugaguguccaggugg

SEQ ID NO: 332588 - RNA, 22 nt, Human
guggcauuugggagaugcgugg

SEQ ID NO: 332589 - RNA, 22 nt, Human
gugccuccaggcucgacuaguc

SEQ ID NO: 332590 - RNA, 21 nt, Human
uggcaggcagcuggaagcuug

SEQ ID NO: 332591 - RNA, 22 nt, Human
ggguucagugaugccuucagga

SEQ ID NO: 332592 - RNA, 22 nt, Human
ggggagaguauuuuauucaagu

SEQ ID NO: 332593 - RNA, 22 nt, Human
gggaggaaggcuugggugagua

SEQ ID NO: 332594 - RNA, 23 nt, Human
ugaaagcaaugggucuauaguau

SEQ ID NO: 332595 - RNA, 22 nt, Human
cuggagcuggcccaggcuggcc

SEQ ID NO: 332596 - RNA, 22 nt, Human
cuucacugcagucauggcucug

SEQ ID NO: 332597 - RNA, 22 nt, Human
gucagcaggguccccuugagug

SEQ ID NO: 332598 - RNA, 23 nt, Human
ggucccaguggagaggccucacc

SEQ ID NO: 332599 - RNA, 22 nt, Human
cacuguugagcaauguacagug

SEQ ID NO: 332600 - RNA, 22 nt, Human
aaugaaacuauauuuagagagg

SEQ ID NO: 332601 - RNA, 18 nt, Human
uccaccgcgugcaccucu

SEQ ID NO: 332602 - RNA, 22 nt, Human
auuccucagcaggccuuuuguu

SEQ ID NO: 332603 - RNA, 17 nt, Human
gcaggcacugcugccug

SEQ ID NO: 332604 - RNA, 22 nt, Human
gagccucguggcggccacugcg

SEQ ID NO: 332605 - RNA, 22 nt, Human
cagaggccccauuggcugugcg

SEQ ID NO: 332606 - RNA, 22 nt, Human
gccaccagccccaugcgcugug

SEQ ID NO: 332607 - RNA, 23 nt, Human
aggcugcagaagaauagggucau

SEQ ID NO: 332608 - RNA, 22 nt, Human
cggucaggugcagcguuggcac

SEQ ID NO: 332609 - RNA, 22 nt, Human
cugagcagaagggugcacgugc

SEQ ID NO: 332610 - RNA, 22 nt, Human
ugcccugcagacccugcagugu

SEQ ID NO: 332611 - RNA, 22 nt, Human
ccuccugggccuugcucuguga

SEQ ID NO: 332612 - RNA, 22 nt, Human
cuggccuggcaggggaccucua

SEQ ID NO: 332613 - RNA, 22 nt, Human
agccacugugugaccagcuguc

SEQ ID NO: 332614 - RNA, 20 nt, Human
ucucccugcccaucucagau

SEQ ID NO: 332615 - RNA, 22 nt, Human
ugucccuggacuccaggagcca

SEQ ID NO: 332616 - RNA, 22 nt, Human
gcugacugguucaggucccgcu

SEQ ID NO: 332617 - RNA, 22 nt, Human
acggccgaugacuccagcaugg

SEQ ID NO: 332618 - RNA, 22 nt, Human
ugcuggaagggucggcgugggc

SEQ ID NO: 332619 - RNA, 22 nt, Human
agcaggaggagagccuggcggu

SEQ ID NO: 332620 - RNA, 22 nt, Human
uggucaggcugcucugcggcgu

SEQ ID NO: 332621 - RNA, 22 nt, Human
uuuccaaggaugugucucucua

SEQ ID NO: 332622 - RNA, 22 nt, Human
aaaccggguccagaucuucagg

SEQ ID NO: 332623 - RNA, 22 nt, Human
gcuguggcuccaauggugagcc

SEQ ID NO: 332624 - RNA, 22 nt, Human
ugcugcccacuguauuucucca

SEQ ID NO: 332625 - RNA, 20 nt, Human
auacuuguuuucaggcuuuu

SEQ ID NO: 332626 - RNA, 22 nt, Human
ccugugguuuacucuguggcua

SEQ ID NO: 332627 - RNA, 22 nt, Human
guggcauuuuagaacagcugac

SEQ ID NO: 332628 - RNA, 22 nt, Human
aaagcacauuacaagcucaguc

SEQ ID NO: 332629 - RNA, 22 nt, Human
gguguugcaguugaagacuggu

SEQ ID NO: 332630 - RNA, 22 nt, Human
ggugugucugccaggaacugca

SEQ ID NO: 332631 - RNA, 22 nt, Human
gccuggggaacuugauccuguc

SEQ ID NO: 332632 - RNA, 22 nt, Human
cugggaccugugugccugggcc

SEQ ID NO: 332633 - RNA, 20 nt, Human
agcuuugguuaagccagugg

SEQ ID NO: 332634 - RNA, 22 nt, Human
ugcaaaaagagcgaggagcccu

SEQ ID NO: 332635 - RNA, 22 nt, Human
gugcuggcuggggcaucaggca

SEQ ID NO: 332636 - RNA, 22 nt, Human
ccuggccauagggcccaggaaa

SEQ ID NO: 332637 - RNA, 19 nt, Human
uaugacaaguacuaguucu

SEQ ID NO: 332638 - RNA, 22 nt, Human
cagcuccaucuugcuuauacca

SEQ ID NO: 332639 - RNA, 22 nt, Human
guuuccaagucucucaacaccc

SEQ ID NO: 332640 - RNA, 22 nt, Human
ggcggcgcguagccggagacuu

SEQ ID NO: 332641 - RNA, 22 nt, Human
acagacacaggcguggagucgc

SEQ ID NO: 332642 - RNA, 22 nt, Human
ucccugccuccuggcagugcca

SEQ ID NO: 332643 - RNA, 22 nt, Human
cuugccagggacucagucaggg

SEQ ID NO: 332644 - RNA, 22 nt, Human
gagcagcagcugggccagguuc

SEQ ID NO: 332645 - RNA, 20 nt, Human
ucuggggaugaggucuagga

SEQ ID NO: 332646 - RNA, 22 nt, Human
augcaucaccgaguugcccacc

SEQ ID NO: 332647 - RNA, 22 nt, Human
ucuccucuccuuucauguuguu

SEQ ID NO: 332648 - RNA, 22 nt, Human
aaggaucauguauauguuuaag

SEQ ID NO: 332649 - RNA, 21 nt, Human
agcugugguuuuacaucuuuu

SEQ ID NO: 332650 - RNA, 22 nt, Human
uccagguccuacuggcccauag

SEQ ID NO: 332651 - RNA, 22 nt, Human
gugggcaucuccuuggaagcca

SEQ ID NO: 332652 - RNA, 22 nt, Human
ggugggucuuguggggcagcuu

SEQ ID NO: 332653 - RNA, 22 nt, Human
ccgcuguccuggagcugcugcu

SEQ ID NO: 332654 - RNA, 22 nt, Human
cagcugcuguucaguuuuguuu

SEQ ID NO: 332655 - RNA, 22 nt, Human
ugcagggcagcuagggagcuuu

SEQ ID NO: 332656 - RNA, 22 nt, Human
ucaucaucauucucccccacuu

SEQ ID NO: 332657 - RNA, 22 nt, Human
acaugcacccaguuacacucuc

SEQ ID NO: 332658 - RNA, 22 nt, Human
cugagaggcacaaggcauuucg

SEQ ID NO: 332659 - RNA, 22 nt, Human
auauggcuguugcacaucuaag

SEQ ID NO: 332660 - RNA, 22 nt, Human
gcccagcugagaagcgcggggc

SEQ ID NO: 332661 - RNA, 22 nt, Human
gagcaccgccuccacgaugccc

SEQ ID NO: 332662 - RNA, 22 nt, Human
ugcugaggagguggcugugcuu

SEQ ID NO: 332663 - RNA, 21 nt, Human
uugcuguuuucccaaugcagu

SEQ ID NO: 332664 - RNA, 22 nt, Human
cuccugcagcccucagcagcca

SEQ ID NO: 332665 - RNA, 22 nt, Human
ggucuggccuccgggcaggugg

SEQ ID NO: 332666 - RNA, 22 nt, Human
gcucuccacugaccacggggca

SEQ ID NO: 332667 - RNA, 22 nt, Human
ucucugccacagcuucugccuu

SEQ ID NO: 332668 - RNA, 22 nt, Human
uggaagggguuacgcagcagga

SEQ ID NO: 332669 - RNA, 22 nt, Human
gguuguaguuggagguuguaua

SEQ ID NO: 332670 - RNA, 20 nt, Human
ucauccaguugguuuauggu

SEQ ID NO: 332671 - RNA, 22 nt, Human
cagagccacugucugccaggca

SEQ ID NO: 332672 - RNA, 22 nt, Human
aagcagcacagcaaugacucua

SEQ ID NO: 332673 - RNA, 22 nt, Human
uagcugcuugaccaggcagugg

SEQ ID NO: 332674 - RNA, 22 nt, Human
aggcucucucugccagccgugc

SEQ ID NO: 332675 - RNA, 21 nt, Human
gcuggcugucucuuacacggu

SEQ ID NO: 332676 - RNA, 22 nt, Human
uuauugcuaugaugauguguag

SEQ ID NO: 332677 - RNA, 20 nt, Human
acguggccaccaguggcuua

SEQ ID NO: 332678 - RNA, 22 nt, Human
ucuugccgcgcaggcgcaguuc

SEQ ID NO: 332679 - RNA, 22 nt, Human
cuggccucacagaggcuaagcc

SEQ ID NO: 332680 - RNA, 22 nt, Human
gaacuuuaauuagcuuuugucu

SEQ ID NO: 332681 - RNA, 20 nt, Human
ggucacuguggcugcaggau

SEQ ID NO: 332682 - RNA, 20 nt, Human
aggaaggagaaucugagcaa

SEQ ID NO: 332683 - RNA, 22 nt, Human
ucggugcgcgaggcgcgguccc

SEQ ID NO: 332684 - RNA, 22 nt, Human
uaguggguuuauacaauuuaaa

SEQ ID NO: 332685 - RNA, 22 nt, Human
ugcuccaucuagagcucugcag

SEQ ID NO: 332686 - RNA, 22 nt, Human
acagcuggccgaggcucaggga

SEQ ID NO: 332687 - RNA, 22 nt, Human
aaggaggaauguagccagcucc

SEQ ID NO: 332688 - RNA, 22 nt, Human
uuggccguuucacugggcaguu

SEQ ID NO: 332689 - RNA, 17 nt, Human
gcccgugggcuacggua

SEQ ID NO: 332690 - RNA, 22 nt, Human
ugcccauggcaggauuucugaa

SEQ ID NO: 332691 - RNA, 22 nt, Human
ggugcggagacuccaugaggcc

SEQ ID NO: 332692 - RNA, 22 nt, Human
ugcuggaguggcacuguguggc

SEQ ID NO: 332693 - RNA, 22 nt, Human
ccaggaugacccccacuuuccu

SEQ ID NO: 332694 - RNA, 22 nt, Human
uuggcgcccaggacgccgccgc

SEQ ID NO: 332695 - RNA, 22 nt, Human
agcuccacucccugccuguuuc

SEQ ID NO: 332696 - RNA, 22 nt, Human
ugaggaaugugacaaaaccaag

SEQ ID NO: 332697 - RNA, 22 nt, Human
uuugcaaaguccauugaaguua

SEQ ID NO: 332698 - RNA, 20 nt, Human
caucaacaccuugucagccu

SEQ ID NO: 332699 - RNA, 22 nt, Human
cugggcuccuaaccauccaggu

SEQ ID NO: 332700 - RNA, 22 nt, Human
acaugcacagcaagggugagag

SEQ ID NO: 332701 - RNA, 22 nt, Human
caugcuggucagccaguggaug

SEQ ID NO: 332702 - RNA, 22 nt, Human
aagaguggagcuggaaaguggg

SEQ ID NO: 332703 - RNA, 22 nt, Human
ggauguggaccuugccugguga

SEQ ID NO: 332704 - RNA, 22 nt, Human
gagcuccuauggucgguggcuc

SEQ ID NO: 332705 - RNA, 22 nt, Human
cgcugggcgcgcuccgaacccg

SEQ ID NO: 332706 - RNA, 20 nt, Human
agcuggcccccgguggccug

SEQ ID NO: 332707 - RNA, 22 nt, Human
gcaccgagaaggaagcaugccu

SEQ ID NO: 332708 - RNA, 22 nt, Human
ggcgagcaugagucacucuggg

SEQ ID NO: 332709 - RNA, 22 nt, Human
gcuuccaaugcuucuaucacau

SEQ ID NO: 332710 - RNA, 22 nt, Human
ggccgcggauuuucccgcuggc

SEQ ID NO: 332711 - RNA, 22 nt, Human
gacgugggucgccaucgauaug

SEQ ID NO: 332712 - RNA, 22 nt, Human
ugucugccugcgggccggcaca

SEQ ID NO: 332713 - RNA, 20 nt, Human
ggacccuggguucuucugag

SEQ ID NO: 332714 - RNA, 22 nt, Human
gcggcgccugggacccgccagc

SEQ ID NO: 332715 - RNA, 22 nt, Human
gcugggcaggccucgugagggc

SEQ ID NO: 332716 - RNA, 22 nt, Human
acuggcaguagagggagcgcau

SEQ ID NO: 332717 - RNA, 22 nt, Human
uccuggcaaagauguugguguu

SEQ ID NO: 332718 - RNA, 22 nt, Human
cuggugcuguagccugauugag

SEQ ID NO: 332719 - RNA, 22 nt, Human
aagcuggccuguaccugcugag

SEQ ID NO: 332720 - RNA, 22 nt, Human
gcggcuccgaagccaggccgcg

SEQ ID NO: 332721 - RNA, 21 nt, Human
uccuccuguagaggguccugg

SEQ ID NO: 332722 - RNA, 23 nt, Human
cauuugauccucacaauaaaugg

SEQ ID NO: 332723 - RNA, 22 nt, Human
cuugucugcuauaaaaauccag

SEQ ID NO: 332724 - RNA, 22 nt, Human
gccagagggauuccuggugugu

SEQ ID NO: 332725 - RNA, 21 nt, Human
uccugcugagaaacagauggu

SEQ ID NO: 332726 - RNA, 22 nt, Human
gccacaggaaagcacccuggag

SEQ ID NO: 332727 - RNA, 22 nt, Human
uggaaggggccaggcgcggagu

SEQ ID NO: 332728 - RNA, 22 nt, Human
aucuucaaagcacaucguuugu

SEQ ID NO: 332729 - RNA, 22 nt, Human
gcagaggggaagcugaggaauu

SEQ ID NO: 332730 - RNA, 22 nt, Human
gggagcugagcuggaagagaau

SEQ ID NO: 332731 - RNA, 22 nt, Human
ugggugguugcugaggcuccuu

SEQ ID NO: 332732 - RNA, 22 nt, Human
ccaggcccugccugugguuccu

SEQ ID NO: 332733 - RNA, 22 nt, Human
gagcucagccugaggccuggcu

SEQ ID NO: 332734 - RNA, 22 nt, Human
gcucgcuuagauuuuccucuga

SEQ ID NO: 332735 - RNA, 22 nt, Human
aagccgggccugagaaaugaca

SEQ ID NO: 332736 - RNA, 22 nt, Human
ggccagccuggggcucccagac

SEQ ID NO: 332737 - RNA, 23 nt, Human
caccccacccugaggaggaggga

SEQ ID NO: 332738 - RNA, 22 nt, Human
uucugauuguuggaggaugcuu

SEQ ID NO: 332739 - RNA, 22 nt, Human
auguucaaguaccuuugugucu

SEQ ID NO: 332740 - RNA, 22 nt, Human
cucugggguggaggaggcugac

SEQ ID NO: 332741 - RNA, 22 nt, Human
cccacugcugcucuccauggca

SEQ ID NO: 332742 - RNA, 22 nt, Human
uccaggagugauaaggccacug

SEQ ID NO: 332743 - RNA, 22 nt, Human
uauggcuucugggccaaauuua

SEQ ID NO: 332744 - RNA, 22 nt, Human
ggcacagcugaugcagacacac

SEQ ID NO: 332745 - RNA, 22 nt, Human
ccugggcugcucauggggauga

SEQ ID NO: 332746 - RNA, 22 nt, Human
augcccagaacccccuggaugg

SEQ ID NO: 332747 - RNA, 22 nt, Human
ucuccuggcauuugguugagua

SEQ ID NO: 332748 - RNA, 22 nt, Human
acccugccucugcuuccuguag

SEQ ID NO: 332749 - RNA, 22 nt, Human
acaagauagcuuagaagauuca

SEQ ID NO: 332750 - RNA, 22 nt, Human
cacauuggcaaacgggguugca

SEQ ID NO: 332751 - RNA, 22 nt, Human
ucugggccggagccgacggcag

SEQ ID NO: 332752 - RNA, 23 nt, Human
uggggcugauggagacggaccag

SEQ ID NO: 332753 - RNA, 22 nt, Human
gaggaggcuuccgggaggcacg

SEQ ID NO: 332754 - RNA, 22 nt, Human
gugcugcagagucucgugccgc

SEQ ID NO: 332755 - RNA, 22 nt, Human
uaaagcauguuucaguaagguu

SEQ ID NO: 332756 - RNA, 22 nt, Human
cagaguccugcaccagcuccag

SEQ ID NO: 332757 - RNA, 22 nt, Human
ccauggccugaaggagugcauc

SEQ ID NO: 332758 - RNA, 22 nt, Human
gcugguggcagagcuccgcggc

SEQ ID NO: 332759 - RNA, 22 nt, Human
gguggcagaggugcaucagccc

SEQ ID NO: 332760 - RNA, 22 nt, Human
gcagcugcgaagaagucuaucu

SEQ ID NO: 332761 - RNA, 19 nt, Human
gcuuccagcacugcaggag

SEQ ID NO: 332762 - RNA, 22 nt, Human
agggccagcagcuuggccaacc

SEQ ID NO: 332763 - RNA, 22 nt, Human
guccuggugccaccugcgggau

SEQ ID NO: 332764 - RNA, 22 nt, Human
gccugcacucaaacacucucuu

SEQ ID NO: 332765 - RNA, 21 nt, Human
ugcuccaggagggggcagucc

SEQ ID NO: 332766 - RNA, 22 nt, Human
cugggguuggccagggcccuag

SEQ ID NO: 332767 - RNA, 22 nt, Human
cuggccagggugcgaucguggu

SEQ ID NO: 332768 - RNA, 22 nt, Human
auccgggguucauuuucacuga

SEQ ID NO: 332769 - RNA, 22 nt, Human
ggcgcaguugagcgugcuguuc

SEQ ID NO: 332770 - RNA, 22 nt, Human
gcucugugcaguucagggacac

SEQ ID NO: 332771 - RNA, 22 nt, Human
gguucaguggaauguguugacc

SEQ ID NO: 332772 - RNA, 22 nt, Human
gucauuuuugacuuugaaguga

SEQ ID NO: 332773 - RNA, 22 nt, Human
cgaggagugugaaggcuugucg

SEQ ID NO: 332774 - RNA, 22 nt, Human
uucuuggcacagaugagauucu

SEQ ID NO: 332775 - RNA, 22 nt, Human
gcacuucaccacuguccugguu

SEQ ID NO: 332776 - RNA, 22 nt, Human
cagcuccagccaccggggggug

SEQ ID NO: 332777 - RNA, 22 nt, Human
ucccacugucuucucgugcucg

SEQ ID NO: 332778 - RNA, 22 nt, Human
ugcuccugaacacagcccuaug

SEQ ID NO: 332779 - RNA, 22 nt, Human
gaguggggcccacugcugggug

SEQ ID NO: 332780 - RNA, 22 nt, Human
gggcagcaucaggaggggcuuu

SEQ ID NO: 332781 - RNA, 22 nt, Human
cucugccagccaaagucaucac

SEQ ID NO: 332782 - RNA, 22 nt, Human
agaauccuggagaagcuguacc

SEQ ID NO: 332783 - RNA, 22 nt, Human
gaccaggagauuugagcuaggc

SEQ ID NO: 332784 - RNA, 22 nt, Human
ugcccuggcuccucccacgcug

SEQ ID NO: 332785 - RNA, 22 nt, Human
uguccugugcacuguagcaugu

SEQ ID NO: 332786 - RNA, 22 nt, Human
guucugucugagcaccacagga

SEQ ID NO: 332787 - RNA, 22 nt, Human adenovirus E
ccgugggcaucaugcugaggga

SEQ ID NO: 332788 - RNA, 22 nt, Human adenovirus E
uuucaguauguggaaucaggcg

SEQ ID NO: 332789 - RNA, 22 nt, Human adenovirus E
gugauuuccccguucuuggugg

SEQ ID NO: 332790 - RNA, 22 nt, Human adenovirus E
cccgaggaaucgagguccaccc

SEQ ID NO: 332791 - RNA, 21 nt, Human adenovirus E
cccugagcagcagcuugacgg

SEQ ID NO: 332792 - RNA, 22 nt, Human adenovirus E
ccgcgucugcuccugcagcuga

SEQ ID NO: 332793 - RNA, 22 nt, Human adenovirus E
ccgugggcaucaugcugaggga

SEQ ID NO: 332794 - RNA, 22 nt, Human adenovirus E
ccugaagagguagugcagguuc

SEQ ID NO: 332795 - RNA, 22 nt, Human adenovirus E
ccucgggcucggugauauucag

SEQ ID NO: 332796 - RNA, 22 nt, Human adenovirus E
accugguggacaacaagucggc

SEQ ID NO: 332797 - RNA, 23 nt, Human adenovirus E
ucagcucgcccaggcgcuggguc

SEQ ID NO: 332798 - RNA, 22 nt, Human adenovirus E
gaggacgacggucuggcggcgg

SEQ ID NO: 332799 - RNA, 22 nt, Human adenovirus E
cgcuggcuccuggaccugguga

SEQ ID NO: 332800 - RNA, 22 nt, Human adenovirus E
cgccucagcaaccugcugggca

SEQ ID NO: 332801 - RNA, 22 nt, Human adenovirus E
ccugcaagaucuccaacgugga

SEQ ID NO: 332802 - RNA, 20 nt, Human adenovirus E
caucguggugcaggagcgcg

SEQ ID NO: 332803 - RNA, 22 nt, Human adenovirus E
cagaauguucaccagguccagg

SEQ ID NO: 332804 - RNA, 22 nt, Human adenovirus E
ggagaucuugcaggccuggcgc

SEQ ID NO: 332805 - RNA, 22 nt, Human
ugggcaccuagcaacccuucuc

SEQ ID NO: 332806 - RNA, 22 nt, Human
ccuggggucagggacgcugugc

SEQ ID NO: 332807 - RNA, 22 nt, Human
ccuggagcacauggcaggaggc

SEQ ID NO: 332808 - RNA, 22 nt, Human
agcuggggguagugagaaauaa

SEQ ID NO: 332809 - RNA, 22 nt, Human
caauacaauuaccaguuaauca

SEQ ID NO: 332810 - RNA, 22 nt, Human
ucugggguuuucacgcugucuc

SEQ ID NO: 332811 - RNA, 22 nt, Human
gcuuccuggagggagagagcug

SEQ ID NO: 332812 - RNA, 22 nt, Human
cugggcuuguguuagcugacaa

SEQ ID NO: 332813 - RNA, 22 nt, Human
uuuacugaacugcuaguacagg

SEQ ID NO: 332814 - RNA, 22 nt, Human
ccuguccagggacugagggaga

SEQ ID NO: 332815 - RNA, 22 nt, Human
agcccugugggccuuguggcac

SEQ ID NO: 332816 - RNA, 22 nt, Human
uagcugggaauuaucugguugc

SEQ ID NO: 332817 - RNA, 22 nt, Human
agagcuggcacugacccucacc

SEQ ID NO: 332818 - RNA, 22 nt, Human
cccugugggguccgccuguccg

SEQ ID NO: 332819 - RNA, 22 nt, Human
cugggauccacgggcucccaag

SEQ ID NO: 332820 - RNA, 22 nt, Human
ggcauccugggacuggcuucuu

SEQ ID NO: 332821 - RNA, 22 nt, Human
uccuguggcucuguggaaccuu

SEQ ID NO: 332822 - RNA, 22 nt, Human
uccugcaggggcugaggaacca

SEQ ID NO: 332823 - RNA, 22 nt, Human
agagcuggaagcugcucuuaga

SEQ ID NO: 332824 - RNA, 22 nt, Human
uccugguggugccggugcccgg

SEQ ID NO: 332825 - RNA, 22 nt, Human
agguggcagagugacaggcuga

SEQ ID NO: 332826 - RNA, 22 nt, Human
gauaauauuagaagauacaaau

SEQ ID NO: 332827 - RNA, 22 nt, Human
gagcugggaguuauagcauguu

SEQ ID NO: 332828 - RNA, 22 nt, Human
gcagagcugggauaugaaccca

SEQ ID NO: 332829 - RNA, 22 nt, Human
augccuggucccaccucuaggu

SEQ ID NO: 332830 - RNA, 22 nt, Human
gcagagcuucuguccuucagga

SEQ ID NO: 332831 - RNA, 22 nt, Human
ggcagagccuucuggagcucgc

SEQ ID NO: 332832 - RNA, 22 nt, Human
uuucagaucacuuucaggaaag

SEQ ID NO: 332833 - RNA, 22 nt, Human
ccugacagcgugucccuggccc

SEQ ID NO: 332834 - RNA, 22 nt, Human
ggcaucccuucuuccaguguca

SEQ ID NO: 332835 - RNA, 22 nt, Human
ccuggugaauguucauggacug

SEQ ID NO: 332836 - RNA, 22 nt, Human
caccaggcugcccaggacaggg

SEQ ID NO: 332837 - RNA, 22 nt, Human
gcuuggggagcucaguguccuu

SEQ ID NO: 332838 - RNA, 22 nt, Human
gagcuccucccaggguagcacu

SEQ ID NO: 332839 - RNA, 22 nt, Human
ggcaccaggaucagucugucau

SEQ ID NO: 332840 - RNA, 22 nt, Human
uccugcaggccagaggggugag

SEQ ID NO: 332841 - RNA, 22 nt, Human
ccugggcagggagaccaggcuc

SEQ ID NO: 332842 - RNA, 22 nt, Human
gcaggagcugcucuccugacga

SEQ ID NO: 332843 - RNA, 22 nt, Human
gcccaugguuacuuuucuggcu

SEQ ID NO: 332844 - RNA, 23 nt, Human
ccugaagggucaggguccucagc

SEQ ID NO: 332845 - RNA, 22 nt, Human
gcccuuggaacagccuccugcu

SEQ ID NO: 332846 - RNA, 20 nt, Human
uggcaccaggugguggcccc

SEQ ID NO: 332847 - RNA, 22 nt, Human
ugguauucuuucuguagaucau

SEQ ID NO: 332848 - RNA, 20 nt, Human
aggcuccuguaccugaggaa

SEQ ID NO: 332849 - RNA, 22 nt, Human
cugggcuccuaaccauccaggu

SEQ ID NO: 332850 - RNA, 22 nt, Human
ccagcccucgguagucccauag

SEQ ID NO: 332851 - RNA, 22 nt, Human
caccaggcacauaguaggcacu

SEQ ID NO: 332852 - RNA, 22 nt, Human
uagucaaaccucagaauacccc

SEQ ID NO: 332853 - RNA, 22 nt, Human
caccaggcuggagugcagaggu

SEQ ID NO: 332854 - RNA, 22 nt, Human
cugcaggagugaaagcaggccu

SEQ ID NO: 332855 - RNA, 19 nt, Human
gcugggagcagacccuccc

SEQ ID NO: 332856 - RNA, 22 nt, Human
cagccccuuccuggcaucugga

SEQ ID NO: 332857 - RNA, 21 nt, Human
ggcaucccaggccagugacug

SEQ ID NO: 332858 - RNA, 22 nt, Human
cccgucccuuuugcccgcuggu

SEQ ID NO: 332859 - RNA, 22 nt, Human
auauaucaugaguaaaacuuga

SEQ ID NO: 332860 - RNA, 22 nt, Human
cccugcagccuugcaugccuuc

SEQ ID NO: 332861 - RNA, 22 nt, Human
uccugcagagccgcccucaggu

SEQ ID NO: 332862 - RNA, 22 nt, Human
ugaucaaaacauuacuccacca

SEQ ID NO: 332863 - RNA, 22 nt, Human
cacagcugaaguagccaugugg

SEQ ID NO: 332864 - RNA, 22 nt, Human
ccugguggccuucagcccacaa

SEQ ID NO: 332865 - RNA, 22 nt, Human
agagcugggacuuggacucaau

SEQ ID NO: 332866 - RNA, 22 nt, Human
gagcugggagcugggauuugga

SEQ ID NO: 332867 - RNA, 20 nt, Human
ucccugccuuuuacugcugg

SEQ ID NO: 332868 - RNA, 22 nt, Human
cagcuccugcagcuggcuccca

SEQ ID NO: 332869 - RNA, 22 nt, Human
aaguaaaauucaaucuucacug

SEQ ID NO: 332870 - RNA, 22 nt, Human
uucuagauugccuguaaguaaa

SEQ ID NO: 332871 - RNA, 22 nt, Human
gcagagcugcagcgaggccugg

SEQ ID NO: 332872 - RNA, 22 nt, Human
uccacuggcccaccuccucagu

SEQ ID NO: 332873 - RNA, 22 nt, Human
cagggagcucugggccggacuc

SEQ ID NO: 332874 - RNA, 22 nt, Human
agcccugucucucacuccaggu

SEQ ID NO: 332875 - RNA, 22 nt, Human
gcagcaggcuuuucauaccuug

SEQ ID NO: 332876 - RNA, 20 nt, Human
gcugggcuaccacuggcccu

SEQ ID NO: 332877 - RNA, 20 nt, Human
agcuccugguauaggugccu

SEQ ID NO: 332878 - RNA, 22 nt, Human
agcuggggguuggauaagggua

SEQ ID NO: 332879 - RNA, 22 nt, Human
augcugggaaguccuaaccaca

SEQ ID NO: 332880 - RNA, 20 nt, Human
cugggcucaagugauccucc

SEQ ID NO: 332881 - RNA, 22 nt, Human
cugggcuagaaggaccaggaug

SEQ ID NO: 332882 - RNA, 21 nt, Human
gcaaaugaguuaacuaacuca

SEQ ID NO: 332883 - RNA, 22 nt, Human
ccugcagggaaucgaggcagaa

SEQ ID NO: 332884 - RNA, 22 nt, Human
gaggccuggaccagccacagag

SEQ ID NO: 332885 - RNA, 22 nt, Human
agagcuggggcauaaaugccac

SEQ ID NO: 332886 - RNA, 22 nt, Human
ccugguggacagcagccagcag

SEQ ID NO: 332887 - RNA, 20 nt, Human
agggcagcuugaggagccgg

SEQ ID NO: 332888 - RNA, 22 nt, Human
gccccuggcuggccagcuccuc

SEQ ID NO: 332889 - RNA, 20 nt, Human
aagcuggguaggagaggagc

SEQ ID NO: 332890 - RNA, 22 nt, Human
ugcaggagcaccagcucacccu

SEQ ID NO: 332891 - RNA, 22 nt, Human
ccaggcccugccugugguuccu

SEQ ID NO: 332892 - RNA, 22 nt, Human
gaccaggcuuccccagaccuca

SEQ ID NO: 332893 - RNA, 22 nt, Human
ccuggagcaaaaaucuaaggag

SEQ ID NO: 332894 - RNA, 22 nt, Human
cauaaucagauguguacauaag

SEQ ID NO: 332895 - RNA, 23 nt, Human
aauuuaguuugagacauuagccu

SEQ ID NO: 332896 - RNA, 22 nt, Human
agcugggguugcacacauuuug

SEQ ID NO: 332897 - RNA, 22 nt, Human
cugucuccagggcaggugcagg

SEQ ID NO: 332898 - RNA, 17 nt, Human
guccuggugugugagga

SEQ ID NO: 332899 - RNA, 22 nt, Human
ggagcuggagagcuagccuagg

SEQ ID NO: 332900 - RNA, 22 nt, Human
cuccaggauguuagacguccag

SEQ ID NO: 332901 - RNA, 22 nt, Human
gucugggguacuuucaucugau

SEQ ID NO: 332902 - RNA, 22 nt, Human
ugcuggggcucugaccacucca

SEQ ID NO: 332903 - RNA, 22 nt, Human
gcugggcuugguuucccugcuu

SEQ ID NO: 332904 - RNA, 22 nt, Human
cccacucccugcacgccugccg

SEQ ID NO: 332905 - RNA, 22 nt, Human
cugggcucaguggcucauggcu

SEQ ID NO: 332906 - RNA, 22 nt, Human
uauaaaugccaggacuuuagau

SEQ ID NO: 332907 - RNA, 22 nt, Human
cagcccacugccucugugguag

SEQ ID NO: 332908 - RNA, 22 nt, Human
gcugggaggaucucucccuguc

SEQ ID NO: 332909 - RNA, 22 nt, Human
agcaauaacagaaaacuuuccu

SEQ ID NO: 332910 - RNA, 22 nt, Human
ugcugaggcccaggagcacuuu

SEQ ID NO: 332911 - RNA, 22 nt, Human
ggcaccaggcugggcauaggcc

SEQ ID NO: 332912 - RNA, 19 nt, Human
uguagcuagugucuaucca

SEQ ID NO: 332913 - RNA, 22 nt, Human
gagcugggucuccaccuuggca

SEQ ID NO: 332914 - RNA, 22 nt, Human
agcuccugcgcacggugcacac

SEQ ID NO: 332915 - RNA, 22 nt, Human
agagcugggaccgucuggaagu

SEQ ID NO: 332916 - RNA, 22 nt, Human
acaaacuuccaucaugaauuuu

SEQ ID NO: 332917 - RNA, 22 nt, Human
cacuguaauagcauuauaagug

SEQ ID NO: 332918 - RNA, 22 nt, Human
ccugcuggccacugcuccaccu

SEQ ID NO: 332919 - RNA, 19 nt, Human
cagcccucuuaccacugug

SEQ ID NO: 332920 - RNA, 22 nt, Human
gagcugggaagauagcuugagc

SEQ ID NO: 332921 - RNA, 22 nt, Human
ucucagccucaccucuauggag

SEQ ID NO: 332922 - RNA, 22 nt, Human
gagcuggggcggauacucagcu

SEQ ID NO: 332923 - RNA, 22 nt, Human
gagcugggacauggguccucuc

SEQ ID NO: 332924 - RNA, 22 nt, Human
ccccugccagcuaucccugaac

SEQ ID NO: 332925 - RNA, 22 nt, Human
caggcucagcaggagccugacc

SEQ ID NO: 332926 - RNA, 19 nt, Human
ccuggcccugcugcgcggg

SEQ ID NO: 332927 - RNA, 22 nt, Human
uagcuggggcuuucauucuugc

SEQ ID NO: 332928 - RNA, 22 nt, Human
ccuggagcuuuuccauccugga

SEQ ID NO: 332929 - RNA, 22 nt, Human
agagcuggaaaaguuguuuuaa

SEQ ID NO: 332930 - RNA, 22 nt, Human
cuggugcacauucgcucucaua

SEQ ID NO: 332931 - RNA, 22 nt, Human
agcuccugcaccaggggccccu

SEQ ID NO: 332932 - RNA, 22 nt, Human
gagcuggguauauggcuuuaug

SEQ ID NO: 332933 - RNA, 22 nt, Human
agagcuggagcagccccacugg

SEQ ID NO: 332934 - RNA, 21 nt, Human
ccagccucagaucagggagcu

SEQ ID NO: 332935 - RNA, 22 nt, Human
gcugggcucuuaucaccuguac

SEQ ID NO: 332936 - RNA, 23 nt, Human
uccuggugacaugccugagcauc

SEQ ID NO: 332937 - RNA, 20 nt, Human
ggcagagcuaugucuguugc

SEQ ID NO: 332938 - RNA, 22 nt, Human
cccuguccugcuaggcccuggu

SEQ ID NO: 332939 - RNA, 22 nt, Human
gcaccaggcuuagagccccagg

SEQ ID NO: 332940 - RNA, 22 nt, Human
gcagagcuccccaagacaccaa

SEQ ID NO: 332941 - RNA, 20 nt, Human
ugcagagcugacauuaccug

SEQ ID NO: 332942 - RNA, 22 nt, Human
agagcuggagaugcagguuucg

SEQ ID NO: 332943 - RNA, 22 nt, Human
gcccuguguguuugcacugauu

SEQ ID NO: 332944 - RNA, 20 nt, Human
acaaaauagguacuggguag

SEQ ID NO: 332945 - RNA, 17 nt, Human
auguauauuaacucuga

SEQ ID NO: 332946 - RNA, 22 nt, Human
gagcuggggcagcuuaggagug

SEQ ID NO: 332947 - RNA, 22 nt, Human
uccugaggcacaauccuagaau

SEQ ID NO: 332948 - RNA, 22 nt, Human
gagggcacgaaacaaccacuuc

SEQ ID NO: 332949 - RNA, 22 nt, Human
cugucccucaguucugggcaaa

SEQ ID NO: 332950 - RNA, 16 nt, Human
gcagagcucagggacu

SEQ ID NO: 332951 - RNA, 22 nt, Human
guaucacuuuugagagugagaa

SEQ ID NO: 332952 - RNA, 22 nt, Human
aagcugggacuuagcgcagaua

SEQ ID NO: 332953 - RNA, 22 nt, Human
gagcugggauucaucuaugucu

SEQ ID NO: 332954 - RNA, 22 nt, Human
ccuggagcuuggucacgcugcg

SEQ ID NO: 332955 - RNA, 22 nt, Human
cccugugguugcuagggcacag

SEQ ID NO: 332956 - RNA, 18 nt, Human
ggagcugggccccacucc

SEQ ID NO: 332957 - RNA, 22 nt, Human
uccugagggcucggggcucaug

SEQ ID NO: 332958 - RNA, 22 nt, Human
ccauggccaauugcaccuugcu

SEQ ID NO: 332959 - RNA, 22 nt, Human
gagcugggcacacgccacuuga

SEQ ID NO: 332960 - RNA, 22 nt, Human
ggaggccacgguuuagcaccga

SEQ ID NO: 332961 - RNA, 22 nt, Human
cugucccucaucaccucugggu

SEQ ID NO: 332962 - RNA, 22 nt, Human
cugggcucaagaagucuucccu

SEQ ID NO: 332963 - RNA, 22 nt, Human
cccagcccacgguccugggugg

SEQ ID NO: 332964 - RNA, 22 nt, Human
aaaauaguuaacguucagagua

SEQ ID NO: 332965 - RNA, 22 nt, Human
cugcagagcagccaguccccca

SEQ ID NO: 332966 - RNA, 22 nt, Human
aacuaaaacugguuuguucucu

SEQ ID NO: 332967 - RNA, 22 nt, Human
caaguaaagaaucacauuucuu

SEQ ID NO: 332968 - RNA, 22 nt, Human
augcugggagugaagccccugg

SEQ ID NO: 332969 - RNA, 22 nt, Human
agcuggggcauuuauccacuaa

SEQ ID NO: 332970 - RNA, 22 nt, Human
auguaaacucacauuuucuuca

SEQ ID NO: 332971 - RNA, 22 nt, Human
ggcaccagggacaauccucuuc

SEQ ID NO: 332972 - RNA, 22 nt, Human
cagaugcuauguauuauguaug

SEQ ID NO: 332973 - RNA, 22 nt, Human
agcuccugugugaagccucccu

SEQ ID NO: 332974 - RNA, 22 nt, Human
gcaccgagaaggaagcaugccu

SEQ ID NO: 332975 - RNA, 22 nt, Human
acauuucaguaaguguuaauuu

SEQ ID NO: 332976 - RNA, 22 nt, Human
agguauuauuagcaucucuauu

SEQ ID NO: 332977 - RNA, 22 nt, Human
cugcaggacgaccgccucaucu

SEQ ID NO: 332978 - RNA, 22 nt, Human
uucaguaugauuccuccaguag

SEQ ID NO: 332979 - RNA, 22 nt, Human
ggcaucccuagaauagccaggu

SEQ ID NO: 332980 - RNA, 23 nt, Human
gagcugggauacaggcuuacugc

SEQ ID NO: 332981 - RNA, 22 nt, Human
cccugccccaggcggcuucacu

SEQ ID NO: 332982 - RNA, 22 nt, Human
ccacucccuuccgguccagggc

SEQ ID NO: 332983 - RNA, 21 nt, Human
ggugacacguggccccgcucu

SEQ ID NO: 332984 - RNA, 22 nt, Human
gcugccucaggcaccuccuggc

SEQ ID NO: 332985 - RNA, 22 nt, Human
agagcuggggccagagucaagg

SEQ ID NO: 332986 - RNA, 22 nt, Human
ugggcaccugaggccuggcagg

SEQ ID NO: 332987 - RNA, 22 nt, Human
ccugcagguuucccccggacgg

SEQ ID NO: 332988 - RNA, 22 nt, Human
cugggcucaaauccuggcccug

SEQ ID NO: 332989 - RNA, 22 nt, Human
ccaggccccagggcuggcuuuc

SEQ ID NO: 332990 - RNA, 22 nt, Human
gauguuuuaggucccuguagcu

SEQ ID NO: 332991 - RNA, 20 nt, Human
cugggcucgguggcccuggc

SEQ ID NO: 332992 - RNA, 22 nt, Human
gugcaccccggggcccugcucc

SEQ ID NO: 332993 - RNA, 17 nt, Human
ggcagagcugacagggc

SEQ ID NO: 332994 - RNA, 22 nt, Human
cagagcugcaaaugccccuccg

SEQ ID NO: 332995 - RNA, 22 nt, Human
aaauaucauuuauaacuuuuaa

SEQ ID NO: 332996 - RNA, 22 nt, Human
ucccugagcucacauggcagga

SEQ ID NO: 332997 - RNA, 22 nt, Human
ccuggggagagaaagcccagcc

SEQ ID NO: 332998 - RNA, 22 nt, Human
ggagcuggcagcgcaacccaga

SEQ ID NO: 332999 - RNA, 23 nt, Human
ccagcccuccaccagcucuaggc

SEQ ID NO: 333000 - RNA, 22 nt, Human
uaugauaugcacuuuaucagaa

SEQ ID NO: 333001 - RNA, 22 nt, Human
gcugauagacugaauguuggga

SEQ ID NO: 333002 - RNA, 22 nt, Human
aagaaaacaugaucuaauuuaa

SEQ ID NO: 333003 - RNA, 22 nt, Human
uaggacauaaguauucuaacuu

SEQ ID NO: 333004 - RNA, 21 nt, Human
accaggccaggaggcuggcac

SEQ ID NO: 333005 - RNA, 22 nt, Human
agagcugguuuacucaggaauu

SEQ ID NO: 333006 - RNA, 22 nt, Human
gacacuccagcuuuuggcucaa

SEQ ID NO: 333007 - RNA, 20 nt, Human
ugcuggggacauacagggug

SEQ ID NO: 333008 - RNA, 22 nt, Human
gaugcuggaagugcugaucuug

SEQ ID NO: 333009 - RNA, 22 nt, Human
gcagagcucaugccugcaccuc

SEQ ID NO: 333010 - RNA, 22 nt, Human
agagcuggggcccguaaagcca

SEQ ID NO: 333011 - RNA, 22 nt, Human
cagagcuggagggaacccuggc

SEQ ID NO: 333012 - RNA, 22 nt, Human
gggcccugugauuucuugagga

SEQ ID NO: 333013 - RNA, 22 nt, Human
agcccuguuuaugccacaucau

SEQ ID NO: 333014 - RNA, 22 nt, Human
cagccccuuguccgguagccac

SEQ ID NO: 333015 - RNA, 22 nt, Human
ugcuggggcagaagagccaaga

SEQ ID NO: 333016 - RNA, 22 nt, Human
gcaggagcucguuuccaggcug

SEQ ID NO: 333017 - RNA, 20 nt, Human
agagcugggaagcucccuau

SEQ ID NO: 333018 - RNA, 22 nt, Human
agcccuguagauuuaggagagu

SEQ ID NO: 333019 - RNA, 22 nt, Human
agaggaggccaggcccacaccu

SEQ ID NO: 333020 - RNA, 21 nt, Human
caggccccaggccuggggugc

SEQ ID NO: 333021 - RNA, 22 nt, Human
cugcagaggccucgccuccucu

SEQ ID NO: 333022 - RNA, 22 nt, Human
ccagggagcggggcugggucuc

SEQ ID NO: 333023 - RNA, 22 nt, Human
agcuggggcugcagagaacagg

SEQ ID NO: 333024 - RNA, 22 nt, Human
ccugcagguugcagaggcggaa

SEQ ID NO: 333025 - RNA, 22 nt, Human
uccugcagagacagaggccuca

SEQ ID NO: 333026 - RNA, 22 nt, Human
caugagauaauuuuucuccagu

SEQ ID NO: 333027 - RNA, 22 nt, Human
ugcugggggugucucaccaggc

SEQ ID NO: 333028 - RNA, 22 nt, Human
ccagcccugaacccugcugcau

SEQ ID NO: 333029 - RNA, 22 nt, Human
ccagccucaucgccugccuguc

SEQ ID NO: 333030 - RNA, 22 nt, Human
cagcuccugccugggcagcugu

SEQ ID NO: 333031 - RNA, 22 nt, Human
ggcacagggggcugaggacuag

SEQ ID NO: 333032 - RNA, 22 nt, Human
gagccuggccuccugccucagc

SEQ ID NO: 333033 - RNA, 22 nt, Human
ccaggcccuugcaagucccacc

SEQ ID NO: 333034 - RNA, 22 nt, Human
uauccaaaguuucucagaaacu

SEQ ID NO: 333035 - RNA, 22 nt, Human
gcccugugccagucacgcugug

SEQ ID NO: 333036 - RNA, 22 nt, Human
cacagcugucagcugaccuagg

SEQ ID NO: 333037 - RNA, 18 nt, Human
auccaaaaagauggaagu

SEQ ID NO: 333038 - RNA, 22 nt, Human
ccucagccuuggccccaggcag

SEQ ID NO: 333039 - RNA, 22 nt, Human
ccugcaggcugcaggccaguuc

SEQ ID NO: 333040 - RNA, 21 nt, Human
agagcugguagguagguaggu

SEQ ID NO: 333041 - RNA, 22 nt, Human
uucaaaugcaaguuacuacuuu

SEQ ID NO: 333042 - RNA, 22 nt, Human
agagcuggcagcagcuucuccu

SEQ ID NO: 333043 - RNA, 22 nt, Human
cagggagcuggugccagccgac

SEQ ID NO: 333044 - RNA, 22 nt, Human
gcccugugcucaugggaacauc

SEQ ID NO: 333045 - RNA, 22 nt, Human
gcaugcugcaccagagccucuc

SEQ ID NO: 333046 - RNA, 22 nt, Human
cccuguccuuggcugugaggcu

SEQ ID NO: 333047 - RNA, 22 nt, Human
uugucuaaugagcuccacuuca

SEQ ID NO: 333048 - RNA, 22 nt, Human
cccucagcuccacccucagcag

SEQ ID NO: 333049 - RNA, 21 nt, Human
agagcuggccugccaggcccu

SEQ ID NO: 333050 - RNA, 22 nt, Human
uuccugguaaauuauguccagg

SEQ ID NO: 333051 - RNA, 18 nt, Human
agcuggggccucuggucc

SEQ ID NO: 333052 - RNA, 16 nt, Human
ggcaccagugaacaca

SEQ ID NO: 333053 - RNA, 22 nt, Human
uaggacaugcuacauaaauagg

SEQ ID NO: 333054 - RNA, 22 nt, Human
cucagccugugaagagcagagg

SEQ ID NO: 333055 - RNA, 22 nt, Human
ggagcuggccgccuaugugcag

SEQ ID NO: 333056 - RNA, 22 nt, Human
uuucagaugguauauacaguag

SEQ ID NO: 333057 - RNA, 19 nt, Human
agcuggggcgguguguguu

SEQ ID NO: 333058 - RNA, 22 nt, Human
cugggcucuaagggagcaccgu

SEQ ID NO: 333059 - RNA, 22 nt, Human
ccugcagguccccggaugcgca

SEQ ID NO: 333060 - RNA, 22 nt, Human
gcccauggcagaacugugagca

SEQ ID NO: 333061 - RNA, 22 nt, Human
gagggcacaaaggcaacauuca

SEQ ID NO: 333062 - RNA, 22 nt, Human
ggcaccaggacaugacucccag

SEQ ID NO: 333063 - RNA, 22 nt, Human
cagagcuguccaaacccugaca

SEQ ID NO: 333064 - RNA, 22 nt, Human
gggccccugggaauucugugau

SEQ ID NO: 333065 - RNA, 22 nt, Human
ggagcuggucagccuugagcau

SEQ ID NO: 333066 - RNA, 21 nt, Human
cagagcuguccaaacccugac

SEQ ID NO: 333067 - RNA, 22 nt, Human
gugcauccacuagggcucuccc

SEQ ID NO: 333068 - RNA, 22 nt, Human
ucccagccuuccagucugguuu

SEQ ID NO: 333069 - RNA, 22 nt, Human
gagcugggaggacugggaacuu

SEQ ID NO: 333070 - RNA, 22 nt, Human
gagguggcgcgccaucccugcc

SEQ ID NO: 333071 - RNA, 22 nt, Human
uuaugguaauuaaaacauguau

SEQ ID NO: 333072 - RNA, 22 nt, Human
uagcuggguugaggucaucuac

SEQ ID NO: 333073 - RNA, 22 nt, Human
uaguaacccacacaacaguaga

SEQ ID NO: 333074 - RNA, 22 nt, Human
ccuggcagcaggugggcccgug

SEQ ID NO: 333075 - RNA, 22 nt, Human
gcccugugcuuggauggcagau

SEQ ID NO: 333076 - RNA, 22 nt, Human
agagcuggacgucugagcccua

SEQ ID NO: 333077 - RNA, 19 nt, Human
uccagccccucugugugug

SEQ ID NO: 333078 - RNA, 20 nt, Human
ccuguggagcugccuccucc

SEQ ID NO: 333079 - RNA, 22 nt, Human
gcuggggagcuagaccucagca

SEQ ID NO: 333080 - RNA, 22 nt, Human
cccugguguccacuggaggaag

SEQ ID NO: 333081 - RNA, 22 nt, Human
ggcagagcugcaugagcacuca

SEQ ID NO: 333082 - RNA, 22 nt, Human
gcccuugggagguuccacuggg

SEQ ID NO: 333083 - RNA, 22 nt, Human
aggcccuggguuagggcccacu

SEQ ID NO: 333084 - RNA, 22 nt, Human
ucugcaggucacgcuccagccu

SEQ ID NO: 333085 - RNA, 22 nt, Human
gugcugggcuccaccccagagg

SEQ ID NO: 333086 - RNA, 22 nt, Human
aaugauugucauuccaaaaagu

SEQ ID NO: 333087 - RNA, 22 nt, Human
uccacuggaacaacucugaggc

SEQ ID NO: 333088 - RNA, 22 nt, Human
gcccagcccugaggucacagcu

SEQ ID NO: 333089 - RNA, 22 nt, Human
cugggcucagaugagaggaagg

SEQ ID NO: 333090 - RNA, 22 nt, Human
acaacaaaaucacuagucuucc

SEQ ID NO: 333091 - RNA, 22 nt, Human
agagcuggcugguagcccugau

SEQ ID NO: 333092 - RNA, 22 nt, Human
gcugggcucuuuaccccuguac

SEQ ID NO: 333093 - RNA, 22 nt, Human
ggcaccagggcaagggucuuuc

SEQ ID NO: 333094 - RNA, 22 nt, Human
aaaaugauauccugacuuuuau

SEQ ID NO: 333095 - RNA, 22 nt, Human
cccugugggaacuccugaguug

SEQ ID NO: 333096 - RNA, 22 nt, Human
aguaaaauuguauuggaaaaca

SEQ ID NO: 333097 - RNA, 22 nt, Human
ugagcuggggucagcuccccug

SEQ ID NO: 333098 - RNA, 22 nt, Human
ccuguggagcuuucagcagcuc

SEQ ID NO: 333099 - RNA, 23 nt, Human
uccugaggaauggcaucucacau

SEQ ID NO: 333100 - RNA, 22 nt, Human
gagcugggccucagaacacagu

SEQ ID NO: 333101 - RNA, 22 nt, Human
gagcugggacuuggaauccaca

SEQ ID NO: 333102 - RNA, 22 nt, Human
cugggguuggccagggcccuag

SEQ ID NO: 333103 - RNA, 22 nt, Human
cagaugcuuggaggacacuugg

SEQ ID NO: 333104 - RNA, 22 nt, Human
cagggagcagcgcuggggccuc

SEQ ID NO: 333105 - RNA, 22 nt, Human
cccuguggcaggaggaggagca

SEQ ID NO: 333106 - RNA, 22 nt, Human
agagcuggaaucagaccucagg

SEQ ID NO: 333107 - RNA, 22 nt, Human
agagcuggcugugggugacuuu

SEQ ID NO: 333108 - RNA, 22 nt, Human
cugucuccuccacugcauggga

SEQ ID NO: 333109 - RNA, 22 nt, Human
ccagccccuauccucgcuccac

SEQ ID NO: 333110 - RNA, 23 nt, Human
uggcaccaggcauucuaggggua

SEQ ID NO: 333111 - RNA, 21 nt, Human
gagcugggcgaggcuccgggg

SEQ ID NO: 333112 - RNA, 22 nt, Human
ugaguuauaaugaauauuugaa

SEQ ID NO: 333113 - RNA, 18 nt, Human
aagcugggaaggagacag

SEQ ID NO: 333114 - RNA, 20 nt, Human
uuucagauuuacagaaaugu

SEQ ID NO: 333115 - RNA, 22 nt, Human
cccuggucagggaaggcgccug

SEQ ID NO: 333116 - RNA, 22 nt, Human
cugugcccaggccccuggggau

SEQ ID NO: 333117 - RNA, 22 nt, Human
uuucagaucauuuuuuaaguac

SEQ ID NO: 333118 - RNA, 22 nt, Human
ucagcuucagaucagcuagaga

SEQ ID NO: 333119 - RNA, 22 nt, Human
aaauauguuuuccaguugucau

SEQ ID NO: 333120 - RNA, 22 nt, Human
agagcuggauggucaagauggc

SEQ ID NO: 333121 - RNA, 18 nt, Human
ugcugggguagaauccac

SEQ ID NO: 333122 - RNA, 22 nt, Human
ggagcugggaacuauguaguau

SEQ ID NO: 333123 - RNA, 22 nt, Human
auaugaaaagaagucaccauug

SEQ ID NO: 333124 - RNA, 21 nt, Human
ggagcuggggagcuggcccca

SEQ ID NO: 333125 - RNA, 22 nt, Human
uccugcagccauuagaggucaa

SEQ ID NO: 333126 - RNA, 22 nt, Human
cugcagccucaaccuccugagc

SEQ ID NO: 333127 - RNA, 22 nt, Human
aacuaaaucuggcauuuagagc

SEQ ID NO: 333128 - RNA, 22 nt, Human
uccugcaguuacaucccagcca

SEQ ID NO: 333129 - RNA, 19 nt, Human
cagccucaaucccucgggc

SEQ ID NO: 333130 - RNA, 20 nt, Human
acuuuacugagcuguaauuc

SEQ ID NO: 333131 - RNA, 22 nt, Human
uccugcagaccucagucagguc

SEQ ID NO: 333132 - RNA, 22 nt, Human
gggcuccuccucugacuguggc

SEQ ID NO: 333133 - RNA, 22 nt, Human
cccagcccagcguucgaggggu

SEQ ID NO: 333134 - RNA, 22 nt, Human
ucaaaguauuuuaacuguaucc

SEQ ID NO: 333135 - RNA, 22 nt, Human
aagcugggagggagcccagagu

SEQ ID NO: 333136 - RNA, 22 nt, Human
acuuuacuccccaacauaaaug

SEQ ID NO: 333137 - RNA, 19 nt, Human
ggcagagcuccugcuuucu

SEQ ID NO: 333138 - RNA, 22 nt, Human
uggcaccaggcgggguggcugu

SEQ ID NO: 333139 - RNA, 22 nt, Human
gcccugugagucaugcggcaga

SEQ ID NO: 333140 - RNA, 22 nt, Human
agagcuggggcucuggguuuaa

SEQ ID NO: 333141 - RNA, 22 nt, Human
ccuggggucacuugcagccgca

SEQ ID NO: 333142 - RNA, 22 nt, Human
ccuggggagccgccugagcccc

SEQ ID NO: 333143 - RNA, 22 nt, Human
agacuuuaaugugcaaaugaaa

SEQ ID NO: 333144 - RNA, 22 nt, Human
augcugggacguacuuguucau

SEQ ID NO: 333145 - RNA, 21 nt, Human
ugggcaccaaaaccuaggagu

SEQ ID NO: 333146 - RNA, 22 nt, Human
ugcagagcuucauugcauaggc

SEQ ID NO: 333147 - RNA, 23 nt, Human
agcuggaggcugucuacucccaa

SEQ ID NO: 333148 - RNA, 22 nt, Human
cugucacccacccagccuguca

SEQ ID NO: 333149 - RNA, 22 nt, Human
gcugggcuucacagagccuuua

SEQ ID NO: 333150 - RNA, 22 nt, Human
cugggugagcuggccagagggu

SEQ ID NO: 333151 - RNA, 22 nt, Human
gcaccaggcagcugagcaggcc

SEQ ID NO: 333152 - RNA, 17 nt, Human
agcccugugcucuuuuu

SEQ ID NO: 333153 - RNA, 22 nt, Human
cagcccucaaaccacuuccagg

SEQ ID NO: 333154 - RNA, 22 nt, Human
uccugcagccacugcaggcaga

SEQ ID NO: 333155 - RNA, 22 nt, Human
uccuguggcguuaucaugugau

SEQ ID NO: 333156 - RNA, 17 nt, Human
uggcacagaggugcuau

SEQ ID NO: 333157 - RNA, 22 nt, Human
ccugggaccucgcgggaagcgg

SEQ ID NO: 333158 - RNA, 22 nt, Human
agagcuggccagggaucacucu

SEQ ID NO: 333159 - RNA, 22 nt, Human
ucagacaaguaaaauaauguaa

SEQ ID NO: 333160 - RNA, 22 nt, Human
ggcaccagggaaggaaggcugg

SEQ ID NO: 333161 - RNA, 22 nt, Human
cccuguggaggcagcauccugc

SEQ ID NO: 333162 - RNA, 22 nt, Human
cccuguccuggaugggagcacu

SEQ ID NO: 333163 - RNA, 22 nt, Human
aaauauguauggaguucaugaa

SEQ ID NO: 333164 - RNA, 22 nt, Human
ccucucccgggugccgcugggc

SEQ ID NO: 333165 - RNA, 22 nt, Human
caccaggcugaaccagagggga

SEQ ID NO: 333166 - RNA, 18 nt, Human
ucuggaacaacuucaugu

SEQ ID NO: 333167 - RNA, 22 nt, Human
gucaaaugcacagaaccauuaa

SEQ ID NO: 333168 - RNA, 22 nt, Human
gagggcacuggguuucaauguc

SEQ ID NO: 333169 - RNA, 22 nt, Human
ugcugggcuggagcugccaggg

SEQ ID NO: 333170 - RNA, 17 nt, Human
ccagggaggggccgcgc

SEQ ID NO: 333171 - RNA, 22 nt, Human
ucaaaguagccggauggaauuu

SEQ ID NO: 333172 - RNA, 19 nt, Human
gggcuccuugggccucucu

SEQ ID NO: 333173 - RNA, 22 nt, Human
auauaacauacauacagaaaag

SEQ ID NO: 333174 - RNA, 20 nt, Human
agcccuguuuccuggagaga

SEQ ID NO: 333175 - RNA, 22 nt, Human
ucccugaggaagggguguggug

SEQ ID NO: 333176 - RNA, 22 nt, Human
cccugccuuguuggagccuaug

SEQ ID NO: 333177 - RNA, 22 nt, Human
gaucucaaagcaguguggguug

SEQ ID NO: 333178 - RNA, 22 nt, Human
gagcugggauuugaaccuggga

SEQ ID NO: 333179 - RNA, 19 nt, Human
auccuggguccuccagcug

SEQ ID NO: 333180 - RNA, 19 nt, Human
agcuccuguucagcagcuc

SEQ ID NO: 333181 - RNA, 17 nt, Human
ggcaccagacggagagu

SEQ ID NO: 333182 - RNA, 22 nt, Human
agccugggcccugccucuucuc

SEQ ID NO: 333183 - RNA, 22 nt, Human
uaggacauguguuuuauauaug

SEQ ID NO: 333184 - RNA, 22 nt, Human
agagcugggugguggugacuca

SEQ ID NO: 333185 - RNA, 22 nt, Human
agaggacacaucuuuccucaaa

SEQ ID NO: 333186 - RNA, 22 nt, Human
aucauccuagaaggaagcuagg

SEQ ID NO: 333187 - RNA, 19 nt, Human
cugcucccuccuucuggca

SEQ ID NO: 333188 - RNA, 22 nt, Human
cugcagaguggagccucggcug

SEQ ID NO: 333189 - RNA, 22 nt, Human
uccugaggcuaaagugcagugg

SEQ ID NO: 333190 - RNA, 22 nt, Human
gccuguggggcugaggcugccu

SEQ ID NO: 333191 - RNA, 20 nt, Human
cccagcccgggccgcgcucg

SEQ ID NO: 333192 - RNA, 22 nt, Human
agaugguagguggcaggacuga

SEQ ID NO: 333193 - RNA, 22 nt, Human
agagcuggguggacuuguaguu

SEQ ID NO: 333194 - RNA, 22 nt, Human
gagcugggcuggcuuccucccu

SEQ ID NO: 333195 - RNA, 22 nt, Human
ccugcagggugcugccacagau

SEQ ID NO: 333196 - RNA, 22 nt, Human
uguggcacuucucuccuuguaa

SEQ ID NO: 333197 - RNA, 22 nt, Human
uaaauguauaggcacuaaaccu

SEQ ID NO: 333198 - RNA, 22 nt, Human
uagcugggucucuguuuucuca

SEQ ID NO: 333199 - RNA, 22 nt, Human
uccuguggggaaaagccuaucu

SEQ ID NO: 333200 - RNA, 22 nt, Human
cucucugaggaaggagcaucug

SEQ ID NO: 333201 - RNA, 22 nt, Human
auaaaugauucagcaggaaaua

SEQ ID NO: 333202 - RNA, 22 nt, Human
agcuccugucucaagggagccu

SEQ ID NO: 333203 - RNA, 22 nt, Human
ugggcuccggcggccucaggcu

SEQ ID NO: 333204 - RNA, 22 nt, Human
cugcaggggcaguccacuuccu

SEQ ID NO: 333205 - RNA, 22 nt, Human
ccuggguacccuuggcggccuu

SEQ ID NO: 333206 - RNA, 22 nt, Human
aacugguaucucuucaguguaa

SEQ ID NO: 333207 - RNA, 22 nt, Human
ggcaccagcaggcaccgaugcc

SEQ ID NO: 333208 - RNA, 22 nt, Human
gagcuggguguuuauuugccaa

SEQ ID NO: 333209 - RNA, 22 nt, Human
agaagucauuuauguuagauga

SEQ ID NO: 333210 - RNA, 22 nt, Human
ccugggcuuucggcggcuuccu

SEQ ID NO: 333211 - RNA, 22 nt, Human
ggaggccaggaagagccgcccu

SEQ ID NO: 333212 - RNA, 22 nt, Human
aaacacaauguuucuuuguucu

SEQ ID NO: 333213 - RNA, 22 nt, Human
cugguggagaugccuggccccu

SEQ ID NO: 333214 - RNA, 21 nt, Human
agagcugggacuugccugaga

SEQ ID NO: 333215 - RNA, 22 nt, Human
ggaggccaccugaccugcuguu

SEQ ID NO: 333216 - RNA, 20 nt, Human
ggcaccaggcuaggauugga

SEQ ID NO: 333217 - RNA, 22 nt, Human
agagcuggcugcugcggugcuu

SEQ ID NO: 333218 - RNA, 22 nt, Human
aaaaguauuuuggaucucagau

SEQ ID NO: 333219 - RNA, 22 nt, Human
agagcuggugcauauucagaaa

SEQ ID NO: 333220 - RNA, 22 nt, Human
caccagguuccgggcagagcug

SEQ ID NO: 333221 - RNA, 22 nt, Human
agagcugggugaagugccauca

SEQ ID NO: 333222 - RNA, 18 nt, Human
gcagagcugggauuccca

SEQ ID NO: 333223 - RNA, 22 nt, Human
ucccugucuaauaugccaugaa

SEQ ID NO: 333224 - RNA, 18 nt, Human
gagcugggagaaggaagg

SEQ ID NO: 333225 - RNA, 22 nt, Human
ccugucaggguuugccucagaa

SEQ ID NO: 333226 - RNA, 22 nt, Human
uccugaggagaagagugcuagg

SEQ ID NO: 333227 - RNA, 22 nt, Human
gagggcacucgagacuacggca

SEQ ID NO: 333228 - RNA, 22 nt, Human
ggcaccagcacuugggauggcu

SEQ ID NO: 333229 - RNA, 21 nt, Human
gcagagcuggaaccaggaccc

SEQ ID NO: 333230 - RNA, 22 nt, Human
gagcugggcgagccggggaagu

SEQ ID NO: 333231 - RNA, 22 nt, Human
cccugccugugggcaucaacau

SEQ ID NO: 333232 - RNA, 22 nt, Human
cccuguccugcuaggcccuggu

SEQ ID NO: 333233 - RNA, 22 nt, Human
ccucugagcuggccuguggggc

SEQ ID NO: 333234 - RNA, 22 nt, Human
ugguggggccagacuucagcuc

SEQ ID NO: 333235 - RNA, 22 nt, Human
aucucccaaauuagccucuuga

SEQ ID NO: 333236 - RNA, 21 nt, Human
cccgugccuucagcaguccug

SEQ ID NO: 333237 - RNA, 22 nt, Human
guggccuccuccguccgccucu

SEQ ID NO: 333238 - RNA, 22 nt, Human
uucaaaccuaucuaagaaauag

SEQ ID NO: 333239 - RNA, 22 nt, Human
aaaugcacaauaaaguaaaggc

SEQ ID NO: 333240 - RNA, 17 nt, Human
aguuggcagccguugcu

SEQ ID NO: 333241 - RNA, 22 nt, Human
acagugauuggcacugauucag

SEQ ID NO: 333242 - RNA, 20 nt, Human
ccagagcugauggcugcccg

SEQ ID NO: 333243 - RNA, 22 nt, Human
ccauuuguaccauuucuuugua

SEQ ID NO: 333244 - RNA, 22 nt, Human
cuggccuggcaggggaccucua

SEQ ID NO: 333245 - RNA, 22 nt, Human
aaugcugugauuuauuaaguau

SEQ ID NO: 333246 - RNA, 22 nt, Human
cuccuuagugccucugcacgag

SEQ ID NO: 333247 - RNA, 22 nt, Human
ucacuguuaauaaauagcaaag

SEQ ID NO: 333248 - RNA, 22 nt, Human
gaaaacacuuugaucugaaagu

SEQ ID NO: 333249 - RNA, 22 nt, Human
ccucagucuauuuccagcaggu

SEQ ID NO: 333250 - RNA, 22 nt, Human
guccguaguggcugaugcuuug

SEQ ID NO: 333251 - RNA, 22 nt, Human
gggcugacaccacccaggcgca

SEQ ID NO: 333252 - RNA, 23 nt, Human
uggugggcccugcuugcucacug

SEQ ID NO: 333253 - RNA, 22 nt, Human
acuugcaucuuagagacucacc

SEQ ID NO: 333254 - RNA, 22 nt, Human
aucaugugacuagguuuggcca

SEQ ID NO: 333255 - RNA, 22 nt, Human
cuggcuuugaucagagugaccu

SEQ ID NO: 333256 - RNA, 22 nt, Human
guuuuaguggguggccacugau

SEQ ID NO: 333257 - RNA, 22 nt, Human
aggcggguuuaggacaaugcuu

SEQ ID NO: 333258 - RNA, 22 nt, Human
guugggcugaagugugugcuua

SEQ ID NO: 333259 - RNA, 22 nt, Human
gugggggcaggcagugcuagga

SEQ ID NO: 333260 - RNA, 22 nt, Human
aucuucaaagcacaucguuugu

SEQ ID NO: 333261 - RNA, 22 nt, Human
uggcggugacggcggcgccugg

SEQ ID NO: 333262 - RNA, 22 nt, Human
gcucagagauguucaguagcuu

SEQ ID NO: 333263 - RNA, 22 nt, Human
ugugcugcucucagugacagcc

SEQ ID NO: 333264 - RNA, 21 nt, Human
ucagcuugcuucauuauuaug

SEQ ID NO: 333265 - RNA, 22 nt, Human
gugcugccuccauauccgucag

SEQ ID NO: 333266 - RNA, 22 nt, Human
gguuuguggagcuggaaacacu

SEQ ID NO: 333267 - RNA, 22 nt, Human
ucaggccaggagaucagauuga

SEQ ID NO: 333268 - RNA, 22 nt, Human
gugcaugucuuuggaggccucc

SEQ ID NO: 333269 - RNA, 22 nt, Human
aaugucaacacaagagaaaugc

SEQ ID NO: 333270 - RNA, 22 nt, Human
accuccuccaaggagccauagg

SEQ ID NO: 333271 - RNA, 22 nt, Human
cccugcuucccugggagaggcg

SEQ ID NO: 333272 - RNA, 22 nt, Human
uuucgagggauuagcuaggacu

SEQ ID NO: 333273 - RNA, 22 nt, Human
ggccuugggauguggcugcagc

SEQ ID NO: 333274 - RNA, 22 nt, Human
gccuggcuaagcagaaggaccc

SEQ ID NO: 333275 - RNA, 22 nt, Human
uuccaggcgcacgucggccuua

SEQ ID NO: 333276 - RNA, 19 nt, Human
uugcuucaugucuuuugcu

SEQ ID NO: 333277 - RNA, 22 nt, Human
ugcaucuaaguggcuaacaacc

SEQ ID NO: 333278 - RNA, 22 nt, Human
ugacuuuggacuagugauuuaa

SEQ ID NO: 333279 - RNA, 22 nt, Human
aacuuaaacaagcucccaaguu

SEQ ID NO: 333280 - RNA, 22 nt, Human
acaccacaaguaacucuuuucc

SEQ ID NO: 333281 - RNA, 22 nt, Human
aagaggaggacgguucccagaa

SEQ ID NO: 333282 - RNA, 22 nt, Human
uuacaguuaaugugacuaacca

SEQ ID NO: 333283 - RNA, 22 nt, Human
cagugacguaaacugcaugugc

SEQ ID NO: 333284 - RNA, 22 nt, Human
ggccgcggauuuucccgcuggc

SEQ ID NO: 333285 - RNA, 22 nt, Human
cacagagagcuacgugcagcgu

SEQ ID NO: 333286 - RNA, 22 nt, Human
agugaauuagccuauuuguaaa

SEQ ID NO: 333287 - RNA, 22 nt, Human
cagcaguacuucucagagguau

SEQ ID NO: 333288 - RNA, 22 nt, Human
ggcugagcuuuucaugaugguu

SEQ ID NO: 333289 - RNA, 22 nt, Human
cagcuccaucuugcuuauacca

SEQ ID NO: 333290 - RNA, 22 nt, Human
uuguugcugcucaaccucuaua

SEQ ID NO: 333291 - RNA, 22 nt, Human
ccuggcagaauauuaaagugca

SEQ ID NO: 333292 - RNA, 23 nt, Human
guuauugcuggugcuggccagcc

SEQ ID NO: 333293 - RNA, 22 nt, Human
ugcauuaagaauuucugaggau

SEQ ID NO: 333294 - RNA, 22 nt, Human
ucagaagguacugaagacaugg

SEQ ID NO: 333295 - RNA, 22 nt, Human
caugucaagacugaagauccag

SEQ ID NO: 333296 - RNA, 22 nt, Human
gaaugcuggcuuacaggcaguu

SEQ ID NO: 333297 - RNA, 22 nt, Human
uccugcagccauuagaggucaa

SEQ ID NO: 333298 - RNA, 22 nt, Human
aagagcuggcucuugcagcagc

SEQ ID NO: 333299 - RNA, 22 nt, Human
aaguguguauuuuucuucagug

SEQ ID NO: 333300 - RNA, 22 nt, Human
agcagugugggcugcacgcugg

SEQ ID NO: 333301 - RNA, 22 nt, Human
acuccuggguuccggagauucu

SEQ ID NO: 333302 - RNA, 22 nt, Human
gagagagacauguaaacgcggu

SEQ ID NO: 333303 - RNA, 22 nt, Human
ugcuccugaacacagcccuaug

SEQ ID NO: 333304 - RNA, 22 nt, Human
ugagcucaagcaauucacccgc

SEQ ID NO: 333305 - RNA, 22 nt, Human
cucugccagccaaagucaucac

SEQ ID NO: 333306 - RNA, 22 nt, Human
cuucauuuggcaggcuggccuc

SEQ ID NO: 333307 - RNA, 22 nt, Human
cuccuuccugguuagcaccuua

SEQ ID NO: 333308 - RNA, 22 nt, Human
auuggccagacuuauccuucag

SEQ ID NO: 333309 - RNA, 22 nt, Human
cgugcggccucggggcccggcu

SEQ ID NO: 333310 - RNA, 22 nt, Human
agucugaaccagauggcaaggu

SEQ ID NO: 333311 - RNA, 22 nt, Human
gccugcuggcuggaaauucucc

SEQ ID NO: 333312 - RNA, 22 nt, Human
uuuuuugucuugaagaaauggu

SEQ ID NO: 333313 - RNA, 22 nt, Human
gggggcgccgccgcucaucuca

SEQ ID NO: 333314 - RNA, 22 nt, Human
cagcuccagccaccggggggug

SEQ ID NO: 333315 - RNA, 22 nt, Human
guuggcuaugagagcuuuagug

SEQ ID NO: 333316 - RNA, 22 nt, Human
gacggggcagccagcugguggc

SEQ ID NO: 333317 - RNA, 22 nt, Human
uugaacaguuuugucagguuca

SEQ ID NO: 333318 - RNA, 22 nt, Human
ucaucuccauacggucucgcag

SEQ ID NO: 333319 - RNA, 22 nt, Human
uagcauuuagaacaccuugaga

SEQ ID NO: 333320 - RNA, 22 nt, Human
cuccagcucgcgagcucugcuc

SEQ ID NO: 333321 - RNA, 22 nt, Human
cuguucccgguggccgggccag

SEQ ID NO: 333322 - RNA, 21 nt, Human
uccaaaggagacugagugugu

SEQ ID NO: 333323 - RNA, 21 nt, Human
agccaggcaagcacccccacu

SEQ ID NO: 333324 - RNA, 19 nt, Human
ugguggaggugcaccugac

SEQ ID NO: 333325 - RNA, 22 nt, Human
uuauuuuguagcucugaucuuu

SEQ ID NO: 333326 - RNA, 22 nt, Human
gaguuugugggaauggaguauu

SEQ ID NO: 333327 - RNA, 22 nt, Human
cuuugcagagggggugggagcu

SEQ ID NO: 333328 - RNA, 19 nt, Human
ucuggcugccaaggauuga

SEQ ID NO: 333329 - RNA, 22 nt, Human
caaagaagagauuuacagagcu

SEQ ID NO: 333330 - RNA, 19 nt, Human
cucugccauuugcugccug

SEQ ID NO: 333331 - RNA, 21 nt, Human
agccugcaauguagguaccgg

SEQ ID NO: 333332 - RNA, 22 nt, Human
uguggguccuccugugugcccg

SEQ ID NO: 333333 - RNA, 22 nt, Human
ugugugggcgaagacagccuuu

SEQ ID NO: 333334 - RNA, 22 nt, Human
cauuuugugcuagacacuaugg

SEQ ID NO: 333335 - RNA, 22 nt, Human
ccaggagagcucucguucagug

SEQ ID NO: 333336 - RNA, 22 nt, Human
gagguuggagggcuggccugca

SEQ ID NO: 333337 - RNA, 22 nt, Human
ggggaggaagcuggaacacggg

SEQ ID NO: 333338 - RNA, 22 nt, Human
agguuuggguucauugcuggcu

SEQ ID NO: 333339 - RNA, 21 nt, Human
uaaagcucguucaggaaaguc

SEQ ID NO: 333340 - RNA, 22 nt, Human
aggcauuacaucuaaauauuua

SEQ ID NO: 333341 - RNA, 19 nt, Human
ugcagcuguaugagcuuaa

SEQ ID NO: 333342 - RNA, 22 nt, Human
uacagcagcccaccuucuucug

SEQ ID NO: 333343 - RNA, 22 nt, Human
ggcuucaguggccagagaugau

SEQ ID NO: 333344 - RNA, 22 nt, Human
uggcuguagaaucagagacuug

SEQ ID NO: 333345 - RNA, 22 nt, Human
ugguuacccagucgcuggaguu

SEQ ID NO: 333346 - RNA, 22 nt, Human
gguuuguugggguccaggccca

SEQ ID NO: 333347 - RNA, 22 nt, Human
ugggaugggaucucgcuguguc

SEQ ID NO: 333348 - RNA, 22 nt, Human
ucaccuguuggauguauacugu

SEQ ID NO: 333349 - RNA, 22 nt, Human
ucuuuuaucuguuguguaacaa

SEQ ID NO: 333350 - RNA, 22 nt, Human
uucccuuucuuaaagaguuagg

SEQ ID NO: 333351 - RNA, 18 nt, Human
gagagcccagcagguggu

SEQ ID NO: 333352 - RNA, 22 nt, Human
acagcuggccgaggcucaggga

SEQ ID NO: 333353 - RNA, 22 nt, Human
uugagcuugaggaguuauuuga

SEQ ID NO: 333354 - RNA, 22 nt, Human
auacagguucucuagggaacag

SEQ ID NO: 333355 - RNA, 22 nt, Human
ggagaggggaacuuguugcuug

SEQ ID NO: 333356 - RNA, 22 nt, Human
augcugugccuggaaagcggcu

SEQ ID NO: 333357 - RNA, 22 nt, Human
ucuguggcaugguaucuggagg

SEQ ID NO: 333358 - RNA, 22 nt, Human
gcugcccauugcucucccacuc

SEQ ID NO: 333359 - RNA, 22 nt, Human
ugcauuugcaauggguacacaa

SEQ ID NO: 333360 - RNA, 22 nt, Human
ggguucagugaugccuucagga

SEQ ID NO: 333361 - RNA, 21 nt, Human
uggcaggcagcuggaagcuug

SEQ ID NO: 333362 - RNA, 22 nt, Human
agacaagagcugaggacauauu

SEQ ID NO: 333363 - RNA, 22 nt, Human
aaaauuaagugucugggaagcc

SEQ ID NO: 333364 - RNA, 22 nt, Human
caagggcagcagccucaagcgg

SEQ ID NO: 333365 - RNA, 22 nt, Human
cucucuccuuagcugcagacca

SEQ ID NO: 333366 - RNA, 22 nt, Human
uccucauucuuggugcaucaaa

SEQ ID NO: 333367 - RNA, 22 nt, Human
cuuuacuucagcaagcuuuccu

SEQ ID NO: 333368 - RNA, 22 nt, Human
ugugcuugucguggagccaggc

SEQ ID NO: 333369 - RNA, 22 nt, Human
cucuccaggcgagguccuacug

SEQ ID NO: 333370 - RNA, 22 nt, Human
cccacucccugcacgccugccg

SEQ ID NO: 333371 - RNA, 22 nt, Human
gaggagagaagcuaacggugcu

SEQ ID NO: 333372 - RNA, 22 nt, Human
uccagcucugcugugcgccggu

SEQ ID NO: 333373 - RNA, 22 nt, Human
ccaccacugaggcacaggagcc

SEQ ID NO: 333374 - RNA, 22 nt, Human
gugccuccaggcucgacuaguc

SEQ ID NO: 333375 - RNA, 22 nt, Human
gucugcccuuggccugggacuu

SEQ ID NO: 333376 - RNA, 22 nt, Human
gaggcuggcagaaaagcacagg

SEQ ID NO: 333377 - RNA, 22 nt, Human
ggcagcaggguagccauuucuc

SEQ ID NO: 333378 - RNA, 22 nt, Human
gugguuguuuccagguuugaaa

SEQ ID NO: 333379 - RNA, 22 nt, Human
gaggcagagacuccaccuucag

SEQ ID NO: 333380 - RNA, 22 nt, Human
agggagcugcucugcuuccgug

SEQ ID NO: 333381 - RNA, 22 nt, Human
gagcuuuucccgucuuucucgu

SEQ ID NO: 333382 - RNA, 22 nt, Human
acagugcugaucuagacugacc

SEQ ID NO: 333383 - RNA, 22 nt, Human
acaccuuuuauucgccaggcac

SEQ ID NO: 333384 - RNA, 22 nt, Human
ggccacuguuuccugggcaguu

SEQ ID NO: 333385 - RNA, 22 nt, Human
ucucccaaccucuggugggugc

SEQ ID NO: 333386 - RNA, 22 nt, Human
gucuggagccacugcugcugcu

SEQ ID NO: 333387 - RNA, 22 nt, Human
gaauguuaaugcacuucuagcu

SEQ ID NO: 333388 - RNA, 22 nt, Human
gggcuguaggagcuggaauggg

SEQ ID NO: 333389 - RNA, 22 nt, Human
cuccgcuuguguauaccuccaa

SEQ ID NO: 333390 - RNA, 22 nt, Human
aggaaaugccgcggcucucuuu

SEQ ID NO: 333391 - RNA, 22 nt, Human
gccuucugauugcuggacugac

SEQ ID NO: 333392 - RNA, 22 nt, Human
cagggcucgcucgcucgcucgc

SEQ ID NO: 333393 - RNA, 22 nt, Human
agccagcauauauauaguugaa

SEQ ID NO: 333394 - RNA, 22 nt, Human
ugcuggcugggcugcuggagac

SEQ ID NO: 333395 - RNA, 22 nt, Human
cugagccagcgggcucacuuuu

SEQ ID NO: 333396 - RNA, 22 nt, Human
ugcugggauuacagucaugagc

SEQ ID NO: 333397 - RNA, 22 nt, Human
agccacauggaccugaugcuag

SEQ ID NO: 333398 - RNA, 22 nt, Human
uuaccugagcggauuuguugca

SEQ ID NO: 333399 - RNA, 22 nt, Human
aagucaauuaguaaacuuggaa

SEQ ID NO: 333400 - RNA, 21 nt, Human
acccugcuuuaugccguccuc

SEQ ID NO: 333401 - RNA, 22 nt, Human
gagcuuggugcugccuguuguc

SEQ ID NO: 333402 - RNA, 22 nt, Human
ggaagcaaauuccagaaccaca

SEQ ID NO: 333403 - RNA, 22 nt, Human
acagcugggaacucacacagca

SEQ ID NO: 333404 - RNA, 22 nt, Human
uggcuacauuuauacucucauu

SEQ ID NO: 333405 - RNA, 22 nt, Human
uaaagacaauuucgagcuguag

SEQ ID NO: 333406 - RNA, 22 nt, Human
uacuguauacuacugcuguucu

SEQ ID NO: 333407 - RNA, 22 nt, Human
ccaggagcccugccacaauggu

SEQ ID NO: 333408 - RNA, 22 nt, Human
aaguuugucucauuugaucuuc

SEQ ID NO: 333409 - RNA, 22 nt, Human
cccacugcaugaguugguauua

SEQ ID NO: 333410 - RNA, 22 nt, Human
uguccagaucaaugcccacaug

SEQ ID NO: 333411 - RNA, 20 nt, Human
ugugugaauuagggcauguu

SEQ ID NO: 333412 - RNA, 22 nt, Human
ggcuuuggggguguccaagaaa

SEQ ID NO: 333413 - RNA, 22 nt, Human
uuugucaccaguggcuuuggua

SEQ ID NO: 333414 - RNA, 22 nt, Human
aguccagggcuuagucagcggg

SEQ ID NO: 333415 - RNA, 22 nt, Human
cccagagcaugugcugccuuug

SEQ ID NO: 333416 - RNA, 22 nt, Human
ggcaagaaccucaauuaccuuu

SEQ ID NO: 333417 - RNA, 21 nt, Human
agggccagaucaccaaggagc

SEQ ID NO: 333418 - RNA, 22 nt, Human
ccuuccaguucuugguuguaau

SEQ ID NO: 333419 - RNA, 22 nt, Human
acacucaugcucagcuggugcu

SEQ ID NO: 333420 - RNA, 22 nt, Human
gagaguuaguugagcagucuga

SEQ ID NO: 333421 - RNA, 22 nt, Human
uugacguccucgauggggaacu

SEQ ID NO: 333422 - RNA, 22 nt, Human
caguuuuacccaagcuuauuuu

SEQ ID NO: 333423 - RNA, 22 nt, Human
cuguuccuccaccucaacaaac

SEQ ID NO: 333424 - RNA, 22 nt, Human
uuccaggccgggcaggaaacac

SEQ ID NO: 333425 - RNA, 22 nt, Human
ggagccaguuuagaccucaguu

SEQ ID NO: 333426 - RNA, 22 nt, Human
acuuugccuucuuacuguguug

SEQ ID NO: 333427 - RNA, 17 nt, Human
ucuccuggcucuaucag

SEQ ID NO: 333428 - RNA, 22 nt, Human
gcugcaagugcauguugcaacu

SEQ ID NO: 333429 - RNA, 19 nt, Human
caggucuucuuggaggacu

SEQ ID NO: 333430 - RNA, 22 nt, Human
gaaacguuguggaaaauccucu

SEQ ID NO: 333431 - RNA, 22 nt, Human
ucuuucagaaacuuugucugcg

SEQ ID NO: 333432 - RNA, 22 nt, Human
ccacugcuguuacuuacgcaaa

SEQ ID NO: 333433 - RNA, 22 nt, Human
cuccccacgccuggacuaagag

SEQ ID NO: 333434 - RNA, 22 nt, Human
gccacaggucggcuagaggguc

SEQ ID NO: 333435 - RNA, 23 nt, Human
ugacacccucauugugugucgca

SEQ ID NO: 333436 - RNA, 22 nt, Human
gcaggggcugagcaccagcggg

SEQ ID NO: 333437 - RNA, 22 nt, Human
cggcagagcccugagucagccu

SEQ ID NO: 333438 - RNA, 22 nt, Human
gccaggcaggccacgcuguguu

SEQ ID NO: 333439 - RNA, 22 nt, Human
cagggccucugugggcucucuc

SEQ ID NO: 333440 - RNA, 22 nt, Human
gguguugcaguugaagacuggu

SEQ ID NO: 333441 - RNA, 22 nt, Human
aagguccuguagccacagagcc

SEQ ID NO: 333442 - RNA, 22 nt, Human
cagaguccugcaccagcuccag

SEQ ID NO: 333443 - RNA, 22 nt, Human
agcaggaaggggaugaugggca

SEQ ID NO: 333444 - RNA, 22 nt, Human
gagcagcaggccagguugcagg

SEQ ID NO: 333445 - RNA, 22 nt, Human
ggcuggcuggcuuagcagagga

SEQ ID NO: 333446 - RNA, 19 nt, Human
cagcaaacacuguaaaugg

SEQ ID NO: 333447 - RNA, 22 nt, Human
uccugaccacuaggaccaggcu

SEQ ID NO: 333448 - RNA, 22 nt, Human
ugcacaguuggcuacaucgugg

SEQ ID NO: 333449 - RNA, 23 nt, Human
cguuuuuuccucagauguucugg

SEQ ID NO: 333450 - RNA, 22 nt, Human
ugcugugcuggcggcagaggcc

SEQ ID NO: 333451 - RNA, 22 nt, Human
ggcugcugcccaccccugcaug

SEQ ID NO: 333452 - RNA, 22 nt, Human
gucuccugaggcauccauugaa

SEQ ID NO: 333453 - RNA, 22 nt, Human
acaagguugauucuggcaucug

SEQ ID NO: 333454 - RNA, 22 nt, Human
cagagccuuaguucuccuagaa

SEQ ID NO: 333455 - RNA, 21 nt, Human
agggccucuguguacuggggg

SEQ ID NO: 333456 - RNA, 22 nt, Human
ccucuucuaggacguccuugug

SEQ ID NO: 333457 - RNA, 22 nt, Human
gggagcugaaggagccggcggg

SEQ ID NO: 333458 - RNA, 22 nt, Human
gcguuggggaccccgaagcugg

SEQ ID NO: 333459 - RNA, 22 nt, Human
uauuuggauagacagggagaug

SEQ ID NO: 333460 - RNA, 22 nt, Human
aaugaguuuguucuauuauuug

SEQ ID NO: 333461 - RNA, 22 nt, Human
cggagaggugggggcagcaucu

SEQ ID NO: 333462 - RNA, 22 nt, Human
caugccugccuggugggcgugg

SEQ ID NO: 333463 - RNA, 22 nt, Human
auuuugacauugcggcauugcu

SEQ ID NO: 333464 - RNA, 22 nt, Human
ugucugccugcgggccggcaca

SEQ ID NO: 333465 - RNA, 22 nt, Human
ggagcgugcacuccaggcccuu

SEQ ID NO: 333466 - RNA, 22 nt, Human
gcaguaaauugagagucauguu

SEQ ID NO: 333467 - RNA, 22 nt, Human
ugcugcccacuguauuucucca

SEQ ID NO: 333468 - RNA, 22 nt, Human
uugucgggcuuacgcagggcca

SEQ ID NO: 333469 - RNA, 22 nt, Human
aggcugcugccuuggagagugu

SEQ ID NO: 333470 - RNA, 22 nt, Human
ggcagaggaagcuggaaguggg

SEQ ID NO: 333471 - RNA, 22 nt, Human
aacugguucuggaggcugcagg

SEQ ID NO: 333472 - RNA, 22 nt, Human
auggguggccccgugugcaguc

SEQ ID NO: 333473 - RNA, 22 nt, Human
uuguuuaaagaacuucugacuu

SEQ ID NO: 333474 - RNA, 22 nt, Human
gggcuggagagucccacguggg

SEQ ID NO: 333475 - RNA, 22 nt, Human
guuugcaaauuguguuaaagcu

SEQ ID NO: 333476 - RNA, 22 nt, Human
gugcuccaggucgcucagagag

SEQ ID NO: 333477 - RNA, 22 nt, Human
auguuguugaacucuuugcaug

SEQ ID NO: 333478 - RNA, 22 nt, Human
uggccuugcccagcgccuaggu

SEQ ID NO: 333479 - RNA, 19 nt, Human
aacuacagcgcacuguccu

SEQ ID NO: 333480 - RNA, 22 nt, Human
gggaagugcccucuucaggaga

SEQ ID NO: 333481 - RNA, 22 nt, Human
uagggagugcguagcagggugg

SEQ ID NO: 333482 - RNA, 22 nt, Human
uuccccuugauaaugcaguaag

SEQ ID NO: 333483 - RNA, 19 nt, Human
uccugcccaccagccaggg

SEQ ID NO: 333484 - RNA, 22 nt, Human
caguuuuucaaaauuacaugau

SEQ ID NO: 333485 - RNA, 22 nt, Human
uggccucuccuggcagcaucca

SEQ ID NO: 333486 - RNA, 22 nt, Human
augauugaaaaugacauugcca

SEQ ID NO: 333487 - RNA, 22 nt, Human
ccagcugcugcaccgugcaugg

SEQ ID NO: 333488 - RNA, 22 nt, Human
cacccucaagcaguggcacgug

SEQ ID NO: 333489 - RNA, 18 nt, Human
ucaugcaaacgcuucaua

SEQ ID NO: 333490 - RNA, 22 nt, Human
ucaugacaacuugcacaguuuu

SEQ ID NO: 333491 - RNA, 22 nt, Human
ucccacugucuucucgugcucg

SEQ ID NO: 333492 - RNA, 22 nt, Human
acaguccuguacaggccauauc

SEQ ID NO: 333493 - RNA, 22 nt, Human
gccuggcaaggcccuguugacu

SEQ ID NO: 333494 - RNA, 21 nt, Human
ugaggccugccagucucagaa

SEQ ID NO: 333495 - RNA, 21 nt, Human
ccaccaggucuucugcucggg

SEQ ID NO: 333496 - RNA, 19 nt, Human
caggauuguuuaaagcuuu

SEQ ID NO: 333497 - RNA, 22 nt, Human
agagcuagaaggaagcauuucu

SEQ ID NO: 333498 - RNA, 22 nt, Human
cagagccacugucugccaggca

SEQ ID NO: 333499 - RNA, 22 nt, Human
cacuguugaagauacuuccucu

SEQ ID NO: 333500 - RNA, 22 nt, Human
ugcagugaugcuucuggcucag

SEQ ID NO: 333501 - RNA, 22 nt, Human
augaauuguccgauguugugca

SEQ ID NO: 333502 - RNA, 17 nt, Human
aguuuuuggaccugugu

SEQ ID NO: 333503 - RNA, 22 nt, Human
ggcagagcuugcagugagccga

SEQ ID NO: 333504 - RNA, 22 nt, Human
ucuuccagauacuuccugacuu

SEQ ID NO: 333505 - RNA, 22 nt, Human
uuauguauggauggcugaaagu

SEQ ID NO: 333506 - RNA, 22 nt, Human
ggcuauguguccagcaucuuug

SEQ ID NO: 333507 - RNA, 22 nt, Human
gccuggagcucggcugagggcg

SEQ ID NO: 333508 - RNA, 22 nt, Human
cccguguggaugcgcuggugcu

SEQ ID NO: 333509 - RNA, 22 nt, Human
aagggugguguaggagaucaaa

SEQ ID NO: 333510 - RNA, 22 nt, Human
gggcucggcaucuguggacucu

SEQ ID NO: 333511 - RNA, 22 nt, Human
ugcugcucuucaccauggccuc

SEQ ID NO: 333512 - RNA, 22 nt, Human
cuucucggccguguggaugcgc

SEQ ID NO: 333513 - RNA, 22 nt, Human
cagugcugcaggcgccugcggu

SEQ ID NO: 333514 - RNA, 17 nt, Human
gugagcugagucaggac

SEQ ID NO: 333515 - RNA, 22 nt, Human
aucgaguucugaugucccuucu

SEQ ID NO: 333516 - RNA, 22 nt, Human
uuuggucuggaaucuucagggu

SEQ ID NO: 333517 - RNA, 22 nt, Human
uccaggcuccccugcgugcucc

SEQ ID NO: 333518 - RNA, 20 nt, Human
uccuccuugcagagcccaga

SEQ ID NO: 333519 - RNA, 22 nt, Human
uuguuuguaaggcucuuagaau

SEQ ID NO: 333520 - RNA, 22 nt, Human
caggaaugccaaccagugcaug

SEQ ID NO: 333521 - RNA, 22 nt, Human
gggggcuggacuuucccacaca

SEQ ID NO: 333522 - RNA, 22 nt, Human
ugcuuggagaaucagucccagc

SEQ ID NO: 333523 - RNA, 22 nt, Human
uuuccaaggaugugucucucua

SEQ ID NO: 333524 - RNA, 22 nt, Human
cugagcagaagggugcacgugc

SEQ ID NO: 333525 - RNA, 22 nt, Human
aagcgcagacacagagagugga

SEQ ID NO: 333526 - RNA, 22 nt, Human
agcuccugaaaagcgcuugcuu

SEQ ID NO: 333527 - RNA, 22 nt, Human
cuugaaguggagcuuuugaaau

SEQ ID NO: 333528 - RNA, 22 nt, Human
caguuuuaugaaugcuuauuag

SEQ ID NO: 333529 - RNA, 22 nt, Human
uucuuugcccauguuuccuaag

SEQ ID NO: 333530 - RNA, 22 nt, Human
ccaaagcuggcuuucaugguuu

SEQ ID NO: 333531 - RNA, 22 nt, Human
caugaccagagaggacggccag

SEQ ID NO: 333532 - RNA, 22 nt, Human
ugucuucuaccuugacagcauu

SEQ ID NO: 333533 - RNA, 22 nt, Human
ccagguaggagagucaacaugu

SEQ ID NO: 333534 - RNA, 22 nt, Human
cacugcccuggggguugccauc

SEQ ID NO: 333535 - RNA, 22 nt, Human
aguuggcauuuuauuuaaguau

SEQ ID NO: 333536 - RNA, 22 nt, Human
cagagggagcccuccaggagca

SEQ ID NO: 333537 - RNA, 22 nt, Human
ggcaagagggcagauggagugc

SEQ ID NO: 333538 - RNA, 19 nt, Human
uuuaaugugugcugcaauc

SEQ ID NO: 333539 - RNA, 22 nt, Human
aguuuccacuggagacacugug

SEQ ID NO: 333540 - RNA, 22 nt, Human
guguggcuaggauggcuuugcu

SEQ ID NO: 333541 - RNA, 22 nt, Human
ggcuguggucauuaggagguug

SEQ ID NO: 333542 - RNA, 22 nt, Human
gcagagcacccugcagugguau

SEQ ID NO: 333543 - RNA, 22 nt, Human
auuaaauuggacgcugggggaa

SEQ ID NO: 333544 - RNA, 19 nt, Human
ggcugccuucugcucaucu

SEQ ID NO: 333545 - RNA, 22 nt, Human
uccuuggcaugccgucuucucc

SEQ ID NO: 333546 - RNA, 22 nt, Human
gccaaaguccuccagccaugca

SEQ ID NO: 333547 - RNA, 20 nt, Human
ggccugagcauggcuggcag

SEQ ID NO: 333548 - RNA, 22 nt, Human
uuguaagacuguagaaugcaaa

SEQ ID NO: 333549 - RNA, 22 nt, Human
gccugcacucaaacacucucuu

SEQ ID NO: 333550 - RNA, 22 nt, Human
aauucaaggaucuguuaaaucu

SEQ ID NO: 333551 - RNA, 22 nt, Human
caguuuccugaagagaaagaau

SEQ ID NO: 333552 - RNA, 20 nt, Human
ucacuguaauugccuacauu

SEQ ID NO: 333553 - RNA, 22 nt, Human
uuccaaggagagcucgaccuca

SEQ ID NO: 333554 - RNA, 22 nt, Human
cugucaaauggaaacuuauccu

SEQ ID NO: 333555 - RNA, 22 nt, Human
uggcugcccccucccguggaca

SEQ ID NO: 333556 - RNA, 22 nt, Human
gccggacugcugcagcugcuag

SEQ ID NO: 333557 - RNA, 22 nt, Human
uccaggagugauaaggccacug

SEQ ID NO: 333558 - RNA, 22 nt, Human
uuuaggcucaaaagaguuggug

SEQ ID NO: 333559 - RNA, 22 nt, Human
gggcugcacuagggcaagguga

SEQ ID NO: 333560 - RNA, 22 nt, Human
auugcacaucugcacuacagcc

SEQ ID NO: 333561 - RNA, 22 nt, Human
uuuucuuggaguggcuguccuu

SEQ ID NO: 333562 - RNA, 19 nt, Human
cucugccucuggcuguggc

SEQ ID NO: 333563 - RNA, 22 nt, Human
gcuuccaaugcuucuaucacau

SEQ ID NO: 333564 - RNA, 22 nt, Human
ggccucugccccgcggggcucg

SEQ ID NO: 333565 - RNA, 22 nt, Human
ggagcugcucagagccaguccc

SEQ ID NO: 333566 - RNA, 22 nt, Human
caacuuuagaccccaaguagcu

SEQ ID NO: 333567 - RNA, 22 nt, Human
cuucuggcguuggaggucugag

SEQ ID NO: 333568 - RNA, 22 nt, Human
ucacgugagggaccugugucug

SEQ ID NO: 333569 - RNA, 22 nt, Human
uuguacuuaaauaugcaaauag

SEQ ID NO: 333570 - RNA, 22 nt, Human
acauuugauauggaguugugua

SEQ ID NO: 333571 - RNA, 22 nt, Human
cagcuuuugcagacuucuugcc

SEQ ID NO: 333572 - RNA, 22 nt, Human
acagcuggaggucugugagcac

SEQ ID NO: 333573 - RNA, 22 nt, Human
ugcaugacaauugccgucaagu

SEQ ID NO: 333574 - RNA, 22 nt, Human
agcauggccucccgggccuggc

SEQ ID NO: 333575 - RNA, 22 nt, Human
ggccgugcuccaaagucaucgu

SEQ ID NO: 333576 - RNA, 22 nt, Human
gacaggugcuaagggaccuggc

SEQ ID NO: 333577 - RNA, 22 nt, Human
ccaggagaaugggauuacccua

SEQ ID NO: 333578 - RNA, 23 nt, Human
agugaugucacccacagacaagg

SEQ ID NO: 333579 - RNA, 22 nt, Human
ugcauaaacuucucugguguga

SEQ ID NO: 333580 - RNA, 18 nt, Human
uggggggcuugucugaag

SEQ ID NO: 333581 - RNA, 21 nt, Human
gccugggaagagaaagguaag

SEQ ID NO: 333582 - RNA, 22 nt, Human
gcagugacagacaacuguuuga

SEQ ID NO: 333583 - RNA, 22 nt, Human
cuccuuaaagggagcagcagcu

SEQ ID NO: 333584 - RNA, 22 nt, Human
aggaaauuuugaaucagugucu

SEQ ID NO: 333585 - RNA, 22 nt, Human
caggccugugacaccgugucug

SEQ ID NO: 333586 - RNA, 19 nt, Human
acucaggcuuccucugagg

SEQ ID NO: 333587 - RNA, 20 nt, Human
cucuuuucacucucaguggu

SEQ ID NO: 333588 - RNA, 22 nt, Human
cacucacccgguccuucccagu

SEQ ID NO: 333589 - RNA, 22 nt, Human
ugccgcugucgccaccauggcu

SEQ ID NO: 333590 - RNA, 22 nt, Human
agugauguagguggauucuggc

SEQ ID NO: 333591 - RNA, 22 nt, Human
agccagugcagcuggaaauuca

SEQ ID NO: 333592 - RNA, 22 nt, Human
uuugcuugauuaggauauggaa

SEQ ID NO: 333593 - RNA, 22 nt, Human
ggccaaggcucuugagggcuga

SEQ ID NO: 333594 - RNA, 22 nt, Human
ucaguguagcagacuuguagcc

SEQ ID NO: 333595 - RNA, 22 nt, Human
aguguauuugccuauaaaaaug

SEQ ID NO: 333596 - RNA, 22 nt, Human
gggcggggcuuccguccuccac

SEQ ID NO: 333597 - RNA, 18 nt, Human
uaaguggacacaggucac

SEQ ID NO: 333598 - RNA, 22 nt, Human
ugugucuuuggcgaugucugga

SEQ ID NO: 333599 - RNA, 22 nt, Human
cuuggcugaacuccaggaugca

SEQ ID NO: 333600 - RNA, 22 nt, Human
ggugagaggcagugcuguggaa

SEQ ID NO: 333601 - RNA, 22 nt, Human
gccuuuuaaggcagagggagau

SEQ ID NO: 333602 - RNA, 22 nt, Human
aggcuguagaucuagacaugua

SEQ ID NO: 333603 - RNA, 22 nt, Human
cuggccgcaguguggaguugug

SEQ ID NO: 333604 - RNA, 22 nt, Human
ugggaaggggagcuggaaagga

SEQ ID NO: 333605 - RNA, 22 nt, Human
uacaggcucuugucagacguau

SEQ ID NO: 333606 - RNA, 22 nt, Human
cugcagggcccaaggucaacgg

SEQ ID NO: 333607 - RNA, 22 nt, Human
cugccguugugaagcucuuaga

SEQ ID NO: 333608 - RNA, 22 nt, Human
ccacuguuuccuuucugcuggc

SEQ ID NO: 333609 - RNA, 22 nt, Human
ugcugcuuguuuuguaaauaaa

SEQ ID NO: 333610 - RNA, 22 nt, Human
uguuaccauaggucagaacguu

SEQ ID NO: 333611 - RNA, 22 nt, Human
cuccugcagcccucagcagcca

SEQ ID NO: 333612 - RNA, 22 nt, Human
gccacaggaaagcacccuggag

SEQ ID NO: 333613 - RNA, 17 nt, Human
agccugcugaucucaca

SEQ ID NO: 333614 - RNA, 22 nt, Human
gacuuugguucagggcucagag

SEQ ID NO: 333615 - RNA, 22 nt, Human
gucuugcacuuaccuaagaacu

SEQ ID NO: 333616 - RNA, 18 nt, Human
ggaaaaggagugucuagc

SEQ ID NO: 333617 - RNA, 22 nt, Human
agaacauaucuguuuucuaacu

SEQ ID NO: 333618 - RNA, 22 nt, Human
ccacugcuaacuugcugcagcu

SEQ ID NO: 333619 - RNA, 22 nt, Human
uggcccgggaguuuugaagagu

SEQ ID NO: 333620 - RNA, 22 nt, Human
ggcagaggagcuggaaacaugg

SEQ ID NO: 333621 - RNA, 22 nt, Human
uuuucaguugugcucucuaguu

SEQ ID NO: 333622 - RNA, 19 nt, Human
ucuuucauuucuagcucug

SEQ ID NO: 333623 - RNA, 22 nt, Human
gccaggucgucuccauguccaa

SEQ ID NO: 333624 - RNA, 21 nt, Human
auacaagaagauggcagucug

SEQ ID NO: 333625 - RNA, 22 nt, Human
aaggcuccagugaaugcuggca

SEQ ID NO: 333626 - RNA, 21 nt, Human
uccaggagcacgggacuagga

SEQ ID NO: 333627 - RNA, 22 nt, Human
cuggcuccauccuugagcucug

SEQ ID NO: 333628 - RNA, 22 nt, Human
uaaaaucaugacagauugacau

SEQ ID NO: 333629 - RNA, 22 nt, Human
cccacugcugcucuccauggca

SEQ ID NO: 333630 - RNA, 22 nt, Human
guucuucaggcugugcucuaga

SEQ ID NO: 333631 - RNA, 22 nt, Human
gacacugcacuuggggcccaca

SEQ ID NO: 333632 - RNA, 22 nt, Human
gaaaggagaggguuaaggagcu

SEQ ID NO: 333633 - RNA, 22 nt, Human
aagcauuuuagauaaagcauca

SEQ ID NO: 333634 - RNA, 22 nt, Human
cacuuggaggaaggccuauuca

SEQ ID NO: 333635 - RNA, 22 nt, Human
cugcagggcagggccuccuggc

SEQ ID NO: 333636 - RNA, 22 nt, Human
augauuuguuaacagacuuaau

SEQ ID NO: 333637 - RNA, 22 nt, Human
cugugugcagggcacaauggaa

SEQ ID NO: 333638 - RNA, 22 nt, Human
auggaguugagcucuguugucc

SEQ ID NO: 333639 - RNA, 22 nt, Human
ccaagaggggaagggccgcagc

SEQ ID NO: 333640 - RNA, 22 nt, Human
ucucgugcaggccuugcucgga

SEQ ID NO: 333641 - RNA, 22 nt, Human
caggcgggcaggugcggccccu

SEQ ID NO: 333642 - RNA, 22 nt, Human
ugucauggacuggauuucugcu

SEQ ID NO: 333643 - RNA, 22 nt, Human
gcugcugcuugaaggcucggag

SEQ ID NO: 333644 - RNA, 22 nt, Human
aguguguccaggaagcagaugg

SEQ ID NO: 333645 - RNA, 22 nt, Human
ugaacagugugagggugugacc

SEQ ID NO: 333646 - RNA, 22 nt, Human
uggauguuugaaguugcaugug

SEQ ID NO: 333647 - RNA, 22 nt, Human
gaauuguacugcaaucagggga

SEQ ID NO: 333648 - RNA, 22 nt, Human
uauuuguuucuaguggcagcaa

SEQ ID NO: 333649 - RNA, 22 nt, Human
gcuugcugaacaggaaccuggc

SEQ ID NO: 333650 - RNA, 22 nt, Human
uggcagaaugaagacuggggcc

SEQ ID NO: 333651 - RNA, 21 nt, Human
gcaggguuugugcugugaguu

SEQ ID NO: 333652 - RNA, 22 nt, Human
uuugaaaggagcuuuauccaga

SEQ ID NO: 333653 - RNA, 20 nt, Human
ucagugggaaagugagagug

SEQ ID NO: 333654 - RNA, 22 nt, Human
ccuccugggccuugcucuguga

SEQ ID NO: 333655 - RNA, 20 nt, Human
cuuguuaaauaugcagguag

SEQ ID NO: 333656 - RNA, 22 nt, Human
ugugcccuguuaaaugcacagu

SEQ ID NO: 333657 - RNA, 22 nt, Human
gcaaaacagucgaugccuccca

SEQ ID NO: 333658 - RNA, 22 nt, Human
uccuccuuuccccgcuggagcc

SEQ ID NO: 333659 - RNA, 22 nt, Human
cagcccaggacugcagguguuu

SEQ ID NO: 333660 - RNA, 22 nt, Human
ucccacacagcccgcucaccgg

SEQ ID NO: 333661 - RNA, 22 nt, Human
acagacacaggcguggagucgc

SEQ ID NO: 333662 - RNA, 22 nt, Human
cagcccacugccucugugguag

SEQ ID NO: 333663 - RNA, 23 nt, Human
gcacagagcaguuaggggaagau

SEQ ID NO: 333664 - RNA, 22 nt, Human
acauucuacaguuaaccauuag

SEQ ID NO: 333665 - RNA, 22 nt, Human
gccauguucuugaaucuggguc

SEQ ID NO: 333666 - RNA, 22 nt, Human
gcucguacaccagcguggaggu

SEQ ID NO: 333667 - RNA, 22 nt, Human
auuuggcauaggcagaggccca

SEQ ID NO: 333668 - RNA, 22 nt, Human
ucucagaguuccucuggagucc

SEQ ID NO: 333669 - RNA, 22 nt, Human
aggcagugguguuugcuggugg

SEQ ID NO: 333670 - RNA, 22 nt, Human
acacuggagauggaccucacaa

SEQ ID NO: 333671 - RNA, 22 nt, Human
agaugcugccaggccccucagu

SEQ ID NO: 333672 - RNA, 22 nt, Human
agcuggugugccaguuccaguu

SEQ ID NO: 333673 - RNA, 22 nt, Human
ugacccucuuccccaugcgcuc

SEQ ID NO: 333674 - RNA, 22 nt, Human
aaaguaauugugguucuugcca

SEQ ID NO: 333675 - RNA, 22 nt, Human
aucuucccaggcuggggagagg

SEQ ID NO: 333676 - RNA, 22 nt, Human
gagggugguggcuuaaggugcu

SEQ ID NO: 333677 - RNA, 22 nt, Human
cagagcugagucuucaagguug

SEQ ID NO: 333678 - RNA, 22 nt, Human
ggagguggagcuggaaguucca

SEQ ID NO: 333679 - RNA, 22 nt, Human
cauuguguauuucuguaguacu

SEQ ID NO: 333680 - RNA, 22 nt, Human
uguccugugcacuguagcaugu

SEQ ID NO: 333681 - RNA, 22 nt, Human
caggggcggguaaaaggccucc

SEQ ID NO: 333682 - RNA, 22 nt, Human
ccccacaccugccgggcagcag

SEQ ID NO: 333683 - RNA, 22 nt, Human
cuuugugauaguguuaagacca

SEQ ID NO: 333684 - RNA, 20 nt, Human
guggcagugguggcagcagu

SEQ ID NO: 333685 - RNA, 22 nt, Human
auuaguguuguggcuucauggc

SEQ ID NO: 333686 - RNA, 22 nt, Human
ccgcuguccuggagcugcugcu

SEQ ID NO: 333687 - RNA, 22 nt, Human
cagcugcuguucaguuuuguuu

SEQ ID NO: 333688 - RNA, 22 nt, Human
guggcauuugggagaugcgugg

SEQ ID NO: 333689 - RNA, 20 nt, Human
ucuuuuauuggcagauccug

SEQ ID NO: 333690 - RNA, 22 nt, Human
auuuccaggaguugaggucuga

SEQ ID NO: 333691 - RNA, 22 nt, Human
auguucaaguaccuuugugucu

SEQ ID NO: 333692 - RNA, 23 nt, Human
uugguuacuggauuugaggggcc

SEQ ID NO: 333693 - RNA, 22 nt, Human
cugcaccgugucucgggcugcc

SEQ ID NO: 333694 - RNA, 22 nt, Human
guggaaauuuuaggaucaucuu

SEQ ID NO: 333695 - RNA, 22 nt, Human
guggcagagagcaagugucuga

SEQ ID NO: 333696 - RNA, 22 nt, Human
aggugcuuggcucgugcacaca

SEQ ID NO: 333697 - RNA, 22 nt, Human
acacuggacucagaggccagaa

SEQ ID NO: 333698 - RNA, 22 nt, Human
gggaggugauuaggaccaugua

SEQ ID NO: 333699 - RNA, 22 nt, Human
acagcugugggcucugcauaua

SEQ ID NO: 333700 - RNA, 22 nt, Human
cagcugccuguauuguccucau

SEQ ID NO: 333701 - RNA, 22 nt, Human
agcaaggcagcuuucacugcuu

SEQ ID NO: 333702 - RNA, 22 nt, Human
gucagcgugcucagccuauuau

SEQ ID NO: 333703 - RNA, 22 nt, Human
cagaugaaguaggugacgagca

SEQ ID NO: 333704 - RNA, 22 nt, Human
ugccauagcaaugguaagcuga

SEQ ID NO: 333705 - RNA, 22 nt, Human
ugguaaaugucuaacaaucacu

SEQ ID NO: 333706 - RNA, 22 nt, Human
ggacaucuguugugguagagga

SEQ ID NO: 333707 - RNA, 21 nt, Human
agagacugucacugcaguacc

SEQ ID NO: 333708 - RNA, 22 nt, Human
ggugcggagacuccaugaggcc

SEQ ID NO: 333709 - RNA, 22 nt, Human
cagcuuugccaaguaaggucuu

SEQ ID NO: 333710 - RNA, 20 nt, Human
agugauuuguuaguacauug

SEQ ID NO: 333711 - RNA, 22 nt, Human
agucagucugcuagccugugga

SEQ ID NO: 333712 - RNA, 18 nt, Human
acagggagggcgcugggg

SEQ ID NO: 333713 - RNA, 22 nt, Human
auuuggucuacauuuuccaaau

SEQ ID NO: 333714 - RNA, 22 nt, Human
gcacaaaagguacuucauguag

SEQ ID NO: 333715 - RNA, 22 nt, Human
uccagguccuacuggcccauag

SEQ ID NO: 333716 - RNA, 22 nt, Human
caaaauuguugaugcugcuuug

SEQ ID NO: 333717 - RNA, 22 nt, Human
ggagaggguagggguccugccc

SEQ ID NO: 333718 - RNA, 22 nt, Human
ccucuuccacugggccccaucc

SEQ ID NO: 333719 - RNA, 22 nt, Human
uugguuaccuucagaaaugagu

SEQ ID NO: 333720 - RNA, 21 nt, Human
gcuccuggugcugcguggcgc

SEQ ID NO: 333721 - RNA, 17 nt, Human
uuagagcuacauguuga

SEQ ID NO: 333722 - RNA, 22 nt, Human
gaugggcaucaaacaugacgug

SEQ ID NO: 333723 - RNA, 22 nt, Human
cugcugccuuccaaaggccagg

SEQ ID NO: 333724 - RNA, 22 nt, Human
gcccucugguggccgccucggc

SEQ ID NO: 333725 - RNA, 22 nt, Human
aauaguguauuuuucaaaauua

SEQ ID NO: 333726 - RNA, 22 nt, Human
guuguuuuugaacggugguggc

SEQ ID NO: 333727 - RNA, 22 nt, Human
cagucucuggugaguugacagu

SEQ ID NO: 333728 - RNA, 22 nt, Human
cuugaaagucagcagaguggau

SEQ ID NO: 333729 - RNA, 22 nt, Human
gcagcccaggcucgcucacugc

SEQ ID NO: 333730 - RNA, 22 nt, Human
aagcaaaagguuacacuucugg

SEQ ID NO: 333731 - RNA, 22 nt, Human
gcaaggagcaccuuucuggaac

SEQ ID NO: 333732 - RNA, 22 nt, Human
cuggcacaggauccgagaccuu

SEQ ID NO: 333733 - RNA, 22 nt, Human
agccccaggcccggacgccucu

SEQ ID NO: 333734 - RNA, 22 nt, Human
ugcgccugcgcaaagguuucug

SEQ ID NO: 333735 - RNA, 18 nt, Human
aggagcggcugcggcugc

SEQ ID NO: 333736 - RNA, 22 nt, Human
aaagcagcagcacguggaagag

SEQ ID NO: 333737 - RNA, 22 nt, Human
ugaggccugaagccuggagccu

SEQ ID NO: 333738 - RNA, 22 nt, Human
uccaaauagcuggaugauggug

SEQ ID NO: 333739 - RNA, 22 nt, Human
aggccagggcacugcucuuuag

SEQ ID NO: 333740 - RNA, 22 nt, Human
cugggaagggacgccagugccu

SEQ ID NO: 333741 - RNA, 22 nt, Human
uuccuccagccuggagcacuuc

SEQ ID NO: 333742 - RNA, 22 nt, Human
cugagcagucuagccagguguu

SEQ ID NO: 333743 - RNA, 22 nt, Human
aaggcaguuaauuuggcuagaa

SEQ ID NO: 333744 - RNA, 18 nt, Human
uggguggcuagggaguuu

SEQ ID NO: 333745 - RNA, 22 nt, Human
auguaagagcuuugcagggaaa

SEQ ID NO: 333746 - RNA, 22 nt, Human
cuggugcuguagccugauugag

SEQ ID NO: 333747 - RNA, 22 nt, Human
uggcaauguggaaugguccagg

SEQ ID NO: 333748 - RNA, 17 nt, Human
agcagcuggguugaucu

SEQ ID NO: 333749 - RNA, 22 nt, Human
acucuguuugcagguagcucag

SEQ ID NO: 333750 - RNA, 21 nt, Human
gucuuuuuaauugcgauuucc

SEQ ID NO: 333751 - RNA, 22 nt, Human
uagcugcuugaccaggcagugg

SEQ ID NO: 333752 - RNA, 22 nt, Human
cccucucccugcagaauguggc

SEQ ID NO: 333753 - RNA, 22 nt, Human
gccuggcgccgggcugccuguc

SEQ ID NO: 333754 - RNA, 22 nt, Human
ccugcgcgucugggucugucuc

SEQ ID NO: 333755 - RNA, 22 nt, Human
ucaccggcagacguggccugau

SEQ ID NO: 333756 - RNA, 22 nt, Human
gaggagaggcuggacgcgguga

SEQ ID NO: 333757 - RNA, 22 nt, Human
gagucgagcagaaagccgucgg

SEQ ID NO: 333758 - RNA, 21 nt, Human
uaaaagaugacaagacagcuc

SEQ ID NO: 333759 - RNA, 22 nt, Human
gauguggcugcucuaaagccca

SEQ ID NO: 333760 - RNA, 22 nt, Human
cucagucucuugggcugugaag

SEQ ID NO: 333761 - RNA, 22 nt, Human
ugcaaaaagagcgaggagcccu

SEQ ID NO: 333762 - RNA, 22 nt, Human
gcagaagcccggucagcgcacg

SEQ ID NO: 333763 - RNA, 22 nt, Human
gcccagcgagcagagguggacg

SEQ ID NO: 333764 - RNA, 22 nt, Human
uggcacaguuaaaguuguagaa

SEQ ID NO: 333765 - RNA, 22 nt, Human
gcugcaggcucugcaggaauug

SEQ ID NO: 333766 - RNA, 22 nt, Human
aaagcacauuacaagcucaguc

SEQ ID NO: 333767 - RNA, 21 nt, Human
acaaauuguuuauauaggaag

SEQ ID NO: 333768 - RNA, 22 nt, Human
agaugcugcuccacaggccagg

SEQ ID NO: 333769 - RNA, 22 nt, Human
gccagguaugaauuacgcacga

SEQ ID NO: 333770 - RNA, 22 nt, Human
ccucuggccuaggccgggagag

SEQ ID NO: 333771 - RNA, 22 nt, Human
cucacagcugcuucaggaucca

SEQ ID NO: 333772 - RNA, 22 nt, Human
ccaucuucucuugaaccuccuu

SEQ ID NO: 333773 - RNA, 22 nt, Human
ucuccacaccagaaggagcuga

SEQ ID NO: 333774 - RNA, 22 nt, Human
gcagcucucuggccugcccugg

SEQ ID NO: 333775 - RNA, 22 nt, Human
ugaacaugcuguugauggccug

SEQ ID NO: 333776 - RNA, 21 nt, Human
auucugaguugucagucuuca

SEQ ID NO: 333777 - RNA, 22 nt, Human
aagcuggccuguaccugcugag

SEQ ID NO: 333778 - RNA, 22 nt, Human
gcuuuuauuucuucacaaaagu

SEQ ID NO: 333779 - RNA, 22 nt, Human
aggagccauugcaggauggcag

SEQ ID NO: 333780 - RNA, 18 nt, Human
uccaccgcgugcaccucu

SEQ ID NO: 333781 - RNA, 22 nt, Human
cgcagcugcugcucugaaacag

SEQ ID NO: 333782 - RNA, 22 nt, Human
cgcgcugcagacagcggaggcc

SEQ ID NO: 333783 - RNA, 22 nt, Human
auauauacuuugacacauucug

SEQ ID NO: 333784 - RNA, 22 nt, Human
aggaagccuggaguccugccca

SEQ ID NO: 333785 - RNA, 22 nt, Human
acugcacuccagcccgagcaac

SEQ ID NO: 333786 - RNA, 22 nt, Human
uuggaaauguagaaaagcagau

SEQ ID NO: 333787 - RNA, 22 nt, Human
guuuccuuuuggaauuagagcu

SEQ ID NO: 333788 - RNA, 22 nt, Human
uuuccagaaauaccauuuggug

SEQ ID NO: 333789 - RNA, 22 nt, Human
uggaaaauauuuaggugaauga

SEQ ID NO: 333790 - RNA, 22 nt, Human
ggcggugguugagaggacggcg

SEQ ID NO: 333791 - RNA, 22 nt, Human
ugcccucagcagcagcuccugc

SEQ ID NO: 333792 - RNA, 22 nt, Human
ugaaguuguuaagguugccauu

SEQ ID NO: 333793 - RNA, 22 nt, Human
gccccagcagcaaugcgguuga

SEQ ID NO: 333794 - RNA, 23 nt, Human
ggaggcacuuaggcagagcagag

SEQ ID NO: 333795 - RNA, 22 nt, Human
gcagcugcgcugguguggggca

SEQ ID NO: 333796 - RNA, 22 nt, Human
uccgggagcugaacgucuugcg

SEQ ID NO: 333797 - RNA, 22 nt, Human
uggagccagcaggacucagagg

SEQ ID NO: 333798 - RNA, 22 nt, Human
cagcuuguuuacaugcuuauuc

SEQ ID NO: 333799 - RNA, 22 nt, Human
ccucuuccuucucacuguggaa

SEQ ID NO: 333800 - RNA, 22 nt, Human
agccagcuaccggggcuccugg

SEQ ID NO: 333801 - RNA, 20 nt, Human
cugcuccacccggcucucag

SEQ ID NO: 333802 - RNA, 22 nt, Human
ugguuuguauauguuugugaga

SEQ ID NO: 333803 - RNA, 18 nt, Human
uccuuucaccccuucucu

SEQ ID NO: 333804 - RNA, 22 nt, Human
uuauuugcccauguuuagcaga

SEQ ID NO: 333805 - RNA, 22 nt, Human
ugcuccguucuucugcuucuug

SEQ ID NO: 333806 - RNA, 19 nt, Human
acugcagggaggaggugug

SEQ ID NO: 333807 - RNA, 22 nt, Human
ccucccagaugugcccaaugga

SEQ ID NO: 333808 - RNA, 22 nt, Human
ggcgcaguugagcgugcuguuc

SEQ ID NO: 333809 - RNA, 22 nt, Human
cagcuggacugggauguagcga

SEQ ID NO: 333810 - RNA, 22 nt, Human
aucccuggccacgaagcugccc

SEQ ID NO: 333811 - RNA, 22 nt, Human
ggaagaggcugaggccaugcug

SEQ ID NO: 333812 - RNA, 22 nt, Human
cuccacagccccuccaguggca

SEQ ID NO: 333813 - RNA, 23 nt, Human
aaaguacuuaaucugcaaaccac

SEQ ID NO: 333814 - RNA, 23 nt, Human
gggcugcuccaggccaaggcugg

SEQ ID NO: 333815 - RNA, 17 nt, Human
ucugcagggggccgugu

SEQ ID NO: 333816 - RNA, 22 nt, Human
aaggaggaauguagccagcucc

SEQ ID NO: 333817 - RNA, 22 nt, Human
uggaagggagcuggaauuugga

SEQ ID NO: 333818 - RNA, 22 nt, Human
agggccagcagcuuggccaacc

SEQ ID NO: 333819 - RNA, 22 nt, Human
aaauucuguccugaaugccauu

SEQ ID NO: 333820 - RNA, 22 nt, Human
agccacagucuguagccagcuu

SEQ ID NO: 333821 - RNA, 22 nt, Human
acaguucuguccuagacuucgu

SEQ ID NO: 333822 - RNA, 22 nt, Human
cuucauuaaugucuauaaguuu

SEQ ID NO: 333823 - RNA, 22 nt, Human
gcacagagagcagugggggaca

SEQ ID NO: 333824 - RNA, 22 nt, Human
ugucuguccaucugucugggac

SEQ ID NO: 333825 - RNA, 22 nt, Human
aacacugagaggggaguggcac

SEQ ID NO: 333826 - RNA, 22 nt, Human
uuuggaaaugagaagccaccuu

SEQ ID NO: 333827 - RNA, 22 nt, Human
cccaggucgucagcaguguggu

SEQ ID NO: 333828 - RNA, 22 nt, Human
agagaugcuguggguagaggca

SEQ ID NO: 333829 - RNA, 22 nt, Human
ugcucccaaaccugacaggcuc

SEQ ID NO: 333830 - RNA, 22 nt, Human
cgcagcuucagggccaggaggg

SEQ ID NO: 333831 - RNA, 21 nt, Human
ucccucagaagcucuugguca

SEQ ID NO: 333832 - RNA, 22 nt, Human
uccguuuucacacugcuauaaa

SEQ ID NO: 333833 - RNA, 19 nt, Human
uuacaugacauaugaagga

SEQ ID NO: 333834 - RNA, 22 nt, Human
acggagcccgugucagguggga

SEQ ID NO: 333835 - RNA, 22 nt, Human
uucagagcuggugucuacagcu

SEQ ID NO: 333836 - RNA, 22 nt, Human
gcauaaaggacuauaaggauca

SEQ ID NO: 333837 - RNA, 22 nt, Human
aggcugucucaccucaggaggg

SEQ ID NO: 333838 - RNA, 22 nt, Human
cuauuuucccauaugguugaca

SEQ ID NO: 333839 - RNA, 22 nt, Human
ugucacagagcgugcaacagaa

SEQ ID NO: 333840 - RNA, 22 nt, Human
ggcagugaugucaaacagugaa

SEQ ID NO: 333841 - RNA, 22 nt, Human
gaacaguuucccuguagaaaau

SEQ ID NO: 333842 - RNA, 22 nt, Human
uuuaaacuaacaguacacguug

SEQ ID NO: 333843 - RNA, 22 nt, Human
uugagcugccuggcuguggcuc

SEQ ID NO: 333844 - RNA, 19 nt, Human
ugguucuccuuccacaguc

SEQ ID NO: 333845 - RNA, 22 nt, Human
uuggaaguucuuagccuuuuca

SEQ ID NO: 333846 - RNA, 22 nt, Human
acgccucugcagcugccgggcc

SEQ ID NO: 333847 - RNA, 22 nt, Human
cuggccucacagaggcuaagcc

SEQ ID NO: 333848 - RNA, 22 nt, Human
uccucccugcacucagugaagu

SEQ ID NO: 333849 - RNA, 22 nt, Human
gccugagccgccugagcggcgg

SEQ ID NO: 333850 - RNA, 22 nt, Human
uugaggagucaggggcacggaa

SEQ ID NO: 333851 - RNA, 22 nt, Human
gacggagcugguugcugcggcu

SEQ ID NO: 333852 - RNA, 22 nt, Human
auguggcuuucugcguuuucuc

SEQ ID NO: 333853 - RNA, 22 nt, Human
gcccagcugcacccuggugggu

SEQ ID NO: 333854 - RNA, 21 nt, Human
gcuggcugucucuuacacggu

SEQ ID NO: 333855 - RNA, 22 nt, Human
ugggcugcuuccucagcugaga

SEQ ID NO: 333856 - RNA, 22 nt, Human
auauuuguuuggcagaguucag

SEQ ID NO: 333857 - RNA, 22 nt, Human
cuggcuuucauggcgcaguuga

SEQ ID NO: 333858 - RNA, 22 nt, Human
ugcaaggcacccacucugcuuu

SEQ ID NO: 333859 - RNA, 22 nt, Human
cagcuccagcccaggcagcucc

SEQ ID NO: 333860 - RNA, 22 nt, Human
ccccaacccugguuccguggcg

SEQ ID NO: 333861 - RNA, 20 nt, Human
aaaaacaguaaugcugaaga

SEQ ID NO: 333862 - RNA, 18 nt, Human
gggcuuuacagaguggag

SEQ ID NO: 333863 - RNA, 18 nt, Human
gagaggagccagaauuuu

SEQ ID NO: 333864 - RNA, 22 nt, Human
guaggggccagaaagacuuaga

SEQ ID NO: 333865 - RNA, 22 nt, Human
guucuccaggggcuguucaucu

SEQ ID NO: 333866 - RNA, 22 nt, Human
ucagccuggcaggauggccugg

SEQ ID NO: 333867 - RNA, 19 nt, Human
ugguggaggccccauguuc

SEQ ID NO: 333868 - RNA, 22 nt, Human
auuuccuggaggaauggaagca

SEQ ID NO: 333869 - RNA, 22 nt, Human
acaagcgggccacagugcuggu

SEQ ID NO: 333870 - RNA, 22 nt, Human
ggcggccugugggucggccuca

SEQ ID NO: 333871 - RNA, 20 nt, Human
ggcagagcuaugucuguugc

SEQ ID NO: 333872 - RNA, 19 nt, Human
cucucagccugucuccuug

SEQ ID NO: 333873 - RNA, 22 nt, Human
uaaaaguuagcuaggacaaagu

SEQ ID NO: 333874 - RNA, 22 nt, Human
cucucuuuuucgugugccgaag

SEQ ID NO: 333875 - RNA, 22 nt, Human
ggcagcugaagaggaacuuugg

SEQ ID NO: 333876 - RNA, 20 nt, Human
gggcucugcauccaucagcc

SEQ ID NO: 333877 - RNA, 22 nt, Human
accuuuaugaaacagcugucgu

SEQ ID NO: 333878 - RNA, 22 nt, Human
uuguauuaaaauguguuucugu

SEQ ID NO: 333879 - RNA, 22 nt, Human
cccuggcucaggcagcuuuguu

SEQ ID NO: 333880 - RNA, 22 nt, Human
gccgugcgugcgcaggugcugu

SEQ ID NO: 333881 - RNA, 22 nt, Human
cugcacagucauuuccucucaa

SEQ ID NO: 333882 - RNA, 22 nt, Human
uuuccagggaggaauguggggu

SEQ ID NO: 333883 - RNA, 22 nt, Human
cgcugggcgcgcuccgaacccg

SEQ ID NO: 333884 - RNA, 22 nt, Human
aaacccugagacuuggggccag

SEQ ID NO: 333885 - RNA, 23 nt, Human
uggccucuccccaccuggcagaa

SEQ ID NO: 333886 - RNA, 22 nt, Human
aggcugcagaggugcugccaga

SEQ ID NO: 333887 - RNA, 22 nt, Human
uugcacagaugcacaugguugc

SEQ ID NO: 333888 - RNA, 22 nt, Human
cacucucacaugcccugucagu

SEQ ID NO: 333889 - RNA, 22 nt, Human
uuuauucucuaguuggucagau

SEQ ID NO: 333890 - RNA, 22 nt, Human
guguuuaaugcagaugugggug

SEQ ID NO: 333891 - RNA, 22 nt, Human
aagguggugaucaucuugaagg

SEQ ID NO: 333892 - RNA, 22 nt, Human
aauguuugaacuuugcauauuu

SEQ ID NO: 333893 - RNA, 22 nt, Human
guggcaggagggcaucacuugg

SEQ ID NO: 333894 - RNA, 22 nt, Human
ugguggcacugacaucagacac

SEQ ID NO: 333895 - RNA, 22 nt, Human
ucaccgccuugcccggccgggc

SEQ ID NO: 333896 - RNA, 22 nt, Human
acacuccagggagggagggaau

SEQ ID NO: 333897 - RNA, 22 nt, Human
gccuucugaucgcuggacugac

SEQ ID NO: 333898 - RNA, 22 nt, Human
ggcggcgcguagccggagacuu

SEQ ID NO: 333899 - RNA, 15 nt, Human
uggugguguugagac

SEQ ID NO: 333900 - RNA, 22 nt, Human
uugcaggucuggggguccuggu

SEQ ID NO: 333901 - RNA, 22 nt, Human
augaagcugguuuuggcuuggg

SEQ ID NO: 333902 - RNA, 22 nt, Human
ugccuggauggcucugagcagg

SEQ ID NO: 333903 - RNA, 22 nt, Human
ggcaucagcccgguccugggcu

SEQ ID NO: 333904 - RNA, 22 nt, Human
uccuuagagugguugugcuaug

SEQ ID NO: 333905 - RNA, 23 nt, Human
uggcucugagcuuccugguggcc

SEQ ID NO: 333906 - RNA, 22 nt, Human
ucuucagacuguuguucuuuug

SEQ ID NO: 333907 - RNA, 22 nt, Human
ucugggaguuucugugggagcu

SEQ ID NO: 333908 - RNA, 22 nt, Human
cugaucuuaaguaacauuauuu

SEQ ID NO: 333909 - RNA, 22 nt, Human
gggcucaucaagccucuccgcc

SEQ ID NO: 333910 - RNA, 22 nt, Human
uucuuuuaauagagauccugug

SEQ ID NO: 333911 - RNA, 22 nt, Human
gccccucuccuugugcaccugc

SEQ ID NO: 333912 - RNA, 22 nt, Human
aaauuaacuaucacuuuuguga

SEQ ID NO: 333913 - RNA, 22 nt, Human
ggugugggucagcuuuauuaau

SEQ ID NO: 333914 - RNA, 22 nt, Human
cucuggcaauugcugcugacuc

SEQ ID NO: 333915 - RNA, 22 nt, Human
gccucugcacuguggcacacca

SEQ ID NO: 333916 - RNA, 22 nt, Human
gcggcgccugggacccgccagc

SEQ ID NO: 333917 - RNA, 22 nt, Human
gcuccugggcccugggcuaacu

SEQ ID NO: 333918 - RNA, 22 nt, Human
aguguuaaggcugguugcuaua

SEQ ID NO: 333919 - RNA, 22 nt, Human
auuugugggacuauaaugcagg

SEQ ID NO: 333920 - RNA, 22 nt, Human
gguggcaagggcagccaguaac

SEQ ID NO: 333921 - RNA, 22 nt, Human
uccaggcugacgcagcuauuua

SEQ ID NO: 333922 - RNA, 22 nt, Human
guagaggggugauucugugaga

SEQ ID NO: 333923 - RNA, 22 nt, Human
ugaaagcucugucaucauuccu

SEQ ID NO: 333924 - RNA, 22 nt, Human
gcuuucagggucacugucaaca

SEQ ID NO: 333925 - RNA, 22 nt, Human
ccaaaauauuagugcuuaagua

SEQ ID NO: 333926 - RNA, 22 nt, Human
gucugcugacagagcauggacc

SEQ ID NO: 333927 - RNA, 22 nt, Human
ugaggcuggaugggaugccucc

SEQ ID NO: 333928 - RNA, 22 nt, Human
cagagcugucauuugccaguga

SEQ ID NO: 333929 - RNA, 22 nt, Human
auaagugcccaaaaugaaagga

SEQ ID NO: 333930 - RNA, 17 nt, Human
gcguguccccgcgucuc

SEQ ID NO: 333931 - RNA, 18 nt, Human
ucuuccaacacugacacc

SEQ ID NO: 333932 - RNA, 22 nt, Human
aagguggcggcugccagguccu

SEQ ID NO: 333933 - RNA, 22 nt, Human
ccggcgucucuuccacuuccua

SEQ ID NO: 333934 - RNA, 22 nt, Human
gugccaccagaugcuguugcua

SEQ ID NO: 333935 - RNA, 22 nt, Human
uaaaguucuuagaacaaggccu

SEQ ID NO: 333936 - RNA, 22 nt, Human
gagacagagagguacucaacau

SEQ ID NO: 333937 - RNA, 22 nt, Human
ccauggccugaaggagugcauc

SEQ ID NO: 333938 - RNA, 22 nt, Human
gcucuggcuacuguggcuaccg

SEQ ID NO: 333939 - RNA, 22 nt, Human
uggcuggcuguccagcugggca

SEQ ID NO: 333940 - RNA, 22 nt, Human
uagagcucuccuuccucugugg

SEQ ID NO: 333941 - RNA, 22 nt, Human
aauguuaaguuuagauuauaac

SEQ ID NO: 333942 - RNA, 23 nt, Human
gguucugccgcuuacugcugugc

SEQ ID NO: 333943 - RNA, 21 nt, Human
agggaaaaggcugagugaggg

SEQ ID NO: 333944 - RNA, 22 nt, Human
uggaucugcucuaugaacugcu

SEQ ID NO: 333945 - RNA, 22 nt, Human
gggcucuguuuagaccagagau

SEQ ID NO: 333946 - RNA, 22 nt, Human
uuuccucacacagaagaucuug

SEQ ID NO: 333947 - RNA, 22 nt, Human
gguguuguacauucuguggauu

SEQ ID NO: 333948 - RNA, 22 nt, Human
guguuucccuggcacaagaacc

SEQ ID NO: 333949 - RNA, 22 nt, Human
cagugccauauugaaagacauu

SEQ ID NO: 333950 - RNA, 22 nt, Human
guuucuccucugugucuuguuu

SEQ ID NO: 333951 - RNA, 22 nt, Human
accaggcccuccagcugcgugg

SEQ ID NO: 333952 - RNA, 22 nt, Human
ugacucauauuucauggauacg

SEQ ID NO: 333953 - RNA, 22 nt, Human
cugcaucacagcaggaggcaca

SEQ ID NO: 333954 - RNA, 22 nt, Human
guuaaugcaaagcagagggcaa

SEQ ID NO: 333955 - RNA, 22 nt, Human
gcugccgacccacagggguuaa

SEQ ID NO: 333956 - RNA, 22 nt, Human
auucccuuugacgaucccuagg

SEQ ID NO: 333957 - RNA, 21 nt, Human
gccaucaccaagcucuucccc

SEQ ID NO: 333958 - RNA, 22 nt, Human
agaggaaguaaucaggaccugc

SEQ ID NO: 333959 - RNA, 22 nt, Human
ccuuuuauauggcucaucacag

SEQ ID NO: 333960 - RNA, 22 nt, Human
uuucauuauaaaaaguuggcuu

SEQ ID NO: 333961 - RNA, 22 nt, Human
ggccagccuggggcucccagac

SEQ ID NO: 333962 - RNA, 22 nt, Human
ucauggcacaugcccuccaggg

SEQ ID NO: 333963 - RNA, 21 nt, Human
ucucuccucaagcucgacccc

SEQ ID NO: 333964 - RNA, 22 nt, Human
guuuuguucaugaacauugggu

SEQ ID NO: 333965 - RNA, 22 nt, Human
acuggcaguagagggagcgcau

SEQ ID NO: 333966 - RNA, 22 nt, Human
aaugauguuuuuaaagaacaua

SEQ ID NO: 333967 - RNA, 22 nt, Human
cgccguccccuaggaaagagcu

SEQ ID NO: 333968 - RNA, 22 nt, Human
uccugucucaguguauuugcag

SEQ ID NO: 333969 - RNA, 22 nt, Human
uggcuccacaggccagggugug

SEQ ID NO: 333970 - RNA, 22 nt, Human
caguguuuagcacagugcuugg

SEQ ID NO: 333971 - RNA, 22 nt, Human
acaaaugcuuaguucaccaaaa

SEQ ID NO: 333972 - RNA, 22 nt, Human
gccccgucguggggccagggau

SEQ ID NO: 333973 - RNA, 22 nt, Human
cucaucuggcuucaguaacagu

SEQ ID NO: 333974 - RNA, 22 nt, Human
ugccuguguccccuucuuggca

SEQ ID NO: 333975 - RNA, 22 nt, Human
ccaaggcuggagggcuuaugua

SEQ ID NO: 333976 - RNA, 22 nt, Human
aaacucuacauggucgcaaaaa

SEQ ID NO: 333977 - RNA, 22 nt, Human
ugagaugaagugauguaaaaca

SEQ ID NO: 333978 - RNA, 22 nt, Human
ggaagccaguugcuuggugugg

SEQ ID NO: 333979 - RNA, 22 nt, Human
cgggaagguggagguugcagug

SEQ ID NO: 333980 - RNA, 21 nt, Human
aauuucagacccauuuugccu

SEQ ID NO: 333981 - RNA, 16 nt, Human
ccccucaggaaguaca

SEQ ID NO: 333982 - RNA, 20 nt, Human
uggccucugagaugccacgg

SEQ ID NO: 333983 - RNA, 18 nt, Human
ucugaaggaaugauucca

SEQ ID NO: 333984 - RNA, 22 nt, Human
ugcccagucuccgggccagccc

SEQ ID NO: 333985 - RNA, 22 nt, Human
uuccccuugcacuaucacccug

SEQ ID NO: 333986 - RNA, 22 nt, Human
gcagcugcgaagaagucuaucu

SEQ ID NO: 333987 - RNA, 22 nt, Human
accccagaggcggaggcugcag

SEQ ID NO: 333988 - RNA, 22 nt, Human
gcugcuggcuuccugcuguuuu

SEQ ID NO: 333989 - RNA, 22 nt, Human
cuuugggcacugaaguaugggu

SEQ ID NO: 333990 - RNA, 18 nt, Human
uccauccucugcucuuca

SEQ ID NO: 333991 - RNA, 18 nt, Human
auggcuccagugucuucc

SEQ ID NO: 333992 - RNA, 22 nt, Human
caugggcucuucuggacugcac

SEQ ID NO: 333993 - RNA, 22 nt, Human
ucugccaucaagaugcucuggc

SEQ ID NO: 333994 - RNA, 22 nt, Human
acauuuuuggguugaugucuga

SEQ ID NO: 333995 - RNA, 22 nt, Human
cucagaggggaugcuuggagaa

SEQ ID NO: 333996 - RNA, 22 nt, Human
acaauuucuaauauagaucuua

SEQ ID NO: 333997 - RNA, 22 nt, Human
uguucuuagguauuugacaguc

SEQ ID NO: 333998 - RNA, 22 nt, Human
guugcauuaaucugcucaggcu

SEQ ID NO: 333999 - RNA, 22 nt, Human
ucggugcgcgaggcgcgguccc

SEQ ID NO: 334000 - RNA, 22 nt, Human
uguuggcagugcuacagucagu

SEQ ID NO: 334001 - RNA, 22 nt, Human
cucaggaaaauauugaagaagu

SEQ ID NO: 334002 - RNA, 22 nt, Human
cuccaggacugaggacagagcu

SEQ ID NO: 334003 - RNA, 22 nt, Human
ucuccaggggcagggucuggag

SEQ ID NO: 334004 - RNA, 22 nt, Human
aauggcagagacuguugaaaua

SEQ ID NO: 334005 - RNA, 22 nt, Human
aggaggguggggucugccuguc

SEQ ID NO: 334006 - RNA, 22 nt, Human
ugggaugagcuauauagaaagu

SEQ ID NO: 334007 - RNA, 22 nt, Human
ggucuggccuccgggcaggugg

SEQ ID NO: 334008 - RNA, 22 nt, Human
gcccagcaccucucucaggguu

SEQ ID NO: 334009 - RNA, 22 nt, Human
cgccccagccaguugagcggcg

SEQ ID NO: 334010 - RNA, 18 nt, Human
auuugcaggcaugcaggc

SEQ ID NO: 334011 - RNA, 22 nt, Human
caaauacaaauacgggcagcuu

SEQ ID NO: 334012 - RNA, 22 nt, Human
accaaauaggcuuccuggguug

SEQ ID NO: 334013 - RNA, 22 nt, Human
gagcugcuggccuccugcggga

SEQ ID NO: 334014 - RNA, 22 nt, Human
cccagaaugauucagcgacagu

SEQ ID NO: 334015 - RNA, 21 nt, Human
uuggaacaagcagcaguuugc

SEQ ID NO: 334016 - RNA, 22 nt, Human
cugggcuguuuguucuggucuc

SEQ ID NO: 334017 - RNA, 22 nt, Human
aggacagcagugcuggcacuug

SEQ ID NO: 334018 - RNA, 22 nt, Human
acccggagucggagguugcagu

SEQ ID NO: 334019 - RNA, 22 nt, Human
agcgcuggugaucucuauuuug

SEQ ID NO: 334020 - RNA, 22 nt, Human
uggcugaggcuuuucuuaaaga

SEQ ID NO: 334021 - RNA, 22 nt, Human
ggcagccuccagggcacuggug

SEQ ID NO: 334022 - RNA, 22 nt, Human
cagcagcucaggcuccuuccca

SEQ ID NO: 334023 - RNA, 22 nt, Human
gaagagguucaacguggucauc

SEQ ID NO: 334024 - RNA, 22 nt, Human
gcaguuaccuauuuuguagaaa

SEQ ID NO: 334025 - RNA, 22 nt, Human
ccagcagaagcucccgcugggu

SEQ ID NO: 334026 - RNA, 22 nt, Human
gucccauaaguagugcaacuug

SEQ ID NO: 334027 - RNA, 22 nt, Human
uggacccaccccagggccugcu

SEQ ID NO: 334028 - RNA, 22 nt, Human
agaucaaggacaugaagaggcu

SEQ ID NO: 334029 - RNA, 22 nt, Human
ucggagcgucacuggcuggagg

SEQ ID NO: 334030 - RNA, 22 nt, Human
guugcaaaugggaagaugguua

SEQ ID NO: 334031 - RNA, 22 nt, Human
auggcagcggagcuggaaauga

SEQ ID NO: 334032 - RNA, 21 nt, Human
uuccuccucuggagaagaaga

SEQ ID NO: 334033 - RNA, 22 nt, Human
agugugaguuacaaagugugaa

SEQ ID NO: 334034 - RNA, 22 nt, Human
ucacagcugggguuuuggcagc

SEQ ID NO: 334035 - RNA, 22 nt, Human
aggcagaugggagcuggaaguu

SEQ ID NO: 334036 - RNA, 22 nt, Human
cgccaguggcagcuggaacagg

SEQ ID NO: 334037 - RNA, 22 nt, Human
caagagcuggguggcaagcuag

SEQ ID NO: 334038 - RNA, 22 nt, Human
ucaccccuugugaaugcugcuc

SEQ ID NO: 334039 - RNA, 18 nt, Human
cugccagugugcucuccg

SEQ ID NO: 334040 - RNA, 22 nt, Human
agagaagagucuugucaaauua

SEQ ID NO: 334041 - RNA, 22 nt, Human
gggagccagcagggcauggagc

SEQ ID NO: 334042 - RNA, 22 nt, Human
gguggcagaggugcaucagccc

SEQ ID NO: 334043 - RNA, 22 nt, Human
ggagugggaacaaugacauggu

SEQ ID NO: 334044 - RNA, 22 nt, Human
uguaagcuucaaauaucuguga

SEQ ID NO: 334045 - RNA, 22 nt, Human
cagcugccuaugaccuagccuc

SEQ ID NO: 334046 - RNA, 22 nt, Human
gcuguagguaaggauggcaaag

SEQ ID NO: 334047 - RNA, 22 nt, Human
ggauguuuauccuaucuuaguu

SEQ ID NO: 334048 - RNA, 22 nt, Human
ccugcgggcugugcugaagccu

SEQ ID NO: 334049 - RNA, 22 nt, Human
agaggagguccuuuucugaugu

SEQ ID NO: 334050 - RNA, 20 nt, Human
auuugcuuaccuuguuucua

SEQ ID NO: 334051 - RNA, 22 nt, Human
ggagggaaccuuggcuggauug

SEQ ID NO: 334052 - RNA, 21 nt, Human
agaugcagugacccacugggg

SEQ ID NO: 334053 - RNA, 22 nt, Human
agcuuuggcaucugacuagccg

SEQ ID NO: 334054 - RNA, 22 nt, Human
cccgaccucgcaaagcgcacuc

SEQ ID NO: 334055 - RNA, 22 nt, Human
ucucuuugacccuuuagcucca

SEQ ID NO: 334056 - RNA, 22 nt, Human
gccagugccugcugcucagggc

SEQ ID NO: 334057 - RNA, 20 nt, Human
agcuggcccccgguggccug

SEQ ID NO: 334058 - RNA, 22 nt, Human
aucagagcugcauuuuagagcc

SEQ ID NO: 334059 - RNA, 23 nt, Human
aacucuggcuagcauagaauaga

SEQ ID NO: 334060 - RNA, 22 nt, Human
ccucugcccuuuuccuguauca

SEQ ID NO: 334061 - RNA, 22 nt, Human
uugaacaguccuaagagacccu

SEQ ID NO: 334062 - RNA, 22 nt, Human
ucagugauuucuggggugaggg

SEQ ID NO: 334063 - RNA, 22 nt, Human
cucagaguccauaguuuacagu

SEQ ID NO: 334064 - RNA, 22 nt, Human
aguggcaguagaugagcugguu

SEQ ID NO: 334065 - RNA, 22 nt, Human
gaugucuucagauggcaagaga

SEQ ID NO: 334066 - RNA, 19 nt, Human
ugggcuuccccagggcaga

SEQ ID NO: 334067 - RNA, 22 nt, Human
uggaauuaucugaagugauuug

SEQ ID NO: 334068 - RNA, 22 nt, Human
ccugaggcccuggcugugcuga

SEQ ID NO: 334069 - RNA, 22 nt, Human
agcacauucccaccuguacuuc

SEQ ID NO: 334070 - RNA, 22 nt, Human
gaaccuggcagcccuauaucug

SEQ ID NO: 334071 - RNA, 22 nt, Human
ccagcagccaccuucucgaaau

SEQ ID NO: 334072 - RNA, 22 nt, Human
gaggggcugggguugacuccaa

SEQ ID NO: 334073 - RNA, 20 nt, Human
cagagccaggguuuuguuuu

SEQ ID NO: 334074 - RNA, 22 nt, Human
ccagcuugcuccucugcaaugg

SEQ ID NO: 334075 - RNA, 22 nt, Human
uccucuccaggugagccgaaau

SEQ ID NO: 334076 - RNA, 22 nt, Human
acgggcugggacggggaagcuc

SEQ ID NO: 334077 - RNA, 22 nt, Human
gccugccuucggugcgcagcgg

SEQ ID NO: 334078 - RNA, 22 nt, Human
ucuacuuccgcaaaaggcacau

SEQ ID NO: 334079 - RNA, 22 nt, Human
gugcacagaaacauacaaugug

SEQ ID NO: 334080 - RNA, 22 nt, Human
agccaccaccacugaaagguua

SEQ ID NO: 334081 - RNA, 22 nt, Human
ggcuggaaggcccuuuguugau

SEQ ID NO: 334082 - RNA, 22 nt, Human
agcaugucuaacucuucagggu

SEQ ID NO: 334083 - RNA, 22 nt, Human
cuugaguaaagaaguauuuuag

SEQ ID NO: 334084 - RNA, 22 nt, Human
cacaguuuuaucuuauacugau

SEQ ID NO: 334085 - RNA, 22 nt, Human
gagguggcugcuugcugggaaa

SEQ ID NO: 334086 - RNA, 22 nt, Human
ggugcccaaggaagguugccgu

SEQ ID NO: 334087 - RNA, 17 nt, Human
ggccugcaccuccugcu

SEQ ID NO: 334088 - RNA, 18 nt, Human
acuguggcucagaguugc

SEQ ID NO: 334089 - RNA, 22 nt, Human
ccaggcuccccaggaggcccuu

SEQ ID NO: 334090 - RNA, 22 nt, Human
ggaggugacuggaucaugggca

SEQ ID NO: 334091 - RNA, 22 nt, Human
ccaggaugacccccacuuuccu

SEQ ID NO: 334092 - RNA, 22 nt, Human
acuugguggcgaacgaggguca

SEQ ID NO: 334093 - RNA, 22 nt, Human
auaguguguaaagugcagugau

SEQ ID NO: 334094 - RNA, 22 nt, Human
acucacagggccucaguuuucc

SEQ ID NO: 334095 - RNA, 22 nt, Human
cugguuuuuagugcuuaggagu

SEQ ID NO: 334096 - RNA, 22 nt, Human
uggcugaggcacagcugccgcc

SEQ ID NO: 334097 - RNA, 22 nt, Human
gcugccuggaauaacggcuggc

SEQ ID NO: 334098 - RNA, 22 nt, Human
auggcucugcugggcaaagcaa

SEQ ID NO: 334099 - RNA, 22 nt, Human
gccguccuacgccaucauagcg

SEQ ID NO: 334100 - RNA, 19 nt, Human
ccuggcccugcugcgcggg

SEQ ID NO: 334101 - RNA, 22 nt, Human
cagcgguggcaaggugacugug

SEQ ID NO: 334102 - RNA, 22 nt, Human
guggcauugccuucugcaggaa

SEQ ID NO: 334103 - RNA, 22 nt, Human
cuuccuaaaagcuucaagagaa

SEQ ID NO: 334104 - RNA, 22 nt, Human
ccuucuagcaaaucaacauaaa

SEQ ID NO: 334105 - RNA, 22 nt, Human
gaaacuguauguaguuuuuggg

SEQ ID NO: 334106 - RNA, 22 nt, Human
ugggcaaaugcuuuuuagucaa

SEQ ID NO: 334107 - RNA, 22 nt, Human
aguguuugaguuugcggcauug

SEQ ID NO: 334108 - RNA, 22 nt, Human
uugauuugauuguaauggcucu

SEQ ID NO: 334109 - RNA, 22 nt, Human
cggcagcgguuggagguuguag

SEQ ID NO: 334110 - RNA, 22 nt, Human
acuuaccagagaggauccgccc

SEQ ID NO: 334111 - RNA, 21 nt, Human
uccagcacagaugaccucccc

SEQ ID NO: 334112 - RNA, 22 nt, Human
auggcugugguaucagacgcag

SEQ ID NO: 334113 - RNA, 22 nt, Human
uagauaccugcuggaccucauu

SEQ ID NO: 334114 - RNA, 22 nt, Human
cgggcagugcccagcggggcag

SEQ ID NO: 334115 - RNA, 22 nt, Human
uguaccacucuacuaaggguuc

SEQ ID NO: 334116 - RNA, 22 nt, Human
accaugucauuuauuggccaaa

SEQ ID NO: 334117 - RNA, 22 nt, Human
cagggcacuuaaauugccucgu

SEQ ID NO: 334118 - RNA, 22 nt, Human
gcagcagcggggccccugcgcg

SEQ ID NO: 334119 - RNA, 21 nt, Human
accgucaguacuaguauugac

SEQ ID NO: 334120 - RNA, 22 nt, Human
acauuucuccuacuuguuauuu

SEQ ID NO: 334121 - RNA, 22 nt, Human
ggugcaauaaaguuguagaacc

SEQ ID NO: 334122 - RNA, 22 nt, Human
gaacugcauugugguauauguu

SEQ ID NO: 334123 - RNA, 22 nt, Human
agugacauuauuuuguguacua

SEQ ID NO: 334124 - RNA, 22 nt, Human
ugggugguugcugaggcuccuu

SEQ ID NO: 334125 - RNA, 22 nt, Human
guggcauuuuagaacagcugac

SEQ ID NO: 334126 - RNA, 22 nt, Human
uccugugccuccaccugcuccg

SEQ ID NO: 334127 - RNA, 22 nt, Human
uccuggcccuguggccugcagu

SEQ ID NO: 334128 - RNA, 23 nt, Human
agguggagcugugcagccggggc

SEQ ID NO: 334129 - RNA, 22 nt, Human
gugcugagugcagagugcagag

SEQ ID NO: 334130 - RNA, 22 nt, Human
ggucuuucuuugauaguggaga

SEQ ID NO: 334131 - RNA, 22 nt, Human
gcuggccugcgagggcaggcug

SEQ ID NO: 334132 - RNA, 22 nt, Human
aaguuacacauuuucauuguaa

SEQ ID NO: 334133 - RNA, 22 nt, Human
cauugcugugggcauuugcugc

SEQ ID NO: 334134 - RNA, 22 nt, Human
gaguuucuucauggugcagagg

SEQ ID NO: 334135 - RNA, 22 nt, Human
agccagugucgugugacaugag

SEQ ID NO: 334136 - RNA, 22 nt, Human
ccaggcaaagcccaugcaagag

SEQ ID NO: 334137 - RNA, 22 nt, Human
gguuguaguuggagguuguaua

SEQ ID NO: 334138 - RNA, 22 nt, Human
uugcugccagcgcccugcaggg

SEQ ID NO: 334139 - RNA, 22 nt, Human
auguuugaaauuguaaguauau

SEQ ID NO: 334140 - RNA, 22 nt, Human
uggcagugugggaggaagguac

SEQ ID NO: 334141 - RNA, 22 nt, Human
ggucagugccuaucaugugggc

SEQ ID NO: 334142 - RNA, 20 nt, Human
caacacugcccauuguuugc

SEQ ID NO: 334143 - RNA, 22 nt, Human
cuugccagggacucagucaggg

SEQ ID NO: 334144 - RNA, 22 nt, Human
gagcuccugaaacguuccugcc

SEQ ID NO: 334145 - RNA, 22 nt, Human
cccucuggcucuucucaggccg

SEQ ID NO: 334146 - RNA, 22 nt, Human
uuccaaguuaggcgagcuggug

SEQ ID NO: 334147 - RNA, 22 nt, Human
uuggaggaagcucaugggggau

SEQ ID NO: 334148 - RNA, 18 nt, Human
gggguagaguguccuauu

SEQ ID NO: 334149 - RNA, 22 nt, Human
gagggaaacagauggguugugg

SEQ ID NO: 334150 - RNA, 22 nt, Human
ggguuguagagcuggaagggga

SEQ ID NO: 334151 - RNA, 22 nt, Human
ugcccuccacaguggcuccacc

SEQ ID NO: 334152 - RNA, 21 nt, Human
ucuccucccggggagaggccg

SEQ ID NO: 334153 - RNA, 22 nt, Human
agguggaguuaagugugaacug

SEQ ID NO: 334154 - RNA, 22 nt, Human
aaacaguguguuucagagaggc

SEQ ID NO: 334155 - RNA, 22 nt, Human
ggaggaggggugacugaaugcu

SEQ ID NO: 334156 - RNA, 22 nt, Human
guguccagagccgggcugaaug

SEQ ID NO: 334157 - RNA, 22 nt, Human
gggagggucugagagcugcacc

SEQ ID NO: 334158 - RNA, 22 nt, Human
cccaccacgugcuuugcuggag

SEQ ID NO: 334159 - RNA, 22 nt, Human
ucagauggucauucacuagggu

SEQ ID NO: 334160 - RNA, 22 nt, Human
ucugcgcccugucgccugcucc

SEQ ID NO: 334161 - RNA, 22 nt, Human
ggcuggaacuucuucuggcauu

SEQ ID NO: 334162 - RNA, 22 nt, Human
uggggugccgacagggagggca

SEQ ID NO: 334163 - RNA, 22 nt, Human
cuuccagcugauuggcauccag

SEQ ID NO: 334164 - RNA, 22 nt, Human
augagcuaagcagaaagcacac

SEQ ID NO: 334165 - RNA, 22 nt, Human
aggcuccaugguucucccucag

SEQ ID NO: 334166 - RNA, 22 nt, Human
acccagcucuuugauggucuug

SEQ ID NO: 334167 - RNA, 22 nt, Human
acaguguuucacuuaaccguuu

SEQ ID NO: 334168 - RNA, 22 nt, Human
ucagguccaagauggccaucca

SEQ ID NO: 334169 - RNA, 22 nt, Human
aggaaaauggaccagaguuguu

SEQ ID NO: 334170 - RNA, 22 nt, Human
ggagucugugucuugaagcagu

SEQ ID NO: 334171 - RNA, 22 nt, Human
uggcauuuuguagcuguguauc

SEQ ID NO: 334172 - RNA, 22 nt, Human
gggcagcaucaggaggggcuuu

SEQ ID NO: 334173 - RNA, 22 nt, Human
gaggcugugugucccucuggac

SEQ ID NO: 334174 - RNA, 22 nt, Human
cacaucauguuaauucauuaca

SEQ ID NO: 334175 - RNA, 22 nt, Human
cugggaggcccacguugggaag

SEQ ID NO: 334176 - RNA, 22 nt, Human
ccugacagcgugucccuggccc

SEQ ID NO: 334177 - RNA, 22 nt, Human
uuugacucugggugcuuuuucg

SEQ ID NO: 334178 - RNA, 22 nt, Human
uccggcggccggccugagcccg

SEQ ID NO: 334179 - RNA, 22 nt, Human
aaaugccucauuuucucucacu

SEQ ID NO: 334180 - RNA, 22 nt, Human
ucacaacugggugucuucauca

SEQ ID NO: 334181 - RNA, 22 nt, Human
uuacuaguggagaaacugaggc

SEQ ID NO: 334182 - RNA, 22 nt, Human
aaggggggcaccugcaugcccg

SEQ ID NO: 334183 - RNA, 22 nt, Human
ggagaguggauuccagcuguau

SEQ ID NO: 334184 - RNA, 22 nt, Human
uucacugugauguuuaagagaa

SEQ ID NO: 334185 - RNA, 22 nt, Human
uaaaguuuauuggcaccaccau

SEQ ID NO: 334186 - RNA, 22 nt, Human
gaggucaggggagaggcugaug

SEQ ID NO: 334187 - RNA, 22 nt, Human
uccagcugugcuccaggaggug

SEQ ID NO: 334188 - RNA, 22 nt, Human
uagcuguucucuguaaauugga

SEQ ID NO: 334189 - RNA, 22 nt, Human
gagccaggcccguacuugcugu

SEQ ID NO: 334190 - RNA, 22 nt, Human
augggaggcagacacuaaguuc

SEQ ID NO: 334191 - RNA, 22 nt, Human
ggcuuccuccuuccugcuguca

SEQ ID NO: 334192 - RNA, 20 nt, Human
gcugugccaugacccucgag

SEQ ID NO: 334193 - RNA, 22 nt, Human
acagagccuccaggagugcugg

SEQ ID NO: 334194 - RNA, 22 nt, Human
agcugcaccggcuggaccacug

SEQ ID NO: 334195 - RNA, 22 nt, Human
gcgacgcaggcacgacguguug

SEQ ID NO: 334196 - RNA, 22 nt, Human
guggccaucuuuggcccugacu

SEQ ID NO: 334197 - RNA, 22 nt, Human
ggccugcuucucugggcuuucu

SEQ ID NO: 334198 - RNA, 22 nt, Human
ucuccaggcuuaaucucagcuu

SEQ ID NO: 334199 - RNA, 22 nt, Human
gggacgugagugaagaaggucu

SEQ ID NO: 334200 - RNA, 22 nt, Human
accauaguuauaacaaaguguu

SEQ ID NO: 334201 - RNA, 22 nt, Human
acaugcacagcaagggugagag

SEQ ID NO: 334202 - RNA, 22 nt, Human
cuccaggacaugacuuucuugc

SEQ ID NO: 334203 - RNA, 22 nt, Human
cagcugcucugguggucucucc

SEQ ID NO: 334204 - RNA, 22 nt, Human
aaagucuuaauguaaguuuagu

SEQ ID NO: 334205 - RNA, 22 nt, Human
uuuacuguuuacagcuaaugca

SEQ ID NO: 334206 - RNA, 22 nt, Human
uuggaaaugcauuuguuauuau

SEQ ID NO: 334207 - RNA, 22 nt, Human
cuucagagugacucagcaucuu

SEQ ID NO: 334208 - RNA, 22 nt, Human
uuauuuaaaauguagguuggga

SEQ ID NO: 334209 - RNA, 22 nt, Human
uuuaauuuucugggcccagcag

SEQ ID NO: 334210 - RNA, 22 nt, Human
ucaggcuuugggaaugccacuu

SEQ ID NO: 334211 - RNA, 22 nt, Human
ggccuugguaaauuggcauuug

SEQ ID NO: 334212 - RNA, 20 nt, Human
cuguuugcuaucaugagcug

SEQ ID NO: 334213 - RNA, 22 nt, Human
gcugauggcuugcuggcugaca

SEQ ID NO: 334214 - RNA, 22 nt, Human
gccauguuuugguaaauaccau

SEQ ID NO: 334215 - RNA, 22 nt, Human
gcagaagucagaccaucugaau

SEQ ID NO: 334216 - RNA, 22 nt, Human
gacuggcucuaucuccuuggcg

SEQ ID NO: 334217 - RNA, 18 nt, Human
uccaggcuccaggcuaac

SEQ ID NO: 334218 - RNA, 22 nt, Human
cugguuuuccaauguuuugacu

SEQ ID NO: 334219 - RNA, 22 nt, Human
aacuuagagcucuccuaaauga

SEQ ID NO: 334220 - RNA, 22 nt, Human
ucagagccccuccgcuguccca

SEQ ID NO: 334221 - RNA, 22 nt, Human
gcggccugcgcugcucccgacg

SEQ ID NO: 334222 - RNA, 22 nt, Human
guuuccaagucucucaacaccc

SEQ ID NO: 334223 - RNA, 22 nt, Human
agguggcagacuaacagaagga

SEQ ID NO: 334224 - RNA, 22 nt, Human
aagcccucagagccucuuugac

SEQ ID NO: 334225 - RNA, 22 nt, Human
gaaacacucaauuuaguaauuc

SEQ ID NO: 334226 - RNA, 22 nt, Human
gauggugcaggugaagugcugg

SEQ ID NO: 334227 - RNA, 22 nt, Human
cuccagaggcgacuugcaucac

SEQ ID NO: 334228 - RNA, 22 nt, Human
auauaccucauucuuugagugc

SEQ ID NO: 334229 - RNA, 22 nt, Human
agcucagaacugcagacaugug

SEQ ID NO: 334230 - RNA, 22 nt, Human
cugagaguauuggcaggcuugg

SEQ ID NO: 334231 - RNA, 22 nt, Human
aggcaguguggagggcuguugc

SEQ ID NO: 334232 - RNA, 22 nt, Human
uaaaguuggaccugauuuuauu

SEQ ID NO: 334233 - RNA, 22 nt, Human
ucaggggcuugaggugcauguc

SEQ ID NO: 334234 - RNA, 22 nt, Human
gguagccaauuuaaacauuucc

SEQ ID NO: 334235 - RNA, 22 nt, Human
ucugaggacagugcugugccug

SEQ ID NO: 334236 - RNA, 17 nt, Human
uuucugcaugauuggac

SEQ ID NO: 334237 - RNA, 22 nt, Human
uuuguugguugcacuggugggu

SEQ ID NO: 334238 - RNA, 23 nt, Human
uugggcaaaucacuaacgucucc

SEQ ID NO: 334239 - RNA, 22 nt, Human
ccucuucagcaaaguucggccc

SEQ ID NO: 334240 - RNA, 22 nt, Human
uggcauuggaauuuguguugca

SEQ ID NO: 334241 - RNA, 22 nt, Human
ucuggcuucaacuuuacugaaa

SEQ ID NO: 334242 - RNA, 23 nt, Human
caaaaugcuaugugcccaaugca

SEQ ID NO: 334243 - RNA, 22 nt, Human
acgugcuggagaagagcucgcc

SEQ ID NO: 334244 - RNA, 20 nt, Human
uuugauugccccucugacuu

SEQ ID NO: 334245 - RNA, 22 nt, Human
agguggagaagagaugggcagu

SEQ ID NO: 334246 - RNA, 22 nt, Human
gcccagcugagaagcgcggggc

SEQ ID NO: 334247 - RNA, 22 nt, Human
uguuuuaagggucaacugucac

SEQ ID NO: 334248 - RNA, 22 nt, Human
ggcucugcugguaagaugccuc

SEQ ID NO: 334249 - RNA, 22 nt, Human
cuguggaguccuggggaaugga

SEQ ID NO: 334250 - RNA, 22 nt, Human
aaauccaucaaaucuucuagaa

SEQ ID NO: 334251 - RNA, 22 nt, Human
gggcugaauuuguugcauguaa

SEQ ID NO: 334252 - RNA, 22 nt, Human
agagacauagcacaguuuuucg

SEQ ID NO: 334253 - RNA, 22 nt, Human
ucugagagccacugaacagcaa

SEQ ID NO: 334254 - RNA, 21 nt, Human
ggcagcucagcagauggggac

SEQ ID NO: 334255 - RNA, 22 nt, Human
cgcugccuucaucccacgccua

SEQ ID NO: 334256 - RNA, 22 nt, Human
aaaggugccucuuacaaggcuu

SEQ ID NO: 334257 - RNA, 22 nt, Human
gggaugagagcugggacagaag

SEQ ID NO: 334258 - RNA, 22 nt, Human
guggccaaggcagagaaagagc

SEQ ID NO: 334259 - RNA, 22 nt, Human
ugucuuuagccacuugccucuu

SEQ ID NO: 334260 - RNA, 22 nt, Human
agaagcagaaggaagcagggcc

SEQ ID NO: 334261 - RNA, 23 nt, Human
ugggcagcuucugcaugcccacc

SEQ ID NO: 334262 - RNA, 22 nt, Human
ggccuugguggcuuugcugaug

SEQ ID NO: 334263 - RNA, 22 nt, Human
uuuucuaacaucuaguaauuug

SEQ ID NO: 334264 - RNA, 23 nt, Human
uguguucagucaaggaucagagu

SEQ ID NO: 334265 - RNA, 22 nt, Human
cucaggucuuaguucugucauc

SEQ ID NO: 334266 - RNA, 22 nt, Human
gagcuccuauggucgguggcuc

SEQ ID NO: 334267 - RNA, 22 nt, Human
ccagcagcgauagggugagugc

SEQ ID NO: 334268 - RNA, 22 nt, Human
cuggagccggcgagccccagcc

SEQ ID NO: 334269 - RNA, 22 nt, Human
aguaucagaugugauuaaaggg

SEQ ID NO: 334270 - RNA, 22 nt, Human
gagaacuugaacuuuuccucug

SEQ ID NO: 334271 - RNA, 22 nt, Human
ucaaaaugccgagugcccaggu

SEQ ID NO: 334272 - RNA, 22 nt, Human
aagcauuucagguagagauauu

SEQ ID NO: 334273 - RNA, 22 nt, Human
ccagcuggcccagcugugcucc

SEQ ID NO: 334274 - RNA, 22 nt, Human
uccucuucaaaauagcucugaa

SEQ ID NO: 334275 - RNA, 22 nt, Human
ggucuggagcuaaucuuguugg

SEQ ID NO: 334276 - RNA, 22 nt, Human
gugcuggggagauaggaagaga

SEQ ID NO: 334277 - RNA, 22 nt, Human
ugaguuagcucuauucuuuugg

SEQ ID NO: 334278 - RNA, 22 nt, Human
uuguaacaguagcugucagcuc

SEQ ID NO: 334279 - RNA, 22 nt, Human
agcugccgaugcccagcugcau

SEQ ID NO: 334280 - RNA, 22 nt, Human
aagugcuuccauguuugagugu

SEQ ID NO: 334281 - RNA, 22 nt, Human
gaagcccuggggucagugucgu

SEQ ID NO: 334282 - RNA, 22 nt, Human
gcucccugguauugcugccacu

SEQ ID NO: 334283 - RNA, 22 nt, Human
ugcugcucaagcugcagcaaaa

SEQ ID NO: 334284 - RNA, 22 nt, Human
ccacuuaagagaacagcuauag

SEQ ID NO: 334285 - RNA, 20 nt, Human
ucucuggcaagaagcugcag

SEQ ID NO: 334286 - RNA, 22 nt, Human
uccuucccaggugucgccgccu

SEQ ID NO: 334287 - RNA, 22 nt, Human
cagagguagccgagugcaaucg

SEQ ID NO: 334288 - RNA, 22 nt, Human
ucugagugggaacucucaugac

SEQ ID NO: 334289 - RNA, 22 nt, Human
cgaggagugugaaggcuugucg

SEQ ID NO: 334290 - RNA, 22 nt, Human
uuggcgcccaggacgccgccgc

SEQ ID NO: 334291 - RNA, 22 nt, Human
aaucccuccccaggcaaguccu

SEQ ID NO: 334292 - RNA, 22 nt, Human
gguuccaggcauggcaggaugu

SEQ ID NO: 334293 - RNA, 20 nt, Human
uuuuccacuccucaaaacag

SEQ ID NO: 334294 - RNA, 22 nt, Human
gcaguggccacauggaggagga

SEQ ID NO: 334295 - RNA, 22 nt, Human
uggcuggggccugaauccugca

SEQ ID NO: 334296 - RNA, 19 nt, Human
cuggcuucaagcaguccuc

SEQ ID NO: 334297 - RNA, 22 nt, Human
gugcaggugguuggcccagccg

SEQ ID NO: 334298 - RNA, 22 nt, Human
gugcaggacagcacaucuccug

SEQ ID NO: 334299 - RNA, 22 nt, Human
ccagcugggucccugcuggggc

SEQ ID NO: 334300 - RNA, 22 nt, Human
accauccuuuaguuugcguuuc

SEQ ID NO: 334301 - RNA, 22 nt, Human
agaguuuacagaaauaagcugu

SEQ ID NO: 334302 - RNA, 22 nt, Human
ucugcccaggaggucccauggg

SEQ ID NO: 334303 - RNA, 22 nt, Human
ccagcuggaacggcagcccagc

SEQ ID NO: 334304 - RNA, 22 nt, Human
ucuuccuggauggggguugaug

SEQ ID NO: 334305 - RNA, 22 nt, Human
acuucacagauauuuauuuggu

SEQ ID NO: 334306 - RNA, 22 nt, Human
agguggcuaugaggaugcaguc

SEQ ID NO: 334307 - RNA, 22 nt, Human
agagugaaguaauuguuaggau

SEQ ID NO: 334308 - RNA, 22 nt, Human
cccagguaaggaugcuccucau

SEQ ID NO: 334309 - RNA, 22 nt, Human
ugggcugcuucuauuggugguc

SEQ ID NO: 334310 - RNA, 22 nt, Human
cuacuucuguggcucuaagaga

SEQ ID NO: 334311 - RNA, 22 nt, Human
auccaggcgaaugcagaaggcc

SEQ ID NO: 334312 - RNA, 22 nt, Human
augguuuuguccucuuugguuc

SEQ ID NO: 334313 - RNA, 21 nt, Human
uggagagugauuucagugugg

SEQ ID NO: 334314 - RNA, 22 nt, Human
gcuggguggaucggaggcucug

SEQ ID NO: 334315 - RNA, 22 nt, Human
ucaccucucuggccgucuaccu

SEQ ID NO: 334316 - RNA, 17 nt, Human
uaagggggaaacggagc

SEQ ID NO: 334317 - RNA, 22 nt, Human
agugaaaaccuaaucaugcagu

SEQ ID NO: 334318 - RNA, 22 nt, Human
acauuuguuucucuagaguagg

SEQ ID NO: 334319 - RNA, 22 nt, Human
auuaauaucccccgccguucug

SEQ ID NO: 334320 - RNA, 22 nt, Human
agccacugugugaccagcuguc

SEQ ID NO: 334321 - RNA, 22 nt, Human
cuucuuaaaguugucacagcug

SEQ ID NO: 334322 - RNA, 22 nt, Human
ccuugcagcauauagagucccu

SEQ ID NO: 334323 - RNA, 22 nt, Human
gcagcccaggaggcgggagccc

SEQ ID NO: 334324 - RNA, 22 nt, Human
cacugguugccucuuucuguuc

SEQ ID NO: 334325 - RNA, 22 nt, Human
uccucagcaaacacuucacucu

SEQ ID NO: 334326 - RNA, 22 nt, Human
ugcuccaucuagagcucugcag

SEQ ID NO: 334327 - RNA, 22 nt, Human
ugggagcaagcuggugcuggag

SEQ ID NO: 334328 - RNA, 22 nt, Human
uuacgcagcugcuccaggaagc

SEQ ID NO: 334329 - RNA, 22 nt, Human
aucagagcuaguacuugcaggu

SEQ ID NO: 334330 - RNA, 22 nt, Human
guguuuugugaggccuucuuuc

SEQ ID NO: 334331 - RNA, 22 nt, Human
cucgagagauccucuugccacc

SEQ ID NO: 334332 - RNA, 22 nt, Human
cugcgugguaggacucaguucu

SEQ ID NO: 334333 - RNA, 22 nt, Human
uuuuucaagacaaccugcaugu

SEQ ID NO: 334334 - RNA, 22 nt, Human
uuuguguuggaagaaaugcuac

SEQ ID NO: 334335 - RNA, 22 nt, Human
agcuccugaaaauccagacugg

SEQ ID NO: 334336 - RNA, 22 nt, Human
agcugcugcaaguggugcuaac

SEQ ID NO: 334337 - RNA, 18 nt, Human
ggugagggagcuggaagc

SEQ ID NO: 334338 - RNA, 22 nt, Human
uuuguaguuguggaugcugaag

SEQ ID NO: 334339 - RNA, 22 nt, Human
aaagggaaguugcacauguucc

SEQ ID NO: 334340 - RNA, 22 nt, Human
cccaggcuggggcuccuccagc

SEQ ID NO: 334341 - RNA, 22 nt, Human
gccaccagccccaugcgcugug

SEQ ID NO: 334342 - RNA, 22 nt, Human
guugugcaaacacuggggucug

SEQ ID NO: 334343 - RNA, 22 nt, Human
uugcugccuuuguacucugaug

SEQ ID NO: 334344 - RNA, 22 nt, Human
aaugguaauauuucauaguugu

SEQ ID NO: 334345 - RNA, 22 nt, Human
cuuuacagauggauaauuguuu

SEQ ID NO: 334346 - RNA, 21 nt, Human
cccuugccugcacuccucggc

SEQ ID NO: 334347 - RNA, 19 nt, Human
gcagcugugggaagagcca

SEQ ID NO: 334348 - RNA, 20 nt, Human
ucacuguaacauuugggggg

SEQ ID NO: 334349 - RNA, 22 nt, Human
aagcccagcaucccugcaccag

SEQ ID NO: 334350 - RNA, 17 nt, Human
cucugggucuccugcuu

SEQ ID NO: 334351 - RNA, 22 nt, Human
cagaggccccauuggcugugcg

SEQ ID NO: 334352 - RNA, 22 nt, Human
ugccuggcugggcugcucaugg

SEQ ID NO: 334353 - RNA, 22 nt, Human
uccacagggaugccugcggcuu

SEQ ID NO: 334354 - RNA, 22 nt, Human
gggccccaagaaccuccuccug

SEQ ID NO: 334355 - RNA, 22 nt, Human
guguaucaacauguuuuuugug

SEQ ID NO: 334356 - RNA, 22 nt, Human
agcuuugcugcuggagaagggu

SEQ ID NO: 334357 - RNA, 22 nt, Human
auuucagcagcccauguuugga

SEQ ID NO: 334358 - RNA, 22 nt, Human
cagggcucacucggcuggcguc

SEQ ID NO: 334359 - RNA, 22 nt, Human
gucuuuuuuacaccuuacauca

SEQ ID NO: 334360 - RNA, 22 nt, Human
uggcugagcugcagcguggcuu

SEQ ID NO: 334361 - RNA, 22 nt, Human
cuaguagcccauuuuggauacc

SEQ ID NO: 334362 - RNA, 22 nt, Human
agcugucuaccugcagaguccu

SEQ ID NO: 334363 - RNA, 22 nt, Human
uugaggucuggcaguagcguug

SEQ ID NO: 334364 - RNA, 22 nt, Human
ugcuggaagggucggcgugggc

SEQ ID NO: 334365 - RNA, 22 nt, Human
auguuuguguuucccauucagg

SEQ ID NO: 334366 - RNA, 22 nt, Human
uccacagguccucuuugcaaag

SEQ ID NO: 334367 - RNA, 22 nt, Human
cugcggcuggggacagcuguug

SEQ ID NO: 334368 - RNA, 22 nt, Human
uuugcuggagaugagcgugggu

SEQ ID NO: 334369 - RNA, 22 nt, Human
agcggcgccggagggaggugcg

SEQ ID NO: 334370 - RNA, 22 nt, Human
uuugccaguauuuuauugauga

SEQ ID NO: 334371 - RNA, 22 nt, Human
gcugaagagagaugcguccagc

SEQ ID NO: 334372 - RNA, 21 nt, Human
uccuccuguagaggguccugg

SEQ ID NO: 334373 - RNA, 22 nt, Human
gccggggcuggggagagacaug

SEQ ID NO: 334374 - RNA, 22 nt, Human
gugcagcugugguggagccagg

SEQ ID NO: 334375 - RNA, 22 nt, Human
gugcgggccuggggguuucucu

SEQ ID NO: 334376 - RNA, 16 nt, Human
ucucccuugucaccug

SEQ ID NO: 334377 - RNA, 21 nt, Human
agcaucugaggcaguuuccua

SEQ ID NO: 334378 - RNA, 22 nt, Human
ucuguuauaaaucacacugcau

SEQ ID NO: 334379 - RNA, 22 nt, Human
uggcaaggccacaggugcaguu

SEQ ID NO: 334380 - RNA, 22 nt, Human
acuuuggugcgaagucacuuua

SEQ ID NO: 334381 - RNA, 18 nt, Human
ucagacaaguuagacagg

SEQ ID NO: 334382 - RNA, 22 nt, Human
aaacacaucauucaugucguca

SEQ ID NO: 334383 - RNA, 22 nt, Human
uagauucugacccucuuuuuac

SEQ ID NO: 334384 - RNA, 17 nt, Human
ugaggccugcaucagug

SEQ ID NO: 334385 - RNA, 22 nt, Human
agagcuccaggguuuuguagug

SEQ ID NO: 334386 - RNA, 22 nt, Human
acaguguuacuugauaguguau

SEQ ID NO: 334387 - RNA, 22 nt, Human
ggguggaaaguauuuggggacc

SEQ ID NO: 334388 - RNA, 22 nt, Human
caguuaaacagauugaguguua

SEQ ID NO: 334389 - RNA, 22 nt, Human
aguggcagggacuucauauaaa

SEQ ID NO: 334390 - RNA, 22 nt, Human
ccauggccaggaaagccaaggu

SEQ ID NO: 334391 - RNA, 22 nt, Human
uuuggauugcuuggaugcuucg

SEQ ID NO: 334392 - RNA, 22 nt, Human
gcagcugccgugagcucacgcc

SEQ ID NO: 334393 - RNA, 22 nt, Human
augcugccuccucuucagccgc

SEQ ID NO: 334394 - RNA, 22 nt, Human
aacuuucagaauccuaugcauu

SEQ ID NO: 334395 - RNA, 22 nt, Human
auuccucagcaggccuuuuguu

SEQ ID NO: 334396 - RNA, 19 nt, Human
uggugcgcuguuccugagc

SEQ ID NO: 334397 - RNA, 22 nt, Human
agcuuugggcagaagaggauuc

SEQ ID NO: 334398 - RNA, 22 nt, Human
guuguacauaugaggauaaguu

SEQ ID NO: 334399 - RNA, 20 nt, Human
gcuccccuucucugggccuc

SEQ ID NO: 334400 - RNA, 22 nt, Human
guuuccagccuccuggguaaag

SEQ ID NO: 334401 - RNA, 22 nt, Human
uggcuccguuguacaggcugga

SEQ ID NO: 334402 - RNA, 22 nt, Human
gcucccuggaauguuggcugcc

SEQ ID NO: 334403 - RNA, 22 nt, Human
gagagaagggggauaugagccu

SEQ ID NO: 334404 - RNA, 22 nt, Human
gcagagcuggaacugguacuca

SEQ ID NO: 334405 - RNA, 22 nt, Human
caggccagcagggccuccgugg

SEQ ID NO: 334406 - RNA, 22 nt, Human
aguuauugagugcagagcaggg

SEQ ID NO: 334407 - RNA, 22 nt, Human
uuaguuuccuguggugugaagu

SEQ ID NO: 334408 - RNA, 22 nt, Human
cagcuggcgacucuccucgaug

SEQ ID NO: 334409 - RNA, 22 nt, Human
uuuggcaagcgaguacuuucug

SEQ ID NO: 334410 - RNA, 22 nt, Human
gcuugcuuuguaaauaucugug

SEQ ID NO: 334411 - RNA, 22 nt, Human
acaaacuucccagacaagcucc

SEQ ID NO: 334412 - RNA, 22 nt, Human
agggcuccuaugccccauggac

SEQ ID NO: 334413 - RNA, 22 nt, Human
ccacccagccagaugcaggaag

SEQ ID NO: 334414 - RNA, 22 nt, Human
uuugcaaaguccauugaaguua

SEQ ID NO: 334415 - RNA, 22 nt, Human
aaggggaguuagugauaaaacc

SEQ ID NO: 334416 - RNA, 22 nt, Human
guuuccaggcuuugguaugguu

SEQ ID NO: 334417 - RNA, 22 nt, Human
caggguggaacaggcaauacuu

SEQ ID NO: 334418 - RNA, 22 nt, Human
cuugccaguguugcagaagcuc

SEQ ID NO: 334419 - RNA, 22 nt, Human
aggacaaaggaccagaucugga

SEQ ID NO: 334420 - RNA, 23 nt, Human
ucuggcugcuccuuucaaugcuc

SEQ ID NO: 334421 - RNA, 22 nt, Human
ggcagguguggugaccagagau

SEQ ID NO: 334422 - RNA, 22 nt, Human
gauggaggagauggcagggugc

SEQ ID NO: 334423 - RNA, 23 nt, Human
agccucuuguggauggucagcga

SEQ ID NO: 334424 - RNA, 22 nt, Human
gggaggaaggcuugggugagua

SEQ ID NO: 334425 - RNA, 22 nt, Human
ccaagaggggcagagggcugca

SEQ ID NO: 334426 - RNA, 22 nt, Human
ggaacuccugcuccaagcagcu

SEQ ID NO: 334427 - RNA, 22 nt, Human
gcuucccacagcuggacugggg

SEQ ID NO: 334428 - RNA, 22 nt, Human
ggcuagcuuagagucaugcuag

SEQ ID NO: 334429 - RNA, 22 nt, Human
uuuguguuguacuucugugcau

SEQ ID NO: 334430 - RNA, 22 nt, Human
cagcaguguacaaggugucaga

SEQ ID NO: 334431 - RNA, 22 nt, Human
uucuuuuaauuucugucugcag

SEQ ID NO: 334432 - RNA, 22 nt, Human
cucccagccuucgccagucuga

SEQ ID NO: 334433 - RNA, 22 nt, Human
ggaagcuguuaucaucuguauc

SEQ ID NO: 334434 - RNA, 22 nt, Human
guugcagauguggaacucgugc

SEQ ID NO: 334435 - RNA, 22 nt, Human
uccaggagggggagccgugccg

SEQ ID NO: 334436 - RNA, 19 nt, Human
gcuuccagcacugcaggag

SEQ ID NO: 334437 - RNA, 23 nt, Human
caccccacccugaggaggaggga

SEQ ID NO: 334438 - RNA, 22 nt, Human
acugccaggauggcacuagagg

SEQ ID NO: 334439 - RNA, 22 nt, Human
aggugggacccguggggugcga

SEQ ID NO: 334440 - RNA, 22 nt, Human
uuuuggcucugcagguuugcac

SEQ ID NO: 334441 - RNA, 22 nt, Human
uuuuuaagagucuggaaauagu

SEQ ID NO: 334442 - RNA, 22 nt, Human
ugcugcgggacccacugugggc

SEQ ID NO: 334443 - RNA, 22 nt, Human
cugggguccuugccauguguca

SEQ ID NO: 334444 - RNA, 22 nt, Human
gcucugugggggaaauccuggg

SEQ ID NO: 334445 - RNA, 22 nt, Human
uuugcagagugcagaagcaucu

SEQ ID NO: 334446 - RNA, 22 nt, Human
gcaguaucuaugugauggguug

SEQ ID NO: 334447 - RNA, 22 nt, Human
cugggcuccuaaccauccaggu

SEQ ID NO: 334448 - RNA, 19 nt, Human
uaugacaaguacuaguucu

SEQ ID NO: 334449 - RNA, 22 nt, Human
cccagcugaacuugcauuccaa

SEQ ID NO: 334450 - RNA, 22 nt, Human
cuagaaguuuggguccauuaag

SEQ ID NO: 334451 - RNA, 22 nt, Human
gccuuugcugugacaaugcugg

SEQ ID NO: 334452 - RNA, 19 nt, Human
gggugaggaagagcguugc

SEQ ID NO: 334453 - RNA, 22 nt, Human
ccaggacaagccagagggacag

SEQ ID NO: 334454 - RNA, 22 nt, Human
auggccugcagugcugccacag

SEQ ID NO: 334455 - RNA, 22 nt, Human
gagguccacugaggcaacaggg

SEQ ID NO: 334456 - RNA, 22 nt, Human
uaaauacuuuuacuccacugau

SEQ ID NO: 334457 - RNA, 22 nt, Human
ucugcuggaaaaccagggaauu

SEQ ID NO: 334458 - RNA, 22 nt, Human
uccaggagcucauccacgucaa

SEQ ID NO: 334459 - RNA, 18 nt, Human
ggcggguguuuuauucac

SEQ ID NO: 334460 - RNA, 22 nt, Human
ucaucaucauucucccccacuu

SEQ ID NO: 334461 - RNA, 22 nt, Human
caagagcuuuagaaaugcucau

SEQ ID NO: 334462 - RNA, 22 nt, Human
gcgcuccucccggcccuggugg

SEQ ID NO: 334463 - RNA, 22 nt, Human
cccaccagaccugcaccggcac

SEQ ID NO: 334464 - RNA, 22 nt, Human
cuggcaguguccagcucgugau

SEQ ID NO: 334465 - RNA, 22 nt, Human
ucccucugcuagugcuugagcu

SEQ ID NO: 334466 - RNA, 22 nt, Human
cuccagcagaaagggcgagugg

SEQ ID NO: 334467 - RNA, 22 nt, Human
aggcuguccucucuugcucagu

SEQ ID NO: 334468 - RNA, 22 nt, Human
caauguuuuuccuuccuuaaua

SEQ ID NO: 334469 - RNA, 22 nt, Human
ccucguccacaauccuugcaca

SEQ ID NO: 334470 - RNA, 18 nt, Human
ggaaggugcuggagugca

SEQ ID NO: 334471 - RNA, 22 nt, Human
uuucugugauaggcugcgacgc

SEQ ID NO: 334472 - RNA, 22 nt, Human
ugggcagggagcuggaaccaca

SEQ ID NO: 334473 - RNA, 22 nt, Human
ucaugucccguugcuggcugcc

SEQ ID NO: 334474 - RNA, 22 nt, Human
uugugcccucaaagggugcguc

SEQ ID NO: 334475 - RNA, 22 nt, Human
agaguuaaugcaggccaagccu

SEQ ID NO: 334476 - RNA, 22 nt, Human
cagaaagugauuugcuauucca

SEQ ID NO: 334477 - RNA, 22 nt, Human
ggcuuuuguuucagcucugcua

SEQ ID NO: 334478 - RNA, 21 nt, Human
acuguauuguuuucaaggauc

SEQ ID NO: 334479 - RNA, 22 nt, Human
agacgcgguggugcaugccugu

SEQ ID NO: 334480 - RNA, 22 nt, Human
cucucugggcccaguuggcacc

SEQ ID NO: 334481 - RNA, 22 nt, Human
ggagaugccuuguuucaggaac

SEQ ID NO: 334482 - RNA, 22 nt, Human
uguaauguuagaaacaauugcu

SEQ ID NO: 334483 - RNA, 22 nt, Human
ugcagcugccuagggcuggcuu

SEQ ID NO: 334484 - RNA, 22 nt, Human
aacccuggggcugcucugccug

SEQ ID NO: 334485 - RNA, 22 nt, Human
agcagcaggugaccucgaugcc

SEQ ID NO: 334486 - RNA, 22 nt, Human
cugcacagccugucugggggcc

SEQ ID NO: 334487 - RNA, 22 nt, Human
gcagggaaguuguaauguaaug

SEQ ID NO: 334488 - RNA, 22 nt, Human
gugauuuucuccuccuagaagu

SEQ ID NO: 334489 - RNA, 22 nt, Human
guagcagagggcccagguaacu

SEQ ID NO: 334490 - RNA, 22 nt, Human
uguguuuuggaaggaacaugca

SEQ ID NO: 334491 - RNA, 22 nt, Human adenovirus F
caccuguaccgggucuuggaaa

SEQ ID NO: 334492 - RNA, 22 nt, Human adenovirus F
cagugguucuuaauccgcaggc

SEQ ID NO: 334493 - RNA, 22 nt, Human adenovirus F
ucgcaucuuuuuugacuuggcu

SEQ ID NO: 334494 - RNA, 22 nt, Human adenovirus F
gucaaaauugauggucugggua

SEQ ID NO: 334495 - RNA, 22 nt, Human adenovirus F
ggagaucuugcaggccugacga

SEQ ID NO: 334496 - RNA, 22 nt, Human adenovirus F
ggagcguguuugucagagguag

SEQ ID NO: 334497 - RNA, 22 nt, Human adenovirus F
ggagggacguggagcgccugca

SEQ ID NO: 334498 - RNA, 22 nt, Human adenovirus F
gccugggagaaaggcauggauu

SEQ ID NO: 334499 - RNA, 22 nt, Human adenovirus F
aacguaugcuguuccgcccuuc

SEQ ID NO: 334500 - RNA, 22 nt, Human adenovirus F
cgcccucuucugcaccugcacg

SEQ ID NO: 334501 - RNA, 22 nt, Human adenovirus F
agcgguggggagaggugugauc

SEQ ID NO: 334502 - RNA, 23 nt, Human adenovirus F
acugucaguggugcggcgguggc

SEQ ID NO: 334503 - RNA, 22 nt, Human adenovirus F
gcaagcccauucugccaguugg

SEQ ID NO: 334504 - RNA, 22 nt, Human adenovirus F
gccucugccaguguuaauacua

SEQ ID NO: 334505 - RNA, 22 nt, Human adenovirus F
cugcuguaugaugggcacgcgg

SEQ ID NO: 334506 - RNA, 22 nt, Human adenovirus F
gaccaccugucgcggucguuua

SEQ ID NO: 334507 - RNA, 22 nt, Human adenovirus F
ugcggagccugagggucgcugg

SEQ ID NO: 334508 - RNA, 22 nt, Human adenovirus F
ugaggcuuggcagucucuaccu

SEQ ID NO: 334509 - RNA, 22 nt, Human adenovirus F
ugcagagccaccggaggcuggc

SEQ ID NO: 334510 - RNA, 22 nt, Human adenovirus F
gaggcguucgacgcgaggauga

SEQ ID NO: 334511 - RNA, 22 nt, Human adenovirus F
cggaaggcauagugcagggacu

SEQ ID NO: 334512 - RNA, 22 nt, Human adenovirus F
uuuaaacgaccgcgacaggugg

SEQ ID NO: 334513 - RNA, 16 nt, Human adenovirus F
agucauuauuuuguac

SEQ ID NO: 334514 - RNA, 22 nt, Human adenovirus F
aguuagcgcccugucgcugccu

SEQ ID NO: 334515 - RNA, 22 nt, Human adenovirus F
gugcaggugcagaagagggcga

SEQ ID NO: 334516 - RNA, 22 nt, Human
uugauacaggccuucuagauga

SEQ ID NO: 334517 - RNA, 22 nt, Human
uagcauuucccaaaugcauuug

SEQ ID NO: 334518 - RNA, 22 nt, Human
uuagaacugaagaagauuaagg

SEQ ID NO: 334519 - RNA, 21 nt, Human
auaaaguuuuacaggaaugca

SEQ ID NO: 334520 - RNA, 22 nt, Human
uguaugaaguuacugagccucu

SEQ ID NO: 334521 - RNA, 23 nt, Human
acaagauagggauaaaaagauaa

SEQ ID NO: 334522 - RNA, 22 nt, Human
uuggaaauacagcaguuacuuu

SEQ ID NO: 334523 - RNA, 22 nt, Human
uuagaacuuaaacuucagaaag

SEQ ID NO: 334524 - RNA, 22 nt, Human
uacaaguaaauuguagauacca

SEQ ID NO: 334525 - RNA, 22 nt, Human
ugcuagaaaucugaaacuagca

SEQ ID NO: 334526 - RNA, 22 nt, Human
aacagcauaaguauuuauuuca

SEQ ID NO: 334527 - RNA, 22 nt, Human
auucugucuuuuuauacaucua

SEQ ID NO: 334528 - RNA, 22 nt, Human
aucuguuccccuaugcucucua

SEQ ID NO: 334529 - RNA, 20 nt, Human
cuguuaaaagguaugaauuc

SEQ ID NO: 334530 - RNA, 22 nt, Human
uauaaaguuucgaaagauguau

SEQ ID NO: 334531 - RNA, 22 nt, Human
uaauuucuagggacuaaggugc

SEQ ID NO: 334532 - RNA, 22 nt, Human
ugaaauuaugcauuguuguacc

SEQ ID NO: 334533 - RNA, 22 nt, Human
uguaugaaaaggaauagauuga

SEQ ID NO: 334534 - RNA, 18 nt, Human
acaaaugugucacaggaa

SEQ ID NO: 334535 - RNA, 22 nt, Human
agaauccuguuuuacuucauca

SEQ ID NO: 334536 - RNA, 22 nt, Human
uaaucuguauuccuacuuugca

SEQ ID NO: 334537 - RNA, 22 nt, Human
cauuuacuuaaaucuuuacaag

SEQ ID NO: 334538 - RNA, 22 nt, Human
uagaaacaaugacaugcuugua

SEQ ID NO: 334539 - RNA, 22 nt, Human
uauacaauggcugaaucaucca

SEQ ID NO: 334540 - RNA, 22 nt, Human
ucugugcauuguaacaacuaaa

SEQ ID NO: 334541 - RNA, 22 nt, Human
ccuacucugagcgccuccgcau

SEQ ID NO: 334542 - RNA, 22 nt, Human
ugucagaugcgauaaacuagug

SEQ ID NO: 334543 - RNA, 21 nt, Human
ucuagaauccuguauaagacu

SEQ ID NO: 334544 - RNA, 22 nt, Human
uuggaaaaacacgauagugguu

SEQ ID NO: 334545 - RNA, 22 nt, Human
uuguaugaucaaaagaaaugua

SEQ ID NO: 334546 - RNA, 22 nt, Human
gugugaaaaugugcacaauaug

SEQ ID NO: 334547 - RNA, 22 nt, Human
acaagguauccacauuaaaugu

SEQ ID NO: 334548 - RNA, 22 nt, Human
uguagaaacuacacaugcaaca

SEQ ID NO: 334549 - RNA, 22 nt, Human
ucauauaaguuuaaaacuaucu

SEQ ID NO: 334550 - RNA, 22 nt, Human
acuucacagaaauuuuaugagg

SEQ ID NO: 334551 - RNA, 20 nt, Human
gcaaaauaggcucuguuggu

SEQ ID NO: 334552 - RNA, 22 nt, Human
caagauaagaucauuuacacua

SEQ ID NO: 334553 - RNA, 22 nt, Human
auguagaauggugauuggcagg

SEQ ID NO: 334554 - RNA, 22 nt, Human
augcugucgaaaccaaacaucu

SEQ ID NO: 334555 - RNA, 22 nt, Human
uauugaaauucuucauguccuc

SEQ ID NO: 334556 - RNA, 22 nt, Human
ucugucaauauaugugcugcag

SEQ ID NO: 334557 - RNA, 22 nt, Human
uaucaauacauguuaucagugu

SEQ ID NO: 334558 - RNA, 22 nt, Human
acuuuacaagcuuauagccuag

SEQ ID NO: 334559 - RNA, 22 nt, Human
aauguaugaagguuccaguuuc

SEQ ID NO: 334560 - RNA, 22 nt, Human
uagucaaaccucagaauacccc

SEQ ID NO: 334561 - RNA, 22 nt, Human
aauguaugcugugguaucuucu

SEQ ID NO: 334562 - RNA, 22 nt, Human
uacauguauguguacgugcaug

SEQ ID NO: 334563 - RNA, 23 nt, Human
auggaagucacuguuuucuuguc

SEQ ID NO: 334564 - RNA, 22 nt, Human
aauacugucuuucacagauauu

SEQ ID NO: 334565 - RNA, 22 nt, Human
gugaaacacccuccaaugcaca

SEQ ID NO: 334566 - RNA, 22 nt, Human
uguaaaaccaaaucaaucuagu

SEQ ID NO: 334567 - RNA, 22 nt, Human
aaaguucuggcauuuucugucu

SEQ ID NO: 334568 - RNA, 22 nt, Human
auguagaaaguucauagaugcg

SEQ ID NO: 334569 - RNA, 22 nt, Human
aguaugaaucucuuuauucugc

SEQ ID NO: 334570 - RNA, 22 nt, Human
uaauaucuggcauucaaacaug

SEQ ID NO: 334571 - RNA, 22 nt, Human
gaauauuuucaguacagauggu

SEQ ID NO: 334572 - RNA, 22 nt, Human
gaacacaucacauuuuacagug

SEQ ID NO: 334573 - RNA, 22 nt, Human
auucucaauggcuacuuucaua

SEQ ID NO: 334574 - RNA, 22 nt, Human
augcuacagaguuugaauaugu

SEQ ID NO: 334575 - RNA, 22 nt, Human
augucaaacacaacaccagugg

SEQ ID NO: 334576 - RNA, 22 nt, Human
uuucacaagacagcuacuguug

SEQ ID NO: 334577 - RNA, 22 nt, Human
auaugugaaugauaucacuuug

SEQ ID NO: 334578 - RNA, 22 nt, Human
cuguuuaucucuaaccuguuua

SEQ ID NO: 334579 - RNA, 22 nt, Human
acugauuacacgaguucugacu

SEQ ID NO: 334580 - RNA, 22 nt, Human
cagcauuuagaauuugaagugu

SEQ ID NO: 334581 - RNA, 22 nt, Human
uuagccauguugaagauuuaga

SEQ ID NO: 334582 - RNA, 22 nt, Human
uacaaaguaauguauaauaucg

SEQ ID NO: 334583 - RNA, 22 nt, Human
aauugcaauuuucuuaaggucu

SEQ ID NO: 334584 - RNA, 22 nt, Human
uuggaaagauuauuauuaugaa

SEQ ID NO: 334585 - RNA, 22 nt, Human
cauaugaaauaugaguugaaca

SEQ ID NO: 334586 - RNA, 22 nt, Human
auguagaagcugacagugcugu

SEQ ID NO: 334587 - RNA, 22 nt, Human
uguacuaaggcuguguagaugu

SEQ ID NO: 334588 - RNA, 22 nt, Human
cauaauuugugguaguggggga

SEQ ID NO: 334589 - RNA, 22 nt, Human
uacaaaguagaaauucaguaaa

SEQ ID NO: 334590 - RNA, 22 nt, Human
uaugaacuagcugauuuaguuu

SEQ ID NO: 334591 - RNA, 22 nt, Human
caaugaaaauuuaaguugcagc

SEQ ID NO: 334592 - RNA, 22 nt, Human
aucaaauauaauaauuuucgcu

SEQ ID NO: 334593 - RNA, 22 nt, Human
cuagaaauauuuuacagucaag

SEQ ID NO: 334594 - RNA, 22 nt, Human
uaaucuguguaccuucaucgga

SEQ ID NO: 334595 - RNA, 22 nt, Human
agaaucucuacucaaguacuug

SEQ ID NO: 334596 - RNA, 22 nt, Human
aauuauguagccauaugaaaca

SEQ ID NO: 334597 - RNA, 19 nt, Human
uugaaauuguuugauaugg

SEQ ID NO: 334598 - RNA, 22 nt, Human
uucugucaaauuugccauaugg

SEQ ID NO: 334599 - RNA, 22 nt, Human
aauacauauggaauuccauguu

SEQ ID NO: 334600 - RNA, 22 nt, Human
guuuuccugaaacugauggugu

SEQ ID NO: 334601 - RNA, 22 nt, Human
auuacucugucugccucugacc

SEQ ID NO: 334602 - RNA, 22 nt, Human
aauucugugcaggcagagcuau

SEQ ID NO: 334603 - RNA, 22 nt, Human
augacaugaccugguagagaca

SEQ ID NO: 334604 - RNA, 22 nt, Human
aaacacagauuucuuuguccca

SEQ ID NO: 334605 - RNA, 23 nt, Human
aaacuacauuuauaguuuuucuc

SEQ ID NO: 334606 - RNA, 22 nt, Human
uguucauaucauuuugaaagcu

SEQ ID NO: 334607 - RNA, 22 nt, Human
uuucauaauauccagagauuuu

SEQ ID NO: 334608 - RNA, 22 nt, Human
uuguaugaggauagcaagaagc

SEQ ID NO: 334609 - RNA, 22 nt, Human
aucugucuugccuugcauauuu

SEQ ID NO: 334610 - RNA, 22 nt, Human
augugaaagagguguucagugg

SEQ ID NO: 334611 - RNA, 22 nt, Human
cuauugaauuaacuauuaaagu

SEQ ID NO: 334612 - RNA, 22 nt, Human
uauugacaauuugugaaacuau

SEQ ID NO: 334613 - RNA, 22 nt, Human
auauacuuggagacuaucauug

SEQ ID NO: 334614 - RNA, 22 nt, Human
uguagaaccuguuuauuauaga

SEQ ID NO: 334615 - RNA, 23 nt, Human
uuuuccuguggagacaugacugg

SEQ ID NO: 334616 - RNA, 22 nt, Human
cuagguauucauguuucguggc

SEQ ID NO: 334617 - RNA, 22 nt, Human
cuaauguaucauggcucucagc

SEQ ID NO: 334618 - RNA, 20 nt, Human
augugaaagaucaguugucu

SEQ ID NO: 334619 - RNA, 22 nt, Human
aauaaucucccuuuuuguaugu

SEQ ID NO: 334620 - RNA, 20 nt, Human
ucugugcaccugcuacaagg

SEQ ID NO: 334621 - RNA, 22 nt, Human
acagauauuuggggaaagacgu

SEQ ID NO: 334622 - RNA, 22 nt, Human
ugugugaaggagccacuguuca

SEQ ID NO: 334623 - RNA, 19 nt, Human
agcaacaccguuuauuucc

SEQ ID NO: 334624 - RNA, 22 nt, Human
uucaugaaacuuaacuguuggg

SEQ ID NO: 334625 - RNA, 22 nt, Human
aguaugaacggaaggccuggga

SEQ ID NO: 334626 - RNA, 22 nt, Human
cacaugaagagagucuaguaau

SEQ ID NO: 334627 - RNA, 22 nt, Human
cauauguauuucucauaauuag

SEQ ID NO: 334628 - RNA, 22 nt, Human
aauaacuuuuaaaagacccugg

SEQ ID NO: 334629 - RNA, 22 nt, Human
uucugucacagugcugguauca

SEQ ID NO: 334630 - RNA, 22 nt, Human
ugcuacaauucacaucuggaua

SEQ ID NO: 334631 - RNA, 22 nt, Human
uuucauugaugggugauagaaa

SEQ ID NO: 334632 - RNA, 22 nt, Human
ugucuucaucuccaugcacaga

SEQ ID NO: 334633 - RNA, 19 nt, Human
cccucuugcacaaagcaaa

SEQ ID NO: 334634 - RNA, 22 nt, Human
uucauacacgaaaaugcaugca

SEQ ID NO: 334635 - RNA, 22 nt, Human
aaaaugacauuccagugauauu

SEQ ID NO: 334636 - RNA, 20 nt, Human
uucugucagauuauauggga

SEQ ID NO: 334637 - RNA, 22 nt, Human
uucugucaaaugccaguagaga

SEQ ID NO: 334638 - RNA, 22 nt, Human
uucugucauccuuucuagaugu

SEQ ID NO: 334639 - RNA, 22 nt, Human
uauucacaugaaaacaaauuuu

SEQ ID NO: 334640 - RNA, 22 nt, Human
ucauaaaucauacuccauuugc

SEQ ID NO: 334641 - RNA, 22 nt, Human
ugugaaaagcaggcuacuuucu

SEQ ID NO: 334642 - RNA, 22 nt, Human
ucaugaacauggaauaucuuuu

SEQ ID NO: 334643 - RNA, 22 nt, Human
cuacaaugacagaauugaguag

SEQ ID NO: 334644 - RNA, 20 nt, Human
uuaucugucaaucugucuca

SEQ ID NO: 334645 - RNA, 22 nt, Human
uauguaaaaauucaucaggcug

SEQ ID NO: 334646 - RNA, 18 nt, Human
ugucauaauauaucaccu

SEQ ID NO: 334647 - RNA, 22 nt, Human
uuaacacauauuuaucaauugc

SEQ ID NO: 334648 - RNA, 22 nt, Human
aguauaaagugguuuucagcac

SEQ ID NO: 334649 - RNA, 22 nt, Human
aucugucaggagcaaggacuac

SEQ ID NO: 334650 - RNA, 22 nt, Human
caaaguuuuaguaaacauauau

SEQ ID NO: 334651 - RNA, 22 nt, Human
cuagaauugcauucuaugaaua

SEQ ID NO: 334652 - RNA, 22 nt, Human
uaugacauuggccaaguucugu

SEQ ID NO: 334653 - RNA, 22 nt, Human
auacuucuuugauguucacagg

SEQ ID NO: 334654 - RNA, 18 nt, Human
cccucuugcacaaagcaa

SEQ ID NO: 334655 - RNA, 22 nt, Human
uuaucauugucgcagucuaauu

SEQ ID NO: 334656 - RNA, 22 nt, Human
acauuucacuguucacagcagg

SEQ ID NO: 334657 - RNA, 22 nt, Human
acauaugauauugaggaucuca

SEQ ID NO: 334658 - RNA, 22 nt, Human
aaaguuugagugauuugacaca

SEQ ID NO: 334659 - RNA, 22 nt, Human
uacaaagucacauugaaaugaa

SEQ ID NO: 334660 - RNA, 22 nt, Human
aucuacauaaaacgaauacaua

SEQ ID NO: 334661 - RNA, 22 nt, Human
aagauaauauucauuaacuaga

SEQ ID NO: 334662 - RNA, 22 nt, Human
uaacacauaucuacaacaugug

SEQ ID NO: 334663 - RNA, 22 nt, Human
aaguuucauuguucauguaaca

SEQ ID NO: 334664 - RNA, 22 nt, Human
ugcuagaagauagcuagaagau

SEQ ID NO: 334665 - RNA, 22 nt, Human
uacuuacagaaggaagcaauug

SEQ ID NO: 334666 - RNA, 22 nt, Human
uuguaugagcuccaggaacuca

SEQ ID NO: 334667 - RNA, 22 nt, Human
uuucaaaccuacuuguauguuu

SEQ ID NO: 334668 - RNA, 22 nt, Human
uuucuugacugcuuaggaaugc

SEQ ID NO: 334669 - RNA, 22 nt, Human
ucugauuagagcauucuugagu

SEQ ID NO: 334670 - RNA, 22 nt, Human
uucaaauacauucuuugccacu

SEQ ID NO: 334671 - RNA, 20 nt, Human
auacacauucauagaaaaau

SEQ ID NO: 334672 - RNA, 22 nt, Human
gguaugaaaugauuccauguua

SEQ ID NO: 334673 - RNA, 21 nt, Human
uaugaacaugaccaauagucc

SEQ ID NO: 334674 - RNA, 22 nt, Human
aauacugccugugagguaacuc

SEQ ID NO: 334675 - RNA, 22 nt, Human
gaacacauuucucugacuguag

SEQ ID NO: 334676 - RNA, 22 nt, Human
auacacauauguguguauaugu

SEQ ID NO: 334677 - RNA, 22 nt, Human
augaagcugaaaaaggcauaua

SEQ ID NO: 334678 - RNA, 22 nt, Human
gaaguucuuagucucauuugca

SEQ ID NO: 334679 - RNA, 23 nt, Human
ucuguacaauugagaagagaaca

SEQ ID NO: 334680 - RNA, 22 nt, Human
uucugucagaagcuagcuccug

SEQ ID NO: 334681 - RNA, 22 nt, Human
uaugaaacauucauacaaauaa

SEQ ID NO: 334682 - RNA, 22 nt, Human
ucugucaaaaguuuucaauaaa

SEQ ID NO: 334683 - RNA, 22 nt, Human
cucauaaugugacuguauuuga

SEQ ID NO: 334684 - RNA, 23 nt, Human
uguaugaauaugccacaguuuaa

SEQ ID NO: 334685 - RNA, 22 nt, Human
uuucacacugcagcaucagaga

SEQ ID NO: 334686 - RNA, 22 nt, Human
uggaaauacuugccauaaaacu

SEQ ID NO: 334687 - RNA, 22 nt, Human
aauugcaacagguagacuuuuc

SEQ ID NO: 334688 - RNA, 22 nt, Human
guguaugauuucaaauggcuag

SEQ ID NO: 334689 - RNA, 22 nt, Human
uacauugcuuucuaauacaucu

SEQ ID NO: 334690 - RNA, 22 nt, Human
uaugaccuuaggaagcaagaag

SEQ ID NO: 334691 - RNA, 23 nt, Human
gaauaguuuuagaaauuggagaa

SEQ ID NO: 334692 - RNA, 22 nt, Human
auaugagaguaaaugccgaucu

SEQ ID NO: 334693 - RNA, 20 nt, Human
agaaauauugaguucagagg

SEQ ID NO: 334694 - RNA, 22 nt, Human
uacagcauauacagaaugaaca

SEQ ID NO: 334695 - RNA, 22 nt, Human
uaugucaaaguuaagaaauagg

SEQ ID NO: 334696 - RNA, 22 nt, Human
guguaugagccuccagcugggc

SEQ ID NO: 334697 - RNA, 22 nt, Human
ucugauuagcaguuuagggaaa

SEQ ID NO: 334698 - RNA, 22 nt, Human
uuucuugaccacuauguugaua

SEQ ID NO: 334699 - RNA, 22 nt, Human
aucaguuauuuuuaagcuauaa

SEQ ID NO: 334700 - RNA, 22 nt, Human
uucugucauuuagcauugucau

SEQ ID NO: 334701 - RNA, 22 nt, Human
uguuagaaauuauuaguaauau

SEQ ID NO: 334702 - RNA, 22 nt, Human
gaaagauauuuauuggcaacag

SEQ ID NO: 334703 - RNA, 22 nt, Human
guuaugaaauaaauauagauca

SEQ ID NO: 334704 - RNA, 22 nt, Human
aaauacauaaagguuguaccag

SEQ ID NO: 334705 - RNA, 22 nt, Human
uguaugaagacuucuucugugu

SEQ ID NO: 334706 - RNA, 22 nt, Human
uuagaacuuaagaauacugucu

SEQ ID NO: 334707 - RNA, 22 nt, Human
auauaauuguucugaaguguuu

SEQ ID NO: 334708 - RNA, 22 nt, Human
uuuacacaaaagauagcacacc

SEQ ID NO: 334709 - RNA, 22 nt, Human
acuggaaaugagaugauaucag

SEQ ID NO: 334710 - RNA, 22 nt, Human
auaacuuagaguaggcaaaagu

SEQ ID NO: 334711 - RNA, 21 nt, Human
aauguauguuuaucucacagu

SEQ ID NO: 334712 - RNA, 22 nt, Human
cagcauuuaucuuguagcagga

SEQ ID NO: 334713 - RNA, 22 nt, Human
ugucuucaguaaaauacacuau

SEQ ID NO: 334714 - RNA, 22 nt, Human
uucugucaugcucauguaauug

SEQ ID NO: 334715 - RNA, 22 nt, Human
acagauauaaacuauaguagug

SEQ ID NO: 334716 - RNA, 22 nt, Human
uaauacuguauacugcaaauuu

SEQ ID NO: 334717 - RNA, 22 nt, Human
aauaauuuuagcucagaguugu

SEQ ID NO: 334718 - RNA, 22 nt, Human
uaguauuuaaucacuuuugucu

SEQ ID NO: 334719 - RNA, 22 nt, Human
uacagcauguccuuagcaaggc

SEQ ID NO: 334720 - RNA, 22 nt, Human
auguuagaaggaauguuaaaag

SEQ ID NO: 334721 - RNA, 22 nt, Human
uacuuacacagcuguagaaggu

SEQ ID NO: 334722 - RNA, 22 nt, Human
cacagucacauaucuaugugug

SEQ ID NO: 334723 - RNA, 22 nt, Human
ucaauaaaauuguuuuccuauc

SEQ ID NO: 334724 - RNA, 22 nt, Human
gaacacaugauuauaaaugcua

SEQ ID NO: 334725 - RNA, 22 nt, Human
aauguaugagcgugaaagcacu

SEQ ID NO: 334726 - RNA, 22 nt, Human
gaacaucagucauaauuuaacg

SEQ ID NO: 334727 - RNA, 22 nt, Human
aaaguuugcaauuuauguuaau

SEQ ID NO: 334728 - RNA, 23 nt, Human
aaaguuugaagcaacaguaguug

SEQ ID NO: 334729 - RNA, 22 nt, Human
uaacuacauuucacugcaauua

SEQ ID NO: 334730 - RNA, 22 nt, Human
ucauuuugggguuugucaucuu

SEQ ID NO: 334731 - RNA, 22 nt, Human
uaacacauuaguucuccuagau

SEQ ID NO: 334732 - RNA, 22 nt, Human
ugagaaaugggucugcugaaga

SEQ ID NO: 334733 - RNA, 22 nt, Human
ucugaaauagaagugucuuucu

SEQ ID NO: 334734 - RNA, 22 nt, Human
uuuuccuguccaggcaauuauu

SEQ ID NO: 334735 - RNA, 23 nt, Human
aauguauguuaguaucuuagaga

SEQ ID NO: 334736 - RNA, 22 nt, Human
uguaugaaucucauuuguuuaa

SEQ ID NO: 334737 - RNA, 22 nt, Human
ucacauuucugauuauaccaaa

SEQ ID NO: 334738 - RNA, 22 nt, Human
augugaaauagcuggauaugaa

SEQ ID NO: 334739 - RNA, 22 nt, Human
aucugcuugaguuugaagucag

SEQ ID NO: 334740 - RNA, 22 nt, Human
uugugcucuguguuauuuaagg

SEQ ID NO: 334741 - RNA, 22 nt, Human
ucuucuuaugugccauuaucuc

SEQ ID NO: 334742 - RNA, 22 nt, Human
aaauaguuagcccugcauauau

SEQ ID NO: 334743 - RNA, 22 nt, Human
uaggaaauggcucaguuacugc

SEQ ID NO: 334744 - RNA, 22 nt, Human
uauacacaaggugugcauuugu

SEQ ID NO: 334745 - RNA, 22 nt, Human
uaucaauugggccaaaugguac

SEQ ID NO: 334746 - RNA, 22 nt, Human
aaauauagcaauuaugccuacu

SEQ ID NO: 334747 - RNA, 23 nt, Human
auguaucucauccaaggaagcuc

SEQ ID NO: 334748 - RNA, 21 nt, Human
uuucugaaggcaacaucuauc

SEQ ID NO: 334749 - RNA, 22 nt, Human
acacagccgugaaucugcuucu

SEQ ID NO: 334750 - RNA, 22 nt, Human
guaguuuucugaaaauuacuuu

SEQ ID NO: 334751 - RNA, 22 nt, Human
uagaaacauguucuguucuguu

SEQ ID NO: 334752 - RNA, 22 nt, Human
uagcauuuauuccagauuugga

SEQ ID NO: 334753 - RNA, 22 nt, Human
uuugacaaauccuucagcaaug

SEQ ID NO: 334754 - RNA, 22 nt, Human
acuggaaaacacuacuacaugc

SEQ ID NO: 334755 - RNA, 22 nt, Human
ucacaauacucacucaauggcu

SEQ ID NO: 334756 - RNA, 22 nt, Human
uaacacauauuugcaguaagca

SEQ ID NO: 334757 - RNA, 22 nt, Human
uaugaacauguucauugacuua

SEQ ID NO: 334758 - RNA, 22 nt, Human
caaauaguaugagcaaugauuc

SEQ ID NO: 334759 - RNA, 23 nt, Human
aaauaugucugagggcaaagaau

SEQ ID NO: 334760 - RNA, 22 nt, Human
aaauaguuguuuggaucaauaa

SEQ ID NO: 334761 - RNA, 22 nt, Human
uuucugaacaaagccauuauca

SEQ ID NO: 334762 - RNA, 22 nt, Human
aauaguauuuauuuggaaaaag

SEQ ID NO: 334763 - RNA, 22 nt, Human
acaugauuuuuaaagagauaau

SEQ ID NO: 334764 - RNA, 22 nt, Human
uguuccaauaaggaguugaaau

SEQ ID NO: 334765 - RNA, 22 nt, Human
ucauacaauucaaucucugauu

SEQ ID NO: 334766 - RNA, 22 nt, Human
uuaacacaucccugcucuaccc

SEQ ID NO: 334767 - RNA, 23 nt, Human
ugugaaauuugaggucagugcuu

SEQ ID NO: 334768 - RNA, 21 nt, Human
caauaaacugcacauugagac

SEQ ID NO: 334769 - RNA, 22 nt, Human
auuuagacuucccagcacugug

SEQ ID NO: 334770 - RNA, 22 nt, Human
uuucucuugcgauaugcuacac

SEQ ID NO: 334771 - RNA, 22 nt, Human
ucauauaacuggauauuuucaa

SEQ ID NO: 334772 - RNA, 22 nt, Human
aagucuguuugagugucacacu

SEQ ID NO: 334773 - RNA, 22 nt, Human
uguaugaauauguuggggaggu

SEQ ID NO: 334774 - RNA, 22 nt, Human
auucacagaauaguuuuaccag

SEQ ID NO: 334775 - RNA, 22 nt, Human
aacuacauuguccuuucugaag

SEQ ID NO: 334776 - RNA, 22 nt, Human
uaacacaugucugggaugugaa

SEQ ID NO: 334777 - RNA, 22 nt, Human
ucacaauauuuaucuuccaauu

SEQ ID NO: 334778 - RNA, 22 nt, Human
auucugucuaagcuggcuacgu

SEQ ID NO: 334779 - RNA, 22 nt, Human
aaaguuaguuucuuauaugucu

SEQ ID NO: 334780 - RNA, 21 nt, Human
acagauauuucauugaacauu

SEQ ID NO: 334781 - RNA, 22 nt, Human
uagaauucaagauucaacaggc

SEQ ID NO: 334782 - RNA, 22 nt, Human
aauugucaaacacaaauaagag

SEQ ID NO: 334783 - RNA, 22 nt, Human
uuuucguuuauuugacauguaa

SEQ ID NO: 334784 - RNA, 22 nt, Human
auguaugaagcuuuguuuggga

SEQ ID NO: 334785 - RNA, 20 nt, Human
auacacauauucuugcaacu

SEQ ID NO: 334786 - RNA, 22 nt, Human
auguuauggcucaaacauuugg

SEQ ID NO: 334787 - RNA, 22 nt, Human
cucugucacuucuccagcugag

SEQ ID NO: 334788 - RNA, 22 nt, Human
agguauaagucucauuucuguu

SEQ ID NO: 334789 - RNA, 22 nt, Human
auaucauuauguuaugagcaca

SEQ ID NO: 334790 - RNA, 22 nt, Human
uguuugaauuuugcuaacgugu

SEQ ID NO: 334791 - RNA, 21 nt, Human
augugaaaccuuccacgcuga

SEQ ID NO: 334792 - RNA, 22 nt, Human
uacauucagaagaauggacacg

SEQ ID NO: 334793 - RNA, 22 nt, Human
uguguaaagcuuguuccagaaa

SEQ ID NO: 334794 - RNA, 19 nt, Human
acauuuagaauguacuugc

SEQ ID NO: 334795 - RNA, 22 nt, Human
uagauauggccgucuguuuuaa

SEQ ID NO: 334796 - RNA, 22 nt, Human
uuuuccuucuagagcagauuuc

SEQ ID NO: 334797 - RNA, 22 nt, Human
aauacuuuccuauauaaggugc

SEQ ID NO: 334798 - RNA, 22 nt, Human
uaugaacuuuugaugugacaug

SEQ ID NO: 334799 - RNA, 22 nt, Human
gagaacucagacgcaggucaug

SEQ ID NO: 334800 - RNA, 22 nt, Human
acauacuuaugcuaaaaauaua

SEQ ID NO: 334801 - RNA, 22 nt, Human
augugaaaaauuucuuauuaca

SEQ ID NO: 334802 - RNA, 22 nt, Human
agucuacaaagaaaaguuauug

SEQ ID NO: 334803 - RNA, 22 nt, Human
uaacacauuuuccucauacgga

SEQ ID NO: 334804 - RNA, 22 nt, Human
ugcuagaauuagguuaaacaaa

SEQ ID NO: 334805 - RNA, 22 nt, Human
uuccuugaaugagucauggaaa

SEQ ID NO: 334806 - RNA, 22 nt, Human
gaauacauuggaaaucagaaua

SEQ ID NO: 334807 - RNA, 22 nt, Human
aaucuuagguuuggcuucaucu

SEQ ID NO: 334808 - RNA, 22 nt, Human
augaaaauguacauguguauaa

SEQ ID NO: 334809 - RNA, 22 nt, Human
uaacacauuuuaagccauuuua

SEQ ID NO: 334810 - RNA, 22 nt, Human
uuguaauuugcaaauguauugu

SEQ ID NO: 334811 - RNA, 22 nt, Human
uuaauacaagcauaugcacaca

SEQ ID NO: 334812 - RNA, 22 nt, Human
ugaaagauugugauucaauaug

SEQ ID NO: 334813 - RNA, 22 nt, Human
aaaguguggucguucauuuugu

SEQ ID NO: 334814 - RNA, 22 nt, Human
ugguauaaaacuuuuuauugaa

SEQ ID NO: 334815 - RNA, 22 nt, Human
uaauaguugugacuuuguaaag

SEQ ID NO: 334816 - RNA, 22 nt, Human
aauucuguaacuuuacugaauu

SEQ ID NO: 334817 - RNA, 22 nt, Human
cauaauuucccaagagauugaa

SEQ ID NO: 334818 - RNA, 22 nt, Human
gugauaaaauucaaauagcucu

SEQ ID NO: 334819 - RNA, 22 nt, Human
auuacaaucgagagaaacaaau

SEQ ID NO: 334820 - RNA, 22 nt, Human
uguacaaagguacuuugauguu

SEQ ID NO: 334821 - RNA, 22 nt, Human
aagcaacucccuccucauuuuu

SEQ ID NO: 334822 - RNA, 22 nt, Human
uaacuuucuucauaugugaacc

SEQ ID NO: 334823 - RNA, 22 nt, Human
uauacaaugaguacauucuggg

SEQ ID NO: 334824 - RNA, 22 nt, Human
uguaggaaaaacaaugaucugc

SEQ ID NO: 334825 - RNA, 22 nt, Human
uaugaacugugagugugauggg

SEQ ID NO: 334826 - RNA, 19 nt, Human
cauuuagaaguacauauua

SEQ ID NO: 334827 - RNA, 22 nt, Human
uguauaaauuuaaauuccugcu

SEQ ID NO: 334828 - RNA, 22 nt, Human
ugaaacuuauaagaauaugaau

SEQ ID NO: 334829 - RNA, 22 nt, Human
aaacagcaggaacaucuugcca

SEQ ID NO: 334830 - RNA, 22 nt, Human
aagcacauuguacauuugugcu

SEQ ID NO: 334831 - RNA, 22 nt, Human
ucuggucaguaauaagaagugg

SEQ ID NO: 334832 - RNA, 22 nt, Human
aguaugaagcugaaugauuuua

SEQ ID NO: 334833 - RNA, 22 nt, Human
uagcauuaucugucuuaucauu

SEQ ID NO: 334834 - RNA, 22 nt, Human
uucugucacuuuuuuggaaucu

SEQ ID NO: 334835 - RNA, 22 nt, Human
cuuugaaaggaagccacacagc

SEQ ID NO: 334836 - RNA, 22 nt, Human
aaaguaguuagucaugugaaaa

SEQ ID NO: 334837 - RNA, 22 nt, Human
uguaggaauguuuuuaaguugg

SEQ ID NO: 334838 - RNA, 22 nt, Human
uacauauguaaacauguauaaa

SEQ ID NO: 334839 - RNA, 23 nt, Human
ugaaacauuuaggguagaauuuc

SEQ ID NO: 334840 - RNA, 22 nt, Human
cagcauuuucuuaauguaggug

SEQ ID NO: 334841 - RNA, 16 nt, Human
uucugucacguacggc

SEQ ID NO: 334842 - RNA, 22 nt, Human
guguaugaggggagaauguuuu

SEQ ID NO: 334843 - RNA, 22 nt, Human
cucugucagaguguugucccca

SEQ ID NO: 334844 - RNA, 22 nt, Human
auuuagcaaaaaaugaugaagc

SEQ ID NO: 334845 - RNA, 22 nt, Human
ugaaacaaugugaaguugcuga

SEQ ID NO: 334846 - RNA, 22 nt, Human
auauucuuccaaaacaucauuu

SEQ ID NO: 334847 - RNA, 22 nt, Human
aaagaauagccuuuguccaaau

SEQ ID NO: 334848 - RNA, 22 nt, Human
aaauauguauggaguucaugaa

SEQ ID NO: 334849 - RNA, 22 nt, Human
auugcuuaucuaucuuuaaguc

SEQ ID NO: 334850 - RNA, 22 nt, Human
acuauaaaaggauaaaccagaa

SEQ ID NO: 334851 - RNA, 22 nt, Human
aauuaugagguagauaucacau

SEQ ID NO: 334852 - RNA, 22 nt, Human
aguaugaaccuggguucuggau

SEQ ID NO: 334853 - RNA, 22 nt, Human
ugaacacauaaggcuuuccugu

SEQ ID NO: 334854 - RNA, 22 nt, Human
gugcuaaaggguuaugaacaag

SEQ ID NO: 334855 - RNA, 16 nt, Human
uguaugaacgucucca

SEQ ID NO: 334856 - RNA, 22 nt, Human
uuucacaaucaaauggugaaau

SEQ ID NO: 334857 - RNA, 22 nt, Human
ugcuagaauuugcagaagcaua

SEQ ID NO: 334858 - RNA, 22 nt, Human
agguaugagauaaaucaaugaa

SEQ ID NO: 334859 - RNA, 22 nt, Human
cuuucauaaaggaaaugaugag

SEQ ID NO: 334860 - RNA, 22 nt, Human
uguaugaaccuuuaauauagug

SEQ ID NO: 334861 - RNA, 22 nt, Human
aaaguguugauaugugacaucc

SEQ ID NO: 334862 - RNA, 22 nt, Human
uuuagacauggcuugcucacuu

SEQ ID NO: 334863 - RNA, 22 nt, Human
auguaugagagauucuuuuauu

SEQ ID NO: 334864 - RNA, 22 nt, Human
uuuuucuugugcuggaucuaau

SEQ ID NO: 334865 - RNA, 22 nt, Human
auaugugaaguggguuauuuug

SEQ ID NO: 334866 - RNA, 22 nt, Human
uguuuauuacaguucuuggaau

SEQ ID NO: 334867 - RNA, 22 nt, Human
ugaccuuauuugaaaauagaga

SEQ ID NO: 334868 - RNA, 22 nt, Human
aaguauuucguucugaaaaagu

SEQ ID NO: 334869 - RNA, 22 nt, Human
aguaugaagauuauaauuuuuc

SEQ ID NO: 334870 - RNA, 21 nt, Human
gaauaguucuguggcagcagu

SEQ ID NO: 334871 - RNA, 22 nt, Human
uaacacauagauauuuuaacuu

SEQ ID NO: 334872 - RNA, 22 nt, Human
ugugugaaggaauauauacuca

SEQ ID NO: 334873 - RNA, 22 nt, Human
uaacacauauuucaagaguagu

SEQ ID NO: 334874 - RNA, 22 nt, Human
aaguuucaaauguugauuaugc

SEQ ID NO: 334875 - RNA, 22 nt, Human
gucaaaaaguagucauuucugu

SEQ ID NO: 334876 - RNA, 17 nt, Human
uuuagaauacaauguuu

SEQ ID NO: 334877 - RNA, 22 nt, Human
auucugucuuuuuaaaauaaua

SEQ ID NO: 334878 - RNA, 22 nt, Human
aucuagcaguguuauaauugga

SEQ ID NO: 334879 - RNA, 22 nt, Human
aaacacaucauucaugucguca

SEQ ID NO: 334880 - RNA, 22 nt, Human
uucacauugugcagauuauggu

SEQ ID NO: 334881 - RNA, 22 nt, Human
guuguuuuuguucucuauagcu

SEQ ID NO: 334882 - RNA, 22 nt, Human
ugacaaaacugcaauuacuuuu

SEQ ID NO: 334883 - RNA, 22 nt, Human
ugugaaaagggcuuuguacaaa

SEQ ID NO: 334884 - RNA, 22 nt, Human
caugaaauugcuccuuuggugc

SEQ ID NO: 334885 - RNA, 22 nt, Human
auaucauucugauguauaucuu

SEQ ID NO: 334886 - RNA, 22 nt, Human
ucagaaagaacacaggcaguag

SEQ ID NO: 334887 - RNA, 22 nt, Human
augcuacauuuugguuuauaaa

SEQ ID NO: 334888 - RNA, 22 nt, Human
gauauguauugaaugaucauuu

SEQ ID NO: 334889 - RNA, 22 nt, Human
agauaugugcgucuuagauuga

SEQ ID NO: 334890 - RNA, 22 nt, Human
ucaaaguuacuugugguuuucu

SEQ ID NO: 334891 - RNA, 22 nt, Human
cucugaaagaguuuaguauuau

SEQ ID NO: 334892 - RNA, 22 nt, Human
gguauaaaugaucagaucgcug

SEQ ID NO: 334893 - RNA, 22 nt, Human
uauguacaugauuucauuugcu

SEQ ID NO: 334894 - RNA, 22 nt, Human
uggaaauauacaaugugucucu

SEQ ID NO: 334895 - RNA, 22 nt, Human
uugugaaacauucauggauuug

SEQ ID NO: 334896 - RNA, 22 nt, Human
uuuuacuuaauucuuggucaug

SEQ ID NO: 334897 - RNA, 20 nt, Human
auaaaauaacugccacaaga

SEQ ID NO: 334898 - RNA, 22 nt, Human
uaggaaaugcuccauugcauaa

SEQ ID NO: 334899 - RNA, 22 nt, Human
aaaaguauuuauggcuauguaa

SEQ ID NO: 334900 - RNA, 17 nt, Human
agguauaaaaugguagc

SEQ ID NO: 334901 - RNA, 22 nt, Human
augacacuuggugauacuuugu

SEQ ID NO: 334902 - RNA, 22 nt, Human
uuuuucuuaaauguggguuggc

SEQ ID NO: 334903 - RNA, 22 nt, Human
acauuuagaguucuuuacucca

SEQ ID NO: 334904 - RNA, 22 nt, Human
aucacauugccagugauuaccc

SEQ ID NO: 334905 - RNA, 22 nt, Human
auccugucaucauaguacuuga

SEQ ID NO: 334906 - RNA, 22 nt, Human
uucacacacagcuuccuauugu

SEQ ID NO: 334907 - RNA, 22 nt, Human
uuucaaacuuuacucuugaauc

SEQ ID NO: 334908 - RNA, 22 nt, Human
aaacacagggauauauauucca

SEQ ID NO: 334909 - RNA, 22 nt, Human
uagacauuucugguuauugaca

SEQ ID NO: 334910 - RNA, 22 nt, Human
aaguauuucuggccugugaaag

SEQ ID NO: 334911 - RNA, 22 nt, Human
uaugaacuguacuguacuaagc

SEQ ID NO: 334912 - RNA, 22 nt, Human
gauucacucauauuuuacguuu

SEQ ID NO: 334913 - RNA, 22 nt, Human
cauaauuuuccaugguuugcua

SEQ ID NO: 334914 - RNA, 22 nt, Human
aaauaguuacuucugcugucuu

SEQ ID NO: 334915 - RNA, 22 nt, Human
ugugaaauucuugaaaugcaca

SEQ ID NO: 334916 - RNA, 22 nt, Human
gcauaugaucacgugugucggu

SEQ ID NO: 334917 - RNA, 22 nt, Human
cucugauuuccuuauucuguca

SEQ ID NO: 334918 - RNA, 22 nt, Human
aaauauacuagaugaugaccca

SEQ ID NO: 334919 - RNA, 22 nt, Human
aaucuucagugucuaaaaagca

SEQ ID NO: 334920 - RNA, 22 nt, Human
cugcucuaacugcauuaguuuu

SEQ ID NO: 334921 - RNA, 22 nt, Human
ucugucaucucuaaaauagaaa

SEQ ID NO: 334922 - RNA, 22 nt, Human
aucauuuuuaagagacucuucu

SEQ ID NO: 334923 - RNA, 22 nt, Human
aaauacauacacuguacguggc

SEQ ID NO: 334924 - RNA, 22 nt, Human
aauaacuuaagaaauuucccca

SEQ ID NO: 334925 - RNA, 23 nt, Human
uuucacaaugagcauuacagaau

SEQ ID NO: 334926 - RNA, 22 nt, Human
aaauuucaguuggaaugagcuc

SEQ ID NO: 334927 - RNA, 22 nt, Human
uuucugaaaucucuuuugagga

SEQ ID NO: 334928 - RNA, 22 nt, Human
aaaguucuuucucuuauuuggu

SEQ ID NO: 334929 - RNA, 22 nt, Human
uaugagaaucugcaguaugcuu

SEQ ID NO: 334930 - RNA, 22 nt, Human
uagauauguguuuauuaugcug

SEQ ID NO: 334931 - RNA, 22 nt, Human
ugaaguuguuaagguugccauu

SEQ ID NO: 334932 - RNA, 23 nt, Human
uagaaugucauucaaugauaugg

SEQ ID NO: 334933 - RNA, 22 nt, Human
aauguaugugcaucauuuacau

SEQ ID NO: 334934 - RNA, 22 nt, Human
aguaugaaaguuaaucaauuua

SEQ ID NO: 334935 - RNA, 22 nt, Human
uucuugaaucacuuuagagaua

SEQ ID NO: 334936 - RNA, 22 nt, Human
aaaguuuguuauaugauaagga

SEQ ID NO: 334937 - RNA, 22 nt, Human
uagcaauagaaacauauaaagu

SEQ ID NO: 334938 - RNA, 22 nt, Human
caauaguucgguccugaaggcc

SEQ ID NO: 334939 - RNA, 22 nt, Human
auaugagaauuggaaaauauca

SEQ ID NO: 334940 - RNA, 22 nt, Human
uguauaaacuuaagcaggaacc

SEQ ID NO: 334941 - RNA, 22 nt, Human
ucaguuaacaacuauuuauuga

SEQ ID NO: 334942 - RNA, 22 nt, Human
aauaucuucuaaggauagaacu

SEQ ID NO: 334943 - RNA, 22 nt, Human
cauaauuucacugucguauggc

SEQ ID NO: 334944 - RNA, 22 nt, Human
uucugucagcgucagaaauucu

SEQ ID NO: 334945 - RNA, 22 nt, Human
uaugacauugcuuuuuagaacu

SEQ ID NO: 334946 - RNA, 22 nt, Human
aucugcuuuugagaauuuacuu

SEQ ID NO: 334947 - RNA, 22 nt, Human
aaucacaugugcucaauuuuaa

SEQ ID NO: 334948 - RNA, 22 nt, Human
uaauaguuucauaaugugcuuc

SEQ ID NO: 334949 - RNA, 22 nt, Human
agguauaagaagauuauuuaua

SEQ ID NO: 334950 - RNA, 22 nt, Human
uguuagaaguuaaucacuaauu

SEQ ID NO: 334951 - RNA, 22 nt, Human
guuuagaacacggaaauacuga

SEQ ID NO: 334952 - RNA, 20 nt, Human
uuucacaaugaacaugucuc

SEQ ID NO: 334953 - RNA, 22 nt, Human
uuucugaagauacagcuuugcu

SEQ ID NO: 334954 - RNA, 22 nt, Human
auguaaacaagguuauugucca

SEQ ID NO: 334955 - RNA, 22 nt, Human
uaugaaaugguaguaggaaggg

SEQ ID NO: 334956 - RNA, 22 nt, Human
ugcuauaaguagacauucaaca

SEQ ID NO: 334957 - RNA, 22 nt, Human
uaucuguuaugggcugaauugc

SEQ ID NO: 334958 - RNA, 22 nt, Human
uaauuucaauagcuugcauaau

SEQ ID NO: 334959 - RNA, 22 nt, Human
uuagacauguuugcuaaaauga

SEQ ID NO: 334960 - RNA, 22 nt, Human
uacauucagcaaaagaaugguu

SEQ ID NO: 334961 - RNA, 20 nt, Human
uuuuccuucugaguauguug

SEQ ID NO: 334962 - RNA, 22 nt, Human
uaugaacucuggagucugagug

SEQ ID NO: 334963 - RNA, 22 nt, Human
ucauaaaugcagugucauaaau

SEQ ID NO: 334964 - RNA, 22 nt, Human
aaucugucguaguaaaaagcag

SEQ ID NO: 334965 - RNA, 22 nt, Human
ucuuuauugcuacugguuuguc

SEQ ID NO: 334966 - RNA, 22 nt, Human
acauaugugcuuauauccauga

SEQ ID NO: 334967 - RNA, 22 nt, Human
uauguacuaacuuucauucuag

SEQ ID NO: 334968 - RNA, 22 nt, Human
aguaugaauacagauuuucucu

SEQ ID NO: 334969 - RNA, 22 nt, Human
aauguaugugauuauuccucua

SEQ ID NO: 334970 - RNA, 22 nt, Human
cagcauuuggaggagaggcuuu

SEQ ID NO: 334971 - RNA, 22 nt, Human
uaauuucacugauaugaaguca

SEQ ID NO: 334972 - RNA, 22 nt, Human
ugagaauuuuuugucaugcauu

SEQ ID NO: 334973 - RNA, 22 nt, Human
agaauccucuucaguaaauucu

SEQ ID NO: 334974 - RNA, 22 nt, Human
gugugaaagcuuguccucugua

SEQ ID NO: 334975 - RNA, 22 nt, Human
aaacacauuuuaggaaaaucua

SEQ ID NO: 334976 - RNA, 22 nt, Human
uucugucacuugcaaucaagag

SEQ ID NO: 334977 - RNA, 22 nt, Human
auaaucuuucuuuuccagauag

SEQ ID NO: 334978 - RNA, 22 nt, Human
caacacauugaagcuaugauga

SEQ ID NO: 334979 - RNA, 22 nt, Human
uguuugaaacuuugaucacuaa

SEQ ID NO: 334980 - RNA, 22 nt, Human
acuaaauacacacauuuguuca

SEQ ID NO: 334981 - RNA, 22 nt, Human
gaacacauuagucugaguuggc

SEQ ID NO: 334982 - RNA, 22 nt, Human
uaugacuuauuucaucaguucu

SEQ ID NO: 334983 - RNA, 22 nt, Human
uuucaaacauagaucugaauau

SEQ ID NO: 334984 - RNA, 20 nt, Human
aguguacagacacuagaaau

SEQ ID NO: 334985 - RNA, 22 nt, Human
ugaaacauugcacuguaugaau

SEQ ID NO: 334986 - RNA, 22 nt, Human
auuucauacuaaggcucaaaaa

SEQ ID NO: 334987 - RNA, 22 nt, Human
augugaaacugaagcauccaua

SEQ ID NO: 334988 - RNA, 22 nt, Human
gaacacauguccuccuuggauu

SEQ ID NO: 334989 - RNA, 22 nt, Human
ucaugaacaucucaaauaacca

SEQ ID NO: 334990 - RNA, 22 nt, Human
aaaaauaggucaaccguguaug

SEQ ID NO: 334991 - RNA, 22 nt, Human
uauauguaagcuauguaagagu

SEQ ID NO: 334992 - RNA, 22 nt, Human
acacauauauacauauuugugc

SEQ ID NO: 334993 - RNA, 22 nt, Human
agaauaugaugguuggagaauu

SEQ ID NO: 334994 - RNA, 22 nt, Human
aauaacuucauguaacauuuaa

SEQ ID NO: 334995 - RNA, 18 nt, Human
cauaauuuucuuucuuua

SEQ ID NO: 334996 - RNA, 22 nt, Human
aacauucaaaacccaguucagu

SEQ ID NO: 334997 - RNA, 22 nt, Human
aauguauggauucaugucugug

SEQ ID NO: 334998 - RNA, 22 nt, Human
cuguaugaacccauauacuuau

SEQ ID NO: 334999 - RNA, 22 nt, Human
gugaaacagaagcuccuggaau

SEQ ID NO: 335000 - RNA, 22 nt, Human
uuggaaauugcaagugauuugc

SEQ ID NO: 335001 - RNA, 22 nt, Human
aaaguucuggggguguuucugg

SEQ ID NO: 335002 - RNA, 22 nt, Human
gucugucaucugagauggagug

SEQ ID NO: 335003 - RNA, 22 nt, Human
gucugucacucaggggcuggag

SEQ ID NO: 335004 - RNA, 21 nt, Human
auucugucaucccagcuacuu

SEQ ID NO: 335005 - RNA, 22 nt, Human
aauguauuccucaugcaagagu

SEQ ID NO: 335006 - RNA, 22 nt, Human
uaugacauuauaaaggauuauu

SEQ ID NO: 335007 - RNA, 22 nt, Human
augaacugcaguauaaacuugg

SEQ ID NO: 335008 - RNA, 22 nt, Human
auaaaguuuaaaagucaauagu

SEQ ID NO: 335009 - RNA, 19 nt, Human
aaacacagauuucuuacca

SEQ ID NO: 335010 - RNA, 22 nt, Human
agucagugaaaacuagaauguu

SEQ ID NO: 335011 - RNA, 22 nt, Human
uaacacaugguuaguacacaau

SEQ ID NO: 335012 - RNA, 20 nt, Human
aucugcuugccuguccucgg

SEQ ID NO: 335013 - RNA, 22 nt, Human
ugucaagucucugaaugaaaug

SEQ ID NO: 335014 - RNA, 22 nt, Human
cauuuacacuucuaaccacaag

SEQ ID NO: 335015 - RNA, 22 nt, Human
uuagacauagaauauugucuag

SEQ ID NO: 335016 - RNA, 22 nt, Human
cagcauuuaaugcagugcuucc

SEQ ID NO: 335017 - RNA, 22 nt, Human
aagaauacguaucaacaauggu

SEQ ID NO: 335018 - RNA, 22 nt, Human
ucugucaaaugagcaaguaacu

SEQ ID NO: 335019 - RNA, 22 nt, Human
uuaacacagggggagacaaagu

SEQ ID NO: 335020 - RNA, 22 nt, Human
cagcauuuggugaucaucuuaa

SEQ ID NO: 335021 - RNA, 22 nt, Human
agcuagaaguacagccauauga

SEQ ID NO: 335022 - RNA, 22 nt, Human
augucaaaucaguuuuaucaga

SEQ ID NO: 335023 - RNA, 22 nt, Human
uauguacuacacuagaacauuu

SEQ ID NO: 335024 - RNA, 22 nt, Human
agcauucauugcuagaauguaa

SEQ ID NO: 335025 - RNA, 22 nt, Human
uugugaaauguuucaaaauagu

SEQ ID NO: 335026 - RNA, 22 nt, Human
cacaugcaucugucauguuugg

SEQ ID NO: 335027 - RNA, 22 nt, Human
auaacuuucuucacccuugcug

SEQ ID NO: 335028 - RNA, 22 nt, Human
aguuagaaaguaaaucauuuga

SEQ ID NO: 335029 - RNA, 22 nt, Human
aaaguuugucacuuggcuagaa

SEQ ID NO: 335030 - RNA, 22 nt, Human
aaaguugugaaaccgaacaugu

SEQ ID NO: 335031 - RNA, 22 nt, Human
aaguaugacauuuaagacaauu

SEQ ID NO: 335032 - RNA, 22 nt, Human
uuuucucuuguuaauguacuga

SEQ ID NO: 335033 - RNA, 22 nt, Human
uagaauucauguuacuguuagc

SEQ ID NO: 335034 - RNA, 22 nt, Human
uuggaaauggcuguaguuauga

SEQ ID NO: 335035 - RNA, 22 nt, Human
auguauuucuauguagugaaga

SEQ ID NO: 335036 - RNA, 22 nt, Human
ucuucauauauaaaguggaaua

SEQ ID NO: 335037 - RNA, 22 nt, Human
uacacacaugcauuugccuuau

SEQ ID NO: 335038 - RNA, 22 nt, Human
aauguaugacaguucuaguggu

SEQ ID NO: 335039 - RNA, 22 nt, Human
augacucuuagcuaaagguaag

SEQ ID NO: 335040 - RNA, 22 nt, Human
cauucacaaagcugauugaugg

SEQ ID NO: 335041 - RNA, 22 nt, Human
aaguuucaugauguaauuauug

SEQ ID NO: 335042 - RNA, 22 nt, Human
ugagaauuuucaguuucacuuu

SEQ ID NO: 335043 - RNA, 22 nt, Human
uuugauaagagcugcugaaacu

SEQ ID NO: 335044 - RNA, 22 nt, Human
acaagauagcuuagaagauuca

SEQ ID NO: 335045 - RNA, 22 nt, Human
gaaacaauuuuuguugucuaag

SEQ ID NO: 335046 - RNA, 22 nt, Human
uaaaguuuggcagacaauaaca

SEQ ID NO: 335047 - RNA, 22 nt, Human
aguaugaauugcuuugccugua

SEQ ID NO: 335048 - RNA, 22 nt, Human
auguagaaauuaggaugauagu

SEQ ID NO: 335049 - RNA, 23 nt, Human
acagaaaguucugcuggacagag

SEQ ID NO: 335050 - RNA, 22 nt, Human
uagcuagaaugcuucgugauau

SEQ ID NO: 335051 - RNA, 22 nt, Human
auguuagaaucucugaaugugg

SEQ ID NO: 335052 - RNA, 22 nt, Human
ucaauauauuccauguuuucuc

SEQ ID NO: 335053 - RNA, 22 nt, Human
acuucacagauauuuauuuggu

SEQ ID NO: 335054 - RNA, 22 nt, Human
acaaaguuugugguauuccaag

SEQ ID NO: 335055 - RNA, 22 nt, Human
aagauauagauaaaacuaugca

SEQ ID NO: 335056 - RNA, 22 nt, Human
agaauaugaucggaauacagau

SEQ ID NO: 335057 - RNA, 22 nt, Human
auucacaguuuccucauauucu

SEQ ID NO: 335058 - RNA, 22 nt, Human
uguaugaaugggaaaaggaaac

SEQ ID NO: 335059 - RNA, 22 nt, Human
uugaauuagacuuugcuacagg

SEQ ID NO: 335060 - RNA, 22 nt, Human
ugaaaucaaugucuucugucuc

SEQ ID NO: 335061 - RNA, 22 nt, Human
aaguaugaaucaaagacuaucu

SEQ ID NO: 335062 - RNA, 22 nt, Human
auguagaacagguuaaugacag

SEQ ID NO: 335063 - RNA, 20 nt, Human
uaacuuucuaugcuuucagc

SEQ ID NO: 335064 - RNA, 22 nt, Human
aaaguuugaaugauauauuagu

SEQ ID NO: 335065 - RNA, 22 nt, Human
uuucauugucuacauaugacau

SEQ ID NO: 335066 - RNA, 22 nt, Human
auguuugacugaguuuggcaga

SEQ ID NO: 335067 - RNA, 22 nt, Human
auuugcuuuuacuauguuaaaa

SEQ ID NO: 335068 - RNA, 22 nt, Human
aguucacauaucuguuuuauuu

SEQ ID NO: 335069 - RNA, 22 nt, Human
gaaaacuauuggccuagaacaa

SEQ ID NO: 335070 - RNA, 22 nt, Human
aucugucaagauagacucugca

SEQ ID NO: 335071 - RNA, 22 nt, Human
aauaacuucaguucuuacauua

SEQ ID NO: 335072 - RNA, 22 nt, Human
gaaacauacgauuuaggagaaa

SEQ ID NO: 335073 - RNA, 22 nt, Human
cucugucaggcugcagaugcuc

SEQ ID NO: 335074 - RNA, 22 nt, Human
uauucacaguugauuuacaguu

SEQ ID NO: 335075 - RNA, 22 nt, Human
aaucacuuuucucuaauguagc

SEQ ID NO: 335076 - RNA, 22 nt, Human
uagaacauaagucauucauuug

SEQ ID NO: 335077 - RNA, 22 nt, Human
aaucuucauuuugacaagauuc

SEQ ID NO: 335078 - RNA, 22 nt, Human
cuaucauuuuacaugguuggug

SEQ ID NO: 335079 - RNA, 22 nt, Human
gaaacuuacuuacucacauuuc

SEQ ID NO: 335080 - RNA, 22 nt, Human
uuguaugaauguauccuaauuu

SEQ ID NO: 335081 - RNA, 22 nt, Human
gagcauuuuugucugcauuuua

SEQ ID NO: 335082 - RNA, 22 nt, Human
aaauauguaagauuagcacuag

SEQ ID NO: 335083 - RNA, 22 nt, Human
agucuacaaucuuaaaugaacu

SEQ ID NO: 335084 - RNA, 22 nt, Human
uaacacaugguucugucaggaa

SEQ ID NO: 335085 - RNA, 22 nt, Human
auuuuccucaagccucuggaag

SEQ ID NO: 335086 - RNA, 22 nt, Human
uguuugaacugaauaacauagu

SEQ ID NO: 335087 - RNA, 22 nt, Human
uaacacaugaaagcaccuucuu

SEQ ID NO: 335088 - RNA, 22 nt, Human
uucugucaaagacuuuuucagg

SEQ ID NO: 335089 - RNA, 22 nt, Human
uguaugaagccagaaucuguuu

SEQ ID NO: 335090 - RNA, 22 nt, Human
aauguauguguauaucaaauca

SEQ ID NO: 335091 - RNA, 18 nt, Human
acacugcagcagucugcu

SEQ ID NO: 335092 - RNA, 22 nt, Human
uuuucauuguuacuaugagcua

SEQ ID NO: 335093 - RNA, 22 nt, Human
ucugcucuguggcuucagcuaa

SEQ ID NO: 335094 - RNA, 22 nt, Human
uguuagaauauuguaauauucg

SEQ ID NO: 335095 - RNA, 22 nt, Human
gaaacauaguugagacacugcu

SEQ ID NO: 335096 - RNA, 22 nt, Human
uguaugaaagaacaagggcuua

SEQ ID NO: 335097 - RNA, 22 nt, Human
uaucauuguguuauuucuucca

SEQ ID NO: 335098 - RNA, 22 nt, Human
ucucaaaucaaacuuugagcuu

SEQ ID NO: 335099 - RNA, 22 nt, Human
gugauaaagacgugucauaauu

SEQ ID NO: 335100 - RNA, 22 nt, Human
uauauauucuuaaguaguguag

SEQ ID NO: 335101 - RNA, 22 nt, Human
guguauaaugcuguuuguacau

SEQ ID NO: 335102 - RNA, 22 nt, Human
uacaaaugaguuguaugaacca

SEQ ID NO: 335103 - RNA, 22 nt, Human
acuagauaauuauaaaagguag

SEQ ID NO: 335104 - RNA, 22 nt, Human
cucauuaaaggaaaucaccugc

SEQ ID NO: 335105 - RNA, 23 nt, Human
acucacaaagcaggaucauguug

SEQ ID NO: 335106 - RNA, 22 nt, Human
augcuacagcaucucucaucag

SEQ ID NO: 335107 - RNA, 22 nt, Human
uaacuuucacaucacacugacu

SEQ ID NO: 335108 - RNA, 22 nt, Human
gucugucauacggcuuauguaa

SEQ ID NO: 335109 - RNA, 22 nt, Human
uauauguaaauaagucuaaugu

SEQ ID NO: 335110 - RNA, 22 nt, Human
ugaaacuucuaauaugaauagu

SEQ ID NO: 335111 - RNA, 22 nt, Human
cacucugaugguuucuguucaa

SEQ ID NO: 335112 - RNA, 22 nt, Human
gagcauuugguuauaguaauuu

SEQ ID NO: 335113 - RNA, 22 nt, Human
uucugucacuuaggaggucaua

SEQ ID NO: 335114 - RNA, 19 nt, Human
auguaugaggucuucugcu

SEQ ID NO: 335115 - RNA, 22 nt, Human
uuucauaaccucaagcuacagu

SEQ ID NO: 335116 - RNA, 21 nt, Human
uaacacauuuugguacuuugg

SEQ ID NO: 335117 - RNA, 22 nt, Human
ugugaaaagcguguguucuagg

SEQ ID NO: 335118 - RNA, 22 nt, Human
aaaguuguucaguaagaaacuc

SEQ ID NO: 335119 - RNA, 17 nt, Human
uauauguaugccucucc

SEQ ID NO: 335120 - RNA, 22 nt, Human
uaacacauaagcugagaccaug

SEQ ID NO: 335121 - RNA, 22 nt, Human
gaaacauauuaauccagugaaa

SEQ ID NO: 335122 - RNA, 22 nt, Human
uugaauuauaagugugucuacu

SEQ ID NO: 335123 - RNA, 22 nt, Human
uauaauguuuuccauggacuga

SEQ ID NO: 335124 - RNA, 22 nt, Human
cauaauuucuguaucagcacca

SEQ ID NO: 335125 - RNA, 22 nt, Human
aguuagaauagucagauuguag

SEQ ID NO: 335126 - RNA, 22 nt, Human
uaugaacuguaacccucaccgc

SEQ ID NO: 335127 - RNA, 22 nt, Human
cauucacaucuuguuccaucac

SEQ ID NO: 335128 - RNA, 22 nt, Human
uguaugaauauguauuuucaua

SEQ ID NO: 335129 - RNA, 22 nt, Human
acaauacuuaccaauguuuuug

SEQ ID NO: 335130 - RNA, 22 nt, Human
acugcuuacccggccugacuuc

SEQ ID NO: 335131 - RNA, 22 nt, Human
aaauaguucagcuuguaaaccc

SEQ ID NO: 335132 - RNA, 22 nt, Human
aaguaugugauacauguuaauu

SEQ ID NO: 335133 - RNA, 22 nt, Human
aaauaguucagccacggugacu

SEQ ID NO: 335134 - RNA, 20 nt, Human
aauuuacucacagaaugaau

SEQ ID NO: 335135 - RNA, 22 nt, Human
acauuuagcuguacaaucuaug

SEQ ID NO: 335136 - RNA, 22 nt, Human
auguagaagugggcauuauaga

SEQ ID NO: 335137 - RNA, 22 nt, Human
aucucuguaaaccauaaauuga

SEQ ID NO: 335138 - RNA, 22 nt, Human
uuagcauuucaguacacauguu

SEQ ID NO: 335139 - RNA, 22 nt, Human
uucacaauggcaaaccauuaaa

SEQ ID NO: 335140 - RNA, 22 nt, Human
auguaugauauuuccaguauca

SEQ ID NO: 335141 - RNA, 22 nt, Human
agauauauuuaagguaauaagu

SEQ ID NO: 335142 - RNA, 22 nt, Human
gaauauuuguaauuacuguuga

SEQ ID NO: 335143 - RNA, 22 nt, Human
cuguaugaguugggaauagaau

SEQ ID NO: 335144 - RNA, 22 nt, Human
uuguauuucuccacuuucuguu

SEQ ID NO: 335145 - RNA, 22 nt, Human
acaauauuguacccagaaguuu

SEQ ID NO: 335146 - RNA, 22 nt, Human
cacacucauuagucauuucucu

SEQ ID NO: 335147 - RNA, 22 nt, Human
aucugucagccugggauuaggg

SEQ ID NO: 335148 - RNA, 22 nt, Human
uuucauaauacuguacaugaaa

SEQ ID NO: 335149 - RNA, 22 nt, Human
cauacaagcguucaauagaugu

SEQ ID NO: 335150 - RNA, 22 nt, Human
auuuugcuggucugaauuacuu

SEQ ID NO: 335151 - RNA, 22 nt, Human
aaucuuucccuauuaaaugugg

SEQ ID NO: 335152 - RNA, 22 nt, Human
cugcucuaauaucagauagacu

SEQ ID NO: 335153 - RNA, 22 nt, Human
uguauaaaccauggacagcuuu

SEQ ID NO: 335154 - RNA, 22 nt, Human
aaaguuagacagcaucauuucu

SEQ ID NO: 335155 - RNA, 22 nt, Human
aaacacauuagcccuguggaaa

SEQ ID NO: 335156 - RNA, 22 nt, Human
ucugcucugggccagcuauuaa

SEQ ID NO: 335157 - RNA, 22 nt, Human
uauggaaagcucuuuuugauug

SEQ ID NO: 335158 - RNA, 22 nt, Human
acauauuuugaaagcuuucuaa

SEQ ID NO: 335159 - RNA, 22 nt, Human
ucacauuuuauaucucugguuu

SEQ ID NO: 335160 - RNA, 22 nt, Human
uucauacaaugggauauuauga

SEQ ID NO: 335161 - RNA, 22 nt, Human
guaugaaaauuguaaaguucuu

SEQ ID NO: 335162 - RNA, 22 nt, Human
uaauuucaccguugcuagaaau

SEQ ID NO: 335163 - RNA, 22 nt, Human
aaauaguuuagcucucauuuca

SEQ ID NO: 335164 - RNA, 22 nt, Human
aucugucaucagcaccacaggu

SEQ ID NO: 335165 - RNA, 21 nt, Human
augugaaauaucaucagagca

SEQ ID NO: 335166 - RNA, 23 nt, Human
aucuguucaucugacacagauuc

SEQ ID NO: 335167 - RNA, 22 nt, Human
caucaaauaggaauauuuggca

SEQ ID NO: 335168 - RNA, 19 nt, Human
ugcuagaaauucugugacu

SEQ ID NO: 335169 - RNA, 22 nt, Human
uauucacaggcacgaaauauug

SEQ ID NO: 335170 - RNA, 22 nt, Human
acaauguaggauauguacuugu

SEQ ID NO: 335171 - RNA, 22 nt, Human
aguaugaagaauacauagauga

SEQ ID NO: 335172 - RNA, 22 nt, Human
uucugucagcugcuuugucuca

SEQ ID NO: 335173 - RNA, 22 nt, Human
uagcauuucacugaucuucacu

SEQ ID NO: 335174 - RNA, 22 nt, Human
ugaacuuagugggaauaucucu

SEQ ID NO: 335175 - RNA, 19 nt, Human
auauauguauacaaugugg

SEQ ID NO: 335176 - RNA, 22 nt, Human
agauuuauguggucacacucag

SEQ ID NO: 335177 - RNA, 22 nt, Human
agcuagaauauugaucugaaau

SEQ ID NO: 335178 - RNA, 18 nt, Human
cucugucauaagugucau

SEQ ID NO: 335179 - RNA, 22 nt, Human
uauuaaauuauggauuuaggag

SEQ ID NO: 335180 - RNA, 22 nt, Human
ugucauaacuuagugacaaauc

SEQ ID NO: 335181 - RNA, 19 nt, Human
uuuuccuucuauauguuuc

SEQ ID NO: 335182 - RNA, 22 nt, Human
ugugaaauauuuauauacucaa

SEQ ID NO: 335183 - RNA, 20 nt, Human
uggaaguucuguugcauugg

SEQ ID NO: 335184 - RNA, 22 nt, Human
uuucaugauuaacuuagugaau

SEQ ID NO: 335185 - RNA, 22 nt, Human
ucacauuuucuacuacuguacg

SEQ ID NO: 335186 - RNA, 22 nt, Human
uuaugacaggaaaaucacagaa

SEQ ID NO: 335187 - RNA, 22 nt, Human
ucuagaauuuugccauauagcu

SEQ ID NO: 335188 - RNA, 22 nt, Human
cucaaauauaagcuaaaugugg

SEQ ID NO: 335189 - RNA, 22 nt, Human
auguaugaugcuaggcucucag

SEQ ID NO: 335190 - RNA, 22 nt, Human
uaauaguuaugguugguucuca

SEQ ID NO: 335191 - RNA, 22 nt, Human
uuuucuuauggugaagcacaaa

SEQ ID NO: 335192 - RNA, 22 nt, Human
uuauuuucuccucagaaagugg

SEQ ID NO: 335193 - RNA, 19 nt, Human
acauauguggauauacaug

SEQ ID NO: 335194 - RNA, 22 nt, Human
auucugucauuucaagaaaaac

SEQ ID NO: 335195 - RNA, 21 nt, Human
uugaccaagggugcgugcucc

SEQ ID NO: 335196 - RNA, 22 nt, Human
uauaauuuggggaaaguggugu

SEQ ID NO: 335197 - RNA, 22 nt, Human
aauuacuuaagagaaacuuuga

SEQ ID NO: 335198 - RNA, 17 nt, Human
ugaauucaaucugcacu

SEQ ID NO: 335199 - RNA, 22 nt, Human
aauguaugggugagaaaguuga

SEQ ID NO: 335200 - RNA, 22 nt, Human
ucuacuauguuucuuaaauaga

SEQ ID NO: 335201 - RNA, 22 nt, Human
caugaaaucugaguauguuucc

SEQ ID NO: 335202 - RNA, 22 nt, Human
cauaauuuuuuuaagucagaac

SEQ ID NO: 335203 - RNA, 22 nt, Human
auguuugaaauuguaaguauau

SEQ ID NO: 335204 - RNA, 20 nt, Human
uaguauuugcauaaggauag

SEQ ID NO: 335205 - RNA, 22 nt, Human
agauauguuuguauauauuugu

SEQ ID NO: 335206 - RNA, 22 nt, Human
cugcucuagagagcauuaguca

SEQ ID NO: 335207 - RNA, 22 nt, Human
auuacaauaagguuuauuugua

SEQ ID NO: 335208 - RNA, 22 nt, Human
aaaguuguaauggaagaaaugc

SEQ ID NO: 335209 - RNA, 22 nt, Human
aaaguuuguugcuuacaaagaa

SEQ ID NO: 335210 - RNA, 22 nt, Human
uucugucuguaaacuucucaau

SEQ ID NO: 335211 - RNA, 22 nt, Human
uucugucucuguguuuacauua

SEQ ID NO: 335212 - RNA, 22 nt, Human
uacauaugaacuuuauaacuug

SEQ ID NO: 335213 - RNA, 22 nt, Human
uguaugaagguuuaccugcugu

SEQ ID NO: 335214 - RNA, 22 nt, Human
gaauaguucuauggcugcaggg

SEQ ID NO: 335215 - RNA, 22 nt, Human
uauggaaacuaauucauuuuuc

SEQ ID NO: 335216 - RNA, 22 nt, Human
guguaugaacgaaagaauggau

SEQ ID NO: 335217 - RNA, 22 nt, Human
acaauacuauuuucaguauccu

SEQ ID NO: 335218 - RNA, 22 nt, Human
uucuacaauaugaauaaugaag

SEQ ID NO: 335219 - RNA, 22 nt, Human
uuauuuugguaaauguuugccu

SEQ ID NO: 335220 - RNA, 22 nt, Human
uauaauuuaucaugucacaguu

SEQ ID NO: 335221 - RNA, 22 nt, Human
aucugcuuccugggcuccauga

SEQ ID NO: 335222 - RNA, 22 nt, Human
auuucauagauuguaaaucccu

SEQ ID NO: 335223 - RNA, 22 nt, Human
auguagaauuccuucuacuuug

SEQ ID NO: 335224 - RNA, 22 nt, Human
acaaucauuccguucacaacag

SEQ ID NO: 335225 - RNA, 21 nt, Human
acauucacaggauauuaucau

SEQ ID NO: 335226 - RNA, 22 nt, Human
augugaaaauccaauggcagca

SEQ ID NO: 335227 - RNA, 22 nt, Human
aguuagaauauaauuauguuaa

SEQ ID NO: 335228 - RNA, 22 nt, Human
cuuuggaauauuuuauugagaa

SEQ ID NO: 335229 - RNA, 22 nt, Human
aucucauaacucauuugaagac

SEQ ID NO: 335230 - RNA, 22 nt, Human
uuauuuacaacucuucucuucc

SEQ ID NO: 335231 - RNA, 22 nt, Human
aauucuguuacuaaugugaugu

SEQ ID NO: 335232 - RNA, 22 nt, Human
ugucaaagccugaaucacauag

SEQ ID NO: 335233 - RNA, 22 nt, Human
augaaacagugaauuagucaag

SEQ ID NO: 335234 - RNA, 20 nt, Human
ucuguacacucaucuucugc

SEQ ID NO: 335235 - RNA, 22 nt, Human
uucugucaaacucacaggccga

SEQ ID NO: 335236 - RNA, 22 nt, Human
aaaguucuaaaacucuuuguga

SEQ ID NO: 335237 - RNA, 22 nt, Human
aaugucauugguaaagauuagg

SEQ ID NO: 335238 - RNA, 22 nt, Human
ucuuugaugugguuaauuauga

SEQ ID NO: 335239 - RNA, 22 nt, Human
ugacuagaccuauaucuuuuug

SEQ ID NO: 335240 - RNA, 22 nt, Human
guuaacacaggacucucugccu

SEQ ID NO: 335241 - RNA, 22 nt, Human
aauacuauguagccaaaauaau

SEQ ID NO: 335242 - RNA, 22 nt, Human
augaacuuauuucugaacuuuu

SEQ ID NO: 335243 - RNA, 22 nt, Human
aauacuauguugugacacauga

SEQ ID NO: 335244 - RNA, 22 nt, Human
cauaauuugauaugcuugaugg

SEQ ID NO: 335245 - RNA, 22 nt, Human
uacaauauguggccuuuuguga

SEQ ID NO: 335246 - RNA, 22 nt, Human astrovirus
cccagcagacuuccauccagug

SEQ ID NO: 335247 - RNA, 22 nt, Human
uuuguuaauucuuauguuagag

SEQ ID NO: 335248 - RNA, 18 nt, Human
acugugugaauuagcucc

SEQ ID NO: 335249 - RNA, 20 nt, Human
acaggagaucugaggaaagg

SEQ ID NO: 335250 - RNA, 22 nt, Human
uuucaaaccuacuuguauguuu

SEQ ID NO: 335251 - RNA, 22 nt, Human
cuguaaauaugaagaauauaug

SEQ ID NO: 335252 - RNA, 22 nt, Human
agacccagaaagcagcugcauu

SEQ ID NO: 335253 - RNA, 22 nt, Human
ggcucagagaccugcgaucuga

SEQ ID NO: 335254 - RNA, 22 nt, Human
uaugacauugcuuuuuagaacu

SEQ ID NO: 335255 - RNA, 22 nt, Human
accaggaguagaauaucuguga

SEQ ID NO: 335256 - RNA, 22 nt, Human
uaucuaaauggaauauuccaga

SEQ ID NO: 335257 - RNA, 22 nt, Human
caaauacuggguaaguuaauuu

SEQ ID NO: 335258 - RNA, 21 nt, Human
uucuucaugaugauuaauggc

SEQ ID NO: 335259 - RNA, 22 nt, Human
gugaaggacuagcauggagggc

SEQ ID NO: 335260 - RNA, 22 nt, Human
ugaacucucucaagugacagaa

SEQ ID NO: 335261 - RNA, 22 nt, Human
cucaggaugaaagucaugguga

SEQ ID NO: 335262 - RNA, 22 nt, Human
caggcagcucgaugccuuguug

SEQ ID NO: 335263 - RNA, 22 nt, Human
ucacugcucuccaauguggagu

SEQ ID NO: 335264 - RNA, 22 nt, Human
uauaauuuggggaaaguggugu

SEQ ID NO: 335265 - RNA, 22 nt, Human
ggcagucuuaucagcauuggac

SEQ ID NO: 335266 - RNA, 22 nt, Human
gagcaccucaauuugcuauuug

SEQ ID NO: 335267 - RNA, 22 nt, Human
aacauuucagcaaauaagaaca

SEQ ID NO: 335268 - RNA, 22 nt, Human
ugaaaugauuauaugguguuug

SEQ ID NO: 335269 - RNA, 22 nt, Human
auguuugacugaguuuggcaga

SEQ ID NO: 335270 - RNA, 22 nt, Human
cccuggaggcaaagguugcagu

SEQ ID NO: 335271 - RNA, 22 nt, Human
ugacccauggucugaucauagg

SEQ ID NO: 335272 - RNA, 17 nt, Human
gaggacagggaaguagg

SEQ ID NO: 335273 - RNA, 22 nt, Human
ccagugcuaagguagccucugc

SEQ ID NO: 335274 - RNA, 22 nt, Human
auuguuaugaaaauaagauguu

SEQ ID NO: 335275 - RNA, 22 nt, Human
aauauaauuuuauuccuagagu

SEQ ID NO: 335276 - RNA, 21 nt, Human
ugaaaugagaaugcugagcac

SEQ ID NO: 335277 - RNA, 22 nt, Human
agaggcaggagguugacuugag

SEQ ID NO: 335278 - RNA, 22 nt, Human
ugcuugaaagggguuucccagu

SEQ ID NO: 335279 - RNA, 22 nt, Human
cucuucuuauggccguggcuga

SEQ ID NO: 335280 - RNA, 22 nt, Human
ucugggaaccagugcggcuggg

SEQ ID NO: 335281 - RNA, 22 nt, Human
aauacuauguagccaaaauaau

SEQ ID NO: 335282 - RNA, 22 nt, Human
uauuucagcacaugggauaggu

SEQ ID NO: 335283 - RNA, 22 nt, Human
aguggcagagguugacugcagu

SEQ ID NO: 335284 - RNA, 22 nt, Human
uugaaaguuuauggagucugca

SEQ ID NO: 335285 - RNA, 22 nt, Human
uaacacauuuuccucauacgga

SEQ ID NO: 335286 - RNA, 22 nt, Human
aucucuguaaaccauaaauuga

SEQ ID NO: 335287 - RNA, 16 nt, Human
auuuccagauuaugca

SEQ ID NO: 335288 - RNA, 21 nt, Human
cccaggaggcugagaagagca

SEQ ID NO: 335289 - RNA, 22 nt, Human
aagggagguaaagcuauuuaaa

SEQ ID NO: 335290 - RNA, 20 nt, Human
acaggggcagcacaauaaug

SEQ ID NO: 335291 - RNA, 22 nt, Human
agggacuuguguccuauguaug

SEQ ID NO: 335292 - RNA, 22 nt, Human
ugacaaaacugcaauuacuuuu

SEQ ID NO: 335293 - RNA, 22 nt, Human
ucuggcaggucaaucauucuuu

SEQ ID NO: 335294 - RNA, 22 nt, Human
uuguaauuugcaaauguauugu

SEQ ID NO: 335295 - RNA, 22 nt, Human
uucuucuucaagugcugcauuc

SEQ ID NO: 335296 - RNA, 22 nt, Human
ucucugguuauuaacuaacucc

SEQ ID NO: 335297 - RNA, 21 nt, Human
cucaggaucuuauauauuagu

SEQ ID NO: 335298 - RNA, 19 nt, Human
ugcccaggccagguugggc

SEQ ID NO: 335299 - RNA, 22 nt, Human
ucaggagaaggcaauguggaaa

SEQ ID NO: 335300 - RNA, 22 nt, Human
uaucuaaaggauuuaauuuagu

SEQ ID NO: 335301 - RNA, 22 nt, Human
caggcagcauuuacucugauga

SEQ ID NO: 335302 - RNA, 22 nt, Human
ucugcugugggucuauauuuua

SEQ ID NO: 335303 - RNA, 22 nt, Human
ucacuguugaccuggaaguggg

SEQ ID NO: 335304 - RNA, 22 nt, Human
ggaggggaacuaaucccgugac

SEQ ID NO: 335305 - RNA, 22 nt, Human
ucaggagaacuuccuucuaccc

SEQ ID NO: 335306 - RNA, 22 nt, Human
uaauuucuagggacuaaggugc

SEQ ID NO: 335307 - RNA, 22 nt, Human
uuuuauagcugaauaguauucc

SEQ ID NO: 335308 - RNA, 22 nt, Human
gauuucuucauuuguggugaau

SEQ ID NO: 335309 - RNA, 22 nt, Human
ucacaugaguauuauuuuccaa

SEQ ID NO: 335310 - RNA, 20 nt, Human
uuucugugagaaacacuguu

SEQ ID NO: 335311 - RNA, 22 nt, Human
uggaaauauacaaugugucucu

SEQ ID NO: 335312 - RNA, 22 nt, Human
cagcuggcugcaugaugccaaa

SEQ ID NO: 335313 - RNA, 22 nt, Human
ucauuuguucucauucucuacu

SEQ ID NO: 335314 - RNA, 22 nt, Human
uuagccauuuuauacaagugua

SEQ ID NO: 335315 - RNA, 22 nt, Human
augcuacagaguuugaauaugu

SEQ ID NO: 335316 - RNA, 18 nt, Human
cugcuugggagacgucag

SEQ ID NO: 335317 - RNA, 22 nt, Human
ggaggggaggauuaaugacaaa

SEQ ID NO: 335318 - RNA, 22 nt, Human
cccaggagaucuggaucucguc

SEQ ID NO: 335319 - RNA, 22 nt, Human
cccaggaaugaggggcggaggc

SEQ ID NO: 335320 - RNA, 20 nt, Human
cauuuguuagcuuucuacug

SEQ ID NO: 335321 - RNA, 22 nt, Human
uugcugugaaaccaugggaagu

SEQ ID NO: 335322 - RNA, 22 nt, Human
cagaccagcucuaugaacccaa

SEQ ID NO: 335323 - RNA, 22 nt, Human
aacuuucuuggaugucucaaca

SEQ ID NO: 335324 - RNA, 23 nt, Human
cuccccaguguccucaugcaucu

SEQ ID NO: 335325 - RNA, 22 nt, Human
uagaaacauguucuguucuguu

SEQ ID NO: 335326 - RNA, 22 nt, Human
gaggcagcgggucaggaccgug

SEQ ID NO: 335327 - RNA, 22 nt, Human
ggccaggaagggaagaucagca

SEQ ID NO: 335328 - RNA, 22 nt, Human
ggacuucuaagugccagacacu

SEQ ID NO: 335329 - RNA, 22 nt, Human
cacauuuaauccuuuauaagua

SEQ ID NO: 335330 - RNA, 22 nt, Human
uuaauuaaauucaugagcauug

SEQ ID NO: 335331 - RNA, 22 nt, Human
gugugaaagcuuguccucugua

SEQ ID NO: 335332 - RNA, 22 nt, Human
uuugaaagggaaauaaacuccu

SEQ ID NO: 335333 - RNA, 20 nt, Human
aggagggaccuggauuggcg

SEQ ID NO: 335334 - RNA, 22 nt, Human
uucuacagacuauaacugugau

SEQ ID NO: 335335 - RNA, 22 nt, Human
uauguacaugauuucauuugcu

SEQ ID NO: 335336 - RNA, 19 nt, Human
uggggcuguguuuugaccc

SEQ ID NO: 335337 - RNA, 22 nt, Human
auacauacauguaugcacauac

SEQ ID NO: 335338 - RNA, 22 nt, Human
cauucuuauauuuacucauuca

SEQ ID NO: 335339 - RNA, 22 nt, Human
ccucaggggucacugugaggag

SEQ ID NO: 335340 - RNA, 21 nt, Human
uccuuccuugagguccuuucc

SEQ ID NO: 335341 - RNA, 22 nt, Human
gaggcaguuugccaugccagga

SEQ ID NO: 335342 - RNA, 22 nt, Human
ucagugugaggucuuccacccg

SEQ ID NO: 335343 - RNA, 22 nt, Human
caggcagccugcggucugcaca

SEQ ID NO: 335344 - RNA, 22 nt, Human
cugcuucugggaugauggagua

SEQ ID NO: 335345 - RNA, 22 nt, Human
auugucuuuccacugagaaguu

SEQ ID NO: 335346 - RNA, 19 nt, Human
caggaaggggcgaaucugg

SEQ ID NO: 335347 - RNA, 22 nt, Human
uuauuacacugaaagaauugcg

SEQ ID NO: 335348 - RNA, 21 nt, Human
gcugcccaacccugcaucucc

SEQ ID NO: 335349 - RNA, 22 nt, Human
uccaggagguuuggaggaagca

SEQ ID NO: 335350 - RNA, 22 nt, Human
uccauuuucuugcucuagguaa

SEQ ID NO: 335351 - RNA, 22 nt, Human
acaaaugucuccucuuuuguua

SEQ ID NO: 335352 - RNA, 23 nt, Human
uggaggaaacacaucagaagacc

SEQ ID NO: 335353 - RNA, 19 nt, Human
ugcauaaauuauauacuuu

SEQ ID NO: 335354 - RNA, 21 nt, Human
aggcaucuaaagagaguagac

SEQ ID NO: 335355 - RNA, 22 nt, Human
aaaauuauucauggcuuuugga

SEQ ID NO: 335356 - RNA, 22 nt, Human
auuuagcaaaaaaugaugaagc

SEQ ID NO: 335357 - RNA, 22 nt, Human
gaggcagcagaacauggaagag

SEQ ID NO: 335358 - RNA, 22 nt, Human
ugugaaauucuugaaaugcaca

SEQ ID NO: 335359 - RNA, 22 nt, Human
uuaacauacaucaugaacaaug

SEQ ID NO: 335360 - RNA, 22 nt, Human
aggaaacuccccuacaucucaa

SEQ ID NO: 335361 - RNA, 22 nt, Human
auagucuuagaucagauaaagu

SEQ ID NO: 335362 - RNA, 22 nt, Human
cauuguuauagcauuacacacc

SEQ ID NO: 335363 - RNA, 22 nt, Human
ucccaggaauccguccucuaga

SEQ ID NO: 335364 - RNA, 22 nt, Human
cugcugugccucuuuucacgug

SEQ ID NO: 335365 - RNA, 22 nt, Human
cccaguuucaacuuuccagugg

SEQ ID NO: 335366 - RNA, 21 nt, Human
acaggagaccgccuggcaguc

SEQ ID NO: 335367 - RNA, 22 nt, Human
uaggagagcugaacuauugucu

SEQ ID NO: 335368 - RNA, 22 nt, Human
uuucuugaccacuauguugaua

SEQ ID NO: 335369 - RNA, 22 nt, Human
ggcagcuuucucacccaugacc

SEQ ID NO: 335370 - RNA, 22 nt, Human
auuuguugcuagcagcacugau

SEQ ID NO: 335371 - RNA, 22 nt, Human
agagggaucacccuguuucugg

SEQ ID NO: 335372 - RNA, 22 nt, Human
ggugagaggcagaggacagcuu

SEQ ID NO: 335373 - RNA, 22 nt, Human
gcaagcugcucuuauguggagg

SEQ ID NO: 335374 - RNA, 22 nt, Human
uguaugaaaaggaauagauuga

SEQ ID NO: 335375 - RNA, 22 nt, Human
cauucauuuaugaaauaucuau

SEQ ID NO: 335376 - RNA, 22 nt, Human
auuguucaaagugcuuugcaug

SEQ ID NO: 335377 - RNA, 22 nt, Human
gagucuuugguaaagucugcug

SEQ ID NO: 335378 - RNA, 18 nt, Human
cccucuugcacaaagcaa

SEQ ID NO: 335379 - RNA, 20 nt, Human
aguuauaguaucuagccaug

SEQ ID NO: 335380 - RNA, 16 nt, Human
cuuccucuucacuggc

SEQ ID NO: 335381 - RNA, 22 nt, Human
aauuuccagaccccauccacag

SEQ ID NO: 335382 - RNA, 22 nt, Human
cucuuaguaaugccaugaagca

SEQ ID NO: 335383 - RNA, 22 nt, Human
ccuccuuuccuguuuuccugag

SEQ ID NO: 335384 - RNA, 22 nt, Human
uaauaguuaugguugguucuca

SEQ ID NO: 335385 - RNA, 21 nt, Human
cccaggaguccuauuuaaaug

SEQ ID NO: 335386 - RNA, 22 nt, Human
ucaauucugguccucaggaacu

SEQ ID NO: 335387 - RNA, 22 nt, Human
agaggcagccguauuucaaagg

SEQ ID NO: 335388 - RNA, 22 nt, Human
ggaugggagcagaggacgacca

SEQ ID NO: 335389 - RNA, 22 nt, Human
agagagagggaaacugcuaaac

SEQ ID NO: 335390 - RNA, 19 nt, Human
uggagggguuugaaugugg

SEQ ID NO: 335391 - RNA, 22 nt, Human
caguugcuggaugugcagcucu

SEQ ID NO: 335392 - RNA, 23 nt, Human
cuuugccacccagagccugacag

SEQ ID NO: 335393 - RNA, 22 nt, Human
uugagaagaggcuuuguaggaa

SEQ ID NO: 335394 - RNA, 22 nt, Human
acacaaguucuaaagauugcgc

SEQ ID NO: 335395 - RNA, 22 nt, Human
gaggccagcuaguccaggaagu

SEQ ID NO: 335396 - RNA, 22 nt, Human
ugagggagagggcgaaaaugaa

SEQ ID NO: 335397 - RNA, 22 nt, Human
ucaaaguuacuugugguuuucu

SEQ ID NO: 335398 - RNA, 21 nt, Human
uucuucuuggacuguuuuggc

SEQ ID NO: 335399 - RNA, 22 nt, Human
aggcaagcugcagagaguccuu

SEQ ID NO: 335400 - RNA, 22 nt, Human
ucauuuauaaggaugcaauuaa

SEQ ID NO: 335401 - RNA, 22 nt, Human
ucauuuaauaauuuuugaguag

SEQ ID NO: 335402 - RNA, 22 nt, Human
cagcucccgccaucgggaggca

SEQ ID NO: 335403 - RNA, 22 nt, Human
agggggugucucugauuggguu

SEQ ID NO: 335404 - RNA, 22 nt, Human
gggcagcuagcccucuagccca

SEQ ID NO: 335405 - RNA, 22 nt, Human
aaaauuauggaguaucccaaag

SEQ ID NO: 335406 - RNA, 17 nt, Human
uggcagcugaaagcucu

SEQ ID NO: 335407 - RNA, 17 nt, Human
agaacuguaguagcucc

SEQ ID NO: 335408 - RNA, 22 nt, Human
agucaauucuuuucaacucaag

SEQ ID NO: 335409 - RNA, 22 nt, Human
aaggcagccuuuguuugauuga

SEQ ID NO: 335410 - RNA, 22 nt, Human
aacugcuguggccuaguacuua

SEQ ID NO: 335411 - RNA, 22 nt, Human
cuuguaauuauaauguacuguu

SEQ ID NO: 335412 - RNA, 22 nt, Human
uucucagguagugcugaugcug

SEQ ID NO: 335413 - RNA, 22 nt, Human
cagcugcuguuacugcuuauua

SEQ ID NO: 335414 - RNA, 22 nt, Human
cugcuguggccagccaggucaa

SEQ ID NO: 335415 - RNA, 22 nt, Human
agagcagcuggggcagagacca

SEQ ID NO: 335416 - RNA, 22 nt, Human
aucauucugauggucaaugcua

SEQ ID NO: 335417 - RNA, 22 nt, Human
ggaguaggaguagaacucauca

SEQ ID NO: 335418 - RNA, 22 nt, Human
agucaauuaucucuaggucauc

SEQ ID NO: 335419 - RNA, 22 nt, Human
agcagagguguuuauuauggga

SEQ ID NO: 335420 - RNA, 22 nt, Human
uuuaaauuuguguuuagagggu

SEQ ID NO: 335421 - RNA, 22 nt, Human
auguuucaaugcacuuuagccu

SEQ ID NO: 335422 - RNA, 22 nt, Human
cagcauuuagaauuugaagugu

SEQ ID NO: 335423 - RNA, 20 nt, Human
aggacagcagcugccacuug

SEQ ID NO: 335424 - RNA, 22 nt, Human
cuucagaagccugcagccuuug

SEQ ID NO: 335425 - RNA, 22 nt, Human
acucaggaaauugagauaaugg

SEQ ID NO: 335426 - RNA, 22 nt, Human
cauuucacaaauggccacauca

SEQ ID NO: 335427 - RNA, 22 nt, Human
guggcagcaaaugccuggacua

SEQ ID NO: 335428 - RNA, 22 nt, Human
uuucaggguacauggagcaaau

SEQ ID NO: 335429 - RNA, 20 nt, Human
augauuuugcacuaacuuca

SEQ ID NO: 335430 - RNA, 22 nt, Human
agggagugguuaagaaggugca

SEQ ID NO: 335431 - RNA, 22 nt, Human
cagaaauguacugacaugcagu

SEQ ID NO: 335432 - RNA, 22 nt, Human
gaggcugauucggggaacagca

SEQ ID NO: 335433 - RNA, 22 nt, Human
uaugaacuguacuguacuaagc

SEQ ID NO: 335434 - RNA, 22 nt, Human
agaaaugaaaccaaagccuaga

SEQ ID NO: 335435 - RNA, 22 nt, Human
uggcagcugagugcacccccuc

SEQ ID NO: 335436 - RNA, 22 nt, Human
uuauagaaggagcauucacuua

SEQ ID NO: 335437 - RNA, 22 nt, Human
ugaaggccagcagagugaaggc

SEQ ID NO: 335438 - RNA, 22 nt, Human
aggcagucuaguccccaggcaa

SEQ ID NO: 335439 - RNA, 22 nt, Human
uucuuaacuggaaaaugucaga

SEQ ID NO: 335440 - RNA, 22 nt, Human
uucaggaucaaguugccaguag

SEQ ID NO: 335441 - RNA, 22 nt, Human
augugaggcagcacggagauua

SEQ ID NO: 335442 - RNA, 22 nt, Human
uuucuagucucgaucucuuaau

SEQ ID NO: 335443 - RNA, 22 nt, Human
aaagauuugaguucugcuuaua

SEQ ID NO: 335444 - RNA, 22 nt, Human
auucaaguggcugcuauguuaa

SEQ ID NO: 335445 - RNA, 22 nt, Human
cagagaaaaaauccugcucuca

SEQ ID NO: 335446 - RNA, 22 nt, Human
gugcauuuaggucacaugaugu

SEQ ID NO: 335447 - RNA, 17 nt, Human
acagagcacaucaagau

SEQ ID NO: 335448 - RNA, 22 nt, Human
uauaucaccaaaaacaguucug

SEQ ID NO: 335449 - RNA, 19 nt, Human
uguguguuuauauauguau

SEQ ID NO: 335450 - RNA, 22 nt, Human
aguuuucacacucaccaaaagg

SEQ ID NO: 335451 - RNA, 22 nt, Human
uucuucuccgaggagggcuggu

SEQ ID NO: 335452 - RNA, 22 nt, Human
aagagggcagcacagguggguc

SEQ ID NO: 335453 - RNA, 22 nt, Human
uggaggaaaaaaccaggcagag

SEQ ID NO: 335454 - RNA, 22 nt, Human
uaacuuucuucauaugugaacc

SEQ ID NO: 335455 - RNA, 22 nt, Human
auucugauaucuuauucuagcu

SEQ ID NO: 335456 - RNA, 22 nt, Human
gaucuguuauaaucucuuuuau

SEQ ID NO: 335457 - RNA, 22 nt, Human
uguugagacugagggagucagc

SEQ ID NO: 335458 - RNA, 22 nt, Human
cccaggaguucgaggcuguagu

SEQ ID NO: 335459 - RNA, 22 nt, Human
cagcauuuaucuuguagcagga

SEQ ID NO: 335460 - RNA, 22 nt, Human
aauggccagcaacaggagugaa

SEQ ID NO: 335461 - RNA, 22 nt, Human
aagaagagaaaugugcugcugg

SEQ ID NO: 335462 - RNA, 22 nt, Human
caggcagccaggggaccugucc

SEQ ID NO: 335463 - RNA, 22 nt, Human
auacacauauguguguauaugu

SEQ ID NO: 335464 - RNA, 22 nt, Human
ccagaccacccuggccaugcac

SEQ ID NO: 335465 - RNA, 22 nt, Human
uuucauaauauccagagauuuu

SEQ ID NO: 335466 - RNA, 22 nt, Human
ucugucaucucuaaaauagaaa

SEQ ID NO: 335467 - RNA, 22 nt, Human
uguugauuaguguuuagacuua

SEQ ID NO: 335468 - RNA, 22 nt, Human
cuguggaauugaugcuuagugu

SEQ ID NO: 335469 - RNA, 22 nt, Human
auuuuacuacuccaauuaauga

SEQ ID NO: 335470 - RNA, 21 nt, Human
uagggcaggcauuggaagaga

SEQ ID NO: 335471 - RNA, 22 nt, Human
guggcaggagacuggaagaugg

SEQ ID NO: 335472 - RNA, 22 nt, Human
agcagaggaggauuuaguuagg

SEQ ID NO: 335473 - RNA, 22 nt, Human
gaggaacccagcugggguugcc

SEQ ID NO: 335474 - RNA, 22 nt, Human
aggcagugcugugcccugaacc

SEQ ID NO: 335475 - RNA, 22 nt, Human
ucaguagcagaaagcaaugagu

SEQ ID NO: 335476 - RNA, 22 nt, Human
uugcugaaaucuaugacauccu

SEQ ID NO: 335477 - RNA, 22 nt, Human
ucauuuguucaucugcucuucu

SEQ ID NO: 335478 - RNA, 22 nt, Human
gcccaggaucugcucagaucau

SEQ ID NO: 335479 - RNA, 22 nt, Human
auaugugaaguggguuauuuug

SEQ ID NO: 335480 - RNA, 22 nt, Human
cuuaacauccugcauuuuucuu

SEQ ID NO: 335481 - RNA, 22 nt, Human
uggcagcugucagaaugcaaau

SEQ ID NO: 335482 - RNA, 22 nt, Human
ucaggagagaaagaauacaauu

SEQ ID NO: 335483 - RNA, 22 nt, Human
uggagaggaaagugcaguuuug

SEQ ID NO: 335484 - RNA, 20 nt, Human
gaagcagcuucauguagaca

SEQ ID NO: 335485 - RNA, 22 nt, Human
uaugagaaucugcaguaugcuu

SEQ ID NO: 335486 - RNA, 22 nt, Human
cagaaccaggaacugauggaga

SEQ ID NO: 335487 - RNA, 22 nt, Human
uagugcuuuaaguuuacagaga

SEQ ID NO: 335488 - RNA, 22 nt, Human
cccuuagcuccaagggguuugg

SEQ ID NO: 335489 - RNA, 22 nt, Human
uucuccagagggcucugcagga

SEQ ID NO: 335490 - RNA, 22 nt, Human
gagaggucaucucccaucagca

SEQ ID NO: 335491 - RNA, 22 nt, Human
aaauuucaguuggaaugagcuc

SEQ ID NO: 335492 - RNA, 22 nt, Human
uucauugugaacacauucugcc

SEQ ID NO: 335493 - RNA, 22 nt, Human
gaucauuugcaggaaacauuaa

SEQ ID NO: 335494 - RNA, 22 nt, Human
agucucugcugguugugccuau

SEQ ID NO: 335495 - RNA, 22 nt, Human
gcaggagaacaaagcaagcugc

SEQ ID NO: 335496 - RNA, 22 nt, Human
gaggcagcuuggggcugugggu

SEQ ID NO: 335497 - RNA, 22 nt, Human
augaaacagugaauuagucaag

SEQ ID NO: 335498 - RNA, 22 nt, Human
cucccaggcacagggaggagcc

SEQ ID NO: 335499 - RNA, 22 nt, Human
aagacauugucauuuuauaauu

SEQ ID NO: 335500 - RNA, 22 nt, Human
uuucacaaucaaauggugaaau

SEQ ID NO: 335501 - RNA, 22 nt, Human
cagucucucagcuuucagcugu

SEQ ID NO: 335502 - RNA, 22 nt, Human
gcaucuaauccaguccagcauc

SEQ ID NO: 335503 - RNA, 22 nt, Human
aggcagcugcccucuccuuccu

SEQ ID NO: 335504 - RNA, 22 nt, Human
aggcaguggcugagaccagggg

SEQ ID NO: 335505 - RNA, 21 nt, Human
agcaccuuacagcuauaaugg

SEQ ID NO: 335506 - RNA, 22 nt, Human
uccauuuucuaaguaucacuua

SEQ ID NO: 335507 - RNA, 22 nt, Human
cagcugccccuccagggcuggg

SEQ ID NO: 335508 - RNA, 22 nt, Human
aggaugagccgcgcaagcugac

SEQ ID NO: 335509 - RNA, 17 nt, Human
agagggaaaaugcgguu

SEQ ID NO: 335510 - RNA, 22 nt, Human
acaucucaugaaugauaaauca

SEQ ID NO: 335511 - RNA, 22 nt, Human
ucuucccuaaucaccaucuuca

SEQ ID NO: 335512 - RNA, 22 nt, Human
cugugauuguuaguuccuauac

SEQ ID NO: 335513 - RNA, 19 nt, Human
cccaggaggcggagguugc

SEQ ID NO: 335514 - RNA, 22 nt, Human
cauauaaauacaacauguguua

SEQ ID NO: 335515 - RNA, 22 nt, Human
caggcagcugacugucagauau

SEQ ID NO: 335516 - RNA, 22 nt, Human
ucuacagacagagcagguggga

SEQ ID NO: 335517 - RNA, 22 nt, Human
gcagaagucagaccaucugaau

SEQ ID NO: 335518 - RNA, 22 nt, Human
aaaguuaguuucuuauaugucu

SEQ ID NO: 335519 - RNA, 22 nt, Human
aggcugcuucaauggauaagau

SEQ ID NO: 335520 - RNA, 19 nt, Human
agauggcaaaaugcaaaga

SEQ ID NO: 335521 - RNA, 21 nt, Human
ugaaugaggaggauggcauuu

SEQ ID NO: 335522 - RNA, 22 nt, Human
caucaucaaaagugacagagaa

SEQ ID NO: 335523 - RNA, 22 nt, Human
ugaaggccuaacuuccagugcu

SEQ ID NO: 335524 - RNA, 22 nt, Human
uggagucugugaugcucugggu

SEQ ID NO: 335525 - RNA, 23 nt, Human
aggauguaggauguauggcagag

SEQ ID NO: 335526 - RNA, 22 nt, Human
uuuaagauucaguaaggcaaac

SEQ ID NO: 335527 - RNA, 22 nt, Human
cccaggagcuucucucugccuc

SEQ ID NO: 335528 - RNA, 22 nt, Human
aaggcaguuaauuuggcuagaa

SEQ ID NO: 335529 - RNA, 22 nt, Human
aggaaaggccuuugcauuuggu

SEQ ID NO: 335530 - RNA, 22 nt, Human
cuuaagaugaggucaugcuaua

SEQ ID NO: 335531 - RNA, 22 nt, Human
uaauacuguauacugcaaauuu

SEQ ID NO: 335532 - RNA, 22 nt, Human
agguccagcuguugcagccucc

SEQ ID NO: 335533 - RNA, 21 nt, Human
auacacauacacauaaaugug

SEQ ID NO: 335534 - RNA, 22 nt, Human
ucaggaugaccacgagccucua

SEQ ID NO: 335535 - RNA, 22 nt, Human
uaguuaaaauaauggagauguu

SEQ ID NO: 335536 - RNA, 22 nt, Human
uuacaguuuaguccaagccaga

SEQ ID NO: 335537 - RNA, 22 nt, Human
aggagagaauguuccaggcuug

SEQ ID NO: 335538 - RNA, 22 nt, Human
cccaggauggggcugcaguuau

SEQ ID NO: 335539 - RNA, 22 nt, Human
gaaauauucuugucuuguuuuc

SEQ ID NO: 335540 - RNA, 22 nt, Human
cuugaaagauuuggccucugug

SEQ ID NO: 335541 - RNA, 22 nt, Human
uacuuucuguccuucuguuaaa

SEQ ID NO: 335542 - RNA, 22 nt, Human
ucaggagaaagccaauuagagu

SEQ ID NO: 335543 - RNA, 22 nt, Human
augcuguggaaguuccugaagc

SEQ ID NO: 335544 - RNA, 22 nt, Human
cagaccagaaggaagccgacaa

SEQ ID NO: 335545 - RNA, 22 nt, Human
uuugaauagaggccccucagaa

SEQ ID NO: 335546 - RNA, 22 nt, Human
cauacaagcguucaauagaugu

SEQ ID NO: 335547 - RNA, 22 nt, Human
uuucugaagauacagcuuugcu

SEQ ID NO: 335548 - RNA, 23 nt, Human
gccaggaguggguagacuaaugc

SEQ ID NO: 335549 - RNA, 17 nt, Human
agauggcaggaggcaga

SEQ ID NO: 335550 - RNA, 22 nt, Human
aucuucucaagcagcauccugu

SEQ ID NO: 335551 - RNA, 22 nt, Human
ggcagcuuguccuucaggagag

SEQ ID NO: 335552 - RNA, 23 nt, Human
ucucuuucaagagcuuaaugugc

SEQ ID NO: 335553 - RNA, 22 nt, Human
augugaaagagguguucagugg

SEQ ID NO: 335554 - RNA, 22 nt, Human
uucucuuuucaccaguugcuaa

SEQ ID NO: 335555 - RNA, 22 nt, Human
cauuuauuggcauguaguaggu

SEQ ID NO: 335556 - RNA, 21 nt, Human
ucauuugugaucugauuucca

SEQ ID NO: 335557 - RNA, 22 nt, Human
guccaugauucuguguaguaga

SEQ ID NO: 335558 - RNA, 22 nt, Human
ugaggcaggacugagcgggaug

SEQ ID NO: 335559 - RNA, 22 nt, Human
accaggaggcuacacuguccca

SEQ ID NO: 335560 - RNA, 22 nt, Human
aagcagaguccccuucccaugg

SEQ ID NO: 335561 - RNA, 20 nt, Human
uuucacagucccuguuuccu

SEQ ID NO: 335562 - RNA, 22 nt, Human
uuuuaucuucauuccuaucuac

SEQ ID NO: 335563 - RNA, 22 nt, Human
cuuuggcacagucucauuugau

SEQ ID NO: 335564 - RNA, 22 nt, Human
auuucagguaccugugggaucc

SEQ ID NO: 335565 - RNA, 22 nt, Human
gucuucuuguguugccugucuu

SEQ ID NO: 335566 - RNA, 22 nt, Human
aggaagcuagagccaccggacu

SEQ ID NO: 335567 - RNA, 22 nt, Human
uccauuuuagagaugaagaaac

SEQ ID NO: 335568 - RNA, 23 nt, Human
aucuguucaucugacacagauuc

SEQ ID NO: 335569 - RNA, 20 nt, Human
aagcacauuucuacaauaau

SEQ ID NO: 335570 - RNA, 22 nt, Human
uuucaacaccagagaccaugcg

SEQ ID NO: 335571 - RNA, 22 nt, Human
uuccaugagcucugaguucaca

SEQ ID NO: 335572 - RNA, 22 nt, Human
cccaggaacagcacagaacagc

SEQ ID NO: 335573 - RNA, 22 nt, Human
auuuaaaugcuuaagaggguuu

SEQ ID NO: 335574 - RNA, 22 nt, Human
uugcaggauuuuagagaugaca

SEQ ID NO: 335575 - RNA, 22 nt, Human
aggagagggguaggauuaauuu

SEQ ID NO: 335576 - RNA, 22 nt, Human
uauguacuacacuagaacauuu

SEQ ID NO: 335577 - RNA, 22 nt, Human
uugcaucuagggcaacccagag

SEQ ID NO: 335578 - RNA, 22 nt, Human
ggguggaguagaaagaugaauu

SEQ ID NO: 335579 - RNA, 22 nt, Human
uugcuagcugguguaugcauug

SEQ ID NO: 335580 - RNA, 22 nt, Human
aaaaaucuaugacugcuucucc

SEQ ID NO: 335581 - RNA, 22 nt, Human
auugaaagcauggauuuggauu

SEQ ID NO: 335582 - RNA, 18 nt, Human
aguaaagcuuauuacaug

SEQ ID NO: 335583 - RNA, 22 nt, Human
uagggaggcuacuucuuguagg

SEQ ID NO: 335584 - RNA, 22 nt, Human
uuuucaguuccaucucugcucu

SEQ ID NO: 335585 - RNA, 20 nt, Human
guaaaauauggucuuugggu

SEQ ID NO: 335586 - RNA, 22 nt, Human
aguucuuuugugaacauaugcu

SEQ ID NO: 335587 - RNA, 22 nt, Human
uucuuuucuuuaggcauugugu

SEQ ID NO: 335588 - RNA, 22 nt, Human
cugcugugcaggugccuaugau

SEQ ID NO: 335589 - RNA, 22 nt, Human
ucauuauuuuggacuggagugu

SEQ ID NO: 335590 - RNA, 22 nt, Human
cacauauuguaguucaccagga

SEQ ID NO: 335591 - RNA, 22 nt, Human
gcccaggaaaugccccguggug

SEQ ID NO: 335592 - RNA, 19 nt, Human
ucuuucauuucuagcucug

SEQ ID NO: 335593 - RNA, 22 nt, Human
ucuuugaacuuggcugaucucu

SEQ ID NO: 335594 - RNA, 22 nt, Human
uguggaaaagaauaagggagau

SEQ ID NO: 335595 - RNA, 23 nt, Human
aggucagcaggcaaggaaauggc

SEQ ID NO: 335596 - RNA, 22 nt, Human
uucaggauccccaccgcguuua

SEQ ID NO: 335597 - RNA, 22 nt, Human
gaaaggccagcucacagaugag

SEQ ID NO: 335598 - RNA, 22 nt, Human
uaggagaggugaauggcacacu

SEQ ID NO: 335599 - RNA, 22 nt, Human
cucccaggggaacuaucaagua

SEQ ID NO: 335600 - RNA, 22 nt, Human
acaauguguuuuuauacauuug

SEQ ID NO: 335601 - RNA, 22 nt, Human
ucgcugugguuucuguacaugg

SEQ ID NO: 335602 - RNA, 18 nt, Human
aagaggaggaaacccagg

SEQ ID NO: 335603 - RNA, 22 nt, Human
aguuagaauagucagauuguag

SEQ ID NO: 335604 - RNA, 22 nt, Human
ucucaggaaauaggauuugagu

SEQ ID NO: 335605 - RNA, 21 nt, Human
uuugaaagcccuauguuuuca

SEQ ID NO: 335606 - RNA, 22 nt, Human
uaauuauuaugacaacaauugc

SEQ ID NO: 335607 - RNA, 22 nt, Human
aacauucugguucuaaaaaccu

SEQ ID NO: 335608 - RNA, 23 nt, Human
uugcacauuggagcuggucuucu

SEQ ID NO: 335609 - RNA, 22 nt, Human
ccaggauggggagcagauagaa

SEQ ID NO: 335610 - RNA, 22 nt, Human
uuuggacuuagccugcagaauu

SEQ ID NO: 335611 - RNA, 22 nt, Human
uagcacauacauaauagauaga

SEQ ID NO: 335612 - RNA, 22 nt, Human
gucuucaauagagccucaauuu

SEQ ID NO: 335613 - RNA, 22 nt, Human
uugauguacagaauuguucaca

SEQ ID NO: 335614 - RNA, 22 nt, Human
cugcugugcacccaggaaggcu

SEQ ID NO: 335615 - RNA, 22 nt, Human
uauacaaugaguacauucuggg

SEQ ID NO: 335616 - RNA, 22 nt, Human
ggaggagggguuuacauuggaa

SEQ ID NO: 335617 - RNA, 22 nt, Human
cagcgucucguugugggccucg

SEQ ID NO: 335618 - RNA, 22 nt, Human
ugucuuuggaauauuuagcuga

SEQ ID NO: 335619 - RNA, 22 nt, Human
aaguuucauuguucauguaaca

SEQ ID NO: 335620 - RNA, 22 nt, Human
guuauacauauguguuaacaaa

SEQ ID NO: 335621 - RNA, 22 nt, Human
cggagaggugggggcagcaucu

SEQ ID NO: 335622 - RNA, 22 nt, Human
aagggcagaauagagaagaugg

SEQ ID NO: 335623 - RNA, 20 nt, Human
uuuacauuuugaaacaguga

SEQ ID NO: 335624 - RNA, 22 nt, Human
uggaaugacagagagucugaau

SEQ ID NO: 335625 - RNA, 22 nt, Human
augacaugaccugguagagaca

SEQ ID NO: 335626 - RNA, 22 nt, Human
gacuucuauuaauaccucuacu

SEQ ID NO: 335627 - RNA, 19 nt, Human
aaagcagaggagcaucuga

SEQ ID NO: 335628 - RNA, 22 nt, Human
gaggcagcuuaggguacugacu

SEQ ID NO: 335629 - RNA, 22 nt, Human
uacauugcuuucuaauacaucu

SEQ ID NO: 335630 - RNA, 22 nt, Human
aaauuauucucauguguuucuu

SEQ ID NO: 335631 - RNA, 22 nt, Human
gcccaggaggucaaguagcuau

SEQ ID NO: 335632 - RNA, 22 nt, Human
guucuucaucauuuuagauagg

SEQ ID NO: 335633 - RNA, 22 nt, Human
ugcacauucacuuagguauugu

SEQ ID NO: 335634 - RNA, 21 nt, Human
uugaaaguaaauucagcagcu

SEQ ID NO: 335635 - RNA, 22 nt, Human
uuuccagagcaugucugcucag

SEQ ID NO: 335636 - RNA, 22 nt, Human
cuuuccaagaaugcagauaccu

SEQ ID NO: 335637 - RNA, 22 nt, Human
uaggcagcugcaaacuucgguc

SEQ ID NO: 335638 - RNA, 22 nt, Human
uauugaugcuuggauugggcca

SEQ ID NO: 335639 - RNA, 22 nt, Human
ucauacaauucaaucucugauu

SEQ ID NO: 335640 - RNA, 22 nt, Human
augcugugucaccuuaggauuu

SEQ ID NO: 335641 - RNA, 22 nt, Human
acauguaaaaggaacaugcaug

SEQ ID NO: 335642 - RNA, 22 nt, Human
gcugcccaggagagguggggcu

SEQ ID NO: 335643 - RNA, 22 nt, Human
gcccaggaugguguguaguggu

SEQ ID NO: 335644 - RNA, 22 nt, Human
accauuuuggguauuuucagag

SEQ ID NO: 335645 - RNA, 17 nt, Human
guccuacccauggucua

SEQ ID NO: 335646 - RNA, 22 nt, Human
auuucauugaaguuaauucuuc

SEQ ID NO: 335647 - RNA, 22 nt, Human
aauauuuguuaguguuuuaaug

SEQ ID NO: 335648 - RNA, 22 nt, Human
uccaggagagguagaggguucc

SEQ ID NO: 335649 - RNA, 22 nt, Human
uuuggaaugguaccuucaguug

SEQ ID NO: 335650 - RNA, 22 nt, Human
guaugaaaauuguaaaguucuu

SEQ ID NO: 335651 - RNA, 22 nt, Human
cacaugaguccugccagguaug

SEQ ID NO: 335652 - RNA, 22 nt, Human
ucaaucacguguuccauguucu

SEQ ID NO: 335653 - RNA, 22 nt, Human
cuugaaagucagcagaguggau

SEQ ID NO: 335654 - RNA, 22 nt, Human
augcuguguauuuuacucuuuc

SEQ ID NO: 335655 - RNA, 23 nt, Human
uucauuugucuacuucacuuguu

SEQ ID NO: 335656 - RNA, 22 nt, Human
aguucucagcuuaguaugcugu

SEQ ID NO: 335657 - RNA, 22 nt, Human
gcuuugaagacuuuuccagggu

SEQ ID NO: 335658 - RNA, 22 nt, Human
ggagaggacauggcucccacag

SEQ ID NO: 335659 - RNA, 17 nt, Human
uuugaaaggaugucagu

SEQ ID NO: 335660 - RNA, 22 nt, Human
gaggccaaguuggagaccaggu

SEQ ID NO: 335661 - RNA, 22 nt, Human
caggagaggcuguacguuucuc

SEQ ID NO: 335662 - RNA, 22 nt, Human
agcaccugccugcauuggcuau

SEQ ID NO: 335663 - RNA, 22 nt, Human
cacaaugugguuugucaucuuu

SEQ ID NO: 335664 - RNA, 22 nt, Human
aagggcagccugacucacgguc

SEQ ID NO: 335665 - RNA, 22 nt, Human
cuugcaggccuuucuagcucua

SEQ ID NO: 335666 - RNA, 22 nt, Human
cauuuguagcuauuuacuguau

SEQ ID NO: 335667 - RNA, 22 nt, Human
aggagcagaauuuaaugugcag

SEQ ID NO: 335668 - RNA, 22 nt, Human
uguucucacuggaugcuucaca

SEQ ID NO: 335669 - RNA, 22 nt, Human
gugacaguggucacuuguaguu

SEQ ID NO: 335670 - RNA, 22 nt, Human
uccaggaguuugagacugcagu

SEQ ID NO: 335671 - RNA, 22 nt, Human
ugugaacuggcagguggacggg

SEQ ID NO: 335672 - RNA, 22 nt, Human
uucaggauggaguaccuuuuau

SEQ ID NO: 335673 - RNA, 22 nt, Human
cagcuggcuggucagugcacaa

SEQ ID NO: 335674 - RNA, 22 nt, Human
uugcuuugccaccagaagucua

SEQ ID NO: 335675 - RNA, 22 nt, Human
ucagauggcacacagagccugc

SEQ ID NO: 335676 - RNA, 22 nt, Human
cucugcauuuuaacagaugauu

SEQ ID NO: 335677 - RNA, 22 nt, Human
uaugccugauaacugugucucu

SEQ ID NO: 335678 - RNA, 22 nt, Human
gcauguguggaggagaugugcu

SEQ ID NO: 335679 - RNA, 22 nt, Human
caguugccuacuacauggcagg

SEQ ID NO: 335680 - RNA, 22 nt, Human
uugcaaaggggaauaaagcaau

SEQ ID NO: 335681 - RNA, 22 nt, Human
cccaggaggccaagguugcagu

SEQ ID NO: 335682 - RNA, 22 nt, Human
cacagucacauaucuaugugug

SEQ ID NO: 335683 - RNA, 22 nt, Human
aggcagugcucaagacagcagc

SEQ ID NO: 335684 - RNA, 19 nt, Human
uucauucuuucuacuuacc

SEQ ID NO: 335685 - RNA, 22 nt, Human
acuauaaaaggauaaaccagaa

SEQ ID NO: 335686 - RNA, 22 nt, Human
gaggccaggacaugaaagcuga

SEQ ID NO: 335687 - RNA, 18 nt, Human
cauaauuuucuuucuuua

SEQ ID NO: 335688 - RNA, 22 nt, Human
gcucaggaaaacagucuaguaa

SEQ ID NO: 335689 - RNA, 22 nt, Human
aaggcagcaugaaucccuguac

SEQ ID NO: 335690 - RNA, 22 nt, Human
gcagcugccccgacugugaguc

SEQ ID NO: 335691 - RNA, 22 nt, Human
ucugucaaaugagcaaguaacu

SEQ ID NO: 335692 - RNA, 22 nt, Human
uagggcagaguccaggaugggc

SEQ ID NO: 335693 - RNA, 22 nt, Human
cugccaggcagggagauggcug

SEQ ID NO: 335694 - RNA, 22 nt, Human
gaggaaccaaucugugauauuc

SEQ ID NO: 335695 - RNA, 22 nt, Human
cugccaucugagccaaaagugc

SEQ ID NO: 335696 - RNA, 22 nt, Human
aggccagcucuacccuuggacu

SEQ ID NO: 335697 - RNA, 22 nt, Human
gggcagcucucacagcagccaa

SEQ ID NO: 335698 - RNA, 22 nt, Human
gugagggguggcugagcaguuu

SEQ ID NO: 335699 - RNA, 22 nt, Human
agggugguucuuuuaguggaag

SEQ ID NO: 335700 - RNA, 22 nt, Human
uuugcagucaaauuugcuaaau

SEQ ID NO: 335701 - RNA, 22 nt, Human
uugcuguguaacuccuggccug

SEQ ID NO: 335702 - RNA, 22 nt, Human
ccaggagauaagcugaguuuau

SEQ ID NO: 335703 - RNA, 22 nt, Human
aaguguagauuauggagugucu

SEQ ID NO: 335704 - RNA, 22 nt, Human
aauguaugaagguuccaguuuc

SEQ ID NO: 335705 - RNA, 16 nt, Human
uucugucacguacggc

SEQ ID NO: 335706 - RNA, 22 nt, Human
cagggagggaggaaaauuugcu

SEQ ID NO: 335707 - RNA, 22 nt, Human
aaaguauuugugauuuuuacca

SEQ ID NO: 335708 - RNA, 22 nt, Human
ucacauuucugauuauaccaaa

SEQ ID NO: 335709 - RNA, 22 nt, Human
uuccucagcuggccugauuggg

SEQ ID NO: 335710 - RNA, 22 nt, Human
uuuuuggguccaggcuguaucu

SEQ ID NO: 335711 - RNA, 22 nt, Human
uaucauuguguuauuucuucca

SEQ ID NO: 335712 - RNA, 22 nt, Human
uacuaaauaguuuaauuccuca

SEQ ID NO: 335713 - RNA, 22 nt, Human
caaaucuauauguugauauucu

SEQ ID NO: 335714 - RNA, 22 nt, Human
accaggagaggcacuugcaaug

SEQ ID NO: 335715 - RNA, 22 nt, Human
uuugcagugucagcuucugugu

SEQ ID NO: 335716 - RNA, 22 nt, Human
gggcagcucuuugguauccuuc

SEQ ID NO: 335717 - RNA, 22 nt, Human
gcaggagacaacuguaaggaga

SEQ ID NO: 335718 - RNA, 22 nt, Human
uuucaaaguugggaauuguaau

SEQ ID NO: 335719 - RNA, 22 nt, Human
aggcagcuuucuggugcaccau

SEQ ID NO: 335720 - RNA, 22 nt, Human
ggcaggcucagcagccaaggag

SEQ ID NO: 335721 - RNA, 22 nt, Human
uaauacagaaguguauuaaaau

SEQ ID NO: 335722 - RNA, 22 nt, Human
gucaggauuaaugggaguaugc

SEQ ID NO: 335723 - RNA, 22 nt, Human
uugaaaggugaacaugaugcac

SEQ ID NO: 335724 - RNA, 22 nt, Human
ucuuagaaauuccccaguggcu

SEQ ID NO: 335725 - RNA, 22 nt, Human
cccaggaugucgaggcugcagu

SEQ ID NO: 335726 - RNA, 22 nt, Human
uaggcagcauggauucugaaua

SEQ ID NO: 335727 - RNA, 20 nt, Human
cagagccaagagcagcaucu

SEQ ID NO: 335728 - RNA, 22 nt, Human
uggaguuccuuugaaaggcucu

SEQ ID NO: 335729 - RNA, 22 nt, Human
ucucuuucuauaugugagucuu

SEQ ID NO: 335730 - RNA, 22 nt, Human
uucugaaccauugagcacugcc

SEQ ID NO: 335731 - RNA, 22 nt, Human
uugcagcuuagugauguuaucu

SEQ ID NO: 335732 - RNA, 22 nt, Human
augcuacagcaucucucaucag

SEQ ID NO: 335733 - RNA, 22 nt, Human
aaauaguuagcccugcauauau

SEQ ID NO: 335734 - RNA, 22 nt, Human
agggaguuagaaauccaggaua

SEQ ID NO: 335735 - RNA, 22 nt, Human
gccaggagugucccacucauuu

SEQ ID NO: 335736 - RNA, 22 nt, Human
gaggagagccugcacuuugacc

SEQ ID NO: 335737 - RNA, 23 nt, Human
auuucuaggggauuuucuggugc

SEQ ID NO: 335738 - RNA, 22 nt, Human
ucagagaggcaauacuguuuaa

SEQ ID NO: 335739 - RNA, 22 nt, Human
cccaggcagccugcagggaagg

SEQ ID NO: 335740 - RNA, 22 nt, Human
aacaaaugaccugauuucuucc

SEQ ID NO: 335741 - RNA, 22 nt, Human
agagggagugaaauggaauaga

SEQ ID NO: 335742 - RNA, 22 nt, Human
uuuccaagagcuuauuucugaa

SEQ ID NO: 335743 - RNA, 22 nt, Human
ucucucagaggaagaggcagug

SEQ ID NO: 335744 - RNA, 22 nt, Human
uuucaguuuaugucuugaauua

SEQ ID NO: 335745 - RNA, 19 nt, Human
agaggcagucuccaacagg

SEQ ID NO: 335746 - RNA, 22 nt, Human
ugcugaugcuguucuguuagga

SEQ ID NO: 335747 - RNA, 22 nt, Human
gagcauuuuugucugcauuuua

SEQ ID NO: 335748 - RNA, 22 nt, Human
gcucucuuuuuccagugguggu

SEQ ID NO: 335749 - RNA, 22 nt, Human
ucagggugaaccaggcaggaau

SEQ ID NO: 335750 - RNA, 22 nt, Human
uguacauagaucuugaaaauua

SEQ ID NO: 335751 - RNA, 22 nt, Human
cuugcacacauguacaugugua

SEQ ID NO: 335752 - RNA, 22 nt, Human
caaggccauauugccuguaugu

SEQ ID NO: 335753 - RNA, 22 nt, Human
uuugcauaggauggacauuuua

SEQ ID NO: 335754 - RNA, 20 nt, Human
aagggcagagggaacagacu

SEQ ID NO: 335755 - RNA, 22 nt, Human
gggagcugaauggcaauggaga

SEQ ID NO: 335756 - RNA, 22 nt, Human
uacaaaugaguuguaugaacca

SEQ ID NO: 335757 - RNA, 22 nt, Human
aggcacaggaaugucauccagu

SEQ ID NO: 335758 - RNA, 22 nt, Human
augaggcaaucaugguccaguu

SEQ ID NO: 335759 - RNA, 22 nt, Human
ucuucacaggagccugccugcc

SEQ ID NO: 335760 - RNA, 22 nt, Human
uuugaaugcaggacauacagaa

SEQ ID NO: 335761 - RNA, 22 nt, Human
ucacuucacacccacuaucaug

SEQ ID NO: 335762 - RNA, 22 nt, Human
guuuuauaggcuguugcuauau

SEQ ID NO: 335763 - RNA, 22 nt, Human
uaaugucagcauaguuuauuuu

SEQ ID NO: 335764 - RNA, 22 nt, Human
agcuggcagcucucagggguac

SEQ ID NO: 335765 - RNA, 23 nt, Human
uuucuucagaagccuugcgaggc

SEQ ID NO: 335766 - RNA, 20 nt, Human
cuucuucauuaacccuacug

SEQ ID NO: 335767 - RNA, 20 nt, Human
ccagaagagaugaucaucca

SEQ ID NO: 335768 - RNA, 22 nt, Human
aauuuccaaauuucugucacac

SEQ ID NO: 335769 - RNA, 22 nt, Human
ucacaauauuuaucuuccaauu

SEQ ID NO: 335770 - RNA, 22 nt, Human
cagcugacccagugaggaggca

SEQ ID NO: 335771 - RNA, 22 nt, Human
cccaggaaaugggcucuugccu

SEQ ID NO: 335772 - RNA, 22 nt, Human
aucaggauucaccccagagcug

SEQ ID NO: 335773 - RNA, 22 nt, Human
cagugauguuucugcaucagag

SEQ ID NO: 335774 - RNA, 22 nt, Human
caggauggugugagugugagga

SEQ ID NO: 335775 - RNA, 22 nt, Human
uuucaguuuccagcuuugucau

SEQ ID NO: 335776 - RNA, 22 nt, Human
uucucuuuugugaugugagaug

SEQ ID NO: 335777 - RNA, 22 nt, Human
uuugacauuggcuuauucuguu

SEQ ID NO: 335778 - RNA, 22 nt, Human
uaaaacuuaacuauccagauua

SEQ ID NO: 335779 - RNA, 22 nt, Human
uaaugucaaggugauagauuug

SEQ ID NO: 335780 - RNA, 22 nt, Human
ccaggagagcaaaggucacucu

SEQ ID NO: 335781 - RNA, 22 nt, Human
ccaggagacccagggaaggagc

SEQ ID NO: 335782 - RNA, 22 nt, Human
ucaggagggugacaggcccugg

SEQ ID NO: 335783 - RNA, 22 nt, Human
acacauauauacauauuugugc

SEQ ID NO: 335784 - RNA, 22 nt, Human
auguagaagcugacagugcugu

SEQ ID NO: 335785 - RNA, 22 nt, Human
ugaaguuguuaagguugccauu

SEQ ID NO: 335786 - RNA, 23 nt, Human
gagugcagaauagacaugcagug

SEQ ID NO: 335787 - RNA, 22 nt, Human
auugaaagguuuugagcagaua

SEQ ID NO: 335788 - RNA, 22 nt, Human
acaguuaucuuugaaauagaga

SEQ ID NO: 335789 - RNA, 21 nt, Human
uguaaguuucaucugaauugg

SEQ ID NO: 335790 - RNA, 22 nt, Human
aauacuauguugugacacauga

SEQ ID NO: 335791 - RNA, 22 nt, Human
uaggaaaugcuccauugcauaa

SEQ ID NO: 335792 - RNA, 22 nt, Human
uaacaucuuuagcagcucgaac

SEQ ID NO: 335793 - RNA, 22 nt, Human
agugcuguuagguuaauauagu

SEQ ID NO: 335794 - RNA, 22 nt, Human
uggcagcuuuuuguuucaggcu

SEQ ID NO: 335795 - RNA, 22 nt, Human
ugccuugcacauaauauacauu

SEQ ID NO: 335796 - RNA, 22 nt, Human
gcccaggagguugggcugugca

SEQ ID NO: 335797 - RNA, 18 nt, Human
aggcagacacuagagguc

SEQ ID NO: 335798 - RNA, 22 nt, Human
uuuccucacuucaugagaguuu

SEQ ID NO: 335799 - RNA, 22 nt, Human
aaaguuuguugcuuacaaagaa

SEQ ID NO: 335800 - RNA, 21 nt, Human
ccugcugugaucuuagugagu

SEQ ID NO: 335801 - RNA, 22 nt, Human
caggcagccugagggaucuggg

SEQ ID NO: 335802 - RNA, 22 nt, Human
aaugagacacgugaagcagaug

SEQ ID NO: 335803 - RNA, 22 nt, Human
cugcugugggcaggguagcugg

SEQ ID NO: 335804 - RNA, 22 nt, Human
agggagcuaggauccugaaggu

SEQ ID NO: 335805 - RNA, 22 nt, Human
uucaguaaaacacugcaauguc

SEQ ID NO: 335806 - RNA, 22 nt, Human
aaggcaguuugggccaccaucu

SEQ ID NO: 335807 - RNA, 22 nt, Human
cagcauuuaaugcagugcuucc

SEQ ID NO: 335808 - RNA, 22 nt, Human
uuugagauggagucuugcucug

SEQ ID NO: 335809 - RNA, 22 nt, Human
gggcagcugccacuccgcuugc

SEQ ID NO: 335810 - RNA, 22 nt, Human
aaggcagcaagaauuccagguu

SEQ ID NO: 335811 - RNA, 22 nt, Human
uucuuaaaacuuauggacaggu

SEQ ID NO: 335812 - RNA, 22 nt, Human
agcaccuguugcacuucauaau

SEQ ID NO: 335813 - RNA, 22 nt, Human
gauuucuugaccccugucucag

SEQ ID NO: 335814 - RNA, 22 nt, Human
uucauucuuauuugugaucugg

SEQ ID NO: 335815 - RNA, 15 nt, Human
cuccaugauuuugca

SEQ ID NO: 335816 - RNA, 22 nt, Human
ucuuagaaguucauguuccagc

SEQ ID NO: 335817 - RNA, 22 nt, Human
cugcucuaauaucagauagacu

SEQ ID NO: 335818 - RNA, 20 nt, Human
agggcagcuugaggagccgg

SEQ ID NO: 335819 - RNA, 22 nt, Human
gccaucacauccaggcuaccuc

SEQ ID NO: 335820 - RNA, 22 nt, Human
ucucagucagccuugauguccc

SEQ ID NO: 335821 - RNA, 22 nt, Human
agaaaauauucauugagaggcu

SEQ ID NO: 335822 - RNA, 22 nt, Human
uaaauuauggcuggcagagcag

SEQ ID NO: 335823 - RNA, 22 nt, Human
aaugaaauguagcuuauccaua

SEQ ID NO: 335824 - RNA, 22 nt, Human
uguguuauugccacugaagacc

SEQ ID NO: 335825 - RNA, 22 nt, Human
gucuauauauugcuugaauaau

SEQ ID NO: 335826 - RNA, 22 nt, Human
uugagaagaaauaguuugcaau

SEQ ID NO: 335827 - RNA, 22 nt, Human
agcugcccagauaggaggaggc

SEQ ID NO: 335828 - RNA, 22 nt, Human
acugcccucccaucuauugcaa

SEQ ID NO: 335829 - RNA, 18 nt, Human
uugcuuuguaagcuugca

SEQ ID NO: 335830 - RNA, 22 nt, Human
ucuuccucuagaucugaggccc

SEQ ID NO: 335831 - RNA, 22 nt, Human
gacccaggagugcagagagugg

SEQ ID NO: 335832 - RNA, 22 nt, Human
gagggucccugcucagggccag

SEQ ID NO: 335833 - RNA, 22 nt, Human
aggcagaugggagcuggaaguu

SEQ ID NO: 335834 - RNA, 22 nt, Human
uagcauuucacugaucuucacu

SEQ ID NO: 335835 - RNA, 22 nt, Human
uggaaagucucuuuugacugua

SEQ ID NO: 335836 - RNA, 22 nt, Human
guugaaaguagaugcuauuugg

SEQ ID NO: 335837 - RNA, 22 nt, Human
cccaagagcuucuaggacgcug

SEQ ID NO: 335838 - RNA, 22 nt, Human
auucacagaauaguuuuaccag

SEQ ID NO: 335839 - RNA, 22 nt, Human
ugaggggagguuggggcacauc

SEQ ID NO: 335840 - RNA, 22 nt, Human
caggguggggaaauagcgcccu

SEQ ID NO: 335841 - RNA, 22 nt, Human
gauggcagcauauugacagcau

SEQ ID NO: 335842 - RNA, 22 nt, Human
gcagcuucaguaggugaagaca

SEQ ID NO: 335843 - RNA, 20 nt, Human
ucuguacacucaucuucugc

SEQ ID NO: 335844 - RNA, 22 nt, Human
cccaggaagaaauucugauuug

SEQ ID NO: 335845 - RNA, 22 nt, Human
agaccaugggcucugaagagca

SEQ ID NO: 335846 - RNA, 22 nt, Human
acauaccauacauggugagaug

SEQ ID NO: 335847 - RNA, 22 nt, Human
ccacagcugaccgcaggugagc

SEQ ID NO: 335848 - RNA, 22 nt, Human
ucagagagugcaaaauauagcu

SEQ ID NO: 335849 - RNA, 22 nt, Human
cagaguggcgacccccucagcu

SEQ ID NO: 335850 - RNA, 22 nt, Human
auugcuguaaauuaucuuauua

SEQ ID NO: 335851 - RNA, 22 nt, Human
ugcccaggaucuggcgaugcuc

SEQ ID NO: 335852 - RNA, 22 nt, Human
ucacccuugauaauguucuucu

SEQ ID NO: 335853 - RNA, 22 nt, Human
uuauucuucuucucuugccagg

SEQ ID NO: 335854 - RNA, 23 nt, Human
uccaggagcaugcuggcuggcga

SEQ ID NO: 335855 - RNA, 22 nt, Human
uugauuaaacaggcauauucaa

SEQ ID NO: 335856 - RNA, 21 nt, Human
gagacagcccagugccagggc

SEQ ID NO: 335857 - RNA, 22 nt, Human
agacaaaugguaauuaugucua

SEQ ID NO: 335858 - RNA, 18 nt, Human
cugcugugucgucugggc

SEQ ID NO: 335859 - RNA, 22 nt, Human
uuuugaauaauucagaaacagc

SEQ ID NO: 335860 - RNA, 22 nt, Human
cucuccucagaacaggcccucu

SEQ ID NO: 335861 - RNA, 22 nt, Human
cugcauuagucaugcuuugcag

SEQ ID NO: 335862 - RNA, 22 nt, Human
auugaaaggcaaaguaggaagc

SEQ ID NO: 335863 - RNA, 22 nt, Human
auucuucauacagacaaguccu

SEQ ID NO: 335864 - RNA, 22 nt, Human
aucauucuauuguugagcugcc

SEQ ID NO: 335865 - RNA, 22 nt, Human
aauaacuuuuaaaagacccugg

SEQ ID NO: 335866 - RNA, 22 nt, Human
auaguuugugaaacacagcagu

SEQ ID NO: 335867 - RNA, 22 nt, Human
gugcagcugugguggagccagg

SEQ ID NO: 335868 - RNA, 22 nt, Human
uaauuucaccguugcuagaaau

SEQ ID NO: 335869 - RNA, 22 nt, Human
uuugaaagcaggugugggaggg

SEQ ID NO: 335870 - RNA, 22 nt, Human
caggcagccuucucgucucaca

SEQ ID NO: 335871 - RNA, 22 nt, Human
caaaugauaccuauuacuaggc

SEQ ID NO: 335872 - RNA, 22 nt, Human
ugaggcaggaugcuugcacagg

SEQ ID NO: 335873 - RNA, 23 nt, Human
auugaugacuugauuacacuuuu

SEQ ID NO: 335874 - RNA, 22 nt, Human
uuauuuucuccucagaaagugg

SEQ ID NO: 335875 - RNA, 22 nt, Human
uucaacuaauguuuauuuuaug

SEQ ID NO: 335876 - RNA, 21 nt, Human
cucaaagaccaaaaguguaga

SEQ ID NO: 335877 - RNA, 22 nt, Human
uugaaaggguuaaagugguaaa

SEQ ID NO: 335878 - RNA, 22 nt, Human
uccaugaggaccaaauucguag

SEQ ID NO: 335879 - RNA, 22 nt, Human
uuagaacuuaaacuucagaaag

SEQ ID NO: 335880 - RNA, 22 nt, Human
acagugacguuuauuugagacg

SEQ ID NO: 335881 - RNA, 22 nt, Human
cauuuuaaaugauuuaagccaa

SEQ ID NO: 335882 - RNA, 18 nt, Human
agcuucccucugagaggg

SEQ ID NO: 335883 - RNA, 22 nt, Human
uucaacuagauuuauacaauuc

SEQ ID NO: 335884 - RNA, 22 nt, Human
uucucugagauagacuaagugg

SEQ ID NO: 335885 - RNA, 22 nt, Human
uucucagauauuuacugagcau

SEQ ID NO: 335886 - RNA, 22 nt, Human
aggacuuagaacauuauguacu

SEQ ID NO: 335887 - RNA, 22 nt, Human
gcccaggauucuuucuuccuua

SEQ ID NO: 335888 - RNA, 22 nt, Human
gcagagcuucuguccuucagga

SEQ ID NO: 335889 - RNA, 20 nt, Human
caggaugauuggacacgaug

SEQ ID NO: 335890 - RNA, 22 nt, Human
cucaucugauaaaucacucuua

SEQ ID NO: 335891 - RNA, 22 nt, Human
aggcaguggaugucaggaaugg

SEQ ID NO: 335892 - RNA, 22 nt, Human
uuagaaagcuuuccauagucaa

SEQ ID NO: 335893 - RNA, 22 nt, Human
agggagcucuaaguagagggac

SEQ ID NO: 335894 - RNA, 22 nt, Human
ugagacaguuuuucuauuucca

SEQ ID NO: 335895 - RNA, 22 nt, Human
aggcagacaaggucccuggucu

SEQ ID NO: 335896 - RNA, 22 nt, Human
aaggcagcacagcaacugcuca

SEQ ID NO: 335897 - RNA, 22 nt, Human
cagcuuucaucagugacacuca

SEQ ID NO: 335898 - RNA, 22 nt, Human
acccaggagcaggcugggcagu

SEQ ID NO: 335899 - RNA, 21 nt, Human
agcagaggcagaauguaugca

SEQ ID NO: 335900 - RNA, 20 nt, Human
agcaagaguaaggacagcga

SEQ ID NO: 335901 - RNA, 22 nt, Human
gacggcagaaacucaugagguc

SEQ ID NO: 335902 - RNA, 22 nt, Human
ccagcagaggggcggagugcag

SEQ ID NO: 335903 - RNA, 22 nt, Human
cagcaggauuugaaaggaagag

SEQ ID NO: 335904 - RNA, 22 nt, Human
aauuauguagccauaugaaaca

SEQ ID NO: 335905 - RNA, 22 nt, Human
aggaugagaagauuggaaucuu

SEQ ID NO: 335906 - RNA, 22 nt, Human
ugaaaugaaacagaacauauca

SEQ ID NO: 335907 - RNA, 22 nt, Human
cauuguuaauugguaucuuaca

SEQ ID NO: 335908 - RNA, 18 nt, Human
ugagaggcagguagagga

SEQ ID NO: 335909 - RNA, 22 nt, Human
aguuagaauauaauuauguuaa

SEQ ID NO: 335910 - RNA, 22 nt, Human
uagaaacaucagcuaaccaaaa

SEQ ID NO: 335911 - RNA, 22 nt, Human
uaaguggaagguuauaugcuaa

SEQ ID NO: 335912 - RNA, 22 nt, Human
aaauaguucagccacggugacu

SEQ ID NO: 335913 - RNA, 22 nt, Human
gugcuuucugcugcauuccucu

SEQ ID NO: 335914 - RNA, 22 nt, Human
aaaugauugucaaaguucuguu

SEQ ID NO: 335915 - RNA, 22 nt, Human
ugcuagaauuagguuaaacaaa

SEQ ID NO: 335916 - RNA, 22 nt, Human
uucuugcaggucacucacugag

SEQ ID NO: 335917 - RNA, 22 nt, Human
aaucuuagguuuggcuucaucu

SEQ ID NO: 335918 - RNA, 22 nt, Human
uuucucuguucucuaacuguaa

SEQ ID NO: 335919 - RNA, 22 nt, Human
ggaggacacuggcucugccuuc

SEQ ID NO: 335920 - RNA, 22 nt, Human
auacuguuucucuucuacauga

SEQ ID NO: 335921 - RNA, 22 nt, Human
uugcugugucugauggcugaga

SEQ ID NO: 335922 - RNA, 22 nt, Human
ucaggaugguguggaggaaaua

SEQ ID NO: 335923 - RNA, 17 nt, Human
gcugacccuggagaagu

SEQ ID NO: 335924 - RNA, 22 nt, Human
ccaggaaauagugcugugaucu

SEQ ID NO: 335925 - RNA, 23 nt, Human
uugcuuucaucaugagaugcucc

SEQ ID NO: 335926 - RNA, 22 nt, Human
ggagcagggcagugaauucugg

SEQ ID NO: 335927 - RNA, 22 nt, Human
gucaggauuggggucaugaguc

SEQ ID NO: 335928 - RNA, 22 nt, Human
acaauacuuaccaauguuuuug

SEQ ID NO: 335929 - RNA, 22 nt, Human
aggccagaaaugucagggagug

SEQ ID NO: 335930 - RNA, 22 nt, Human
gaaagauauuuauuggcaacag

SEQ ID NO: 335931 - RNA, 21 nt, Human
uucuccccagcgaauccucgg

SEQ ID NO: 335932 - RNA, 22 nt, Human
uucuucuucuggcugcaccugg

SEQ ID NO: 335933 - RNA, 22 nt, Human
uaaguucauaagcuuauucuua

SEQ ID NO: 335934 - RNA, 22 nt, Human
ucacaauuuggauacagcuaug

SEQ ID NO: 335935 - RNA, 22 nt, Human
cauugcuuccuaugucccuucu

SEQ ID NO: 335936 - RNA, 21 nt, Human
auaaaguuuuacaggaaugca

SEQ ID NO: 335937 - RNA, 22 nt, Human
uugcugaagugaagguauguuu

SEQ ID NO: 335938 - RNA, 22 nt, Human
gagaggauccacaaaccaggaa

SEQ ID NO: 335939 - RNA, 22 nt, Human
ugcuagaaaucugaaacuagca

SEQ ID NO: 335940 - RNA, 22 nt, Human
ugcugcuguuuccuacaucuca

SEQ ID NO: 335941 - RNA, 22 nt, Human
aaggagaaaugguagaugugca

SEQ ID NO: 335942 - RNA, 22 nt, Human
uucuuauagaagcaaccauugu

SEQ ID NO: 335943 - RNA, 23 nt, Human
uacaugcuauaauuucacccuca

SEQ ID NO: 335944 - RNA, 22 nt, Human
agaggcaggaagagcugauuuu

SEQ ID NO: 335945 - RNA, 22 nt, Human
uucuucaaugugcccuguuuuc

SEQ ID NO: 335946 - RNA, 22 nt, Human
aacaugcucuguuucuuggaug

SEQ ID NO: 335947 - RNA, 22 nt, Human
gcugcugucacggugcuaaggg

SEQ ID NO: 335948 - RNA, 22 nt, Human
aagaacuuccuaauauauuuuc

SEQ ID NO: 335949 - RNA, 19 nt, Human
uuucccagcccuugcugug

SEQ ID NO: 335950 - RNA, 22 nt, Human
cauuuuaagaugaccugguuuc

SEQ ID NO: 335951 - RNA, 22 nt, Human
gcuuugaagucugugucuuuug

SEQ ID NO: 335952 - RNA, 22 nt, Human
uugaauuauaagugugucuacu

SEQ ID NO: 335953 - RNA, 22 nt, Human
ggagcggagggagggccacugu

SEQ ID NO: 335954 - RNA, 22 nt, Human
agauauauuuaagguaauaagu

SEQ ID NO: 335955 - RNA, 22 nt, Human
ugaaauuaugcauuguuguacc

SEQ ID NO: 335956 - RNA, 22 nt, Human
ggugguggagccagcugggagu

SEQ ID NO: 335957 - RNA, 22 nt, Human
gagaggcaggcgcugcaauggu

SEQ ID NO: 335958 - RNA, 22 nt, Human
aguuauaugugaaaacacguau

SEQ ID NO: 335959 - RNA, 22 nt, Human
ggcagcuauuccaagcagcacu

SEQ ID NO: 335960 - RNA, 22 nt, Human
ggaaaugacuuggugcuucguu

SEQ ID NO: 335961 - RNA, 21 nt, Human
auucugucaucccagcuacuu

SEQ ID NO: 335962 - RNA, 22 nt, Human
ucucuucuaacacuagaaauuc

SEQ ID NO: 335963 - RNA, 22 nt, Human
uuuauuguuuagaagggggcug

SEQ ID NO: 335964 - RNA, 22 nt, Human
auguauuucuauguagugaaga

SEQ ID NO: 335965 - RNA, 22 nt, Human
ucugcagggaugugagggguga

SEQ ID NO: 335966 - RNA, 22 nt, Human
uuuuuuaguuaggucagaaugu

SEQ ID NO: 335967 - RNA, 22 nt, Human
caggguggcacucagcgcaucu

SEQ ID NO: 335968 - RNA, 22 nt, Human
aaaggccacuugaaggauuuuu

SEQ ID NO: 335969 - RNA, 22 nt, Human
aacaucuacuaagugccaggca

SEQ ID NO: 335970 - RNA, 22 nt, Human
cauuuguaggaugcuucuuguu

SEQ ID NO: 335971 - RNA, 22 nt, Human
acucagaagauauaaugacuca

SEQ ID NO: 335972 - RNA, 22 nt, Human
gagggcauaguuaaauaggagg

SEQ ID NO: 335973 - RNA, 16 nt, Human
aggaggggaauuagga

SEQ ID NO: 335974 - RNA, 22 nt, Human
cagcugacagugaggugggggc

SEQ ID NO: 335975 - RNA, 19 nt, Human
ugcuagaaauucugugacu

SEQ ID NO: 335976 - RNA, 22 nt, Human
ccaggaagcugucugauaugaa

SEQ ID NO: 335977 - RNA, 22 nt, Human
gcccaggagguggaggugcagu

SEQ ID NO: 335978 - RNA, 20 nt, Human
guugaaaguaauaugaugcu

SEQ ID NO: 335979 - RNA, 22 nt, Human
gaaccucagugaaacuggaggu

SEQ ID NO: 335980 - RNA, 22 nt, Human
aguggcaggcggagauguagga

SEQ ID NO: 335981 - RNA, 22 nt, Human
acaaauauuuacugaauccacu

SEQ ID NO: 335982 - RNA, 22 nt, Human
uuggaaagcaagcuggacauac

SEQ ID NO: 335983 - RNA, 22 nt, Human
uacauauguaaacauguauaaa

SEQ ID NO: 335984 - RNA, 20 nt, Human
ccacaggaguccagucgacc

SEQ ID NO: 335985 - RNA, 22 nt, Human
caggcagcgcucguggccuggc

SEQ ID NO: 335986 - RNA, 22 nt, Human
uuugaaagcuacuuucggguca

SEQ ID NO: 335987 - RNA, 22 nt, Human
uucauugucucuguuugccuuc

SEQ ID NO: 335988 - RNA, 22 nt, Human
uagcacauuguugaccagaagg

SEQ ID NO: 335989 - RNA, 22 nt, Human
acuaagugauucuaagcaucuu

SEQ ID NO: 335990 - RNA, 22 nt, Human
cuucucagaucucagcuuugag

SEQ ID NO: 335991 - RNA, 22 nt, Human
auauuguugacuauaagaguaa

SEQ ID NO: 335992 - RNA, 22 nt, Human
caaauauuccagguacaucccu

SEQ ID NO: 335993 - RNA, 22 nt, Human
caggguggcacaucacagcauu

SEQ ID NO: 335994 - RNA, 22 nt, Human
cauuuguaguaucuguuuauau

SEQ ID NO: 335995 - RNA, 22 nt, Human
ccucagaugucuuaaggcacug

SEQ ID NO: 335996 - RNA, 22 nt, Human
auauaauuguucugaaguguuu

SEQ ID NO: 335997 - RNA, 22 nt, Human
gcugcugugccuggcguccugu

SEQ ID NO: 335998 - RNA, 22 nt, Human
ugaggcagccugcauuaaagag

SEQ ID NO: 335999 - RNA, 22 nt, Human
guucuugccagcauccucaggu

SEQ ID NO: 336000 - RNA, 22 nt, Human
cccaggcagugugugcaugcgu

SEQ ID NO: 336001 - RNA, 22 nt, Human
aaggcaguagguguuucaaacu

SEQ ID NO: 336002 - RNA, 22 nt, Human
agccagcucccuccccugcagg

SEQ ID NO: 336003 - RNA, 22 nt, Human
ucaggagauguaaccuuagcug

SEQ ID NO: 336004 - RNA, 22 nt, Human
gaagcagcuggugagauggagc

SEQ ID NO: 336005 - RNA, 22 nt, Human
uuugaaaguucuucugacacua

SEQ ID NO: 336006 - RNA, 22 nt, Human
gaugccucuuuuggcugaauua

SEQ ID NO: 336007 - RNA, 22 nt, Human
gggcagcucugcccaucagagg

SEQ ID NO: 336008 - RNA, 22 nt, Human
aaauauagugacacuuauaguc

SEQ ID NO: 336009 - RNA, 22 nt, Human
acccaggaugauaauguucaca

SEQ ID NO: 336010 - RNA, 22 nt, Human
uccaggagugcugguuagagua

SEQ ID NO: 336011 - RNA, 17 nt, Human
cauuuguugaucaguug

SEQ ID NO: 336012 - RNA, 22 nt, Human
cuauuacauuucuggacauuca

SEQ ID NO: 336013 - RNA, 22 nt, Human
agcugcccugguaagauugaug

SEQ ID NO: 336014 - RNA, 22 nt, Human
auuuugaugcuaucuaaugaau

SEQ ID NO: 336015 - RNA, 22 nt, Human
auauucuuccaaaacaucauuu

SEQ ID NO: 336016 - RNA, 22 nt, Human
cccaggaguuggaggcuacggu

SEQ ID NO: 336017 - RNA, 22 nt, Human
ucacugucugaaagaaauggcc

SEQ ID NO: 336018 - RNA, 22 nt, Human
aaacacagggauauauauucca

SEQ ID NO: 336019 - RNA, 22 nt, Human
cugcuuugggcagcuuuguggc

SEQ ID NO: 336020 - RNA, 20 nt, Human
aaacauucauguacaaguga

SEQ ID NO: 336021 - RNA, 22 nt, Human
aagggaggggauguaagccugg

SEQ ID NO: 336022 - RNA, 22 nt, Human
ucucaggaagugauauugagac

SEQ ID NO: 336023 - RNA, 22 nt, Human
aggguggcaccuggaagggaug

SEQ ID NO: 336024 - RNA, 22 nt, Human
uaacaguguggacuugagaucu

SEQ ID NO: 336025 - RNA, 22 nt, Human
gcuggcuugauaguuucugcuu

SEQ ID NO: 336026 - RNA, 22 nt, Human
ugaaaugagauaauuuaagugc

SEQ ID NO: 336027 - RNA, 22 nt, Human
uucuuacagaguuuacagagcc

SEQ ID NO: 336028 - RNA, 22 nt, Human
cugcuguguuccuccugcaucu

SEQ ID NO: 336029 - RNA, 21 nt, Human
gccaggaguagauuacauuua

SEQ ID NO: 336030 - RNA, 22 nt, Human
aaauguauugcauaggauauuu

SEQ ID NO: 336031 - RNA, 22 nt, Human
aaugcauauguaggcaagcagu

SEQ ID NO: 336032 - RNA, 22 nt, Human
acccaggacacagagaugaccc

SEQ ID NO: 336033 - RNA, 22 nt, Human
uuaauuuuaaccuguuuguguc

SEQ ID NO: 336034 - RNA, 21 nt, Human
ugaggcaggggugcuuuuguc

SEQ ID NO: 336035 - RNA, 18 nt, Human
cauuguacaaugcuuuau

SEQ ID NO: 336036 - RNA, 22 nt, Human
ucaauauauuccauguuuucuc

SEQ ID NO: 336037 - RNA, 22 nt, Human
ugcuucuggaaacaguggcugu

SEQ ID NO: 336038 - RNA, 22 nt, Human
cuuucauaaaggaaaugaugag

SEQ ID NO: 336039 - RNA, 22 nt, Human
ugcccaggauugugaggucagg

SEQ ID NO: 336040 - RNA, 22 nt, Human
gaggcaguuccugagugacaag

SEQ ID NO: 336041 - RNA, 22 nt, Human
uuucaguucaguuuauuauauc

SEQ ID NO: 336042 - RNA, 22 nt, Human
uaacacauaucuacaacaugug

SEQ ID NO: 336043 - RNA, 22 nt, Human
cugcgcagggguggcgccagaa

SEQ ID NO: 336044 - RNA, 22 nt, Human
ugaggggaacugaugcccauug

SEQ ID NO: 336045 - RNA, 17 nt, Human
aggcagcucagaacauc

SEQ ID NO: 336046 - RNA, 22 nt, Human
ggauggcauguugggcucuguu

SEQ ID NO: 336047 - RNA, 22 nt, Human
gaacacauguccuccuuggauu

SEQ ID NO: 336048 - RNA, 22 nt, Human
aaguuugcauagauuaagcauu

SEQ ID NO: 336049 - RNA, 22 nt, Human
gaggcagcauucgcauagacag

SEQ ID NO: 336050 - RNA, 22 nt, Human
uuugaaagagcugauacaugaa

SEQ ID NO: 336051 - RNA, 22 nt, Human
agagggagcccagucauagcug

SEQ ID NO: 336052 - RNA, 23 nt, Human
uuccagaguccacaucugccacc

SEQ ID NO: 336053 - RNA, 22 nt, Human
uuuggaauuggaaagugcugug

SEQ ID NO: 336054 - RNA, 22 nt, Human
uguaugaagccagaaucuguuu

SEQ ID NO: 336055 - RNA, 22 nt, Human
auuuuacuuugugaauauugac

SEQ ID NO: 336056 - RNA, 22 nt, Human
ugugaaagcaagucuaguucuc

SEQ ID NO: 336057 - RNA, 22 nt, Human
uguaugaagacuucuucugugu

SEQ ID NO: 336058 - RNA, 22 nt, Human
ugucaaagccugaaucacauag

SEQ ID NO: 336059 - RNA, 22 nt, Human
gaaauaagaguccaugccaggu

SEQ ID NO: 336060 - RNA, 22 nt, Human
agaaguuguagguuugcauauu

SEQ ID NO: 336061 - RNA, 22 nt, Human
aggcagcuggaaaacuccaggc

SEQ ID NO: 336062 - RNA, 22 nt, Human
aggcagcuuucuguaggggugu

SEQ ID NO: 336063 - RNA, 19 nt, Human
auauauguauacaaugugg

SEQ ID NO: 336064 - RNA, 22 nt, Human
auggaaagugcauggaagucau

SEQ ID NO: 336065 - RNA, 22 nt, Human
uaaucuguauuccuacuuugca

SEQ ID NO: 336066 - RNA, 21 nt, Human
uucucagagucuauuacaguu

SEQ ID NO: 336067 - RNA, 21 nt, Human
uggagacucugguucuuugug

SEQ ID NO: 336068 - RNA, 22 nt, Human
agaaaugacacacaugagacau

SEQ ID NO: 336069 - RNA, 22 nt, Human
auugaaagcacaaagaacaagu

SEQ ID NO: 336070 - RNA, 21 nt, Human
ggagggcagcccagacuggcu

SEQ ID NO: 336071 - RNA, 22 nt, Human
gaagcagccacggggagacaga

SEQ ID NO: 336072 - RNA, 22 nt, Human
acacaaauuguaggauaauugc

SEQ ID NO: 336073 - RNA, 21 nt, Human
aucacauuggcuguuauuauu

SEQ ID NO: 336074 - RNA, 22 nt, Human
gaggggaaagugugaggcugcg

SEQ ID NO: 336075 - RNA, 22 nt, Human
acugauuacacgaguucugacu

SEQ ID NO: 336076 - RNA, 22 nt, Human
uuugacaucuaagaauucuuac

SEQ ID NO: 336077 - RNA, 23 nt, Human
ucuugaaaagccuacagcaguuc

SEQ ID NO: 336078 - RNA, 22 nt, Human
aguggcagagccaaguagagcc

SEQ ID NO: 336079 - RNA, 22 nt, Human
aucacuguguauguauaugcag

SEQ ID NO: 336080 - RNA, 22 nt, Human
gaggacaggagacucacuguuu

SEQ ID NO: 336081 - RNA, 22 nt, Human
ugauugaacugagcuucaagau

SEQ ID NO: 336082 - RNA, 23 nt, Human
cagcccuuccugcauguuuuugu

SEQ ID NO: 336083 - RNA, 22 nt, Human
gcagaggggaagcugaggaauu

SEQ ID NO: 336084 - RNA, 22 nt, Human
cugaacucuuuaugacagcuug

SEQ ID NO: 336085 - RNA, 22 nt, Human
uccaggaggcaccuuuggacca

SEQ ID NO: 336086 - RNA, 22 nt, Human
gcacaauuauuuaugcaguaug

SEQ ID NO: 336087 - RNA, 22 nt, Human
uuuucguuuauuugacauguaa

SEQ ID NO: 336088 - RNA, 22 nt, Human
ugaugaaauguugaggcaguga

SEQ ID NO: 336089 - RNA, 22 nt, Human
uucugucaaacucacaggccga

SEQ ID NO: 336090 - RNA, 22 nt, Human
gcccaggaagugacucagaugu

SEQ ID NO: 336091 - RNA, 22 nt, Human
uauguuauuuucauacaacaga

SEQ ID NO: 336092 - RNA, 22 nt, Human
cugcgcagcaaucagagaggag

SEQ ID NO: 336093 - RNA, 22 nt, Human
gggaggugauggcaagcagcgg

SEQ ID NO: 336094 - RNA, 22 nt, Human
uguaugaaccuuuaauauagug

SEQ ID NO: 336095 - RNA, 22 nt, Human
cucaugauguagcgaaugagaa

SEQ ID NO: 336096 - RNA, 22 nt, Human
ucugggaagcugguccuguucu

SEQ ID NO: 336097 - RNA, 22 nt, Human
ugaaaugaagggcuuguucugg

SEQ ID NO: 336098 - RNA, 22 nt, Human
uggcuucuugggaugggucauu

SEQ ID NO: 336099 - RNA, 22 nt, Human
ucaggagauggucuuuauaggc

SEQ ID NO: 336100 - RNA, 22 nt, Human
auguuauaguuauaaaaugagg

SEQ ID NO: 336101 - RNA, 22 nt, Human
ucaucugucauccacaaagcug

SEQ ID NO: 336102 - RNA, 22 nt, Human
aggagggagaugcccauccugg

SEQ ID NO: 336103 - RNA, 22 nt, Human
aaaauugaagugaucaggaacu

SEQ ID NO: 336104 - RNA, 22 nt, Human
ugcuggguuaccuaagccuaaa

SEQ ID NO: 336105 - RNA, 22 nt, Human
ucacaguaucacacaaggauua

SEQ ID NO: 336106 - RNA, 22 nt, Human
uaggaggguuagagggaaauau

SEQ ID NO: 336107 - RNA, 22 nt, Human
uuucacagguacaaacacuccu

SEQ ID NO: 336108 - RNA, 22 nt, Human
aaguauaagcuauucuucauga

SEQ ID NO: 336109 - RNA, 22 nt, Human
acagucauuagauacaaugucu

SEQ ID NO: 336110 - RNA, 22 nt, Human
gcaggagacuggcugugguagu

SEQ ID NO: 336111 - RNA, 22 nt, Human
ucauauaaguuuaaaacuaucu

SEQ ID NO: 336112 - RNA, 22 nt, Human
ugcauaguucuccuuccuccuc

SEQ ID NO: 336113 - RNA, 22 nt, Human
guaucacuuuugagagugagaa

SEQ ID NO: 336114 - RNA, 22 nt, Human
ucacaaaugaggaaaucgagca

SEQ ID NO: 336115 - RNA, 22 nt, Human
uauuuccaggccccacucuaga

SEQ ID NO: 336116 - RNA, 22 nt, Human
aggcaacuuuuggggaugaugg

SEQ ID NO: 336117 - RNA, 22 nt, Human
auuuguagugaagugaaaauaa

SEQ ID NO: 336118 - RNA, 22 nt, Human
guuguuuugcaggauccuuaca

SEQ ID NO: 336119 - RNA, 22 nt, Human
aauacaguagguaauaguucau

SEQ ID NO: 336120 - RNA, 22 nt, Human
uuucuucauucaccuucacccc

SEQ ID NO: 336121 - RNA, 22 nt, Human
ugaggggagacagaguggacuc

SEQ ID NO: 336122 - RNA, 22 nt, Human
aggcagccaaucagaggcugac

SEQ ID NO: 336123 - RNA, 22 nt, Human
aucugucaucagcaccacaggu

SEQ ID NO: 336124 - RNA, 22 nt, Human
aucuguuccccuaugcucucua

SEQ ID NO: 336125 - RNA, 22 nt, Human
aggcagucuaucucuggagccu

SEQ ID NO: 336126 - RNA, 22 nt, Human
augacacuuggugauacuuugu

SEQ ID NO: 336127 - RNA, 22 nt, Human
aauugcaacagguagacuuuuc

SEQ ID NO: 336128 - RNA, 22 nt, Human
ggagauggaauagauucugacu

SEQ ID NO: 336129 - RNA, 22 nt, Human
uucuacaugguugcucagaggg

SEQ ID NO: 336130 - RNA, 22 nt, Human
ggagcuguuggcagcuaucuug

SEQ ID NO: 336131 - RNA, 22 nt, Human
aauuuuaaucaguggugcugag

SEQ ID NO: 336132 - RNA, 22 nt, Human
cccaucacagacacuggguuau

SEQ ID NO: 336133 - RNA, 22 nt, Human
aggagaggaaucauuauuacaa

SEQ ID NO: 336134 - RNA, 19 nt, Human
agacagagcucaguggguu

SEQ ID NO: 336135 - RNA, 22 nt, Human
ucauuucuccgaccugcugucc

SEQ ID NO: 336136 - RNA, 22 nt, Human
ggaggacaggggcugcagcaca

SEQ ID NO: 336137 - RNA, 22 nt, Human
uguuguuuucucauggagaaua

SEQ ID NO: 336138 - RNA, 22 nt, Human
ucugguaaccuuuaucccuccu

SEQ ID NO: 336139 - RNA, 22 nt, Human
agugcuuucccugaaaccuucc

SEQ ID NO: 336140 - RNA, 22 nt, Human
gucacuguuuccuauuauauuu

SEQ ID NO: 336141 - RNA, 22 nt, Human
ucucauugguauauacaugugu

SEQ ID NO: 336142 - RNA, 22 nt, Human
gagagcuggguucaaguagcug

SEQ ID NO: 336143 - RNA, 23 nt, Human
cccuggaguaaauucuuggaagg

SEQ ID NO: 336144 - RNA, 22 nt, Human
cugagccagcuggcaugugcua

SEQ ID NO: 336145 - RNA, 22 nt, Human
auacagauguugaauguuauau

SEQ ID NO: 336146 - RNA, 22 nt, Human
cuugaaagcuuugcgucuucua

SEQ ID NO: 336147 - RNA, 22 nt, Human
ucaucucaaaacccaaggggca

SEQ ID NO: 336148 - RNA, 22 nt, Human
cagcuuccgaccgggggcugca

SEQ ID NO: 336149 - RNA, 22 nt, Human
cccuguacagucucuguggcac

SEQ ID NO: 336150 - RNA, 22 nt, Human
caggaugagaggcccagggaag

SEQ ID NO: 336151 - RNA, 22 nt, Human
uuugaaagacagaauauuuuug

SEQ ID NO: 336152 - RNA, 22 nt, Human
ucucaggagccacagcgggagu

SEQ ID NO: 336153 - RNA, 22 nt, Human
aguaugaauacagauuuucucu

SEQ ID NO: 336154 - RNA, 22 nt, Human
aaugucugagucucuguauccc

SEQ ID NO: 336155 - RNA, 22 nt, Human
uugcauuucccauugaguaaug

SEQ ID NO: 336156 - RNA, 18 nt, Human
ggcaucugcacagcagcc

SEQ ID NO: 336157 - RNA, 22 nt, Human
uuugaaguggaaaaggauuuaa

SEQ ID NO: 336158 - RNA, 22 nt, Human
uuggcaggaauauugcagaggu

SEQ ID NO: 336159 - RNA, 22 nt, Human
guuaacacaggacucucugccu

SEQ ID NO: 336160 - RNA, 20 nt, Human
ucucuucuggggagauaaaa

SEQ ID NO: 336161 - RNA, 22 nt, Human
caggauagaaaggccauggagu

SEQ ID NO: 336162 - RNA, 22 nt, Human
uuuguuuagaugguaaaucagu

SEQ ID NO: 336163 - RNA, 22 nt, Human
uggucuuuaagguagcugucau

SEQ ID NO: 336164 - RNA, 22 nt, Human
caggagagauaugaguccccac

SEQ ID NO: 336165 - RNA, 22 nt, Human
auuucaaggcuauuaauauaaa

SEQ ID NO: 336166 - RNA, 22 nt, Human
ugugugaaggagccacuguuca

SEQ ID NO: 336167 - RNA, 22 nt, Human
ggccagcucuuguccacggagg

SEQ ID NO: 336168 - RNA, 22 nt, Human
uccauuuucaucucauguauaa

SEQ ID NO: 336169 - RNA, 22 nt, Human
gaauaguucuauggcugcaggg

SEQ ID NO: 336170 - RNA, 20 nt, Human
aucugcuugccuguccucgg

SEQ ID NO: 336171 - RNA, 22 nt, Human
gagagggauacugaguuuuggu

SEQ ID NO: 336172 - RNA, 22 nt, Human
uggaagggagugacagucagag

SEQ ID NO: 336173 - RNA, 22 nt, Human
agucugucuacuuaaagucugu

SEQ ID NO: 336174 - RNA, 23 nt, Human
gugcugugagccccuuggccucc

SEQ ID NO: 336175 - RNA, 22 nt, Human
ucauucuuuaccaaguugucac

SEQ ID NO: 336176 - RNA, 22 nt, Human
auucuucaaagagugucaaagu

SEQ ID NO: 336177 - RNA, 22 nt, Human
gagguagccacagauagagacu

SEQ ID NO: 336178 - RNA, 23 nt, Human
uagaaugucauucaaugauaugg

SEQ ID NO: 336179 - RNA, 22 nt, Human
uaacuacauuucacugcaauua

SEQ ID NO: 336180 - RNA, 22 nt, Human
guucuucagauuccauuucagu

SEQ ID NO: 336181 - RNA, 22 nt, Human
acauuuagaguucuuuacucca

SEQ ID NO: 336182 - RNA, 22 nt, Human
cacucaggcugugucaggagga

SEQ ID NO: 336183 - RNA, 22 nt, Human
ugcuguguucuccugacucacc

SEQ ID NO: 336184 - RNA, 22 nt, Human
uugaaauggaagugaaaauucu

SEQ ID NO: 336185 - RNA, 22 nt, Human
caggaaagggaugggcugccac

SEQ ID NO: 336186 - RNA, 22 nt, Human
ggagagugggagcaacuguugc

SEQ ID NO: 336187 - RNA, 22 nt, Human
ugccuggauucgguuguuguca

SEQ ID NO: 336188 - RNA, 22 nt, Human
aaauauacuagaugaugaccca

SEQ ID NO: 336189 - RNA, 22 nt, Human
ugugauauuugaguauugucaa

SEQ ID NO: 336190 - RNA, 22 nt, Human
acagcagcuugcgugucugguc

SEQ ID NO: 336191 - RNA, 22 nt, Human
gcaggagagccagcaggcuucc

SEQ ID NO: 336192 - RNA, 22 nt, Human
uugauacaggcucuauuucauc

SEQ ID NO: 336193 - RNA, 22 nt, Human
gaggccaggaagcccaagauca

SEQ ID NO: 336194 - RNA, 22 nt, Human
aaauugcauuuuaaagguagau

SEQ ID NO: 336195 - RNA, 22 nt, Human
uuauggcauauuccucauugua

SEQ ID NO: 336196 - RNA, 22 nt, Human
aacauucuauuuugcuaaaaca

SEQ ID NO: 336197 - RNA, 22 nt, Human
uuuugcuugagugcacaaaaug

SEQ ID NO: 336198 - RNA, 22 nt, Human
uuucacaucagagguagauuag

SEQ ID NO: 336199 - RNA, 16 nt, Human
gcccaggacgggaggc

SEQ ID NO: 336200 - RNA, 22 nt, Human
caaguaaagaaucacauuucuu

SEQ ID NO: 336201 - RNA, 22 nt, Human
auguuucaccaguuuuauaaga

SEQ ID NO: 336202 - RNA, 22 nt, Human
gacagugcauuuccuggcaugg

SEQ ID NO: 336203 - RNA, 22 nt, Human
gacccaggcccaaggcugccag

SEQ ID NO: 336204 - RNA, 17 nt, Human
gagacagcaggagcccc

SEQ ID NO: 336205 - RNA, 22 nt, Human
auucuucauaccuacugagguu

SEQ ID NO: 336206 - RNA, 22 nt, Human
caggacagagcccagacugugu

SEQ ID NO: 336207 - RNA, 22 nt, Human
agcacauucugccuugcuuugc

SEQ ID NO: 336208 - RNA, 22 nt, Human
gggcagcugccccucucugggc

SEQ ID NO: 336209 - RNA, 22 nt, Human
uuauuuaaaagugguaagauuc

SEQ ID NO: 336210 - RNA, 22 nt, Human
augcugugcuggcuaaccaugg

SEQ ID NO: 336211 - RNA, 22 nt, Human
cagauggaacacagaaaggaga

SEQ ID NO: 336212 - RNA, 22 nt, Human
uuucuuauacuauauugucauc

SEQ ID NO: 336213 - RNA, 22 nt, Human
cuuugaaaggaagccacacagc

SEQ ID NO: 336214 - RNA, 22 nt, Human
acuugcauuauauuuaucacaa

SEQ ID NO: 336215 - RNA, 22 nt, Human
aggggaugauccucccgcagcg

SEQ ID NO: 336216 - RNA, 17 nt, Human
uccaugagacaugaaga

SEQ ID NO: 336217 - RNA, 22 nt, Human
agaccauggccauccuaggaaa

SEQ ID NO: 336218 - RNA, 22 nt, Human
auuuaaauuuucugauggagag

SEQ ID NO: 336219 - RNA, 22 nt, Human
aucacauugccagugauuaccc

SEQ ID NO: 336220 - RNA, 22 nt, Human
gggcagcucagccaccaugcag

SEQ ID NO: 336221 - RNA, 22 nt, Human
cucaagacugaucgcaguggaa

SEQ ID NO: 336222 - RNA, 22 nt, Human
aggaagcuuagugaaaggacca

SEQ ID NO: 336223 - RNA, 22 nt, Human
uacaucauaauaauacuuagaa

SEQ ID NO: 336224 - RNA, 22 nt, Human
acaagcaugggcuuugacauca

SEQ ID NO: 336225 - RNA, 22 nt, Human
uuugcaguuucauugcugaaau

SEQ ID NO: 336226 - RNA, 22 nt, Human
uucuuuugggaauuacguaugc

SEQ ID NO: 336227 - RNA, 22 nt, Human
uacugccuggagcauuggugcu

SEQ ID NO: 336228 - RNA, 22 nt, Human
uuugaaaucuaaucaaggaaca

SEQ ID NO: 336229 - RNA, 22 nt, Human
agcuaccuggcuuaucacuguc

SEQ ID NO: 336230 - RNA, 22 nt, Human
acauaugugcuuauauccauga

SEQ ID NO: 336231 - RNA, 22 nt, Human
ucuucuuaugugccauuaucuc

SEQ ID NO: 336232 - RNA, 22 nt, Human
ccucaggaaaugaauaaauggc

SEQ ID NO: 336233 - RNA, 22 nt, Human
accuugaugccuuuccaagaug

SEQ ID NO: 336234 - RNA, 22 nt, Human
gagaacucagacgcaggucaug

SEQ ID NO: 336235 - RNA, 22 nt, Human
caauacuuccuuguuagaggca

SEQ ID NO: 336236 - RNA, 22 nt, Human
aaacugcuuuccacaguggcua

SEQ ID NO: 336237 - RNA, 22 nt, Human
auaucauucugauguauaucuu

SEQ ID NO: 336238 - RNA, 21 nt, Human
ucaggagagcccaucuacaaa

SEQ ID NO: 336239 - RNA, 18 nt, Human
augggaggggccaagaga

SEQ ID NO: 336240 - RNA, 21 nt, Human
gcaaauguucaggaaaaaaga

SEQ ID NO: 336241 - RNA, 22 nt, Human
uuucuuguaagauguuuauuaa

SEQ ID NO: 336242 - RNA, 22 nt, Human
uuuuucaagacaaccugcaugu

SEQ ID NO: 336243 - RNA, 22 nt, Human
aggguggcugaguagauggaag

SEQ ID NO: 336244 - RNA, 22 nt, Human
ccucagggaaugggaggcuggg

SEQ ID NO: 336245 - RNA, 22 nt, Human
uuccagcaggcagacaggagau

SEQ ID NO: 336246 - RNA, 22 nt, Human
uucacauugugcagauuauggu

SEQ ID NO: 336247 - RNA, 22 nt, Human
ugaggcaggacauggacaacug

SEQ ID NO: 336248 - RNA, 22 nt, Human
uccaggagugauaaggccacug

SEQ ID NO: 336249 - RNA, 22 nt, Human
ugugaaaagggcuuuguacaaa

SEQ ID NO: 336250 - RNA, 22 nt, Human
cauuaaaauaucucaugguguu

SEQ ID NO: 336251 - RNA, 22 nt, Human
caacacauugaagcuaugauga

SEQ ID NO: 336252 - RNA, 22 nt, Human
aagcaauauacugauaugauua

SEQ ID NO: 336253 - RNA, 22 nt, Human
cucaggauuuacuaauuucaag

SEQ ID NO: 336254 - RNA, 20 nt, Human
aggaggggauagaaucaaag

SEQ ID NO: 336255 - RNA, 22 nt, Human
gggugggacugaagucugaggg

SEQ ID NO: 336256 - RNA, 22 nt, Human
ggaggggaugguuugacccugg

SEQ ID NO: 336257 - RNA, 22 nt, Human
agccuuguuggucugaguuugg

SEQ ID NO: 336258 - RNA, 22 nt, Human
caagaugggcaccccagcaccu

SEQ ID NO: 336259 - RNA, 22 nt, Human
uagaaauaaaucugcagcuggg

SEQ ID NO: 336260 - RNA, 22 nt, Human
ucccaggauguuuauggcuggu

SEQ ID NO: 336261 - RNA, 22 nt, Human
uugaaagugccaaguccuagug

SEQ ID NO: 336262 - RNA, 22 nt, Human
agagggauggccccguaacuca

SEQ ID NO: 336263 - RNA, 18 nt, Human
ugugaacacauuuuucug

SEQ ID NO: 336264 - RNA, 22 nt, Human
aucuccaggcauuucaagagac

SEQ ID NO: 336265 - RNA, 20 nt, Human
gggugggagagucugagggu

SEQ ID NO: 336266 - RNA, 22 nt, Human
cugcuucuccaaaguaggacuu

SEQ ID NO: 336267 - RNA, 22 nt, Human
gaaggaggugucaguuggacug

SEQ ID NO: 336268 - RNA, 22 nt, Human
uaugaacucuggagucugagug

SEQ ID NO: 336269 - RNA, 22 nt, Human
cuguggaaaauuuguauguaau

SEQ ID NO: 336270 - RNA, 22 nt, Human
gaggccaaucaauagggcaaua

SEQ ID NO: 336271 - RNA, 22 nt, Human
uucuucucucauagauuaaggu

SEQ ID NO: 336272 - RNA, 22 nt, Human
cccaggaagagugaguggcauu

SEQ ID NO: 336273 - RNA, 22 nt, Human
uuucucuugcgauaugcuacac

SEQ ID NO: 336274 - RNA, 22 nt, Human
ugagauguaagguaugcuuacu

SEQ ID NO: 336275 - RNA, 22 nt, Human
agcuagccuaggcagagugcau

SEQ ID NO: 336276 - RNA, 20 nt, Human
uccaugaguuagagacuaua

SEQ ID NO: 336277 - RNA, 22 nt, Human
augcugugguagacagcauucc

SEQ ID NO: 336278 - RNA, 22 nt, Human
gaggccagaguuccccgaguca

SEQ ID NO: 336279 - RNA, 22 nt, Human
uucacagaauggcaaguuaugg

SEQ ID NO: 336280 - RNA, 22 nt, Human
cacaauuuccuugcuucacuuu

SEQ ID NO: 336281 - RNA, 22 nt, Human
auguagaacagguuaaugacag

SEQ ID NO: 336282 - RNA, 22 nt, Human
caugcugugcaucuugaugacc

SEQ ID NO: 336283 - RNA, 22 nt, Human
uagggauguccugagacuuggc

SEQ ID NO: 336284 - RNA, 22 nt, Human
gaaggccaagaggcuccaagau

SEQ ID NO: 336285 - RNA, 22 nt, Human
aggccagcagcaugacggcauc

SEQ ID NO: 336286 - RNA, 17 nt, Human
gagagcugcugcuuccg

SEQ ID NO: 336287 - RNA, 22 nt, Human
agaggggacagccaccugcccg

SEQ ID NO: 336288 - RNA, 22 nt, Human
auuauuauauagggaaaguccc

SEQ ID NO: 336289 - RNA, 22 nt, Human
cucaggauagcugcgcagccug

SEQ ID NO: 336290 - RNA, 22 nt, Human
uugaaagacuucuccugugaaa

SEQ ID NO: 336291 - RNA, 22 nt, Human
guuuuccugaaacugauggugu

SEQ ID NO: 336292 - RNA, 22 nt, Human
aagggaggaggauuuauuguac

SEQ ID NO: 336293 - RNA, 22 nt, Human
uuaugacaggaaaaucacagaa

SEQ ID NO: 336294 - RNA, 22 nt, Human
cagauccacccuuguagugaca

SEQ ID NO: 336295 - RNA, 22 nt, Human
aauauaaugcuguuuuaugcca

SEQ ID NO: 336296 - RNA, 22 nt, Human
agcaccuugcucuuggccuucc

SEQ ID NO: 336297 - RNA, 22 nt, Human
cagagggcucuuggcugccugc

SEQ ID NO: 336298 - RNA, 22 nt, Human
ucucucuucaacccuuaacuag

SEQ ID NO: 336299 - RNA, 22 nt, Human
augcuguggaugccuugcccca

SEQ ID NO: 336300 - RNA, 22 nt, Human
uaccauuucauucuuuccucau

SEQ ID NO: 336301 - RNA, 22 nt, Human
uaaggccaggcuguggucggca

SEQ ID NO: 336302 - RNA, 22 nt, Human
acauaugauauugaggaucuca

SEQ ID NO: 336303 - RNA, 22 nt, Human
gcuggcaggagccuuucccuuu

SEQ ID NO: 336304 - RNA, 22 nt, Human
uccagccuaggggaacagcugc

SEQ ID NO: 336305 - RNA, 19 nt, Human
cuucuggcccugagccacc

SEQ ID NO: 336306 - RNA, 22 nt, Human
gaaacauacgauuuaggagaaa

SEQ ID NO: 336307 - RNA, 22 nt, Human
ucagagaguuacacaaauuguu

SEQ ID NO: 336308 - RNA, 22 nt, Human
gugaaacagaagcuccuggaau

SEQ ID NO: 336309 - RNA, 22 nt, Human
uccccagggcugcagagggugu

SEQ ID NO: 336310 - RNA, 22 nt, Human
auaucacaguaguuguuuaguu

SEQ ID NO: 336311 - RNA, 22 nt, Human
aguccaaggagagacagcauuu

SEQ ID NO: 336312 - RNA, 22 nt, Human
ccaggagagcgcccucccggcc

SEQ ID NO: 336313 - RNA, 22 nt, Human
gcagaggagcaaguugcuacag

SEQ ID NO: 336314 - RNA, 22 nt, Human
auuuagaacuuuguuugccaau

SEQ ID NO: 336315 - RNA, 22 nt, Human
aggccagccucaggcagggacc

SEQ ID NO: 336316 - RNA, 22 nt, Human
auuauucuuaugucaucauggc

SEQ ID NO: 336317 - RNA, 22 nt, Human
ucacauuuucuacuacuguacg

SEQ ID NO: 336318 - RNA, 22 nt, Human
uugaaggacauccuauuucuag

SEQ ID NO: 336319 - RNA, 22 nt, Human
uugaauaggacucagcagugau

SEQ ID NO: 336320 - RNA, 22 nt, Human
aaagccaugggucuuuggcaua

SEQ ID NO: 336321 - RNA, 22 nt, Human
gagaggagguggcuaugacagc

SEQ ID NO: 336322 - RNA, 22 nt, Human
gaggcagcugaaggagugacag

SEQ ID NO: 336323 - RNA, 22 nt, Human
uauuuuaaagugaagggucuug

SEQ ID NO: 336324 - RNA, 22 nt, Human
cugcuuuggacaacuauucuug

SEQ ID NO: 336325 - RNA, 22 nt, Human
cagcagagggagccauugaaau

SEQ ID NO: 336326 - RNA, 22 nt, Human
caggcagggagcuggaaaggau

SEQ ID NO: 336327 - RNA, 22 nt, Human
ccaugagcuuccuauauagggu

SEQ ID NO: 336328 - RNA, 22 nt, Human
ggcagcuaguuuaagaaagagg

SEQ ID NO: 336329 - RNA, 21 nt, Human
aaugcauuaacauaaagcuga

SEQ ID NO: 336330 - RNA, 22 nt, Human
gaggcugcccaacuggagugga

SEQ ID NO: 336331 - RNA, 22 nt, Human
cucagaauuuagggcucugagg

SEQ ID NO: 336332 - RNA, 22 nt, Human
cauaauuuuccaugguuugcua

SEQ ID NO: 336333 - RNA, 22 nt, Human
acuggaaaacacuacuacaugc

SEQ ID NO: 336334 - RNA, 22 nt, Human
auccagucaaaauuaguaaggu

SEQ ID NO: 336335 - RNA, 22 nt, Human
aggaagcucaaagccaugaugu

SEQ ID NO: 336336 - RNA, 22 nt, Human
uccaggagaaggccauccagcg

SEQ ID NO: 336337 - RNA, 22 nt, Human
uaucuguuaggaucagagcugg

SEQ ID NO: 336338 - RNA, 22 nt, Human
acucaggaaaaauguagugaua

SEQ ID NO: 336339 - RNA, 22 nt, Human
uugaaaggaauacagaggccua

SEQ ID NO: 336340 - RNA, 22 nt, Human
acaggagaaaucuggucaaaag

SEQ ID NO: 336341 - RNA, 22 nt, Human
ugguaauuuacgcauuucugua

SEQ ID NO: 336342 - RNA, 22 nt, Human
aagugggaauagaaaugaaggu

SEQ ID NO: 336343 - RNA, 22 nt, Human
ggugaguugggguucacagguc

SEQ ID NO: 336344 - RNA, 22 nt, Human
guuuagaacacggaaauacuga

SEQ ID NO: 336345 - RNA, 22 nt, Human
agguauaagaagauuauuuaua

SEQ ID NO: 336346 - RNA, 22 nt, Human
cuucuucaagagaaugggagac

SEQ ID NO: 336347 - RNA, 22 nt, Human
cuugaaagcacuuaguaaauua

SEQ ID NO: 336348 - RNA, 18 nt, Human
agggagagaccgcggguc

SEQ ID NO: 336349 - RNA, 22 nt, Human
ggcagaggagcuggaaacaugg

SEQ ID NO: 336350 - RNA, 22 nt, Human
ccaggagaugggaaaguagcag

SEQ ID NO: 336351 - RNA, 22 nt, Human
gcucccaggcauggagguaauu

SEQ ID NO: 336352 - RNA, 22 nt, Human
cccaggaaugggaaggaggaau

SEQ ID NO: 336353 - RNA, 22 nt, Human
ucucuucucuagugagcaacug

SEQ ID NO: 336354 - RNA, 22 nt, Human
uagggcagagcuuguacacgau

SEQ ID NO: 336355 - RNA, 22 nt, Human
gguaugaaaugauuccauguua

SEQ ID NO: 336356 - RNA, 22 nt, Human
uagugcuuaauaaauuucagaa

SEQ ID NO: 336357 - RNA, 20 nt, Human
gaguuccccauuucuccugg

SEQ ID NO: 336358 - RNA, 22 nt, Human
uccaggagugugugcuaauggg

SEQ ID NO: 336359 - RNA, 22 nt, Human
gcuguggucugugagcuccaaa

SEQ ID NO: 336360 - RNA, 22 nt, Human
uauuucagcccuacuacuuggc

SEQ ID NO: 336361 - RNA, 18 nt, Human
cucaccauucugcccaau

SEQ ID NO: 336362 - RNA, 22 nt, Human
agucucuuccuucaaggcuggu

SEQ ID NO: 336363 - RNA, 22 nt, Human
gaggucaggggagaggcugaug

SEQ ID NO: 336364 - RNA, 22 nt, Human
cucuucuugaaagaggaauuca

SEQ ID NO: 336365 - RNA, 22 nt, Human
gggacuucauagcuaggcacuu

SEQ ID NO: 336366 - RNA, 22 nt, Human
cggagccugcuuguugcagcug

SEQ ID NO: 336367 - RNA, 22 nt, Human
acauuuuuauucaucaaagcag

SEQ ID NO: 336368 - RNA, 22 nt, Human
uuaaaugaggcugauguagauu

SEQ ID NO: 336369 - RNA, 22 nt, Human
ucugggaaugaauaagaccugu

SEQ ID NO: 336370 - RNA, 22 nt, Human
acaacauuauacauagaaagcu

SEQ ID NO: 336371 - RNA, 22 nt, Human
agucccuguacuuuccacugcc

SEQ ID NO: 336372 - RNA, 22 nt, Human
uuaauacaagcauaugcacaca

SEQ ID NO: 336373 - RNA, 22 nt, Human
uugaagagugccuuccagacau

SEQ ID NO: 336374 - RNA, 22 nt, Human
gcccaggaaauaaaagugggcu

SEQ ID NO: 336375 - RNA, 22 nt, Human
ugaggcaggagaaucaccggaa

SEQ ID NO: 336376 - RNA, 22 nt, Human
ucucuguaguugggcagcugcu

SEQ ID NO: 336377 - RNA, 22 nt, Human
agucucugcaugccugcugugc

SEQ ID NO: 336378 - RNA, 22 nt, Human
gcaggagagucugugccagguu

SEQ ID NO: 336379 - RNA, 22 nt, Human
ugagaacugaggauuugaauuc

SEQ ID NO: 336380 - RNA, 22 nt, Human
gaggcaugcagagcuggagcag

SEQ ID NO: 336381 - RNA, 22 nt, Human
aaguaugacauuuaagacaauu

SEQ ID NO: 336382 - RNA, 22 nt, Human
auuacaaucgagagaaacaaau

SEQ ID NO: 336383 - RNA, 19 nt, Human
cuuugucagaacaugcuuc

SEQ ID NO: 336384 - RNA, 22 nt, Human
agugcuuugagcguuugaaaag

SEQ ID NO: 336385 - RNA, 22 nt, Human
caguuuuugccauuaagaguaa

SEQ ID NO: 336386 - RNA, 22 nt, Human
cuagggaguggcagagcuggga

SEQ ID NO: 336387 - RNA, 22 nt, Human
uuagacauguuugcuaaaauga

SEQ ID NO: 336388 - RNA, 22 nt, Human
aggcagcuggcaaauucuagag

SEQ ID NO: 336389 - RNA, 22 nt, Human
uuugcaguagacaucuuauuuu

SEQ ID NO: 336390 - RNA, 22 nt, Human
caguucuuaauaccaugugguu

SEQ ID NO: 336391 - RNA, 22 nt, Human
aggacagggauucaaacuccca

SEQ ID NO: 336392 - RNA, 22 nt, Human
cugaggaagacagcagcugugu

SEQ ID NO: 336393 - RNA, 17 nt, Human
ucaggauguagcaguag

SEQ ID NO: 336394 - RNA, 22 nt, Human
aucugucaggagcaaggacuac

SEQ ID NO: 336395 - RNA, 22 nt, Human
caaggccaagucucugugaaga

SEQ ID NO: 336396 - RNA, 22 nt, Human
accaggagccacaggaggagcc

SEQ ID NO: 336397 - RNA, 22 nt, Human
gaagcagcagcuggggacaguu

SEQ ID NO: 336398 - RNA, 22 nt, Human
uccaggagacacccuugugugu

SEQ ID NO: 336399 - RNA, 22 nt, Human
agugcuuuagagaaauggugcu

SEQ ID NO: 336400 - RNA, 18 nt, Human
gcaggagauggguggggu

SEQ ID NO: 336401 - RNA, 18 nt, Human
gaugggagcaagagaaga

SEQ ID NO: 336402 - RNA, 23 nt, Human
aaauuauugcucuucaauugccu

SEQ ID NO: 336403 - RNA, 22 nt, Human
aggcaguggagcuggaauaggc

SEQ ID NO: 336404 - RNA, 22 nt, Human
ucagugcacagagauuuuuguu

SEQ ID NO: 336405 - RNA, 22 nt, Human
uccaugagaacccuuggagaua

SEQ ID NO: 336406 - RNA, 17 nt, Human
gucauucucagaaaaug

SEQ ID NO: 336407 - RNA, 22 nt, Human
uccaggagcauccaggugaagc

SEQ ID NO: 336408 - RNA, 22 nt, Human
ggcucagaccucccagcuccag

SEQ ID NO: 336409 - RNA, 22 nt, Human
ucacacagauugguagagcuga

SEQ ID NO: 336410 - RNA, 22 nt, Human
acacauuucucuuuuuguaagu

SEQ ID NO: 336411 - RNA, 22 nt, Human
cuuaagauuugcgauaccuaau

SEQ ID NO: 336412 - RNA, 22 nt, Human
gcauucuuuuuaggagguuccu

SEQ ID NO: 336413 - RNA, 22 nt, Human
cauaauuucacugucguauggc

SEQ ID NO: 336414 - RNA, 22 nt, Human
uccaggagaccagauguaggcc

SEQ ID NO: 336415 - RNA, 22 nt, Human
agccagcugugggcucaggcgg

SEQ ID NO: 336416 - RNA, 20 nt, Human
aggaagcugagauguagagg

SEQ ID NO: 336417 - RNA, 22 nt, Human
ccucuucuaggacguccuugug

SEQ ID NO: 336418 - RNA, 22 nt, Human
augaaaauguacauguguauaa

SEQ ID NO: 336419 - RNA, 23 nt, Human
acaagauagggauaaaaagauaa

SEQ ID NO: 336420 - RNA, 17 nt, Human
gcccaggaaggacggcc

SEQ ID NO: 336421 - RNA, 22 nt, Human
auugaggcagcauaguucaggg

SEQ ID NO: 336422 - RNA, 22 nt, Human
uucuucuucauuucugacgaug

SEQ ID NO: 336423 - RNA, 22 nt, Human
aaaggccaauaaagacaagcug

SEQ ID NO: 336424 - RNA, 22 nt, Human
ugcugcugaucauuuauagucu

SEQ ID NO: 336425 - RNA, 23 nt, Human
aaacugcuuccaauuccugccau

SEQ ID NO: 336426 - RNA, 22 nt, Human
acuguugucaggcugcuuugga

SEQ ID NO: 336427 - RNA, 22 nt, Human
caaggccaugagcagcgagugu

SEQ ID NO: 336428 - RNA, 22 nt, Human
aucacauucuuucaaagcaguc

SEQ ID NO: 336429 - RNA, 22 nt, Human
cuuagaaaucgaacucagguua

SEQ ID NO: 336430 - RNA, 22 nt, Human
agugcuuuauguuguugugcaa

SEQ ID NO: 336431 - RNA, 22 nt, Human
cucugcaugccuugcucagaca

SEQ ID NO: 336432 - RNA, 22 nt, Human
augcugugagugugccgcagag

SEQ ID NO: 336433 - RNA, 22 nt, Human
ggaggaggcggcagaaguuccu

SEQ ID NO: 336434 - RNA, 23 nt, Human
cuucucagaagucugugccagga

SEQ ID NO: 336435 - RNA, 22 nt, Human
gcaggcaguuauuuaguagaau

SEQ ID NO: 336436 - RNA, 23 nt, Human
guaaaauacgcagugcaguguga

SEQ ID NO: 336437 - RNA, 22 nt, Human
cacaauguauauguauaucaaa

SEQ ID NO: 336438 - RNA, 22 nt, Human
uucaggaucauuuguuuuaucu

SEQ ID NO: 336439 - RNA, 22 nt, Human
cccaggaguaagugacauuguu

SEQ ID NO: 336440 - RNA, 22 nt, Human
gucaggaugggcagccaaacua

SEQ ID NO: 336441 - RNA, 22 nt, Human
guugacagcuggugagcugcua

SEQ ID NO: 336442 - RNA, 22 nt, Human
ucucacuggguauaaaugagua

SEQ ID NO: 336443 - RNA, 22 nt, Human
uuucauugucuacauaugacau

SEQ ID NO: 336444 - RNA, 22 nt, Human
ucuucucuccugcuuggcagaa

SEQ ID NO: 336445 - RNA, 22 nt, Human
gaggcugaggguuagagaguca

SEQ ID NO: 336446 - RNA, 22 nt, Human
cccaggagaccuagaucuguuu

SEQ ID NO: 336447 - RNA, 23 nt, Human
uuucaaauuacucugcagaugac

SEQ ID NO: 336448 - RNA, 20 nt, Human
uucacagaggacucagguca

SEQ ID NO: 336449 - RNA, 22 nt, Human
ugcugcuguauccuuaguguca

SEQ ID NO: 336450 - RNA, 22 nt, Human
uguaugaaagaacaagggcuua

SEQ ID NO: 336451 - RNA, 22 nt, Human
agaaucucuacucaaguacuug

SEQ ID NO: 336452 - RNA, 22 nt, Human
uugaaagaggcaaaguuugauc

SEQ ID NO: 336453 - RNA, 22 nt, Human
aguggacucuucccagugcuug

SEQ ID NO: 336454 - RNA, 22 nt, Human
ccuuaaauucuccauuugaaag

SEQ ID NO: 336455 - RNA, 22 nt, Human
uagaaauguugguauuaacauu

SEQ ID NO: 336456 - RNA, 22 nt, Human
auucaaauuaaguuaauucagc

SEQ ID NO: 336457 - RNA, 22 nt, Human
aucugccuggcuccaggugagc

SEQ ID NO: 336458 - RNA, 22 nt, Human
gagugcagaugaacagaagauu

SEQ ID NO: 336459 - RNA, 22 nt, Human
uggccaggcagguagaacggcc

SEQ ID NO: 336460 - RNA, 22 nt, Human
aagacugucuuuucugagugac

SEQ ID NO: 336461 - RNA, 23 nt, Human
cuugcaggaagcagauggcacac

SEQ ID NO: 336462 - RNA, 22 nt, Human
cuuuccaaugcauuuccaaugu

SEQ ID NO: 336463 - RNA, 22 nt, Human
caaaguuuuaguaaacauauau

SEQ ID NO: 336464 - RNA, 22 nt, Human
auucaaguccagcuucucuaca

SEQ ID NO: 336465 - RNA, 22 nt, Human
gcaccugauugauuucacugcu

SEQ ID NO: 336466 - RNA, 22 nt, Human
gaucuucuagcagaaguaauuu

SEQ ID NO: 336467 - RNA, 22 nt, Human
aaguccaugaucaagauguggc

SEQ ID NO: 336468 - RNA, 22 nt, Human
ucugcaggcuuauaggaugggu

SEQ ID NO: 336469 - RNA, 22 nt, Human
uuugcauaaaggagcauuucuc

SEQ ID NO: 336470 - RNA, 22 nt, Human
ucauuucaaguucugacagcua

SEQ ID NO: 336471 - RNA, 21 nt, Human
uccaggaguucuaauaggugu

SEQ ID NO: 336472 - RNA, 22 nt, Human
ucaauaaaauuguuuuccuauc

SEQ ID NO: 336473 - RNA, 21 nt, Human
uggaggaauaaagcacagaag

SEQ ID NO: 336474 - RNA, 22 nt, Human
uuaaauauuauguugucugcaa

SEQ ID NO: 336475 - RNA, 22 nt, Human
gauaaugaugacaaugacaacc

SEQ ID NO: 336476 - RNA, 22 nt, Human
uuugaaguucccccauaucaga

SEQ ID NO: 336477 - RNA, 22 nt, Human
gagguggaaggcaggaacaaau

SEQ ID NO: 336478 - RNA, 22 nt, Human
uugcucagcacuggagccagcu

SEQ ID NO: 336479 - RNA, 22 nt, Human
gucaggaucaaauugaaguuau

SEQ ID NO: 336480 - RNA, 22 nt, Human
aggugagggugccagugcaugg

SEQ ID NO: 336481 - RNA, 21 nt, Human
acagcauguuuguguguuugc

SEQ ID NO: 336482 - RNA, 22 nt, Human
cagaagaggacuggguagcuca

SEQ ID NO: 336483 - RNA, 22 nt, Human
cucaggauucucgacacucaca

SEQ ID NO: 336484 - RNA, 21 nt, Human
uucuucaguuuaauauaaaau

SEQ ID NO: 336485 - RNA, 22 nt, Human
aauuuuaagcauaugacugguu

SEQ ID NO: 336486 - RNA, 22 nt, Human
guucuucaucauuaacacucug

SEQ ID NO: 336487 - RNA, 22 nt, Human
ccugcugugaccggggagcagg

SEQ ID NO: 336488 - RNA, 22 nt, Human
cauuguuaccaucuuuuaccua

SEQ ID NO: 336489 - RNA, 23 nt, Human
aucauucuccaaucuggagcagg

SEQ ID NO: 336490 - RNA, 22 nt, Human
uucuucagucccacuagccaca

SEQ ID NO: 336491 - RNA, 22 nt, Human
caggcagcuagauuuauaacaa

SEQ ID NO: 336492 - RNA, 22 nt, Human
uauuuccagcaguaagaagaca

SEQ ID NO: 336493 - RNA, 22 nt, Human
cugcuguguggauucaauggcu

SEQ ID NO: 336494 - RNA, 22 nt, Human
augauguugauaaauuacuuua

SEQ ID NO: 336495 - RNA, 22 nt, Human
cagcuuccauaagagauggaga

SEQ ID NO: 336496 - RNA, 22 nt, Human
cccaggagguagagguugcagu

SEQ ID NO: 336497 - RNA, 22 nt, Human
aagacaauuugauacuaguugc

SEQ ID NO: 336498 - RNA, 22 nt, Human
aaggcaguacuuuauguccaua

SEQ ID NO: 336499 - RNA, 22 nt, Human
caugcugugugguuagaacugu

SEQ ID NO: 336500 - RNA, 22 nt, Human
uuuccauguuggugaaaugagg

SEQ ID NO: 336501 - RNA, 18 nt, Human
ggcagggaaaagauaggg

SEQ ID NO: 336502 - RNA, 22 nt, Human
ugaggcagugcugggaagccug

SEQ ID NO: 336503 - RNA, 22 nt, Human
uggaguucauccaugacagcuu

SEQ ID NO: 336504 - RNA, 22 nt, Human
gcugcccacaaugauuacaugg

SEQ ID NO: 336505 - RNA, 22 nt, Human
uugcagcuucgagucuaucugu

SEQ ID NO: 336506 - RNA, 22 nt, Human
cuugcugugugguguucucaga

SEQ ID NO: 336507 - RNA, 22 nt, Human
gcuccuucaggugguagcuguu

SEQ ID NO: 336508 - RNA, 22 nt, Human
agaggggaaggaugugauguga

SEQ ID NO: 336509 - RNA, 22 nt, Human
cauucuuacacaauauuuuaau

SEQ ID NO: 336510 - RNA, 22 nt, Human
ucuucaucucagauuaacagga

SEQ ID NO: 336511 - RNA, 19 nt, Human
auacagauguauccaugau

SEQ ID NO: 336512 - RNA, 22 nt, Human
gaaggccacggaauggagcugg

SEQ ID NO: 336513 - RNA, 22 nt, Human
ugaaggaaugaguauacuguuu

SEQ ID NO: 336514 - RNA, 19 nt, Human
ggcagucucaagcagcaca

SEQ ID NO: 336515 - RNA, 22 nt, Human
aucaguuauuuuuaagcuauaa

SEQ ID NO: 336516 - RNA, 22 nt, Human
uagggaggaggguuuucaaauc

SEQ ID NO: 336517 - RNA, 22 nt, Human
cuacuucuaaguacauggugau

SEQ ID NO: 336518 - RNA, 22 nt, Human
caaauguaaauucuuuugaagc

SEQ ID NO: 336519 - RNA, 22 nt, Human
ucauuucaaugauacuacuaag

SEQ ID NO: 336520 - RNA, 22 nt, Human
ucuuugaauucaaacuguucaa

SEQ ID NO: 336521 - RNA, 22 nt, Human
agcccaggucucaaaguacagg

SEQ ID NO: 336522 - RNA, 21 nt, Human
uacagaaugcgcuucagucug

SEQ ID NO: 336523 - RNA, 20 nt, Human
ggaggguggaagaaagcaag

SEQ ID NO: 336524 - RNA, 22 nt, Human
agggaggucuuugaggggcuua

SEQ ID NO: 336525 - RNA, 22 nt, Human
ccuggagaccagaggauacuuc

SEQ ID NO: 336526 - RNA, 22 nt, Human
aggaugaauaacugaaauggug

SEQ ID NO: 336527 - RNA, 22 nt, Human
uugcauuuccuguacuguuuga

SEQ ID NO: 336528 - RNA, 22 nt, Human
gaggcaacacauuuggaaagca

SEQ ID NO: 336529 - RNA, 22 nt, Human
aggcaagcccccagugaggcuc

SEQ ID NO: 336530 - RNA, 22 nt, Human
ucuucuuccucauuuauacaua

SEQ ID NO: 336531 - RNA, 22 nt, Human
aguaugaagauuauaauuuuuc

SEQ ID NO: 336532 - RNA, 22 nt, Human
cuucugugauuugguuaggaua

SEQ ID NO: 336533 - RNA, 22 nt, Human
aucugcuuuugagaauuuacuu

SEQ ID NO: 336534 - RNA, 22 nt, Human
cugccaggcgauggauuggcug

SEQ ID NO: 336535 - RNA, 22 nt, Human
uugcuuuguuacugcaguuucc

SEQ ID NO: 336536 - RNA, 22 nt, Human
uggcuguguuaccacuucaugu

SEQ ID NO: 336537 - RNA, 22 nt, Human
cuagccaugggcauuaaaggua

SEQ ID NO: 336538 - RNA, 21 nt, Human
auugaaagucaacaaucaguu

SEQ ID NO: 336539 - RNA, 23 nt, Human
aggcagcagguuguccaggguga

SEQ ID NO: 336540 - RNA, 22 nt, Human
uucugucuguaaacuucucaau

SEQ ID NO: 336541 - RNA, 22 nt, Human
aauguaugggugagaaaguuga

SEQ ID NO: 336542 - RNA, 22 nt, Human
caucaucaaaacaaauggaguc

SEQ ID NO: 336543 - RNA, 22 nt, Human
ugaaggcccagccacagaaugg

SEQ ID NO: 336544 - RNA, 21 nt, Human
acagucuccccagaucucucc

SEQ ID NO: 336545 - RNA, 22 nt, Human
aggcaguuguugcugagcagcu

SEQ ID NO: 336546 - RNA, 22 nt, Human
auuuagacuucccagcacugug

SEQ ID NO: 336547 - RNA, 22 nt, Human
cuggcaaguacugggccagcuc

SEQ ID NO: 336548 - RNA, 22 nt, Human
aagcagaggguauggccagguu

SEQ ID NO: 336549 - RNA, 23 nt, Human
uugaaagguagcuggcagcuaga

SEQ ID NO: 336550 - RNA, 22 nt, Human
gcagggaagacccggagcagcg

SEQ ID NO: 336551 - RNA, 22 nt, Human
gaagcagcuuucuggugaggag

SEQ ID NO: 336552 - RNA, 22 nt, Human
caacugcugacaccaucacucc

SEQ ID NO: 336553 - RNA, 23 nt, Human
uccaggagaauuccagggcccgg

SEQ ID NO: 336554 - RNA, 22 nt, Human
gccaggagacuccauucauuug

SEQ ID NO: 336555 - RNA, 17 nt, Human
gaggagcuccaguaggu

SEQ ID NO: 336556 - RNA, 22 nt, Human
ugaccuuauuugaaaauagaga

SEQ ID NO: 336557 - RNA, 22 nt, Human
gggcagcugcagggauggugac

SEQ ID NO: 336558 - RNA, 22 nt, Human
acagauauaaacuauaguagug

SEQ ID NO: 336559 - RNA, 22 nt, Human
gggauggggagcuggaaagggg

SEQ ID NO: 336560 - RNA, 22 nt, Human
auucuucaucacuaccuuguga

SEQ ID NO: 336561 - RNA, 22 nt, Human
ugcuugugagaguuuuuucaga

SEQ ID NO: 336562 - RNA, 22 nt, Human
acuuuugguucuguaacuguga

SEQ ID NO: 336563 - RNA, 22 nt, Human
agcccagggacagggcggaugu

SEQ ID NO: 336564 - RNA, 22 nt, Human
cucagagaggcaguggaaguca

SEQ ID NO: 336565 - RNA, 22 nt, Human
ugccaggagucaggccaggcag

SEQ ID NO: 336566 - RNA, 22 nt, Human
agugcuuugaacgaaaggcuga

SEQ ID NO: 336567 - RNA, 22 nt, Human
uuucauugcagagucugugugc

SEQ ID NO: 336568 - RNA, 22 nt, Human
ucuucagauggccaguuguccc

SEQ ID NO: 336569 - RNA, 17 nt, Human
uugaacugcugagucag

SEQ ID NO: 336570 - RNA, 22 nt, Human
uggcagcuaucuuuaaugagau

SEQ ID NO: 336571 - RNA, 22 nt, Human
uaugaacauguucauugacuua

SEQ ID NO: 336572 - RNA, 22 nt, Human
caaugugguggcagaugucagu

SEQ ID NO: 336573 - RNA, 22 nt, Human
uucugucacuuuuuuggaaucu

SEQ ID NO: 336574 - RNA, 22 nt, Human
agaaaugaagagagucaagguu

SEQ ID NO: 336575 - RNA, 22 nt, Human
cagucucucugaaguauuaaga

SEQ ID NO: 336576 - RNA, 22 nt, Human
uugcagcuucuaccacuguuuc

SEQ ID NO: 336577 - RNA, 22 nt, Human
aauucuguaacuuuacugaauu

SEQ ID NO: 336578 - RNA, 22 nt, Human
ugcuucagaggaaaggcaaaag

SEQ ID NO: 336579 - RNA, 22 nt, Human
agaaaacuugucacagcucuca

SEQ ID NO: 336580 - RNA, 20 nt, Human
uucugucagauuauauggga

SEQ ID NO: 336581 - RNA, 23 nt, Human
ggagugcaauggcgccaucucgg

SEQ ID NO: 336582 - RNA, 22 nt, Human
ggcagcacugcagcuuguuggg

SEQ ID NO: 336583 - RNA, 22 nt, Human
gcuguguuuuauguuagguuaa

SEQ ID NO: 336584 - RNA, 22 nt, Human
uauuaaauuauggauuuaggag

SEQ ID NO: 336585 - RNA, 19 nt, Human
ugcugcuguccuugcaggg

SEQ ID NO: 336586 - RNA, 22 nt, Human
auuaguaaaacauuguauaugu

SEQ ID NO: 336587 - RNA, 22 nt, Human
aacauucaaaacccaguucagu

SEQ ID NO: 336588 - RNA, 22 nt, Human
uuuuuauaugaaggauagugcg

SEQ ID NO: 336589 - RNA, 22 nt, Human
agggcagcucucaccucuggcc

SEQ ID NO: 336590 - RNA, 22 nt, Human
ggaggaggggcgcuuugucuau

SEQ ID NO: 336591 - RNA, 22 nt, Human
ccuggacucaggcugugggcac

SEQ ID NO: 336592 - RNA, 22 nt, Human
uucaggauccccuugaugggcu

SEQ ID NO: 336593 - RNA, 22 nt, Human
ucuagaauuuugccauauagcu

SEQ ID NO: 336594 - RNA, 22 nt, Human
gucccauaaguagugcaacuug

SEQ ID NO: 336595 - RNA, 22 nt, Human
ucaugaacauggaauaucuuuu

SEQ ID NO: 336596 - RNA, 22 nt, Human
gaaucucaaggcuugugaggau

SEQ ID NO: 336597 - RNA, 22 nt, Human
ucauaaaucauacuccauuugc

SEQ ID NO: 336598 - RNA, 19 nt, Human
aggguggcaaaggagggug

SEQ ID NO: 336599 - RNA, 22 nt, Human
ggcagccuugagggaggccugg

SEQ ID NO: 336600 - RNA, 22 nt, Human
ucugucaaaaguuuucaauaaa

SEQ ID NO: 336601 - RNA, 20 nt, Human
aagagaggaaguuauacuag

SEQ ID NO: 336602 - RNA, 22 nt, Human
cugccaggcacgugcagcauca

SEQ ID NO: 336603 - RNA, 22 nt, Human
ucuacugugguccuuguaacca

SEQ ID NO: 336604 - RNA, 22 nt, Human
acugcuuacccggccugacuuc

SEQ ID NO: 336605 - RNA, 22 nt, Human
cugacccauauaagaguggagg

SEQ ID NO: 336606 - RNA, 22 nt, Human
aggcagcuggcagcacccaggg

SEQ ID NO: 336607 - RNA, 22 nt, Human
agaaaugaagcaggaguuauua

SEQ ID NO: 336608 - RNA, 22 nt, Human
ugcuguguggaugugaagaauc

SEQ ID NO: 336609 - RNA, 22 nt, Human
aaaauacuguggaguguugaaa

SEQ ID NO: 336610 - RNA, 22 nt, Human
augcuguguuuuaaauggaaau

SEQ ID NO: 336611 - RNA, 22 nt, Human
uauguaaaaauucaucaggcug

SEQ ID NO: 336612 - RNA, 23 nt, Human
ugugaaauuugaggucagugcuu

SEQ ID NO: 336613 - RNA, 22 nt, Human
aggagaaggaagugcaucacua

SEQ ID NO: 336614 - RNA, 22 nt, Human
agggcagcacaaggcauggacu

SEQ ID NO: 336615 - RNA, 22 nt, Human
gagugcagaugccagccccagu

SEQ ID NO: 336616 - RNA, 22 nt, Human
uaggcagcagugcuaugauucu

SEQ ID NO: 336617 - RNA, 21 nt, Human
uugaccaagggugcgugcucc

SEQ ID NO: 336618 - RNA, 22 nt, Human
agaccaagacuauaaugagagg

SEQ ID NO: 336619 - RNA, 22 nt, Human
uucuucuugaaacuuuagguug

SEQ ID NO: 336620 - RNA, 22 nt, Human
gagaggugaaggcugcccuggg

SEQ ID NO: 336621 - RNA, 22 nt, Human
gcugugcuugggaagaaucucu

SEQ ID NO: 336622 - RNA, 17 nt, Human
gccucugcuugugucau

SEQ ID NO: 336623 - RNA, 22 nt, Human
agcuggcaguaugacuggugac

SEQ ID NO: 336624 - RNA, 22 nt, Human
auuuucaaaacaucugcugugu

SEQ ID NO: 336625 - RNA, 22 nt, Human
uuguuugaggucacugauauuu

SEQ ID NO: 336626 - RNA, 22 nt, Human
acaauucugaugguuucccagu

SEQ ID NO: 336627 - RNA, 22 nt, Human
gacccaggguauccagagcugc

SEQ ID NO: 336628 - RNA, 22 nt, Human
ggcagaagauaggacagggaau

SEQ ID NO: 336629 - RNA, 22 nt, Human
ucaggagacuggcagugcccac

SEQ ID NO: 336630 - RNA, 22 nt, Human
aucacauuguuagcauagacug

SEQ ID NO: 336631 - RNA, 22 nt, Human
uaacacaugucugggaugugaa

SEQ ID NO: 336632 - RNA, 22 nt, Human
aggagaggcucuaacucugugu

SEQ ID NO: 336633 - RNA, 20 nt, Human
gggagucuggaugaaagaug

SEQ ID NO: 336634 - RNA, 19 nt, Human
ucaucucacagggccuggc

SEQ ID NO: 336635 - RNA, 22 nt, Human
gugaaacacccuccaaugcaca

SEQ ID NO: 336636 - RNA, 22 nt, Human
uuuugugagcccauaaaugcca

SEQ ID NO: 336637 - RNA, 22 nt, Human
ccagagagauugcuucuaaaga

SEQ ID NO: 336638 - RNA, 22 nt, Human
cauaauaucuccgauuacuugc

SEQ ID NO: 336639 - RNA, 22 nt, Human
auucuucacaaauauauagaag

SEQ ID NO: 336640 - RNA, 22 nt, Human
gcugcuguugauuuaguccaau

SEQ ID NO: 336641 - RNA, 22 nt, Human
uggcagcuguuaauguuuuguu

SEQ ID NO: 336642 - RNA, 22 nt, Human
ucugucaauauaugugcugcag

SEQ ID NO: 336643 - RNA, 22 nt, Human
agcagccuuugaucaucuggga

SEQ ID NO: 336644 - RNA, 22 nt, Human
aggccagaugucgggcuagaag

SEQ ID NO: 336645 - RNA, 22 nt, Human
agcugaugccauguggaacagu

SEQ ID NO: 336646 - RNA, 22 nt, Human
uagauuuuacuucugucauuac

SEQ ID NO: 336647 - RNA, 22 nt, Human
uagggaugagccaguggguagu

SEQ ID NO: 336648 - RNA, 22 nt, Human
agagagcauugaggaaaucuuc

SEQ ID NO: 336649 - RNA, 22 nt, Human
gccugcagauauauaggauggu

SEQ ID NO: 336650 - RNA, 22 nt, Human
ugaaaugauaucugauaacaaa

SEQ ID NO: 336651 - RNA, 22 nt, Human
aggaggggcauagaaauguaau

SEQ ID NO: 336652 - RNA, 22 nt, Human
cuuuggcagccucugcuauuga

SEQ ID NO: 336653 - RNA, 20 nt, Human
gcccaggaauuugcauuucu

SEQ ID NO: 336654 - RNA, 22 nt, Human
cuguaugaacccauauacuuau

SEQ ID NO: 336655 - RNA, 22 nt, Human
ugaggcaggagaaucacaugaa

SEQ ID NO: 336656 - RNA, 22 nt, Human
cauuugcagagggugacacucu

SEQ ID NO: 336657 - RNA, 22 nt, Human
cccaggagagaggccaguuggc

SEQ ID NO: 336658 - RNA, 22 nt, Human
cauuuccugucuggaggucaaa

SEQ ID NO: 336659 - RNA, 22 nt, Human
uguccucagauaugucuacucu

SEQ ID NO: 336660 - RNA, 22 nt, Human
cagugauggauauggagaaguc

SEQ ID NO: 336661 - RNA, 22 nt, Human
agggaagcuuguuacugagaag

SEQ ID NO: 336662 - RNA, 22 nt, Human
ucaguucugcuagaaaaacagu

SEQ ID NO: 336663 - RNA, 22 nt, Human
uccaggagcucauccacgucaa

SEQ ID NO: 336664 - RNA, 22 nt, Human
gaagcacauggcuauagcuauu

SEQ ID NO: 336665 - RNA, 22 nt, Human
agagggcaaguguaguccagua

SEQ ID NO: 336666 - RNA, 22 nt, Human
ugcauggacucaucagacaaga

SEQ ID NO: 336667 - RNA, 22 nt, Human
cuucuucacacuggucugaagc

SEQ ID NO: 336668 - RNA, 22 nt, Human
ugucugugaccucuuaggcaag

SEQ ID NO: 336669 - RNA, 22 nt, Human
guguuuuaagaaagaagcucag

SEQ ID NO: 336670 - RNA, 22 nt, Human
ucauuuugggguuugucaucuu

SEQ ID NO: 336671 - RNA, 22 nt, Human
uacagcauauacagaaugaaca

SEQ ID NO: 336672 - RNA, 22 nt, Human
gcuccucuauuccccacauuuu

SEQ ID NO: 336673 - RNA, 19 nt, Human
uucuccagccugaccugag

SEQ ID NO: 336674 - RNA, 22 nt, Human
cagucucuugcuucauuaguug

SEQ ID NO: 336675 - RNA, 22 nt, Human
cugagagugcucuuugauguca

SEQ ID NO: 336676 - RNA, 23 nt, Human
agaggggagcaucugcuggcuga

SEQ ID NO: 336677 - RNA, 22 nt, Human
gaggccagaagugccucgggcu

SEQ ID NO: 336678 - RNA, 22 nt, Human
cuuagcaugugguguccuugua

SEQ ID NO: 336679 - RNA, 22 nt, Human
aaggcagcucagcucauggcag

SEQ ID NO: 336680 - RNA, 22 nt, Human
cagaaggcuggcagauugagau

SEQ ID NO: 336681 - RNA, 22 nt, Human
uagcacaucuucuuggccugca

SEQ ID NO: 336682 - RNA, 22 nt, Human
caggcagaguuagagcaacugg

SEQ ID NO: 336683 - RNA, 22 nt, Human
cuugaaagaagggucuuuuaau

SEQ ID NO: 336684 - RNA, 22 nt, Human
cagcuucugucugauuagcaag

SEQ ID NO: 336685 - RNA, 22 nt, Human
uguuuucagucauauagcaggu

SEQ ID NO: 336686 - RNA, 22 nt, Human
uucugugaaucuuuuuucccac

SEQ ID NO: 336687 - RNA, 22 nt, Human
acaguacauaauccugagucug

SEQ ID NO: 336688 - RNA, 22 nt, Human
guuugcauuuauuagucuucug

SEQ ID NO: 336689 - RNA, 22 nt, Human
agcugcccuuuaugaugcugaa

SEQ ID NO: 336690 - RNA, 22 nt, Human
agacucaagacugcagaagacg

SEQ ID NO: 336691 - RNA, 22 nt, Human
aucauuuuuaagagacucuucu

SEQ ID NO: 336692 - RNA, 22 nt, Human
agaauccuguuuuacuucauca

SEQ ID NO: 336693 - RNA, 22 nt, Human
aggccagaaauuuggaguaugu

SEQ ID NO: 336694 - RNA, 22 nt, Human
ucuuugcaaaauacaacaaugg

SEQ ID NO: 336695 - RNA, 22 nt, Human
ucacaguaaaagcauggaagag

SEQ ID NO: 336696 - RNA, 21 nt, Human
gaacauuuggguuguuucuac

SEQ ID NO: 336697 - RNA, 22 nt, Human
ggcagcuucuuaauauggagac

SEQ ID NO: 336698 - RNA, 22 nt, Human
uuugacaucaauacccuagaau

SEQ ID NO: 336699 - RNA, 22 nt, Human
uggaaggaaagguagcagagaa

SEQ ID NO: 336700 - RNA, 22 nt, Human
ggugaagggccuuaggagacag

SEQ ID NO: 336701 - RNA, 23 nt, Human
ggcagcucucaucugaugacuga

SEQ ID NO: 336702 - RNA, 22 nt, Human
aggagggacaccaauauauguu

SEQ ID NO: 336703 - RNA, 22 nt, Human
ucccaggaucugagggcagaga

SEQ ID NO: 336704 - RNA, 23 nt, Human
cuugcagggcuggaggcuuagaa

SEQ ID NO: 336705 - RNA, 22 nt, Human
aaguuucaugauguaauuauug

SEQ ID NO: 336706 - RNA, 22 nt, Human
cacaaaugguuguagacauuaa

SEQ ID NO: 336707 - RNA, 22 nt, Human
uugacaauguccuuugaauuuc

SEQ ID NO: 336708 - RNA, 22 nt, Human
uuuggaauauuaaaaugucuca

SEQ ID NO: 336709 - RNA, 22 nt, Human
uucuucucagggucccacaugg

SEQ ID NO: 336710 - RNA, 23 nt, Human
auguuauuauuagcagucuugcc

SEQ ID NO: 336711 - RNA, 23 nt, Human
aggcgagcucuucuccagcacgu

SEQ ID NO: 336712 - RNA, 23 nt, Human
cugcuguuuucuguaccugaagc

SEQ ID NO: 336713 - RNA, 22 nt, Human
gcagagaacccagcagauuggc

SEQ ID NO: 336714 - RNA, 22 nt, Human
uuugaaagcaccauuugaguag

SEQ ID NO: 336715 - RNA, 22 nt, Human
agcugccccaugagaggcaggu

SEQ ID NO: 336716 - RNA, 22 nt, Human
cugcuguggaugcaggaccuca

SEQ ID NO: 336717 - RNA, 22 nt, Human
cucuucuugccugaugaggcag

SEQ ID NO: 336718 - RNA, 22 nt, Human
uuucaguuuuugcucgauguau

SEQ ID NO: 336719 - RNA, 22 nt, Human
agcccaggaaguugaggcuugc

SEQ ID NO: 336720 - RNA, 22 nt, Human
ucacauucucagcaucuauaca

SEQ ID NO: 336721 - RNA, 22 nt, Human
ucuucaaguuccaaagugcagg

SEQ ID NO: 336722 - RNA, 22 nt, Human
uaaggccagccagcaaaucugu

SEQ ID NO: 336723 - RNA, 22 nt, Human
ugguauaaaacuuuuuauugaa

SEQ ID NO: 336724 - RNA, 22 nt, Human
agaggaugauuuuaaggacacu

SEQ ID NO: 336725 - RNA, 22 nt, Human
uaacacauauuucaagaguagu

SEQ ID NO: 336726 - RNA, 22 nt, Human
aaugucugccagaacugaucau

SEQ ID NO: 336727 - RNA, 22 nt, Human
guggcagcggugugcaaggagg

SEQ ID NO: 336728 - RNA, 22 nt, Human
acuucacagauauuuauuuggu

SEQ ID NO: 336729 - RNA, 22 nt, Human
uuguaugaucaaaagaaaugua

SEQ ID NO: 336730 - RNA, 22 nt, Human
gacccaggagagaggguugcau

SEQ ID NO: 336731 - RNA, 21 nt, Human
ucacagacuggucagugaggc

SEQ ID NO: 336732 - RNA, 19 nt, Human
augucuggguaacagcugc

SEQ ID NO: 336733 - RNA, 22 nt, Human
ccaggagacaaagaugacugcu

SEQ ID NO: 336734 - RNA, 21 nt, Human
ucucugugucuuuaagcugga

SEQ ID NO: 336735 - RNA, 22 nt, Human
acagucuacuugagcuuguaua

SEQ ID NO: 336736 - RNA, 22 nt, Human
caggauggccccggggcugugc

SEQ ID NO: 336737 - RNA, 22 nt, Human
gcucaggaucccaggggugugc

SEQ ID NO: 336738 - RNA, 19 nt, Human
cauuuuaagcauccccagu

SEQ ID NO: 336739 - RNA, 22 nt, Human
uggcagucuggguuggcaguua

SEQ ID NO: 336740 - RNA, 22 nt, Human
gccucugcaauuacauugugcc

SEQ ID NO: 336741 - RNA, 22 nt, Human
uuccaugaaggagacugagaag

SEQ ID NO: 336742 - RNA, 22 nt, Human
cucaaauauaagcuaaaugugg

SEQ ID NO: 336743 - RNA, 22 nt, Human
auucuucaccugagucagucua

SEQ ID NO: 336744 - RNA, 22 nt, Human
ucagcugcucaaauuuauguca

SEQ ID NO: 336745 - RNA, 23 nt, Human
uccaugagaugugggcuucuagu

SEQ ID NO: 336746 - RNA, 22 nt, Human
gagggagggaaaguuuaacacu

SEQ ID NO: 336747 - RNA, 22 nt, Human
uauuugcaacauaaaacucuga

SEQ ID NO: 336748 - RNA, 22 nt, Human
gagggagggccaggucccaacc

SEQ ID NO: 336749 - RNA, 22 nt, Human
cagggagggacaauugucaccu

SEQ ID NO: 336750 - RNA, 22 nt, Human
aggcaccuugagagcaggagcu

SEQ ID NO: 336751 - RNA, 22 nt, Human
ccugcugugaagccaggccugu

SEQ ID NO: 336752 - RNA, 22 nt, Human
ugcauuuccagauuucuggagu

SEQ ID NO: 336753 - RNA, 22 nt, Human
ucuuugaugugguuaauuauga

SEQ ID NO: 336754 - RNA, 22 nt, Human
uucuugaaucacuuuagagaua

SEQ ID NO: 336755 - RNA, 22 nt, Human
gcagcugcuggagggaggcagg

SEQ ID NO: 336756 - RNA, 23 nt, Human
uuucacaaugagcauuacagaau

SEQ ID NO: 336757 - RNA, 22 nt, Human
uuuccucauuuaucugcuggga

SEQ ID NO: 336758 - RNA, 22 nt, Human
ugcauaaagugccauaguauua

SEQ ID NO: 336759 - RNA, 21 nt, Human
uuugaaagcuacaucuauagc

SEQ ID NO: 336760 - RNA, 22 nt, Human
ucugggaauuuauuggcacuuu

SEQ ID NO: 336761 - RNA, 22 nt, Human
cauucacaucuuguuccaucac

SEQ ID NO: 336762 - RNA, 22 nt, Human
ugagaauuuucaguuucacuuu

SEQ ID NO: 336763 - RNA, 22 nt, Human
aauacauauggaauuccauguu

SEQ ID NO: 336764 - RNA, 22 nt, Human
ggagaggagcuauugggggcuc

SEQ ID NO: 336765 - RNA, 22 nt, Human
ugaggcaggaggauugcaggau

SEQ ID NO: 336766 - RNA, 22 nt, Human
agugcuuuccuucuugugacau

SEQ ID NO: 336767 - RNA, 22 nt, Human
uugaacugguaguuggaaaucu

SEQ ID NO: 336768 - RNA, 20 nt, Human
uuucuugucggcuguugcug

SEQ ID NO: 336769 - RNA, 22 nt, Human
uuuucauuguuccucgagcauu

SEQ ID NO: 336770 - RNA, 22 nt, Human
cagcauuuucuuaauguaggug

SEQ ID NO: 336771 - RNA, 22 nt, Human
cccaggagacugagcuguaacc

SEQ ID NO: 336772 - RNA, 22 nt, Human
ugaggcagugauguuuaagcac

SEQ ID NO: 336773 - RNA, 22 nt, Human
uucacaauggcaaaccauuaaa

SEQ ID NO: 336774 - RNA, 22 nt, Human
cauuuacacuucuaaccacaag

SEQ ID NO: 336775 - RNA, 20 nt, Human
ucauuucuugggguuccaag

SEQ ID NO: 336776 - RNA, 22 nt, Human
aaaacuaaauacgcuuugccuc

SEQ ID NO: 336777 - RNA, 22 nt, Human
gaggucaggcuugcagcagggu

SEQ ID NO: 336778 - RNA, 22 nt, Human
uauuucuucgggauucaagcua

SEQ ID NO: 336779 - RNA, 22 nt, Human
acccaggaggcagagguugcag

SEQ ID NO: 336780 - RNA, 22 nt, Human
uuauuuacaacucuucucuucc

SEQ ID NO: 336781 - RNA, 22 nt, Human
aaagacuuggcuuaugauuugc

SEQ ID NO: 336782 - RNA, 17 nt, Human
agagagagcaugccacc

SEQ ID NO: 336783 - RNA, 22 nt, Human
auaugagaguaaaugccgaucu

SEQ ID NO: 336784 - RNA, 23 nt, Human
cugcugugaaacaugguuuuggu

SEQ ID NO: 336785 - RNA, 22 nt, Human
ugucccucugaggcuucccugg

SEQ ID NO: 336786 - RNA, 22 nt, Human
uuuucauuguuacuaugagcua

SEQ ID NO: 336787 - RNA, 22 nt, Human
aaaguuugagugauuugacaca

SEQ ID NO: 336788 - RNA, 22 nt, Human
ccucaggaaccacauugcugcu

SEQ ID NO: 336789 - RNA, 22 nt, Human
uuccugagggacuuuugagauu

SEQ ID NO: 336790 - RNA, 22 nt, Human
ugucucugggugauucaguccu

SEQ ID NO: 336791 - RNA, 22 nt, Human
gauguguuuccaggauuuguuu

SEQ ID NO: 336792 - RNA, 22 nt, Human
acaaucauuccguucacaacag

SEQ ID NO: 336793 - RNA, 17 nt, Human
aaucuguuuacagucag

SEQ ID NO: 336794 - RNA, 22 nt, Human
agcuagaauauugaucugaaau

SEQ ID NO: 336795 - RNA, 22 nt, Human
gagccaaggguugccauggaga

SEQ ID NO: 336796 - RNA, 22 nt, Human
uuuuuauaacucuuuugugaca

SEQ ID NO: 336797 - RNA, 22 nt, Human
cagaguggcacucugcuggaug

SEQ ID NO: 336798 - RNA, 22 nt, Human
aauaacuucaguucuuacauua

SEQ ID NO: 336799 - RNA, 22 nt, Human
gcucucuugguggcuguccugg

SEQ ID NO: 336800 - RNA, 22 nt, Human
gcccaggaguugguggcugcag

SEQ ID NO: 336801 - RNA, 22 nt, Human
caggcaggucagugaagaagga

SEQ ID NO: 336802 - RNA, 21 nt, Human
uaaggccaagucuauuucugu

SEQ ID NO: 336803 - RNA, 22 nt, Human
auuguauaacagcauguauuuu

SEQ ID NO: 336804 - RNA, 22 nt, Human
uuucauaaccucaagcuacagu

SEQ ID NO: 336805 - RNA, 22 nt, Human
uucucagagcacugcugacaaa

SEQ ID NO: 336806 - RNA, 22 nt, Human
cauucacaaagcugauugaugg

SEQ ID NO: 336807 - RNA, 22 nt, Human
uuagaacugaagaagauuaagg

SEQ ID NO: 336808 - RNA, 17 nt, Human
ggcagcugugugcaugc

SEQ ID NO: 336809 - RNA, 22 nt, Human
uugaaagucacaauggcauuaa

SEQ ID NO: 336810 - RNA, 22 nt, Human
uaucuguuggcuccuaguugua

SEQ ID NO: 336811 - RNA, 22 nt, Human
uggcagcucuguucaacaugag

SEQ ID NO: 336812 - RNA, 22 nt, Human
uagaacauaagucauucauuug

SEQ ID NO: 336813 - RNA, 19 nt, Human
ucccaggaagcaaauguca

SEQ ID NO: 336814 - RNA, 20 nt, Human
cuguggaauuuuaccaugcg

SEQ ID NO: 336815 - RNA, 22 nt, Human
uucuuugaguuaguacagucca

SEQ ID NO: 336816 - RNA, 22 nt, Human
gccaggagaaugcuagcagagg

SEQ ID NO: 336817 - RNA, 22 nt, Human
gaggcagagaccuucaggaccu

SEQ ID NO: 336818 - RNA, 22 nt, Human
gucaggaugacaagugcuuuca

SEQ ID NO: 336819 - RNA, 22 nt, Human
uuguauuucuccacuuucuguu

SEQ ID NO: 336820 - RNA, 22 nt, Human
aggcagcuggaggcagagacua

SEQ ID NO: 336821 - RNA, 22 nt, Human
ggcuuggaaaugguaaugagcu

SEQ ID NO: 336822 - RNA, 22 nt, Human
ggcaggcaaugaggaugggaag

SEQ ID NO: 336823 - RNA, 22 nt, Human
ugaaaugagcauuuauucuuua

SEQ ID NO: 336824 - RNA, 22 nt, Human
ggauguugauugaauggccauu

SEQ ID NO: 336825 - RNA, 22 nt, Human
uauuucuaagagauaucuguac

SEQ ID NO: 336826 - RNA, 21 nt, Human
augugaaaccuuccacgcuga

SEQ ID NO: 336827 - RNA, 22 nt, Human
ggcagcuggggcagugcccugu

SEQ ID NO: 336828 - RNA, 22 nt, Human
aggcagcuuuguaguaaagcua

SEQ ID NO: 336829 - RNA, 21 nt, Human
gauuugcagaaacuagacagg

SEQ ID NO: 336830 - RNA, 23 nt, Human
ugaguucucaucuuggcuucuau

SEQ ID NO: 336831 - RNA, 22 nt, Human
uuucauuuugguuaugccauaa

SEQ ID NO: 336832 - RNA, 22 nt, Human
ugaugaaacugagguuccaaga

SEQ ID NO: 336833 - RNA, 22 nt, Human
aaggcagcagaggaaaggugcu

SEQ ID NO: 336834 - RNA, 22 nt, Human
augcuguggggagugaggguag

SEQ ID NO: 336835 - RNA, 22 nt, Human
agcugcccagcuaggaagaagg

SEQ ID NO: 336836 - RNA, 22 nt, Human
uccaggaggguuuucugccuuc

SEQ ID NO: 336837 - RNA, 22 nt, Human
agcccaggcagagggaugcuug

SEQ ID NO: 336838 - RNA, 17 nt, Human
ucauuuguugugacuag

SEQ ID NO: 336839 - RNA, 22 nt, Human
aaggcagccgugugacugcaug

SEQ ID NO: 336840 - RNA, 22 nt, Human
gcagaggacagggauuuagauu

SEQ ID NO: 336841 - RNA, 22 nt, Human
gacagaggcuggagcaccuccu

SEQ ID NO: 336842 - RNA, 17 nt, Human
uucaaagcuuaucaagg

SEQ ID NO: 336843 - RNA, 22 nt, Human
uuuuuaguagagguggguuuca

SEQ ID NO: 336844 - RNA, 22 nt, Human
aggcagcuggacauaacuaacc

SEQ ID NO: 336845 - RNA, 22 nt, Human
uaaaugaagaaauggagauugu

SEQ ID NO: 336846 - RNA, 22 nt, Human
uucauguguauggaacauuuuu

SEQ ID NO: 336847 - RNA, 22 nt, Human
accaggaggccuugguucugag

SEQ ID NO: 336848 - RNA, 22 nt, Human
uagcuagaaugcuucgugauau

SEQ ID NO: 336849 - RNA, 21 nt, Human
aggucagcccagcucuggaag

SEQ ID NO: 336850 - RNA, 22 nt, Human
gagaggaguuacuauuuccgag

SEQ ID NO: 336851 - RNA, 22 nt, Human
acauacuuaugcuaaaaauaua

SEQ ID NO: 336852 - RNA, 22 nt, Human
agcugccgaugcccagcugcau

SEQ ID NO: 336853 - RNA, 22 nt, Human
gaaauauugggacucagagcuu

SEQ ID NO: 336854 - RNA, 22 nt, Human
uuagcauuucaguacacauguu

SEQ ID NO: 336855 - RNA, 22 nt, Human
gcuguguuugacaguagcagac

SEQ ID NO: 336856 - RNA, 22 nt, Human
uuuucaguaaugucuacauaau

SEQ ID NO: 336857 - RNA, 22 nt, Human
acuucuucuucagcugggggau

SEQ ID NO: 336858 - RNA, 22 nt, Human
uacuuuuagccuauuugauucu

SEQ ID NO: 336859 - RNA, 19 nt, Human
gaggagcuaucggagacag

SEQ ID NO: 336860 - RNA, 22 nt, Human
aucuuucuccauauacaucuuu

SEQ ID NO: 336861 - RNA, 22 nt, Human
auguuagaaucucugaaugugg

SEQ ID NO: 336862 - RNA, 22 nt, Human
ugaaaugaaugugauucgauag

SEQ ID NO: 336863 - RNA, 22 nt, Human
ugcauauuguccuugauauuau

SEQ ID NO: 336864 - RNA, 22 nt, Human
uauucacaguugauuuacaguu

SEQ ID NO: 336865 - RNA, 22 nt, Human
gcaggaagcauagaagaaugcc

SEQ ID NO: 336866 - RNA, 22 nt, Human
ucugggaacugagcuccccuag

SEQ ID NO: 336867 - RNA, 22 nt, Human
ucugggaagcugcgugccuguu

SEQ ID NO: 336868 - RNA, 22 nt, Human
gaggaaccaaaucagcuugcac

SEQ ID NO: 336869 - RNA, 22 nt, Human
gugcuaaaggguuaugaacaag

SEQ ID NO: 336870 - RNA, 22 nt, Human
ucagccucucugaguccagacc

SEQ ID NO: 336871 - RNA, 22 nt, Human
uggcaguccccugugccuggaa

SEQ ID NO: 336872 - RNA, 22 nt, Human
uucagcaagaccaccauguacc

SEQ ID NO: 336873 - RNA, 22 nt, Human
uggagagguuuaaacaaaaguu

SEQ ID NO: 336874 - RNA, 22 nt, Human
aagcaccucuaugauugcuuuu

SEQ ID NO: 336875 - RNA, 20 nt, Human
agauuauuccuaagauuucu

SEQ ID NO: 336876 - RNA, 23 nt, Human
auguaucucauccaaggaagcuc

SEQ ID NO: 336877 - RNA, 22 nt, Human
agucugucugucacuucugcag

SEQ ID NO: 336878 - RNA, 23 nt, Human
cccaggagccugaguccucucug

SEQ ID NO: 336879 - RNA, 22 nt, Human
cuguguuugaugagaagccacc

SEQ ID NO: 336880 - RNA, 18 nt, Human
ugaggcagucagugaugg

SEQ ID NO: 336881 - RNA, 22 nt, Human
agguaggggguuugggaacugc

SEQ ID NO: 336882 - RNA, 22 nt, Human
gauuucuugauaauucaaaucc

SEQ ID NO: 336883 - RNA, 22 nt, Human
aguucacauaucuguuuuauuu

SEQ ID NO: 336884 - RNA, 22 nt, Human
cugguacaaaaugcugauauca

SEQ ID NO: 336885 - RNA, 22 nt, Human
uacaguaagaugaaauagcaau

SEQ ID NO: 336886 - RNA, 22 nt, Human
acuuggcaaguaucuauaaagu

SEQ ID NO: 336887 - RNA, 22 nt, Human
augugaaauagcuggauaugaa

SEQ ID NO: 336888 - RNA, 22 nt, Human
uggcagcuggagggcaauggcc

SEQ ID NO: 336889 - RNA, 22 nt, Human
cauagagugauguaagguaugu

SEQ ID NO: 336890 - RNA, 22 nt, Human
gaauagcuuccuuuuuuccaaa

SEQ ID NO: 336891 - RNA, 20 nt, Human
ucaggaugugcugagugaag

SEQ ID NO: 336892 - RNA, 22 nt, Human
auugaaagauuuugggcucaug

SEQ ID NO: 336893 - RNA, 22 nt, Human
acauauauuacuaguaaagaca

SEQ ID NO: 336894 - RNA, 22 nt, Human
gaggcagcagggcugguuccuu

SEQ ID NO: 336895 - RNA, 22 nt, Human
aggaagcugccugggaugggaa

SEQ ID NO: 336896 - RNA, 22 nt, Human
uuccaugaaauguguuaugcuu

SEQ ID NO: 336897 - RNA, 22 nt, Human
aauuuguuaaaagugagugaca

SEQ ID NO: 336898 - RNA, 21 nt, Human
agccuguugguuuacugcuca

SEQ ID NO: 336899 - RNA, 22 nt, Human
aucaggaugcugucaguuacca

SEQ ID NO: 336900 - RNA, 22 nt, Human
aucaggauagugguuaccuggg

SEQ ID NO: 336901 - RNA, 22 nt, Human
cugggaaauggcuucgagcuca

SEQ ID NO: 336902 - RNA, 22 nt, Human
uuaagauagaacccaguagucu

SEQ ID NO: 336903 - RNA, 22 nt, Human
augaaacacacacgcgcauacu

SEQ ID NO: 336904 - RNA, 22 nt, Human
cuuuuccacugagccucacaaa

SEQ ID NO: 336905 - RNA, 22 nt, Human
caguucuuauuuggccaguguc

SEQ ID NO: 336906 - RNA, 22 nt, Human
cacugagcugauagaauuccag

SEQ ID NO: 336907 - RNA, 22 nt, Human
ggaggaggggugacugaaugcu

SEQ ID NO: 336908 - RNA, 22 nt, Human
cagggaggcugucuuaugccug

SEQ ID NO: 336909 - RNA, 22 nt, Human
gcagaggccuagguggaaggcc

SEQ ID NO: 336910 - RNA, 22 nt, Human
gaggguggguuucuugcacguc

SEQ ID NO: 336911 - RNA, 22 nt, Human
ucuuuguaaaugccuagcauaa

SEQ ID NO: 336912 - RNA, 22 nt, Human
ucuuuggaucccaacuggcugg

SEQ ID NO: 336913 - RNA, 22 nt, Human
guucuucaggcugugcucuaga

SEQ ID NO: 336914 - RNA, 22 nt, Human
gaaggaggcguuagcccuagga

SEQ ID NO: 336915 - RNA, 22 nt, Human
augaguucaauuguuucaguca

SEQ ID NO: 336916 - RNA, 22 nt, Human
gggcagcuguaucugagcuuau

SEQ ID NO: 336917 - RNA, 22 nt, Human
ucuuugcaggccaaauuguuaa

SEQ ID NO: 336918 - RNA, 22 nt, Human
uucauuaguucugaagaugucu

SEQ ID NO: 336919 - RNA, 21 nt, Human
uuccagagauuguuucaccug

SEQ ID NO: 336920 - RNA, 21 nt, Human
uaugaacaugaccaauagucc

SEQ ID NO: 336921 - RNA, 22 nt, Human
auaagcauguuagaauauuuga

SEQ ID NO: 336922 - RNA, 22 nt, Human
auucuucacuguuucagaauga

SEQ ID NO: 336923 - RNA, 22 nt, Human
uucuucaacaaggacacuguua

SEQ ID NO: 336924 - RNA, 22 nt, Human
gcucaggagcucuugguggcgc

SEQ ID NO: 336925 - RNA, 22 nt, Human
cuucccagaccuuagagugcag

SEQ ID NO: 336926 - RNA, 22 nt, Human
uucuucucggcugucagauagu

SEQ ID NO: 336927 - RNA, 22 nt, Human
uuuuacuuaauucuuggucaug

SEQ ID NO: 336928 - RNA, 22 nt, Human
acauuuaaauaccuauguuucu

SEQ ID NO: 336929 - RNA, 20 nt, Human
aggcagcugggaaaugaggg

SEQ ID NO: 336930 - RNA, 22 nt, Human
uagcacaucuggcgcuuauagg

SEQ ID NO: 336931 - RNA, 22 nt, Human
gcagcuaccacccaggaaggac

SEQ ID NO: 336932 - RNA, 22 nt, Human
cccaggaguuagagguuguggu

SEQ ID NO: 336933 - RNA, 23 nt, Human
aguaaagcaauuguuggcgagag

SEQ ID NO: 336934 - RNA, 17 nt, Human
aaggccauuuccaccca

SEQ ID NO: 336935 - RNA, 22 nt, Human
uggagcugggguuugaaucugg

SEQ ID NO: 336936 - RNA, 22 nt, Human
ggggcagcucccgagggcagga

SEQ ID NO: 336937 - RNA, 22 nt, Human
agucucugucguagaucagcgu

SEQ ID NO: 336938 - RNA, 22 nt, Human
aaguauuucguucugaaaaagu

SEQ ID NO: 336939 - RNA, 22 nt, Human
aucugccugcaguggagguggg

SEQ ID NO: 336940 - RNA, 22 nt, Human
ucucaagaucucaagauggccc

SEQ ID NO: 336941 - RNA, 20 nt, Human
ccucaguguccuggacuggg

SEQ ID NO: 336942 - RNA, 19 nt, Human
uugaaagauuagcuuucua

SEQ ID NO: 336943 - RNA, 22 nt, Human
accaggagccauagagucaggc

SEQ ID NO: 336944 - RNA, 22 nt, Human
uuauuauuggugaguuaaggaa

SEQ ID NO: 336945 - RNA, 22 nt, Human
uagaagcaguaauagaaauagg

SEQ ID NO: 336946 - RNA, 22 nt, Human
gugcuuuuaaaggcaauuagua

SEQ ID NO: 336947 - RNA, 22 nt, Human
cucacugugccuuuucccaaac

SEQ ID NO: 336948 - RNA, 22 nt, Human
gagggagucugugcaaagaauu

SEQ ID NO: 336949 - RNA, 22 nt, Human
aaucauaauuguauacauucau

SEQ ID NO: 336950 - RNA, 22 nt, Human
ucucaggaucuaauacauggua

SEQ ID NO: 336951 - RNA, 22 nt, Human
gaaggccacaaaaaaugucaua

SEQ ID NO: 336952 - RNA, 22 nt, Human
ccacaucucgguccccucuuug

SEQ ID NO: 336953 - RNA, 22 nt, Human
aaaaacugcaauuacuuuuguc

SEQ ID NO: 336954 - RNA, 18 nt, Human
gagucuuuguuacugcug

SEQ ID NO: 336955 - RNA, 22 nt, Human
aguaugaauugcuuugccugua

SEQ ID NO: 336956 - RNA, 22 nt, Human
cucacuguuuaauagcuggauc

SEQ ID NO: 336957 - RNA, 22 nt, Human
cagcuggccccacaguagaggc

SEQ ID NO: 336958 - RNA, 22 nt, Human
aggcagaucacuugaggccagg

SEQ ID NO: 336959 - RNA, 22 nt, Human
uggcagcuauggucuaagggcc

SEQ ID NO: 336960 - RNA, 22 nt, Human
gggcagcuggauaguuuuaaau

SEQ ID NO: 336961 - RNA, 22 nt, Human
aucaggauguuuggcugucaua

SEQ ID NO: 336962 - RNA, 22 nt, Human
uucaggaugaaagugugcaaca

SEQ ID NO: 336963 - RNA, 22 nt, Human
agucuuuccugcuugacuguuc

SEQ ID NO: 336964 - RNA, 22 nt, Human
ugaggcagguggauuacaaggu

SEQ ID NO: 336965 - RNA, 22 nt, Human
auagcuguuagauuggggucga

SEQ ID NO: 336966 - RNA, 22 nt, Human
augaggcauuccacucaaacuc

SEQ ID NO: 336967 - RNA, 22 nt, Human
gagagucuaggaaccucauaua

SEQ ID NO: 336968 - RNA, 22 nt, Human
aagauuauggcagauaacaauu

SEQ ID NO: 336969 - RNA, 19 nt, Human
uuugcagugguuccuuugu

SEQ ID NO: 336970 - RNA, 22 nt, Human
cauuuccagcuccugcaucaug

SEQ ID NO: 336971 - RNA, 22 nt, Human
augcuguguggccaccuccaug

SEQ ID NO: 336972 - RNA, 22 nt, Human
gcuguucucuguaacaugcauu

SEQ ID NO: 336973 - RNA, 22 nt, Human
cauggagauaaacugaaauauu

SEQ ID NO: 336974 - RNA, 22 nt, Human
cccaggaaaagcagugccagca

SEQ ID NO: 336975 - RNA, 22 nt, Human
cggcagcugauugcagagcacc

SEQ ID NO: 336976 - RNA, 22 nt, Human
caggcagcucugcuuuuccuaa

SEQ ID NO: 336977 - RNA, 22 nt, Human
cagaaggcuuuguggaguagac

SEQ ID NO: 336978 - RNA, 18 nt, Human
gaggcagcuagcaauuuu

SEQ ID NO: 336979 - RNA, 22 nt, Human
augugaaaauccaauggcagca

SEQ ID NO: 336980 - RNA, 19 nt, Human
uuugaaaggauuguuauuu

SEQ ID NO: 336981 - RNA, 22 nt, Human
guuaugaaauaaauauagauca

SEQ ID NO: 336982 - RNA, 22 nt, Human
cgaggcaggcaggcggaggaua

SEQ ID NO: 336983 - RNA, 22 nt, Human
uucauucuugggaucagagagu

SEQ ID NO: 336984 - RNA, 22 nt, Human
auguaugaagcuuuguuuggga

SEQ ID NO: 336985 - RNA, 22 nt, Human
aaggccagacaggaccacaucu

SEQ ID NO: 336986 - RNA, 22 nt, Human
uaauuauucuagucacauagca

SEQ ID NO: 336987 - RNA, 22 nt, Human
uccaugagggacacuggaugcu

SEQ ID NO: 336988 - RNA, 22 nt, Human
uacaaagucacauugaaaugaa

SEQ ID NO: 336989 - RNA, 22 nt, Human
uacucagagucauugcccuucu

SEQ ID NO: 336990 - RNA, 22 nt, Human
auguagaagugggcauuauaga

SEQ ID NO: 336991 - RNA, 22 nt, Human
caaaugauacuguuuuuagucu

SEQ ID NO: 336992 - RNA, 22 nt, Human
uggaaauacuugccauaaaacu

SEQ ID NO: 336993 - RNA, 22 nt, Human
gauuuuauuagcccaaacuuug

SEQ ID NO: 336994 - RNA, 21 nt, Human
uuagaaagcucacuacaguua

SEQ ID NO: 336995 - RNA, 22 nt, Human
aggcaccuugcgguccagugaa

SEQ ID NO: 336996 - RNA, 22 nt, Human
auuacucugucugccucugacc

SEQ ID NO: 336997 - RNA, 22 nt, Human
aaaccgcaauuacuuuugcguc

SEQ ID NO: 336998 - RNA, 22 nt, Human
cucuggcuucuaccuugcaguu

SEQ ID NO: 336999 - RNA, 23 nt, Human
ucguugaauagcaauagcacaac

SEQ ID NO: 337000 - RNA, 22 nt, Human
cagagggcacaugguuuccuca

SEQ ID NO: 337001 - RNA, 22 nt, Human
ugcaggaaauuccaggguggcc

SEQ ID NO: 337002 - RNA, 22 nt, Human
uggaaauggaucugaugagucu

SEQ ID NO: 337003 - RNA, 22 nt, Human
gagcagcucugugccuggagac

SEQ ID NO: 337004 - RNA, 22 nt, Human
uccugagagcagcugcuuugga

SEQ ID NO: 337005 - RNA, 22 nt, Human
augcugucgaaaccaaacaucu

SEQ ID NO: 337006 - RNA, 18 nt, Human
acacugcagcagucugcu

SEQ ID NO: 337007 - RNA, 22 nt, Human
cucuccucugaaguggugaccc

SEQ ID NO: 337008 - RNA, 22 nt, Human
cuuucauucuuagauauuagug

SEQ ID NO: 337009 - RNA, 22 nt, Human
gggcagcucuggcugugggaag

SEQ ID NO: 337010 - RNA, 22 nt, Human
uguguaaagcuuguuccagaaa

SEQ ID NO: 337011 - RNA, 22 nt, Human
uuagaaagaacuuuagauauca

SEQ ID NO: 337012 - RNA, 22 nt, Human
agaaaugacaagacugaucagg

SEQ ID NO: 337013 - RNA, 21 nt, Human
gauuuuaaagagacugccaca

SEQ ID NO: 337014 - RNA, 23 nt, Human
acacauuuuucccguucugaggu

SEQ ID NO: 337015 - RNA, 22 nt, Human
caggcagcucaaccuugggagc

SEQ ID NO: 337016 - RNA, 22 nt, Human
ccucacugaagaggugacauuu

SEQ ID NO: 337017 - RNA, 22 nt, Human
acacuaaugagaaaggaauuaa

SEQ ID NO: 337018 - RNA, 22 nt, Human
aaaggaagaugccaggacucug

SEQ ID NO: 337019 - RNA, 22 nt, Human
auguuagaaggaauguuaaaag

SEQ ID NO: 337020 - RNA, 22 nt, Human
cccaggagagaggggauaaagc

SEQ ID NO: 337021 - RNA, 22 nt, Human
uucaucaauguguuuaauaaug

SEQ ID NO: 337022 - RNA, 22 nt, Human
uguaaaaccaaaucaaucuagu

SEQ ID NO: 337023 - RNA, 22 nt, Human
ccugcuguaaugugucuuuauu

SEQ ID NO: 337024 - RNA, 22 nt, Human
agaauaugaucggaauacagau

SEQ ID NO: 337025 - RNA, 22 nt, Human
cagagccauuauggagacuugc

SEQ ID NO: 337026 - RNA, 22 nt, Human
ggggggugcugaucaguggagc

SEQ ID NO: 337027 - RNA, 22 nt, Human
uauaauuuaucaugucacaguu

SEQ ID NO: 337028 - RNA, 22 nt, Human
aucauucuaguccuuauggucu

SEQ ID NO: 337029 - RNA, 22 nt, Human
acccaggacaugggcacccgug

SEQ ID NO: 337030 - RNA, 22 nt, Human
ucaggauaaaauguaauggcaa

SEQ ID NO: 337031 - RNA, 22 nt, Human
gaugccuccaaaugagggcaga

SEQ ID NO: 337032 - RNA, 22 nt, Human
uuuagacauggcuugcucacuu

SEQ ID NO: 337033 - RNA, 22 nt, Human
gcccaggaguugaagggcugac

SEQ ID NO: 337034 - RNA, 22 nt, Human
cauuuguaucauauguaucuua

SEQ ID NO: 337035 - RNA, 22 nt, Human
aggggcucaaagugugcaggga

SEQ ID NO: 337036 - RNA, 19 nt, Human
cauuuagaaguacauauua

SEQ ID NO: 337037 - RNA, 22 nt, Human
uuugaaauuaagauauugucca

SEQ ID NO: 337038 - RNA, 22 nt, Human
cccaggagaauauuuuuggguc

SEQ ID NO: 337039 - RNA, 22 nt, Human
cccuggaggcuggaggcaguag

SEQ ID NO: 337040 - RNA, 22 nt, Human
uugaauaguguuuucaguauac

SEQ ID NO: 337041 - RNA, 22 nt, Human
gaggacagagccgccuggcaag

SEQ ID NO: 337042 - RNA, 20 nt, Human
augugaaagaucaguugucu

SEQ ID NO: 337043 - RNA, 22 nt, Human
gauuuuaauuauaggagguccu

SEQ ID NO: 337044 - RNA, 22 nt, Human
acugcuuuaucugagaaguccu

SEQ ID NO: 337045 - RNA, 22 nt, Human
caggagaggaggcuacuucuua

SEQ ID NO: 337046 - RNA, 21 nt, Human
ucuagaauccuguauaagacu

SEQ ID NO: 337047 - RNA, 20 nt, Human
cagaggcaaggagacuugga

SEQ ID NO: 337048 - RNA, 22 nt, Human
uucauucuugucuuuguauagu

SEQ ID NO: 337049 - RNA, 22 nt, Human
uucuucaaauagcagggaguca

SEQ ID NO: 337050 - RNA, 22 nt, Human
cuucugcaauaaguuuuggucc

SEQ ID NO: 337051 - RNA, 22 nt, Human
guugaaagagcauggacuugaa

SEQ ID NO: 337052 - RNA, 22 nt, Human
uucauucugggcucuaaggaac

SEQ ID NO: 337053 - RNA, 22 nt, Human
gaccauuugcuaguaaauugca

SEQ ID NO: 337054 - RNA, 22 nt, Human
ggaccuggcaauuugcaucucu

SEQ ID NO: 337055 - RNA, 22 nt, Human
ggcagcuuucaauaggguuaug

SEQ ID NO: 337056 - RNA, 20 nt, Human
ugaaggccauuuguuccaga

SEQ ID NO: 337057 - RNA, 22 nt, Human
aauguaugugauuauuccucua

SEQ ID NO: 337058 - RNA, 22 nt, Human
aggacaggauugagcugaacug

SEQ ID NO: 337059 - RNA, 22 nt, Human
cuccccagguucaggagguggg

SEQ ID NO: 337060 - RNA, 22 nt, Human
cccaggugcugcgugaagccuc

SEQ ID NO: 337061 - RNA, 22 nt, Human
uugcagcugcaguaaauguuca

SEQ ID NO: 337062 - RNA, 20 nt, Human
gcucccagccugcagucccc

SEQ ID NO: 337063 - RNA, 22 nt, Human
agauggagaaugacaauuaagg

SEQ ID NO: 337064 - RNA, 21 nt, Human
agcagaggggacauguuugau

SEQ ID NO: 337065 - RNA, 22 nt, Human
augucaaaucaguuuuaucaga

SEQ ID NO: 337066 - RNA, 22 nt, Human
gcucccagcaauugaggcagcc

SEQ ID NO: 337067 - RNA, 22 nt, Human
auccaugaucaauuuauuacua

SEQ ID NO: 337068 - RNA, 22 nt, Human
gugauuuugagaccuauauagu

SEQ ID NO: 337069 - RNA, 22 nt, Human
ugcaggaaucagaggggaagcg

SEQ ID NO: 337070 - RNA, 22 nt, Human
uaaaaugaucucucauguucuu

SEQ ID NO: 337071 - RNA, 22 nt, Human
guucucucugcuuccaagaugg

SEQ ID NO: 337072 - RNA, 22 nt, Human
gaucauuuugaugcccuuuuag

SEQ ID NO: 337073 - RNA, 22 nt, Human
caggggaguuuuaugcaacaga

SEQ ID NO: 337074 - RNA, 22 nt, Human
aggaagcuccaugaaggcagag

SEQ ID NO: 337075 - RNA, 22 nt, Human
uguucuucuagauugccuuuua

SEQ ID NO: 337076 - RNA, 22 nt, Human
acccaggagccgugagagguua

SEQ ID NO: 337077 - RNA, 22 nt, Human
uauuauuaaauggcagaauuuu

SEQ ID NO: 337078 - RNA, 22 nt, Human
ugaggcaggagguugagaacug

SEQ ID NO: 337079 - RNA, 22 nt, Human
ggcaggcugggugucauggagu

SEQ ID NO: 337080 - RNA, 22 nt, Human
gucaaaaaguagucauuucugu

SEQ ID NO: 337081 - RNA, 22 nt, Human
ucuuugcaaauguuauuaucuu

SEQ ID NO: 337082 - RNA, 22 nt, Human
cccauugugguuguugaggaua

SEQ ID NO: 337083 - RNA, 17 nt, Human
ugaaggccaugaccacg

SEQ ID NO: 337084 - RNA, 22 nt, Human
uuuaaaauuuagaccucuccac

SEQ ID NO: 337085 - RNA, 22 nt, Human
caaggccacugcucagguuucc

SEQ ID NO: 337086 - RNA, 22 nt, Human
gguauaaaugaucagaucgcug

SEQ ID NO: 337087 - RNA, 21 nt, Human
auggagggaccagggaagcag

SEQ ID NO: 337088 - RNA, 22 nt, Human
gcucccagacugaccagaggug

SEQ ID NO: 337089 - RNA, 20 nt, Human
agcuucuucugucuaauuuu

SEQ ID NO: 337090 - RNA, 22 nt, Human
cccaggagauggagguugcagu

SEQ ID NO: 337091 - RNA, 21 nt, Human
agggagcuggccacacagccu

SEQ ID NO: 337092 - RNA, 22 nt, Human
ggagaggggcaaguuuaucuag

SEQ ID NO: 337093 - RNA, 22 nt, Human
aauccugugugacucuggggag

SEQ ID NO: 337094 - RNA, 22 nt, Human
accaggaguaacagugaguggu

SEQ ID NO: 337095 - RNA, 22 nt, Human
uucagcaaacacgaugcuuguu

SEQ ID NO: 337096 - RNA, 22 nt, Human
uugugcucuguguuauuuaagg

SEQ ID NO: 337097 - RNA, 22 nt, Human
uauucacaggcacgaaauauug

SEQ ID NO: 337098 - RNA, 20 nt, Human
uuucacaaugaacaugucuc

SEQ ID NO: 337099 - RNA, 22 nt, Human
uuauuugcccauguuuagcaga

SEQ ID NO: 337100 - RNA, 19 nt, Human
caaggccaccauuucuccg

SEQ ID NO: 337101 - RNA, 22 nt, Human
gagggaggugauacugaacgua

SEQ ID NO: 337102 - RNA, 22 nt, Human
uuugacauggaauaacucauuu

SEQ ID NO: 337103 - RNA, 22 nt, Human
uauucaaaguaccuucauugcc

SEQ ID NO: 337104 - RNA, 22 nt, Human
auuucauacuaaggcucaaaaa

SEQ ID NO: 337105 - RNA, 22 nt, Human
gaccuggaggauccucuucuug

SEQ ID NO: 337106 - RNA, 19 nt, Human
agcauuuggaauucuacac

SEQ ID NO: 337107 - RNA, 22 nt, Human
cuucucagaggccagaagcuau

SEQ ID NO: 337108 - RNA, 22 nt, Human
ucuuaaagagcgcaauuugagg

SEQ ID NO: 337109 - RNA, 19 nt, Human
caggagagcaugcacuuug

SEQ ID NO: 337110 - RNA, 22 nt, Human
acagaaauugggcaaauggaag

SEQ ID NO: 337111 - RNA, 22 nt, Human
ucucaaaucaaacuuugagcuu

SEQ ID NO: 337112 - RNA, 22 nt, Human
acuuaaaaagaaucuuuucacg

SEQ ID NO: 337113 - RNA, 22 nt, Human
agguauaagucucauuucuguu

SEQ ID NO: 337114 - RNA, 22 nt, Human
ucagugugaguaccaugcucag

SEQ ID NO: 337115 - RNA, 22 nt, Human
ucucuucuagcuucuugugguu

SEQ ID NO: 337116 - RNA, 22 nt, Human
uagaauucaagauucaacaggc

SEQ ID NO: 337117 - RNA, 18 nt, Human
guaggucaguaccaagca

SEQ ID NO: 337118 - RNA, 20 nt, Human
cugcugugauucccuccucc

SEQ ID NO: 337119 - RNA, 22 nt, Human
uuucuucucgacaccuuauccc

SEQ ID NO: 337120 - RNA, 22 nt, Human
gaucuucucuuuaguagaaaca

SEQ ID NO: 337121 - RNA, 22 nt, Human
uuuauuugaaucaggggagaau

SEQ ID NO: 337122 - RNA, 22 nt, Human
ugucaaauuuuuauugcaguau

SEQ ID NO: 337123 - RNA, 22 nt, Human
cugcuguguuucugcuagaaaa

SEQ ID NO: 337124 - RNA, 22 nt, Human
caguucuuuguggggaguucuc

SEQ ID NO: 337125 - RNA, 18 nt, Human
ugucauaauauaucaccu

SEQ ID NO: 337126 - RNA, 22 nt, Human
gggaggugauuaggaccaugua

SEQ ID NO: 337127 - RNA, 22 nt, Human
ccucacugcuauguguuugcuc

SEQ ID NO: 337128 - RNA, 22 nt, Human
ugucuucaucuccaugcacaga

SEQ ID NO: 337129 - RNA, 22 nt, Human
gugcugugcgcuuuuucuguau

SEQ ID NO: 337130 - RNA, 22 nt, Human
gaacacauuucucugacuguag

SEQ ID NO: 337131 - RNA, 22 nt, Human
ugaaacuucuaauaugaauagu

SEQ ID NO: 337132 - RNA, 21 nt, Human
ccaggaaggacugagcucccu

SEQ ID NO: 337133 - RNA, 22 nt, Human
uguuagaaguuaaucacuaauu

SEQ ID NO: 337134 - RNA, 22 nt, Human
gucccaggugggcuccaccucu

SEQ ID NO: 337135 - RNA, 22 nt, Human
gcucaggaaauaguuuaguguu

SEQ ID NO: 337136 - RNA, 22 nt, Human
cccgggaggaggaaguugcagu

SEQ ID NO: 337137 - RNA, 22 nt, Human
guucuucaucuuaaccaucugu

SEQ ID NO: 337138 - RNA, 19 nt, Human
ugcaagcuuuuucuuguua

SEQ ID NO: 337139 - RNA, 22 nt, Human
uuaacaauagaguuucuucagg

SEQ ID NO: 337140 - RNA, 22 nt, Human
ugaaucugauuucccuggaggc

SEQ ID NO: 337141 - RNA, 22 nt, Human
uuguaugaauguauccuaauuu

SEQ ID NO: 337142 - RNA, 20 nt, Human
aggcaguuagaaggagauga

SEQ ID NO: 337143 - RNA, 22 nt, Human
uagcuguguaagcuugguaaga

SEQ ID NO: 337144 - RNA, 22 nt, Human
uucugucacuugcaaucaagag

SEQ ID NO: 337145 - RNA, 22 nt, Human
uuucucugcugccugugucgau

SEQ ID NO: 337146 - RNA, 22 nt, Human
gagggaggggagcuccacccuc

SEQ ID NO: 337147 - RNA, 22 nt, Human
uuucuuaguccuagagugauuu

SEQ ID NO: 337148 - RNA, 22 nt, Human
uagaaaugaauguuuaaaaguc

SEQ ID NO: 337149 - RNA, 22 nt, Human
aggcaggcuggucugaagagug

SEQ ID NO: 337150 - RNA, 22 nt, Human
guacauuucucuuguucuuauu

SEQ ID NO: 337151 - RNA, 22 nt, Human
gauuucuuuagguguaauagug

SEQ ID NO: 337152 - RNA, 22 nt, Human
aaaggccacacugcucuuucuc

SEQ ID NO: 337153 - RNA, 22 nt, Human
aaauuaguacauugcaaagucc

SEQ ID NO: 337154 - RNA, 22 nt, Human
uggaaggagacugggaagugug

SEQ ID NO: 337155 - RNA, 22 nt, Human
ggaggggagauguuugggcuca

SEQ ID NO: 337156 - RNA, 22 nt, Human
ggagggaaugucuagcauucuu

SEQ ID NO: 337157 - RNA, 22 nt, Human
gggcagcuccuguggaauccac

SEQ ID NO: 337158 - RNA, 22 nt, Human
ucauuauccuaguaucuugaau

SEQ ID NO: 337159 - RNA, 22 nt, Human
acagucucuccacacugcaggg

SEQ ID NO: 337160 - RNA, 22 nt, Human
guucuucaguaaaauuaaaugu

SEQ ID NO: 337161 - RNA, 22 nt, Human
ucuuucaaugagcauucuuucc

SEQ ID NO: 337162 - RNA, 21 nt, Human
aaaggccauaaucacggagca

SEQ ID NO: 337163 - RNA, 22 nt, Human
cuguuucaagugaagucagaca

SEQ ID NO: 337164 - RNA, 22 nt, Human
ugaggcagaguaagauacauga

SEQ ID NO: 337165 - RNA, 22 nt, Human
uggcagcuuccugcucauagga

SEQ ID NO: 337166 - RNA, 18 nt, Human
agaggggagguaagucug

SEQ ID NO: 337167 - RNA, 22 nt, Human
cucagaagccuucagucuuggc

SEQ ID NO: 337168 - RNA, 22 nt, Human
uugaacaguccuaagagacccu

SEQ ID NO: 337169 - RNA, 22 nt, Human
cuugcaggauuuugcugcugua

SEQ ID NO: 337170 - RNA, 22 nt, Human
auguucuuccaaaucuguaaca

SEQ ID NO: 337171 - RNA, 22 nt, Human
gauuucuuugcaagcuguguuc

SEQ ID NO: 337172 - RNA, 21 nt, Human
agccagcuaucacacagcauu

SEQ ID NO: 337173 - RNA, 22 nt, Human
auugcuguggaaauauaagaug

SEQ ID NO: 337174 - RNA, 20 nt, Human
cugagagucugugcuuaguc

SEQ ID NO: 337175 - RNA, 19 nt, Human
uuuuccuucuauauguuuc

SEQ ID NO: 337176 - RNA, 22 nt, Human
auugcuaggaacagguugcacc

SEQ ID NO: 337177 - RNA, 22 nt, Human
auuucacucauucauguuacuu

SEQ ID NO: 337178 - RNA, 22 nt, Human
uguacuaaggcuguguagaugu

SEQ ID NO: 337179 - RNA, 22 nt, Human
aggcggcugguguccugcaggu

SEQ ID NO: 337180 - RNA, 22 nt, Human
auuggcagaaacagcagggcca

SEQ ID NO: 337181 - RNA, 22 nt, Human
ucauuguuucugcuuuucauga

SEQ ID NO: 337182 - RNA, 22 nt, Human
agaccgagaaguucuccaggcc

SEQ ID NO: 337183 - RNA, 21 nt, Human
agucuguuaggaugacucuga

SEQ ID NO: 337184 - RNA, 22 nt, Human
cugcuguguaucauuuuagaug

SEQ ID NO: 337185 - RNA, 22 nt, Human
cuucuucaaccugaaaguuuca

SEQ ID NO: 337186 - RNA, 22 nt, Human
caaggccaaagggccacuguca

SEQ ID NO: 337187 - RNA, 22 nt, Human
uggagacucugcaucugugaca

SEQ ID NO: 337188 - RNA, 22 nt, Human
ugugugucagagucuccauggu

SEQ ID NO: 337189 - RNA, 22 nt, Human
ugaaaugagauagauaaucagg

SEQ ID NO: 337190 - RNA, 22 nt, Human
aagccgaggccacacagcagga

SEQ ID NO: 337191 - RNA, 22 nt, Human
augcugugaaaaagaaggcuga

SEQ ID NO: 337192 - RNA, 22 nt, Human
augugaaacugaagcauccaua

SEQ ID NO: 337193 - RNA, 22 nt, Human
uggaggggcaauggagcgcgga

SEQ ID NO: 337194 - RNA, 22 nt, Human
uaacacauaagcugagaccaug

SEQ ID NO: 337195 - RNA, 22 nt, Human
caguggagagacuuuuacucuu

SEQ ID NO: 337196 - RNA, 22 nt, Human
gauggcagguaguggucucauc

SEQ ID NO: 337197 - RNA, 22 nt, Human
agucuugcucuugcaucugcuu

SEQ ID NO: 337198 - RNA, 22 nt, Human
acaaaugugucuaauugugccu

SEQ ID NO: 337199 - RNA, 23 nt, Human
cccaggaguuucacugcaaaggu

SEQ ID NO: 337200 - RNA, 22 nt, Human
uagcugcugcagcacagggagg

SEQ ID NO: 337201 - RNA, 22 nt, Human
aaccauuugcaguuacugagac

SEQ ID NO: 337202 - RNA, 22 nt, Human
gagggccagcagccucagcaug

SEQ ID NO: 337203 - RNA, 22 nt, Human
ggcagaggaaggaugaauucac

SEQ ID NO: 337204 - RNA, 19 nt, Human
agaaguuagacauugcaau

SEQ ID NO: 337205 - RNA, 22 nt, Human
ucaggaauccagacagggcaca

SEQ ID NO: 337206 - RNA, 22 nt, Human
cggcagcucgagggccacccgu

SEQ ID NO: 337207 - RNA, 22 nt, Human
guuuuucuuugugugaagacaa

SEQ ID NO: 337208 - RNA, 23 nt, Human
aaaguuugaagcaacaguaguug

SEQ ID NO: 337209 - RNA, 22 nt, Human
gccaggagagcuccuucagguu

SEQ ID NO: 337210 - RNA, 22 nt, Human
cuucucagucaccugugagucu

SEQ ID NO: 337211 - RNA, 22 nt, Human
gaggcgagaagcuggagauggu

SEQ ID NO: 337212 - RNA, 22 nt, Human
ucuuugaauuucugacugucuu

SEQ ID NO: 337213 - RNA, 22 nt, Human
auuccaguuggguucuaauaca

SEQ ID NO: 337214 - RNA, 22 nt, Human
ugaaacauugcacuguaugaau

SEQ ID NO: 337215 - RNA, 22 nt, Human
gucaggauuuacaaacuucagu

SEQ ID NO: 337216 - RNA, 22 nt, Human
uucuucaguguagcaacuguau

SEQ ID NO: 337217 - RNA, 22 nt, Human
aggcagaggagaaugaucuucc

SEQ ID NO: 337218 - RNA, 22 nt, Human
cagguaaaaauaaauuugugag

SEQ ID NO: 337219 - RNA, 22 nt, Human
ugccaggauggccagggggcca

SEQ ID NO: 337220 - RNA, 22 nt, Human
acaccauacucauguugguucc

SEQ ID NO: 337221 - RNA, 22 nt, Human
uauuuucuggacagucuugcuu

SEQ ID NO: 337222 - RNA, 22 nt, Human
ugcccacauggugccauggcca

SEQ ID NO: 337223 - RNA, 22 nt, Human
ucgagcucuggagccaaggaug

SEQ ID NO: 337224 - RNA, 19 nt, Human
cuugcugggugguuucugc

SEQ ID NO: 337225 - RNA, 22 nt, Human
uguaugaaguuacugagccucu

SEQ ID NO: 337226 - RNA, 22 nt, Human
guguaugaacgaaagaauggau

SEQ ID NO: 337227 - RNA, 22 nt, Human
cuugcugucccuugguaugaac

SEQ ID NO: 337228 - RNA, 20 nt, Human
accaauguuagcuuaguacu

SEQ ID NO: 337229 - RNA, 22 nt, Human
gcagcugaaagggaucucuaca

SEQ ID NO: 337230 - RNA, 22 nt, Human
aguaaaaauugaggugcaaaau

SEQ ID NO: 337231 - RNA, 19 nt, Human
uauggcaggccgaggcacu

SEQ ID NO: 337232 - RNA, 22 nt, Human
cugaacuuauugagugcuugcu

SEQ ID NO: 337233 - RNA, 22 nt, Human
uuucaguguaucuuccaaaagc

SEQ ID NO: 337234 - RNA, 22 nt, Human
accaggagguguuugcucaagu

SEQ ID NO: 337235 - RNA, 22 nt, Human
gcuggcagggacagcugcgugu

SEQ ID NO: 337236 - RNA, 22 nt, Human
uguggaaaauuggaacguuccu

SEQ ID NO: 337237 - RNA, 22 nt, Human
cuuaagauuugagauaccuaau

SEQ ID NO: 337238 - RNA, 22 nt, Human
uuuacaaccucauauucugaug

SEQ ID NO: 337239 - RNA, 22 nt, Human
caggagauguaagacuucuguu

SEQ ID NO: 337240 - RNA, 22 nt, Human
gaagcagcugccagagaugucu

SEQ ID NO: 337241 - RNA, 22 nt, Human
uugcacuaggaaaaggcagcca

SEQ ID NO: 337242 - RNA, 22 nt, Human
guuuucaauuauaagauggcuu

SEQ ID NO: 337243 - RNA, 22 nt, Human
ucugcugugauuugcuaccugu

SEQ ID NO: 337244 - RNA, 22 nt, Human
cugagacuuucaugugcuuuua

SEQ ID NO: 337245 - RNA, 20 nt, Human
gggcaguucaaugccacucu

SEQ ID NO: 337246 - RNA, 22 nt, Human
uggcagcuguguccagguagaa

SEQ ID NO: 337247 - RNA, 22 nt, Human
uuugaagucagacacugcuuug

SEQ ID NO: 337248 - RNA, 22 nt, Human
uucaggaugcucagaguagucu

SEQ ID NO: 337249 - RNA, 22 nt, Human
aguacauauaguaauuuagcca

SEQ ID NO: 337250 - RNA, 22 nt, Human
aggcuagcaaugggagaugagu

SEQ ID NO: 337251 - RNA, 22 nt, Human
cuggaggcacccuuagagaggc

SEQ ID NO: 337252 - RNA, 22 nt, Human
ucuuagcacagcuauauaaguu

SEQ ID NO: 337253 - RNA, 22 nt, Human
gagaggaguagacacuuugguu

SEQ ID NO: 337254 - RNA, 22 nt, Human
cucuuucugauucgcugggacc

SEQ ID NO: 337255 - RNA, 22 nt, Human
ugaugaaaauaugauucugagg

SEQ ID NO: 337256 - RNA, 22 nt, Human
uauuuccaagcugaauccaaug

SEQ ID NO: 337257 - RNA, 22 nt, Human
ggaggcagaauagagugugggu

SEQ ID NO: 337258 - RNA, 22 nt, Human
ugauuuccuaggucuggagaag

SEQ ID NO: 337259 - RNA, 22 nt, Human
uuguugguggaauugaugcuag

SEQ ID NO: 337260 - RNA, 22 nt, Human
cggaggggauacauuuucugaa

SEQ ID NO: 337261 - RNA, 22 nt, Human
ucccaggaugugcgugccgccg

SEQ ID NO: 337262 - RNA, 22 nt, Human
gauugaaacauaggcagucgag

SEQ ID NO: 337263 - RNA, 22 nt, Human
aucuugcauuugcuaaaaugca

SEQ ID NO: 337264 - RNA, 22 nt, Human
aaggcagccagauccuuugggu

SEQ ID NO: 337265 - RNA, 22 nt, Human
agcucccagagcucgagaguaa

SEQ ID NO: 337266 - RNA, 22 nt, Human
aaaaugaugcuguaauuuggca

SEQ ID NO: 337267 - RNA, 22 nt, Human
cugaaugaggaaaagagugagg

SEQ ID NO: 337268 - RNA, 22 nt, Human
ccucaugguacuuacuguagcu

SEQ ID NO: 337269 - RNA, 22 nt, Human
gaggcagcugggcuggugguuu

SEQ ID NO: 337270 - RNA, 22 nt, Human
aagcaauagcaacaacuuuaca

SEQ ID NO: 337271 - RNA, 22 nt, Human
ggcagcugucucugaguuagca

SEQ ID NO: 337272 - RNA, 22 nt, Human
uuugaaagucaaccuuccaguu

SEQ ID NO: 337273 - RNA, 22 nt, Human
cucccaggguagggagagacua

SEQ ID NO: 337274 - RNA, 22 nt, Human
gugauaaagacgugucauaauu

SEQ ID NO: 337275 - RNA, 22 nt, Human
uaucuguuaugggcugaauugc

SEQ ID NO: 337276 - RNA, 19 nt, Human
uagaggagaagggaagugg

SEQ ID NO: 337277 - RNA, 22 nt, Human
cucaggauugugccuagggaga

SEQ ID NO: 337278 - RNA, 22 nt, Human
agcccaggaaucugcaucuuga

SEQ ID NO: 337279 - RNA, 22 nt, Human
gaaggccacuuuguguugagaa

SEQ ID NO: 337280 - RNA, 19 nt, Human
acauuuaaauucagaucuc

SEQ ID NO: 337281 - RNA, 22 nt, Human
acaggccacaguggagucucug

SEQ ID NO: 337282 - RNA, 22 nt, Human
uuuguaaauagcaguacucaug

SEQ ID NO: 337283 - RNA, 23 nt, Human
agggugagcaagcuauggagacc

SEQ ID NO: 337284 - RNA, 22 nt, Human
cuucugugcuucacaguugcca

SEQ ID NO: 337285 - RNA, 22 nt, Human
agucacuguucugucaugucaa

SEQ ID NO: 337286 - RNA, 22 nt, Human
uggaaagcgaggaguuggcauu

SEQ ID NO: 337287 - RNA, 22 nt, Human
auguagagcaguguuguccaau

SEQ ID NO: 337288 - RNA, 22 nt, Human
cuguucucuggcgguggcuguu

SEQ ID NO: 337289 - RNA, 22 nt, Human
uucaaauacauucuuugccacu

SEQ ID NO: 337290 - RNA, 22 nt, Human
uggcagcugcaggccuccugag

SEQ ID NO: 337291 - RNA, 21 nt, Human
ggcagcucagcagauggggac

SEQ ID NO: 337292 - RNA, 22 nt, Human
cccaugagauucugaauuuggc

SEQ ID NO: 337293 - RNA, 22 nt, Human
auucuucauuuacuguuacuug

SEQ ID NO: 337294 - RNA, 21 nt, Human
acagcaagccuucacaugagu

SEQ ID NO: 337295 - RNA, 22 nt, Human
uuucaaagucaauaucauuacc

SEQ ID NO: 337296 - RNA, 22 nt, Human
gaggcaguguuuacugcccugu

SEQ ID NO: 337297 - RNA, 22 nt, Human
auucucuuuguauaacaucuug

SEQ ID NO: 337298 - RNA, 22 nt, Human
cccucuacagggaagcgcuuuc

SEQ ID NO: 337299 - RNA, 22 nt, Human
cugcccaggaaccagaggggca

SEQ ID NO: 337300 - RNA, 22 nt, Human
uaauuucacugauaugaaguca

SEQ ID NO: 337301 - RNA, 22 nt, Human
cuggaaauuggagaugauguuu

SEQ ID NO: 337302 - RNA, 19 nt, Human
gcuuuggagggagguucua

SEQ ID NO: 337303 - RNA, 22 nt, Human
gcucaggaucagccaccucuuu

SEQ ID NO: 337304 - RNA, 21 nt, Human
aggcagcucaggcccagagag

SEQ ID NO: 337305 - RNA, 22 nt, Human
auauuucaugggguuccauacu

SEQ ID NO: 337306 - RNA, 22 nt, Human
uuucugcugugcuuucuugcgu

SEQ ID NO: 337307 - RNA, 22 nt, Human
guuguuuuuguucucuauagcu

SEQ ID NO: 337308 - RNA, 22 nt, Human
uucucagagugaccaagucuuu

SEQ ID NO: 337309 - RNA, 22 nt, Human
cccuggaguccuggcaguugau

SEQ ID NO: 337310 - RNA, 22 nt, Human
aaggaguuuggguagucauaca

SEQ ID NO: 337311 - RNA, 22 nt, Human
uccaggagacacaagguacaua

SEQ ID NO: 337312 - RNA, 23 nt, Human
agggagcuaaaaggcuggagcag

SEQ ID NO: 337313 - RNA, 17 nt, Human
uuucuccuuccaucuca

SEQ ID NO: 337314 - RNA, 22 nt, Human
gaggagagggcugcgggcccac

SEQ ID NO: 337315 - RNA, 20 nt, Human
gcccaagguccagaaggggg

SEQ ID NO: 337316 - RNA, 23 nt, Human
uuuggacuugugacucuucuccu

SEQ ID NO: 337317 - RNA, 19 nt, Human
uggagaggaaaugcugcuc

SEQ ID NO: 337318 - RNA, 22 nt, Human
uucuucaauuuuccauauacug

SEQ ID NO: 337319 - RNA, 22 nt, Human
gucaggaucucccaguacauau

SEQ ID NO: 337320 - RNA, 22 nt, Human
cagaugaggcaaccucauugcu

SEQ ID NO: 337321 - RNA, 21 nt, Human
gcucagaguauugcacuguuu

SEQ ID NO: 337322 - RNA, 22 nt, Human
cccaggagguggaguucacagu

SEQ ID NO: 337323 - RNA, 22 nt, Human
gaggggaagacuucuggacagu

SEQ ID NO: 337324 - RNA, 22 nt, Human
ucugucuccucugaggugccag

SEQ ID NO: 337325 - RNA, 22 nt, Human
ucaacugcaaguuugcuuaguu

SEQ ID NO: 337326 - RNA, 22 nt, Human
augugucuuugagacucugcua

SEQ ID NO: 337327 - RNA, 22 nt, Human
guuuauaaggcccaauauuucu

SEQ ID NO: 337328 - RNA, 20 nt, Human
acuugcugggcuuuguuacc

SEQ ID NO: 337329 - RNA, 22 nt, Human
gucuucaacaauaacuaccacu

SEQ ID NO: 337330 - RNA, 22 nt, Human
uaucuguuugcucacagguguu

SEQ ID NO: 337331 - RNA, 22 nt, Human
aagaggaggacgguucccagaa

SEQ ID NO: 337332 - RNA, 22 nt, Human
aggaguggugcaggaccugcca

SEQ ID NO: 337333 - RNA, 22 nt, Human
gcuucccacagcuggacugggg

SEQ ID NO: 337334 - RNA, 22 nt, Human
gaagaggaugacaggagccggu

SEQ ID NO: 337335 - RNA, 22 nt, Human
acaauacuauuuucaguauccu

SEQ ID NO: 337336 - RNA, 22 nt, Human
aaauacauaaagguuguaccag

SEQ ID NO: 337337 - RNA, 22 nt, Human
uagcccagcaugagcagagcug

SEQ ID NO: 337338 - RNA, 22 nt, Human
cagagagagucaaaucuuugcu

SEQ ID NO: 337339 - RNA, 22 nt, Human
gauggcagcagcagccagggau

SEQ ID NO: 337340 - RNA, 20 nt, Human
gccaggagggugugaugagc

SEQ ID NO: 337341 - RNA, 22 nt, Human
ugcacauuaguguuugagaugc

SEQ ID NO: 337342 - RNA, 22 nt, Human
ugugccagccucuggcuguguc

SEQ ID NO: 337343 - RNA, 22 nt, Human
cugucccuucauuauucacuac

SEQ ID NO: 337344 - RNA, 22 nt, Human
uucacagucacccuucuccaug

SEQ ID NO: 337345 - RNA, 22 nt, Human
uucucugaguacguuucagugu

SEQ ID NO: 337346 - RNA, 22 nt, Human
ggagugucagaaacaguguccu

SEQ ID NO: 337347 - RNA, 22 nt, Human
gaacccaggcuuuugaggcugu

SEQ ID NO: 337348 - RNA, 22 nt, Human
aguucuucauaaccuuacugug

SEQ ID NO: 337349 - RNA, 22 nt, Human
uuauacuaaaacgcauugaauu

SEQ ID NO: 337350 - RNA, 22 nt, Human
uaaucuguguaccuucaucgga

SEQ ID NO: 337351 - RNA, 22 nt, Human
acucaggaagaaagcagcuggu

SEQ ID NO: 337352 - RNA, 22 nt, Human
cccagggaagccauuucugacu

SEQ ID NO: 337353 - RNA, 22 nt, Human
cuuaaaaucuggcaguuagcua

SEQ ID NO: 337354 - RNA, 22 nt, Human
uugcucaggcuggugugcagug

SEQ ID NO: 337355 - RNA, 22 nt, Human
ccaggaugacccccacuuuccu

SEQ ID NO: 337356 - RNA, 22 nt, Human
uucaaacaguguagaauauaug

SEQ ID NO: 337357 - RNA, 22 nt, Human
uuucacaaaugucuuuaacuug

SEQ ID NO: 337358 - RNA, 22 nt, Human
ugccgcagugcggggagggccc

SEQ ID NO: 337359 - RNA, 23 nt, Human
ccacuagcaccuguucaacuucu

SEQ ID NO: 337360 - RNA, 22 nt, Human
gacccaggcucgugggacggcu

SEQ ID NO: 337361 - RNA, 20 nt, Human
uauuuguauuugggaaaguu

SEQ ID NO: 337362 - RNA, 22 nt, Human
gccaggaggcuuaacuggacag

SEQ ID NO: 337363 - RNA, 22 nt, Human
cagaagaguagcugaacaaguu

SEQ ID NO: 337364 - RNA, 22 nt, Human
auuuccauagagcgucucacag

SEQ ID NO: 337365 - RNA, 22 nt, Human
gcccaggaguuugcauuuuaac

SEQ ID NO: 337366 - RNA, 22 nt, Human
caggauggagggagggcuguua

SEQ ID NO: 337367 - RNA, 22 nt, Human
ucuacuauguuucuuaaauaga

SEQ ID NO: 337368 - RNA, 22 nt, Human
agucucugggcaugguugugac

SEQ ID NO: 337369 - RNA, 22 nt, Human
uccauucauucauugaugaaca

SEQ ID NO: 337370 - RNA, 18 nt, Human
gugcugugggcaguggcc

SEQ ID NO: 337371 - RNA, 22 nt, Human
gcaaauauucaagacuuuucca

SEQ ID NO: 337372 - RNA, 22 nt, Human
uggcagcagccauggaaggccc

SEQ ID NO: 337373 - RNA, 22 nt, Human
cggagggguuugaacagaggag

SEQ ID NO: 337374 - RNA, 22 nt, Human
cugcccagaagccagaugggca

SEQ ID NO: 337375 - RNA, 16 nt, Human
uguaugaacgucucca

SEQ ID NO: 337376 - RNA, 19 nt, Human
ugugaaagcuaguguucuu

SEQ ID NO: 337377 - RNA, 22 nt, Human
aggguggcuggaggaaucagaa

SEQ ID NO: 337378 - RNA, 22 nt, Human
caugaaauugcuccuuuggugc

SEQ ID NO: 337379 - RNA, 22 nt, Human
aguuugaaaguauugacagaag

SEQ ID NO: 337380 - RNA, 22 nt, Human
aauucugugcaggcagagcuau

SEQ ID NO: 337381 - RNA, 22 nt, Human
gccaggagcccugggcaaguuc

SEQ ID NO: 337382 - RNA, 22 nt, Human
ugaaggccagcucuuuaucagc

SEQ ID NO: 337383 - RNA, 22 nt, Human
agucuacaaucuuaaaugaacu

SEQ ID NO: 337384 - RNA, 22 nt, Human
ucauuucccuccuacaaagagg

SEQ ID NO: 337385 - RNA, 22 nt, Human
aggccagcccugggcugagaga

SEQ ID NO: 337386 - RNA, 22 nt, Human
cuauuucaaggcccagauauga

SEQ ID NO: 337387 - RNA, 22 nt, Human
uuuucagugggcaaugauguga

SEQ ID NO: 337388 - RNA, 22 nt, Human
caucacccggaacugugucugc

SEQ ID NO: 337389 - RNA, 22 nt, Human
gaggcagcaauaaaaagaauuu

SEQ ID NO: 337390 - RNA, 18 nt, Human
uugagggaggggcagagu

SEQ ID NO: 337391 - RNA, 22 nt, Human
cuugcuucauuagugucuuagu

SEQ ID NO: 337392 - RNA, 22 nt, Human
aauacuuuccuauauaaggugc

SEQ ID NO: 337393 - RNA, 22 nt, Human
ccucaggauacaggagccacag

SEQ ID NO: 337394 - RNA, 22 nt, Human
uuacuuuggguccugcuuauaa

SEQ ID NO: 337395 - RNA, 20 nt, Human
auaaaauaacugccacaaga

SEQ ID NO: 337396 - RNA, 22 nt, Human
agggagcucaguuggaagcggu

SEQ ID NO: 337397 - RNA, 22 nt, Human
gcuucccagcagaggaaagacu

SEQ ID NO: 337398 - RNA, 20 nt, Human
auacacauucauagaaaaau

SEQ ID NO: 337399 - RNA, 22 nt, Human
uucucagaggagucgggagcug

SEQ ID NO: 337400 - RNA, 22 nt, Human
agaaggggagaagcuaccagga

SEQ ID NO: 337401 - RNA, 23 nt, Human
acagaaaucauuuguaagguacc

SEQ ID NO: 337402 - RNA, 19 nt, Human
agcaacaccguuuauuucc

SEQ ID NO: 337403 - RNA, 22 nt, Human
caaggccagggaauuuuucugg

SEQ ID NO: 337404 - RNA, 22 nt, Human
aggaggcacucacucucagggu

SEQ ID NO: 337405 - RNA, 22 nt, Human
guguugaugacauuuuagaaac

SEQ ID NO: 337406 - RNA, 22 nt, Human
cagcugacuucauaggaagaca

SEQ ID NO: 337407 - RNA, 22 nt, Human
auugaaagauauacuguucuca

SEQ ID NO: 337408 - RNA, 22 nt, Human
acaaaguuugugguauuccaag

SEQ ID NO: 337409 - RNA, 22 nt, Human
cuuaaauucuuaaugcccucau

SEQ ID NO: 337410 - RNA, 22 nt, Human
aggaagcugcuggaguagugug

SEQ ID NO: 337411 - RNA, 22 nt, Human
aggcagauuacuugaggccagg

SEQ ID NO: 337412 - RNA, 21 nt, Human
gagugcagcaagguagagucu

SEQ ID NO: 337413 - RNA, 22 nt, Human
aucuacccacugaacacaauau

SEQ ID NO: 337414 - RNA, 22 nt, Human
gagccagcuauguagcaagagg

SEQ ID NO: 337415 - RNA, 22 nt, Human
augcuuuuccaggagaaauaua

SEQ ID NO: 337416 - RNA, 19 nt, Human
ugaaauggcaguugcuaaa

SEQ ID NO: 337417 - RNA, 20 nt, Human
agagcagcaguuggugaggu

SEQ ID NO: 337418 - RNA, 22 nt, Human
uucaugugaauauauuugucuu

SEQ ID NO: 337419 - RNA, 22 nt, Human
ucuucauuuuauagcaucugug

SEQ ID NO: 337420 - RNA, 22 nt, Human
uuugacauuauccuguuacugg

SEQ ID NO: 337421 - RNA, 22 nt, Human
gccaugcuugguaugcugugag

SEQ ID NO: 337422 - RNA, 22 nt, Human
gaacaucagucauaauuuaacg

SEQ ID NO: 337423 - RNA, 22 nt, Human
augcuacauuuugguuuauaaa

SEQ ID NO: 337424 - RNA, 22 nt, Human
ucugggaacagccuggcugugu

SEQ ID NO: 337425 - RNA, 22 nt, Human
cagucuucuaaccuagcagccu

SEQ ID NO: 337426 - RNA, 22 nt, Human
gauuuuauauggcauacugugg

SEQ ID NO: 337427 - RNA, 22 nt, Human
gcaucuaaacuugcaucauugu

SEQ ID NO: 337428 - RNA, 21 nt, Human
aggaggggucuuucccacuga

SEQ ID NO: 337429 - RNA, 22 nt, Human
gcucaggacccaggugugaccu

SEQ ID NO: 337430 - RNA, 22 nt, Human
gccaggagaaaaggcgaaugau

SEQ ID NO: 337431 - RNA, 22 nt, Human
uagggaugacgaaaggacagag

SEQ ID NO: 337432 - RNA, 22 nt, Human
cuuaaagaaauugaggagagga

SEQ ID NO: 337433 - RNA, 22 nt, Human
aaauacauacacuguacguggc

SEQ ID NO: 337434 - RNA, 22 nt, Human
guugaaugaaucauucuaugua

SEQ ID NO: 337435 - RNA, 22 nt, Human
uccaggagucagacagauggug

SEQ ID NO: 337436 - RNA, 22 nt, Human
uucucacuauguauguagauug

SEQ ID NO: 337437 - RNA, 22 nt, Human
ccaggcugagcaugauuggagc

SEQ ID NO: 337438 - RNA, 22 nt, Human
gagacagcacaggccacuggga

SEQ ID NO: 337439 - RNA, 22 nt, Human
ugaggcaguauuuuagugacuu

SEQ ID NO: 337440 - RNA, 19 nt, Human
ugaggggcucacagucuca

SEQ ID NO: 337441 - RNA, 22 nt, Human
aguaugaacggaaggccuggga

SEQ ID NO: 337442 - RNA, 22 nt, Human
aauuaugagguagauaucacau

SEQ ID NO: 337443 - RNA, 22 nt, Human
uugaaaguccuucuugaguuac

SEQ ID NO: 337444 - RNA, 22 nt, Human
aggcggcuccgggagugugggc

SEQ ID NO: 337445 - RNA, 22 nt, Human
guccucuggaagaugaguucuu

SEQ ID NO: 337446 - RNA, 22 nt, Human
uaggagggcccugaaaauggca

SEQ ID NO: 337447 - RNA, 21 nt, Human
uuucuucacuuugccccaugu

SEQ ID NO: 337448 - RNA, 22 nt, Human
ggcuuggaaauugcaggacaca

SEQ ID NO: 337449 - RNA, 22 nt, Human
aauguauguguauaucaaauca

SEQ ID NO: 337450 - RNA, 17 nt, Human
uauauguaugccucucc

SEQ ID NO: 337451 - RNA, 16 nt, Human
ccccaggacuuggcac

SEQ ID NO: 337452 - RNA, 22 nt, Human
auuugcuuaucuccacaguugu

SEQ ID NO: 337453 - RNA, 22 nt, Human
agaggucagauuucuccuggug

SEQ ID NO: 337454 - RNA, 21 nt, Human
uccaggaguggcugggcaggg

SEQ ID NO: 337455 - RNA, 22 nt, Human
uauguacuaacuuucauucuag

SEQ ID NO: 337456 - RNA, 22 nt, Human
gguggaaggccuggaaggaggc

SEQ ID NO: 337457 - RNA, 22 nt, Human
cugcuguggguuaagacacugu

SEQ ID NO: 337458 - RNA, 22 nt, Human
ugaaaugacaaagguuuuucuu

SEQ ID NO: 337459 - RNA, 22 nt, Human
cuugaaguugcaaaacauuaau

SEQ ID NO: 337460 - RNA, 22 nt, Human
aaggaaccuggaguagagggag

SEQ ID NO: 337461 - RNA, 22 nt, Human
ugaggcaggaaguuauauaaug

SEQ ID NO: 337462 - RNA, 22 nt, Human
caggaugagaagggcucuuacg

SEQ ID NO: 337463 - RNA, 22 nt, Human
cuagguauucauguuucguggc

SEQ ID NO: 337464 - RNA, 22 nt, Human
acccaggacaaaauaaccaggu

SEQ ID NO: 337465 - RNA, 22 nt, Human
aggcagcuuaagcccuggccca

SEQ ID NO: 337466 - RNA, 22 nt, Human
ggcaagaaggcuucagguagcu

SEQ ID NO: 337467 - RNA, 22 nt, Human
agugauggugagugagaagcuc

SEQ ID NO: 337468 - RNA, 22 nt, Human
uggcagagcaaaaagauagaau

SEQ ID NO: 337469 - RNA, 20 nt, Human
uauuuacaacuuagagccuc

SEQ ID NO: 337470 - RNA, 22 nt, Human
agggagcucacaguccaguaga

SEQ ID NO: 337471 - RNA, 22 nt, Human
gaggcagaaguugcagugagca

SEQ ID NO: 337472 - RNA, 22 nt, Human
ucugucccugagagcucaggag

SEQ ID NO: 337473 - RNA, 22 nt, Human
cuugcuggugguguuuucuaug

SEQ ID NO: 337474 - RNA, 20 nt, Human
aucaggauucuugcuuuguu

SEQ ID NO: 337475 - RNA, 22 nt, Human
auacuaaaguauagaacuuagu

SEQ ID NO: 337476 - RNA, 22 nt, Human
acagauguacacucauauauaa

SEQ ID NO: 337477 - RNA, 22 nt, Human
caggagaucuuaggaauucuua

SEQ ID NO: 337478 - RNA, 22 nt, Human
uugcugugucauuuguuuaauc

SEQ ID NO: 337479 - RNA, 22 nt, Human
uguagggaggaaggguuggaaa

SEQ ID NO: 337480 - RNA, 22 nt, Human
acagauauuuggggaaagacgu

SEQ ID NO: 337481 - RNA, 22 nt, Human
ucagucucaucaacucuauucc

SEQ ID NO: 337482 - RNA, 22 nt, Human
cugcugugcauauuuaucuagg

SEQ ID NO: 337483 - RNA, 22 nt, Human
uucagaauauuuguuuuacaug

SEQ ID NO: 337484 - RNA, 22 nt, Human
ccucugcucugguccaugugcu

SEQ ID NO: 337485 - RNA, 20 nt, Human
cucuccucacccgugucagg

SEQ ID NO: 337486 - RNA, 22 nt, Human
uagugcuuaacacaaagugauu

SEQ ID NO: 337487 - RNA, 22 nt, Human
ucauaaaugcagugucauaaau

SEQ ID NO: 337488 - RNA, 22 nt, Human
aucacaaaggcugcuucaugau

SEQ ID NO: 337489 - RNA, 22 nt, Human
cauaugaaauaugaguugaaca

SEQ ID NO: 337490 - RNA, 20 nt, Human
augugucuguaaacaacucu

SEQ ID NO: 337491 - RNA, 22 nt, Human
uucugaaagccaauucauugaa

SEQ ID NO: 337492 - RNA, 22 nt, Human
ugaggcaguugagcuuccugag

SEQ ID NO: 337493 - RNA, 22 nt, Human
cuguuuaucucuaaccuguuua

SEQ ID NO: 337494 - RNA, 22 nt, Human
uuugcacuagcauuuguccaug

SEQ ID NO: 337495 - RNA, 22 nt, Human
cagcuacuccucccaugacuuc

SEQ ID NO: 337496 - RNA, 22 nt, Human
agggagcuucuggccucagccu

SEQ ID NO: 337497 - RNA, 22 nt, Human
ucucagucuuugcaaggaugcu

SEQ ID NO: 337498 - RNA, 22 nt, Human
caaaugauagagccgauuauca

SEQ ID NO: 337499 - RNA, 22 nt, Human
ccccaggagaaaucuuaaacua

SEQ ID NO: 337500 - RNA, 22 nt, Human
aagcagaggaccgacggaggga

SEQ ID NO: 337501 - RNA, 22 nt, Human
cagcugccuucugcgggaaguc

SEQ ID NO: 337502 - RNA, 22 nt, Human
ucucugaguauccugaacugcc

SEQ ID NO: 337503 - RNA, 22 nt, Human
aagacugugucuauggcuacuc

SEQ ID NO: 337504 - RNA, 22 nt, Human
acaugcauaggagaagucuuua

SEQ ID NO: 337505 - RNA, 22 nt, Human
gagggagggacuagcauucucu

SEQ ID NO: 337506 - RNA, 23 nt, Human
cugcuguguuggucucgauggga

SEQ ID NO: 337507 - RNA, 22 nt, Human
aggcucagaggugagcaucugc

SEQ ID NO: 337508 - RNA, 22 nt, Human
aaaguuugcaauuuauguuaau

SEQ ID NO: 337509 - RNA, 22 nt, Human
agagugcagauaagagaauguu

SEQ ID NO: 337510 - RNA, 22 nt, Human
gcugcugugaauuuuuuaaaug

SEQ ID NO: 337511 - RNA, 19 nt, Human
uucaggauugacccuacug

SEQ ID NO: 337512 - RNA, 22 nt, Human
aaguugagaugucauaggagac

SEQ ID NO: 337513 - RNA, 22 nt, Human
agugcugucaguuuuauagaua

SEQ ID NO: 337514 - RNA, 22 nt, Human
cucuucuugcuagacugagugc

SEQ ID NO: 337515 - RNA, 22 nt, Human
uuucaugagauuccuccacauc

SEQ ID NO: 337516 - RNA, 22 nt, Human
uccauuuuucaugacuccucaa

SEQ ID NO: 337517 - RNA, 22 nt, Human
aggcagcauuugaauccagguc

SEQ ID NO: 337518 - RNA, 22 nt, Human
ccacuguuuuucaguuaacuuu

SEQ ID NO: 337519 - RNA, 22 nt, Human
accaggaggaaguguuaaugau

SEQ ID NO: 337520 - RNA, 22 nt, Human
aaauuuucagagcacuagagaa

SEQ ID NO: 337521 - RNA, 22 nt, Human
agcccagguucuaaagccaaac

SEQ ID NO: 337522 - RNA, 22 nt, Human
uggcagcuagauaguguguuua

SEQ ID NO: 337523 - RNA, 22 nt, Human
gcagcugagagaagaacagggc

SEQ ID NO: 337524 - RNA, 22 nt, Human
cagaguucaaagccugcuggga

SEQ ID NO: 337525 - RNA, 22 nt, Human
aauguaugcugugguaucuucu

SEQ ID NO: 337526 - RNA, 22 nt, Human
aagcaccugcaguugacaaaaa

SEQ ID NO: 337527 - RNA, 22 nt, Human
auaucaaacgaaguuauuuuaa

SEQ ID NO: 337528 - RNA, 17 nt, Human
uuuagaauacaauguuu

SEQ ID NO: 337529 - RNA, 19 nt, Human
ccauggagagagaugcauu

SEQ ID NO: 337530 - RNA, 21 nt, Human
uuucugaaggcaacaucuauc

SEQ ID NO: 337531 - RNA, 17 nt, Human
ggcagccucaggcguuu

SEQ ID NO: 337532 - RNA, 22 nt, Human
acaaauaugguacucggagaaa

SEQ ID NO: 337533 - RNA, 22 nt, Human
uuugaaagaaaccagugaguga

SEQ ID NO: 337534 - RNA, 23 nt, Human
auuugagaaaguauuuuuaagac

SEQ ID NO: 337535 - RNA, 22 nt, Human
uucugucacagugcugguauca

SEQ ID NO: 337536 - RNA, 22 nt, Human
agaguucugcucuucucaguga

SEQ ID NO: 337537 - RNA, 22 nt, Human
uccuucuuugacaaguggcaga

SEQ ID NO: 337538 - RNA, 22 nt, Human
aggcagcaugggcccagagucc

SEQ ID NO: 337539 - RNA, 22 nt, Human
uucaggauucucucccauuuac

SEQ ID NO: 337540 - RNA, 22 nt, Human
aucaggauuauuaaaucuggau

SEQ ID NO: 337541 - RNA, 22 nt, Human
ugaaaugaucaguuugguuacu

SEQ ID NO: 337542 - RNA, 22 nt, Human
uaaugcuuaacagcuggcuuuu

SEQ ID NO: 337543 - RNA, 22 nt, Human
agggcagccucucagccuaggu

SEQ ID NO: 337544 - RNA, 22 nt, Human
uguucauuuggcccuuuuguau

SEQ ID NO: 337545 - RNA, 22 nt, Human
agucucagaaaagaagcaugga

SEQ ID NO: 337546 - RNA, 22 nt, Human
uucaauucugcucugaucuuag

SEQ ID NO: 337547 - RNA, 22 nt, Human
gcagggaagaucuuggagcugc

SEQ ID NO: 337548 - RNA, 22 nt, Human
uggcagcugguacagugggucu

SEQ ID NO: 337549 - RNA, 22 nt, Human
uccaggaguccugggagugauu

SEQ ID NO: 337550 - RNA, 22 nt, Human
aggacagcaguuggugagguuc

SEQ ID NO: 337551 - RNA, 20 nt, Human
uugauaggcagcuugucagg

SEQ ID NO: 337552 - RNA, 22 nt, Human
acucaggagggaucagcuauca

SEQ ID NO: 337553 - RNA, 21 nt, Human
uuucacaaaaguaugugacaa

SEQ ID NO: 337554 - RNA, 22 nt, Human
ggaggugguggcagugacaauu

SEQ ID NO: 337555 - RNA, 22 nt, Human
ugaggcagcuuuuucugugugu

SEQ ID NO: 337556 - RNA, 22 nt, Human
uccaggaggaggaaggcugcca

SEQ ID NO: 337557 - RNA, 22 nt, Human
uuuuguuguaauauaccuaucc

SEQ ID NO: 337558 - RNA, 22 nt, Human
acccaggagacggaggugcagu

SEQ ID NO: 337559 - RNA, 22 nt, Human
ccaggagcagauauggacauaa

SEQ ID NO: 337560 - RNA, 22 nt, Human
cacucugaugguuucuguucaa

SEQ ID NO: 337561 - RNA, 22 nt, Human
aaggccagcuuguagggcuggu

SEQ ID NO: 337562 - RNA, 21 nt, Human
cgcagagcgaacuugcggcgc

SEQ ID NO: 337563 - RNA, 22 nt, Human
ccuugcugaccaucaccuuuga

SEQ ID NO: 337564 - RNA, 22 nt, Human
ccagaagaccccguccaccucc

SEQ ID NO: 337565 - RNA, 20 nt, Human
ugcugucguguuuucugcuu

SEQ ID NO: 337566 - RNA, 22 nt, Human
ugugaaauauuuauauacucaa

SEQ ID NO: 337567 - RNA, 22 nt, Human
aaauauagcaauuaugccuacu

SEQ ID NO: 337568 - RNA, 22 nt, Human
gucaggauuauaauccccaugg

SEQ ID NO: 337569 - RNA, 19 nt, Human
auguaugaggucuucugcu

SEQ ID NO: 337570 - RNA, 22 nt, Human
ucaugcuuaaaagacacuugag

SEQ ID NO: 337571 - RNA, 22 nt, Human
gagagcaggaggcagcgggacg

SEQ ID NO: 337572 - RNA, 20 nt, Human
caguccaaucagaggccacc

SEQ ID NO: 337573 - RNA, 22 nt, Human
gacagcugugcaggagaagggg

SEQ ID NO: 337574 - RNA, 22 nt, Human
gaggcaccucgcgggaggaggc

SEQ ID NO: 337575 - RNA, 22 nt, Human
aaaguucuggcauuuucugucu

SEQ ID NO: 337576 - RNA, 22 nt, Human
aguugcagacgcagagauguug

SEQ ID NO: 337577 - RNA, 22 nt, Human
cuuugcaaacugucacacuuuc

SEQ ID NO: 337578 - RNA, 22 nt, Human
uuugacauugccaauuugcuca

SEQ ID NO: 337579 - RNA, 22 nt, Human
uucugucaaagacuuuuucagg

SEQ ID NO: 337580 - RNA, 22 nt, Human
cucugauuuccuuauucuguca

SEQ ID NO: 337581 - RNA, 21 nt, Human
cccaggaggagcuccggcucc

SEQ ID NO: 337582 - RNA, 22 nt, Human
uuggaaauugcaagugauuugc

SEQ ID NO: 337583 - RNA, 22 nt, Human
auaucaguaucuauguauuugu

SEQ ID NO: 337584 - RNA, 22 nt, Human
aucauuucccuuuagaucacaa

SEQ ID NO: 337585 - RNA, 22 nt, Human
cuugaaagucacaugcagcccu

SEQ ID NO: 337586 - RNA, 17 nt, Human
cccaugagcccacuccc

SEQ ID NO: 337587 - RNA, 23 nt, Human
uuugaaguugacugccuuccaga

SEQ ID NO: 337588 - RNA, 22 nt, Human
ggcucagacucccaggcccucu

SEQ ID NO: 337589 - RNA, 22 nt, Human
gcuugaaaauucauagguauuu

SEQ ID NO: 337590 - RNA, 22 nt, Human
cagcagagcugggcuuugaauu

SEQ ID NO: 337591 - RNA, 22 nt, Human
aaacacauuagcccuguggaaa

SEQ ID NO: 337592 - RNA, 22 nt, Human
ccaggagaaugggauuacccua

SEQ ID NO: 337593 - RNA, 22 nt, Human
guggaaugaauagauuugcauu

SEQ ID NO: 337594 - RNA, 22 nt, Human
cuguuaaucugcuugcaugaug

SEQ ID NO: 337595 - RNA, 22 nt, Human
aggcaggcccucuggaaaggua

SEQ ID NO: 337596 - RNA, 21 nt, Human
ucacaucuauguuaagcaaac

SEQ ID NO: 337597 - RNA, 22 nt, Human
auucugucuuuuuaaaauaaua

SEQ ID NO: 337598 - RNA, 22 nt, Human
uggcaaggccacaggugcaguu

SEQ ID NO: 337599 - RNA, 22 nt, Human
uucugucagcgucagaaauucu

SEQ ID NO: 337600 - RNA, 20 nt, Human
ucuggcaggugaacgagcug

SEQ ID NO: 337601 - RNA, 22 nt, Human
aucaggauuacacggggaugcu

SEQ ID NO: 337602 - RNA, 22 nt, Human
auuucagaugaccaaauggaaa

SEQ ID NO: 337603 - RNA, 23 nt, Human
uggacgccgacuuuggaggcgcu

SEQ ID NO: 337604 - RNA, 22 nt, Human
ggccagcuuugagcugcaggaa

SEQ ID NO: 337605 - RNA, 22 nt, Human
uuagcaucugcuguaagcuuau

SEQ ID NO: 337606 - RNA, 19 nt, Human
aaaaacuuaguccagaaag

SEQ ID NO: 337607 - RNA, 22 nt, Human
gcugauguaagacuuuugguuu

SEQ ID NO: 337608 - RNA, 22 nt, Human
ggagcuguucaggacugcuuca

SEQ ID NO: 337609 - RNA, 22 nt, Human
cugacuguaauucuguucuuaa

SEQ ID NO: 337610 - RNA, 23 nt, Human
uucuucucaauuaguugauucag

SEQ ID NO: 337611 - RNA, 22 nt, Human
caaugaaaauuuaaguugcagc

SEQ ID NO: 337612 - RNA, 22 nt, Human
ccccaggagauuugggagcaca

SEQ ID NO: 337613 - RNA, 19 nt, Human
gaggcgaggcgugcaggag

SEQ ID NO: 337614 - RNA, 22 nt, Human
auuuuccucaagccucuggaag

SEQ ID NO: 337615 - RNA, 22 nt, Human
acuagauaauuauaaaagguag

SEQ ID NO: 337616 - RNA, 22 nt, Human
uuugaaguguuauuucuaucac

SEQ ID NO: 337617 - RNA, 22 nt, Human
auguagaauggugauuggcagg

SEQ ID NO: 337618 - RNA, 22 nt, Human
agaauaugaugguuggagaauu

SEQ ID NO: 337619 - RNA, 22 nt, Human
ugaggcagcaauuguauuguau

SEQ ID NO: 337620 - RNA, 22 nt, Human
uggcagcugugcuucauucuuu

SEQ ID NO: 337621 - RNA, 22 nt, Human
uuggcaguaaaagaaaaugcuu

SEQ ID NO: 337622 - RNA, 22 nt, Human
uucugucaaaugccaguagaga

SEQ ID NO: 337623 - RNA, 22 nt, Human
uuuauucaucaucuguucauau

SEQ ID NO: 337624 - RNA, 22 nt, Human
uuggaaagauuauuauuaugaa

SEQ ID NO: 337625 - RNA, 19 nt, Human
caggaugaucccaugacac

SEQ ID NO: 337626 - RNA, 22 nt, Human
uguuuuuaaauaaugauagaaa

SEQ ID NO: 337627 - RNA, 22 nt, Human
ucucuucuaauuaggguccaug

SEQ ID NO: 337628 - RNA, 22 nt, Human
aagacuguacauuuuccagucu

SEQ ID NO: 337629 - RNA, 22 nt, Human
cuacccaggcuuagagggcugg

SEQ ID NO: 337630 - RNA, 22 nt, Human
auaacuuagaguaggcaaaagu

SEQ ID NO: 337631 - RNA, 22 nt, Human
uucaggauaguggugaguggca

SEQ ID NO: 337632 - RNA, 22 nt, Human
gccacaggcacuuaagggcugg

SEQ ID NO: 337633 - RNA, 22 nt, Human
cccaggaggaggaaaaagcucg

SEQ ID NO: 337634 - RNA, 22 nt, Human
ucuccucuauuucuguauguau

SEQ ID NO: 337635 - RNA, 22 nt, Human
gugauuuucuccuccuagaagu

SEQ ID NO: 337636 - RNA, 22 nt, Human
gcuuuggaugugugccugaggu

SEQ ID NO: 337637 - RNA, 22 nt, Human
caggcagcccugcaccaagugu

SEQ ID NO: 337638 - RNA, 22 nt, Human
cgccucagccguggucaucuuc

SEQ ID NO: 337639 - RNA, 22 nt, Human
ucugauuagagcauucuugagu

SEQ ID NO: 337640 - RNA, 22 nt, Human
aagcacauuguacauuugugcu

SEQ ID NO: 337641 - RNA, 22 nt, Human
cugcugugucagaguccagggg

SEQ ID NO: 337642 - RNA, 22 nt, Human
uuguaaaugaccuuuucuaauu

SEQ ID NO: 337643 - RNA, 22 nt, Human
cugcugugagugguucuugccu

SEQ ID NO: 337644 - RNA, 22 nt, Human
uugaaaguuaucuagauucuga

SEQ ID NO: 337645 - RNA, 22 nt, Human
guucuucagaggggaaagaacc

SEQ ID NO: 337646 - RNA, 23 nt, Human
aaacuacauuuauaguuuuucuc

SEQ ID NO: 337647 - RNA, 22 nt, Human
cacaaauggccguguucaaaga

SEQ ID NO: 337648 - RNA, 22 nt, Human
augcagcugugggcaagaaaug

SEQ ID NO: 337649 - RNA, 22 nt, Human
ccugucacgaugacugcacucu

SEQ ID NO: 337650 - RNA, 22 nt, Human
uuauccuggauuauauauguga

SEQ ID NO: 337651 - RNA, 22 nt, Human
cccaggaggucgaagcugcagu

SEQ ID NO: 337652 - RNA, 22 nt, Human
cccagaaggucgaggcugcagu

SEQ ID NO: 337653 - RNA, 22 nt, Human
uucugggacaucuggacaguuu

SEQ ID NO: 337654 - RNA, 22 nt, Human
cugccagucuaugcugcucggc

SEQ ID NO: 337655 - RNA, 22 nt, Human
ucuacugcacuggugucucauc

SEQ ID NO: 337656 - RNA, 22 nt, Human
ccacagagacaggguccuugcu

SEQ ID NO: 337657 - RNA, 22 nt, Human
ggcagcuuccuaggagagggca

SEQ ID NO: 337658 - RNA, 22 nt, Human
ucuucagacuccaaauguuuua

SEQ ID NO: 337659 - RNA, 22 nt, Human
aaauguuucuacuugugagcau

SEQ ID NO: 337660 - RNA, 22 nt, Human
uagacauuucugguuauugaca

SEQ ID NO: 337661 - RNA, 22 nt, Human
cuucuucaucuguaaaacuugg

SEQ ID NO: 337662 - RNA, 22 nt, Human
cagcuggccaaucagggcgccc

SEQ ID NO: 337663 - RNA, 22 nt, Human
agauaugugcgucuuagauuga

SEQ ID NO: 337664 - RNA, 18 nt, Human
gagaggagccagaauuuu

SEQ ID NO: 337665 - RNA, 22 nt, Human
uucucugaaggccaugcucacu

SEQ ID NO: 337666 - RNA, 22 nt, Human
gaaguacaguuuuaucuagcca

SEQ ID NO: 337667 - RNA, 22 nt, Human
auaugagaauuggaaaauauca

SEQ ID NO: 337668 - RNA, 22 nt, Human
aaguuucaaauguugauuaugc

SEQ ID NO: 337669 - RNA, 22 nt, Human
ucagauggguuuugaaggaugu

SEQ ID NO: 337670 - RNA, 22 nt, Human
uguauaaauuuaaauuccugcu

SEQ ID NO: 337671 - RNA, 22 nt, Human
ucccaggaauugaagccagugu

SEQ ID NO: 337672 - RNA, 20 nt, Human
ucauuguguugccaauuccc

SEQ ID NO: 337673 - RNA, 22 nt, Human
agaggacaaaaugagaagugcu

SEQ ID NO: 337674 - RNA, 22 nt, Human
agcauccaacaggagggaaggg

SEQ ID NO: 337675 - RNA, 22 nt, Human
aauaacuuaagaaauuucccca

SEQ ID NO: 337676 - RNA, 22 nt, Human
gagaggggcccaagccacauag

SEQ ID NO: 337677 - RNA, 22 nt, Human
aaagccagagcaagcugucaca

SEQ ID NO: 337678 - RNA, 22 nt, Human
agaggccagguccagaguuugu

SEQ ID NO: 337679 - RNA, 22 nt, Human
ugucugugaccucuuuggagcc

SEQ ID NO: 337680 - RNA, 22 nt, Human
gucugucaucugagauggagug

SEQ ID NO: 337681 - RNA, 22 nt, Human
aucaaauauaauaauuuucgcu

SEQ ID NO: 337682 - RNA, 22 nt, Human
cauggcugcgagaagagugggu

SEQ ID NO: 337683 - RNA, 22 nt, Human
uuaaauuagucaagcuucucug

SEQ ID NO: 337684 - RNA, 22 nt, Human
augggaggaugcucgggugcuc

SEQ ID NO: 337685 - RNA, 22 nt, Human
uuugaaaggaauuaggaugaca

SEQ ID NO: 337686 - RNA, 22 nt, Human
cugcaucacagcaggaggcaca

SEQ ID NO: 337687 - RNA, 23 nt, Human
uuagagaugauuaaaaaaucuug

SEQ ID NO: 337688 - RNA, 22 nt, Human
uuauucuuuucuccagaauccc

SEQ ID NO: 337689 - RNA, 22 nt, Human
guugaaagcuuuucauuuaguu

SEQ ID NO: 337690 - RNA, 22 nt, Human
cuucuucagcacaauauugaug

SEQ ID NO: 337691 - RNA, 22 nt, Human
uugugaguagugccgcaauaaa

SEQ ID NO: 337692 - RNA, 22 nt, Human
uuggaaaaacacgauagugguu

SEQ ID NO: 337693 - RNA, 22 nt, Human
gugacagucaaagacaugacuu

SEQ ID NO: 337694 - RNA, 22 nt, Human
aucaggaugaagcuguagcgaa

SEQ ID NO: 337695 - RNA, 20 nt, Human
accaggagauggaggcaggg

SEQ ID NO: 337696 - RNA, 22 nt, Human
agggcagccauugagggauucu

SEQ ID NO: 337697 - RNA, 22 nt, Human
acauuucacuguucacagcagg

SEQ ID NO: 337698 - RNA, 22 nt, Human
gcagaggcuguagggaagguug

SEQ ID NO: 337699 - RNA, 20 nt, Human
ugugaaagcaguagaaugac

SEQ ID NO: 337700 - RNA, 22 nt, Human
ucagagaguuggaaagaauuaa

SEQ ID NO: 337701 - RNA, 21 nt, Human
acucaggagacuaacuauguc

SEQ ID NO: 337702 - RNA, 22 nt, Human
uuccaugaagggcagccucuca

SEQ ID NO: 337703 - RNA, 22 nt, Human
uccaugucuucaugugucuaac

SEQ ID NO: 337704 - RNA, 22 nt, Human
uuaaauauuuucagcaggguca

SEQ ID NO: 337705 - RNA, 22 nt, Human
uaauaguuucauaaugugcuuc

SEQ ID NO: 337706 - RNA, 22 nt, Human
gucuucuuuaaccuacuaaagc

SEQ ID NO: 337707 - RNA, 22 nt, Human
gaggcagugucgguggcaggau

SEQ ID NO: 337708 - RNA, 22 nt, Human
agagggauaauauguauuguaa

SEQ ID NO: 337709 - RNA, 22 nt, Human
uucaggauuguguuuuuccuga

SEQ ID NO: 337710 - RNA, 22 nt, Human
ggagugggaacaaugacauggu

SEQ ID NO: 337711 - RNA, 22 nt, Human
cuuguccccagcagguugguuu

SEQ ID NO: 337712 - RNA, 22 nt, Human
cugucauuuaagacauucugga

SEQ ID NO: 337713 - RNA, 22 nt, Human
accauguguuuuacacauggua

SEQ ID NO: 337714 - RNA, 19 nt, Human
uugaaauuguuugauaugg

SEQ ID NO: 337715 - RNA, 22 nt, Human
augcaucuauucccaagggcag

SEQ ID NO: 337716 - RNA, 22 nt, Human
caggcagcaggagcccugcucg

SEQ ID NO: 337717 - RNA, 22 nt, Human
aggacagcagugcuggcacuug

SEQ ID NO: 337718 - RNA, 22 nt, Human
aggcaggccccugagaauagac

SEQ ID NO: 337719 - RNA, 22 nt, Human
uucacagacuuuccauagauug

SEQ ID NO: 337720 - RNA, 19 nt, Human
agccuggcuuugcucugcu

SEQ ID NO: 337721 - RNA, 22 nt, Human
ucugcucugggccagcuauuaa

SEQ ID NO: 337722 - RNA, 22 nt, Human
ggcagcugcaaaucugcucugu

SEQ ID NO: 337723 - RNA, 22 nt, Human
gcauaugaucacgugugucggu

SEQ ID NO: 337724 - RNA, 22 nt, Human
ugaaagguuauuuaggucugcu

SEQ ID NO: 337725 - RNA, 20 nt, Human
cgugcugugaccuugagcau

SEQ ID NO: 337726 - RNA, 22 nt, Human
ccccaggacguggcccucauag

SEQ ID NO: 337727 - RNA, 22 nt, Human
aaggcagcaccgccuccugaaa

SEQ ID NO: 337728 - RNA, 22 nt, Human
ugagagggcccagagcacacca

SEQ ID NO: 337729 - RNA, 22 nt, Human
aaacacaucauucaugucguca

SEQ ID NO: 337730 - RNA, 22 nt, Human
uuauuucauugauuucuaagac

SEQ ID NO: 337731 - RNA, 21 nt, Human
uuugaaagugggugauucuuu

SEQ ID NO: 337732 - RNA, 22 nt, Human
ucaggaugguccuuuaugagaa

SEQ ID NO: 337733 - RNA, 22 nt, Human
aggcagcugugaggacuggauu

SEQ ID NO: 337734 - RNA, 22 nt, Human
auguuugaaauuguaaguauau

SEQ ID NO: 337735 - RNA, 20 nt, Human
ggcagcuugggcagcaguua

SEQ ID NO: 337736 - RNA, 22 nt, Human
uuugaagugggcauuagaaccu

SEQ ID NO: 337737 - RNA, 22 nt, Human
uuuaucuuuaggacuuugcaga

SEQ ID NO: 337738 - RNA, 22 nt, Human
uguccauggauagagcugcucg

SEQ ID NO: 337739 - RNA, 22 nt, Human
gaggagagaugguagauugggu

SEQ ID NO: 337740 - RNA, 22 nt, Human
gaacacauuagucugaguuggc

SEQ ID NO: 337741 - RNA, 22 nt, Human
uaaggccagcaugaaugcagca

SEQ ID NO: 337742 - RNA, 22 nt, Human
uccugaggcucacuuugaaugu

SEQ ID NO: 337743 - RNA, 22 nt, Human
ugugaaggagaugaagggagug

SEQ ID NO: 337744 - RNA, 22 nt, Human
acccaggauagagugcugcagu

SEQ ID NO: 337745 - RNA, 22 nt, Human
auuauuauuguugauguuaggg

SEQ ID NO: 337746 - RNA, 22 nt, Human
auuugcuuucagguauaaaagg

SEQ ID NO: 337747 - RNA, 22 nt, Human
uguaggaaaaacaaugaucugc

SEQ ID NO: 337748 - RNA, 22 nt, Human
uucugucucuguguuuacauua

SEQ ID NO: 337749 - RNA, 22 nt, Human
cuacaaugacagaauugaguag

SEQ ID NO: 337750 - RNA, 22 nt, Human
uccaggaggugaggggaccaaa

SEQ ID NO: 337751 - RNA, 22 nt, Human
guccaugauucugugacacccu

SEQ ID NO: 337752 - RNA, 17 nt, Human
ugauaguucauuuuaag

SEQ ID NO: 337753 - RNA, 22 nt, Human
ucucagaguuuagagcugagcc

SEQ ID NO: 337754 - RNA, 22 nt, Human
ugucuucaguaaaauacacuau

SEQ ID NO: 337755 - RNA, 21 nt, Human
agagagggagaugaaacaucc

SEQ ID NO: 337756 - RNA, 22 nt, Human
uaacacauauuugcaguaagca

SEQ ID NO: 337757 - RNA, 22 nt, Human
uccaugagagguaacuuuacaa

SEQ ID NO: 337758 - RNA, 22 nt, Human
cccaggaggacauuccauaccc

SEQ ID NO: 337759 - RNA, 22 nt, Human
gcaguucuacuuauccauagac

SEQ ID NO: 337760 - RNA, 22 nt, Human
cauuuguaauacugacuugcag

SEQ ID NO: 337761 - RNA, 22 nt, Human
ucaaauaaugccauucaucauc

SEQ ID NO: 337762 - RNA, 22 nt, Human
cugcugugcuuguggccacccg

SEQ ID NO: 337763 - RNA, 22 nt, Human
ugugcaggugcaggaagggggc

SEQ ID NO: 337764 - RNA, 17 nt, Human
ccuguguuugcuccuuc

SEQ ID NO: 337765 - RNA, 22 nt, Human
ccaggagaugggagcaucuaaa

SEQ ID NO: 337766 - RNA, 23 nt, Human
uguugaaguaacuguuacauaga

SEQ ID NO: 337767 - RNA, 22 nt, Human
cauuuacuuaaaucuuuacaag

SEQ ID NO: 337768 - RNA, 22 nt, Human
cauaauuucccaagagauugaa

SEQ ID NO: 337769 - RNA, 22 nt, Human
uucaauucaauucuaaauauau

SEQ ID NO: 337770 - RNA, 22 nt, Human
cauucauuagaauagauaugua

SEQ ID NO: 337771 - RNA, 22 nt, Human
ggugaaggcacaagagggcaag

SEQ ID NO: 337772 - RNA, 22 nt, Human
uguaugaauauguauuuucaua

SEQ ID NO: 337773 - RNA, 22 nt, Human
caggcagcagaggaguguggga

SEQ ID NO: 337774 - RNA, 22 nt, Human
cugagcugggaguagagacucu

SEQ ID NO: 337775 - RNA, 22 nt, Human
gucuuuaugguaugaaaacuga

SEQ ID NO: 337776 - RNA, 22 nt, Human
ccaggcugcagucaaggggcau

SEQ ID NO: 337777 - RNA, 22 nt, Human
cucccaggacucagaggagaag

SEQ ID NO: 337778 - RNA, 18 nt, Human
gcagcugacacuggaguu

SEQ ID NO: 337779 - RNA, 22 nt, Human
ccauuguaaauucuguggaagu

SEQ ID NO: 337780 - RNA, 23 nt, Human
uuugaaaguaucaacucgccuga

SEQ ID NO: 337781 - RNA, 22 nt, Human
agcuggcagucauccuagugag

SEQ ID NO: 337782 - RNA, 22 nt, Human
uuccuuaguugacugucuuagu

SEQ ID NO: 337783 - RNA, 22 nt, Human
uucuucuuucccccugugguac

SEQ ID NO: 337784 - RNA, 22 nt, Human
ucucuucuaauuuucccgagua

SEQ ID NO: 337785 - RNA, 22 nt, Human
caagauggguguugugaugguu

SEQ ID NO: 337786 - RNA, 22 nt, Human
aaaggugacacucugccagcug

SEQ ID NO: 337787 - RNA, 22 nt, Human
ucuggucaguaauaagaagugg

SEQ ID NO: 337788 - RNA, 22 nt, Human
ccuugcguuuuacagcuucuag

SEQ ID NO: 337789 - RNA, 22 nt, Human
cauucucaauaguagaugagua

SEQ ID NO: 337790 - RNA, 22 nt, Human
uaugacauuauaaaggauuauu

SEQ ID NO: 337791 - RNA, 22 nt, Human
aucugcuugaaugagcaacagg

SEQ ID NO: 337792 - RNA, 22 nt, Human
guuaaauucgaugauggauaaa

SEQ ID NO: 337793 - RNA, 22 nt, Human
gaaacauauuaauccagugaaa

SEQ ID NO: 337794 - RNA, 22 nt, Human
cacauauuugaugaagcuuugu

SEQ ID NO: 337795 - RNA, 22 nt, Human
uuucuaggcacagugucuuccc

SEQ ID NO: 337796 - RNA, 22 nt, Human
ggcaagcucaggccucaggugu

SEQ ID NO: 337797 - RNA, 22 nt, Human
aaauuguugaucuacaguaagg

SEQ ID NO: 337798 - RNA, 19 nt, Human
ucauuguugguuugucggg

SEQ ID NO: 337799 - RNA, 22 nt, Human
ucaagugcuugugagguauuug

SEQ ID NO: 337800 - RNA, 22 nt, Human
uucuucuugucugcccucacau

SEQ ID NO: 337801 - RNA, 22 nt, Human
uucaugugauaaaugugugacu

SEQ ID NO: 337802 - RNA, 22 nt, Human
ggccagcucugcacagcagcug

SEQ ID NO: 337803 - RNA, 22 nt, Human
gcauguguuauuuuauguauga

SEQ ID NO: 337804 - RNA, 22 nt, Human
auuaaauuagcaaacugugaaa

SEQ ID NO: 337805 - RNA, 22 nt, Human
gagggaauggugugcaagaggu

SEQ ID NO: 337806 - RNA, 22 nt, Human
uaaauuaugucacaugacucug

SEQ ID NO: 337807 - RNA, 22 nt, Human
uugcccagaguccacagcguac

SEQ ID NO: 337808 - RNA, 22 nt, Human
cuggcugggagcgagcugcuca

SEQ ID NO: 337809 - RNA, 23 nt, Human
uuuuccagaaucgacucuguaga

SEQ ID NO: 337810 - RNA, 22 nt, Human
cccaggaggcagagguuggagc

SEQ ID NO: 337811 - RNA, 22 nt, Human
uauagccauuuccaguggcauc

SEQ ID NO: 337812 - RNA, 22 nt, Human
uugugaaauguuucaaaauagu

SEQ ID NO: 337813 - RNA, 22 nt, Human
uacacacagaggccaugggauu

SEQ ID NO: 337814 - RNA, 22 nt, Human
uauaauguuuuccauggacuga

SEQ ID NO: 337815 - RNA, 22 nt, Human
acccaggacuuggcaaccucau

SEQ ID NO: 337816 - RNA, 22 nt, Human
aggcagccaucugcaggaagga

SEQ ID NO: 337817 - RNA, 22 nt, Human
aaugcuuuuugcgaaaugugca

SEQ ID NO: 337818 - RNA, 22 nt, Human
aagggaggccagagguuuugca

SEQ ID NO: 337819 - RNA, 22 nt, Human
ugaaaugauguacaagaaggca

SEQ ID NO: 337820 - RNA, 22 nt, Human
acccaggagguggaggcugcag

SEQ ID NO: 337821 - RNA, 22 nt, Human
uggcagcuggaucccaaggcag

SEQ ID NO: 337822 - RNA, 22 nt, Human
cacucaggguacaauggagggc

SEQ ID NO: 337823 - RNA, 18 nt, Human
ggucuuuaggucaguguc

SEQ ID NO: 337824 - RNA, 22 nt, Human
agcagagguuuguuggaaaccu

SEQ ID NO: 337825 - RNA, 22 nt, Human
cagcaggagcagucagacuccu

SEQ ID NO: 337826 - RNA, 22 nt, Human
uauuuccaaaagccuauuauga

SEQ ID NO: 337827 - RNA, 22 nt, Human
acaauacaggcuucuggacuua

SEQ ID NO: 337828 - RNA, 22 nt, Human
gggcagcugccagaggccaugg

SEQ ID NO: 337829 - RNA, 22 nt, Human
uucauacacgaaaaugcaugca

SEQ ID NO: 337830 - RNA, 20 nt, Human
uuaucugucaaucugucuca

SEQ ID NO: 337831 - RNA, 22 nt, Human
ucuuuuggaaaugaugugcagg

SEQ ID NO: 337832 - RNA, 22 nt, Human
gaauauuuucaguacagauggu

SEQ ID NO: 337833 - RNA, 22 nt, Human
ugaggcagcccacuuuccuuag

SEQ ID NO: 337834 - RNA, 22 nt, Human
ucugcucuguggcuucagcuaa

SEQ ID NO: 337835 - RNA, 22 nt, Human
cuggcuuucucugugguguuca

SEQ ID NO: 337836 - RNA, 22 nt, Human
ucauucuugaucacuaguuagu

SEQ ID NO: 337837 - RNA, 22 nt, Human
aucaggaucugggagccugaaa

SEQ ID NO: 337838 - RNA, 22 nt, Human
ugaggggauacgguacacauug

SEQ ID NO: 337839 - RNA, 22 nt, Human
augcagcuucaggauuaugaug

SEQ ID NO: 337840 - RNA, 22 nt, Human
ugcuuuggaucuauuugcugag

SEQ ID NO: 337841 - RNA, 23 nt, Human
acauacauggagauaaagugaug

SEQ ID NO: 337842 - RNA, 22 nt, Human
ggcacagagcccagcuuccuag

SEQ ID NO: 337843 - RNA, 22 nt, Human
agaccuggauuccaauccuacc

SEQ ID NO: 337844 - RNA, 22 nt, Human
ucugaaauagaagugucuuucu

SEQ ID NO: 337845 - RNA, 22 nt, Human
uucccucucacuuaaagcuugg

SEQ ID NO: 337846 - RNA, 22 nt, Human
uacauaugaacuuuauaacuug

SEQ ID NO: 337847 - RNA, 22 nt, Human
cuucagaggggacucaaaguca

SEQ ID NO: 337848 - RNA, 21 nt, Human
cccacggaaugaugaggcacu

SEQ ID NO: 337849 - RNA, 22 nt, Human
aggcugcugaggccaccacgcu

SEQ ID NO: 337850 - RNA, 22 nt, Human
gaaaggccauuucugaggguuu

SEQ ID NO: 337851 - RNA, 19 nt, Human
ccaggagagcuuggagaag

SEQ ID NO: 337852 - RNA, 22 nt, Human
ugaggcagugugagauaauaaa

SEQ ID NO: 337853 - RNA, 22 nt, Human
aaaggccacugcaagggaaggu

SEQ ID NO: 337854 - RNA, 22 nt, Human
cucaggauccaucuccugcccu

SEQ ID NO: 337855 - RNA, 22 nt, Human
uaacauuagguagacauaagcc

SEQ ID NO: 337856 - RNA, 22 nt, Human
ugucaagucucugaaugaaaug

SEQ ID NO: 337857 - RNA, 22 nt, Human
gcauguguugguuuaugcaugu

SEQ ID NO: 337858 - RNA, 22 nt, Human
gcugggaagugcaagaucaagg

SEQ ID NO: 337859 - RNA, 22 nt, Human
aggcaagcgcagaagcggagga

SEQ ID NO: 337860 - RNA, 22 nt, Human
cuucucagcauuuugucagucu

SEQ ID NO: 337861 - RNA, 22 nt, Human
uggcagcuggcucugcgcaggc

SEQ ID NO: 337862 - RNA, 22 nt, Human
gcagcuccuccugggcuggaga

SEQ ID NO: 337863 - RNA, 22 nt, Human
uugggcucaggaguuugagacc

SEQ ID NO: 337864 - RNA, 22 nt, Human
uccaugaggcagggaggcuggc

SEQ ID NO: 337865 - RNA, 22 nt, Human
uaugaacuguaacccucaccgc

SEQ ID NO: 337866 - RNA, 22 nt, Human
agagcagcugugacauggacag

SEQ ID NO: 337867 - RNA, 22 nt, Human
uggggcucaccuaggcuggaag

SEQ ID NO: 337868 - RNA, 22 nt, Human
caauaguucgguccugaaggcc

SEQ ID NO: 337869 - RNA, 22 nt, Human
ugcuuucaaaggcuuucuagau

SEQ ID NO: 337870 - RNA, 22 nt, Human
auguaugaugcuaggcucucag

SEQ ID NO: 337871 - RNA, 22 nt, Human
aaauaguuguuuggaucaauaa

SEQ ID NO: 337872 - RNA, 22 nt, Human
aggaagcuaaccagggagugag

SEQ ID NO: 337873 - RNA, 22 nt, Human
uguagaaacuacacaugcaaca

SEQ ID NO: 337874 - RNA, 22 nt, Human
ugcuucugggcaaaugugugug

SEQ ID NO: 337875 - RNA, 22 nt, Human
ugucauaacuuagugacaaauc

SEQ ID NO: 337876 - RNA, 22 nt, Human
uuucaguuguccuguuaauagc

SEQ ID NO: 337877 - RNA, 22 nt, Human
uuccuugaaugagucauggaaa

SEQ ID NO: 337878 - RNA, 22 nt, Human
ccaggagagcaggcgugcagcu

SEQ ID NO: 337879 - RNA, 22 nt, Human
acauuuaaccaaacuguuuaau

SEQ ID NO: 337880 - RNA, 22 nt, Human
uuuucuuauggugaagcacaaa

SEQ ID NO: 337881 - RNA, 22 nt, Human
ccaggagagcauugcacagagg

SEQ ID NO: 337882 - RNA, 22 nt, Human
aaaguguggucguucauuuugu

SEQ ID NO: 337883 - RNA, 19 nt, Human
uucuccaggcugcagaggg

SEQ ID NO: 337884 - RNA, 22 nt, Human
ccugccugcaccuucucugggg

SEQ ID NO: 337885 - RNA, 22 nt, Human
aaugucauugguaaagauuagg

SEQ ID NO: 337886 - RNA, 22 nt, Human
uuucugaaaucucuuuugagga

SEQ ID NO: 337887 - RNA, 22 nt, Human
cuacccagauccaggauggcua

SEQ ID NO: 337888 - RNA, 22 nt, Human
aaaaugacauuccagugauauu

SEQ ID NO: 337889 - RNA, 22 nt, Human
cugcuuuguaaaauagacauaa

SEQ ID NO: 337890 - RNA, 22 nt, Human
aaucuguuuaguucugcguaug

SEQ ID NO: 337891 - RNA, 22 nt, Human
ggguggagaggcuaaguccagu

SEQ ID NO: 337892 - RNA, 22 nt, Human
agauauguuuguauauauuugu

SEQ ID NO: 337893 - RNA, 22 nt, Human
uuucuaggucuuccauacugcc

SEQ ID NO: 337894 - RNA, 22 nt, Human
uucuaugccauguucagcuacu

SEQ ID NO: 337895 - RNA, 22 nt, Human
agggauggaagacuugaagacc

SEQ ID NO: 337896 - RNA, 22 nt, Human
guagccauuggcaaugaagccu

SEQ ID NO: 337897 - RNA, 22 nt, Human
aaauauaguaaaugcauaguuc

SEQ ID NO: 337898 - RNA, 22 nt, Human
ucuucauauauaaaguggaaua

SEQ ID NO: 337899 - RNA, 22 nt, Human
uccaggagaggccugaccaggu

SEQ ID NO: 337900 - RNA, 22 nt, Human
ugaaagauugugauucaauaug

SEQ ID NO: 337901 - RNA, 22 nt, Human
ugaggcaggaguuaaugugcuc

SEQ ID NO: 337902 - RNA, 22 nt, Human
ugcuuggccuacuuguccuuug

SEQ ID NO: 337903 - RNA, 22 nt, Human
acccaggaggugacacagggcu

SEQ ID NO: 337904 - RNA, 22 nt, Human
auguucuuguucaaaugucagu

SEQ ID NO: 337905 - RNA, 21 nt, Human
uucucagaucgaguagugaga

SEQ ID NO: 337906 - RNA, 22 nt, Human
gaagcagcaaguauaggacagg

SEQ ID NO: 337907 - RNA, 22 nt, Human
cuauugaauuaacuauuaaagu

SEQ ID NO: 337908 - RNA, 22 nt, Human
gaaacuuacuuacucacauuuc

SEQ ID NO: 337909 - RNA, 22 nt, Human
aacuagucagugauucucagaa

SEQ ID NO: 337910 - RNA, 22 nt, Human
ggacaagccugugaguggguuu

SEQ ID NO: 337911 - RNA, 22 nt, Human
uccaggagguagugcuuaauuu

SEQ ID NO: 337912 - RNA, 19 nt, Human
cccaggagucuggcugguu

SEQ ID NO: 337913 - RNA, 22 nt, Human
gagguggucgaggagggguacc

SEQ ID NO: 337914 - RNA, 22 nt, Human
gaggcaucugggcacagaagug

SEQ ID NO: 337915 - RNA, 22 nt, Human
ucuucucucauguaggagggaa

SEQ ID NO: 337916 - RNA, 22 nt, Human
uguaugaauauguuggggaggu

SEQ ID NO: 337917 - RNA, 22 nt, Human
agugcagcaugcuggggaggcu

SEQ ID NO: 337918 - RNA, 22 nt, Human
gaggcagcugaagcuucaaaga

SEQ ID NO: 337919 - RNA, 22 nt, Human
ggaggcaggaaagacagguuca

SEQ ID NO: 337920 - RNA, 22 nt, Human
aggaaagguagcgugccagcag

SEQ ID NO: 337921 - RNA, 22 nt, Human
ugcauguguguguauuuauaaa

SEQ ID NO: 337922 - RNA, 22 nt, Human
agucagugaaaacuagaauguu

SEQ ID NO: 337923 - RNA, 22 nt, Human
cccaggaaacccgaaggcgacc

SEQ ID NO: 337924 - RNA, 22 nt, Human
ucuuuucaucauuuaauaggua

SEQ ID NO: 337925 - RNA, 22 nt, Human
cacaauuuguuuuaucaguauu

SEQ ID NO: 337926 - RNA, 22 nt, Human
uagcauuucccaaaugcauuug

SEQ ID NO: 337927 - RNA, 22 nt, Human
auuuccuuugcaaagacugugc

SEQ ID NO: 337928 - RNA, 22 nt, Human
cagcaggauaugguggagagag

SEQ ID NO: 337929 - RNA, 22 nt, Human
uuugaaagggacaaagucacug

SEQ ID NO: 337930 - RNA, 22 nt, Human
gcugcccaggguggagccggcu

SEQ ID NO: 337931 - RNA, 18 nt, Human
agucuucugauccauuuu

SEQ ID NO: 337932 - RNA, 22 nt, Human
aggaagcuccuggagagccagu

SEQ ID NO: 337933 - RNA, 17 nt, Human
gccaggagguuugagcu

SEQ ID NO: 337934 - RNA, 22 nt, Human
aagagggcugcaaucuuauugc

SEQ ID NO: 337935 - RNA, 22 nt, Human
acccaggacucucuuccaguag

SEQ ID NO: 337936 - RNA, 22 nt, Human
gaggccagggaugcaaugagag

SEQ ID NO: 337937 - RNA, 22 nt, Human
auucuucaccauggauaauuug

SEQ ID NO: 337938 - RNA, 22 nt, Human
gcugaaugaauguauuuuaaaa

SEQ ID NO: 337939 - RNA, 22 nt, Human
ugucucugauaaguaguucagu

SEQ ID NO: 337940 - RNA, 22 nt, Human
ggccagagaauaugccuuacgu

SEQ ID NO: 337941 - RNA, 22 nt, Human
gucuucuguaagaugagguccc

SEQ ID NO: 337942 - RNA, 22 nt, Human
cuuuggcaaugucauuuucaau

SEQ ID NO: 337943 - RNA, 22 nt, Human
agaggacagguuuuccaugggc

SEQ ID NO: 337944 - RNA, 22 nt, Human
uugaagaggacuuugcagcugu

SEQ ID NO: 337945 - RNA, 22 nt, Human
uuaaaaugaauauugauuagca

SEQ ID NO: 337946 - RNA, 18 nt, Human
agggaguuuuagggaagg

SEQ ID NO: 337947 - RNA, 22 nt, Human
acucaggaauggggcugggacu

SEQ ID NO: 337948 - RNA, 22 nt, Human
ccaaaugugccuguuucaacaa

SEQ ID NO: 337949 - RNA, 22 nt, Human
uauugacaauuugugaaacuau

SEQ ID NO: 337950 - RNA, 22 nt, Human
uuggaaauacagcaguuacuuu

SEQ ID NO: 337951 - RNA, 22 nt, Human
aggcaggcaaccaccugggaag

SEQ ID NO: 337952 - RNA, 18 nt, Human
acucaggaaaugaugaca

SEQ ID NO: 337953 - RNA, 22 nt, Human
ugaggcagggagaguggauaug

SEQ ID NO: 337954 - RNA, 22 nt, Human
augcuguggccagaguucaacu

SEQ ID NO: 337955 - RNA, 22 nt, Human
augcuguguuugagaaccuagg

SEQ ID NO: 337956 - RNA, 22 nt, Human
ugaggcagcauucuucaagaca

SEQ ID NO: 337957 - RNA, 22 nt, Human
cagcuagcuaagaaggccagag

SEQ ID NO: 337958 - RNA, 22 nt, Human
gccagagguucaacaacugucu

SEQ ID NO: 337959 - RNA, 22 nt, Human
caugcuguguguuuuagcucca

SEQ ID NO: 337960 - RNA, 22 nt, Human
ucauuuguaccauuuuuuaaga

SEQ ID NO: 337961 - RNA, 22 nt, Human
gcuuuggagccuguguucugcc

SEQ ID NO: 337962 - RNA, 22 nt, Human
ucauuuaauagcuuuugucuuu

SEQ ID NO: 337963 - RNA, 22 nt, Human
gugggagcuuuggcaucaggcu

SEQ ID NO: 337964 - RNA, 22 nt, Human
guguguuuagcauuagcagggg

SEQ ID NO: 337965 - RNA, 21 nt, Human
ggcagccucuguggaagggga

SEQ ID NO: 337966 - RNA, 22 nt, Human
uuucacauuagauaugucauuu

SEQ ID NO: 337967 - RNA, 22 nt, Human
uuuccuaguucuaagaaaugua

SEQ ID NO: 337968 - RNA, 22 nt, Human
cccaggaagaggggucaggugu

SEQ ID NO: 337969 - RNA, 22 nt, Human
agaggauguucuaggcacucau

SEQ ID NO: 337970 - RNA, 22 nt, Human
uuguaugaggauagcaagaagc

SEQ ID NO: 337971 - RNA, 22 nt, Human
agugcuguaacaacuuauuugg

SEQ ID NO: 337972 - RNA, 19 nt, Human
uaaggccaaaaguaagugu

SEQ ID NO: 337973 - RNA, 22 nt, Human
ucuguggauuuuaguguucaug

SEQ ID NO: 337974 - RNA, 22 nt, Human
ugcuagugcaggguuuucaguu

SEQ ID NO: 337975 - RNA, 22 nt, Human
uguugaagauaaaguucucauu

SEQ ID NO: 337976 - RNA, 22 nt, Human
aaaggaagauugagcuuuucca

SEQ ID NO: 337977 - RNA, 22 nt, Human
uauuucagggagaauaaauuug

SEQ ID NO: 337978 - RNA, 22 nt, Human
aagaggagacuucagcaacuug

SEQ ID NO: 337979 - RNA, 22 nt, Human
uagcauuuauuccagauuugga

SEQ ID NO: 337980 - RNA, 22 nt, Human
ucccaggacaggccacauggaa

SEQ ID NO: 337981 - RNA, 22 nt, Human
gaggauggaggugugagcuaug

SEQ ID NO: 337982 - RNA, 22 nt, Human
gguuauauaauucagugcuuuc

SEQ ID NO: 337983 - RNA, 22 nt, Human
auucuuaauugccaugcuguau

SEQ ID NO: 337984 - RNA, 22 nt, Human
agugcuuuagcauccaacuguc

SEQ ID NO: 337985 - RNA, 22 nt, Human
ugugaaaagcaggcuacuuucu

SEQ ID NO: 337986 - RNA, 17 nt, Human
agguauaaaaugguagc

SEQ ID NO: 337987 - RNA, 22 nt, Human
uauuugaaaguguacaaaaacu

SEQ ID NO: 337988 - RNA, 22 nt, Human
gaaaggcaguacagcugagccu

SEQ ID NO: 337989 - RNA, 23 nt, Human
aaugauuucaugaugauagcagc

SEQ ID NO: 337990 - RNA, 22 nt, Human
cuggcuguauuaguuugauccu

SEQ ID NO: 337991 - RNA, 22 nt, Human
aaggcagcagugcacgacugau

SEQ ID NO: 337992 - RNA, 22 nt, Human
uucugucacuuaggaggucaua

SEQ ID NO: 337993 - RNA, 22 nt, Human
ccccaggagcuuguuuuagaga

SEQ ID NO: 337994 - RNA, 22 nt, Human
uaacacauagauauuuuaacuu

SEQ ID NO: 337995 - RNA, 22 nt, Human
gaaggccacaagagaaguuaag

SEQ ID NO: 337996 - RNA, 22 nt, Human
ucugggaaaugcuguuccuugu

SEQ ID NO: 337997 - RNA, 22 nt, Human
cagagcucuauguucauggagg

SEQ ID NO: 337998 - RNA, 22 nt, Human
uugguuuacuaggauucaaauu

SEQ ID NO: 337999 - RNA, 22 nt, Human
aagagaggacauggugaaccug

SEQ ID NO: 338000 - RNA, 22 nt, Human
ugcuauaaguagacauucaaca

SEQ ID NO: 338001 - RNA, 22 nt, Human
gcccaguaguucaagguugcag

SEQ ID NO: 338002 - RNA, 23 nt, Human
uucuuucaagaaguucacagugc

SEQ ID NO: 338003 - RNA, 22 nt, Human
cccaggaaaguggaggcggcug

SEQ ID NO: 338004 - RNA, 22 nt, Human
uagcaauagaaacauauaaagu

SEQ ID NO: 338005 - RNA, 16 nt, Human
aaggagggaagagaau

SEQ ID NO: 338006 - RNA, 22 nt, Human
ugcuuugggucucucuaguuuc

SEQ ID NO: 338007 - RNA, 22 nt, Human
ggaggcugagaaguccaagauc

SEQ ID NO: 338008 - RNA, 22 nt, Human
ucuucagacccuuagcugugau

SEQ ID NO: 338009 - RNA, 22 nt, Human
augcuguguccuagugaaagaa

SEQ ID NO: 338010 - RNA, 19 nt, Human
aaacacagauuucuuacca

SEQ ID NO: 338011 - RNA, 18 nt, Human
uggcagcuagguaaagaa

SEQ ID NO: 338012 - RNA, 19 nt, Human
cccaggagcaguauugaug

SEQ ID NO: 338013 - RNA, 22 nt, Human
gcagcucccagcuugaaagguc

SEQ ID NO: 338014 - RNA, 22 nt, Human
gaggagcugggcugagaggguc

SEQ ID NO: 338015 - RNA, 22 nt, Human
gggcagcuggcuuauagguuug

SEQ ID NO: 338016 - RNA, 22 nt, Human
aggcaguuguagagagggcucu

SEQ ID NO: 338017 - RNA, 22 nt, Human
auguggaggaaaugaguguaca

SEQ ID NO: 338018 - RNA, 22 nt, Human
auguuauuaaaguacagauucu

SEQ ID NO: 338019 - RNA, 22 nt, Human
ccauccuaucugaccuacuugu

SEQ ID NO: 338020 - RNA, 22 nt, Human
gaaauauuucucuugagccccu

SEQ ID NO: 338021 - RNA, 20 nt, Human
aucuucuuggccagcuugcu

SEQ ID NO: 338022 - RNA, 22 nt, Human
auaucauuauguuaugagcaca

SEQ ID NO: 338023 - RNA, 22 nt, Human
uacagcauguccuuagcaaggc

SEQ ID NO: 338024 - RNA, 22 nt, Human
caggaugagguagaggcagaua

SEQ ID NO: 338025 - RNA, 22 nt, Human
caguuucuacgaaggucaaccc

SEQ ID NO: 338026 - RNA, 22 nt, Human
aaaacaguuuaggcaucacagu

SEQ ID NO: 338027 - RNA, 22 nt, Human
aauuacuuaagagaaacuuuga

SEQ ID NO: 338028 - RNA, 22 nt, Human
aucuucucauguguaaugaggu

SEQ ID NO: 338029 - RNA, 18 nt, Human
ccucagggagagagacgc

SEQ ID NO: 338030 - RNA, 22 nt, Human
ugaggcaggacuugcauaaagu

SEQ ID NO: 338031 - RNA, 22 nt, Human
aaggcagccucugccagccggg

SEQ ID NO: 338032 - RNA, 21 nt, Human
agcagaggcugccuggugacu

SEQ ID NO: 338033 - RNA, 22 nt, Human
gaggccuggagccgccuaggcg

SEQ ID NO: 338034 - RNA, 22 nt, Human
ccccaggaagccucagauuugc

SEQ ID NO: 338035 - RNA, 22 nt, Human
uuuguuaaauauuuauugagug

SEQ ID NO: 338036 - RNA, 22 nt, Human
gcugccagccaacuugcugugc

SEQ ID NO: 338037 - RNA, 22 nt, Human
cacaugcaucugucauguuugg

SEQ ID NO: 338038 - RNA, 22 nt, Human
gaaauauuacaguggaggggau

SEQ ID NO: 338039 - RNA, 22 nt, Human
aggguccugggugcaguugcuu

SEQ ID NO: 338040 - RNA, 22 nt, Human
ugaugaauaaacuugagaguca

SEQ ID NO: 338041 - RNA, 17 nt, Human
gcgcagcuccuggcgcg

SEQ ID NO: 338042 - RNA, 22 nt, Human
cucugucaggcugcagaugcuc

SEQ ID NO: 338043 - RNA, 22 nt, Human
cccuggagguggagguugcagg

SEQ ID NO: 338044 - RNA, 22 nt, Human
aagcaccuggguuauaucuuag

SEQ ID NO: 338045 - RNA, 22 nt, Human
gaggggaaaguucugcacaagg

SEQ ID NO: 338046 - RNA, 22 nt, Human
acaugauuuuuaaagagauaau

SEQ ID NO: 338047 - RNA, 22 nt, Human
uaaggccaaacuauuauaguuc

SEQ ID NO: 338048 - RNA, 22 nt, Human
aauaucagcacuuuugugguau

SEQ ID NO: 338049 - RNA, 20 nt, Human
aggaggcauagucuggaaag

SEQ ID NO: 338050 - RNA, 22 nt, Human
gagggagugccagagggccagc

SEQ ID NO: 338051 - RNA, 20 nt, Human
uucaggauucuagaccacac

SEQ ID NO: 338052 - RNA, 22 nt, Human
aaaggccagguuggcugguauu

SEQ ID NO: 338053 - RNA, 19 nt, Human
ggcagcuugggaagguagc

SEQ ID NO: 338054 - RNA, 22 nt, Human
ucugcaggcucuagaugagguu

SEQ ID NO: 338055 - RNA, 22 nt, Human
auucacaaaaugauauagauac

SEQ ID NO: 338056 - RNA, 22 nt, Human
uaugaacugugagugugauggg

SEQ ID NO: 338057 - RNA, 22 nt, Human
caggauggucagaugcauuguc

SEQ ID NO: 338058 - RNA, 22 nt, Human
uucccucuccuacucaggaaag

SEQ ID NO: 338059 - RNA, 17 nt, Human
acucaggaucugggagu

SEQ ID NO: 338060 - RNA, 22 nt, Human
uucacacacagcuuccuauugu

SEQ ID NO: 338061 - RNA, 22 nt, Human
aggcacagcacaccuggccccc

SEQ ID NO: 338062 - RNA, 22 nt, Human
cugcccaggcugaaggaacauc

SEQ ID NO: 338063 - RNA, 22 nt, Human
cccaugagguggagguugcagu

SEQ ID NO: 338064 - RNA, 22 nt, Human
uggcagcuauuacaaggaaguc

SEQ ID NO: 338065 - RNA, 22 nt, Human
uagcccagaagagggaagcaac

SEQ ID NO: 338066 - RNA, 23 nt, Human
ucuguacaauugagaagagaaca

SEQ ID NO: 338067 - RNA, 22 nt, Human
auggagggugucagagagcgaa

SEQ ID NO: 338068 - RNA, 21 nt, Human
uucuucaaagaagaaggcaca

SEQ ID NO: 338069 - RNA, 22 nt, Human
cuugcugggguaagucugugcu

SEQ ID NO: 338070 - RNA, 21 nt, Human
uucaaaaugguguguuugucu

SEQ ID NO: 338071 - RNA, 22 nt, Human
cgcagggauuucaaggggccuu

SEQ ID NO: 338072 - RNA, 19 nt, Human
accaggagacagugagcuu

SEQ ID NO: 338073 - RNA, 22 nt, Human
agcugcccuguggggaggguug

SEQ ID NO: 338074 - RNA, 22 nt, Human
aaccauuugccauuaucuuaag

SEQ ID NO: 338075 - RNA, 22 nt, Human
ugaggcagaaauuccuguuuuc

SEQ ID NO: 338076 - RNA, 22 nt, Human
augugaggaagaaagagguaag

SEQ ID NO: 338077 - RNA, 22 nt, Human
aaggaaccauuugugugcaugg

SEQ ID NO: 338078 - RNA, 22 nt, Human
auuugcuuuuacuauguuaaaa

SEQ ID NO: 338079 - RNA, 22 nt, Human
guuuuauaggugaaauauuacu

SEQ ID NO: 338080 - RNA, 22 nt, Human
uaacacauuuuaagccauuuua

SEQ ID NO: 338081 - RNA, 22 nt, Human
ucuaaagaagaggguucugcgg

SEQ ID NO: 338082 - RNA, 22 nt, Human
uuugcauaagucauguccagug

SEQ ID NO: 338083 - RNA, 22 nt, Human
auguuuuugagauacaaacaga

SEQ ID NO: 338084 - RNA, 23 nt, Human
gggcaguuauguuguccuuggcu

SEQ ID NO: 338085 - RNA, 22 nt, Human
auccaugaagguacuucucagg

SEQ ID NO: 338086 - RNA, 22 nt, Human
uuccuuaggcuguuugcagugc

SEQ ID NO: 338087 - RNA, 22 nt, Human
acacauuucuaaauuuuuaccg

SEQ ID NO: 338088 - RNA, 22 nt, Human
uuugaaaguccuaggagagucc

SEQ ID NO: 338089 - RNA, 22 nt, Human
cucaggaucgcuugcccuaggg

SEQ ID NO: 338090 - RNA, 22 nt, Human
ugcauguguuugccacagugag

SEQ ID NO: 338091 - RNA, 22 nt, Human
agcgagggaggucugaggacag

SEQ ID NO: 338092 - RNA, 22 nt, Human
auuucauagauuguaaaucccu

SEQ ID NO: 338093 - RNA, 20 nt, Human
uuucaagucagcaauucuca

SEQ ID NO: 338094 - RNA, 22 nt, Human
aggucagcaugaguagaaggua

SEQ ID NO: 338095 - RNA, 23 nt, Human
uugauuucaaaugcagagaacac

SEQ ID NO: 338096 - RNA, 22 nt, Human
uguuuuaaagccauugccuuuc

SEQ ID NO: 338097 - RNA, 22 nt, Human
auguagaaaguucauagaugcg

SEQ ID NO: 338098 - RNA, 22 nt, Human
aaaggccaugguuggaguguuu

SEQ ID NO: 338099 - RNA, 22 nt, Human
agagugucugguagcugcucug

SEQ ID NO: 338100 - RNA, 22 nt, Human
ggaggagguggguuaaguugua

SEQ ID NO: 338101 - RNA, 22 nt, Human
uucugucaugcucauguaauug

SEQ ID NO: 338102 - RNA, 22 nt, Human
uuuuccagauuggacuuagucc

SEQ ID NO: 338103 - RNA, 22 nt, Human
aagcgccaugguuccugcgcag

SEQ ID NO: 338104 - RNA, 22 nt, Human
cuggguaaguuccuaaggcuca

SEQ ID NO: 338105 - RNA, 22 nt, Human
cuguaugaggaucagacuggac

SEQ ID NO: 338106 - RNA, 22 nt, Human
uagggauguggugagaacugag

SEQ ID NO: 338107 - RNA, 20 nt, Human
gcagcuacucugucucgcuc

SEQ ID NO: 338108 - RNA, 22 nt, Human
cucaggaugucggugacuauug

SEQ ID NO: 338109 - RNA, 22 nt, Human
uugaaaguagcagcugcauaug

SEQ ID NO: 338110 - RNA, 22 nt, Human
ccaggcugccgaggaaagaaag

SEQ ID NO: 338111 - RNA, 22 nt, Human
ggcagccuugacuagugacuua

SEQ ID NO: 338112 - RNA, 22 nt, Human
uccauuuuagaagaaaauccac

SEQ ID NO: 338113 - RNA, 22 nt, Human
aaaggccauuacuugcuuuuag

SEQ ID NO: 338114 - RNA, 22 nt, Human
ucugcaggcuuggaguggcagc

SEQ ID NO: 338115 - RNA, 22 nt, Human
ggaggcagaacuucccgucagu

SEQ ID NO: 338116 - RNA, 22 nt, Human
cucaggauuuaaaggggcacuc

SEQ ID NO: 338117 - RNA, 22 nt, Human
gaccauuuguugaaaagauuau

SEQ ID NO: 338118 - RNA, 23 nt, Human
uugcauagacauccucauagauu

SEQ ID NO: 338119 - RNA, 22 nt, Human
auuucucuuagcaagacauuac

SEQ ID NO: 338120 - RNA, 22 nt, Human
uggcagcucauuuggaaaugga

SEQ ID NO: 338121 - RNA, 22 nt, Human
ucaguucuuuauuucacaguga

SEQ ID NO: 338122 - RNA, 21 nt, Human
cuguggaagggaacuagaggg

SEQ ID NO: 338123 - RNA, 22 nt, Human
uccaggaggcucugguugacgu

SEQ ID NO: 338124 - RNA, 22 nt, Human
gaggcagcaugguaccuuggag

SEQ ID NO: 338125 - RNA, 22 nt, Human
aggcagcguagcaaggcuagua

SEQ ID NO: 338126 - RNA, 22 nt, Human
augcuuuuaugucacaugguca

SEQ ID NO: 338127 - RNA, 22 nt, Human
auguaugagagauucuuuuauu

SEQ ID NO: 338128 - RNA, 22 nt, Human
aguucucaagacaauuaccugu

SEQ ID NO: 338129 - RNA, 17 nt, Human
uucucugagcuguauug

SEQ ID NO: 338130 - RNA, 22 nt, Human
ugcuagaauuugcagaagcaua

SEQ ID NO: 338131 - RNA, 22 nt, Human
cugucauugagccugucagggc

SEQ ID NO: 338132 - RNA, 22 nt, Human
ucugauuagcaguuuagggaaa

SEQ ID NO: 338133 - RNA, 22 nt, Human
ccaggagaagcaucugagugua

SEQ ID NO: 338134 - RNA, 22 nt, Human
auuaaauuaaguggcuaauuua

SEQ ID NO: 338135 - RNA, 22 nt, Human
caaauguauaaauguacuuucu

SEQ ID NO: 338136 - RNA, 22 nt, Human
guugaaagaugucuugguuccc

SEQ ID NO: 338137 - RNA, 22 nt, Human
uucuccaacacaagcaugaugu

SEQ ID NO: 338138 - RNA, 22 nt, Human
ucuucagagugaaagucuguga

SEQ ID NO: 338139 - RNA, 22 nt, Human
aucugucagccugggauuaggg

SEQ ID NO: 338140 - RNA, 22 nt, Human
auguuuccagguucuuccuaug

SEQ ID NO: 338141 - RNA, 22 nt, Human
ggccagaggugguacauagcuu

SEQ ID NO: 338142 - RNA, 22 nt, Human
auaguuugaaggcuguucuacu

SEQ ID NO: 338143 - RNA, 21 nt, Human
cucuugugucagagccagagg

SEQ ID NO: 338144 - RNA, 22 nt, Human
guguaugagccuccagcugggc

SEQ ID NO: 338145 - RNA, 22 nt, Human
cugcugugccuuaaaaugcaag

SEQ ID NO: 338146 - RNA, 22 nt, Human
ugaaagcagcaccaauaccauu

SEQ ID NO: 338147 - RNA, 22 nt, Human
gaggagagaacauuccuccaua

SEQ ID NO: 338148 - RNA, 22 nt, Human
aggcaguggaaggagaaagcaa

SEQ ID NO: 338149 - RNA, 22 nt, Human
ggcagacuguaauaggagaauu

SEQ ID NO: 338150 - RNA, 22 nt, Human
aggagaggucucccuuccccag

SEQ ID NO: 338151 - RNA, 22 nt, Human
aucaggaugacuauaaggcugc

SEQ ID NO: 338152 - RNA, 22 nt, Human
cucuucuuggcccccaugaggg

SEQ ID NO: 338153 - RNA, 22 nt, Human
auggcagccugagcagaggaau

SEQ ID NO: 338154 - RNA, 22 nt, Human
aaagcagagguugcagugagcu

SEQ ID NO: 338155 - RNA, 22 nt, Human
ggugaagggugucauggcauuu

SEQ ID NO: 338156 - RNA, 22 nt, Human
ugaggcaggagaauggcgggaa

SEQ ID NO: 338157 - RNA, 22 nt, Human
uugaaauaucaaguuauuagug

SEQ ID NO: 338158 - RNA, 22 nt, Human
ucaggagacauucuuaaaguag

SEQ ID NO: 338159 - RNA, 22 nt, Human
aauggccagcugggagaguuga

SEQ ID NO: 338160 - RNA, 22 nt, Human
auacaacagaaaaugauuauuc

SEQ ID NO: 338161 - RNA, 22 nt, Human
cacaggagagcugggaggugcc

SEQ ID NO: 338162 - RNA, 22 nt, Human
aacauauaaacucuuaaguuca

SEQ ID NO: 338163 - RNA, 22 nt, Human
ggcagcauauauucagugggca

SEQ ID NO: 338164 - RNA, 22 nt, Human
cagucucuaaaucaaucugaau

SEQ ID NO: 338165 - RNA, 22 nt, Human
uuguaaauaguaguaagaugcc

SEQ ID NO: 338166 - RNA, 22 nt, Human
gcccaggaguugaaugcagcag

SEQ ID NO: 338167 - RNA, 22 nt, Human
ccacugaggcaggcaguaucua

SEQ ID NO: 338168 - RNA, 22 nt, Human
aaguaaaauguuuccuuuauua

SEQ ID NO: 338169 - RNA, 23 nt, Human
cugcccugaucuugaucuauugu

SEQ ID NO: 338170 - RNA, 22 nt, Human
gaggagaggcuggacgcgguga

SEQ ID NO: 338171 - RNA, 22 nt, Human
augcugugucuagcaggaacac

SEQ ID NO: 338172 - RNA, 22 nt, Human
uaucuguuguccaugcagaaag

SEQ ID NO: 338173 - RNA, 22 nt, Human
aucaggaucugcaucauaagaa

SEQ ID NO: 338174 - RNA, 22 nt, Human
uuucagaaagcugaacauauga

SEQ ID NO: 338175 - RNA, 22 nt, Human
agucuacaaagaaaaguuauug

SEQ ID NO: 338176 - RNA, 22 nt, Human
ucucacuuuccagacuuuucaa

SEQ ID NO: 338177 - RNA, 22 nt, Human
cuagaaauauuuuacagucaag

SEQ ID NO: 338178 - RNA, 20 nt, Human
uuuuccuucugaguauguug

SEQ ID NO: 338179 - RNA, 22 nt, Human
ucacaucucccuggaggacaca

SEQ ID NO: 338180 - RNA, 22 nt, Human
ggccagcagucacagggucaga

SEQ ID NO: 338181 - RNA, 22 nt, Human
ggcagcaucucuggcagcagcu

SEQ ID NO: 338182 - RNA, 22 nt, Human
gaauauuuguaauuacuguuga

SEQ ID NO: 338183 - RNA, 23 nt, Human
uaugaacugcauugcuggugugu

SEQ ID NO: 338184 - RNA, 19 nt, Human
ucugccucuggucaggcuc

SEQ ID NO: 338185 - RNA, 22 nt, Human
aguaugaagaauacauagauga

SEQ ID NO: 338186 - RNA, 22 nt, Human
uucugagacaauugagagucua

SEQ ID NO: 338187 - RNA, 22 nt, Human
gaacacaugauuauaaaugcua

SEQ ID NO: 338188 - RNA, 22 nt, Human
uacccaggaggaaacugaggcu

SEQ ID NO: 338189 - RNA, 22 nt, Human
uuucaaaauuuugcagugguaa

SEQ ID NO: 338190 - RNA, 22 nt, Human
aaugucugcucuacucaggagg

SEQ ID NO: 338191 - RNA, 22 nt, Human
auauucuugugauuauaaagua

SEQ ID NO: 338192 - RNA, 22 nt, Human
agauuuauguggucacacucag

SEQ ID NO: 338193 - RNA, 22 nt, Human
uagaaacaaugacaugcuugua

SEQ ID NO: 338194 - RNA, 22 nt, Human
uuucacauaugguuguugauug

SEQ ID NO: 338195 - RNA, 22 nt, Human
cagcugcuuuaguuuuccaucc

SEQ ID NO: 338196 - RNA, 22 nt, Human
cagaggaugaucuggccucucu

SEQ ID NO: 338197 - RNA, 22 nt, Human
aggcagcccacaggacacagga

SEQ ID NO: 338198 - RNA, 22 nt, Human
uugcuucaguagcucuuuaaag

SEQ ID NO: 338199 - RNA, 22 nt, Human
uuugaagucaggcuuucuaccc

SEQ ID NO: 338200 - RNA, 22 nt, Human
cagugguuauacuuacuguuuc

SEQ ID NO: 338201 - RNA, 22 nt, Human
acauucuuaacaguuaaaaacu

SEQ ID NO: 338202 - RNA, 22 nt, Human
cagaggcagccgggggagaacg

SEQ ID NO: 338203 - RNA, 22 nt, Human
aggguagggccguagggccaug

SEQ ID NO: 338204 - RNA, 21 nt, Human
aaauacagaaacuuguuuuca

SEQ ID NO: 338205 - RNA, 22 nt, Human
augcuguguggucaaguuaauu

SEQ ID NO: 338206 - RNA, 22 nt, Human
aucugccucuucuucauugcga

SEQ ID NO: 338207 - RNA, 22 nt, Human
uccagaaacuuuuccagucuca

SEQ ID NO: 338208 - RNA, 22 nt, Human
uuuguaugugauaagacuauuc

SEQ ID NO: 338209 - RNA, 20 nt, Human
ggcaggcuuuauauggaggg

SEQ ID NO: 338210 - RNA, 22 nt, Human
agacaguguguguauauauggu

SEQ ID NO: 338211 - RNA, 22 nt, Human
uuagagucaaaauggcauguua

SEQ ID NO: 338212 - RNA, 22 nt, Human
aagcuggcaugucaccugagaa

SEQ ID NO: 338213 - RNA, 22 nt, Human
cuucagaauccagaaucagaau

SEQ ID NO: 338214 - RNA, 22 nt, Human
ccuucauugcaucuuuaagaga

SEQ ID NO: 338215 - RNA, 22 nt, Human
gagcagcuccagccgcaugacu

SEQ ID NO: 338216 - RNA, 19 nt, Human
uggcagggagaguuugaag

SEQ ID NO: 338217 - RNA, 22 nt, Human
aagcagcuuuugaagagugagg

SEQ ID NO: 338218 - RNA, 22 nt, Human
uuccuuaguguuagauucugug

SEQ ID NO: 338219 - RNA, 18 nt, Human
ggcagcuugacuagcaac

SEQ ID NO: 338220 - RNA, 22 nt, Human
uuugauaagagcugcugaaacu

SEQ ID NO: 338221 - RNA, 22 nt, Human
aguauugugacucaaguauucu

SEQ ID NO: 338222 - RNA, 19 nt, Human
uucacaauuaugaaauuag

SEQ ID NO: 338223 - RNA, 22 nt, Human
ccagcagagcauggggaggaag

SEQ ID NO: 338224 - RNA, 22 nt, Human
uaucuguuguaguacagaugau

SEQ ID NO: 338225 - RNA, 22 nt, Human
uagugcuuuaggccugaguguc

SEQ ID NO: 338226 - RNA, 22 nt, Human
aaacugcugguugcuggccagc

SEQ ID NO: 338227 - RNA, 22 nt, Human
acaguggagaaggcaugaggcu

SEQ ID NO: 338228 - RNA, 17 nt, Human
caggcagacauguaagc

SEQ ID NO: 338229 - RNA, 22 nt, Human
cugcuguguugccagugucacc

SEQ ID NO: 338230 - RNA, 22 nt, Human
aauguaugagcgugaaagcacu

SEQ ID NO: 338231 - RNA, 22 nt, Human
gcccaggaguucaaggcugcag

SEQ ID NO: 338232 - RNA, 22 nt, Human
uuucauaauacuguacaugaaa

SEQ ID NO: 338233 - RNA, 22 nt, Human
ccccggaggcggagguugcagu

SEQ ID NO: 338234 - RNA, 22 nt, Human
cccaggaggcgcagguugcggu

SEQ ID NO: 338235 - RNA, 22 nt, Human
uaugaccuuaggaagcaagaag

SEQ ID NO: 338236 - RNA, 18 nt, Human
ucaggagacacagacgca

SEQ ID NO: 338237 - RNA, 20 nt, Human
uuuuccagaaaguaucauug

SEQ ID NO: 338238 - RNA, 22 nt, Human
cugacagucucauugauuugcu

SEQ ID NO: 338239 - RNA, 22 nt, Human
aaaggcaggcuuucacaucuca

SEQ ID NO: 338240 - RNA, 22 nt, Human
agcuacccgaggacaggcuaag

SEQ ID NO: 338241 - RNA, 22 nt, Human
gagcagcucgagaaggaagcag

SEQ ID NO: 338242 - RNA, 22 nt, Human
ggcuuugccuggaauuuccuug

SEQ ID NO: 338243 - RNA, 22 nt, Human
gugucccaggccucuggaauua

SEQ ID NO: 338244 - RNA, 22 nt, Human
ucucucuugucaccccaucugc

SEQ ID NO: 338245 - RNA, 19 nt, Human
agucuuucccacucgucuu

SEQ ID NO: 338246 - RNA, 22 nt, Human
ggcagcuuguccuggaggaugg

SEQ ID NO: 338247 - RNA, 22 nt, Human
ugaaaucaaugucuucugucuc

SEQ ID NO: 338248 - RNA, 22 nt, Human
uaaaauagcaugugcagugaaa

SEQ ID NO: 338249 - RNA, 22 nt, Human
uaauuccaaguugagacaugca

SEQ ID NO: 338250 - RNA, 22 nt, Human
acaggagacccugcugguucug

SEQ ID NO: 338251 - RNA, 22 nt, Human
uuucacacugcagcaucagaga

SEQ ID NO: 338252 - RNA, 22 nt, Human
gaggagagaagcuaacggugcu

SEQ ID NO: 338253 - RNA, 22 nt, Human
uucagggagagcgggacgggug

SEQ ID NO: 338254 - RNA, 22 nt, Human
aacaugcugccuuucuacgagu

SEQ ID NO: 338255 - RNA, 22 nt, Human
gcucacugccauucucuagaug

SEQ ID NO: 338256 - RNA, 23 nt, Human
uaauucacauauacauugcuuca

SEQ ID NO: 338257 - RNA, 21 nt, Human
uccaggagcacgggacuagga

SEQ ID NO: 338258 - RNA, 22 nt, Human
uguuugaacugaauaacauagu

SEQ ID NO: 338259 - RNA, 22 nt, Human
gugugaaaaugugcacaauaug

SEQ ID NO: 338260 - RNA, 22 nt, Human
ucuuagcauuucauaacaacug

SEQ ID NO: 338261 - RNA, 22 nt, Human
uggcagcugccauguccacgug

SEQ ID NO: 338262 - RNA, 22 nt, Human
ggcaucuccaaaacaugaacuc

SEQ ID NO: 338263 - RNA, 22 nt, Human
ggcagaggaggggugaauuugc

SEQ ID NO: 338264 - RNA, 22 nt, Human
cucuucucugcagccuuugaag

SEQ ID NO: 338265 - RNA, 22 nt, Human
cuacccagagugaaucucuuaa

SEQ ID NO: 338266 - RNA, 22 nt, Human
gaaaacuauuggccuagaacaa

SEQ ID NO: 338267 - RNA, 22 nt, Human
cuuuggcaaggguuuuaauugu

SEQ ID NO: 338268 - RNA, 22 nt, Human
uuuucucuuguuaauguacuga

SEQ ID NO: 338269 - RNA, 22 nt, Human
uugcugaauugaauccuuuggu

SEQ ID NO: 338270 - RNA, 22 nt, Human
cuuaacagagagaaguguugcu

SEQ ID NO: 338271 - RNA, 21 nt, Human
gaauaguucuguggcagcagu

SEQ ID NO: 338272 - RNA, 22 nt, Human
uggcagcuagcuguuuucaugc

SEQ ID NO: 338273 - RNA, 22 nt, Human
uucagcaaauggacuguucagg

SEQ ID NO: 338274 - RNA, 20 nt, Human
gggcagcuccccucauucug

SEQ ID NO: 338275 - RNA, 22 nt, Human
gcagaggccaggccaccagcaa

SEQ ID NO: 338276 - RNA, 23 nt, Human
ucucaagaggaagcagggcucau

SEQ ID NO: 338277 - RNA, 22 nt, Human
guucuucaaagugacaacuaaa

SEQ ID NO: 338278 - RNA, 22 nt, Human
acuguguggaccacucugaggc

SEQ ID NO: 338279 - RNA, 22 nt, Human
aagauaauauucauuaacuaga

SEQ ID NO: 338280 - RNA, 22 nt, Human
auuucagauucagaaauguagg

SEQ ID NO: 338281 - RNA, 22 nt, Human
guguguuucagaagccaggugu

SEQ ID NO: 338282 - RNA, 22 nt, Human
uccaggagguaugaguggcccc

SEQ ID NO: 338283 - RNA, 22 nt, Human
caaggccacuccagagacuggu

SEQ ID NO: 338284 - RNA, 22 nt, Human
ggaggggagucucccaaagccg

SEQ ID NO: 338285 - RNA, 22 nt, Human
uacaaguaaauuguagauacca

SEQ ID NO: 338286 - RNA, 20 nt, Human
uaggcagcuugacccuuggu

SEQ ID NO: 338287 - RNA, 22 nt, Human
auuuugcuggucugaauuacuu

SEQ ID NO: 338288 - RNA, 22 nt, Human
guccucugaaguugugcaaugc

SEQ ID NO: 338289 - RNA, 22 nt, Human
uuuaaaaucagaugggaguugg

SEQ ID NO: 338290 - RNA, 18 nt, Human
cgaggcaggcggaucacg

SEQ ID NO: 338291 - RNA, 22 nt, Human
aguauaaagugguuuucagcac

SEQ ID NO: 338292 - RNA, 22 nt, Human
uucuuaacucaaauauauaucc

SEQ ID NO: 338293 - RNA, 22 nt, Human
ucuuugaauccuuuacaucuga

SEQ ID NO: 338294 - RNA, 18 nt, Human
gucacuguguuucugagc

SEQ ID NO: 338295 - RNA, 22 nt, Human
ggagaggauguuuuaguaacuu

SEQ ID NO: 338296 - RNA, 22 nt, Human
aagauggagcacgagcagaagc

SEQ ID NO: 338297 - RNA, 22 nt, Human
cccuugcaucccauguguggcc

SEQ ID NO: 338298 - RNA, 22 nt, Human
agucucuuauucccuauugcug

SEQ ID NO: 338299 - RNA, 22 nt, Human
gacccaggaagcuacuucuggu

SEQ ID NO: 338300 - RNA, 22 nt, Human
ucuacuguagugaugcugcagu

SEQ ID NO: 338301 - RNA, 22 nt, Human
guuuuucuaggaccaugugauu

SEQ ID NO: 338302 - RNA, 20 nt, Human
auuuggcaugaaguauugau

SEQ ID NO: 338303 - RNA, 22 nt, Human
uuucaucuuccuuggcauaggu

SEQ ID NO: 338304 - RNA, 21 nt, Human
cccagggaagccgcagucacc

SEQ ID NO: 338305 - RNA, 22 nt, Human
aagaauacguaucaacaauggu

SEQ ID NO: 338306 - RNA, 22 nt, Human
cucccagggucuaggcugcugg

SEQ ID NO: 338307 - RNA, 22 nt, Human
ccaggaaauggcuugcuucuuu

SEQ ID NO: 338308 - RNA, 22 nt, Human
uguacauacauagauauacaca

SEQ ID NO: 338309 - RNA, 22 nt, Human
uuucuucagagagagcuuuccc

SEQ ID NO: 338310 - RNA, 22 nt, Human
uucacagacauugcagacugaa

SEQ ID NO: 338311 - RNA, 22 nt, Human
acccaggauaaucuguguaucu

SEQ ID NO: 338312 - RNA, 22 nt, Human
cuguggaaauaaacaaugcuaa

SEQ ID NO: 338313 - RNA, 22 nt, Human
uauuucagucacuucuucucug

SEQ ID NO: 338314 - RNA, 23 nt, Human
cuuuuaacuagaguaucagcugc

SEQ ID NO: 338315 - RNA, 22 nt, Human
ugaaaugagagcacagaauaaa

SEQ ID NO: 338316 - RNA, 22 nt, Human
gaggaggcacuugagcagaugu

SEQ ID NO: 338317 - RNA, 22 nt, Human
cagcaggaggugaguagcaggu

SEQ ID NO: 338318 - RNA, 20 nt, Human
agaggccaguuaggagucua

SEQ ID NO: 338319 - RNA, 22 nt, Human
aggcagcuuucagugucucuca

SEQ ID NO: 338320 - RNA, 22 nt, Human
gaggcagccucaguggaccucg

SEQ ID NO: 338321 - RNA, 23 nt, Human
ucccaggaaucugcauuuuuaac

SEQ ID NO: 338322 - RNA, 22 nt, Human
cauuuguuggucagauuguagu

SEQ ID NO: 338323 - RNA, 22 nt, Human
gugguaaucggauucuuaccgg

SEQ ID NO: 338324 - RNA, 22 nt, Human
cgucuuccucuuacgaugcgcu

SEQ ID NO: 338325 - RNA, 22 nt, Human
aauagcucacugauuucucuuu

SEQ ID NO: 338326 - RNA, 23 nt, Human
agcacacuuguacaaugcccuag

SEQ ID NO: 338327 - RNA, 22 nt, Human
agaggccggccgagcccauggg

SEQ ID NO: 338328 - RNA, 22 nt, Human
uugcuuuguggugguucuucca

SEQ ID NO: 338329 - RNA, 22 nt, Human
gcagagaagaugcccaggcuuc

SEQ ID NO: 338330 - RNA, 22 nt, Human
gcccaggaaguugaggcugccg

SEQ ID NO: 338331 - RNA, 21 nt, Human
uggcaggcagcuggaagcuug

SEQ ID NO: 338332 - RNA, 23 nt, Human
gaggcagcuccugcagugcccug

SEQ ID NO: 338333 - RNA, 22 nt, Human
uuucuucaauugcuaacaagga

SEQ ID NO: 338334 - RNA, 22 nt, Human
acagagagaaacaaucagcagc

SEQ ID NO: 338335 - RNA, 22 nt, Human
uuuuaguguagucaccgugggu

SEQ ID NO: 338336 - RNA, 22 nt, Human
agaggaggcagcuuaacucagu

SEQ ID NO: 338337 - RNA, 22 nt, Human
gcuaugcaggagccuaaugaca

SEQ ID NO: 338338 - RNA, 22 nt, Human
gccaggaguucagaugcauguu

SEQ ID NO: 338339 - RNA, 22 nt, Human
uuugaauaucacaaacuuucaa

SEQ ID NO: 338340 - RNA, 22 nt, Human
auaacuuucuucacccuugcug

SEQ ID NO: 338341 - RNA, 22 nt, Human
ucuccucucuuaccugguacaa

SEQ ID NO: 338342 - RNA, 22 nt, Human
guucuucaggccauccucccag

SEQ ID NO: 338343 - RNA, 20 nt, Human
ucucagcauaagaacccuuc

SEQ ID NO: 338344 - RNA, 22 nt, Human
augaaggcuguguggagccccc

SEQ ID NO: 338345 - RNA, 22 nt, Human
aucuuguuauaagagauaaugg

SEQ ID NO: 338346 - RNA, 22 nt, Human
uagugcuuggcccuaccagaua

SEQ ID NO: 338347 - RNA, 22 nt, Human
ggcagcuguaagaugagugaau

SEQ ID NO: 338348 - RNA, 22 nt, Human
ggccaggagcugcacagggcuc

SEQ ID NO: 338349 - RNA, 22 nt, Human
cugcugugaguuuggaggucua

SEQ ID NO: 338350 - RNA, 22 nt, Human
aggcaggcacacuuccuccagg

SEQ ID NO: 338351 - RNA, 22 nt, Human
uggagagguugaauaacuuguc

SEQ ID NO: 338352 - RNA, 22 nt, Human
uaucuguucaauggaagaugac

SEQ ID NO: 338353 - RNA, 22 nt, Human
cagugcugggcagaggagagcg

SEQ ID NO: 338354 - RNA, 22 nt, Human
cucauuaaaggaaaucaccugc

SEQ ID NO: 338355 - RNA, 21 nt, Human
ucuuccuccacagcgugccac

SEQ ID NO: 338356 - RNA, 22 nt, Human
agaggggaggcgaaccagaguc

SEQ ID NO: 338357 - RNA, 22 nt, Human
ccaggagagcucucguucagug

SEQ ID NO: 338358 - RNA, 22 nt, Human
cccaggagagggaaccaaaugu

SEQ ID NO: 338359 - RNA, 23 nt, Human
agaugaggcuucuccauguuggu

SEQ ID NO: 338360 - RNA, 22 nt, Human
aaaguuuguuauaugauaagga

SEQ ID NO: 338361 - RNA, 22 nt, Human
ucauuugugugagugauuugac

SEQ ID NO: 338362 - RNA, 22 nt, Human
uccuuagagacaagaccaguuu

SEQ ID NO: 338363 - RNA, 22 nt, Human
gccaggaguguguggcuauguu

SEQ ID NO: 338364 - RNA, 22 nt, Human
uuugaaagaauuuauguacuuu

SEQ ID NO: 338365 - RNA, 22 nt, Human
ucccaggaugaagacaguguug

SEQ ID NO: 338366 - RNA, 22 nt, Human
uaugaaacauucauacaaauaa

SEQ ID NO: 338367 - RNA, 22 nt, Human
uucuccagaccuugugacuaug

SEQ ID NO: 338368 - RNA, 22 nt, Human
ugaggggagaagcagcagccug

SEQ ID NO: 338369 - RNA, 22 nt, Human
uuagccauggacugaauugacu

SEQ ID NO: 338370 - RNA, 23 nt, Human
gaggcacucaggaaaugugagug

SEQ ID NO: 338371 - RNA, 22 nt, Human
aggcaguuuauccccagagccu

SEQ ID NO: 338372 - RNA, 22 nt, Human
gagugucugaauuagagcacaa

SEQ ID NO: 338373 - RNA, 22 nt, Human
gacccaggguggucaccugaaa

SEQ ID NO: 338374 - RNA, 22 nt, Human
uugaaguuguaguucagugaag

SEQ ID NO: 338375 - RNA, 22 nt, Human
aauugcaauuuucuuaaggucu

SEQ ID NO: 338376 - RNA, 22 nt, Human
acuguagcugccacuggaugca

SEQ ID NO: 338377 - RNA, 22 nt, Human
ugaacuccaaauacugcugauu

SEQ ID NO: 338378 - RNA, 22 nt, Human
gcugguuuccuuaucuauaaag

SEQ ID NO: 338379 - RNA, 20 nt, Human
uguuaaaggacacuugcuuu

SEQ ID NO: 338380 - RNA, 22 nt, Human
uaacacaugaaagcaccuucuu

SEQ ID NO: 338381 - RNA, 22 nt, Human
cgaggcagaggcugaaacggcu

SEQ ID NO: 338382 - RNA, 19 nt, Human
gacagugcaguuguaguac

SEQ ID NO: 338383 - RNA, 22 nt, Human
uguccucuuccagugcuccuuc

SEQ ID NO: 338384 - RNA, 22 nt, Human
uucaggaucacuaaacccucca

SEQ ID NO: 338385 - RNA, 22 nt, Human
uuucaguuacugcuauaucauu

SEQ ID NO: 338386 - RNA, 22 nt, Human
uuugaaaguguuuacuugggaa

SEQ ID NO: 338387 - RNA, 22 nt, Human
agacucaagcagauaggaauua

SEQ ID NO: 338388 - RNA, 22 nt, Human
uauaaaguuucgaaagauguau

SEQ ID NO: 338389 - RNA, 23 nt, Human
gggcagcuuaagcuuguuuuucu

SEQ ID NO: 338390 - RNA, 22 nt, Human
uuucauugaugggugauagaaa

SEQ ID NO: 338391 - RNA, 22 nt, Human
auuuccaguccuaaugaucugg

SEQ ID NO: 338392 - RNA, 22 nt, Human
uuucaaagaccauuaacuauca

SEQ ID NO: 338393 - RNA, 22 nt, Human
cuuccuucugaagcauagaagc

SEQ ID NO: 338394 - RNA, 22 nt, Human
aguuugaauugaaaugcagaug

SEQ ID NO: 338395 - RNA, 22 nt, Human
aggcagcagugauaagauagga

SEQ ID NO: 338396 - RNA, 22 nt, Human
ggcagcucugcuccacaugagu

SEQ ID NO: 338397 - RNA, 22 nt, Human
aaauacuagaauucagaguuga

SEQ ID NO: 338398 - RNA, 22 nt, Human
ugaguuuugucuugcuagaagu

SEQ ID NO: 338399 - RNA, 22 nt, Human
ggaggugggauuaggaccuaaa

SEQ ID NO: 338400 - RNA, 22 nt, Human
uaugaaaugguaguaggaaggg

SEQ ID NO: 338401 - RNA, 22 nt, Human
auaaaugauucagcaggaaaua

SEQ ID NO: 338402 - RNA, 22 nt, Human
cuguaguugaugauuucugaua

SEQ ID NO: 338403 - RNA, 15 nt, Human
uggcagcuuguuaag

SEQ ID NO: 338404 - RNA, 22 nt, Human
acuggcagcagcagcccuuggg

SEQ ID NO: 338405 - RNA, 19 nt, Human
gcagcugcuugaaaagaaa

SEQ ID NO: 338406 - RNA, 22 nt, Human
ggggcagccuccaggaaagcug

SEQ ID NO: 338407 - RNA, 22 nt, Human
uaucaucuuguugucaugcagc

SEQ ID NO: 338408 - RNA, 22 nt, Human
uccaggaggcagggcugugccc

SEQ ID NO: 338409 - RNA, 22 nt, Human
uggcaggcagugugggagcugg

SEQ ID NO: 338410 - RNA, 19 nt, Human
acauuuagaauguacuugc

SEQ ID NO: 338411 - RNA, 22 nt, Human
gcugucccgcugacuuccagcu

SEQ ID NO: 338412 - RNA, 22 nt, Human
uacuuccuguuuccaugucugu

SEQ ID NO: 338413 - RNA, 22 nt, Human
cuaaucaucuuucucuuaaagc

SEQ ID NO: 338414 - RNA, 22 nt, Human
auguuauggcucaaacauuugg

SEQ ID NO: 338415 - RNA, 22 nt, Human
aggcagauauuggggugaugug

SEQ ID NO: 338416 - RNA, 22 nt, Human
gccaggaggggagaguguguca

SEQ ID NO: 338417 - RNA, 22 nt, Human
aaggcagcuucaccacagcauu

SEQ ID NO: 338418 - RNA, 23 nt, Human
uuuuccuguggagacaugacugg

SEQ ID NO: 338419 - RNA, 22 nt, Human
acagugcuggcuacaacccugg

SEQ ID NO: 338420 - RNA, 22 nt, Human
ucaggagaaaauaucaggaagu

SEQ ID NO: 338421 - RNA, 22 nt, Human
cccagcaggaggagguugcagu

SEQ ID NO: 338422 - RNA, 22 nt, Human
uagauauguguuuauuaugcug

SEQ ID NO: 338423 - RNA, 22 nt, Human
ccacagagcauuagauuucaga

SEQ ID NO: 338424 - RNA, 22 nt, Human
accauccugaaaccuucaugcu

SEQ ID NO: 338425 - RNA, 22 nt, Human
ccaugagccaggcugaggaagc

SEQ ID NO: 338426 - RNA, 22 nt, Human
ugagccuguccugugcauguga

SEQ ID NO: 338427 - RNA, 22 nt, Human
ugagaaaugggucugcugaaga

SEQ ID NO: 338428 - RNA, 22 nt, Human
uguucauaucauuuugaaagcu

SEQ ID NO: 338429 - RNA, 22 nt, Human
aguaaagcagaguugcaguaca

SEQ ID NO: 338430 - RNA, 22 nt, Human
uuuauuuggcauccagggagaa

SEQ ID NO: 338431 - RNA, 22 nt, Human
ccaggcugggcuacaaguugag

SEQ ID NO: 338432 - RNA, 22 nt, Human
ucugucucaaguucuugcacuc

SEQ ID NO: 338433 - RNA, 22 nt, Human
cagcagaggugguucacauugu

SEQ ID NO: 338434 - RNA, 22 nt, Human
acucagaaugacugaugcugug

SEQ ID NO: 338435 - RNA, 22 nt, Human
augaaacaguguguauagcaaa

SEQ ID NO: 338436 - RNA, 22 nt, Human
cuccaggagggggauggcugua

SEQ ID NO: 338437 - RNA, 22 nt, Human
uugauacaggccuucuagauga

SEQ ID NO: 338438 - RNA, 22 nt, Human
auuugcuuuaagguauaaaagg

SEQ ID NO: 338439 - RNA, 22 nt, Human
uuugcaaagaaauuauugcugu

SEQ ID NO: 338440 - RNA, 22 nt, Human
gcccaggauggagaauaguggu

SEQ ID NO: 338441 - RNA, 22 nt, Human
uuugaauguuuuagguacuuaa

SEQ ID NO: 338442 - RNA, 22 nt, Human
gcccaggaaagauagggccuca

SEQ ID NO: 338443 - RNA, 22 nt, Human
acucuucuugcugcucauuaau

SEQ ID NO: 338444 - RNA, 22 nt, Human
guugaaagaucauguggcugcc

SEQ ID NO: 338445 - RNA, 20 nt, Human
uucuucucuaguuaucuuca

SEQ ID NO: 338446 - RNA, 22 nt, Human
uuaacacaucccugcucuaccc

SEQ ID NO: 338447 - RNA, 22 nt, Human
aauguauuccucaugcaagagu

SEQ ID NO: 338448 - RNA, 22 nt, Human
ucacagacacagggagaagcau

SEQ ID NO: 338449 - RNA, 22 nt, Human
uccaggagggauugggcugugg

SEQ ID NO: 338450 - RNA, 22 nt, Human
aagugaagaaauacaugagaau

SEQ ID NO: 338451 - RNA, 22 nt, Human
gauauguauugaaugaucauuu

SEQ ID NO: 338452 - RNA, 22 nt, Human
uaucuguugucuuuuacaugua

SEQ ID NO: 338453 - RNA, 22 nt, Human
cuagccugggauuugaacuuau

SEQ ID NO: 338454 - RNA, 19 nt, Human
acaaaugauguugcacuga

SEQ ID NO: 338455 - RNA, 22 nt, Human
uggcagcuccggguaggggcug

SEQ ID NO: 338456 - RNA, 22 nt, Human
gagguagcaugcuggaagggac

SEQ ID NO: 338457 - RNA, 23 nt, Human
uggcagcuguguaagagaaagca

SEQ ID NO: 338458 - RNA, 22 nt, Human
uuuuccuucuagagcagauuuc

SEQ ID NO: 338459 - RNA, 22 nt, Human
aagcaaaggcaggagcuuguga

SEQ ID NO: 338460 - RNA, 22 nt, Human
gaggaggcuuccgggaggcacg

SEQ ID NO: 338461 - RNA, 22 nt, Human
uguuugaaacuuugaucacuaa

SEQ ID NO: 338462 - RNA, 22 nt, Human
acuaaauacacacauuuguuca

SEQ ID NO: 338463 - RNA, 17 nt, Human
ugaauucaaucugcacu

SEQ ID NO: 338464 - RNA, 22 nt, Human
auucuucagcaggggacacuau

SEQ ID NO: 338465 - RNA, 21 nt, Human
uaauaauuccacuacagagua

SEQ ID NO: 338466 - RNA, 22 nt, Human
uuugacaaauccuucagcaaug

SEQ ID NO: 338467 - RNA, 22 nt, Human
agcugcccuuaauaggcauuca

SEQ ID NO: 338468 - RNA, 22 nt, Human
aaaauuauagaucuagugccug

SEQ ID NO: 338469 - RNA, 22 nt, Human
uucaauucuaaacuaauauucu

SEQ ID NO: 338470 - RNA, 22 nt, Human
agggcaguucaacuucauagug

SEQ ID NO: 338471 - RNA, 22 nt, Human
caggauggagaguuguugguug

SEQ ID NO: 338472 - RNA, 22 nt, Human
ucccaggacccaggcauucaca

SEQ ID NO: 338473 - RNA, 22 nt, Human
caaggccaagguuuugugaacu

SEQ ID NO: 338474 - RNA, 22 nt, Human
uuuuagcacuaagugauaugcu

SEQ ID NO: 338475 - RNA, 22 nt, Human
uuaugauuugccacagauuggu

SEQ ID NO: 338476 - RNA, 20 nt, Human
augcuuucuugugugcugcu

SEQ ID NO: 338477 - RNA, 22 nt, Human
ugcccaggcuggaaugcagugg

SEQ ID NO: 338478 - RNA, 22 nt, Human
auuuccaggagaaaggauuuua

SEQ ID NO: 338479 - RNA, 21 nt, Human
gugcuuuuccuuaauguucuu

SEQ ID NO: 338480 - RNA, 22 nt, Human
cagcuggcgggcagagccgcca

SEQ ID NO: 338481 - RNA, 22 nt, Human
auuuucagagacaucuggacuu

SEQ ID NO: 338482 - RNA, 17 nt, Human
uuucaucugggaccacc

SEQ ID NO: 338483 - RNA, 22 nt, Human
uaaaugagggcugacaugauug

SEQ ID NO: 338484 - RNA, 22 nt, Human
auguuucaccagcaaauuaccu

SEQ ID NO: 338485 - RNA, 22 nt, Human
gagcagcucugggugacccagu

SEQ ID NO: 338486 - RNA, 22 nt, Human
cauaauauacuacauugaugaa

SEQ ID NO: 338487 - RNA, 22 nt, Human
uugacacaguuuucucauuaag

SEQ ID NO: 338488 - RNA, 22 nt, Human
gugguuuugccauuacaaguaa

SEQ ID NO: 338489 - RNA, 22 nt, Human
caggagagcccggguccgggcu

SEQ ID NO: 338490 - RNA, 22 nt, Human
uucugugauugacauguggcuu

SEQ ID NO: 338491 - RNA, 22 nt, Human
uucuuucucaacaugaauguuu

SEQ ID NO: 338492 - RNA, 22 nt, Human
uuaaagggccgauuuccaggcc

SEQ ID NO: 338493 - RNA, 20 nt, Human
ccucaggaugagggugagca

SEQ ID NO: 338494 - RNA, 22 nt, Human
uucucagaugauucagauaaac

SEQ ID NO: 338495 - RNA, 22 nt, Human
cagcuucugcuaucgaacaucu

SEQ ID NO: 338496 - RNA, 16 nt, Human
ucccaggaggcggaac

SEQ ID NO: 338497 - RNA, 22 nt, Human
aaauauaauuucugccucaaua

SEQ ID NO: 338498 - RNA, 23 nt, Human
uuuauccaacucuguaaucucuc

SEQ ID NO: 338499 - RNA, 22 nt, Human
auucuucacauaagugcuguac

SEQ ID NO: 338500 - RNA, 22 nt, Human
gggagucugggcuagacuccuu

SEQ ID NO: 338501 - RNA, 20 nt, Human
caucaucacaugagccaauu

SEQ ID NO: 338502 - RNA, 22 nt, Human
ucauuucucccggccaaaaacu

SEQ ID NO: 338503 - RNA, 22 nt, Human
ucuucuccagugcuucugcaca

SEQ ID NO: 338504 - RNA, 22 nt, Human
uacugcaugguggaguggagcu

SEQ ID NO: 338505 - RNA, 22 nt, Human
gaaacugugaucguguucuggg

SEQ ID NO: 338506 - RNA, 22 nt, Human
agaggaugguugaggaagaccu

SEQ ID NO: 338507 - RNA, 22 nt, Human
aguuauaaucugcuacugauau

SEQ ID NO: 338508 - RNA, 22 nt, Human
gcgucugaguugcgggggcuca

SEQ ID NO: 338509 - RNA, 22 nt, Human
aaaguuugaaugauauauuagu

SEQ ID NO: 338510 - RNA, 22 nt, Human
augaggcaguacacacaaagcc

SEQ ID NO: 338511 - RNA, 22 nt, Human
agucucuuuaaucacagugucu

SEQ ID NO: 338512 - RNA, 22 nt, Human
acugccauuggucaaaugagug

SEQ ID NO: 338513 - RNA, 22 nt, Human
aggccagacagcuagaaacagg

SEQ ID NO: 338514 - RNA, 22 nt, Human
ucugugcauuguaacaacuaaa

SEQ ID NO: 338515 - RNA, 22 nt, Human
uacauguauguguacgugcaug

SEQ ID NO: 338516 - RNA, 22 nt, Human
uuucaucuaacacuacauaggg

SEQ ID NO: 338517 - RNA, 22 nt, Human
agauggaguuaguaccagaguc

SEQ ID NO: 338518 - RNA, 22 nt, Human
caggcagcagccacucugguau

SEQ ID NO: 338519 - RNA, 22 nt, Human
aggccagcaagaaagagagucu

SEQ ID NO: 338520 - RNA, 22 nt, Human
ugcuggaauaauuucauguuaa

SEQ ID NO: 338521 - RNA, 22 nt, Human
uggcagcugauuagauggugcc

SEQ ID NO: 338522 - RNA, 22 nt, Human
uuucuucacaggguauugggug

SEQ ID NO: 338523 - RNA, 22 nt, Human
uucugucagaagcuagcuccug

SEQ ID NO: 338524 - RNA, 22 nt, Human
uacaaaguagaaauucaguaaa

SEQ ID NO: 338525 - RNA, 22 nt, Human
aucauuacuccuguaaaauugu

SEQ ID NO: 338526 - RNA, 23 nt, Human
ucaggauauugugugccaaggug

SEQ ID NO: 338527 - RNA, 23 nt, Human
ucagagagcuguugagagcugcc

SEQ ID NO: 338528 - RNA, 22 nt, Human
cuuuguagcugcuucugauuua

SEQ ID NO: 338529 - RNA, 22 nt, Human
gucuccugagacugcagucacc

SEQ ID NO: 338530 - RNA, 22 nt, Human
gaaacaauuuuuguugucuaag

SEQ ID NO: 338531 - RNA, 20 nt, Human
gcccaggaucucugaggcau

SEQ ID NO: 338532 - RNA, 22 nt, Human
uccaggagauacacugcaccag

SEQ ID NO: 338533 - RNA, 22 nt, Human
gagggaggcaucaugaauccag

SEQ ID NO: 338534 - RNA, 22 nt, Human
gcagcugcagacccucagugcu

SEQ ID NO: 338535 - RNA, 19 nt, Human
ugccuggacaaaugugggg

SEQ ID NO: 338536 - RNA, 22 nt, Human
uuuacauuucccucugucaguu

SEQ ID NO: 338537 - RNA, 22 nt, Human
cagucuuuguucccauuacuga

SEQ ID NO: 338538 - RNA, 22 nt, Human
gucaggauuugaacucaggucu

SEQ ID NO: 338539 - RNA, 22 nt, Human
cuggaguuagaguagacacuga

SEQ ID NO: 338540 - RNA, 22 nt, Human
auacacauguguaugugcaugc

SEQ ID NO: 338541 - RNA, 22 nt, Human
aaacacauuuuaggaaaaucua

SEQ ID NO: 338542 - RNA, 22 nt, Human
gaggcagccagagguucucauu

SEQ ID NO: 338543 - RNA, 22 nt, Human
acauuucuaguuguucaucucc

SEQ ID NO: 338544 - RNA, 22 nt, Human
uggggcuccuccuggcaggagg

SEQ ID NO: 338545 - RNA, 22 nt, Human
augaagcugaaaaaggcauaua

SEQ ID NO: 338546 - RNA, 22 nt, Human
gcuccucuucucccacugaaug

SEQ ID NO: 338547 - RNA, 22 nt, Human
uucauugugauucuuggcuagc

SEQ ID NO: 338548 - RNA, 22 nt, Human
aaggccaacuaggaugagcuag

SEQ ID NO: 338549 - RNA, 22 nt, Human
ugaaugaguuuggcugcuguuc

SEQ ID NO: 338550 - RNA, 22 nt, Human
acuucacagaaauuuuaugagg

SEQ ID NO: 338551 - RNA, 22 nt, Human
ucagaaaagguagcugugacaa

SEQ ID NO: 338552 - RNA, 22 nt, Human
ugaggcaggaauggggaaaagu

SEQ ID NO: 338553 - RNA, 22 nt, Human
ucccaggacuuccaguuggagg

SEQ ID NO: 338554 - RNA, 19 nt, Human
uuucuuaggccuuuggccu

SEQ ID NO: 338555 - RNA, 22 nt, Human
aagauauagauaaaacuaugca

SEQ ID NO: 338556 - RNA, 22 nt, Human
aaauaguucagcuuguaaaccc

SEQ ID NO: 338557 - RNA, 22 nt, Human
ugaacacauaaggcuuuccugu

SEQ ID NO: 338558 - RNA, 22 nt, Human
cuuugcaauagaggcacacaug

SEQ ID NO: 338559 - RNA, 22 nt, Human
auggagacgcaagggaccuagg

SEQ ID NO: 338560 - RNA, 22 nt, Human
uucuucaguuugguaaauguaa

SEQ ID NO: 338561 - RNA, 22 nt, Human
uguauaaacuuaagcaggaacc

SEQ ID NO: 338562 - RNA, 22 nt, Human
guuuuaguggguggccacugau

SEQ ID NO: 338563 - RNA, 22 nt, Human
agacgagggccuggcacacagu

SEQ ID NO: 338564 - RNA, 22 nt, Human
aguuggagugaacaugagauug

SEQ ID NO: 338565 - RNA, 22 nt, Human
gcaugucaugucauguaggaau

SEQ ID NO: 338566 - RNA, 22 nt, Human
ugccuguguugauuacuuuguc

SEQ ID NO: 338567 - RNA, 17 nt, Human
aggccagaugaggcaag

SEQ ID NO: 338568 - RNA, 22 nt, Human
ccuggagagagaggccaacugc

SEQ ID NO: 338569 - RNA, 22 nt, Human
cuggcuugcagcucaucauaaa

SEQ ID NO: 338570 - RNA, 22 nt, Human
ugaaggccagggauuugcagcc

SEQ ID NO: 338571 - RNA, 22 nt, Human
gccugcagaacugugaggcaau

SEQ ID NO: 338572 - RNA, 22 nt, Human
aucaggaucaugcuggguggga

SEQ ID NO: 338573 - RNA, 22 nt, Human
uuucacagcuggguggcagagu

SEQ ID NO: 338574 - RNA, 22 nt, Human
uuccaagagcuuuaauuguuga

SEQ ID NO: 338575 - RNA, 23 nt, Human
agaugagccaacaccuccaugcc

SEQ ID NO: 338576 - RNA, 23 nt, Human
acugucugauauguuuuccauca

SEQ ID NO: 338577 - RNA, 21 nt, Human
auaagcaugcugauuacauuu

SEQ ID NO: 338578 - RNA, 22 nt, Human
gauuucuugauaaguaguguga

SEQ ID NO: 338579 - RNA, 22 nt, Human
gugguaauagagcuccaaacua

SEQ ID NO: 338580 - RNA, 22 nt, Human
gcccaggagccuggagaugugu

SEQ ID NO: 338581 - RNA, 18 nt, Human
aauuuccauaugaauugc

SEQ ID NO: 338582 - RNA, 22 nt, Human
acccaggagcucugggguccuc

SEQ ID NO: 338583 - RNA, 21 nt, Human
cagcagaguaaugcauucgua

SEQ ID NO: 338584 - RNA, 22 nt, Human
ggcaggcugcuugggucauguc

SEQ ID NO: 338585 - RNA, 22 nt, Human
ucucugaguaagugacaguuca

SEQ ID NO: 338586 - RNA, 22 nt, Human
gcaggagaaaugaagauugggu

SEQ ID NO: 338587 - RNA, 22 nt, Human
aagaagagaacuggcauccuaa

SEQ ID NO: 338588 - RNA, 22 nt, Human
ugaaggcccuaucuccauauac

SEQ ID NO: 338589 - RNA, 20 nt, Human
augugagggguugaaguggg

SEQ ID NO: 338590 - RNA, 22 nt, Human
ggacagcugcuuucaggccaca

SEQ ID NO: 338591 - RNA, 22 nt, Human
ggaggaugccaagcugugcaca

SEQ ID NO: 338592 - RNA, 22 nt, Human
aggagcagaacugauucugacu

SEQ ID NO: 338593 - RNA, 22 nt, Human
cuggcugugcagucuuccagaa

SEQ ID NO: 338594 - RNA, 22 nt, Human
ugauuuccccagucuugcugcu

SEQ ID NO: 338595 - RNA, 22 nt, Human
ucugggaaguccucugucaugc

SEQ ID NO: 338596 - RNA, 22 nt, Human
ugaggcaggaguucaggcugcg

SEQ ID NO: 338597 - RNA, 22 nt, Human
guguaugaggggagaauguuuu

SEQ ID NO: 338598 - RNA, 22 nt, Human
aaucuucauuuugacaagauuc

SEQ ID NO: 338599 - RNA, 22 nt, Human
gcgcaggagccgcggagggccg

SEQ ID NO: 338600 - RNA, 22 nt, Human
cuugaacucaaugugaggaaga

SEQ ID NO: 338601 - RNA, 22 nt, Human
uuugacaaaggaaaaaugcaca

SEQ ID NO: 338602 - RNA, 19 nt, Human
acuggcaguuucugcaugg

SEQ ID NO: 338603 - RNA, 22 nt, Human
auuacaguaacagcuacaaugc

SEQ ID NO: 338604 - RNA, 22 nt, Human
uccaggagguugagacugcagu

SEQ ID NO: 338605 - RNA, 22 nt, Human
caagagagaugcagcucacuca

SEQ ID NO: 338606 - RNA, 21 nt, Human
aggcagcuggaaggccuggcu

SEQ ID NO: 338607 - RNA, 22 nt, Human
ggcaugcucuuuguccacagua

SEQ ID NO: 338608 - RNA, 22 nt, Human
augcugugucaggaauuugaua

SEQ ID NO: 338609 - RNA, 22 nt, Human
gccaggagggaaaggacaauuu

SEQ ID NO: 338610 - RNA, 22 nt, Human
gguggagcuggaccaggagagg

SEQ ID NO: 338611 - RNA, 22 nt, Human
ucugcaggcuguacaggaagca

SEQ ID NO: 338612 - RNA, 20 nt, Human
uugagcuuuuaguacagaca

SEQ ID NO: 338613 - RNA, 22 nt, Human
aaguguauauaugacuuauaaa

SEQ ID NO: 338614 - RNA, 20 nt, Human
agaggaggauuauuuuauuc

SEQ ID NO: 338615 - RNA, 22 nt, Human
ugagccugguugcagugucugg

SEQ ID NO: 338616 - RNA, 22 nt, Human
cccauucauccucgcuuccuuc

SEQ ID NO: 338617 - RNA, 22 nt, Human
aaaguuugucacuuggcuagaa

SEQ ID NO: 338618 - RNA, 22 nt, Human
uacaauauguggccuuuuguga

SEQ ID NO: 338619 - RNA, 20 nt, Human
uuucaguugguuaauggcau

SEQ ID NO: 338620 - RNA, 22 nt, Human
gcagcugaauguccauugcugc

SEQ ID NO: 338621 - RNA, 21 nt, Human
aauguauguuuaucucacagu

SEQ ID NO: 338622 - RNA, 22 nt, Human
aguaugaaaguuaaucaauuua

SEQ ID NO: 338623 - RNA, 22 nt, Human
ugugaaaagcguguguucuagg

SEQ ID NO: 338624 - RNA, 22 nt, Human
guaggcagggcuguggggagaa

SEQ ID NO: 338625 - RNA, 22 nt, Human
caugaaaucugaguauguuucc

SEQ ID NO: 338626 - RNA, 22 nt, Human
ucugaaaugcaaauuugacuga

SEQ ID NO: 338627 - RNA, 22 nt, Human
uguagaaccuguuuauuauaga

SEQ ID NO: 338628 - RNA, 22 nt, Human
auccugucaucauaguacuuga

SEQ ID NO: 338629 - RNA, 22 nt, Human
acaauguaggauauguacuugu

SEQ ID NO: 338630 - RNA, 22 nt, Human
uauuuuaucugccagaguggag

SEQ ID NO: 338631 - RNA, 22 nt, Human
uuuuuguagucauuagaagagg

SEQ ID NO: 338632 - RNA, 22 nt, Human
uuugaacuucuaccugucauau

SEQ ID NO: 338633 - RNA, 22 nt, Human
ucaggaugagcucauaacuaug

SEQ ID NO: 338634 - RNA, 22 nt, Human
ccaggcagcaaauuuucugaau

SEQ ID NO: 338635 - RNA, 22 nt, Human
caggauggucuucauuuggcuc

SEQ ID NO: 338636 - RNA, 22 nt, Human
caggaaaggugugucaugaugg

SEQ ID NO: 338637 - RNA, 22 nt, Human
auuuccagugcacugaauagaa

SEQ ID NO: 338638 - RNA, 22 nt, Human
cugcuuugacuguuaagaacca

SEQ ID NO: 338639 - RNA, 22 nt, Human
gcagaggauagcauaugaaccu

SEQ ID NO: 338640 - RNA, 22 nt, Human
uucuucaaaacaacacuggccu

SEQ ID NO: 338641 - RNA, 22 nt, Human
aaaguauucuugacuguuuuuc

SEQ ID NO: 338642 - RNA, 22 nt, Human
acauugcugcauucuccuuccc

SEQ ID NO: 338643 - RNA, 22 nt, Human
uuuuaucugcuucauuaguuga

SEQ ID NO: 338644 - RNA, 22 nt, Human
caaggccauaagagauacaaaa

SEQ ID NO: 338645 - RNA, 22 nt, Human
cucacugacgaggaagcugaga

SEQ ID NO: 338646 - RNA, 22 nt, Human
gaauauuuuuaaagggacuaau

SEQ ID NO: 338647 - RNA, 22 nt, Human
uaauaguugugacuuuguaaag

SEQ ID NO: 338648 - RNA, 22 nt, Human
uuacaagcagcuacauaucaca

SEQ ID NO: 338649 - RNA, 22 nt, Human
ggaggaugagcuacgaggagcu

SEQ ID NO: 338650 - RNA, 22 nt, Human
ucaugaacaucucaaauaacca

SEQ ID NO: 338651 - RNA, 22 nt, Human
uuaguuuucccaucuuuauggu

SEQ ID NO: 338652 - RNA, 22 nt, Human
ccuugcauauauuauaucuuug

SEQ ID NO: 338653 - RNA, 22 nt, Human
ggugagggaguggaacgaggug

SEQ ID NO: 338654 - RNA, 22 nt, Human
aacauacauauuucagugucca

SEQ ID NO: 338655 - RNA, 22 nt, Human
aagcaacucccuccucauuuuu

SEQ ID NO: 338656 - RNA, 22 nt, Human
ggacagaggguugacagaguau

SEQ ID NO: 338657 - RNA, 22 nt, Human
gaggcugccccuuccucagcug

SEQ ID NO: 338658 - RNA, 21 nt, Human
aucauucuggaaaauucaagc

SEQ ID NO: 338659 - RNA, 22 nt, Human
agucucugccagcuuguccucu

SEQ ID NO: 338660 - RNA, 22 nt, Human
cuucucaaaguugugaaucagg

SEQ ID NO: 338661 - RNA, 22 nt, Human
aggagaggcaucaagaaaaucg

SEQ ID NO: 338662 - RNA, 22 nt, Human
accaggagagauuuuauugaga

SEQ ID NO: 338663 - RNA, 22 nt, Human
uugaacauuggcaauuucauau

SEQ ID NO: 338664 - RNA, 22 nt, Human
caggcagcugaggacuuugcua

SEQ ID NO: 338665 - RNA, 22 nt, Human
gaggccaggggccuggagauga

SEQ ID NO: 338666 - RNA, 22 nt, Human
aagauuauuuaagacaggaacc

SEQ ID NO: 338667 - RNA, 22 nt, Human
ugcugugagguugagaaggaag

SEQ ID NO: 338668 - RNA, 22 nt, Human
cuguaugaguugggaauagaau

SEQ ID NO: 338669 - RNA, 22 nt, Human
gaaggccauuagagccugugcc

SEQ ID NO: 338670 - RNA, 22 nt, Human
ucuuuccauggccacacagucu

SEQ ID NO: 338671 - RNA, 22 nt, Human
cugcuguggugucaagcaucuc

SEQ ID NO: 338672 - RNA, 22 nt, Human
ucauuuguugcuguuaccugag

SEQ ID NO: 338673 - RNA, 18 nt, Human
ucuuuggacaacuacugg

SEQ ID NO: 338674 - RNA, 22 nt, Human
acacagccgugaaucugcuucu

SEQ ID NO: 338675 - RNA, 18 nt, Human
cucugucauaagugucau

SEQ ID NO: 338676 - RNA, 22 nt, Human
cauuuguauguuccuccuuagg

SEQ ID NO: 338677 - RNA, 18 nt, Human
ccagguggugacagagau

SEQ ID NO: 338678 - RNA, 22 nt, Human
cucaggauagauuguccucuca

SEQ ID NO: 338679 - RNA, 22 nt, Human
augacucuuagcuaaagguaag

SEQ ID NO: 338680 - RNA, 22 nt, Human
aaagcagaacugagagagcugg

SEQ ID NO: 338681 - RNA, 22 nt, Human
cucuucuuuaguccagaccauc

SEQ ID NO: 338682 - RNA, 22 nt, Human
ggaggggucucuagcgaggaga

SEQ ID NO: 338683 - RNA, 22 nt, Human
uuuguuuagaaagagauuggug

SEQ ID NO: 338684 - RNA, 23 nt, Human
uuucaacuccugccauuauuucu

SEQ ID NO: 338685 - RNA, 22 nt, Human
gcugcccagacauugaaucagg

SEQ ID NO: 338686 - RNA, 22 nt, Human
uucuagaugauaaaccagcagc

SEQ ID NO: 338687 - RNA, 22 nt, Human
uucauucuuugaaucugaggua

SEQ ID NO: 338688 - RNA, 22 nt, Human
uuucuugacugcuuaggaaugc

SEQ ID NO: 338689 - RNA, 22 nt, Human
ucauacaucuguccuggagcuc

SEQ ID NO: 338690 - RNA, 22 nt, Human
aggcaguuuaggcagcgauuua

SEQ ID NO: 338691 - RNA, 22 nt, Human
aucuacauaaaacgaauacaua

SEQ ID NO: 338692 - RNA, 20 nt, Human
cugcugugugugccucagcc

SEQ ID NO: 338693 - RNA, 22 nt, Human
ucuuagaaguuuauggcacgga

SEQ ID NO: 338694 - RNA, 22 nt, Human
ggcagggaagcuggcaucacgg

SEQ ID NO: 338695 - RNA, 22 nt, Human
uuaaaauagccagugccccucu

SEQ ID NO: 338696 - RNA, 22 nt, Human
cucaggaaaggccaugcaaggg

SEQ ID NO: 338697 - RNA, 22 nt, Human
cauuuguaucugggcugcugug

SEQ ID NO: 338698 - RNA, 22 nt, Human
uauuucagcaagaagaaugugg

SEQ ID NO: 338699 - RNA, 22 nt, Human
aaaggugacugcagcagcuauu

SEQ ID NO: 338700 - RNA, 22 nt, Human
ugcacagugaccccuggugacu

SEQ ID NO: 338701 - RNA, 22 nt, Human
uaugaacuuuugaugugacaug

SEQ ID NO: 338702 - RNA, 22 nt, Human
cugcugugugcuuacuuggguu

SEQ ID NO: 338703 - RNA, 22 nt, Human
ucacaguuauagucuguagaau

SEQ ID NO: 338704 - RNA, 22 nt, Human
gccaggagccagcuucuuagca

SEQ ID NO: 338705 - RNA, 22 nt, Human
caucucaugggcaugccaagcu

SEQ ID NO: 338706 - RNA, 20 nt, Human
ugaaggccagcagcauaggg

SEQ ID NO: 338707 - RNA, 22 nt, Human
aguaccaugcuuccugacuggu

SEQ ID NO: 338708 - RNA, 22 nt, Human
uugcugaaaacaguggguauug

SEQ ID NO: 338709 - RNA, 22 nt, Human
cuucuucaguugcauguauugg

SEQ ID NO: 338710 - RNA, 20 nt, Human
ugugcaggagagugaggcug

SEQ ID NO: 338711 - RNA, 22 nt, Human
uucuucaaccaucuacauaaac

SEQ ID NO: 338712 - RNA, 22 nt, Human
aggucagcaggccaggggcgaa

SEQ ID NO: 338713 - RNA, 20 nt, Human
cagaggcauuuucagacucu

SEQ ID NO: 338714 - RNA, 22 nt, Human
gaggcugcuguuagcccugggc

SEQ ID NO: 338715 - RNA, 22 nt, Human
uuggcagugucugcaaaaugga

SEQ ID NO: 338716 - RNA, 22 nt, Human
gguuugaacagcuuuggagaag

SEQ ID NO: 338717 - RNA, 22 nt, Human
cccaggaggcagagguugcagu

SEQ ID NO: 338718 - RNA, 22 nt, Human
cccaggaaguggagguugcagu

SEQ ID NO: 338719 - RNA, 22 nt, Human
auguuuccauuuucuuguauca

SEQ ID NO: 338720 - RNA, 22 nt, Human
uacauucagaagaauggacacg

SEQ ID NO: 338721 - RNA, 18 nt, Human
cugcccagagcauuucau

SEQ ID NO: 338722 - RNA, 22 nt, Human
aguaugaaccuggguucuggau

SEQ ID NO: 338723 - RNA, 22 nt, Human
aggagagcuggugucuggaauc

SEQ ID NO: 338724 - RNA, 22 nt, Human
aggcaggcucaaugcccagucu

SEQ ID NO: 338725 - RNA, 22 nt, Human
ugcuacaauucacaucuggaua

SEQ ID NO: 338726 - RNA, 22 nt, Human
agaggggaguccuaaucugauu

SEQ ID NO: 338727 - RNA, 22 nt, Human
uuggaaauggcuguaguuauga

SEQ ID NO: 338728 - RNA, 22 nt, Human
uucaggauucugugucugacaa

SEQ ID NO: 338729 - RNA, 22 nt, Human
cauuuguuaaccaguguggauu

SEQ ID NO: 338730 - RNA, 20 nt, Human
uggcaucucucaauuguagg

SEQ ID NO: 338731 - RNA, 15 nt, Human
uucaggauaugacuc

SEQ ID NO: 338732 - RNA, 22 nt, Human
uauacacaaggugugcauuugu

SEQ ID NO: 338733 - RNA, 22 nt, Human
uuuaaauuauaguuaaugucug

SEQ ID NO: 338734 - RNA, 22 nt, Human
uacuuacagaaggaagcaauug

SEQ ID NO: 338735 - RNA, 22 nt, Human
uucaggauucuuucagacuggg

SEQ ID NO: 338736 - RNA, 22 nt, Human
aaaguucuaaaacucuuuguga

SEQ ID NO: 338737 - RNA, 22 nt, Human
cccaaggaagacgcuugugaua

SEQ ID NO: 338738 - RNA, 22 nt, Human
agugcuuugguauagaacuauu

SEQ ID NO: 338739 - RNA, 20 nt, Human
aggcucagcugagcucuugg

SEQ ID NO: 338740 - RNA, 22 nt, Human
guccaugacugugacucacaug

SEQ ID NO: 338741 - RNA, 22 nt, Human
uuucuucagccacuccaaacug

SEQ ID NO: 338742 - RNA, 20 nt, Human
uuugucuguuaaguguuucu

SEQ ID NO: 338743 - RNA, 22 nt, Human
aucuuucaaucaggaaaaaucu

SEQ ID NO: 338744 - RNA, 22 nt, Human
gaaacauaguugagacacugcu

SEQ ID NO: 338745 - RNA, 22 nt, Human
aaacacagauuucuuuguccca

SEQ ID NO: 338746 - RNA, 22 nt, Human
gucuuucuaugaugaacuguug

SEQ ID NO: 338747 - RNA, 22 nt, Human
aggccagcgcugcuagcucccg

SEQ ID NO: 338748 - RNA, 22 nt, Human
uugugaaacauucauggauuug

SEQ ID NO: 338749 - RNA, 22 nt, Human
cugccuccugccgugcagcuuc

SEQ ID NO: 338750 - RNA, 22 nt, Human
aauaucaguauauuguaucagu

SEQ ID NO: 338751 - RNA, 22 nt, Human
uaggaaauggcucaguuacugc

SEQ ID NO: 338752 - RNA, 22 nt, Human
gaggcagugcauugucuagggg

SEQ ID NO: 338753 - RNA, 22 nt, Human
acuggcaggcugcuggccggcg

SEQ ID NO: 338754 - RNA, 22 nt, Human
uucaggauaugugauaucugaa

SEQ ID NO: 338755 - RNA, 22 nt, Human
uccaggagauucauuaggucau

SEQ ID NO: 338756 - RNA, 15 nt, Human
caggagaggaagguu

SEQ ID NO: 338757 - RNA, 20 nt, Human
ucugugcaccugcuacaagg

SEQ ID NO: 338758 - RNA, 22 nt, Human
aauaauuuuagcucagaguugu

SEQ ID NO: 338759 - RNA, 22 nt, Human
aagagagggguugcauggaaau

SEQ ID NO: 338760 - RNA, 20 nt, Human
uuucaguuaucuugaccuuc

SEQ ID NO: 338761 - RNA, 22 nt, Human
uccauuuuguagguaugcuaca

SEQ ID NO: 338762 - RNA, 22 nt, Human
ucugcuguauuagguugaacug

SEQ ID NO: 338763 - RNA, 22 nt, Human
uuagccauauagaaaaagagcu

SEQ ID NO: 338764 - RNA, 22 nt, Human
auugcuguacacuucuagaucu

SEQ ID NO: 338765 - RNA, 22 nt, Human
cagaggcagugggguugcuccu

SEQ ID NO: 338766 - RNA, 22 nt, Human
cugcuuugauuagaagaguaca

SEQ ID NO: 338767 - RNA, 22 nt, Human
gauucacucauauuuuacguuu

SEQ ID NO: 338768 - RNA, 22 nt, Human
cccuugcacauuugucuuuaau

SEQ ID NO: 338769 - RNA, 22 nt, Human
gagcauuugguuauaguaauuu

SEQ ID NO: 338770 - RNA, 22 nt, Human
gaggagcuugaggcuaggagcc

SEQ ID NO: 338771 - RNA, 22 nt, Human
cagcuggcaaguggagcagggu

SEQ ID NO: 338772 - RNA, 17 nt, Human
aagacagaagccaugag

SEQ ID NO: 338773 - RNA, 22 nt, Human
aggcagugcaugcaaaggucgg

SEQ ID NO: 338774 - RNA, 22 nt, Human
agucuccuuggccucaaugccu

SEQ ID NO: 338775 - RNA, 22 nt, Human
uuuaaauggcauuuucccagau

SEQ ID NO: 338776 - RNA, 22 nt, Human
cuaauguaucauggcucucagc

SEQ ID NO: 338777 - RNA, 22 nt, Human
cccaggaaugagcaggcagggg

SEQ ID NO: 338778 - RNA, 22 nt, Human
ugcugaugaguccuucuaucgc

SEQ ID NO: 338779 - RNA, 22 nt, Human
aaucuucagugucuaaaaagca

SEQ ID NO: 338780 - RNA, 22 nt, Human
ucagguggcuuggagggggacg

SEQ ID NO: 338781 - RNA, 22 nt, Human
gagguagcgaguggacagugca

SEQ ID NO: 338782 - RNA, 22 nt, Human
gaacacaucacauuuuacagug

SEQ ID NO: 338783 - RNA, 22 nt, Human
gaaucucaguggaagcaggaag

SEQ ID NO: 338784 - RNA, 22 nt, Human
acuucaugcagaagagagcugu

SEQ ID NO: 338785 - RNA, 22 nt, Human
uagcucuucauuucaucugauu

SEQ ID NO: 338786 - RNA, 22 nt, Human
ggaggccagggacccagucagc

SEQ ID NO: 338787 - RNA, 22 nt, Human
cuugggaaugcuaacagaugac

SEQ ID NO: 338788 - RNA, 22 nt, Human
cugcuguguuucacaccucugg

SEQ ID NO: 338789 - RNA, 22 nt, Human
gucauucuuaacaacucaguag

SEQ ID NO: 338790 - RNA, 22 nt, Human
uaaggccaauuaacaaccaggg

SEQ ID NO: 338791 - RNA, 22 nt, Human
ugaggcaguauucuccauucca

SEQ ID NO: 338792 - RNA, 22 nt, Human
aggaaaacacaguauugaugga

SEQ ID NO: 338793 - RNA, 22 nt, Human
uggcagcugucuguggggucuc

SEQ ID NO: 338794 - RNA, 22 nt, Human
uuagccauuaauguccugugca

SEQ ID NO: 338795 - RNA, 22 nt, Human
uaacacauuaguucuccuagau

SEQ ID NO: 338796 - RNA, 22 nt, Human
uccaggaguccuggguggcccc

SEQ ID NO: 338797 - RNA, 22 nt, Human
gaggagcuggcugucgggaggc

SEQ ID NO: 338798 - RNA, 22 nt, Human
uuugcagugauucuugcaguga

SEQ ID NO: 338799 - RNA, 22 nt, Human
uucuccucuguuggccuucccu

SEQ ID NO: 338800 - RNA, 22 nt, Human
aaagauuauggcauugaaauac

SEQ ID NO: 338801 - RNA, 22 nt, Human
cagcugacccgugggaggcggg

SEQ ID NO: 338802 - RNA, 22 nt, Human
acaggagaauuaucuggaacaa

SEQ ID NO: 338803 - RNA, 20 nt, Human
cccagugaagcauggaagag

SEQ ID NO: 338804 - RNA, 22 nt, Human
ucacauuuuauaucucugguuu

SEQ ID NO: 338805 - RNA, 22 nt, Human
caaauagugucacauugugagg

SEQ ID NO: 338806 - RNA, 22 nt, Human
aggcagugccuggaccccagcu

SEQ ID NO: 338807 - RNA, 22 nt, Human
auaaauaucacuguugucccuc

SEQ ID NO: 338808 - RNA, 22 nt, Human
caaguaaacaauaugugauuca

SEQ ID NO: 338809 - RNA, 22 nt, Human
uaagauaaguggguugagaugg

SEQ ID NO: 338810 - RNA, 22 nt, Human
auaaagauuucuuuuucucuac

SEQ ID NO: 338811 - RNA, 22 nt, Human
uaggcagcgcuuggcugugcuu

SEQ ID NO: 338812 - RNA, 22 nt, Human
caagauaagaucauuuacacua

SEQ ID NO: 338813 - RNA, 22 nt, Human
uacccagggcuuuucugaugca

SEQ ID NO: 338814 - RNA, 22 nt, Human
aguguguccagaaaucuguauu

SEQ ID NO: 338815 - RNA, 22 nt, Human
gaaggccauugcguccugggau

SEQ ID NO: 338816 - RNA, 22 nt, Human
cauuuguuaauuacuauuaucu

SEQ ID NO: 338817 - RNA, 19 nt, Human
caagugaagccugggaugg

SEQ ID NO: 338818 - RNA, 23 nt, Human
uccuuccuuugagaggcuccauc

SEQ ID NO: 338819 - RNA, 22 nt, Human
acaugauuuuaguaucauaaua

SEQ ID NO: 338820 - RNA, 22 nt, Human
gaccaaggaagaggggagccag

SEQ ID NO: 338821 - RNA, 22 nt, Human
uaguauuuaaucacuuuugucu

SEQ ID NO: 338822 - RNA, 22 nt, Human
cacagcauaaugaaauauacuu

SEQ ID NO: 338823 - RNA, 22 nt, Human
acauauuuugaaagcuuucuaa

SEQ ID NO: 338824 - RNA, 22 nt, Human
auuugcuucugugaaaucaagu

SEQ ID NO: 338825 - RNA, 22 nt, Human
aucccaugagaccacguuggcu

SEQ ID NO: 338826 - RNA, 22 nt, Human
agacgagggcccccaggacagc

SEQ ID NO: 338827 - RNA, 22 nt, Human
ccagaggaaaaauaucucccua

SEQ ID NO: 338828 - RNA, 20 nt, Human
guggcaggcagugaaggagc

SEQ ID NO: 338829 - RNA, 22 nt, Human
ucuacccagagcuaugaccuga

SEQ ID NO: 338830 - RNA, 22 nt, Human
gaggcaguguugaaaaggagag

SEQ ID NO: 338831 - RNA, 22 nt, Human
agaggccaggcugcagagggau

SEQ ID NO: 338832 - RNA, 22 nt, Human
uuucccaguucccugcucuaua

SEQ ID NO: 338833 - RNA, 19 nt, Human
ggucagcugggcuagaggc

SEQ ID NO: 338834 - RNA, 22 nt, Human
agaggagugggaagcagugcaa

SEQ ID NO: 338835 - RNA, 22 nt, Human
cucugucacuucuccagcugag

SEQ ID NO: 338836 - RNA, 22 nt, Human
augugaaaaauuucuuauuaca

SEQ ID NO: 338837 - RNA, 22 nt, Human
cauuuucagcacccaucugaaa

SEQ ID NO: 338838 - RNA, 22 nt, Human
augcugugccuggaaagcggcu

SEQ ID NO: 338839 - RNA, 22 nt, Human
uucaugaaacuuaacuguuggg

SEQ ID NO: 338840 - RNA, 22 nt, Human
cuucaggauuuaggaagaugaa

SEQ ID NO: 338841 - RNA, 22 nt, Human
ucuucuucccaucccucaaaug

SEQ ID NO: 338842 - RNA, 22 nt, Human
uuugcaaagugacuauuauaug

SEQ ID NO: 338843 - RNA, 22 nt, Human
aggcacaggccucagcacccag

SEQ ID NO: 338844 - RNA, 22 nt, Human
cagcaggaccauugaggcauca

SEQ ID NO: 338845 - RNA, 22 nt, Human
aaggcagcaggauuuggugacu

SEQ ID NO: 338846 - RNA, 22 nt, Human
ugucuucagcaaaugccuuucu

SEQ ID NO: 338847 - RNA, 22 nt, Human
ggccagaaguuggaaaagagcc

SEQ ID NO: 338848 - RNA, 22 nt, Human
cucaacagcucugccauacucc

SEQ ID NO: 338849 - RNA, 22 nt, Human
gaggcacuggaggaaaggagaa

SEQ ID NO: 338850 - RNA, 22 nt, Human
aggagcagcuucugaaccaugu

SEQ ID NO: 338851 - RNA, 22 nt, Human
uucuuuuacauuaagauuucag

SEQ ID NO: 338852 - RNA, 22 nt, Human
gcagcugcagagaccggguggg

SEQ ID NO: 338853 - RNA, 22 nt, Human
uuagagucaagcugcauguucu

SEQ ID NO: 338854 - RNA, 23 nt, Human
cuuuuaacuugaucugagaccag

SEQ ID NO: 338855 - RNA, 22 nt, Human
cucaggauguacuacagaaggc

SEQ ID NO: 338856 - RNA, 22 nt, Human
uuucuucagccuucacaaccug

SEQ ID NO: 338857 - RNA, 22 nt, Human
ccaggacaaguguggccauggc

SEQ ID NO: 338858 - RNA, 22 nt, Human
aguuauuacucuuuaacauauu

SEQ ID NO: 338859 - RNA, 22 nt, Human
ucaggagaaucagggcuguccu

SEQ ID NO: 338860 - RNA, 23 nt, Human
uggcaaggaaugggauggagacu

SEQ ID NO: 338861 - RNA, 22 nt, Human
aaagccauuacaaaauuucaua

SEQ ID NO: 338862 - RNA, 21 nt, Human
gcugcaucaaucuacccaggg

SEQ ID NO: 338863 - RNA, 22 nt, Human
agcuucccaagguuggaagguu

SEQ ID NO: 338864 - RNA, 22 nt, Human
guuuucaaggggauuuaacuga

SEQ ID NO: 338865 - RNA, 22 nt, Human
uugguuuagagagugugguuac

SEQ ID NO: 338866 - RNA, 22 nt, Human
uauuuccaccuauuauuuucug

SEQ ID NO: 338867 - RNA, 22 nt, Human
gaugagcauuguuucauguguu

SEQ ID NO: 338868 - RNA, 22 nt, Human
gaggcagcucuucugaaugggg

SEQ ID NO: 338869 - RNA, 22 nt, Human
uaaggccaaggggccauagucu

SEQ ID NO: 338870 - RNA, 22 nt, Human
cuagaauugcauucuaugaaua

SEQ ID NO: 338871 - RNA, 22 nt, Human
agacagcuaauaaaugagugug

SEQ ID NO: 338872 - RNA, 22 nt, Human
acuuuacaagcuuauagccuag

SEQ ID NO: 338873 - RNA, 22 nt, Human
cccaggagaugcacuccauugg

SEQ ID NO: 338874 - RNA, 22 nt, Human
aagcuggagaguuaggugaaua

SEQ ID NO: 338875 - RNA, 22 nt, Human
ucaggagaguguucaguggagg

SEQ ID NO: 338876 - RNA, 22 nt, Human
uuucuagggcucuugucuucug

SEQ ID NO: 338877 - RNA, 22 nt, Human
cagggaggaugggcuguuuugc

SEQ ID NO: 338878 - RNA, 18 nt, Human
gcagcuagccaggggggc

SEQ ID NO: 338879 - RNA, 21 nt, Human
aaucauacaaaacaugucagg

SEQ ID NO: 338880 - RNA, 22 nt, Human
auaugugaaugauaucacuuug

SEQ ID NO: 338881 - RNA, 22 nt, Human
ggagggacccacucuagaggug

SEQ ID NO: 338882 - RNA, 23 nt, Human
gugagucuugccuuugcugugga

SEQ ID NO: 338883 - RNA, 23 nt, Human
auucuucauuaucuucuagaaaa

SEQ ID NO: 338884 - RNA, 20 nt, Human
cucaggauacugcaaaguug

SEQ ID NO: 338885 - RNA, 22 nt, Human
cagcugccugucuggaggcaau

SEQ ID NO: 338886 - RNA, 22 nt, Human
ccuacucugagcgccuccgcau

SEQ ID NO: 338887 - RNA, 22 nt, Human
aggcaguguguagcuggaagag

SEQ ID NO: 338888 - RNA, 22 nt, Human
uuagccauuaaauuacaaggug

SEQ ID NO: 338889 - RNA, 22 nt, Human
uggaggaaguggcuggccagaa

SEQ ID NO: 338890 - RNA, 21 nt, Human
cugcuguggcccccgacaugc

SEQ ID NO: 338891 - RNA, 22 nt, Human
cacagacccagaagggaugaag

SEQ ID NO: 338892 - RNA, 22 nt, Human
uacuuuuuagcacagugugugc

SEQ ID NO: 338893 - RNA, 22 nt, Human
aggaugaggcuggcaggucuug

SEQ ID NO: 338894 - RNA, 22 nt, Human
uccaggagggggagccgugccg

SEQ ID NO: 338895 - RNA, 19 nt, Human
ugagaggcuuaaggcagcu

SEQ ID NO: 338896 - RNA, 22 nt, Human
aucugcuugaguuugaagucag

SEQ ID NO: 338897 - RNA, 22 nt, Human
ggcagcuggguuggccagaaac

SEQ ID NO: 338898 - RNA, 22 nt, Human
guaggcagguggaggagugaag

SEQ ID NO: 338899 - RNA, 22 nt, Human
cuagcaucagaugagaagcugu

SEQ ID NO: 338900 - RNA, 22 nt, Human
aaucuucuuucuuaacaguaca

SEQ ID NO: 338901 - RNA, 22 nt, Human
aucaggauccaccuugagccug

SEQ ID NO: 338902 - RNA, 22 nt, Human
cccaggagguuggggcuacagu

SEQ ID NO: 338903 - RNA, 22 nt, Human
auucugucauuucaagaaaaac

SEQ ID NO: 338904 - RNA, 22 nt, Human
auugaaagagaauguagcucuu

SEQ ID NO: 338905 - RNA, 22 nt, Human
cccaggaacuccagagcuccuc

SEQ ID NO: 338906 - RNA, 22 nt, Human
uauauguaaauaagucuaaugu

SEQ ID NO: 338907 - RNA, 22 nt, Human
uuugaaauaugaggcauuauga

SEQ ID NO: 338908 - RNA, 22 nt, Human
ucugcugucacucauuugcuuc

SEQ ID NO: 338909 - RNA, 22 nt, Human
cagucccuaguggagcucacag

SEQ ID NO: 338910 - RNA, 22 nt, Human
cauuuauucauuugcuagggcu

SEQ ID NO: 338911 - RNA, 22 nt, Human
uaucaauugggccaaaugguac

SEQ ID NO: 338912 - RNA, 22 nt, Human
ggagcaggagucucuugaauuu

SEQ ID NO: 338913 - RNA, 22 nt, Human
uaagaacuucggacauguuauc

SEQ ID NO: 338914 - RNA, 22 nt, Human
gucugucauacggcuuauguaa

SEQ ID NO: 338915 - RNA, 19 nt, Human
ucucugcuucucuuggcau

SEQ ID NO: 338916 - RNA, 22 nt, Human
cugaaaauguuacacaggaaga

SEQ ID NO: 338917 - RNA, 22 nt, Human
agugagaguauuaaugugaacu

SEQ ID NO: 338918 - RNA, 22 nt, Human
uuucacaagacagcuacuguug

SEQ ID NO: 338919 - RNA, 22 nt, Human
gucacuguauccagguuccagc

SEQ ID NO: 338920 - RNA, 22 nt, Human
aaauaguuuagcucucauuuca

SEQ ID NO: 338921 - RNA, 22 nt, Human
agagacagaggcaauauagcuu

SEQ ID NO: 338922 - RNA, 22 nt, Human
uugacacagaucaauauucaac

SEQ ID NO: 338923 - RNA, 22 nt, Human
gaaggccauuuuuagguagaau

SEQ ID NO: 338924 - RNA, 22 nt, Human
aaucugucguaguaaaaagcag

SEQ ID NO: 338925 - RNA, 22 nt, Human
caaggccaguccauuuuggaag

SEQ ID NO: 338926 - RNA, 22 nt, Human
ucauuuguggaagugauugugg

SEQ ID NO: 338927 - RNA, 22 nt, Human
agcccaggagguggagguugca

SEQ ID NO: 338928 - RNA, 22 nt, Human
cuuugaauugccguuucaucug

SEQ ID NO: 338929 - RNA, 22 nt, Human
uucuucuuuccuauaauuaauu

SEQ ID NO: 338930 - RNA, 22 nt, Human
ggaagaggcugaggccaugcug

SEQ ID NO: 338931 - RNA, 22 nt, Human
uggcagagugcagaagaggcau

SEQ ID NO: 338932 - RNA, 22 nt, Human
uggagaggagcaccauggccau

SEQ ID NO: 338933 - RNA, 22 nt, Human
acucagaaccauuuacucugag

SEQ ID NO: 338934 - RNA, 22 nt, Human
caaauguauucucacuucaggg

SEQ ID NO: 338935 - RNA, 22 nt, Human
ucuuuauugcuacugguuuguc

SEQ ID NO: 338936 - RNA, 22 nt, Human
caagauggaguccgggaaugug

SEQ ID NO: 338937 - RNA, 22 nt, Human
guucuucagucacaucacagaa

SEQ ID NO: 338938 - RNA, 22 nt, Human
uuuauauuucccaggauuggcc

SEQ ID NO: 338939 - RNA, 22 nt, Human
auauauuugagaauauucauga

SEQ ID NO: 338940 - RNA, 22 nt, Human
ccaugagacagcaacugaaagu

SEQ ID NO: 338941 - RNA, 22 nt, Human
cuuuggaauauuuuauugagaa

SEQ ID NO: 338942 - RNA, 22 nt, Human
gggcagcuggccagguauucug

SEQ ID NO: 338943 - RNA, 22 nt, Human
aucugcuuccugggcuccauga

SEQ ID NO: 338944 - RNA, 18 nt, Human
uuccaugauuccuuucac

SEQ ID NO: 338945 - RNA, 22 nt, Human
acucaggaaaugaagacugguu

SEQ ID NO: 338946 - RNA, 22 nt, Human
gaggcagcaaaauauaucauaa

SEQ ID NO: 338947 - RNA, 22 nt, Human
acccaggagagagcuauaaaau

SEQ ID NO: 338948 - RNA, 22 nt, Human
aaagcagaggugauaugacuua

SEQ ID NO: 338949 - RNA, 22 nt, Human
acuggaaaugagaugauaucag

SEQ ID NO: 338950 - RNA, 22 nt, Human
ugcuguggcaguuuauguauag

SEQ ID NO: 338951 - RNA, 22 nt, Human
uugcauuugaucuuggguucuc

SEQ ID NO: 338952 - RNA, 22 nt, Human
gagugcaggccugagcaccauc

SEQ ID NO: 338953 - RNA, 22 nt, Human
uuauacauguguuuugagauga

SEQ ID NO: 338954 - RNA, 22 nt, Human
cucccagagagcaggugggccg

SEQ ID NO: 338955 - RNA, 22 nt, Human
ugucucaguacacuccgauguu

SEQ ID NO: 338956 - RNA, 22 nt, Human
auuacaauaagguuuauuugua

SEQ ID NO: 338957 - RNA, 22 nt, Human
ucacaaauauuuuaacaguagg

SEQ ID NO: 338958 - RNA, 22 nt, Human
uccaggaguggggcagaggucu

SEQ ID NO: 338959 - RNA, 20 nt, Human
agcauuugaaauaugacuau

SEQ ID NO: 338960 - RNA, 22 nt, Human
uugguuuaggaacuggcuugga

SEQ ID NO: 338961 - RNA, 22 nt, Human
ccauccugcauugcuauucaga

SEQ ID NO: 338962 - RNA, 22 nt, Human
cauaauuugugguaguggggga

SEQ ID NO: 338963 - RNA, 22 nt, Human
aaaguugugaaaccgaacaugu

SEQ ID NO: 338964 - RNA, 22 nt, Human
agggcagcccuucugggagggc

SEQ ID NO: 338965 - RNA, 20 nt, Human
gucaggauuaguaaacucug

SEQ ID NO: 338966 - RNA, 22 nt, Human
aggcuagcuuuggcucaguaaa

SEQ ID NO: 338967 - RNA, 22 nt, Human
uuagccaugugggaaaaacagc

SEQ ID NO: 338968 - RNA, 22 nt, Human
cagagccacuuggagaugagaa

SEQ ID NO: 338969 - RNA, 22 nt, Human
uucaggaugacaccauguccag

SEQ ID NO: 338970 - RNA, 22 nt, Human
aggguagguguaagauagcccu

SEQ ID NO: 338971 - RNA, 22 nt, Human
aguaugaagcugaaugauuuua

SEQ ID NO: 338972 - RNA, 20 nt, Human
cuguuaaaagguaugaauuc

SEQ ID NO: 338973 - RNA, 19 nt, Human
uuagccauccacagugaaa

SEQ ID NO: 338974 - RNA, 21 nt, Human
uucugggaaaugagcuggggc

SEQ ID NO: 338975 - RNA, 22 nt, Human
gcaucuaaauaaacgugggagu

SEQ ID NO: 338976 - RNA, 22 nt, Human
uauaucauggagauuaacauuc

SEQ ID NO: 338977 - RNA, 22 nt, Human
ucuuuuggguucuuaugauuua

SEQ ID NO: 338978 - RNA, 22 nt, Human
cugcccaggaaggagaggaugg

SEQ ID NO: 338979 - RNA, 22 nt, Human
agucuugcauuuucugaagaug

SEQ ID NO: 338980 - RNA, 18 nt, Human
caugucugcgccacaagg

SEQ ID NO: 338981 - RNA, 22 nt, Human
uuuguaaaggccugaauuucag

SEQ ID NO: 338982 - RNA, 22 nt, Human
aggggagguggcagaaaugugc

SEQ ID NO: 338983 - RNA, 22 nt, Human
uccucagaaaccccugugaggu

SEQ ID NO: 338984 - RNA, 22 nt, Human
cggagaggaccugcaacucgcu

SEQ ID NO: 338985 - RNA, 22 nt, Human
agugcuuugugcucucacugca

SEQ ID NO: 338986 - RNA, 22 nt, Human
ucucccaggcugcccuguggac

SEQ ID NO: 338987 - RNA, 21 nt, Human
ucacuagugccuucugucauu

SEQ ID NO: 338988 - RNA, 22 nt, Human
uaaggccaaguucauauacaac

SEQ ID NO: 338989 - RNA, 22 nt, Human
gugcugugucuaucaggaauaa

SEQ ID NO: 338990 - RNA, 22 nt, Human
cugcugugauugggagaaaccg

SEQ ID NO: 338991 - RNA, 22 nt, Human
auugaaaguccuaucuaaggga

SEQ ID NO: 338992 - RNA, 22 nt, Human
cugcagagcaaguaacauccuc

SEQ ID NO: 338993 - RNA, 21 nt, Human
cacucaggguaugugccaggc

SEQ ID NO: 338994 - RNA, 22 nt, Human
aggccagcacgacagccgcagg

SEQ ID NO: 338995 - RNA, 22 nt, Human
auucaaguucuucugucuuugc

SEQ ID NO: 338996 - RNA, 22 nt, Human
uccuucuuucccccuagucauu

SEQ ID NO: 338997 - RNA, 22 nt, Human
uuuauuguuaucaugggugagu

SEQ ID NO: 338998 - RNA, 22 nt, Human
ccugcucagagcgucuugugug

SEQ ID NO: 338999 - RNA, 22 nt, Human
auucucaauggcuacuuucaua

SEQ ID NO: 339000 - RNA, 22 nt, Human
auuggcaguuagugacgaggcu

SEQ ID NO: 339001 - RNA, 22 nt, Human
uagugcuugagucucuccguac

SEQ ID NO: 339002 - RNA, 22 nt, Human
uauauauucuuaaguaguguag

SEQ ID NO: 339003 - RNA, 22 nt, Human
aggcaagcauuuaaccacucau

SEQ ID NO: 339004 - RNA, 22 nt, Human
agcagagccugggcuaggggug

SEQ ID NO: 339005 - RNA, 20 nt, Human
auacacauauucuugcaacu

SEQ ID NO: 339006 - RNA, 22 nt, Human
cccaggagagagacuugaaucu

SEQ ID NO: 339007 - RNA, 22 nt, Human
uguucuuuggcuucacagcucu

SEQ ID NO: 339008 - RNA, 22 nt, Human
gcaaguuauuuccauuuaaagc

SEQ ID NO: 339009 - RNA, 22 nt, Human
ucauauaacuggauauuuucaa

SEQ ID NO: 339010 - RNA, 22 nt, Human
caacugugaauuuuaugauacc

SEQ ID NO: 339011 - RNA, 22 nt, Human
agcaccauugcaaauauggcag

SEQ ID NO: 339012 - RNA, 22 nt, Human
uucucagaauugacugggagca

SEQ ID NO: 339013 - RNA, 22 nt, Human
gaaggccaguuuugagauaggu

SEQ ID NO: 339014 - RNA, 22 nt, Human
ucauuguuauguuuugcugucu

SEQ ID NO: 339015 - RNA, 22 nt, Human
cagcugccccgcuggcugacca

SEQ ID NO: 339016 - RNA, 22 nt, Human
gccaggagcaugucauuguuga

SEQ ID NO: 339017 - RNA, 22 nt, Human
caacagcugaucuuugaugaag

SEQ ID NO: 339018 - RNA, 22 nt, Human
auacuucuuugauguucacagg

SEQ ID NO: 339019 - RNA, 22 nt, Human
ccauggcaauggucagucuauu

SEQ ID NO: 339020 - RNA, 22 nt, Human
auucuucagaauaucuggcacu

SEQ ID NO: 339021 - RNA, 22 nt, Human
auauaauacaaccugcuaagug

SEQ ID NO: 339022 - RNA, 23 nt, Human
ucagucuucccugucaguaauag

SEQ ID NO: 339023 - RNA, 22 nt, Human
uuagacauagaauauugucuag

SEQ ID NO: 339024 - RNA, 22 nt, Human
aaguaugugauacauguuaauu

SEQ ID NO: 339025 - RNA, 22 nt, Human
auggaguucuuuaaauucacag

SEQ ID NO: 339026 - RNA, 22 nt, Human
gcuacugauugaccuuggagag

SEQ ID NO: 339027 - RNA, 20 nt, Human
cuucuucaguaguuuguucu

SEQ ID NO: 339028 - RNA, 20 nt, Human
ucacaucuggcagcugauga

SEQ ID NO: 339029 - RNA, 22 nt, Human
aagcagagcaagcguauuuauu

SEQ ID NO: 339030 - RNA, 22 nt, Human
ucaggauggcuucugcaucaaa

SEQ ID NO: 339031 - RNA, 22 nt, Human
gcugccagcuuuccuuggcuga

SEQ ID NO: 339032 - RNA, 22 nt, Human
agccagcuguucuggggcagca

SEQ ID NO: 339033 - RNA, 22 nt, Human
agaccauagggaccucagguug

SEQ ID NO: 339034 - RNA, 22 nt, Human
gauggcaggcaggugaguagag

SEQ ID NO: 339035 - RNA, 22 nt, Human
uuaggaguccagaugucuuggg

SEQ ID NO: 339036 - RNA, 22 nt, Human
cuucuucauaggcaguccuguu

SEQ ID NO: 339037 - RNA, 22 nt, Human
uugaaauacugcauuguucagu

SEQ ID NO: 339038 - RNA, 22 nt, Human
uggcagcuugaaugcagucuuu

SEQ ID NO: 339039 - RNA, 22 nt, Human
cauuuccacuucugaaaacugg

SEQ ID NO: 339040 - RNA, 22 nt, Human
ugaaggccacuuccugugagcu

SEQ ID NO: 339041 - RNA, 22 nt, Human
uguacaaagguacuuugauguu

SEQ ID NO: 339042 - RNA, 22 nt, Human
ugccaggauauaagagugcgau

SEQ ID NO: 339043 - RNA, 22 nt, Human
auucacaguuuccucauauucu

SEQ ID NO: 339044 - RNA, 22 nt, Human
uugauagguuuuauguauaguu

SEQ ID NO: 339045 - RNA, 22 nt, Human
uauauguaagcuauguaagagu

SEQ ID NO: 339046 - RNA, 22 nt, Human
ucaaauaccagcaauuucaugu

SEQ ID NO: 339047 - RNA, 22 nt, Human
aguggcaguagaugagcugguu

SEQ ID NO: 339048 - RNA, 22 nt, Human
cugcucuagagagcauuaguca

SEQ ID NO: 339049 - RNA, 22 nt, Human
aaguauuucuggccugugaaag

SEQ ID NO: 339050 - RNA, 22 nt, Human
aucaggaucacagaaacuuuua

SEQ ID NO: 339051 - RNA, 22 nt, Human
guggcaggagagacacagccau

SEQ ID NO: 339052 - RNA, 22 nt, Human
uaacacaugguucugucaggaa

SEQ ID NO: 339053 - RNA, 22 nt, Human
cuccaggaaaauagggaaugag

SEQ ID NO: 339054 - RNA, 22 nt, Human
uguauuuuuagaccuuuagacc

SEQ ID NO: 339055 - RNA, 22 nt, Human
agccuauuccaggaugagcuca

SEQ ID NO: 339056 - RNA, 22 nt, Human
uucacauuggugauauguuucu

SEQ ID NO: 339057 - RNA, 22 nt, Human
ucagagagccucaggcacugcc

SEQ ID NO: 339058 - RNA, 22 nt, Human
gaaggggacuggcagcugcaga

SEQ ID NO: 339059 - RNA, 22 nt, Human
uauuuguugaguuguuaugucu

SEQ ID NO: 339060 - RNA, 22 nt, Human
cacaaaugugcagaaaugugag

SEQ ID NO: 339061 - RNA, 22 nt, Human
aauaaucucccuuuuuguaugu

SEQ ID NO: 339062 - RNA, 22 nt, Human
accgaaggaaacuggaaccguu

SEQ ID NO: 339063 - RNA, 22 nt, Human
aauacugucuuucacagauauu

SEQ ID NO: 339064 - RNA, 22 nt, Human
ugcuuuggccacuagaauucag

SEQ ID NO: 339065 - RNA, 22 nt, Human
uugcaauagccuuauuuccaaa

SEQ ID NO: 339066 - RNA, 21 nt, Human
ggcagcguguggacaggaagg

SEQ ID NO: 339067 - RNA, 22 nt, Human
gaggagcugggucagggagaca

SEQ ID NO: 339068 - RNA, 22 nt, Human
gaggaaccacucugagaagcca

SEQ ID NO: 339069 - RNA, 22 nt, Human
ugcuuagacgucaaguacagcc

SEQ ID NO: 339070 - RNA, 22 nt, Human
guuuucugauuagcaaaucuga

SEQ ID NO: 339071 - RNA, 22 nt, Human
gaaaggugccccauaggcagga

SEQ ID NO: 339072 - RNA, 22 nt, Human
aaaguucuggggguguuucugg

SEQ ID NO: 339073 - RNA, 22 nt, Human
auuucccagcuuugaucaguuu

SEQ ID NO: 339074 - RNA, 22 nt, Human
caugugguucaaguacuccaca

SEQ ID NO: 339075 - RNA, 22 nt, Human
acauacauauguuuaaaugcau

SEQ ID NO: 339076 - RNA, 22 nt, Human
uucagugucaauuuuuaaauau

SEQ ID NO: 339077 - RNA, 22 nt, Human
gagggaugguaguugacacuga

SEQ ID NO: 339078 - RNA, 22 nt, Human
ugaaacauuugaugaucuuugg

SEQ ID NO: 339079 - RNA, 22 nt, Human
cccaggaccgcgcggcugagcg

SEQ ID NO: 339080 - RNA, 22 nt, Human
gaccauuucuaggaaucagacu

SEQ ID NO: 339081 - RNA, 22 nt, Human
cugcuguguggugaaacucagu

SEQ ID NO: 339082 - RNA, 22 nt, Human
aaggcaguaaaaucuaccuugc

SEQ ID NO: 339083 - RNA, 22 nt, Human
ggccagcugggccaccaggugc

SEQ ID NO: 339084 - RNA, 22 nt, Human
ggaagaggaggagccaggcuuu

SEQ ID NO: 339085 - RNA, 22 nt, Human
ccaggagaauaauggcagauua

SEQ ID NO: 339086 - RNA, 22 nt, Human
aaaaauaggucaaccguguaug

SEQ ID NO: 339087 - RNA, 22 nt, Human
aucuuucagggccauuuguauu

SEQ ID NO: 339088 - RNA, 23 nt, Human
ugaaacauuuaggguagaauuuc

SEQ ID NO: 339089 - RNA, 22 nt, Human
agacagcugggaaauggagugu

SEQ ID NO: 339090 - RNA, 22 nt, Human
uguaugaagguuuaccugcugu

SEQ ID NO: 339091 - RNA, 22 nt, Human
ggcagcuaggggcagggaauuc

SEQ ID NO: 339092 - RNA, 22 nt, Human
cucugucagaguguugucccca

SEQ ID NO: 339093 - RNA, 22 nt, Human
ggauggagguucucagaugcuc

SEQ ID NO: 339094 - RNA, 22 nt, Human
cccaggaaaugaacuucugauu

SEQ ID NO: 339095 - RNA, 22 nt, Human
ccugcuguucuguuuagugaac

SEQ ID NO: 339096 - RNA, 19 nt, Human
caggaaugagguaauggcu

SEQ ID NO: 339097 - RNA, 22 nt, Human
gaggggagacagggaaaucagu

SEQ ID NO: 339098 - RNA, 19 nt, Human
aucugccuguuaucacaua

SEQ ID NO: 339099 - RNA, 22 nt, Human
aaaauaacuucuacuauuugca

SEQ ID NO: 339100 - RNA, 22 nt, Human
ucccaggagcaccuuuugagcc

SEQ ID NO: 339101 - RNA, 22 nt, Human
uaacacaugguuaguacacaau

SEQ ID NO: 339102 - RNA, 22 nt, Human
acuuucugcaguguuggaaaug

SEQ ID NO: 339103 - RNA, 22 nt, Human
uccaggagguugagugaguucc

SEQ ID NO: 339104 - RNA, 22 nt, Human
ccaggaguggcuggugaccuuc

SEQ ID NO: 339105 - RNA, 19 nt, Human
ugaggggaggagaggccug

SEQ ID NO: 339106 - RNA, 22 nt, Human
gcuguguuggugaagcuguagc

SEQ ID NO: 339107 - RNA, 22 nt, Human
aggccagcuuccagaggggcag

SEQ ID NO: 339108 - RNA, 22 nt, Human
uucagaaugugaccuuauuugg

SEQ ID NO: 339109 - RNA, 22 nt, Human
agagcagcacguuguccccaca

SEQ ID NO: 339110 - RNA, 22 nt, Human
uugaauaguuuuggauagcaua

SEQ ID NO: 339111 - RNA, 22 nt, Human
ggauggcaggacaaggacccag

SEQ ID NO: 339112 - RNA, 22 nt, Human
auucauuuagguauucacuuac

SEQ ID NO: 339113 - RNA, 22 nt, Human
aggcagcauccagaggagaaug

SEQ ID NO: 339114 - RNA, 22 nt, Human
ccagugcuuccaggaauacggu

SEQ ID NO: 339115 - RNA, 22 nt, Human
cagugaaaucacaacuuuaguu

SEQ ID NO: 339116 - RNA, 22 nt, Human
gaaggucaccuccccucucugg

SEQ ID NO: 339117 - RNA, 22 nt, Human
uuuuaucuaccuaugcucauuu

SEQ ID NO: 339118 - RNA, 22 nt, Human
cacccugggcugggccuguuaa

SEQ ID NO: 339119 - RNA, 22 nt, Human
ucuggcuuucauuuguuuaaag

SEQ ID NO: 339120 - RNA, 22 nt, Human
caggaggggguggaguuucgcc

SEQ ID NO: 339121 - RNA, 22 nt, Human
aggaggggcaaugauagucugg

SEQ ID NO: 339122 - RNA, 22 nt, Human
ucucaggaagauuagggcuaag

SEQ ID NO: 339123 - RNA, 22 nt, Human
aaagauaauguuuccuuauucu

SEQ ID NO: 339124 - RNA, 22 nt, Human
ugaacucgggaggaggcugcag

SEQ ID NO: 339125 - RNA, 20 nt, Human
uacagaaugcaauaaaaugg

SEQ ID NO: 339126 - RNA, 23 nt, Human
uccaggagaaccccugucugucc

SEQ ID NO: 339127 - RNA, 22 nt, Human
aaaaacuguaauuacuuuugca

SEQ ID NO: 339128 - RNA, 22 nt, Human
cauuuguaguuaaaaaugucuc

SEQ ID NO: 339129 - RNA, 22 nt, Human
gacagcuguggagaggcaugug

SEQ ID NO: 339130 - RNA, 22 nt, Human
ucucgacagccuggcacagugg

SEQ ID NO: 339131 - RNA, 22 nt, Human
gcccaggaggcagagguugugg

SEQ ID NO: 339132 - RNA, 22 nt, Human
aaaagucugcucucauuucaga

SEQ ID NO: 339133 - RNA, 22 nt, Human
uagcauuaucugucuuaucauu

SEQ ID NO: 339134 - RNA, 22 nt, Human
caggaaugaggucguaaguguc

SEQ ID NO: 339135 - RNA, 22 nt, Human
aagggcaggaaaagauggaugu

SEQ ID NO: 339136 - RNA, 22 nt, Human
ugaaucaguauaaauucucaaa

SEQ ID NO: 339137 - RNA, 22 nt, Human
ucaggauguuaauauagcauua

SEQ ID NO: 339138 - RNA, 22 nt, Human
gcccaggaguuggaggcugcag

SEQ ID NO: 339139 - RNA, 22 nt, Human
gucagagagggcacgugcacac

SEQ ID NO: 339140 - RNA, 22 nt, Human
aggcagacucaauggcuagaua

SEQ ID NO: 339141 - RNA, 22 nt, Human
agucuucucauuucacaugcuu

SEQ ID NO: 339142 - RNA, 22 nt, Human
uucugucaaauuugccauaugg

SEQ ID NO: 339143 - RNA, 22 nt, Human
uuucaugauuaacuuagugaau

SEQ ID NO: 339144 - RNA, 22 nt, Human
gaagcagcgaaguggaagggac

SEQ ID NO: 339145 - RNA, 22 nt, Human
aacaugauggggaagaacaaga

SEQ ID NO: 339146 - RNA, 22 nt, Human
gauggacagccuggaaggaaag

SEQ ID NO: 339147 - RNA, 19 nt, Human
cccucuugcacaaagcaaa

SEQ ID NO: 339148 - RNA, 22 nt, Human
ugaacaguuucaagaaaacuuu

SEQ ID NO: 339149 - RNA, 22 nt, Human
aauaucaacaguguccuucuaa

SEQ ID NO: 339150 - RNA, 22 nt, Human
caugauuuugucuuguguuaau

SEQ ID NO: 339151 - RNA, 22 nt, Human
cccaggaggcggagguuguggu

SEQ ID NO: 339152 - RNA, 22 nt, Human
uggugguuaugcgcuuuguggg

SEQ ID NO: 339153 - RNA, 22 nt, Human
cauguuuacuaccaggagaaug

SEQ ID NO: 339154 - RNA, 22 nt, Human
gaggcagcggcucacagagaaa

SEQ ID NO: 339155 - RNA, 22 nt, Human
ugaacaaacugcauucuucacu

SEQ ID NO: 339156 - RNA, 22 nt, Human
uaaacauuuguuauucuuguuu

SEQ ID NO: 339157 - RNA, 22 nt, Human
uuugaauagcauaggauuacau

SEQ ID NO: 339158 - RNA, 22 nt, Human
ggagccuggucagguuggcucc

SEQ ID NO: 339159 - RNA, 22 nt, Human
aucugccuccaaguccaugugu

SEQ ID NO: 339160 - RNA, 22 nt, Human
gaggccaggagugcuguaaguu

SEQ ID NO: 339161 - RNA, 22 nt, Human
gagugcaguuggggugagggga

SEQ ID NO: 339162 - RNA, 22 nt, Human
gcucagagcuugaaguuccacu

SEQ ID NO: 339163 - RNA, 22 nt, Human
ucuucacaugaccuucaugucu

SEQ ID NO: 339164 - RNA, 22 nt, Human
uugcaucuaccauaucaaagau

SEQ ID NO: 339165 - RNA, 22 nt, Human
gucaggaugcuauuguuauuaa

SEQ ID NO: 339166 - RNA, 22 nt, Human
uugauuucuauucagauguaga

SEQ ID NO: 339167 - RNA, 22 nt, Human
uuugaaagccuggcuuuucucu

SEQ ID NO: 339168 - RNA, 22 nt, Human
aaucuucuacuugacaguucuc

SEQ ID NO: 339169 - RNA, 22 nt, Human
auggagggugguaagacagaga

SEQ ID NO: 339170 - RNA, 22 nt, Human
auacauauaugguacuuccugg

SEQ ID NO: 339171 - RNA, 22 nt, Human
cuacccagcaccuaggcugccu

SEQ ID NO: 339172 - RNA, 22 nt, Human
cucaggauauugggcuggagca

SEQ ID NO: 339173 - RNA, 22 nt, Human
aaagccaugaauguuauagagg

SEQ ID NO: 339174 - RNA, 22 nt, Human
ucaggagagagaaauuggggcu

SEQ ID NO: 339175 - RNA, 22 nt, Human
uagggauguaaacauaguaauu

SEQ ID NO: 339176 - RNA, 22 nt, Human
ccagugcuucuuugcuagcugg

SEQ ID NO: 339177 - RNA, 22 nt, Human
uucccaugccuggccccuaucc

SEQ ID NO: 339178 - RNA, 22 nt, Human
aaaguuguaauggaagaaaugc

SEQ ID NO: 339179 - RNA, 22 nt, Human
uuuuucuuaaauguggguuggc

SEQ ID NO: 339180 - RNA, 22 nt, Human
auuugcaaagucguaucuguga

SEQ ID NO: 339181 - RNA, 22 nt, Human
aaggcagccaugugcuuugggu

SEQ ID NO: 339182 - RNA, 22 nt, Human
ccaggacagugaacauguaaga

SEQ ID NO: 339183 - RNA, 22 nt, Human
ucaggaggccaccaggaccugu

SEQ ID NO: 339184 - RNA, 22 nt, Human
augaacugcaguauaaacuugg

SEQ ID NO: 339185 - RNA, 22 nt, Human
uuaucauugucgcagucuaauu

SEQ ID NO: 339186 - RNA, 22 nt, Human
uauucacaugaaaacaaauuuu

SEQ ID NO: 339187 - RNA, 22 nt, Human
caagauggacauaaggagagaa

SEQ ID NO: 339188 - RNA, 22 nt, Human
gugcugugugauccaugcuggc

SEQ ID NO: 339189 - RNA, 22 nt, Human
ccuggauucaagucuuucuuuc

SEQ ID NO: 339190 - RNA, 22 nt, Human
ccuucuucuguguggcccaaga

SEQ ID NO: 339191 - RNA, 22 nt, Human
caggcagcaucagucugcugua

SEQ ID NO: 339192 - RNA, 22 nt, Human
cccuggaggucagaggccuggg

SEQ ID NO: 339193 - RNA, 22 nt, Human
aaacauuugcaacucgguuugg

SEQ ID NO: 339194 - RNA, 22 nt, Human
augaaggcaguuaaacgucauc

SEQ ID NO: 339195 - RNA, 21 nt, Human
acagauauuucauugaacauu

SEQ ID NO: 339196 - RNA, 22 nt, Human
uuggaauucaaguuguagcuua

SEQ ID NO: 339197 - RNA, 22 nt, Human
accaggagggacccugguggcc

SEQ ID NO: 339198 - RNA, 22 nt, Human
ucugaacuccagcccugcucuc

SEQ ID NO: 339199 - RNA, 22 nt, Human
cccuuagcucaauuucuugccc

SEQ ID NO: 339200 - RNA, 22 nt, Human
uacauucagcaaaagaaugguu

SEQ ID NO: 339201 - RNA, 22 nt, Human
uucacagauguauuggaacucc

SEQ ID NO: 339202 - RNA, 18 nt, Human
gagagggaucccucagga

SEQ ID NO: 339203 - RNA, 22 nt, Human
ccccaggacacauggaccaagu

SEQ ID NO: 339204 - RNA, 22 nt, Human
aaggagaguacaggaguuggua

SEQ ID NO: 339205 - RNA, 22 nt, Human
uaaagcacauaucuuacaauaa

SEQ ID NO: 339206 - RNA, 21 nt, Human
aggcagcaggauccagggaca

SEQ ID NO: 339207 - RNA, 22 nt, Human
guuauaaaaugcacaguuguuu

SEQ ID NO: 339208 - RNA, 23 nt, Human
cccauuuucauguuaacuccugg

SEQ ID NO: 339209 - RNA, 22 nt, Human
auucuucauuguugauucaugu

SEQ ID NO: 339210 - RNA, 22 nt, Human
cuguggaaggccuguccugaaa

SEQ ID NO: 339211 - RNA, 23 nt, Human
ggagaggggugugggcaucuuua

SEQ ID NO: 339212 - RNA, 19 nt, Human
uccaggagcaaagccaguu

SEQ ID NO: 339213 - RNA, 17 nt, Human
cccacggaggugugaaa

SEQ ID NO: 339214 - RNA, 22 nt, Human
caaggccagagccagcgauaag

SEQ ID NO: 339215 - RNA, 22 nt, Human
ggucagagggugggcugccugu

SEQ ID NO: 339216 - RNA, 22 nt, Human
cugcuuugcauagcugccagag

SEQ ID NO: 339217 - RNA, 22 nt, Human
aucaggaucacugggagucuug

SEQ ID NO: 339218 - RNA, 22 nt, Human
uccuuagagauacugucuugaa

SEQ ID NO: 339219 - RNA, 22 nt, Human
gaggcagcugggauacaaggga

SEQ ID NO: 339220 - RNA, 19 nt, Human
aggcagcaggccagggaug

SEQ ID NO: 339221 - RNA, 22 nt, Human
cagaggcacaagaaagcaaggc

SEQ ID NO: 339222 - RNA, 22 nt, Human
ucucuucuauuugagacuauuu

SEQ ID NO: 339223 - RNA, 22 nt, Human
uaguuuuacuugcgaugauaau

SEQ ID NO: 339224 - RNA, 22 nt, Human
caacauuucaaggucuuuagga

SEQ ID NO: 339225 - RNA, 22 nt, Human
ugaaacaaugugaaguugcuga

SEQ ID NO: 339226 - RNA, 22 nt, Human
ugacuagaccuauaucuuuuug

SEQ ID NO: 339227 - RNA, 22 nt, Human
ggcagcucacgggcauggggug

SEQ ID NO: 339228 - RNA, 22 nt, Human
agcugcuacugcucugccagag

SEQ ID NO: 339229 - RNA, 22 nt, Human
uuagccauugucagcacauggc

SEQ ID NO: 339230 - RNA, 22 nt, Human
gagagggagccagccaggaacc

SEQ ID NO: 339231 - RNA, 22 nt, Human
gcugcugucagugguggcaguu

SEQ ID NO: 339232 - RNA, 22 nt, Human
acacauuuacauguuuacguau

SEQ ID NO: 339233 - RNA, 22 nt, Human
aaucuguucuacucuauucaga

SEQ ID NO: 339234 - RNA, 21 nt, Human
ggcagccugacccccagagag

SEQ ID NO: 339235 - RNA, 22 nt, Human
ucccaggaaggauucggcauuu

SEQ ID NO: 339236 - RNA, 22 nt, Human
uuccucagaaaauacuguccaa

SEQ ID NO: 339237 - RNA, 20 nt, Human
uugauucaagggcugaugga

SEQ ID NO: 339238 - RNA, 22 nt, Human
uaugucaaaguuaagaaauagg

SEQ ID NO: 339239 - RNA, 22 nt, Human
aucaggauucaguaucuccagc

SEQ ID NO: 339240 - RNA, 22 nt, Human
auuuucaucauggguuuaacau

SEQ ID NO: 339241 - RNA, 22 nt, Human
aucauucuagcuguuguguuga

SEQ ID NO: 339242 - RNA, 20 nt, Human
aggcaccugucacaggugag

SEQ ID NO: 339243 - RNA, 22 nt, Human
ucccaggaagaucccagggacc

SEQ ID NO: 339244 - RNA, 22 nt, Human
aacauuuaugauugagguaaau

SEQ ID NO: 339245 - RNA, 22 nt, Human
ccagaggaggggggucuuucug

SEQ ID NO: 339246 - RNA, 23 nt, Human
gaauaguuuuagaaauuggagaa

SEQ ID NO: 339247 - RNA, 22 nt, Human
acaaauguggacauggauaaug

SEQ ID NO: 339248 - RNA, 22 nt, Human
caggaugggauguagugggccc

SEQ ID NO: 339249 - RNA, 22 nt, Human
ccaggcugugguuuagauagag

SEQ ID NO: 339250 - RNA, 22 nt, Human
agaggcagaaguguucaaaccc

SEQ ID NO: 339251 - RNA, 22 nt, Human
aggcagacaaggacacaguggg

SEQ ID NO: 339252 - RNA, 22 nt, Human
uuuccaagacuccaguucuccc

SEQ ID NO: 339253 - RNA, 21 nt, Human
cucaggauggcggccuggugg

SEQ ID NO: 339254 - RNA, 23 nt, Human
ugaaggccuggaggacgcguugu

SEQ ID NO: 339255 - RNA, 22 nt, Human
ggagaagggacagacucagcuu

SEQ ID NO: 339256 - RNA, 22 nt, Human
ugacauaauaauccaaacauac

SEQ ID NO: 339257 - RNA, 22 nt, Human
aaguggacuaauacaaggacua

SEQ ID NO: 339258 - RNA, 22 nt, Human
ugguaauuaauuugauagguuc

SEQ ID NO: 339259 - RNA, 23 nt, Human
auggaagucacuguuuucuuguc

SEQ ID NO: 339260 - RNA, 22 nt, Human
aaauguuuugcucccauguggu

SEQ ID NO: 339261 - RNA, 22 nt, Human
gaaauuauugcuagagacugca

SEQ ID NO: 339262 - RNA, 22 nt, Human
auguuuccgugagcauccuuga

SEQ ID NO: 339263 - RNA, 22 nt, Human
accaggaggccuggagcacaaa

SEQ ID NO: 339264 - RNA, 22 nt, Human
agagguagagguugcagugagc

SEQ ID NO: 339265 - RNA, 22 nt, Human
agugcuuucuugcuccaucagu

SEQ ID NO: 339266 - RNA, 22 nt, Human
gucuccugagccuugacugcaa

SEQ ID NO: 339267 - RNA, 22 nt, Human
uugaauuagacuuugcuacagg

SEQ ID NO: 339268 - RNA, 22 nt, Human
ugguuuugcuaaaauagaaaga

SEQ ID NO: 339269 - RNA, 22 nt, Human
ucccaggauguuggcggcaggu

SEQ ID NO: 339270 - RNA, 22 nt, Human
auugcuuaucuaucuuuaaguc

SEQ ID NO: 339271 - RNA, 22 nt, Human
uuucucaguuacuagcuguggu

SEQ ID NO: 339272 - RNA, 22 nt, Human
ucuaaccuuugaaacugcuuuc

SEQ ID NO: 339273 - RNA, 22 nt, Human
agugcagccgagaucaggugcu

SEQ ID NO: 339274 - RNA, 22 nt, Human
aucugcaggaaugugugcagag

SEQ ID NO: 339275 - RNA, 22 nt, Human
aguggcagagugcacucaggca

SEQ ID NO: 339276 - RNA, 22 nt, Human
uuuuagauaguuuaacugcacu

SEQ ID NO: 339277 - RNA, 22 nt, Human
ggccaggagaggagggcacuga

SEQ ID NO: 339278 - RNA, 22 nt, Human
ucuucaauuagauuuaccaauu

SEQ ID NO: 339279 - RNA, 22 nt, Human
ucuuagaaugucaacugauguu

SEQ ID NO: 339280 - RNA, 22 nt, Human
aaguaugaaucaaagacuaucu

SEQ ID NO: 339281 - RNA, 22 nt, Human
caggcagcugcuggguucagcc

SEQ ID NO: 339282 - RNA, 22 nt, Human
uacagcuaggcaaaaaugacau

SEQ ID NO: 339283 - RNA, 22 nt, Human
gucugucacucaggggcuggag

SEQ ID NO: 339284 - RNA, 22 nt, Human
aggcagguuggugagaagacug

SEQ ID NO: 339285 - RNA, 22 nt, Human
gaauacauuggaaaucagaaua

SEQ ID NO: 339286 - RNA, 22 nt, Human
uauuuucuguggaggaccagau

SEQ ID NO: 339287 - RNA, 22 nt, Human
uuaacacauauuuaucaauugc

SEQ ID NO: 339288 - RNA, 22 nt, Human
ugcccaggguuucuaagagcag

SEQ ID NO: 339289 - RNA, 22 nt, Human
aagauauucaaagauuuauuag

SEQ ID NO: 339290 - RNA, 22 nt, Human
agaccaagugcaggugccacua

SEQ ID NO: 339291 - RNA, 17 nt, Human
caagagagaugacugga

SEQ ID NO: 339292 - RNA, 22 nt, Human
ucaguuaacaacuauuuauuga

SEQ ID NO: 339293 - RNA, 22 nt, Human
aggguggccaugagggagagau

SEQ ID NO: 339294 - RNA, 22 nt, Human
ugaggcagucacccccuccugc

SEQ ID NO: 339295 - RNA, 22 nt, Human
aggacagcccuugagagcacau

SEQ ID NO: 339296 - RNA, 22 nt, Human
cccaggaggguggccucugccc

SEQ ID NO: 339297 - RNA, 22 nt, Human
uuuacacaaaagauagcacacc

SEQ ID NO: 339298 - RNA, 22 nt, Human
gccauuuucugucuuguuuauu

SEQ ID NO: 339299 - RNA, 22 nt, Human
uuugcaauuugugcugcaaaug

SEQ ID NO: 339300 - RNA, 22 nt, Human
uucucagauccaucagaagucc

SEQ ID NO: 339301 - RNA, 22 nt, Human
ugaguucuaguggcugcagauu

SEQ ID NO: 339302 - RNA, 22 nt, Human
gauguagagggaagauuuuaaa

SEQ ID NO: 339303 - RNA, 22 nt, Human
aauacugccugugagguaacuc

SEQ ID NO: 339304 - RNA, 19 nt, Human
gagcgcagagggcagggga

SEQ ID NO: 339305 - RNA, 22 nt, Human
cccaugagaccugguuuaaggc

SEQ ID NO: 339306 - RNA, 22 nt, Human
ugggagcccaagggagcugccg

SEQ ID NO: 339307 - RNA, 22 nt, Human
uuauuuaaugugaucugaagag

SEQ ID NO: 339308 - RNA, 23 nt, Human
accaggagaaaagcuuugcggga

SEQ ID NO: 339309 - RNA, 22 nt, Human
gcucaggaccgaggggugggaa

SEQ ID NO: 339310 - RNA, 22 nt, Human
cauuuguuuagaagucuuuaua

SEQ ID NO: 339311 - RNA, 22 nt, Human
accaggaguugggggugggacc

SEQ ID NO: 339312 - RNA, 22 nt, Human
cugcuguguuggcauuggauag

SEQ ID NO: 339313 - RNA, 22 nt, Human
aggcagcuaagauggauaauga

SEQ ID NO: 339314 - RNA, 22 nt, Human
ucugaaagaagggcagucuuuu

SEQ ID NO: 339315 - RNA, 19 nt, Human
accaggaguaucagagcug

SEQ ID NO: 339316 - RNA, 22 nt, Human
aucucauaacucauuugaagac

SEQ ID NO: 339317 - RNA, 22 nt, Human
aggcagcugaccacaguaugau

SEQ ID NO: 339318 - RNA, 22 nt, Human
gaggagaggggcucccaagagc

SEQ ID NO: 339319 - RNA, 22 nt, Human
uucagaaguagcuaagcaguca

SEQ ID NO: 339320 - RNA, 21 nt, Human
gggugggaggacacagcaggc

SEQ ID NO: 339321 - RNA, 22 nt, Human
ugcugcugauggcaccuaggca

SEQ ID NO: 339322 - RNA, 22 nt, Human
gcccaggaagccaccgggaagu

SEQ ID NO: 339323 - RNA, 22 nt, Human
aucugcagaggacaggcgagga

SEQ ID NO: 339324 - RNA, 22 nt, Human
ugaacuuagugggaauaucucu

SEQ ID NO: 339325 - RNA, 22 nt, Human
uacauaguauucacauuguuuu

SEQ ID NO: 339326 - RNA, 22 nt, Human
ucugggaacucugucauuuccc

SEQ ID NO: 339327 - RNA, 22 nt, Human
uuccaugaaagugaaauggagc

SEQ ID NO: 339328 - RNA, 22 nt, Human
uuugaaaggguuaugagacuga

SEQ ID NO: 339329 - RNA, 22 nt, Human
cccaaggacacgggcagggaca

SEQ ID NO: 339330 - RNA, 22 nt, Human
aaagaauagccuuuguccaaau

SEQ ID NO: 339331 - RNA, 22 nt, Human
cagucucagaggugggaguggg

SEQ ID NO: 339332 - RNA, 22 nt, Human
cuuuuauuuugaauuaagggcu

SEQ ID NO: 339333 - RNA, 20 nt, Human
gaugggaaucggagcuggua

SEQ ID NO: 339334 - RNA, 22 nt, Human
cccaggagacauauagaaggac

SEQ ID NO: 339335 - RNA, 22 nt, Human
agguaugagauaaaucaaugaa

SEQ ID NO: 339336 - RNA, 21 nt, Human
agaggcaggcauuaaguacac

SEQ ID NO: 339337 - RNA, 22 nt, Human
augcugugccuucucugugcca

SEQ ID NO: 339338 - RNA, 22 nt, Human
uccaggagggguaggcaguaug

SEQ ID NO: 339339 - RNA, 23 nt, Human
aaggccagaauuucaauggugcc

SEQ ID NO: 339340 - RNA, 22 nt, Human
ggugaaggucagagcaggaaaa

SEQ ID NO: 339341 - RNA, 22 nt, Human
gaucuucuauguaaugaagugu

SEQ ID NO: 339342 - RNA, 22 nt, Human
gggcaguuuauucuagaugguu

SEQ ID NO: 339343 - RNA, 22 nt, Human
auuaaaauuccaagguaugcca

SEQ ID NO: 339344 - RNA, 22 nt, Human
uggaguucucaggugagggcuu

SEQ ID NO: 339345 - RNA, 22 nt, Human
caggaugaagggcaaaggcaag

SEQ ID NO: 339346 - RNA, 22 nt, Human
ggguggagcuuggacaccagua

SEQ ID NO: 339347 - RNA, 22 nt, Human
ucuuuccaaggacucuguagca

SEQ ID NO: 339348 - RNA, 22 nt, Human
cccaggagguguagcugcgugg

SEQ ID NO: 339349 - RNA, 22 nt, Human
gcagcugccuucagcuggaugg

SEQ ID NO: 339350 - RNA, 22 nt, Human
ucacugcucagucuguacuaca

SEQ ID NO: 339351 - RNA, 22 nt, Human
uuuuccagagcugucucuugca

SEQ ID NO: 339352 - RNA, 22 nt, Human
auucuucacaccuguuccuguu

SEQ ID NO: 339353 - RNA, 22 nt, Human
aggcaggcacuccggaaguguc

SEQ ID NO: 339354 - RNA, 22 nt, Human
ucugcagguguuggaaggguca

SEQ ID NO: 339355 - RNA, 21 nt, Human
ugcugaugucagagaagcaag

SEQ ID NO: 339356 - RNA, 22 nt, Human
augauauuugcaaugugcuugc

SEQ ID NO: 339357 - RNA, 22 nt, Human
uucugucauccuuucuagaugu

SEQ ID NO: 339358 - RNA, 22 nt, Human
agggaagcccuggcugagaccc

SEQ ID NO: 339359 - RNA, 17 nt, Human
agaggcagauacuugga

SEQ ID NO: 339360 - RNA, 22 nt, Human
ugccuggaaggcccaugggaag

SEQ ID NO: 339361 - RNA, 22 nt, Human
uguguucuggaaagcucacuga

SEQ ID NO: 339362 - RNA, 22 nt, Human
uuucugugguggguaguucaga

SEQ ID NO: 339363 - RNA, 22 nt, Human
ugaaguuauauauguugaaaau

SEQ ID NO: 339364 - RNA, 22 nt, Human
uagcucuucaaucacugucucc

SEQ ID NO: 339365 - RNA, 22 nt, Human
cagaggcaggaagaugggcagu

SEQ ID NO: 339366 - RNA, 22 nt, Human
uccauguguuuuccuguccaca

SEQ ID NO: 339367 - RNA, 22 nt, Human
aggcagguccccuggaaggcac

SEQ ID NO: 339368 - RNA, 22 nt, Human
gaucauuuacuuguucuggacu

SEQ ID NO: 339369 - RNA, 20 nt, Human
cccaggagugagcagcuuua

SEQ ID NO: 339370 - RNA, 22 nt, Human
ucaugcuuauugcauauuugga

SEQ ID NO: 339371 - RNA, 22 nt, Human
cuggccagcugacagcagggcu

SEQ ID NO: 339372 - RNA, 22 nt, Human
gaucuguuucauucacagucug

SEQ ID NO: 339373 - RNA, 20 nt, Human
uggaaguucuguugcauugg

SEQ ID NO: 339374 - RNA, 22 nt, Human
aauguauggauucaugucugug

SEQ ID NO: 339375 - RNA, 22 nt, Human
auacaacuuuacaugcaauucc

SEQ ID NO: 339376 - RNA, 22 nt, Human
acccaggagacagguugcagug

SEQ ID NO: 339377 - RNA, 22 nt, Human
acaacauucuuaaauacacuga

SEQ ID NO: 339378 - RNA, 22 nt, Human
agaggcggagguugcagugagc

SEQ ID NO: 339379 - RNA, 19 nt, Human
acauauguggauauacaug

SEQ ID NO: 339380 - RNA, 22 nt, Human
ggagguggcagggaacauaauu

SEQ ID NO: 339381 - RNA, 19 nt, Human
aauacaguguuauagaauu

SEQ ID NO: 339382 - RNA, 22 nt, Human
uccaggaggacugagggggcug

SEQ ID NO: 339383 - RNA, 22 nt, Human
gaggagcuugugagaagauguc

SEQ ID NO: 339384 - RNA, 22 nt, Human
uaauuauuugaagacauuagag

SEQ ID NO: 339385 - RNA, 22 nt, Human
acuggcaguagagggagcgcau

SEQ ID NO: 339386 - RNA, 22 nt, Human
uuagccaugcccuagaagagga

SEQ ID NO: 339387 - RNA, 22 nt, Human
augcagcugucagggagaacau

SEQ ID NO: 339388 - RNA, 22 nt, Human
uccucagacuucccuuugugua

SEQ ID NO: 339389 - RNA, 22 nt, Human
aaucauucuuauuucacagcaa

SEQ ID NO: 339390 - RNA, 22 nt, Human
uggcaucucaaacaggcagauu

SEQ ID NO: 339391 - RNA, 22 nt, Human
auuuggcaacauuaauugaauc

SEQ ID NO: 339392 - RNA, 22 nt, Human
agaggaggaagagcuuuaaaau

SEQ ID NO: 339393 - RNA, 22 nt, Human
uaucuuguaauagguccacuug

SEQ ID NO: 339394 - RNA, 22 nt, Human
aauaauuagugggacagagaac

SEQ ID NO: 339395 - RNA, 22 nt, Human
gcagaggagaugaagauacuuu

SEQ ID NO: 339396 - RNA, 22 nt, Human
cagagggaaaaggggaguaaua

SEQ ID NO: 339397 - RNA, 22 nt, Human
uuucccagagguaugaauaagu

SEQ ID NO: 339398 - RNA, 22 nt, Human
cugcugugcagacagacucucu

SEQ ID NO: 339399 - RNA, 22 nt, Human
uacuaucucuucuaacuucaga

SEQ ID NO: 339400 - RNA, 21 nt, Human
caauaaacugcacauugagac

SEQ ID NO: 339401 - RNA, 22 nt, Human
gccucugcccuccugggacugc

SEQ ID NO: 339402 - RNA, 22 nt, Human
cccagcaguaaccaguggaaau

SEQ ID NO: 339403 - RNA, 21 nt, Human
gggcagcucuguuuuauuuuc

SEQ ID NO: 339404 - RNA, 22 nt, Human
ugaggcagaaaauagcaguuca

SEQ ID NO: 339405 - RNA, 22 nt, Human
cagugguugguagauacuugag

SEQ ID NO: 339406 - RNA, 22 nt, Human
ucacaauacucacucaauggcu

SEQ ID NO: 339407 - RNA, 22 nt, Human
auauucuucuuguucagacuau

SEQ ID NO: 339408 - RNA, 22 nt, Human
cacacucauuagucauuucucu

SEQ ID NO: 339409 - RNA, 22 nt, Human
gagaggcagaggccugaaaccg

SEQ ID NO: 339410 - RNA, 22 nt, Human
ccucuucuagguuucagccugc

SEQ ID NO: 339411 - RNA, 22 nt, Human
auucugucuaagcuggcuacgu

SEQ ID NO: 339412 - RNA, 22 nt, Human
aaugauuuccccuacacagaag

SEQ ID NO: 339413 - RNA, 22 nt, Human
ugguaaauauguccauucucuu

SEQ ID NO: 339414 - RNA, 17 nt, Human
aagagaggcugagcugg

SEQ ID NO: 339415 - RNA, 22 nt, Human
cucucagacugaagggccugug

SEQ ID NO: 339416 - RNA, 23 nt, Human
accaggaguugucucaggaaaca

SEQ ID NO: 339417 - RNA, 23 nt, Human
cagaaaacccagagcucaguccc

SEQ ID NO: 339418 - RNA, 22 nt, Human
acgagagguccuuagaaucugu

SEQ ID NO: 339419 - RNA, 22 nt, Human
uggcagcagacaaaaggccauu

SEQ ID NO: 339420 - RNA, 22 nt, Human
uggagacugugcuaagggaguu

SEQ ID NO: 339421 - RNA, 22 nt, Human
aagcuggaacaucuugaggaag

SEQ ID NO: 339422 - RNA, 22 nt, Human
ucaggagacuuaugucacagug

SEQ ID NO: 339423 - RNA, 22 nt, Human
uggcaaggcugugggggcagag

SEQ ID NO: 339424 - RNA, 22 nt, Human
cuggcagucugccucuucacug

SEQ ID NO: 339425 - RNA, 22 nt, Human
agaggccaugcuagaggccugg

SEQ ID NO: 339426 - RNA, 22 nt, Human
uaucuguuccaggcacucagcu

SEQ ID NO: 339427 - RNA, 22 nt, Human
uuucaaauagaaucuuuccaaa

SEQ ID NO: 339428 - RNA, 22 nt, Human
cuuaaauuuucaucuacaagaa

SEQ ID NO: 339429 - RNA, 22 nt, Human
uucugucauuuagcauugucau

SEQ ID NO: 339430 - RNA, 22 nt, Human
cccaagagguggagguugcagu

SEQ ID NO: 339431 - RNA, 22 nt, Human
cuugauguauaaguugauaugu

SEQ ID NO: 339432 - RNA, 22 nt, Human
aaucuuucccuauuaaaugugg

SEQ ID NO: 339433 - RNA, 22 nt, Human
agcaccugucacaagcagaagg

SEQ ID NO: 339434 - RNA, 23 nt, Human
acuuuauugaccccaggucaguu

SEQ ID NO: 339435 - RNA, 22 nt, Human
agggcagcagcuccuccuagcu

SEQ ID NO: 339436 - RNA, 22 nt, Human
aauugucaaacacaaauaagag

SEQ ID NO: 339437 - RNA, 20 nt, Human
auccaugagagucuggauuc

SEQ ID NO: 339438 - RNA, 22 nt, Human
ugcuuggcuuucugagcuucug

SEQ ID NO: 339439 - RNA, 22 nt, Human
cagagccaggucuaggagucuc

SEQ ID NO: 339440 - RNA, 20 nt, Human
cccaggaguuugcucuuacu

SEQ ID NO: 339441 - RNA, 22 nt, Human
accaggagcauuuuuuauuagu

SEQ ID NO: 339442 - RNA, 23 nt, Human
acuauaaaguuguucugauuuac

SEQ ID NO: 339443 - RNA, 22 nt, Human
uuucagggagccuagaagagcu

SEQ ID NO: 339444 - RNA, 22 nt, Human
gcauuuccugugcuuggcauau

SEQ ID NO: 339445 - RNA, 22 nt, Human
uagauauggccgucuguuuuaa

SEQ ID NO: 339446 - RNA, 22 nt, Human
ggugaagguggaacgcagagca

SEQ ID NO: 339447 - RNA, 22 nt, Human
aaaggagacuucagaucuccuu

SEQ ID NO: 339448 - RNA, 23 nt, Human
acagaaaguucugcuggacagag

SEQ ID NO: 339449 - RNA, 22 nt, Human
aggcagcugaggucuggcgccc

SEQ ID NO: 339450 - RNA, 22 nt, Human
cugcuuccauaaauaaugugcu

SEQ ID NO: 339451 - RNA, 22 nt, Human
aaagcagagcagggcacuuaug

SEQ ID NO: 339452 - RNA, 22 nt, Human
aggcaguuucugggacagcaua

SEQ ID NO: 339453 - RNA, 22 nt, Human
cccaggaauuggaggcugcagu

SEQ ID NO: 339454 - RNA, 18 nt, Human
ugcuggguaacuguaugg

SEQ ID NO: 339455 - RNA, 22 nt, Human
acaagauagcuuagaagauuca

SEQ ID NO: 339456 - RNA, 22 nt, Human
gugguaauuuaauccuacacug

SEQ ID NO: 339457 - RNA, 22 nt, Human
ucauuuguugaacuuuagugcg

SEQ ID NO: 339458 - RNA, 22 nt, Human
ugaguaauaaacugucuugcuc

SEQ ID NO: 339459 - RNA, 22 nt, Human
ugaguuuuuucaacauaugaag

SEQ ID NO: 339460 - RNA, 21 nt, Human
augucaaaugcuuuauuuuau

SEQ ID NO: 339461 - RNA, 22 nt, Human
cugcugugugaccauggacagg

SEQ ID NO: 339462 - RNA, 21 nt, Human
aaugaaguggcuauuuugagg

SEQ ID NO: 339463 - RNA, 21 nt, Human
uacugagaccucacagugugc

SEQ ID NO: 339464 - RNA, 22 nt, Human
cccaggaggcagagauagcagu

SEQ ID NO: 339465 - RNA, 22 nt, Human
uacugcauaacuggcauguggg

SEQ ID NO: 339466 - RNA, 22 nt, Human
aucuuucaguuucauaccaauu

SEQ ID NO: 339467 - RNA, 22 nt, Human
ggguacuuaauauuuacggggu

SEQ ID NO: 339468 - RNA, 22 nt, Human
ucuggcaggcaaucggcucugg

SEQ ID NO: 339469 - RNA, 22 nt, Human
ugaggcagguaagcaaguuuug

SEQ ID NO: 339470 - RNA, 22 nt, Human
aguggaccagaagacugaagcu

SEQ ID NO: 339471 - RNA, 22 nt, Human
caguaaagcauguaugucuuca

SEQ ID NO: 339472 - RNA, 22 nt, Human
agcccagggaaccaggaagugg

SEQ ID NO: 339473 - RNA, 22 nt, Human
gcucaggacuggaggagcgggg

SEQ ID NO: 339474 - RNA, 22 nt, Human
uuucagcugguaaaggaguagc

SEQ ID NO: 339475 - RNA, 22 nt, Human
uucuucuuuaucucaguauccu

SEQ ID NO: 339476 - RNA, 20 nt, Human
uaacuuucuaugcuuucagc

SEQ ID NO: 339477 - RNA, 22 nt, Human
cuuugcaaacgauuaccacaug

SEQ ID NO: 339478 - RNA, 22 nt, Human
agaggggaaguaaugaaugaua

SEQ ID NO: 339479 - RNA, 22 nt, Human
uccacauccauugcuugacuuu

SEQ ID NO: 339480 - RNA, 22 nt, Human
guaaaauagaauaacguggcua

SEQ ID NO: 339481 - RNA, 18 nt, Human
acaaaugugucacaggaa

SEQ ID NO: 339482 - RNA, 22 nt, Human
gauuucuuuaugaaguacagaa

SEQ ID NO: 339483 - RNA, 22 nt, Human
auuaucuauguagaaugauuuu

SEQ ID NO: 339484 - RNA, 22 nt, Human
uuuacuuuugguaaggucauuu

SEQ ID NO: 339485 - RNA, 22 nt, Human
ucauuuguacuugugugcuugu

SEQ ID NO: 339486 - RNA, 22 nt, Human
uaagcugugggagauuggcaua

SEQ ID NO: 339487 - RNA, 20 nt, Human
agaaauauugaguucagagg

SEQ ID NO: 339488 - RNA, 22 nt, Human
caagaugugccuaaucagaccu

SEQ ID NO: 339489 - RNA, 22 nt, Human
gugcauuugugcaugcacaugu

SEQ ID NO: 339490 - RNA, 22 nt, Human
gggcagcugucuugguucucaa

SEQ ID NO: 339491 - RNA, 22 nt, Human
gggcagcucggaagugggaaag

SEQ ID NO: 339492 - RNA, 22 nt, Human
gggagacacgcugcaggcauaa

SEQ ID NO: 339493 - RNA, 22 nt, Human
uugagaagaauguguugaguuu

SEQ ID NO: 339494 - RNA, 22 nt, Human
gcggagggcgagcccgcggagc

SEQ ID NO: 339495 - RNA, 22 nt, Human
guccucuguuagaaaugugcuu

SEQ ID NO: 339496 - RNA, 22 nt, Human
uauacaauggcugaaucaucca

SEQ ID NO: 339497 - RNA, 22 nt, Human
uggaaggaagccaaggaagguu

SEQ ID NO: 339498 - RNA, 22 nt, Human
cuucagagugcagaagauuggg

SEQ ID NO: 339499 - RNA, 22 nt, Human
cccaggaggcagaaguugcagu

SEQ ID NO: 339500 - RNA, 22 nt, Human
ucauuuuucacacagggucacc

SEQ ID NO: 339501 - RNA, 22 nt, Human
aaaggccacacagagcagggag

SEQ ID NO: 339502 - RNA, 22 nt, Human
guuauauauaguauuucucuga

SEQ ID NO: 339503 - RNA, 22 nt, Human
uuucauggcuaggacuagagug

SEQ ID NO: 339504 - RNA, 22 nt, Human
ucucaguguguuuucucucaga

SEQ ID NO: 339505 - RNA, 22 nt, Human
cucauaaugugacuguauuuga

SEQ ID NO: 339506 - RNA, 22 nt, Human
aggcagcuagagagugaaacug

SEQ ID NO: 339507 - RNA, 22 nt, Human
agacaaauggaguaugagcaac

SEQ ID NO: 339508 - RNA, 22 nt, Human
uugcauuuaaguagauguuaca

SEQ ID NO: 339509 - RNA, 21 nt, Human
ucucugguuggaguugugcca

SEQ ID NO: 339510 - RNA, 23 nt, Human
gcagaggagcaagcuggacacca

SEQ ID NO: 339511 - RNA, 22 nt, Human
aggcagcuuuaacugguaguag

SEQ ID NO: 339512 - RNA, 22 nt, Human
uuugaaaggugucgagaugugu

SEQ ID NO: 339513 - RNA, 22 nt, Human
cccaggagguggagguugcagc

SEQ ID NO: 339514 - RNA, 22 nt, Human
uacaacauuguguugcuucaua

SEQ ID NO: 339515 - RNA, 22 nt, Human
uuucaugaggggcaaaaucuca

SEQ ID NO: 339516 - RNA, 22 nt, Human
auucugucuuuuuauacaucua

SEQ ID NO: 339517 - RNA, 20 nt, Human
ucacuaguaaccaucugcuu

SEQ ID NO: 339518 - RNA, 22 nt, Human
gauggcagucaaccaggugagg

SEQ ID NO: 339519 - RNA, 22 nt, Human
aaaguuagacagcaucauuucu

SEQ ID NO: 339520 - RNA, 22 nt, Human
aaaaguauuuauggcuauguaa

SEQ ID NO: 339521 - RNA, 22 nt, Human
ggagcacuauaauagagauuuu

SEQ ID NO: 339522 - RNA, 18 nt, Human
uuugcaaaggaaguaugg

SEQ ID NO: 339523 - RNA, 22 nt, Human
cucugaaagaguuuaguauuau

SEQ ID NO: 339524 - RNA, 19 nt, Human
ggcaggcuggauagagagg

SEQ ID NO: 339525 - RNA, 20 nt, Human
aauuuacucacagaaugaau

SEQ ID NO: 339526 - RNA, 22 nt, Human
ggcugaaggaugaaagcugcag

SEQ ID NO: 339527 - RNA, 22 nt, Human
caaggccacguucugcaugcgg

SEQ ID NO: 339528 - RNA, 22 nt, Human
ucugcuguaaagaauuucugcc

SEQ ID NO: 339529 - RNA, 22 nt, Human
ucugaaggugcuagagaaagcu

SEQ ID NO: 339530 - RNA, 20 nt, Human
gagauggacagaugaagggg

SEQ ID NO: 339531 - RNA, 23 nt, Human
acagacaacacugaugagagaaa

SEQ ID NO: 339532 - RNA, 22 nt, Human
uccaugaguuugaggaaaagag

SEQ ID NO: 339533 - RNA, 22 nt, Human
ggagaggguguggaaaguuauc

SEQ ID NO: 339534 - RNA, 22 nt, Human
ucaggauguccaaaauccagcc

SEQ ID NO: 339535 - RNA, 22 nt, Human
gaggucagucagaccaggguuu

SEQ ID NO: 339536 - RNA, 22 nt, Human
ucuuccaagguugcacacuauc

SEQ ID NO: 339537 - RNA, 22 nt, Human
cccaggaacagggcucagaccc

SEQ ID NO: 339538 - RNA, 22 nt, Human
uuuaaauucugucugccgcuua

SEQ ID NO: 339539 - RNA, 22 nt, Human
uucucugaucuugcuagacuga

SEQ ID NO: 339540 - RNA, 22 nt, Human
aucaggauggguuuggcuuagg

SEQ ID NO: 339541 - RNA, 22 nt, Human
cccaggagguggagcuugcagu

SEQ ID NO: 339542 - RNA, 23 nt, Human
ucucaggacacacaugucuauca

SEQ ID NO: 339543 - RNA, 22 nt, Human
cagcauuuggaggagaggcuuu

SEQ ID NO: 339544 - RNA, 22 nt, Human
agaggcggagcuugcagugagc

SEQ ID NO: 339545 - RNA, 22 nt, Human
gcaggggcuaaggacacagaga

SEQ ID NO: 339546 - RNA, 22 nt, Human
cccaggaggugugcccaacucg

SEQ ID NO: 339547 - RNA, 23 nt, Human
aggcagcuggguagcaucuuucu

SEQ ID NO: 339548 - RNA, 19 nt, Human
uucauucucuuauuguugu

SEQ ID NO: 339549 - RNA, 22 nt, Human
auacuuucugaccaauuaauug

SEQ ID NO: 339550 - RNA, 22 nt, Human
ucccaggaggugcuuccuagga

SEQ ID NO: 339551 - RNA, 22 nt, Human
uaauaucuacuucauagaguuu

SEQ ID NO: 339552 - RNA, 22 nt, Human
gcaaagcauucuguggagucua

SEQ ID NO: 339553 - RNA, 22 nt, Human
caggagaaauguggcugcuacc

SEQ ID NO: 339554 - RNA, 22 nt, Human
augaaggcuguguagauggaug

SEQ ID NO: 339555 - RNA, 22 nt, Human
uaugacuuauuucaucaguucu

SEQ ID NO: 339556 - RNA, 22 nt, Human
cucagugugaaugcucaguaaa

SEQ ID NO: 339557 - RNA, 19 nt, Human
guugaaaguaggugagggu

SEQ ID NO: 339558 - RNA, 22 nt, Human
ugaggcagauauuuauuggguu

SEQ ID NO: 339559 - RNA, 23 nt, Human
uggagcugacagucagagggagg

SEQ ID NO: 339560 - RNA, 22 nt, Human
cuggccagaguuggagggugug

SEQ ID NO: 339561 - RNA, 22 nt, Human
gaggcauggccugaggcuagga

SEQ ID NO: 339562 - RNA, 22 nt, Human
aauaguauuuauuuggaaaaag

SEQ ID NO: 339563 - RNA, 22 nt, Human
ucaucugucccaggcuuuuuuc

SEQ ID NO: 339564 - RNA, 17 nt, Human
ccaggagagaugcuugu

SEQ ID NO: 339565 - RNA, 22 nt, Human
ugcuagaagauagcuagaagau

SEQ ID NO: 339566 - RNA, 22 nt, Human
gagcagcugagcuggaaugaga

SEQ ID NO: 339567 - RNA, 22 nt, Human
cauaauuugauaugcuugaugg

SEQ ID NO: 339568 - RNA, 22 nt, Human
acuuugcagggcuugauaucca

SEQ ID NO: 339569 - RNA, 22 nt, Human
ccaggagaugauguuggggauu

SEQ ID NO: 339570 - RNA, 22 nt, Human
uuaacauuguccuuagcagauu

SEQ ID NO: 339571 - RNA, 22 nt, Human
caguuucuauggcugggcucug

SEQ ID NO: 339572 - RNA, 22 nt, Human
guaggcagugguuggaagagaa

SEQ ID NO: 339573 - RNA, 23 nt, Human
agaggcaggaguggcuugcccgg

SEQ ID NO: 339574 - RNA, 22 nt, Human
uggcagcugaauggcuggaugg

SEQ ID NO: 339575 - RNA, 22 nt, Human
uauggaaacuaauucauuuuuc

SEQ ID NO: 339576 - RNA, 22 nt, Human
caggcagcugcgacaagagagc

SEQ ID NO: 339577 - RNA, 22 nt, Human
uuagccauguugaagauuuaga

SEQ ID NO: 339578 - RNA, 22 nt, Human
aucaggaugacaacugcugggu

SEQ ID NO: 339579 - RNA, 22 nt, Human
uuuccagguauuaauacuguau

SEQ ID NO: 339580 - RNA, 22 nt, Human
guucuucagcauuagaagucau

SEQ ID NO: 339581 - RNA, 22 nt, Human
auucuuauuuaaauagagucug

SEQ ID NO: 339582 - RNA, 23 nt, Human
auguauuuaaauuucagugauga

SEQ ID NO: 339583 - RNA, 22 nt, Human
gaggcacugcaguacagugacu

SEQ ID NO: 339584 - RNA, 22 nt, Human
augucaaacacaacaccagugg

SEQ ID NO: 339585 - RNA, 22 nt, Human
aggcacaguggcucacaccugu

SEQ ID NO: 339586 - RNA, 22 nt, Human
uuauuauagauuaugcaagauu

SEQ ID NO: 339587 - RNA, 22 nt, Human
aaagcagacugauuugcaucac

SEQ ID NO: 339588 - RNA, 22 nt, Human
gugguuuucuccaacccagaac

SEQ ID NO: 339589 - RNA, 22 nt, Human
aggcacaguuucauccccgggc

SEQ ID NO: 339590 - RNA, 22 nt, Human
uguuugaauuuugcuaacgugu

SEQ ID NO: 339591 - RNA, 22 nt, Human
gcccaggaguucaagucuagug

SEQ ID NO: 339592 - RNA, 22 nt, Human
caggcgagugaacagacucuca

SEQ ID NO: 339593 - RNA, 22 nt, Human
auucauaacggcaaaugucacc

SEQ ID NO: 339594 - RNA, 22 nt, Human
aguaugaaucucuuuauucugc

SEQ ID NO: 339595 - RNA, 21 nt, Human
cuugaaagguagagucuacag

SEQ ID NO: 339596 - RNA, 22 nt, Human
agagggcagggcgguaaguccu

SEQ ID NO: 339597 - RNA, 22 nt, Human
ugaggcagggaguuuaauuguc

SEQ ID NO: 339598 - RNA, 22 nt, Human
cuaauacacccuauugcuuguu

SEQ ID NO: 339599 - RNA, 19 nt, Human
aguggcagaucuggaagua

SEQ ID NO: 339600 - RNA, 22 nt, Human
agaaaugaauauguagugguua

SEQ ID NO: 339601 - RNA, 22 nt, Human
uuuccuaggagauugaucacau

SEQ ID NO: 339602 - RNA, 22 nt, Human
ucugggaacacacgucacuuca

SEQ ID NO: 339603 - RNA, 22 nt, Human
gcccaggauggcuggaggugcu

SEQ ID NO: 339604 - RNA, 20 nt, Human
cccaggagcugugccccauc

SEQ ID NO: 339605 - RNA, 23 nt, Human
cccagggacacgaugacaccucc

SEQ ID NO: 339606 - RNA, 22 nt, Human
cuguauuucccacauucucuau

SEQ ID NO: 339607 - RNA, 22 nt, Human
ucacaaauagcuauauuaagga

SEQ ID NO: 339608 - RNA, 22 nt, Human
aaggagagagcuuugcuggaac

SEQ ID NO: 339609 - RNA, 22 nt, Human
ccaugagcuucaacugacacag

SEQ ID NO: 339610 - RNA, 22 nt, Human
agagagggcauagaaaaaggga

SEQ ID NO: 339611 - RNA, 22 nt, Human
uguuccaauaaggaguugaaau

SEQ ID NO: 339612 - RNA, 22 nt, Human
uaugacauuggccaaguucugu

SEQ ID NO: 339613 - RNA, 22 nt, Human
ugugugaaggaauauauacuca

SEQ ID NO: 339614 - RNA, 20 nt, Human
caggagggacauuucagcau

SEQ ID NO: 339615 - RNA, 22 nt, Human
aaggcagcuuuaaaaaagaugc

SEQ ID NO: 339616 - RNA, 17 nt, Human
agcugaccagauggacu

SEQ ID NO: 339617 - RNA, 22 nt, Human
ucuccuccuuuuuucaacauag

SEQ ID NO: 339618 - RNA, 18 nt, Human
aagaggaggagcagguug

SEQ ID NO: 339619 - RNA, 23 nt, Human
ugcaugugaauucauacuuguuu

SEQ ID NO: 339620 - RNA, 22 nt, Human
ccaggagacuguacugauauuu

SEQ ID NO: 339621 - RNA, 22 nt, Human
cauuuguauagugcuuagacca

SEQ ID NO: 339622 - RNA, 22 nt, Human
auuaaauuggaucugcauaguu

SEQ ID NO: 339623 - RNA, 22 nt, Human
acauuuuuuagagucccacauu

SEQ ID NO: 339624 - RNA, 22 nt, Human
gucuucuuuucagucugcuugu

SEQ ID NO: 339625 - RNA, 18 nt, Human
uaggagagaauuuauuua

SEQ ID NO: 339626 - RNA, 22 nt, Human
aagauggaguaguguaaugguu

SEQ ID NO: 339627 - RNA, 17 nt, Human
uccaggagaggcaaugg

SEQ ID NO: 339628 - RNA, 22 nt, Human
aggagaggguggcauuaaguuu

SEQ ID NO: 339629 - RNA, 22 nt, Human
gcagcugcaauaggcaucaagc

SEQ ID NO: 339630 - RNA, 21 nt, Human
augugaaauaucaucagagca

SEQ ID NO: 339631 - RNA, 22 nt, Human
caguuucuuggaugccaauuuc

SEQ ID NO: 339632 - RNA, 22 nt, Human
ucuucauuccguagauauuuau

SEQ ID NO: 339633 - RNA, 22 nt, Human
gggcaguugauggaggucugga

SEQ ID NO: 339634 - RNA, 22 nt, Human
acaugcauacacguacauaccu

SEQ ID NO: 339635 - RNA, 22 nt, Human
cuucuucauguauugauagucu

SEQ ID NO: 339636 - RNA, 22 nt, Human
acagugcuaaacacuucuugaa

SEQ ID NO: 339637 - RNA, 22 nt, Human
cuugaaagcacuccuuugacug

SEQ ID NO: 339638 - RNA, 22 nt, Human
aaauauguaagauuagcacuag

SEQ ID NO: 339639 - RNA, 22 nt, Human
uuaaauuuuagaaacagacucu

SEQ ID NO: 339640 - RNA, 22 nt, Human
uacuuacacagcuguagaaggu

SEQ ID NO: 339641 - RNA, 19 nt, Human
uucccaggaaaggggugca

SEQ ID NO: 339642 - RNA, 22 nt, Human
uugcauuuuuagaugcuucugu

SEQ ID NO: 339643 - RNA, 22 nt, Human
gaggagaggccaucguuguuau

SEQ ID NO: 339644 - RNA, 22 nt, Human
aaggcagcccuggcucagccug

SEQ ID NO: 339645 - RNA, 22 nt, Human
aguccaugguucugacucaucu

SEQ ID NO: 339646 - RNA, 20 nt, Human
cugcuguguuauuguagaac

SEQ ID NO: 339647 - RNA, 22 nt, Human
acccaggaggcaagguugcagu

SEQ ID NO: 339648 - RNA, 22 nt, Human
auuggcaggaaccgaggagggg

SEQ ID NO: 339649 - RNA, 22 nt, Human
agaccaagaaaggaugaggauc

SEQ ID NO: 339650 - RNA, 22 nt, Human
cuggcaguguccagcucgugau

SEQ ID NO: 339651 - RNA, 22 nt, Human
aagggcagagggaaucccacau

SEQ ID NO: 339652 - RNA, 22 nt, Human
guugaaaguggagaaccugguu

SEQ ID NO: 339653 - RNA, 22 nt, Human
gaaacuguauguaguuuuuggg

SEQ ID NO: 339654 - RNA, 22 nt, Human
ugauugaagaggugaggaaguu

SEQ ID NO: 339655 - RNA, 22 nt, Human
ggcagcuuccugagccagcagc

SEQ ID NO: 339656 - RNA, 22 nt, Human
gggaagcaggugcagcucgccu

SEQ ID NO: 339657 - RNA, 22 nt, Human
caaggccaguuucuccuaguca

SEQ ID NO: 339658 - RNA, 22 nt, Human
uuggcagugaugcagcuuguuc

SEQ ID NO: 339659 - RNA, 22 nt, Human
auguaugauauuuccaguauca

SEQ ID NO: 339660 - RNA, 22 nt, Human
aaggagagguuguccguguugu

SEQ ID NO: 339661 - RNA, 22 nt, Human
uuucacuagaacguucuuguuu

SEQ ID NO: 339662 - RNA, 22 nt, Human
agggcagcagcggcccaggccu

SEQ ID NO: 339663 - RNA, 22 nt, Human
uguuuauuacaguucuuggaau

SEQ ID NO: 339664 - RNA, 22 nt, Human
aaauaguuacuucugcugucuu

SEQ ID NO: 339665 - RNA, 22 nt, Human
cuggccaggcuugggacagaca

SEQ ID NO: 339666 - RNA, 22 nt, Human
agggagcugagcugugagcagc

SEQ ID NO: 339667 - RNA, 22 nt, Human
cccaggaguuugaguucagcau

SEQ ID NO: 339668 - RNA, 22 nt, Human
aucacugucgucaucugagauu

SEQ ID NO: 339669 - RNA, 22 nt, Human
cagaggcaaaagagguggaggu

SEQ ID NO: 339670 - RNA, 22 nt, Human
uuauuucauguaaaauuuaugu

SEQ ID NO: 339671 - RNA, 22 nt, Human
aauacaguaauuuugaugaguu

SEQ ID NO: 339672 - RNA, 22 nt, Human
guaggcagucucucaggugauc

SEQ ID NO: 339673 - RNA, 22 nt, Human
cugcaucaguggauaugauggu

SEQ ID NO: 339674 - RNA, 22 nt, Human
ggauggcagucugcaugagaaa

SEQ ID NO: 339675 - RNA, 22 nt, Human
augcugugauuguagaaauauu

SEQ ID NO: 339676 - RNA, 22 nt, Human
uaacaauaguguuugcuaguca

SEQ ID NO: 339677 - RNA, 22 nt, Human
uucucuuugacauuauucaggu

SEQ ID NO: 339678 - RNA, 22 nt, Human
gagagucuagugcaccuaguuu

SEQ ID NO: 339679 - RNA, 21 nt, Human
agggagcuuuagguagaaguu

SEQ ID NO: 339680 - RNA, 22 nt, Human
uggcagcucccagagcuuccaa

SEQ ID NO: 339681 - RNA, 19 nt, Human
uuugaaagaguuuuauugg

SEQ ID NO: 339682 - RNA, 23 nt, Human
cagggaggagauacuguguaucu

SEQ ID NO: 339683 - RNA, 22 nt, Human
agaggggagagcuaagcaauuc

SEQ ID NO: 339684 - RNA, 18 nt, Human
aaacuggcuuggccugug

SEQ ID NO: 339685 - RNA, 22 nt, Human
ucagugaucuaaggguauggcc

SEQ ID NO: 339686 - RNA, 22 nt, Human
ccaggagagcagaagcccaggc

SEQ ID NO: 339687 - RNA, 22 nt, Human
ucucucuuuuuaaucauguaau

SEQ ID NO: 339688 - RNA, 22 nt, Human
gucaggaugagggaugaggagu

SEQ ID NO: 339689 - RNA, 22 nt, Human
uaaggccaauuacauauguuca

SEQ ID NO: 339690 - RNA, 22 nt, Human
uacacacaugcauuugccuuau

SEQ ID NO: 339691 - RNA, 22 nt, Human
uaaaguuuggcagacaauaaca

SEQ ID NO: 339692 - RNA, 22 nt, Human
aaggcagccauagcaccaucca

SEQ ID NO: 339693 - RNA, 22 nt, Human
aaaguguugauaugugacaucc

SEQ ID NO: 339694 - RNA, 22 nt, Human
aaaguucuuucucuuauuuggu

SEQ ID NO: 339695 - RNA, 22 nt, Human
aggagggaccuaggaauauugc

SEQ ID NO: 339696 - RNA, 22 nt, Human
ugaaucauggauaaauagcuua

SEQ ID NO: 339697 - RNA, 19 nt, Human
gugcuuuuuaagagcucag

SEQ ID NO: 339698 - RNA, 22 nt, Human
aauaacuucauguaacauuuaa

SEQ ID NO: 339699 - RNA, 22 nt, Human
aggcugcucaguagauggagcu

SEQ ID NO: 339700 - RNA, 22 nt, Human
uagggcaggggaggaaucugaa

SEQ ID NO: 339701 - RNA, 20 nt, Human
ugcguguguauuuauuuucu

SEQ ID NO: 339702 - RNA, 22 nt, Human
agcccaggugagggguucgaaa

SEQ ID NO: 339703 - RNA, 22 nt, Human
acauuuagcuguacaaucuaug

SEQ ID NO: 339704 - RNA, 22 nt, Human
cagaggauucccuagugaccug

SEQ ID NO: 339705 - RNA, 22 nt, Human
gggcacagaagucuaagacauc

SEQ ID NO: 339706 - RNA, 22 nt, Human
ccucuucugcuucaggagcacu

SEQ ID NO: 339707 - RNA, 22 nt, Human
ucacacagguuugcaaugauuu

SEQ ID NO: 339708 - RNA, 22 nt, Human
accaggagucuagccuagucaa

SEQ ID NO: 339709 - RNA, 22 nt, Human
uuaacacagggggagacaaagu

SEQ ID NO: 339710 - RNA, 22 nt, Human
agaggacagacggaaagugcca

SEQ ID NO: 339711 - RNA, 22 nt, Human
aauaugcauuaacuguguacau

SEQ ID NO: 339712 - RNA, 22 nt, Human
uggcagcuccuggggccagcac

SEQ ID NO: 339713 - RNA, 22 nt, Human
gucuucuuguuuugaaggaaau

SEQ ID NO: 339714 - RNA, 22 nt, Human
ucacugcugcugccaugaugga

SEQ ID NO: 339715 - RNA, 22 nt, Human
gcuuggcauugaccauuaucau

SEQ ID NO: 339716 - RNA, 22 nt, Human
uuucaaacauaucuucauuacu

SEQ ID NO: 339717 - RNA, 22 nt, Human
ucuuuguaacugucuauugaga

SEQ ID NO: 339718 - RNA, 22 nt, Human
ucuuugcagaauuuaacuuugc

SEQ ID NO: 339719 - RNA, 22 nt, Human
uuucuucauagaccuugucuug

SEQ ID NO: 339720 - RNA, 22 nt, Human
aaagcagauucugaugcaguag

SEQ ID NO: 339721 - RNA, 22 nt, Human
uuguuuuaucuuucuacagacu

SEQ ID NO: 339722 - RNA, 22 nt, Human
uauuuccauguuagaacuaagu

SEQ ID NO: 339723 - RNA, 19 nt, Human
ggcagcuggacgcuguuca

SEQ ID NO: 339724 - RNA, 22 nt, Human
uucuucaaacaaaaguggcaug

SEQ ID NO: 339725 - RNA, 22 nt, Human
uuuguuuacucauucauugaug

SEQ ID NO: 339726 - RNA, 22 nt, Human
auguagaauuccuucuacuuug

SEQ ID NO: 339727 - RNA, 22 nt, Human
gcaagcugaugugauagugaaa

SEQ ID NO: 339728 - RNA, 17 nt, Human
aggcaggcagagcggga

SEQ ID NO: 339729 - RNA, 21 nt, Human
cccaggagaagaaaagaugca

SEQ ID NO: 339730 - RNA, 22 nt, Human
cuucucaguugcaagugucaga

SEQ ID NO: 339731 - RNA, 22 nt, Human
uucacagaugccugaugugugg

SEQ ID NO: 339732 - RNA, 22 nt, Human
uucaacuauuaugaauaaaauu

SEQ ID NO: 339733 - RNA, 22 nt, Human
cccaggagaccugugaaaggac

SEQ ID NO: 339734 - RNA, 23 nt, Human
caguggagacucaugcuuccuua

SEQ ID NO: 339735 - RNA, 22 nt, Human
uccaggaguuugaccugugggc

SEQ ID NO: 339736 - RNA, 22 nt, Human
uugcaggaaacugagugugagc

SEQ ID NO: 339737 - RNA, 22 nt, Human
cugccaggcagcagagggagaa

SEQ ID NO: 339738 - RNA, 22 nt, Human
uucuucuuaauguccugggaac

SEQ ID NO: 339739 - RNA, 22 nt, Human
uuuguagaggguaauugacaga

SEQ ID NO: 339740 - RNA, 22 nt, Human
aggcaggcucaggcccaugcuu

SEQ ID NO: 339741 - RNA, 22 nt, Human
uccaugagacagauacuguaag

SEQ ID NO: 339742 - RNA, 22 nt, Human
uggaggaaguugcuggaaguca

SEQ ID NO: 339743 - RNA, 21 nt, Human
uaacacauuuugguacuuugg

SEQ ID NO: 339744 - RNA, 22 nt, Human
auguucuguuuuguaauucaua

SEQ ID NO: 339745 - RNA, 22 nt, Human
cucucuguuaugcuuucaugaa

SEQ ID NO: 339746 - RNA, 19 nt, Human
uuacuuggcaaagucaguc

SEQ ID NO: 339747 - RNA, 22 nt, Human
gagggugggccagauaugaggg

SEQ ID NO: 339748 - RNA, 22 nt, Human
caagauggagaagcagcaaggg

SEQ ID NO: 339749 - RNA, 22 nt, Human
ugaggggagcuagcaugccuug

SEQ ID NO: 339750 - RNA, 22 nt, Human
guaguucugcagugucaccuga

SEQ ID NO: 339751 - RNA, 22 nt, Human
gucaggauguuuauucuccagu

SEQ ID NO: 339752 - RNA, 22 nt, Human
gcccaggauaaugcugucccug

SEQ ID NO: 339753 - RNA, 22 nt, Human
uagaauucauguuacuguuagc

SEQ ID NO: 339754 - RNA, 22 nt, Human
cuacccaggcuggagugcagua

SEQ ID NO: 339755 - RNA, 22 nt, Human
gccaggaggcugcuguguaggc

SEQ ID NO: 339756 - RNA, 22 nt, Human
auauacuuggagacuaucauug

SEQ ID NO: 339757 - RNA, 23 nt, Human
uguaugaauaugccacaguuuaa

SEQ ID NO: 339758 - RNA, 22 nt, Human
auuugcuugugcuaugaaaguu

SEQ ID NO: 339759 - RNA, 22 nt, Human
uccaugagcuagcuuuccaaag

SEQ ID NO: 339760 - RNA, 22 nt, Human
cuugcugucuugcauuuagagc

SEQ ID NO: 339761 - RNA, 22 nt, Human
caaauaguuuuucauguauuau

SEQ ID NO: 339762 - RNA, 22 nt, Human
caggagggcccgagacucuucc

SEQ ID NO: 339763 - RNA, 22 nt, Human
cuucagaaugggacuguguuug

SEQ ID NO: 339764 - RNA, 22 nt, Human
gagagguccauuccccugucag

SEQ ID NO: 339765 - RNA, 19 nt, Human
gaggucagcaagaaguauu

SEQ ID NO: 339766 - RNA, 22 nt, Human
acagaauugaaaguauaaucug

SEQ ID NO: 339767 - RNA, 22 nt, Human
agugagggaugaagaacugcgg

SEQ ID NO: 339768 - RNA, 22 nt, Human
aggcagauuuaggagaaaagaa

SEQ ID NO: 339769 - RNA, 22 nt, Human
cucuucuugucucugguuagaa

SEQ ID NO: 339770 - RNA, 22 nt, Human
uguuagaaauuauuaguaauau

SEQ ID NO: 339771 - RNA, 22 nt, Human
ucccuucacagaugcgauguuu

SEQ ID NO: 339772 - RNA, 22 nt, Human
ucauuucuauugcuacugucug

SEQ ID NO: 339773 - RNA, 22 nt, Human
guagggagcccagagcccagug

SEQ ID NO: 339774 - RNA, 22 nt, Human
ucugcaucauuuuucagagccg

SEQ ID NO: 339775 - RNA, 22 nt, Human
aaggccagccugagagcuaaca

SEQ ID NO: 339776 - RNA, 22 nt, Human
gagaaaugcaugcaugucauca

SEQ ID NO: 339777 - RNA, 22 nt, Human
cuggcugugcugcaggcuuugg

SEQ ID NO: 339778 - RNA, 22 nt, Human
agugugucugaucacuugugag

SEQ ID NO: 339779 - RNA, 22 nt, Human
uucugucagcugcuuugucuca

SEQ ID NO: 339780 - RNA, 22 nt, Human
agcauucauugcuagaauguaa

SEQ ID NO: 339781 - RNA, 19 nt, Human
uggcaucuguaaaauggug

SEQ ID NO: 339782 - RNA, 22 nt, Human
aaucacuuuucucuaauguagc

SEQ ID NO: 339783 - RNA, 22 nt, Human
ugcccagggauaagccuagaga

SEQ ID NO: 339784 - RNA, 22 nt, Human
augaacuuauuucugaacuuuu

SEQ ID NO: 339785 - RNA, 22 nt, Human
uggcagcugcguuguguuucug

SEQ ID NO: 339786 - RNA, 22 nt, Human
gaaguucuuagucucauuugca

SEQ ID NO: 339787 - RNA, 22 nt, Human
cuaucauuuuacaugguuggug

SEQ ID NO: 339788 - RNA, 22 nt, Human
uccaugagcuagggauucauca

SEQ ID NO: 339789 - RNA, 22 nt, Human
gaggaggccaguggaaggaagc

SEQ ID NO: 339790 - RNA, 22 nt, Human
uaaauuauguuccauguccuuu

SEQ ID NO: 339791 - RNA, 22 nt, Human
aguuagaaaguaaaucauuuga

SEQ ID NO: 339792 - RNA, 22 nt, Human
gaggggcagagguagagaacaa

SEQ ID NO: 339793 - RNA, 22 nt, Human
uuagaacuuaagaauacugucu

SEQ ID NO: 339794 - RNA, 22 nt, Human
uugcugaaguuaaugcuugcaa

SEQ ID NO: 339795 - RNA, 21 nt, Human
gacaaagugaagcaggcagga

SEQ ID NO: 339796 - RNA, 22 nt, Human
aucaggaucagggcuagcagag

SEQ ID NO: 339797 - RNA, 21 nt, Human
auuucagagcacacaaguaaa

SEQ ID NO: 339798 - RNA, 22 nt, Human
augaggcaucugcagucacuag

SEQ ID NO: 339799 - RNA, 22 nt, Human
uucuuuuccuacacagcgauuu

SEQ ID NO: 339800 - RNA, 22 nt, Human
cagcauuuggugaucaucuuaa

SEQ ID NO: 339801 - RNA, 22 nt, Human
ggaagagggaaccacgacugua

SEQ ID NO: 339802 - RNA, 22 nt, Human
aggagggagcuuaagccaggca

SEQ ID NO: 339803 - RNA, 22 nt, Human
ugagaauuuuuugucaugcauu

SEQ ID NO: 339804 - RNA, 22 nt, Human
acacaaugcauauuuuuccaga

SEQ ID NO: 339805 - RNA, 22 nt, Human
uuauuuugguaaauguuugccu

SEQ ID NO: 339806 - RNA, 20 nt, Human
aggcagcuggccaggcaggu

SEQ ID NO: 339807 - RNA, 22 nt, Human
uuauucuuuaaacauauauguu

SEQ ID NO: 339808 - RNA, 22 nt, Human
ccuccucugggaagauucagag

SEQ ID NO: 339809 - RNA, 22 nt, Human
uaugaacuagcugauuuaguuu

SEQ ID NO: 339810 - RNA, 22 nt, Human
cccaggaggcagagcuugcagu

SEQ ID NO: 339811 - RNA, 22 nt, Human
uuucacauuuaggcgugaauug

SEQ ID NO: 339812 - RNA, 19 nt, Human
uaucuguuuccugcuuguc

SEQ ID NO: 339813 - RNA, 22 nt, Human
gaggcagcaucuauggugggaa

SEQ ID NO: 339814 - RNA, 22 nt, Human
cgaggcagacaaaaguuggaag

SEQ ID NO: 339815 - RNA, 22 nt, Human
auuaaauuuucacuaggcuccc

SEQ ID NO: 339816 - RNA, 22 nt, Human
ucugcuguucauucuuuuagcu

SEQ ID NO: 339817 - RNA, 22 nt, Human
caaggccaguucaccaagggca

SEQ ID NO: 339818 - RNA, 22 nt, Human
ucagucuuugcuuaugacaaua

SEQ ID NO: 339819 - RNA, 22 nt, Human
agcuucuuggcucagcacuugg

SEQ ID NO: 339820 - RNA, 22 nt, Human
uuaucacuuaugagcuuuuugc

SEQ ID NO: 339821 - RNA, 22 nt, Human
ccaggaaaauaccaagcuuuaa

SEQ ID NO: 339822 - RNA, 22 nt, Human
uucugggagagaaagggccuug

SEQ ID NO: 339823 - RNA, 22 nt, Human
gggagggguugcauguuugagu

SEQ ID NO: 339824 - RNA, 22 nt, Human
uacaaaguaauguauaauaucg

SEQ ID NO: 339825 - RNA, 22 nt, Human
auguaaacaagguuauugucca

SEQ ID NO: 339826 - RNA, 22 nt, Human
auucuucaguauguguggauug

SEQ ID NO: 339827 - RNA, 21 nt, Human
uuucuuaggcucuaaaaugac

SEQ ID NO: 339828 - RNA, 22 nt, Human
gggacgggcaguccaagggguc

SEQ ID NO: 339829 - RNA, 22 nt, Human
agcugcccugggcuggagaugg

SEQ ID NO: 339830 - RNA, 22 nt, Human
uucaggauggcggauguugggg

SEQ ID NO: 339831 - RNA, 19 nt, Human
ucccaggaaccuuuuauuu

SEQ ID NO: 339832 - RNA, 22 nt, Human
gcugcccauuccacuggauggu

SEQ ID NO: 339833 - RNA, 19 nt, Human
uggcaggcccaggauggac

SEQ ID NO: 339834 - RNA, 22 nt, Human
ucagagaguuagugucuuagcu

SEQ ID NO: 339835 - RNA, 22 nt, Human
guggaauguccuugaucauaag

SEQ ID NO: 339836 - RNA, 22 nt, Human
guaggcagauaggagugcagcc

SEQ ID NO: 339837 - RNA, 22 nt, Human
cagaauggcuuuuauggcucag

SEQ ID NO: 339838 - RNA, 22 nt, Human
ggcuuggaccagucacaguggu

SEQ ID NO: 339839 - RNA, 22 nt, Human
cugcugugagcacuccagccug

SEQ ID NO: 339840 - RNA, 22 nt, Human
agcagcauuaugauauaucuua

SEQ ID NO: 339841 - RNA, 22 nt, Human
ugaggcaguucuuacuuguauu

SEQ ID NO: 339842 - RNA, 22 nt, Human
cauugcuguuaauugucucuag

SEQ ID NO: 339843 - RNA, 22 nt, Human
auucuucaucagagaugcacua

SEQ ID NO: 339844 - RNA, 22 nt, Human
ugaaagggguugaguuacagcu

SEQ ID NO: 339845 - RNA, 22 nt, Human
cuacagacccaccuuggaagaa

SEQ ID NO: 339846 - RNA, 22 nt, Human
uccaggagucuagccucaggcc

SEQ ID NO: 339847 - RNA, 22 nt, Human
cccaggagaauauaauguucuu

SEQ ID NO: 339848 - RNA, 20 nt, Human
cugcccagccacugagggau

SEQ ID NO: 339849 - RNA, 22 nt, Human
ugaaagcacaaguucuaacagg

SEQ ID NO: 339850 - RNA, 22 nt, Human
ucucuguacaguacaugccgug

SEQ ID NO: 339851 - RNA, 22 nt, Human
agaggcaguauacaauccgagc

SEQ ID NO: 339852 - RNA, 22 nt, Human
uuucugaacaaagccauuauca

SEQ ID NO: 339853 - RNA, 22 nt, Human
agaagucauuuauguuagauga

SEQ ID NO: 339854 - RNA, 15 nt, Human
cccaggaguucgaga

SEQ ID NO: 339855 - RNA, 22 nt, Human
uuugaaaggagcuuuauccaga

SEQ ID NO: 339856 - RNA, 22 nt, Human
auucuuauuauaguaaaacagu

SEQ ID NO: 339857 - RNA, 22 nt, Human
ggaggugggcuaaggacucucu

SEQ ID NO: 339858 - RNA, 22 nt, Human
gaggcagagugcaccccaggag

SEQ ID NO: 339859 - RNA, 22 nt, Human
ugcuggguagaaguauuagucu

SEQ ID NO: 339860 - RNA, 22 nt, Human
aaucacaugugcucaauuuuaa

SEQ ID NO: 339861 - RNA, 18 nt, Human
uggcagcaggaagccauu

SEQ ID NO: 339862 - RNA, 19 nt, Human
aucugccuuagugcugcug

SEQ ID NO: 339863 - RNA, 22 nt, Human
aaaauauuuuagggccaggaga

SEQ ID NO: 339864 - RNA, 22 nt, Human
ucuucagauaaagggagaguau

SEQ ID NO: 339865 - RNA, 22 nt, Human
auggaaagggaagcaaggaaca

SEQ ID NO: 339866 - RNA, 22 nt, Human
aggcagcccugugcuggaugcu

SEQ ID NO: 339867 - RNA, 22 nt, Human
auugugcaaauauuaucuguag

SEQ ID NO: 339868 - RNA, 22 nt, Human
cuguguuggcuuuucucuugua

SEQ ID NO: 339869 - RNA, 22 nt, Human
uuuaacagaugugaaauuuuca

SEQ ID NO: 339870 - RNA, 22 nt, Human
uggaaauguauuugggcaugcc

SEQ ID NO: 339871 - RNA, 22 nt, Human
augacaguucuacacuuaaucu

SEQ ID NO: 339872 - RNA, 22 nt, Human
aaauuauuaugccccucuauaa

SEQ ID NO: 339873 - RNA, 22 nt, Human
uuugacaugcaaagcacuuuag

SEQ ID NO: 339874 - RNA, 20 nt, Human
cucaggauugucuagccccu

SEQ ID NO: 339875 - RNA, 22 nt, Human
ugaggggaaggcaugauaaaua

SEQ ID NO: 339876 - RNA, 22 nt, Human
uaggcagcuuagguuagaagug

SEQ ID NO: 339877 - RNA, 22 nt, Human
caggaggaagaacucugcaaca

SEQ ID NO: 339878 - RNA, 22 nt, Human
uguuagaauauuguaauauucg

SEQ ID NO: 339879 - RNA, 22 nt, Human
cucagaagaacaaaggcucuac

SEQ ID NO: 339880 - RNA, 22 nt, Human
aaggcagucugguuucaaagca

SEQ ID NO: 339881 - RNA, 22 nt, Human
cuccaggaaagccugaggcccg

SEQ ID NO: 339882 - RNA, 22 nt, Human
uucuucaugcuguugcugcuug

SEQ ID NO: 339883 - RNA, 22 nt, Human
ggaagaggcugagccagguccc

SEQ ID NO: 339884 - RNA, 22 nt, Human
ugaggcagcaauugauuauuca

SEQ ID NO: 339885 - RNA, 21 nt, Human
ucuugaaaauuguagcaguuu

SEQ ID NO: 339886 - RNA, 22 nt, Human
uucauucugcaguucucagcuc

SEQ ID NO: 339887 - RNA, 22 nt, Human
cagcagaggcacgucugugaau

SEQ ID NO: 339888 - RNA, 22 nt, Human
uuuucagaggccuaagagguuu

SEQ ID NO: 339889 - RNA, 22 nt, Human
uuccaugacaccgagggaaguc

SEQ ID NO: 339890 - RNA, 22 nt, Human
uucuacaauaugaauaaugaag

SEQ ID NO: 339891 - RNA, 22 nt, Human
aaaggccaccaacaugaagcau

SEQ ID NO: 339892 - RNA, 22 nt, Human
caggcagcucuaauggaaagug

SEQ ID NO: 339893 - RNA, 22 nt, Human
gugcauuugacgaauacucacu

SEQ ID NO: 339894 - RNA, 20 nt, Human
ucagaugggagugagccauc

SEQ ID NO: 339895 - RNA, 22 nt, Human
gagcgauguggguauguagaag

SEQ ID NO: 339896 - RNA, 22 nt, Human
cccaggaggcagauguugcagu

SEQ ID NO: 339897 - RNA, 22 nt, Human
uauugaaauucuucauguccuc

SEQ ID NO: 339898 - RNA, 22 nt, Human
cucccagagaccaagcugagaa

SEQ ID NO: 339899 - RNA, 20 nt, Human
agcugccccugggcacugcc

SEQ ID NO: 339900 - RNA, 22 nt, Human
ucaggagacaaagggugcggag

SEQ ID NO: 339901 - RNA, 22 nt, Human
ucuucagaggaagucagucuuu

SEQ ID NO: 339902 - RNA, 22 nt, Human
cugcucuaacugcauuaguuuu

SEQ ID NO: 339903 - RNA, 22 nt, Human
cagcugacgccagaguggaauu

SEQ ID NO: 339904 - RNA, 22 nt, Human
cagaggcaggauaagaacugcg

SEQ ID NO: 339905 - RNA, 22 nt, Human
gcagcugagcgugaggaagagu

SEQ ID NO: 339906 - RNA, 17 nt, Human
cucacggaggaugaauc

SEQ ID NO: 339907 - RNA, 17 nt, Human
ucccaggaacagggaau

SEQ ID NO: 339908 - RNA, 22 nt, Human
uauuucagguauggugugaaau

SEQ ID NO: 339909 - RNA, 22 nt, Human
uuuuucuugugcuggaucuaau

SEQ ID NO: 339910 - RNA, 18 nt, Human
ugcuuggagcauuuacca

SEQ ID NO: 339911 - RNA, 22 nt, Human
uuuuccuguccaggcaauuauu

SEQ ID NO: 339912 - RNA, 22 nt, Human
ucagucucuggggcuucuguuu

SEQ ID NO: 339913 - RNA, 22 nt, Human
uuguaugagcuccaggaacuca

SEQ ID NO: 339914 - RNA, 22 nt, Human
uuuggaauguaguuuaaucauc

SEQ ID NO: 339915 - RNA, 22 nt, Human
ggcagcuucucccaggcuguuu

SEQ ID NO: 339916 - RNA, 18 nt, Human
ucuuccaacacugacacc

SEQ ID NO: 339917 - RNA, 22 nt, Human
agugugagcccuggaguggugc

SEQ ID NO: 339918 - RNA, 22 nt, Human
ccaagaugaucuuuacaguguu

SEQ ID NO: 339919 - RNA, 22 nt, Human
uaggcagccagcaucaguuggg

SEQ ID NO: 339920 - RNA, 22 nt, Human
cacaugaagagagucuaguaau

SEQ ID NO: 339921 - RNA, 22 nt, Human
uucuucuccuaaggagaguccu

SEQ ID NO: 339922 - RNA, 22 nt, Human
aaacaugaauagauauuaaaca

SEQ ID NO: 339923 - RNA, 22 nt, Human
agauggcagggguaccuggaag

SEQ ID NO: 339924 - RNA, 22 nt, Human
uucaggauuauacucucuuccc

SEQ ID NO: 339925 - RNA, 22 nt, Human
gaacuguaguuaauacuacaca

SEQ ID NO: 339926 - RNA, 22 nt, Human
aguguuugagacacauuucacu

SEQ ID NO: 339927 - RNA, 22 nt, Human
ucccaggauuuuaggcucucag

SEQ ID NO: 339928 - RNA, 22 nt, Human
agagggcagucucagauuggga

SEQ ID NO: 339929 - RNA, 22 nt, Human
aauauccacacugugucccugc

SEQ ID NO: 339930 - RNA, 22 nt, Human
guguaugauuucaaauggcuag

SEQ ID NO: 339931 - RNA, 22 nt, Human
uaauuucaauagcuugcauaau

SEQ ID NO: 339932 - RNA, 22 nt, Human
caggacagcucaacaccuccuc

SEQ ID NO: 339933 - RNA, 22 nt, Human
ggcaggcagaggcugagacagg

SEQ ID NO: 339934 - RNA, 22 nt, Human
uugcauuugacaaauuauuuaa

SEQ ID NO: 339935 - RNA, 22 nt, Human
ucuucucuacaccagcagcccc

SEQ ID NO: 339936 - RNA, 22 nt, Human
cugcugugacagcugccguguu

SEQ ID NO: 339937 - RNA, 22 nt, Human
gcccaggagaggccagggcuga

SEQ ID NO: 339938 - RNA, 22 nt, Human
auucuucacauggauaggaucu

SEQ ID NO: 339939 - RNA, 22 nt, Human
uuucacaacugcuuauuugaga

SEQ ID NO: 339940 - RNA, 22 nt, Human
aacuacauuguccuuucugaag

SEQ ID NO: 339941 - RNA, 22 nt, Human
uaaggccaccguuauagaacca

SEQ ID NO: 339942 - RNA, 22 nt, Human
aauguaugacaguucuaguggu

SEQ ID NO: 339943 - RNA, 22 nt, Human
ucccaggaaaacacucgaggac

SEQ ID NO: 339944 - RNA, 23 nt, Human
acucacaaagcaggaucauguug

SEQ ID NO: 339945 - RNA, 22 nt, Human
uugaaagaagaagcugcgaugu

SEQ ID NO: 339946 - RNA, 22 nt, Human
ggaggggauuuaguagaugcua

SEQ ID NO: 339947 - RNA, 22 nt, Human
auuauauaggacuugcccuucc

SEQ ID NO: 339948 - RNA, 22 nt, Human
ugucagaugcgauaaacuagug

SEQ ID NO: 339949 - RNA, 22 nt, Human
uguaugaaugggaaaaggaaac

SEQ ID NO: 339950 - RNA, 22 nt, Human
cggcagcuccgcgccguaggac

SEQ ID NO: 339951 - RNA, 22 nt, Human
uguauaaaccauggacagcuuu

SEQ ID NO: 339952 - RNA, 22 nt, Human
auacaaagacaaaucucaaucu

SEQ ID NO: 339953 - RNA, 22 nt, Human
cauuuucaugaguuucuguuca

SEQ ID NO: 339954 - RNA, 22 nt, Human
ucagucuucccuccagugcaac

SEQ ID NO: 339955 - RNA, 21 nt, Human
acauucacaggauauuaucau

SEQ ID NO: 339956 - RNA, 22 nt, Human
ucuuugcacugugcaagcagaa

SEQ ID NO: 339957 - RNA, 22 nt, Human
aaaggccaagcaugagguggac

SEQ ID NO: 339958 - RNA, 22 nt, Human
uguaggaauguuuuuaaguugg

SEQ ID NO: 339959 - RNA, 22 nt, Human
uuacacaacaucuguauuauua

SEQ ID NO: 339960 - RNA, 22 nt, Human
cccaggagauaacguucccaag

SEQ ID NO: 339961 - RNA, 22 nt, Human
cugcugugcaacauugcaccua

SEQ ID NO: 339962 - RNA, 22 nt, Human
aaggcagcaacuaauggaucuc

SEQ ID NO: 339963 - RNA, 22 nt, Human
ccagguaggagagagggauccu

SEQ ID NO: 339964 - RNA, 22 nt, Human
ucaccgccuugcccggccgggc

SEQ ID NO: 339965 - RNA, 22 nt, Human
aucugucaagauagacucugca

SEQ ID NO: 339966 - RNA, 22 nt, Human
aggcuggagggcaauggcaaga

SEQ ID NO: 339967 - RNA, 22 nt, Human
aagauaaacucuugauuucuga

SEQ ID NO: 339968 - RNA, 22 nt, Human
aagggcaggagaagacggauau

SEQ ID NO: 339969 - RNA, 22 nt, Human
guuaucaugcuucaucaucacu

SEQ ID NO: 339970 - RNA, 20 nt, Human
ggggcugcaugcagagaaga

SEQ ID NO: 339971 - RNA, 22 nt, Human
cacucuccagcacaccccauuu

SEQ ID NO: 339972 - RNA, 22 nt, Human
aggcugcugccuuggagagugu

SEQ ID NO: 339973 - RNA, 22 nt, Human
aaggcaguaggaucuuccacag

SEQ ID NO: 339974 - RNA, 22 nt, Human
uugcauuugagaaaguucuccu

SEQ ID NO: 339975 - RNA, 22 nt, Human
gagagaaaugugcaguuugggc

SEQ ID NO: 339976 - RNA, 22 nt, Human
uuggaugaagucuagcuuuagu

SEQ ID NO: 339977 - RNA, 22 nt, Human
cucaggauggaagccuacagga

SEQ ID NO: 339978 - RNA, 22 nt, Human
cuguauuuguccucuauuuauu

SEQ ID NO: 339979 - RNA, 22 nt, Human
uuucaucuucccagagaccuug

SEQ ID NO: 339980 - RNA, 22 nt, Human
uccaggagagguguggggacug

SEQ ID NO: 339981 - RNA, 22 nt, Human
uauggaaagcucuuuuugauug

SEQ ID NO: 339982 - RNA, 22 nt, Human
gcuccucugucaaaugagagug

SEQ ID NO: 339983 - RNA, 22 nt, Human
aaauacagaguugcuuaaaagc

SEQ ID NO: 339984 - RNA, 22 nt, Human
auugaaagaguuuucugcugca

SEQ ID NO: 339985 - RNA, 20 nt, Human
cuucuucagccuaugcuuca

SEQ ID NO: 339986 - RNA, 22 nt, Human
ucaggagagaguuggguaggcu

SEQ ID NO: 339987 - RNA, 22 nt, Human
cuucucagcaugguuacuguga

SEQ ID NO: 339988 - RNA, 22 nt, Human
cagaccucaguccucaguagga

SEQ ID NO: 339989 - RNA, 22 nt, Human
ggagcugugcagugacuacaga

SEQ ID NO: 339990 - RNA, 21 nt, Human
ggauggauagggaagagauuu

SEQ ID NO: 339991 - RNA, 17 nt, Human
gcuguaguuugauaaga

SEQ ID NO: 339992 - RNA, 22 nt, Human
gaggcagcaggcugaggaggau

SEQ ID NO: 339993 - RNA, 23 nt, Human
aauguauguuaguaucuuagaga

SEQ ID NO: 339994 - RNA, 22 nt, Human
guucuucacauuucauugagga

SEQ ID NO: 339995 - RNA, 22 nt, Human
cuuugaagagauuacugugcuc

SEQ ID NO: 339996 - RNA, 22 nt, Human
ggggcagcuaccggaaguaggg

SEQ ID NO: 339997 - RNA, 22 nt, Human
aucaggauagucuguaaauugu

SEQ ID NO: 339998 - RNA, 22 nt, Human
cuuaaauuggaugaguuaaguu

SEQ ID NO: 339999 - RNA, 22 nt, Human
aauuuccagaucagaugacuca

SEQ ID NO: 340000 - RNA, 22 nt, Human
cauuuguacagaacagcuuuau

SEQ ID NO: 340001 - RNA, 22 nt, Human
ucauggauggccgggaggugau

SEQ ID NO: 340002 - RNA, 22 nt, Human
cuuacagagaagaaaauguagu

SEQ ID NO: 340003 - RNA, 22 nt, Human
uccaggagaaaacugacggugg

SEQ ID NO: 340004 - RNA, 19 nt, Human
agggaguuuauauuugcac

SEQ ID NO: 340005 - RNA, 22 nt, Human
caggcagcugggucaccguccc

SEQ ID NO: 340006 - RNA, 22 nt, Human
ugccuugcgggcguuucuguug

SEQ ID NO: 340007 - RNA, 22 nt, Human
auugaaagauaggcuacugugg

SEQ ID NO: 340008 - RNA, 19 nt, Human
gccaggagggcucuggcug

SEQ ID NO: 340009 - RNA, 18 nt, Human
cugcccagagcacuugug

SEQ ID NO: 340010 - RNA, 23 nt, Human
ucuccuccuagauacagucaugg

SEQ ID NO: 340011 - RNA, 22 nt, Human
uguuuuaagagcgcacuuuaua

SEQ ID NO: 340012 - RNA, 22 nt, Human
auguucuuucagccagugcauc

SEQ ID NO: 340013 - RNA, 22 nt, Human
uaacuuucacaucacacugacu

SEQ ID NO: 340014 - RNA, 22 nt, Human
uuuggaauuggcauucuauucu

SEQ ID NO: 340015 - RNA, 22 nt, Human
uuccaagaguaaauucaaauug

SEQ ID NO: 340016 - RNA, 22 nt, Human
acagucuugcuguauggucagg

SEQ ID NO: 340017 - RNA, 22 nt, Human
uuugcaaauaccaugaaacuug

SEQ ID NO: 340018 - RNA, 22 nt, Human
guguauaaugcuguuuguacau

SEQ ID NO: 340019 - RNA, 19 nt, Human
aggcaggugcagagguccc

SEQ ID NO: 340020 - RNA, 22 nt, Human
cccaggagacagaaacagaggu

SEQ ID NO: 340021 - RNA, 22 nt, Human
uuucaaagaguuguaaauuacu

SEQ ID NO: 340022 - RNA, 18 nt, Human
aggcaggcuggagugacu

SEQ ID NO: 340023 - RNA, 22 nt, Human
ucucacugcaaauauuauguau

SEQ ID NO: 340024 - RNA, 22 nt, Human
ccagcagagucuaggaaggagg

SEQ ID NO: 340025 - RNA, 21 nt, Human
ggacagcugcgcgcagggcuc

SEQ ID NO: 340026 - RNA, 22 nt, Human
aucugccugagucuagguuuuc

SEQ ID NO: 340027 - RNA, 22 nt, Human
agggggugcccagaugaaggau

SEQ ID NO: 340028 - RNA, 22 nt, Human
aguaaaucagaccucauuaugu

SEQ ID NO: 340029 - RNA, 22 nt, Human
uaaggccauuauggugggcccg

SEQ ID NO: 340030 - RNA, 19 nt, Human
uggagacugagagugagca

SEQ ID NO: 340031 - RNA, 22 nt, Human
aguuugaaauguuggcaauauu

SEQ ID NO: 340032 - RNA, 22 nt, Human
accaggaguuuugaccaggggc

SEQ ID NO: 340033 - RNA, 22 nt, Human
ugccuguguccccuucuuggca

SEQ ID NO: 340034 - RNA, 22 nt, Human
uucauacaaugggauauuauga

SEQ ID NO: 340035 - RNA, 22 nt, Human
aauucuguuacuaaugugaugu

SEQ ID NO: 340036 - RNA, 18 nt, Human
ucauuuguuuugcaugaa

SEQ ID NO: 340037 - RNA, 22 nt, Human
gauggcaggugauagccgaguc

SEQ ID NO: 340038 - RNA, 22 nt, Human
aaacagcaggaacaucuugcca

SEQ ID NO: 340039 - RNA, 22 nt, Human
ggagaggaaaugccagcacuuc

SEQ ID NO: 340040 - RNA, 22 nt, Human
aaggcagccuuuugaguugauu

SEQ ID NO: 340041 - RNA, 19 nt, Human
cuggccaggccaggggccc

SEQ ID NO: 340042 - RNA, 22 nt, Human
aauauaugugguauugaccagc

SEQ ID NO: 340043 - RNA, 22 nt, Human
uguaugaaucucauuuguuuaa

SEQ ID NO: 340044 - RNA, 22 nt, Human
auacuguuuugugacuuaucuu

SEQ ID NO: 340045 - RNA, 22 nt, Human
gcaggcagagguggaggagaca

SEQ ID NO: 340046 - RNA, 22 nt, Human
acccaggaaaacauggugcaga

SEQ ID NO: 340047 - RNA, 22 nt, Human
uagcuuuccuuguugccugugc

SEQ ID NO: 340048 - RNA, 22 nt, Human
uucucagagcucacuguaguaa

SEQ ID NO: 340049 - RNA, 22 nt, Human
aucuuucuauuucuaaaaacua

SEQ ID NO: 340050 - RNA, 22 nt, Human
cucacugucuguacuagcugau

SEQ ID NO: 340051 - RNA, 22 nt, Human
ucuucacauggaacaugaagcu

SEQ ID NO: 340052 - RNA, 22 nt, Human
auaaucuuucuuuuccagauag

SEQ ID NO: 340053 - RNA, 22 nt, Human
auacaacuuuaucuguaaugag

SEQ ID NO: 340054 - RNA, 22 nt, Human
aagucuguuugagugucacacu

SEQ ID NO: 340055 - RNA, 22 nt, Human
aggcacagagaaugcccuccau

SEQ ID NO: 340056 - RNA, 22 nt, Human
aauauuguuucaagaucacaga

SEQ ID NO: 340057 - RNA, 22 nt, Human
cagcagagaaauuaaacuucug

SEQ ID NO: 340058 - RNA, 22 nt, Human
ucugucuucaucagcaugugau

SEQ ID NO: 340059 - RNA, 22 nt, Human
ggaggcgauccugggaaacacc

SEQ ID NO: 340060 - RNA, 22 nt, Human
gaggagagagggacugucugca

SEQ ID NO: 340061 - RNA, 22 nt, Human
gggcagcugccaagugcaucgc

SEQ ID NO: 340062 - RNA, 22 nt, Human
ugaaaggugacauuucuuggau

SEQ ID NO: 340063 - RNA, 22 nt, Human
gucaggauuuuaaaaucccagu

SEQ ID NO: 340064 - RNA, 22 nt, Human
gucauauacacugcauguaauc

SEQ ID NO: 340065 - RNA, 21 nt, Human
auacauucuauuaagcauuua

SEQ ID NO: 340066 - RNA, 22 nt, Human
uacccaggggcugagcagaggu

SEQ ID NO: 340067 - RNA, 22 nt, Human
uaucaauacauguuaucagugu

SEQ ID NO: 340068 - RNA, 22 nt, Human
aggguagggcccggagacagac

SEQ ID NO: 340069 - RNA, 19 nt, Human
uccaggaggcugccauuga

SEQ ID NO: 340070 - RNA, 22 nt, Human
acucaggaaaugagaggcucuc

SEQ ID NO: 340071 - RNA, 22 nt, Human
acagucuugagcaucagccaga

SEQ ID NO: 340072 - RNA, 22 nt, Human
ugaaagguagcuggccucauag

SEQ ID NO: 340073 - RNA, 22 nt, Human
ccucaggauccgcaggugcagu

SEQ ID NO: 340074 - RNA, 22 nt, Human
auaaaguuuaaaagucaauagu

SEQ ID NO: 340075 - RNA, 20 nt, Human
ucagugauuuugaagaggaa

SEQ ID NO: 340076 - RNA, 22 nt, Human
cuccaugaauuugagcuuugug

SEQ ID NO: 340077 - RNA, 22 nt, Human
ucuuugaaagcuguucuagagu

SEQ ID NO: 340078 - RNA, 19 nt, Human
agcuuccauauucucuagu

SEQ ID NO: 340079 - RNA, 22 nt, Human
aggguaggaacugaguggaagg

SEQ ID NO: 340080 - RNA, 22 nt, Human
aucugucuugccuugcauauuu

SEQ ID NO: 340081 - RNA, 22 nt, Human
aagugagugguaaggagcaugg

SEQ ID NO: 340082 - RNA, 22 nt, Human
aguccuuugggaaaaaugacua

SEQ ID NO: 340083 - RNA, 23 nt, Human
uggaaagcggaccuggggcagag

SEQ ID NO: 340084 - RNA, 22 nt, Human
auguuucagauacagaucaaau

SEQ ID NO: 340085 - RNA, 22 nt, Human
guaguuuucugaaaauuacuuu

SEQ ID NO: 340086 - RNA, 20 nt, Human
uaguauuugcauaaggauag

SEQ ID NO: 340087 - RNA, 22 nt, Human
cagugucuccagaugcuccaau

SEQ ID NO: 340088 - RNA, 20 nt, Human
cugcugugguccuuuauuuu

SEQ ID NO: 340089 - RNA, 22 nt, Human
cccaggagauggugcguggucu

SEQ ID NO: 340090 - RNA, 20 nt, Human
gcaaaauaggcucuguuggu

SEQ ID NO: 340091 - RNA, 22 nt, Human
uaaauuguuuucuagaaguugu

SEQ ID NO: 340092 - RNA, 22 nt, Human
uuuaacagguaaaguaaaugug

SEQ ID NO: 340093 - RNA, 22 nt, Human
uuguuauaaagacuaaauaugu

SEQ ID NO: 340094 - RNA, 22 nt, Human
aggcagcuucugauuagcagcg

SEQ ID NO: 340095 - RNA, 22 nt, Human
gaaauauuguacuggagauguu

SEQ ID NO: 340096 - RNA, 23 nt, Human
ccacagagcugccaauuccugug

SEQ ID NO: 340097 - RNA, 22 nt, Human
cucaggaugcaauuccaucaag

SEQ ID NO: 340098 - RNA, 22 nt, Human
gaauacaugauacaugaacugc

SEQ ID NO: 340099 - RNA, 22 nt, Human
aggcaagcauugggaacagggc

SEQ ID NO: 340100 - RNA, 22 nt, Human
agaggcagcagucauacuacag

SEQ ID NO: 340101 - RNA, 22 nt, Human
acacauauucauauguacuuac

SEQ ID NO: 340102 - RNA, 23 nt, Human
aaauaugucugagggcaaagaau

SEQ ID NO: 340103 - RNA, 22 nt, Human
acuggcagagacccugauggcc

SEQ ID NO: 340104 - RNA, 22 nt, Human
agucauaugacccuucacaaac

SEQ ID NO: 340105 - RNA, 22 nt, Human
gaaacugugaggaucuuaacuu

SEQ ID NO: 340106 - RNA, 22 nt, Human
caggcagcguccugcuuccugu

SEQ ID NO: 340107 - RNA, 22 nt, Human
aggcagcaugggccccagcucc

SEQ ID NO: 340108 - RNA, 22 nt, Human
caggaugguggcaugaucagaa

SEQ ID NO: 340109 - RNA, 22 nt, Human
aggcaggcugcuauggaguaga

SEQ ID NO: 340110 - RNA, 20 nt, Human
cccagguaggugccaugagu

SEQ ID NO: 340111 - RNA, 23 nt, Human
aggcccaacucugugagggcugc

SEQ ID NO: 340112 - RNA, 22 nt, Human
gacagcuggcaguggaaaggug

SEQ ID NO: 340113 - RNA, 22 nt, Human
cccaggagccaucugucuuggc

SEQ ID NO: 340114 - RNA, 22 nt, Human
ucaucuugcugccauugcuuua

SEQ ID NO: 340115 - RNA, 22 nt, Human
acauuguuugagaauacagaug

SEQ ID NO: 340116 - RNA, 22 nt, Human
ugaggggagcccgcccuggacg

SEQ ID NO: 340117 - RNA, 22 nt, Human
agaauccucuucaguaaauucu

SEQ ID NO: 340118 - RNA, 19 nt, Human
aaggcagcaguagcaucca

SEQ ID NO: 340119 - RNA, 22 nt, Human
aaauuagucgguuuaggaauuu

SEQ ID NO: 340120 - RNA, 22 nt, Human
aggcagacugugcgggaagagu

SEQ ID NO: 340121 - RNA, 22 nt, Human
uccaggaggccucauuuccugu

SEQ ID NO: 340122 - RNA, 22 nt, Human
uuuuucagccaugaauuacacu

SEQ ID NO: 340123 - RNA, 22 nt, Human
uugaacuguaagcaugucugcc

SEQ ID NO: 340124 - RNA, 22 nt, Human
ugccugugguuccaguuuuuuc

SEQ ID NO: 340125 - RNA, 22 nt, Human
aacagcauaaguauuuauuuca

SEQ ID NO: 340126 - RNA, 22 nt, Human
ucugcaggaggcuggcugcagg

SEQ ID NO: 340127 - RNA, 22 nt, Human
ccagagagaaauggauuugagu

SEQ ID NO: 340128 - RNA, 20 nt, Human
uuucugugcccaggucuguu

SEQ ID NO: 340129 - RNA, 22 nt, Human
acuugcugguggcauuuacagu

SEQ ID NO: 340130 - RNA, 22 nt, Human
uuucaaacuuuacucuugaauc

SEQ ID NO: 340131 - RNA, 22 nt, Human
aaauuauaggugccaccuugga

SEQ ID NO: 340132 - RNA, 22 nt, Human
gggagagguuacccgagcaacu

SEQ ID NO: 340133 - RNA, 22 nt, Human
cauaauuucuguaucagcacca

SEQ ID NO: 340134 - RNA, 22 nt, Human
gagggcaguagccucguacccu

SEQ ID NO: 340135 - RNA, 22 nt, Human
aagcagcuggaagaguaagaug

SEQ ID NO: 340136 - RNA, 23 nt, Human
uagggcagcugggagggacaugc

SEQ ID NO: 340137 - RNA, 19 nt, Human
ugaguucugugguucucaa

SEQ ID NO: 340138 - RNA, 22 nt, Human
acaauauuguacccagaaguuu

SEQ ID NO: 340139 - RNA, 22 nt, Human
agauggagaccuuggaugaacu

SEQ ID NO: 340140 - RNA, 22 nt, Human
uacccaggagaaacagcagggc

SEQ ID NO: 340141 - RNA, 22 nt, Human
auccaugauuaguaggauaaag

SEQ ID NO: 340142 - RNA, 22 nt, Human
cucacugugaccucagcagaca

SEQ ID NO: 340143 - RNA, 22 nt, Human
caugucuguguacacaugcaca

SEQ ID NO: 340144 - RNA, 22 nt, Human
accaggagacaugaccaaugag

SEQ ID NO: 340145 - RNA, 22 nt, Human
uucaugugaucacagauuguaa

SEQ ID NO: 340146 - RNA, 22 nt, Human
ugcauggaggaagaugaaugca

SEQ ID NO: 340147 - RNA, 22 nt, Human
cuucuucaauagcaagcgcaua

SEQ ID NO: 340148 - RNA, 22 nt, Human
aacaguaaagacagaauuuauc

SEQ ID NO: 340149 - RNA, 22 nt, Human
uuacuuugcuuucucauuacag

SEQ ID NO: 340150 - RNA, 22 nt, Human
aaggccagaguacuagaggcug

SEQ ID NO: 340151 - RNA, 22 nt, Human
guuuuauaauugcuucauaaga

SEQ ID NO: 340152 - RNA, 22 nt, Human
uagcuaucuguguccagaucca

SEQ ID NO: 340153 - RNA, 22 nt, Human
ugacaguuaagguauacauuca

SEQ ID NO: 340154 - RNA, 22 nt, Human
ucucaggacuuugggaagcuca

SEQ ID NO: 340155 - RNA, 22 nt, Human
aauugcuaaagauuauguuuuc

SEQ ID NO: 340156 - RNA, 22 nt, Human
uauuuuaaagacugccagccua

SEQ ID NO: 340157 - RNA, 22 nt, Human
cccaggagguggagguugcagu

SEQ ID NO: 340158 - RNA, 22 nt, Human
cauauguauuucucauaauuag

SEQ ID NO: 340159 - RNA, 22 nt, Human
guuugcauauuugcacaggaau

SEQ ID NO: 340160 - RNA, 22 nt, Human
uuuuaacuuaaaauacauagau

SEQ ID NO: 340161 - RNA, 22 nt, Human
cucacuguccaacaggcuuuac

SEQ ID NO: 340162 - RNA, 22 nt, Human
uuuaacagaugcuaugucuacc

SEQ ID NO: 340163 - RNA, 22 nt, Human
uuuagaaguucacacauuuaaa

SEQ ID NO: 340164 - RNA, 22 nt, Human
uuugaaaggaaguuaauacuuu

SEQ ID NO: 340165 - RNA, 22 nt, Human
auuaaauuggacgcugggggaa

SEQ ID NO: 340166 - RNA, 22 nt, Human
agugcuuuaccuagauaauguu

SEQ ID NO: 340167 - RNA, 22 nt, Human
cuucagaagaaaagcagugugu

SEQ ID NO: 340168 - RNA, 22 nt, Human
ccuggagauuucuucaagcuuu

SEQ ID NO: 340169 - RNA, 22 nt, Human
gcagagcuccccaagacaccaa

SEQ ID NO: 340170 - RNA, 22 nt, Human
agggagcuuccgaacuacagcu

SEQ ID NO: 340171 - RNA, 22 nt, Human
agcuagaaguacagccauauga

SEQ ID NO: 340172 - RNA, 22 nt, Human
acugugugacuguuauuacugu

SEQ ID NO: 340173 - RNA, 22 nt, Human
agaggccacuuugccugugaug

SEQ ID NO: 340174 - RNA, 22 nt, Human
uguaggccuauguccagcaauu

SEQ ID NO: 340175 - RNA, 22 nt, Human
ucagaaagaacacaggcaguag

SEQ ID NO: 340176 - RNA, 19 nt, Human
cuucuucuuggcagccaag

SEQ ID NO: 340177 - RNA, 18 nt, Human
aggcaggugcuggaaguc

SEQ ID NO: 340178 - RNA, 22 nt, Human
uugauacauuuuuaggauaaac

SEQ ID NO: 340179 - RNA, 22 nt, Human
uggcagcugaggggaggcuuug

SEQ ID NO: 340180 - RNA, 22 nt, Human
uguuuuaaucucccauugcucu

SEQ ID NO: 340181 - RNA, 22 nt, Human
cccaggagguggagguugcggu

SEQ ID NO: 340182 - RNA, 22 nt, Human
cucaggauuaaggaaucuaaau

SEQ ID NO: 340183 - RNA, 22 nt, Human
uuuaaauuuagaagaaacacug

SEQ ID NO: 340184 - RNA, 22 nt, Human
agaggagguccuuuucugaugu

SEQ ID NO: 340185 - RNA, 20 nt, Human
uccaggagaacugggagccg

SEQ ID NO: 340186 - RNA, 22 nt, Human
ucucaggaauagaguggcagca

SEQ ID NO: 340187 - RNA, 22 nt, Human
uuaaauuccagccucauaauag

SEQ ID NO: 340188 - RNA, 22 nt, Human
uugugguuaaccgcacauuuuu

SEQ ID NO: 340189 - RNA, 22 nt, Human
uuacaagauaaccugaugcugu

SEQ ID NO: 340190 - RNA, 22 nt, Human
gcccaggacucagggugucgcg

SEQ ID NO: 340191 - RNA, 22 nt, Human
uauguguuugacacccugcaag

SEQ ID NO: 340192 - RNA, 22 nt, Human
aaauuauuacaagcuaguuggc

SEQ ID NO: 340193 - RNA, 22 nt, Human
ugaauaguccuuggaauaacug

SEQ ID NO: 340194 - RNA, 22 nt, Human
auuucccaugugaaucaauugg

SEQ ID NO: 340195 - RNA, 22 nt, Human
ggaggggagguccagcugaucu

SEQ ID NO: 340196 - RNA, 22 nt, Human
ugaaacuuauaagaauaugaau

SEQ ID NO: 340197 - RNA, 22 nt, Human
acaagguauccacauuaaaugu

SEQ ID NO: 340198 - RNA, 22 nt, Human
ggacagcucugccaggagcuca

SEQ ID NO: 340199 - RNA, 22 nt, Human
ccuugcugcgugcuagcacaga

SEQ ID NO: 340200 - RNA, 22 nt, Human
gaccauuuuuacagagcauuca

SEQ ID NO: 340201 - RNA, 22 nt, Human
aggcagcagucaugaggaaaga

SEQ ID NO: 340202 - RNA, 21 nt, Human
gauugaaaccauggcagugag

SEQ ID NO: 340203 - RNA, 22 nt, Human
agcaccaugaccuugccauuga

SEQ ID NO: 340204 - RNA, 22 nt, Human
uaugauuuguagacauuugauu

SEQ ID NO: 340205 - RNA, 22 nt, Human
uaauaucuggcauucaaacaug

SEQ ID NO: 340206 - RNA, 22 nt, Human
aaagccauugaacuguacuuua

SEQ ID NO: 340207 - RNA, 22 nt, Human
gcucacugcaaccucugcuucc

SEQ ID NO: 340208 - RNA, 22 nt, Human
cagcagagaccaagugauuuga

SEQ ID NO: 340209 - RNA, 22 nt, Human
ugaaagguuaaaaguaguauug

SEQ ID NO: 340210 - RNA, 22 nt, Human
ugucucugaggugagggucagc

SEQ ID NO: 340211 - RNA, 17 nt, Human
caaggccagcaucuuca

SEQ ID NO: 340212 - RNA, 22 nt, Human
gagguggugguggaggcauagc

SEQ ID NO: 340213 - RNA, 22 nt, Human
ccagggaguuuccaaucugaga

SEQ ID NO: 340214 - RNA, 22 nt, Human
cccaggaaaucaggcuuucuag

SEQ ID NO: 340215 - RNA, 20 nt, Human
aguguacagacacuagaaau

SEQ ID NO: 340216 - RNA, 22 nt, Human
cccaggaaagagacugcugggu

SEQ ID NO: 340217 - RNA, 22 nt, Human
ucccaggacaugggcucugcuc

SEQ ID NO: 340218 - RNA, 22 nt, Human
uagggcaggugaagaaaagcua

SEQ ID NO: 340219 - RNA, 22 nt, Human
auguagaaauuaggaugauagu

SEQ ID NO: 340220 - RNA, 22 nt, Human
ggcaugcugcguacagaugaac

SEQ ID NO: 340221 - RNA, 22 nt, Human
ggagguggcagagggacauucu

SEQ ID NO: 340222 - RNA, 22 nt, Human
cucaggaugcaggucacaggac

SEQ ID NO: 340223 - RNA, 22 nt, Human
uuaacaugucuugacuucaucu

SEQ ID NO: 340224 - RNA, 20 nt, Human
ugaggcaggagaauggcaug

SEQ ID NO: 340225 - RNA, 22 nt, Human
uuucaaacauagaucugaauau

SEQ ID NO: 340226 - RNA, 22 nt, Human
cgaggcagggaagcugcaaaag

SEQ ID NO: 340227 - RNA, 22 nt, Human
ugaaaugacagucuuaagcucu

SEQ ID NO: 340228 - RNA, 22 nt, Human
caggauggucucgaucuccuga

SEQ ID NO: 340229 - RNA, 22 nt, Human
caucaaauaggaauauuuggca

SEQ ID NO: 340230 - RNA, 19 nt, Human
cucucacucgccacauccu

SEQ ID NO: 340231 - RNA, 22 nt, Human
gagagaggccuccauguacuga

SEQ ID NO: 340232 - RNA, 22 nt, Human
uauuuguauguguguacauaua

SEQ ID NO: 340233 - RNA, 20 nt, Human
uccaggagguuaguguggcu

SEQ ID NO: 340234 - RNA, 22 nt, Human
gugcagcugcaggagucagguc

SEQ ID NO: 340235 - RNA, 22 nt, Human
cccaggaaccuaccagcucgag

SEQ ID NO: 340236 - RNA, 22 nt, Human
caaauaguaugagcaaugauuc

SEQ ID NO: 340237 - RNA, 22 nt, Human
ucccaggaaugucugaaaguga

SEQ ID NO: 340238 - RNA, 22 nt, Human
auucauuugcuauuguguaugg

SEQ ID NO: 340239 - RNA, 22 nt, Human
aaauauguauggaguucaugaa

SEQ ID NO: 340240 - RNA, 21 nt, Human
ccauaccuaccucaccugguu

SEQ ID NO: 340241 - RNA, 22 nt, Human
aaaguaguuagucaugugaaaa

SEQ ID NO: 340242 - RNA, 23 nt, Human
accaggagccaagaucucccugg

SEQ ID NO: 340243 - RNA, 22 nt, Human
ggagaggagauuguggcauuuu

SEQ ID NO: 340244 - RNA, 22 nt, Human
uggcagcuacagacagagguga

SEQ ID NO: 340245 - RNA, 22 nt, Human
cauaauuuuuuuaagucagaac

SEQ ID NO: 340246 - RNA, 22 nt, Human
uagucaaaccucagaauacccc

SEQ ID NO: 340247 - RNA, 22 nt, Human
agagugcaaccgaaacaagcag

SEQ ID NO: 340248 - RNA, 18 nt, Human
ugaauagggguuugcaga

SEQ ID NO: 340249 - RNA, 22 nt, Human
gaggcagcuggguccggucggg

SEQ ID NO: 340250 - RNA, 22 nt, Human
gcugauguuuaguugauguuac

SEQ ID NO: 340251 - RNA, 22 nt, Human
aggcagcucuguggccucccag

SEQ ID NO: 340252 - RNA, 22 nt, Human
gauauuuugagaaauccuauga

SEQ ID NO: 340253 - RNA, 17 nt, Human
uagcuguguuucagcua

SEQ ID NO: 340254 - RNA, 22 nt, Human
ucacagacauggugagguaaca

SEQ ID NO: 340255 - RNA, 22 nt, Human
cagaggcauacucccagucuug

SEQ ID NO: 340256 - RNA, 22 nt, Human
uuauccaagcagaagcugcaca

SEQ ID NO: 340257 - RNA, 22 nt, Human
gucaggauuauuuuauuaaaag

SEQ ID NO: 340258 - RNA, 22 nt, Human
ugaaggccucugguacaugcca

SEQ ID NO: 340259 - RNA, 22 nt, Human
uucaggaugcagagguuguagu

SEQ ID NO: 340260 - RNA, 22 nt, Human
cugcuguguuagcagguuuagu

SEQ ID NO: 340261 - RNA, 22 nt, Human
agucucuuuguggacucugccu

SEQ ID NO: 340262 - RNA, 22 nt, Human
ugaguucucacccauucuucuu

SEQ ID NO: 340263 - RNA, 22 nt, Human
aauaucuucuaaggauagaacu

SEQ ID NO: 340264 - RNA, 22 nt, Human
ugauuuuuagcuauucugaaga

SEQ ID NO: 340265 - RNA, 22 nt, Human
ccaggagagcucuaaauggcug

SEQ ID NO: 340266 - RNA, 22 nt, Human
aucuagcaguguuauaauugga

SEQ ID NO: 340267 - RNA, 22 nt, Human
ucaauucaacacaugcacauug

SEQ ID NO: 340268 - RNA, 22 nt, Human
uuugcagucuggccugcuuugg

SEQ ID NO: 340269 - RNA, 22 nt, Human
gugauaaaauucaaauagcucu

SEQ ID NO: 340270 - RNA, 22 nt, Human
aauguaugugcaucauuuacau

SEQ ID NO: 340271 - RNA, 22 nt, Human
ugcaggaacugggagggauagu

SEQ ID NO: 340272 - RNA, 22 nt, Human
gaggcugcuuugaugacaggag

SEQ ID NO: 340273 - RNA, 22 nt, Human
aggcagagcuggguuuugaaau

SEQ ID NO: 340274 - RNA, 22 nt, Human
ccaggagauuuuuccauagcac

SEQ ID NO: 340275 - RNA, 22 nt, Human
gccaggaggucagccccucaac

SEQ ID NO: 340276 - RNA, 22 nt, Human
aaaguuguucaguaagaaacuc

SEQ ID NO: 340277 - RNA, 22 nt, Human
aggaagcuggugugaggaugaa

SEQ ID NO: 340278 - RNA, 22 nt, Human
auacaacagaaaaugauuauuc

SEQ ID NO: 340279 - RNA, 22 nt, Human
uuuagcaaaaaagcucugcgua

SEQ ID NO: 340280 - RNA, 22 nt, Human
acaaacagaguugaaaaauagg

SEQ ID NO: 340281 - RNA, 22 nt, Human
gcuuccaaugcuucuaucacau

SEQ ID NO: 340282 - RNA, 22 nt, Human
cuggcucgcauuauauuuuggg

SEQ ID NO: 340283 - RNA, 22 nt, Human
uaacaaaguauuguuuguguau

SEQ ID NO: 340284 - RNA, 22 nt, Human
aguaacagguguacagacuauc

SEQ ID NO: 340285 - RNA, 22 nt, Human
uaggugucuggacaacuuugua

SEQ ID NO: 340286 - RNA, 22 nt, Human
aaaugccucauuuucucucacu

SEQ ID NO: 340287 - RNA, 23 nt, Human
agcaacagugggugaguguugcu

SEQ ID NO: 340288 - RNA, 22 nt, Human
ccagguaggagagucaacaugu

SEQ ID NO: 340289 - RNA, 22 nt, Human
uuuauacuccacucugcaagcg

SEQ ID NO: 340290 - RNA, 22 nt, Human
aaucugagggaacuugaacucc

SEQ ID NO: 340291 - RNA, 22 nt, Human
aacccagaaacgcaggcgguca

SEQ ID NO: 340292 - RNA, 22 nt, Human
uagaaagagcuuugcuuccuuu

SEQ ID NO: 340293 - RNA, 22 nt, Human
uuuaggcucaaaagaguuggug

SEQ ID NO: 340294 - RNA, 22 nt, Human
cauccauagauugagagauggu

SEQ ID NO: 340295 - RNA, 22 nt, Human
aacuuucagaauccuaugcauu

SEQ ID NO: 340296 - RNA, 22 nt, Human
uguggugccgagagucuggacg

SEQ ID NO: 340297 - RNA, 22 nt, Human
uucacagcuaagagcuaaguaa

SEQ ID NO: 340298 - RNA, 22 nt, Human
agagcaauuagcuuagguaaaa

SEQ ID NO: 340299 - RNA, 22 nt, Human
ugugcuugucguggagccaggc

SEQ ID NO: 340300 - RNA, 22 nt, Human
ggaacaguugcgucaugggccu

SEQ ID NO: 340301 - RNA, 18 nt, Human
uauaaacacacuuagguu

SEQ ID NO: 340302 - RNA, 21 nt, Human
uaaacauaaccuuguauggcu

SEQ ID NO: 340303 - RNA, 22 nt, Human
ucugaaauuuuaguuauagaaa

SEQ ID NO: 340304 - RNA, 22 nt, Human
guuugcaaauuguguuaaagcu

SEQ ID NO: 340305 - RNA, 22 nt, Human
guugcauuaaucugcucaggcu

SEQ ID NO: 340306 - RNA, 22 nt, Human
aagauuuaccacuuuauucaag

SEQ ID NO: 340307 - RNA, 22 nt, Human
agcauuagguguguuucagagg

SEQ ID NO: 340308 - RNA, 22 nt, Human
ucaaagaucagaugguuguagg

SEQ ID NO: 340309 - RNA, 22 nt, Human
ucucugguuaugucauuaagca

SEQ ID NO: 340310 - RNA, 22 nt, Human
uaucacauacuucucauccagg

SEQ ID NO: 340311 - RNA, 22 nt, Human
cuucuuaaaguugucacagcug

SEQ ID NO: 340312 - RNA, 22 nt, Human
uggaucuugaugcuccaagagu

SEQ ID NO: 340313 - RNA, 22 nt, Human
uaagaaacauuuuuaugacagu

SEQ ID NO: 340314 - RNA, 22 nt, Human
aaguguguauuuuucuucagug

SEQ ID NO: 340315 - RNA, 19 nt, Human
agcagccaucgaccaugga

SEQ ID NO: 340316 - RNA, 20 nt, Human
cagcucugggcaggucgagg

SEQ ID NO: 340317 - RNA, 23 nt, Human
aguguucagcauguaguaaauac

SEQ ID NO: 340318 - RNA, 22 nt, Human
cugggguccuugccauguguca

SEQ ID NO: 340319 - RNA, 19 nt, Human
gagcagcuuccuaucuggu

SEQ ID NO: 340320 - RNA, 22 nt, Human
uugaauaguuuuggauagcaua

SEQ ID NO: 340321 - RNA, 22 nt, Human
cuggcuuuuuucccauuaugca

SEQ ID NO: 340322 - RNA, 22 nt, Human
uugagacacaaggcacaguaag

SEQ ID NO: 340323 - RNA, 22 nt, Human
caauguacaaaauaauuacaca

SEQ ID NO: 340324 - RNA, 23 nt, Human
aaugaguugggcagcauacaggc

SEQ ID NO: 340325 - RNA, 19 nt, Human
caggauuguuuaaagcuuu

SEQ ID NO: 340326 - RNA, 23 nt, Human
gacagguaaggguugggagaauc

SEQ ID NO: 340327 - RNA, 23 nt, Human
aguacauuugacccaaauaagcu

SEQ ID NO: 340328 - RNA, 22 nt, Human
acaguguuucacuuaaccguuu

SEQ ID NO: 340329 - RNA, 22 nt, Human
ugaggauggaaugcugugcaag

SEQ ID NO: 340330 - RNA, 22 nt, Human
uucaguaagcacuucuagagcu

SEQ ID NO: 340331 - RNA, 22 nt, Human
acucuguaauucugaagcaccu

SEQ ID NO: 340332 - RNA, 22 nt, Human
aauguuaaguuuagauuauaac

SEQ ID NO: 340333 - RNA, 22 nt, Human
cauugcaacuucaaacuccugg

SEQ ID NO: 340334 - RNA, 22 nt, Human
agaauaaccaguguuucacagu

SEQ ID NO: 340335 - RNA, 22 nt, Human
cagcaguacuucucagagguau

SEQ ID NO: 340336 - RNA, 22 nt, Human
cauuguuggcagagggacagag

SEQ ID NO: 340337 - RNA, 22 nt, Human
ugcauguuucuguauguuaaug

SEQ ID NO: 340338 - RNA, 22 nt, Human
augcuuucucuuaguucauuga

SEQ ID NO: 340339 - RNA, 22 nt, Human
uuagcaaacaucuucgugugag

SEQ ID NO: 340340 - RNA, 22 nt, Human
ucaccuguuggauguauacugu

SEQ ID NO: 340341 - RNA, 22 nt, Human
uuucauuauaaaaaguuggcuu

SEQ ID NO: 340342 - RNA, 22 nt, Human
aucagagcuaguacuugcaggu

SEQ ID NO: 340343 - RNA, 22 nt, Human
uccagcagguccgagacaaguu

SEQ ID NO: 340344 - RNA, 22 nt, Human
cacccucaagcaguggcacgug

SEQ ID NO: 340345 - RNA, 22 nt, Human
aggcuuaacuacaauuuuugcc

SEQ ID NO: 340346 - RNA, 22 nt, Human
cagugccagcugcuuggccuac

SEQ ID NO: 340347 - RNA, 17 nt, Human
ucugagaaugcuggagg

SEQ ID NO: 340348 - RNA, 22 nt, Human
aaugaguuuguucuauuauuug

SEQ ID NO: 340349 - RNA, 17 nt, Human
ucugagaacuugaagca

SEQ ID NO: 340350 - RNA, 20 nt, Human
uugcaaagugaauagcaauu

SEQ ID NO: 340351 - RNA, 22 nt, Human
aagugcaggucucagcuacucu

SEQ ID NO: 340352 - RNA, 22 nt, Human
ugacucauauuucauggauacg

SEQ ID NO: 340353 - RNA, 22 nt, Human
caagcagauauuuuagucaaga

SEQ ID NO: 340354 - RNA, 22 nt, Human
uucaacaacuugguucaaaugg

SEQ ID NO: 340355 - RNA, 22 nt, Human
gucaaaacaaaguuaagaauuc

SEQ ID NO: 340356 - RNA, 22 nt, Human
agucauguguucaucuuucauu

SEQ ID NO: 340357 - RNA, 22 nt, Human
augcaguuagguaauagucuca

SEQ ID NO: 340358 - RNA, 22 nt, Human
guggcauuugggagaugcgugg

SEQ ID NO: 340359 - RNA, 22 nt, Human
cagcagcucaggcuccuuccca

SEQ ID NO: 340360 - RNA, 22 nt, Human
cagacucuugagcugauuguau

SEQ ID NO: 340361 - RNA, 22 nt, Human
cauagacauugauagguuauau

SEQ ID NO: 340362 - RNA, 22 nt, Human
gagcagcagcugggccagguuc

SEQ ID NO: 340363 - RNA, 22 nt, Human
guuaacaacacugugagugcug

SEQ ID NO: 340364 - RNA, 22 nt, Human
cucagcaacccacacacggucu

SEQ ID NO: 340365 - RNA, 22 nt, Human
ugcaauuagcguauuaguuuau

SEQ ID NO: 340366 - RNA, 22 nt, Human
uuagaaaaaggcuguggucuua

SEQ ID NO: 340367 - RNA, 22 nt, Human
uugcuauuuugagagucauagu

SEQ ID NO: 340368 - RNA, 22 nt, Human
cacugguugccucuuucuguuc

SEQ ID NO: 340369 - RNA, 22 nt, Human
guggccaaggcagagaaagagc

SEQ ID NO: 340370 - RNA, 22 nt, Human
uugaacaguuuugucagguuca

SEQ ID NO: 340371 - RNA, 22 nt, Human
gagcaaggaugggucuauagua

SEQ ID NO: 340372 - RNA, 22 nt, Human
auuccaaagccugaauaaugga

SEQ ID NO: 340373 - RNA, 22 nt, Human
ucuuggcaguucuugugcuuuu

SEQ ID NO: 340374 - RNA, 22 nt, Human
cucucugggcccaguuggcacc

SEQ ID NO: 340375 - RNA, 22 nt, Human
agaagagccacuguugacggca

SEQ ID NO: 340376 - RNA, 22 nt, Human
auguuuguguuucccauucagg

SEQ ID NO: 340377 - RNA, 23 nt, Human
uguguucagucaaggaucagagu

SEQ ID NO: 340378 - RNA, 22 nt, Human
uagaaguuaaaggaauacagaa

SEQ ID NO: 340379 - RNA, 21 nt, Human
agaugcagugacccacugggg

SEQ ID NO: 340380 - RNA, 22 nt, Human
auugagaaaauucgagcaaguu

SEQ ID NO: 340381 - RNA, 22 nt, Human
agcacauucccaccuguacuuc

SEQ ID NO: 340382 - RNA, 17 nt, Human
agcagcuggguugaucu

SEQ ID NO: 340383 - RNA, 22 nt, Human
aaggagucugggccauucagag

SEQ ID NO: 340384 - RNA, 22 nt, Human
uuuuucaagacaaccugcaugu

SEQ ID NO: 340385 - RNA, 22 nt, Human
augcacaagguagauuauuauu

SEQ ID NO: 340386 - RNA, 22 nt, Human
gcagcaaucuucacagugucau

SEQ ID NO: 340387 - RNA, 22 nt, Human
aaugaaacuaguagaaucuuug

SEQ ID NO: 340388 - RNA, 22 nt, Human
ucuaguuagugguugauacugu

SEQ ID NO: 340389 - RNA, 22 nt, Human
guugcaaaugggaagaugguua

SEQ ID NO: 340390 - RNA, 22 nt, Human
auuuacucgugcuucauugaau

SEQ ID NO: 340391 - RNA, 22 nt, Human
uucaaacacugcuuugagaggg

SEQ ID NO: 340392 - RNA, 23 nt, Human
acaaguguuuccaauauggcugg

SEQ ID NO: 340393 - RNA, 22 nt, Human
aaaacauuuuacugccaucuca

SEQ ID NO: 340394 - RNA, 22 nt, Human
acaaucagcacugaguuuaucu

SEQ ID NO: 340395 - RNA, 22 nt, Human
caagccaggaaggauccagcac

SEQ ID NO: 340396 - RNA, 22 nt, Human
uuguacaaauaggaaccucuga

SEQ ID NO: 340397 - RNA, 22 nt, Human
cagugccaaggauggccuggga

SEQ ID NO: 340398 - RNA, 22 nt, Human
uuguguacucaccagcacauac

SEQ ID NO: 340399 - RNA, 22 nt, Human
cuggcuuucauggcgcaguuga

SEQ ID NO: 340400 - RNA, 20 nt, Human
cucuuuucacucucaguggu

SEQ ID NO: 340401 - RNA, 22 nt, Human
gauuuucauuauagcuaguuuc

SEQ ID NO: 340402 - RNA, 22 nt, Human
ggcaauuacguauuagucaugu

SEQ ID NO: 340403 - RNA, 22 nt, Human
uuguaacaguagcugucagcuc

SEQ ID NO: 340404 - RNA, 22 nt, Human
aucagagcugcauuuuagagcc

SEQ ID NO: 340405 - RNA, 21 nt, Human
ucaggaagagccaguucaugc

SEQ ID NO: 340406 - RNA, 22 nt, Human
gcaguuaccuauuuuguagaaa

SEQ ID NO: 340407 - RNA, 21 nt, Human
acagaagcggcgaguggcccc

SEQ ID NO: 340408 - RNA, 22 nt, Human
aacaguaugugagauuuacaca

SEQ ID NO: 340409 - RNA, 22 nt, Human
agcaauguuggccuauauaccu

SEQ ID NO: 340410 - RNA, 22 nt, Human
ugagcaccaggcaccacagcuc

SEQ ID NO: 340411 - RNA, 23 nt, Human
auaugucaugcaccagcacuuua

SEQ ID NO: 340412 - RNA, 22 nt, Human
aguaacuuaagcaauuguguau

SEQ ID NO: 340413 - RNA, 22 nt, Human
aagcaauucacaguucacuuaa

SEQ ID NO: 340414 - RNA, 22 nt, Human
cauuucaaacaguuacagcugc

SEQ ID NO: 340415 - RNA, 22 nt, Human
ugucacagugcacagcuaagaa

SEQ ID NO: 340416 - RNA, 22 nt, Human
cuucauuaaugucuauaaguuu

SEQ ID NO: 340417 - RNA, 22 nt, Human
uuucaugauuaacuuagugaau

SEQ ID NO: 340418 - RNA, 22 nt, Human
agcaaggcagcuuucacugcuu

SEQ ID NO: 340419 - RNA, 22 nt, Human
uucacauaaucugcagcaagcg

SEQ ID NO: 340420 - RNA, 22 nt, Human
cuaagguuggcaguggaauugg

SEQ ID NO: 340421 - RNA, 22 nt, Human
gagccugagcaaugugauguuu

SEQ ID NO: 340422 - RNA, 23 nt, Human
ugcaaaauuugcagaguucgaug

SEQ ID NO: 340423 - RNA, 22 nt, Human
auaguagcgagaucucagcuca

SEQ ID NO: 340424 - RNA, 22 nt, Human
ggugcaauaaaguuguagaacc

SEQ ID NO: 340425 - RNA, 22 nt, Human
aucuucaaggaaaaaauacagu

SEQ ID NO: 340426 - RNA, 22 nt, Human
guuuugaauacuacuagaacuu

SEQ ID NO: 340427 - RNA, 19 nt, Human
cauaauacaguggaucuga

SEQ ID NO: 340428 - RNA, 22 nt, Human
aguacaagugaugugguaaaaa

SEQ ID NO: 340429 - RNA, 22 nt, Human
gagcuuuucccgucuuucucgu

SEQ ID NO: 340430 - RNA, 22 nt, Human
gcauuacuucuuucauagguca

SEQ ID NO: 340431 - RNA, 22 nt, Human
ccagaaugugugaaauuugaug

SEQ ID NO: 340432 - RNA, 22 nt, Human
uugaguuuccugacagcgaagg

SEQ ID NO: 340433 - RNA, 22 nt, Human
uauaaacuccucuugcauuccu

SEQ ID NO: 340434 - RNA, 22 nt, Human
uuuucuuggaguggcuguccuu

SEQ ID NO: 340435 - RNA, 22 nt, Human
accagaagcuggagcacaagga

SEQ ID NO: 340436 - RNA, 22 nt, Human
aaugaaacuauauuuagagagg

SEQ ID NO: 340437 - RNA, 22 nt, Human
auugaacauuguucuaggaggc

SEQ ID NO: 340438 - RNA, 22 nt, Human
augaagcugguuuuggcuuggg

SEQ ID NO: 340439 - RNA, 22 nt, Human
gcucaugggcccagagcagccc

SEQ ID NO: 340440 - RNA, 22 nt, Human
aagcaacuaaggcaaggaaaug

SEQ ID NO: 340441 - RNA, 22 nt, Human
ucuaauuuuggcauuuuaaccu

SEQ ID NO: 340442 - RNA, 22 nt, Human
ucuuugcauggacauguguuuu

SEQ ID NO: 340443 - RNA, 22 nt, Human
aauuagaagcuguuagcaaaau

SEQ ID NO: 340444 - RNA, 22 nt, Human
ucaagaaagggcuucaccagga

SEQ ID NO: 340445 - RNA, 22 nt, Human
cauaaauuguacccauuccaac

SEQ ID NO: 340446 - RNA, 20 nt, Human
aauagcacagcucaaacauu

SEQ ID NO: 340447 - RNA, 22 nt, Human
aagcaaaagguuacacuucugg

SEQ ID NO: 340448 - RNA, 22 nt, Human
uguccuguccuuccuggaaguc

SEQ ID NO: 340449 - RNA, 22 nt, Human
uucguuuaguccacaaaugcau

SEQ ID NO: 340450 - RNA, 22 nt, Human
ucacaauacucacucaauggcu

SEQ ID NO: 340451 - RNA, 22 nt, Human
cugucaaauggaaacuuauccu

SEQ ID NO: 340452 - RNA, 22 nt, Human
uuuguaguuguggaugcugaag

SEQ ID NO: 340453 - RNA, 22 nt, Human
cucaucuggcuucaguaacagu

SEQ ID NO: 340454 - RNA, 22 nt, Human
guuugagauggguuauugcucu

SEQ ID NO: 340455 - RNA, 22 nt, Human
uugcauauccuccaacacaugg

SEQ ID NO: 340456 - RNA, 22 nt, Human
uuaaaagaauccuguuauccuc

SEQ ID NO: 340457 - RNA, 22 nt, Human
uguucaguuugcuaucauaauc

SEQ ID NO: 340458 - RNA, 22 nt, Human
gacauacagcccucucccuggu

SEQ ID NO: 340459 - RNA, 21 nt, Human
aaagugguaaggauuauuuug

SEQ ID NO: 340460 - RNA, 22 nt, Human
gacuggcucuaucaggauaaau

SEQ ID NO: 340461 - RNA, 22 nt, Human
uugaacaguccuaagagacccu

SEQ ID NO: 340462 - RNA, 22 nt, Human
guucugucugagcaccacagga

SEQ ID NO: 340463 - RNA, 21 nt, Human
ucaauuauggaugugugcaaa

SEQ ID NO: 340464 - RNA, 22 nt, Human
aaucuucaggguccuggggcuc

SEQ ID NO: 340465 - RNA, 22 nt, Human
aagccacugcagcaggagcugc

SEQ ID NO: 340466 - RNA, 19 nt, Human
uaugacaaguacuaguucu

SEQ ID NO: 340467 - RNA, 22 nt, Human
agaaacaucgcuuaguccucau

SEQ ID NO: 340468 - RNA, 22 nt, Human
caaauacaaauacgggcagcuu

SEQ ID NO: 340469 - RNA, 22 nt, Human
cucagcaacagcgacuuaaggg

SEQ ID NO: 340470 - RNA, 22 nt, Human
ucagcacaggucuugcaaaaca

SEQ ID NO: 340471 - RNA, 22 nt, Human
ucaguguagcagacuuguagcc

SEQ ID NO: 340472 - RNA, 22 nt, Human
auacaccaccuuggaucuuuca

SEQ ID NO: 340473 - RNA, 22 nt, Human
ucaaagcacuggggaaagccug

SEQ ID NO: 340474 - RNA, 22 nt, Human
aguucugacucugaaucuggga

SEQ ID NO: 340475 - RNA, 23 nt, Human
uugcauuaauguggaggcacagg

SEQ ID NO: 340476 - RNA, 22 nt, Human
agugccaaaucgagggcucuga

SEQ ID NO: 340477 - RNA, 18 nt, Human
ucuuccaacacugacacc

SEQ ID NO: 340478 - RNA, 22 nt, Human
cuuuauguuggggugucuuagu

SEQ ID NO: 340479 - RNA, 18 nt, Human
gaacagcaauuucauguu

SEQ ID NO: 340480 - RNA, 22 nt, Human
aaacaguguguuucagagaggc

SEQ ID NO: 340481 - RNA, 18 nt, Human
ucagacaaguuagacagg

SEQ ID NO: 340482 - RNA, 22 nt, Human
caauaauugcuuuccagaguua

SEQ ID NO: 340483 - RNA, 22 nt, Human
augaacaguacaaagcacagac

SEQ ID NO: 340484 - RNA, 22 nt, Human
ucuacaacgugguuuuguugua

SEQ ID NO: 340485 - RNA, 22 nt, Human
cgcaggugccggcagauggggu

SEQ ID NO: 340486 - RNA, 22 nt, Human
ugagacaaagcagcugacagaa

SEQ ID NO: 340487 - RNA, 22 nt, Human
auagcaaaggacaauagucagu

SEQ ID NO: 340488 - RNA, 22 nt, Human
agacacuguguacagaaaaaga

SEQ ID NO: 340489 - RNA, 22 nt, Human
ugcauuucccauuguguggcuc

SEQ ID NO: 340490 - RNA, 22 nt, Human
cauuaacacuuuggauuuagac

SEQ ID NO: 340491 - RNA, 22 nt, Human
aucuucaaagcacaucguuugu

SEQ ID NO: 340492 - RNA, 22 nt, Human
guucuucaaagugacaacuaaa

SEQ ID NO: 340493 - RNA, 22 nt, Human
agagaagagucuugucaaauua

SEQ ID NO: 340494 - RNA, 19 nt, Human
cuggcuucaagcaguccuc

SEQ ID NO: 340495 - RNA, 22 nt, Human
cccauugugguuguugaggaua

SEQ ID NO: 340496 - RNA, 22 nt, Human
aaagaugucauacacauuaaga

SEQ ID NO: 340497 - RNA, 22 nt, Human
uaguauuuccuguaagcuauag

SEQ ID NO: 340498 - RNA, 22 nt, Human
gcagcucucuggccugcccugg

SEQ ID NO: 340499 - RNA, 22 nt, Human
cagcacauggauggaguuagga

SEQ ID NO: 340500 - RNA, 22 nt, Human
gcaguugcaggauuuguguugu

SEQ ID NO: 340501 - RNA, 22 nt, Human
acaaagugaaaagcaucgaauu

SEQ ID NO: 340502 - RNA, 22 nt, Human
uucaaaccuaucuaagaaauag

SEQ ID NO: 340503 - RNA, 22 nt, Human
cagugccauauugaaagacauu

SEQ ID NO: 340504 - RNA, 22 nt, Human
agcagugugggcugcacgcugg

SEQ ID NO: 340505 - RNA, 22 nt, Human
uuuagcaaggagaaauaauccu

SEQ ID NO: 340506 - RNA, 22 nt, Human
uuugaaauguaucaguauaggu

SEQ ID NO: 340507 - RNA, 22 nt, Human
caucugcaggggaagccaguuu

SEQ ID NO: 340508 - RNA, 20 nt, Human
cuuguuaaauaugcagguag

SEQ ID NO: 340509 - RNA, 22 nt, Human
uagaagaacaugucaaacuaua

SEQ ID NO: 340510 - RNA, 22 nt, Human
ugagaagcauuaggaagaacau

SEQ ID NO: 340511 - RNA, 19 nt, Human
ucuuucauuucuagcucug

SEQ ID NO: 340512 - RNA, 22 nt, Human
aucuuuggguacaaacuugccu

SEQ ID NO: 340513 - RNA, 22 nt, Human
ucagacaccgucuauuuugccu

SEQ ID NO: 340514 - RNA, 22 nt, Human
ggguucagugaugccuucagga

SEQ ID NO: 340515 - RNA, 22 nt, Human
gagcaacacauugaaugaggau

SEQ ID NO: 340516 - RNA, 22 nt, Human
uucaguuuugcuuuuaaucaug

SEQ ID NO: 340517 - RNA, 23 nt, Human
ugaaagcaaugggucuauaguau

SEQ ID NO: 340518 - RNA, 22 nt, Human
cauuuugugcuagacacuaugg

SEQ ID NO: 340519 - RNA, 22 nt, Human
caaagaugccaaaaggaagaca

SEQ ID NO: 340520 - RNA, 22 nt, Human
ugaacagugugagggugugacc

SEQ ID NO: 340521 - RNA, 22 nt, Human
uaaagcaaugaaaguuuugcag

SEQ ID NO: 340522 - RNA, 22 nt, Human
ugcuuguauucauaucacagcu

SEQ ID NO: 340523 - RNA, 22 nt, Human
agcagcaggugaccucgaugcc

SEQ ID NO: 340524 - RNA, 22 nt, Human
gaagaaguguaagucuguuuca

SEQ ID NO: 340525 - RNA, 20 nt, Human
caucaacaccuugucagccu

SEQ ID NO: 340526 - RNA, 22 nt, Human
acuuuucuuaucagaaaggcca

SEQ ID NO: 340527 - RNA, 22 nt, Human
aauagcaaaugcucauuugaaa

SEQ ID NO: 340528 - RNA, 22 nt, Human
guucaguuauuucugaagauau

SEQ ID NO: 340529 - RNA, 22 nt, Human
gcaagcagcccagaacagcucu

SEQ ID NO: 340530 - RNA, 22 nt, Human
agugaaaaccuaaucaugcagu

SEQ ID NO: 340531 - RNA, 22 nt, Human
gcaguggccacauggaggagga

SEQ ID NO: 340532 - RNA, 22 nt, Human
aguuggcauuuuauuuaaguau

SEQ ID NO: 340533 - RNA, 22 nt, Human
agugaaauaugcccauugcugu

SEQ ID NO: 340534 - RNA, 22 nt, Human
uucagcacuggacagcgagucu

SEQ ID NO: 340535 - RNA, 22 nt, Human
cacagcuaccugcaugccugcu

SEQ ID NO: 340536 - RNA, 22 nt, Human
caaagaagagauuuacagagcu

SEQ ID NO: 340537 - RNA, 22 nt, Human
uucaaacaguguagaauauaug

SEQ ID NO: 340538 - RNA, 22 nt, Human
acagugauuggcacugauucag

SEQ ID NO: 340539 - RNA, 22 nt, Human
caagucugaccucugggugaag

SEQ ID NO: 340540 - RNA, 22 nt, Human
cagcucugguuccugggcccag

SEQ ID NO: 340541 - RNA, 22 nt, Human
ccauuuguaccauuucuuugua

SEQ ID NO: 340542 - RNA, 22 nt, Human
ucagagccccuccgcuguccca

SEQ ID NO: 340543 - RNA, 22 nt, Human
uaaccuguuaagggcugaccca

SEQ ID NO: 340544 - RNA, 22 nt, Human
aacuagaaagaacauauuucca

SEQ ID NO: 340545 - RNA, 22 nt, Human
aagccugagccaugcuuuacug

SEQ ID NO: 340546 - RNA, 22 nt, Human
gcagaagucagaccaucugaau

SEQ ID NO: 340547 - RNA, 22 nt, Human
caguuaaacagauugaguguua

SEQ ID NO: 340548 - RNA, 22 nt, Human
agaaaucugacugcugugcaca

SEQ ID NO: 340549 - RNA, 22 nt, Human
gagcagcuguucugacuugucu

SEQ ID NO: 340550 - RNA, 22 nt, Human
caaaauuguugaugcugcuuug

SEQ ID NO: 340551 - RNA, 21 nt, Human
uucacaguggauaacuuucug

SEQ ID NO: 340552 - RNA, 22 nt, Human
gacagguaaagaugguggcagg

SEQ ID NO: 340553 - RNA, 19 nt, Human
ucaaagucugagucacuuu

SEQ ID NO: 340554 - RNA, 22 nt, Human
gugaccaucaucucagcuaguu

SEQ ID NO: 340555 - RNA, 22 nt, Human
uguccugugcacuguagcaugu

SEQ ID NO: 340556 - RNA, 22 nt, Human
ucuauuaaugauucaauagugu

SEQ ID NO: 340557 - RNA, 22 nt, Human
uagcagcacuauuuguuguagu

SEQ ID NO: 340558 - RNA, 22 nt, Human
gaugaguucuuucuauucuauu

SEQ ID NO: 340559 - RNA, 20 nt, Human
aaaaacaguaaugcugaaga

SEQ ID NO: 340560 - RNA, 23 nt, Human
augcaacauugccaguaugggca

SEQ ID NO: 340561 - RNA, 22 nt, Human
ccagaacagaccugccugaccu

SEQ ID NO: 340562 - RNA, 22 nt, Human
gguucaguggaauguguugacc

SEQ ID NO: 340563 - RNA, 22 nt, Human
agccacauggaccugaugcuag

SEQ ID NO: 340564 - RNA, 22 nt, Human
ggcucucuuaacuggccauccu

SEQ ID NO: 340565 - RNA, 22 nt, Human
auguaacauaugugaucgcauu

SEQ ID NO: 340566 - RNA, 22 nt, Human
uuguagucuaggauagauuuuu

SEQ ID NO: 340567 - RNA, 22 nt, Human
cuucucaaaguugugaaucagg

SEQ ID NO: 340568 - RNA, 22 nt, Human
agugaauuagccuauuuguaaa

SEQ ID NO: 340569 - RNA, 22 nt, Human coronavirus 229E
ccauagaagacauacuuuuuag

SEQ ID NO: 340570 - RNA, 22 nt, Human coronavirus 229E
uuaccagacuaacaucuauuca

SEQ ID NO: 340571 - RNA, 22 nt, Human coronavirus 229E
ugagggcagaaccauuuauggu

SEQ ID NO: 340572 - RNA, 22 nt, Human coronavirus 229E
ugucugaaauccauaguagcua

SEQ ID NO: 340573 - RNA, 22 nt, Human coronavirus 229E
gcauaugaaacagcaagacaag

SEQ ID NO: 340574 - RNA, 22 nt, Human coronavirus 229E
gucugucauagauagccugaau

SEQ ID NO: 340575 - RNA, 22 nt, Human coronavirus 229E
agauguuaacaguuaauguggu

SEQ ID NO: 340576 - RNA, 22 nt, Human coronavirus 229E
gcagaggauguuuguacuuguu

SEQ ID NO: 340577 - RNA, 22 nt, Human coronavirus 229E
uacacauuuugacauugaagaa

SEQ ID NO: 340578 - RNA, 22 nt, Human coronavirus 229E
uuaagauuggagcuguuaaaca

SEQ ID NO: 340579 - RNA, 22 nt, Human coronavirus 229E
uuuguuaaugacaaaauuacug

SEQ ID NO: 340580 - RNA, 22 nt, Human coronavirus 229E
uuuucaugcccuauuuuaugua

SEQ ID NO: 340581 - RNA, 22 nt, Human coronavirus 229E
uauucaaucagcacuuucuguu

SEQ ID NO: 340582 - RNA, 22 nt, Human coronavirus 229E
ccagaguauauugauguuaaua

SEQ ID NO: 340583 - RNA, 22 nt, Human coronavirus 229E
auuucuuuugcuccaugguggu

SEQ ID NO: 340584 - RNA, 20 nt, Human coronavirus 229E
auuguuaugacaagaacccu

SEQ ID NO: 340585 - RNA, 22 nt, Human coronavirus 229E
uuuguuaaugacaaaauuacug

SEQ ID NO: 340586 - RNA, 22 nt, Human coronavirus 229E
uuugaacaguguaauuaagcuc

SEQ ID NO: 340587 - RNA, 22 nt, Human coronavirus 229E
agauguuaacaguuaauguggu

SEQ ID NO: 340588 - RNA, 22 nt, Human coronavirus 229E
gccuaucuacuuguugaucagc

SEQ ID NO: 340589 - RNA, 22 nt, Human coronavirus 229E
ggugcuaauuucacuggucaaa

SEQ ID NO: 340590 - RNA, 18 nt, Human coronavirus 229E
ggucaaggucucuggggc

SEQ ID NO: 340591 - RNA, 22 nt, Human coronavirus 229E
gcuuuaacaccauuggccacaa

SEQ ID NO: 340592 - RNA, 22 nt, Human coronavirus 229E
uguugcaacaugcuacaauucu

SEQ ID NO: 340593 - RNA, 22 nt, Human coronavirus 229E
ugucugaaauccauaguagcua

SEQ ID NO: 340594 - RNA, 22 nt, Human coronavirus 229E
caagcugucacgcaaauaccug

SEQ ID NO: 340595 - RNA, 20 nt, Human coronavirus 229E
uaguaugugguucucaaaca

SEQ ID NO: 340596 - RNA, 22 nt, Human coronavirus 229E
gugcaauuucuaaugaauggua

SEQ ID NO: 340597 - RNA, 22 nt, Human coronavirus 229E
uacacauuuugacauugaagaa

SEQ ID NO: 340598 - RNA, 22 nt, Human coronavirus 229E
gucugucauagauagccugaau

SEQ ID NO: 340599 - RNA, 20 nt, Human coronavirus 229E
aucuucaaguugaaucugca

SEQ ID NO: 340600 - RNA, 22 nt, Human
auguaguauuuggaaauguaaa

SEQ ID NO: 340601 - RNA, 22 nt, Human
aaaguaauugugguucuugcca

SEQ ID NO: 340602 - RNA, 22 nt, Human
aaauugcaaaaguacuuuuagg

SEQ ID NO: 340603 - RNA, 22 nt, Human
ccauccaugguguugguuguau

SEQ ID NO: 340604 - RNA, 22 nt, Human
uuagacaucaagaagccaaugu

SEQ ID NO: 340605 - RNA, 22 nt, Human
auuggccagacuuauccuucag

SEQ ID NO: 340606 - RNA, 22 nt, Human
guucuccaggggcuguucaucu

SEQ ID NO: 340607 - RNA, 22 nt, Human
ugaauaaucuuggguauuaaua

SEQ ID NO: 340608 - RNA, 22 nt, Human
uuuugaauaauucagaaacagc

SEQ ID NO: 340609 - RNA, 22 nt, Human
gcacaaaagguacuucauguag

SEQ ID NO: 340610 - RNA, 22 nt, Human
gaauaauugugaugcuugaagu

SEQ ID NO: 340611 - RNA, 22 nt, Human
cauucauaggaggagaugauua

SEQ ID NO: 340612 - RNA, 22 nt, Human
aucauccauggcugaucauaaa

SEQ ID NO: 340613 - RNA, 22 nt, Human
aauagcaaaugcucauuugaaa

SEQ ID NO: 340614 - RNA, 22 nt, Human
uuaugggcgaugcaaaccugau

SEQ ID NO: 340615 - RNA, 22 nt, Human
cuggugcuguagccugauugag

SEQ ID NO: 340616 - RNA, 22 nt, Human
uuugacaugugcuuauaacuuu

SEQ ID NO: 340617 - RNA, 22 nt, Human
uucccagauuggagggcagggg

SEQ ID NO: 340618 - RNA, 22 nt, Human
ucuguuauaaaucacacugcau

SEQ ID NO: 340619 - RNA, 22 nt, Human
uuguugcugcucaaccucuaua

SEQ ID NO: 340620 - RNA, 22 nt, Human
ucucuuaauuguaaugguuccu

SEQ ID NO: 340621 - RNA, 22 nt, Human
gucaaaacaaaguuaagaauuc

SEQ ID NO: 340622 - RNA, 22 nt, Human
cuucucugucacaggguuacgu

SEQ ID NO: 340623 - RNA, 22 nt, Human
cuucuggguauuccagauaccu

SEQ ID NO: 340624 - RNA, 22 nt, Human
aagccacugcagcaggagcugc

SEQ ID NO: 340625 - RNA, 22 nt, Human
acaagucaguggaauuaauauu

SEQ ID NO: 340626 - RNA, 22 nt, Human
auuaauaucccccgccguucug

SEQ ID NO: 340627 - RNA, 22 nt, Human
ugcugguucuuaggagagagau

SEQ ID NO: 340628 - RNA, 22 nt, Human
aggcauuacaucuaaauauuua

SEQ ID NO: 340629 - RNA, 22 nt, Human
gauucugaaauuaacagacugg

SEQ ID NO: 340630 - RNA, 20 nt, Human
uaugauaauuacaaaauagu

SEQ ID NO: 340631 - RNA, 22 nt, Human
cauuaacacuuuggauuuagac

SEQ ID NO: 340632 - RNA, 22 nt, Human
caagucuagcuuggucacuugg

SEQ ID NO: 340633 - RNA, 22 nt, Human
uuugaaauguaucaguauaggu

SEQ ID NO: 340634 - RNA, 22 nt, Human
ggcagguguggugaccagagau

SEQ ID NO: 340635 - RNA, 22 nt, Human
uguuuuaagggucaacugucac

SEQ ID NO: 340636 - RNA, 22 nt, Human
cugcugagguggagauugcagu

SEQ ID NO: 340637 - RNA, 22 nt, Human
guuucuccucugugucuuguuu

SEQ ID NO: 340638 - RNA, 22 nt, Human
uuuagcaaggagaaauaauccu

SEQ ID NO: 340639 - RNA, 22 nt, Human
uaucauuuuacugugacauuuu

SEQ ID NO: 340640 - RNA, 23 nt, Human
aaguaccuacacauuauuucaga

SEQ ID NO: 340641 - RNA, 22 nt, Human
uaacuucucugagccucauucc

SEQ ID NO: 340642 - RNA, 23 nt, Human
uaucauuucagcucucugccugg

SEQ ID NO: 340643 - RNA, 22 nt, Human
uccuuggcaugccgucuucucc

SEQ ID NO: 340644 - RNA, 22 nt, Human
cugaugcucuggauguagucaa

SEQ ID NO: 340645 - RNA, 22 nt, Human
uccucuucaaaauagcucugaa

SEQ ID NO: 340646 - RNA, 21 nt, Human
ccacaauucuaguuacauaug

SEQ ID NO: 340647 - RNA, 22 nt, Human
acauucuacaguuaaccauuag

SEQ ID NO: 340648 - RNA, 22 nt, Human
uauaaacuccucuugcauuccu

SEQ ID NO: 340649 - RNA, 22 nt, Human
uacaccagauuauuuauaacau

SEQ ID NO: 340650 - RNA, 22 nt, Human
uuucugaggaauuaauacagaa

SEQ ID NO: 340651 - RNA, 22 nt, Human
ucuguggcaaacacagugacca

SEQ ID NO: 340652 - RNA, 22 nt, Human
agcugugaccuucaagagcuac

SEQ ID NO: 340653 - RNA, 22 nt, Human
aauguuaaguuuagauuauaac

SEQ ID NO: 340654 - RNA, 22 nt, Human
acaaguuucauuguuuagaacc

SEQ ID NO: 340655 - RNA, 22 nt, Human
uaaaccuuauuugaauaccaac

SEQ ID NO: 340656 - RNA, 22 nt, Human
acagcaucccugaagauaacca

SEQ ID NO: 340657 - RNA, 22 nt, Human
aacaugaugacauuguaagcuu

SEQ ID NO: 340658 - RNA, 22 nt, Human
uacauuuauaaggcuucucugu

SEQ ID NO: 340659 - RNA, 22 nt, Human
agaggcucuuugagcugggaga

SEQ ID NO: 340660 - RNA, 23 nt, Human
aguguucagcauguaguaaauac

SEQ ID NO: 340661 - RNA, 22 nt, Human
uuuaaaccuaucuaagaaauag

SEQ ID NO: 340662 - RNA, 22 nt, Human
ucccagauuccugcucuuauau

SEQ ID NO: 340663 - RNA, 22 nt, Human
gcuucuggugaggccucaggaa

SEQ ID NO: 340664 - RNA, 22 nt, Human
aucauuaacccuugaugcuggg

SEQ ID NO: 340665 - RNA, 22 nt, Human
aggguugaagucugguccucau

SEQ ID NO: 340666 - RNA, 22 nt, Human
uuacaauuacuugaucucagcu

SEQ ID NO: 340667 - RNA, 22 nt, Human
caaccugaugugcaugccacgg

SEQ ID NO: 340668 - RNA, 22 nt, Human
cuugccagggacucagucaggg

SEQ ID NO: 340669 - RNA, 22 nt, Human
caguggguccugcgucugccag

SEQ ID NO: 340670 - RNA, 18 nt, Human
ucuuccaacacugacacc

SEQ ID NO: 340671 - RNA, 22 nt, Human
auucauucugaccucaagagaa

SEQ ID NO: 340672 - RNA, 22 nt, Human
uagggcucugagaguucagccu

SEQ ID NO: 340673 - RNA, 22 nt, Human
uuugccaguauuuuauugauga

SEQ ID NO: 340674 - RNA, 22 nt, Human
uuugaauauacuucaaacaaag

SEQ ID NO: 340675 - RNA, 22 nt, Human
cuaguuuuaagcuccuugaggu

SEQ ID NO: 340676 - RNA, 22 nt, Human
cauaacauccuugcuacuuuga

SEQ ID NO: 340677 - RNA, 22 nt, Human
caacccaagguuaguuggucuu

SEQ ID NO: 340678 - RNA, 22 nt, Human
acauuuaaugauccuacuguga

SEQ ID NO: 340679 - RNA, 22 nt, Human
ugaauagagcugcaguggacau

SEQ ID NO: 340680 - RNA, 22 nt, Human
augauugaaaaugacauugcca

SEQ ID NO: 340681 - RNA, 22 nt, Human
aagaaaagguaaccgcuuaucu

SEQ ID NO: 340682 - RNA, 22 nt, Human
ccucuucuaggacguccuugug

SEQ ID NO: 340683 - RNA, 22 nt, Human
cgggcacucagggucgaggugg

SEQ ID NO: 340684 - RNA, 23 nt, Human
cacuggugggguuuaaaagaagc

SEQ ID NO: 340685 - RNA, 23 nt, Human
agggcacugaagcuggaauuggg

SEQ ID NO: 340686 - RNA, 22 nt, Human
aucaucaucuaaauugugucgc

SEQ ID NO: 340687 - RNA, 22 nt, Human
uuucacauaugguuguugauug

SEQ ID NO: 340688 - RNA, 22 nt, Human
aggcggcugguguccugcaggu

SEQ ID NO: 340689 - RNA, 22 nt, Human
uucuucaaccaucuacauaaac

SEQ ID NO: 340690 - RNA, 20 nt, Human
agcuucuucugucuaauuuu

SEQ ID NO: 340691 - RNA, 23 nt, Human
uuagagaugauuaaaaaaucuug

SEQ ID NO: 340692 - RNA, 22 nt, Human
ucagagagccucaggcacugcc

SEQ ID NO: 340693 - RNA, 22 nt, Human
agcccagguucuaaagccaaac

SEQ ID NO: 340694 - RNA, 22 nt, Human
cuacccagcaccuaggcugccu

SEQ ID NO: 340695 - RNA, 22 nt, Human
auuuaaauuuucugauggagag

SEQ ID NO: 340696 - RNA, 22 nt, Human
ucacauuuuauaucucugguuu

SEQ ID NO: 340697 - RNA, 22 nt, Human
aaggcagcagugcacgacugau

SEQ ID NO: 340698 - RNA, 20 nt, Human
uauuuacaacuuagagccuc

SEQ ID NO: 340699 - RNA, 22 nt, Human
uuaucacuuaugagcuuuuugc

SEQ ID NO: 340700 - RNA, 22 nt, Human
aaguuucaaauguugauuaugc

SEQ ID NO: 340701 - RNA, 22 nt, Human
uucaacuauuaugaauaaaauu

SEQ ID NO: 340702 - RNA, 22 nt, Human
uuucuuauacuauauugucauc

SEQ ID NO: 340703 - RNA, 22 nt, Human
auuaguaaaacauuguauaugu

SEQ ID NO: 340704 - RNA, 22 nt, Human
aggguggcaccuggaagggaug

SEQ ID NO: 340705 - RNA, 22 nt, Human
gcucccaggcauggagguaauu

SEQ ID NO: 340706 - RNA, 22 nt, Human
uuugcaguuucauugcugaaau

SEQ ID NO: 340707 - RNA, 22 nt, Human
uucucugaaggccaugcucacu

SEQ ID NO: 340708 - RNA, 22 nt, Human
uucaggauggcggauguugggg

SEQ ID NO: 340709 - RNA, 18 nt, Human
aaacuggcuuggccugug

SEQ ID NO: 340710 - RNA, 22 nt, Human
ucucaggaauagaguggcagca

SEQ ID NO: 340711 - RNA, 16 nt, Human
aaggagggaagagaau

SEQ ID NO: 340712 - RNA, 22 nt, Human
gaggagaggcuggacgcgguga

SEQ ID NO: 340713 - RNA, 23 nt, Human
aggcagcagguuguccaggguga

SEQ ID NO: 340714 - RNA, 22 nt, Human
ggagguggcagggaacauaauu

SEQ ID NO: 340715 - RNA, 22 nt, Human
ggugaaggcacaagagggcaag

SEQ ID NO: 340716 - RNA, 22 nt, Human
agucuucucauuucacaugcuu

SEQ ID NO: 340717 - RNA, 22 nt, Human
aaauuagucgguuuaggaauuu

SEQ ID NO: 340718 - RNA, 22 nt, Human
uggcaaggccacaggugcaguu

SEQ ID NO: 340719 - RNA, 22 nt, Human
gauugaaacauaggcagucgag

SEQ ID NO: 340720 - RNA, 22 nt, Human
aggcuagcaaugggagaugagu

SEQ ID NO: 340721 - RNA, 22 nt, Human
ccucagaugucuuaaggcacug

SEQ ID NO: 340722 - RNA, 22 nt, Human
aagaggaggacgguucccagaa

SEQ ID NO: 340723 - RNA, 22 nt, Human
uaaggccagccagcaaaucugu

SEQ ID NO: 340724 - RNA, 22 nt, Human
ucauuuguggaagugauugugg

SEQ ID NO: 340725 - RNA, 22 nt, Human
uugaaguuguaguucagugaag

SEQ ID NO: 340726 - RNA, 22 nt, Human
cugcccaggcugaaggaacauc

SEQ ID NO: 340727 - RNA, 18 nt, Human
aggcaggcuggagugacu

SEQ ID NO: 340728 - RNA, 22 nt, Human
cccagggaagccauuucugacu

SEQ ID NO: 340729 - RNA, 22 nt, Human
auuuagacuucccagcacugug

SEQ ID NO: 340730 - RNA, 21 nt, Human
uuagaaagcucacuacaguua

SEQ ID NO: 340731 - RNA, 22 nt, Human
ggcagcuuguccuggaggaugg

SEQ ID NO: 340732 - RNA, 22 nt, Human
aaauauguauggaguucaugaa

SEQ ID NO: 340733 - RNA, 22 nt, Human
uuuuuuaguuaggucagaaugu

SEQ ID NO: 340734 - RNA, 22 nt, Human
uguuccaauaaggaguugaaau

SEQ ID NO: 340735 - RNA, 22 nt, Human
ugccuugcacauaauauacauu

SEQ ID NO: 340736 - RNA, 19 nt, Human
cauuuagaaguacauauua

SEQ ID NO: 340737 - RNA, 22 nt, Human
uucuuaacucaaauauauaucc

SEQ ID NO: 340738 - RNA, 22 nt, Human
cagauggaacacagaaaggaga

SEQ ID NO: 340739 - RNA, 22 nt, Human
uucuuaaaacuuauggacaggu

SEQ ID NO: 340740 - RNA, 22 nt, Human
augaggcaaucaugguccaguu

SEQ ID NO: 340741 - RNA, 22 nt, Human
aaggcaguuugggccaccaucu

SEQ ID NO: 340742 - RNA, 22 nt, Human
cucuucuuggcccccaugaggg

SEQ ID NO: 340743 - RNA, 22 nt, Human
gugauaaagacgugucauaauu

SEQ ID NO: 340744 - RNA, 22 nt, Human
uuucuucaauugcuaacaagga

SEQ ID NO: 340745 - RNA, 22 nt, Human
uguguaaagcuuguuccagaaa

SEQ ID NO: 340746 - RNA, 22 nt, Human
cuucucagaggccagaagcuau

SEQ ID NO: 340747 - RNA, 22 nt, Human
cucagagaggcaguggaaguca

SEQ ID NO: 340748 - RNA, 22 nt, Human
ugauuuccuaggucuggagaag

SEQ ID NO: 340749 - RNA, 22 nt, Human
guugaaagcuuuucauuuaguu

SEQ ID NO: 340750 - RNA, 22 nt, Human
gaucuguuauaaucucuuuuau

SEQ ID NO: 340751 - RNA, 22 nt, Human
cuuuggaauauuuuauugagaa

SEQ ID NO: 340752 - RNA, 21 nt, Human
aaugcauuaacauaaagcuga

SEQ ID NO: 340753 - RNA, 22 nt, Human
agagugcagauaagagaauguu

SEQ ID NO: 340754 - RNA, 22 nt, Human
caggagagauaugaguccccac

SEQ ID NO: 340755 - RNA, 22 nt, Human
aagugaagaaauacaugagaau

SEQ ID NO: 340756 - RNA, 22 nt, Human
uacaaaguagaaauucaguaaa

SEQ ID NO: 340757 - RNA, 22 nt, Human
uggcuucuugggaugggucauu

SEQ ID NO: 340758 - RNA, 22 nt, Human
ucagugcacagagauuuuuguu

SEQ ID NO: 340759 - RNA, 19 nt, Human
uuugcagugguuccuuugu

SEQ ID NO: 340760 - RNA, 22 nt, Human
cuagaaauauuuuacagucaag

SEQ ID NO: 340761 - RNA, 22 nt, Human
ccaggcugcagucaaggggcau

SEQ ID NO: 340762 - RNA, 22 nt, Human
ugcuagaauuagguuaaacaaa

SEQ ID NO: 340763 - RNA, 22 nt, Human
aguaugaauacagauuuucucu

SEQ ID NO: 340764 - RNA, 22 nt, Human
guuaaauucgaugauggauaaa

SEQ ID NO: 340765 - RNA, 22 nt, Human
ucccaggaugugcgugccgccg

SEQ ID NO: 340766 - RNA, 22 nt, Human
ucagauggguuuugaaggaugu

SEQ ID NO: 340767 - RNA, 22 nt, Human
ugcuggguagaaguauuagucu

SEQ ID NO: 340768 - RNA, 22 nt, Human
ucccaggauguuggcggcaggu

SEQ ID NO: 340769 - RNA, 22 nt, Human
aaauauacuagaugaugaccca

SEQ ID NO: 340770 - RNA, 22 nt, Human
agggugguucuuuuaguggaag

SEQ ID NO: 340771 - RNA, 22 nt, Human
caggcagcucuaauggaaagug

SEQ ID NO: 340772 - RNA, 22 nt, Human
auucuuauuuaaauagagucug

SEQ ID NO: 340773 - RNA, 22 nt, Human
ccucuucuaggacguccuugug

SEQ ID NO: 340774 - RNA, 22 nt, Human
uaucuguuggcuccuaguugua

SEQ ID NO: 340775 - RNA, 22 nt, Human
accaggagguguuugcucaagu

SEQ ID NO: 340776 - RNA, 23 nt, Human
ugaguucucaucuuggcuucuau

SEQ ID NO: 340777 - RNA, 22 nt, Human
acucuucuugcugcucauuaau

SEQ ID NO: 340778 - RNA, 22 nt, Human
ugcccagggauaagccuagaga

SEQ ID NO: 340779 - RNA, 22 nt, Human
uugcugaagugaagguauguuu

SEQ ID NO: 340780 - RNA, 22 nt, Human
uacuuacagaaggaagcaauug

SEQ ID NO: 340781 - RNA, 22 nt, Human
uggaaagucucuuuugacugua

SEQ ID NO: 340782 - RNA, 22 nt, Human
auaaaugauucagcaggaaaua

SEQ ID NO: 340783 - RNA, 22 nt, Human
agucucuuuaaucacagugucu

SEQ ID NO: 340784 - RNA, 22 nt, Human
cccaggaaguggagguugcagu

SEQ ID NO: 340785 - RNA, 22 nt, Human
aaagcagagguugcagugagcu

SEQ ID NO: 340786 - RNA, 22 nt, Human
cucuucuuuaguccagaccauc

SEQ ID NO: 340787 - RNA, 21 nt, Human
ucuugaaaauuguagcaguuu

SEQ ID NO: 340788 - RNA, 18 nt, Human
cucugucauaagugucau

SEQ ID NO: 340789 - RNA, 22 nt, Human
cuggguaaguuccuaaggcuca

SEQ ID NO: 340790 - RNA, 22 nt, Human
cucauuaaaggaaaucaccugc

SEQ ID NO: 340791 - RNA, 22 nt, Human
caagauaagaucauuuacacua

SEQ ID NO: 340792 - RNA, 22 nt, Human
cccuuagcucaauuucuugccc

SEQ ID NO: 340793 - RNA, 22 nt, Human
gcagcugccuucagcuggaugg

SEQ ID NO: 340794 - RNA, 22 nt, Human
cugagccagcuggcaugugcua

SEQ ID NO: 340795 - RNA, 22 nt, Human
uucuacaauaugaauaaugaag

SEQ ID NO: 340796 - RNA, 22 nt, Human
uacccaggggcugagcagaggu

SEQ ID NO: 340797 - RNA, 19 nt, Human
acauuuagaauguacuugc

SEQ ID NO: 340798 - RNA, 22 nt, Human
ggcaagaaggcuucagguagcu

SEQ ID NO: 340799 - RNA, 22 nt, Human
gccaggagggaaaggacaauuu

SEQ ID NO: 340800 - RNA, 22 nt, Human
uaaguucauaagcuuauucuua

SEQ ID NO: 340801 - RNA, 22 nt, Human
uuuuacuuaauucuuggucaug

SEQ ID NO: 340802 - RNA, 22 nt, Human
ucauuuguugaacuuuagugcg

SEQ ID NO: 340803 - RNA, 22 nt, Human
ucauuuguucucauucucuacu

SEQ ID NO: 340804 - RNA, 22 nt, Human
auucacaaaaugauauagauac

SEQ ID NO: 340805 - RNA, 22 nt, Human
cagagggaaaaggggaguaaua

SEQ ID NO: 340806 - RNA, 22 nt, Human
gccagagguucaacaacugucu

SEQ ID NO: 340807 - RNA, 22 nt, Human
uucugggagagaaagggccuug

SEQ ID NO: 340808 - RNA, 22 nt, Human
cuggcaguguccagcucgugau

SEQ ID NO: 340809 - RNA, 22 nt, Human
aguucucagcuuaguaugcugu

SEQ ID NO: 340810 - RNA, 22 nt, Human
acagaaauugggcaaauggaag

SEQ ID NO: 340811 - RNA, 22 nt, Human
aauacauauggaauuccauguu

SEQ ID NO: 340812 - RNA, 22 nt, Human
uagggcaggggaggaaucugaa

SEQ ID NO: 340813 - RNA, 22 nt, Human
uucuagaugauaaaccagcagc

SEQ ID NO: 340814 - RNA, 18 nt, Human
guaggucaguaccaagca

SEQ ID NO: 340815 - RNA, 21 nt, Human
uucuucuuggacuguuuuggc

SEQ ID NO: 340816 - RNA, 22 nt, Human
ucucacuuuccagacuuuucaa

SEQ ID NO: 340817 - RNA, 22 nt, Human
uggagagguugaauaacuuguc

SEQ ID NO: 340818 - RNA, 22 nt, Human
acucaggagggaucagcuauca

SEQ ID NO: 340819 - RNA, 21 nt, Human
uccaggaguggcugggcaggg

SEQ ID NO: 340820 - RNA, 22 nt, Human
uucauugugaacacauucugcc

SEQ ID NO: 340821 - RNA, 22 nt, Human
aucauucuaguccuuauggucu

SEQ ID NO: 340822 - RNA, 22 nt, Human
augcugugucaccuuaggauuu

SEQ ID NO: 340823 - RNA, 22 nt, Human
ugaggggaacugaugcccauug

SEQ ID NO: 340824 - RNA, 22 nt, Human
uuugaaaggagcuuuauccaga

SEQ ID NO: 340825 - RNA, 22 nt, Human
aguauaaagugguuuucagcac

SEQ ID NO: 340826 - RNA, 22 nt, Human
ucuuucaaugagcauucuuucc

SEQ ID NO: 340827 - RNA, 22 nt, Human
uucuucuucuggcugcaccugg

SEQ ID NO: 340828 - RNA, 22 nt, Human
cugcgcagggguggcgccagaa

SEQ ID NO: 340829 - RNA, 22 nt, Human
acccaggaggugacacagggcu

SEQ ID NO: 340830 - RNA, 22 nt, Human
gcaaagcauucuguggagucua

SEQ ID NO: 340831 - RNA, 22 nt, Human
ugaggcagucacccccuccugc

SEQ ID NO: 340832 - RNA, 22 nt, Human
ggaggugggcuaaggacucucu

SEQ ID NO: 340833 - RNA, 22 nt, Human
agggagcucacaguccaguaga

SEQ ID NO: 340834 - RNA, 22 nt, Human
gcccaggauucuuucuuccuua

SEQ ID NO: 340835 - RNA, 19 nt, Human
acauuuaaauucagaucuc

SEQ ID NO: 340836 - RNA, 22 nt, Human
agaggggaaggaugugauguga

SEQ ID NO: 340837 - RNA, 22 nt, Human
uuuccagguauuaauacuguau

SEQ ID NO: 340838 - RNA, 22 nt, Human
ggaggagguggguuaaguugua

SEQ ID NO: 340839 - RNA, 22 nt, Human
uaacacaugucugggaugugaa

SEQ ID NO: 340840 - RNA, 22 nt, Human
cacaaugugguuugucaucuuu

SEQ ID NO: 340841 - RNA, 22 nt, Human
uuucacauuuaggcgugaauug

SEQ ID NO: 340842 - RNA, 22 nt, Human
ugaggcaggaaguuauauaaug

SEQ ID NO: 340843 - RNA, 22 nt, Human
gugguuuucuccaacccagaac

SEQ ID NO: 340844 - RNA, 20 nt, Human
cagagccaagagcagcaucu

SEQ ID NO: 340845 - RNA, 22 nt, Human
uuucugcugugcuuucuugcgu

SEQ ID NO: 340846 - RNA, 20 nt, Human
cuucuucauuaacccuacug

SEQ ID NO: 340847 - RNA, 22 nt, Human
uugcagcugcaguaaauguuca

SEQ ID NO: 340848 - RNA, 22 nt, Human
uuucaucuucccagagaccuug

SEQ ID NO: 340849 - RNA, 22 nt, Human
agaggaggaagagcuuuaaaau

SEQ ID NO: 340850 - RNA, 22 nt, Human
cuagguauucauguuucguggc

SEQ ID NO: 340851 - RNA, 22 nt, Human
uagggauguaaacauaguaauu

SEQ ID NO: 340852 - RNA, 23 nt, Human
auguaucucauccaaggaagcuc

SEQ ID NO: 340853 - RNA, 22 nt, Human
gcucacugcaaccucugcuucc

SEQ ID NO: 340854 - RNA, 22 nt, Human
uuagacauguuugcuaaaauga

SEQ ID NO: 340855 - RNA, 22 nt, Human
aaucuuagguuuggcuucaucu

SEQ ID NO: 340856 - RNA, 22 nt, Human
cauuuguauagugcuuagacca

SEQ ID NO: 340857 - RNA, 22 nt, Human
aggcagcaugggcccagagucc

SEQ ID NO: 340858 - RNA, 21 nt, Human
cucaggauggcggccuggugg

SEQ ID NO: 340859 - RNA, 22 nt, Human
gaggcagcuuaggguacugacu

SEQ ID NO: 340860 - RNA, 22 nt, Human
uacagcauauacagaaugaaca

SEQ ID NO: 340861 - RNA, 22 nt, Human
aagacugugucuauggcuacuc

SEQ ID NO: 340862 - RNA, 22 nt, Human
ccaggcugagcaugauuggagc

SEQ ID NO: 340863 - RNA, 21 nt, Human
ucaggagagcccaucuacaaa

SEQ ID NO: 340864 - RNA, 22 nt, Human
aucaggaucugggagccugaaa

SEQ ID NO: 340865 - RNA, 22 nt, Human
uuccuuaguguuagauucugug

SEQ ID NO: 340866 - RNA, 22 nt, Human
agaaaacuugucacagcucuca

SEQ ID NO: 340867 - RNA, 22 nt, Human
caugcugugcaucuugaugacc

SEQ ID NO: 340868 - RNA, 22 nt, Human
uuuuccagagcugucucuugca

SEQ ID NO: 340869 - RNA, 22 nt, Human
aggcagacucaauggcuagaua

SEQ ID NO: 340870 - RNA, 22 nt, Human
agacaguguguguauauauggu

SEQ ID NO: 340871 - RNA, 22 nt, Human
uucuucucagggucccacaugg

SEQ ID NO: 340872 - RNA, 22 nt, Human
agugcuuuagagaaauggugcu

SEQ ID NO: 340873 - RNA, 22 nt, Human
ucuucaaguuccaaagugcagg

SEQ ID NO: 340874 - RNA, 22 nt, Human
ucugucaauauaugugcugcag

SEQ ID NO: 340875 - RNA, 21 nt, Human
gcucagaguauugcacuguuu

SEQ ID NO: 340876 - RNA, 22 nt, Human
agccagcuguucuggggcagca

SEQ ID NO: 340877 - RNA, 22 nt, Human
acaauguaggauauguacuugu

SEQ ID NO: 340878 - RNA, 22 nt, Human
uagauuuuacuucugucauuac

SEQ ID NO: 340879 - RNA, 17 nt, Human
agguauaaaaugguagc

SEQ ID NO: 340880 - RNA, 22 nt, Human
uagcauuucccaaaugcauuug

SEQ ID NO: 340881 - RNA, 22 nt, Human
cagcugacccgugggaggcggg

SEQ ID NO: 340882 - RNA, 21 nt, Human
agucuguuaggaugacucuga

SEQ ID NO: 340883 - RNA, 22 nt, Human
agaggggacagccaccugcccg

SEQ ID NO: 340884 - RNA, 22 nt, Human
aguguguccagaaaucuguauu

SEQ ID NO: 340885 - RNA, 22 nt, Human
uuguuauaaagacuaaauaugu

SEQ ID NO: 340886 - RNA, 22 nt, Human
uucugugauugacauguggcuu

SEQ ID NO: 340887 - RNA, 22 nt, Human
gggcacagaagucuaagacauc

SEQ ID NO: 340888 - RNA, 22 nt, Human
agaggaugauuuuaaggacacu

SEQ ID NO: 340889 - RNA, 22 nt, Human
gcauaugaucacgugugucggu

SEQ ID NO: 340890 - RNA, 21 nt, Human
uggagacucugguucuuugug

SEQ ID NO: 340891 - RNA, 22 nt, Human
cucacuguuuaauagcuggauc

SEQ ID NO: 340892 - RNA, 22 nt, Human
cuuuggcaaugucauuuucaau

SEQ ID NO: 340893 - RNA, 22 nt, Human
ucuggcaggcaaucggcucugg

SEQ ID NO: 340894 - RNA, 22 nt, Human
aacagcauaaguauuuauuuca

SEQ ID NO: 340895 - RNA, 22 nt, Human
cagaccagaaggaagccgacaa

SEQ ID NO: 340896 - RNA, 22 nt, Human
accaggaggaaguguuaaugau

SEQ ID NO: 340897 - RNA, 22 nt, Human
aucauucugauggucaaugcua

SEQ ID NO: 340898 - RNA, 22 nt, Human
uuuuucuuaaauguggguuggc

SEQ ID NO: 340899 - RNA, 22 nt, Human
aucaggauucaccccagagcug

SEQ ID NO: 340900 - RNA, 22 nt, Human
aguucuuuugugaacauaugcu

SEQ ID NO: 340901 - RNA, 22 nt, Human
uccuuagagacaagaccaguuu

SEQ ID NO: 340902 - RNA, 22 nt, Human
cauuuguaggaugcuucuuguu

SEQ ID NO: 340903 - RNA, 22 nt, Human
auguucuuucagccagugcauc

SEQ ID NO: 340904 - RNA, 19 nt, Human
ggucagcugggcuagaggc

SEQ ID NO: 340905 - RNA, 22 nt, Human
uggcagcuggagggcaauggcc

SEQ ID NO: 340906 - RNA, 22 nt, Human
uggcagcugucagaaugcaaau

SEQ ID NO: 340907 - RNA, 22 nt, Human
agauggagaccuuggaugaacu

SEQ ID NO: 340908 - RNA, 22 nt, Human
caaauaguuuuucauguauuau

SEQ ID NO: 340909 - RNA, 22 nt, Human
cagcugacgccagaguggaauu

SEQ ID NO: 340910 - RNA, 22 nt, Human
aaauaguuagcccugcauauau

SEQ ID NO: 340911 - RNA, 22 nt, Human
uucuugaaucacuuuagagaua

SEQ ID NO: 340912 - RNA, 22 nt, Human
ucaggagacuggcagugcccac

SEQ ID NO: 340913 - RNA, 22 nt, Human
acauuuuuauucaucaaagcag

SEQ ID NO: 340914 - RNA, 22 nt, Human
cuagcaucagaugagaagcugu

SEQ ID NO: 340915 - RNA, 22 nt, Human
uaggcagcagugcuaugauucu

SEQ ID NO: 340916 - RNA, 22 nt, Human
uuucaguuacugcuauaucauu

SEQ ID NO: 340917 - RNA, 22 nt, Human
aucugcaggaaugugugcagag

SEQ ID NO: 340918 - RNA, 22 nt, Human
uaaaaugaucucucauguucuu

SEQ ID NO: 340919 - RNA, 22 nt, Human
uuauuucauugauuucuaagac

SEQ ID NO: 340920 - RNA, 22 nt, Human
agccuuguuggucugaguuugg

SEQ ID NO: 340921 - RNA, 22 nt, Human
cccaggagguguagcugcgugg

SEQ ID NO: 340922 - RNA, 22 nt, Human
uggggcucaccuaggcuggaag

SEQ ID NO: 340923 - RNA, 23 nt, Human
agaggggagcaucugcuggcuga

SEQ ID NO: 340924 - RNA, 17 nt, Human
ucccaggaacagggaau

SEQ ID NO: 340925 - RNA, 23 nt, Human
ugaaacauuuaggguagaauuuc

SEQ ID NO: 340926 - RNA, 22 nt, Human
auugaaagauuuugggcucaug

SEQ ID NO: 340927 - RNA, 22 nt, Human
auugaaagcauggauuuggauu

SEQ ID NO: 340928 - RNA, 20 nt, Human
ucauuucuugggguuccaag

SEQ ID NO: 340929 - RNA, 20 nt, Human
ugaaggccauuuguuccaga

SEQ ID NO: 340930 - RNA, 22 nt, Human
gaccauuucuaggaaucagacu

SEQ ID NO: 340931 - RNA, 22 nt, Human
auaaauaucacuguugucccuc

SEQ ID NO: 340932 - RNA, 19 nt, Human
gagcgcagagggcagggga

SEQ ID NO: 340933 - RNA, 22 nt, Human
cccaggaggcagauguugcagu

SEQ ID NO: 340934 - RNA, 22 nt, Human
ucuuuccauggccacacagucu

SEQ ID NO: 340935 - RNA, 22 nt, Human
cccaggaacuccagagcuccuc

SEQ ID NO: 340936 - RNA, 22 nt, Human
acagucuugagcaucagccaga

SEQ ID NO: 340937 - RNA, 22 nt, Human
uucaggauucucucccauuuac

SEQ ID NO: 340938 - RNA, 22 nt, Human
auguuauggcucaaacauuugg

SEQ ID NO: 340939 - RNA, 22 nt, Human
gcuguguuugacaguagcagac

SEQ ID NO: 340940 - RNA, 22 nt, Human
auuaaauuaaguggcuaauuua

SEQ ID NO: 340941 - RNA, 22 nt, Human
uuucaaauagaaucuuuccaaa

SEQ ID NO: 340942 - RNA, 22 nt, Human
uuucaaaauuuugcagugguaa

SEQ ID NO: 340943 - RNA, 22 nt, Human
uugcuucaguagcucuuuaaag

SEQ ID NO: 340944 - RNA, 22 nt, Human
acuggaaaugagaugauaucag

SEQ ID NO: 340945 - RNA, 22 nt, Human
aucaggauuauuaaaucuggau

SEQ ID NO: 340946 - RNA, 22 nt, Human
aggggaugauccucccgcagcg

SEQ ID NO: 340947 - RNA, 22 nt, Human
agccuauuccaggaugagcuca

SEQ ID NO: 340948 - RNA, 22 nt, Human
uguucuuuggcuucacagcucu

SEQ ID NO: 340949 - RNA, 21 nt, Human
gaacauuuggguuguuucuac

SEQ ID NO: 340950 - RNA, 23 nt, Human
acagacaacacugaugagagaaa

SEQ ID NO: 340951 - RNA, 22 nt, Human
cccaggagaccuagaucuguuu

SEQ ID NO: 340952 - RNA, 23 nt, Human
cagcccuuccugcauguuuuugu

SEQ ID NO: 340953 - RNA, 20 nt, Human
aggaggggauagaaucaaag

SEQ ID NO: 340954 - RNA, 22 nt, Human
agagggcagggcgguaaguccu

SEQ ID NO: 340955 - RNA, 22 nt, Human
cagcauuuggugaucaucuuaa

SEQ ID NO: 340956 - RNA, 22 nt, Human
cccaggaaccuaccagcucgag

SEQ ID NO: 340957 - RNA, 22 nt, Human
gcucaggacccaggugugaccu

SEQ ID NO: 340958 - RNA, 22 nt, Human
uucugaaccauugagcacugcc

SEQ ID NO: 340959 - RNA, 22 nt, Human
uuguaaaugaccuuuucuaauu

SEQ ID NO: 340960 - RNA, 22 nt, Human
uguauaaauuuaaauuccugcu

SEQ ID NO: 340961 - RNA, 22 nt, Human
guaugaaaauuguaaaguucuu

SEQ ID NO: 340962 - RNA, 22 nt, Human
ggcaggcagaggcugagacagg

SEQ ID NO: 340963 - RNA, 22 nt, Human
aaauacuagaauucagaguuga

SEQ ID NO: 340964 - RNA, 22 nt, Human
uuggaugaagucuagcuuuagu

SEQ ID NO: 340965 - RNA, 22 nt, Human
aaggcagcaacuaauggaucuc

SEQ ID NO: 340966 - RNA, 22 nt, Human
ugaggggagcccgcccuggacg

SEQ ID NO: 340967 - RNA, 22 nt, Human
uugguuuagagagugugguuac

SEQ ID NO: 340968 - RNA, 22 nt, Human
ucucuucuagcuucuugugguu

SEQ ID NO: 340969 - RNA, 22 nt, Human
cucacugugaccucagcagaca

SEQ ID NO: 340970 - RNA, 22 nt, Human
uccaggagugauaaggccacug

SEQ ID NO: 340971 - RNA, 20 nt, Human
uccaugaguuagagacuaua

SEQ ID NO: 340972 - RNA, 22 nt, Human
uugauacaggccuucuagauga

SEQ ID NO: 340973 - RNA, 22 nt, Human
cucaggauuaaggaaucuaaau

SEQ ID NO: 340974 - RNA, 22 nt, Human
ugugaaaagggcuuuguacaaa

SEQ ID NO: 340975 - RNA, 22 nt, Human
uuagagucaagcugcauguucu

SEQ ID NO: 340976 - RNA, 22 nt, Human
gcugugcuugggaagaaucucu

SEQ ID NO: 340977 - RNA, 22 nt, Human
gagggagggccaggucccaacc

SEQ ID NO: 340978 - RNA, 20 nt, Human
gcccaagguccagaaggggg

SEQ ID NO: 340979 - RNA, 22 nt, Human
aggcaagcauugggaacagggc

SEQ ID NO: 340980 - RNA, 22 nt, Human
guuguuuugcaggauccuuaca

SEQ ID NO: 340981 - RNA, 22 nt, Human
caggacagcucaacaccuccuc

SEQ ID NO: 340982 - RNA, 22 nt, Human
ggcagaagauaggacagggaau

SEQ ID NO: 340983 - RNA, 22 nt, Human
cuggccaggcuugggacagaca

SEQ ID NO: 340984 - RNA, 22 nt, Human
caggcagcccugcaccaagugu

SEQ ID NO: 340985 - RNA, 22 nt, Human
uucugggacaucuggacaguuu

SEQ ID NO: 340986 - RNA, 22 nt, Human
ugcccaggaucuggcgaugcuc

SEQ ID NO: 340987 - RNA, 20 nt, Human
uuuacauuuugaaacaguga

SEQ ID NO: 340988 - RNA, 21 nt, Human
cugcuguggcccccgacaugc

SEQ ID NO: 340989 - RNA, 22 nt, Human
ccaggacaaguguggccauggc

SEQ ID NO: 340990 - RNA, 22 nt, Human
cccaggagaugcacuccauugg

SEQ ID NO: 340991 - RNA, 22 nt, Human
aggcaguuuaggcagcgauuua

SEQ ID NO: 340992 - RNA, 22 nt, Human
uuuauuuggcauccagggagaa

SEQ ID NO: 340993 - RNA, 22 nt, Human
cccaggagauaacguucccaag

SEQ ID NO: 340994 - RNA, 22 nt, Human
gaggagagccugcacuuugacc

SEQ ID NO: 340995 - RNA, 22 nt, Human
uuguaugaggauagcaagaagc

SEQ ID NO: 340996 - RNA, 22 nt, Human
agcaccuguugcacuucauaau

SEQ ID NO: 340997 - RNA, 22 nt, Human
uuugaaaguguuuacuugggaa

SEQ ID NO: 340998 - RNA, 22 nt, Human
gagaggggcccaagccacauag

SEQ ID NO: 340999 - RNA, 23 nt, Human
accaggagaaaagcuuugcggga

SEQ ID NO: 341000 - RNA, 22 nt, Human
aagggcagaauagagaagaugg

SEQ ID NO: 341001 - RNA, 23 nt, Human
cccagggacacgaugacaccucc

SEQ ID NO: 341002 - RNA, 22 nt, Human
agggagcuucuggccucagccu

SEQ ID NO: 341003 - RNA, 22 nt, Human
gucauauacacugcauguaauc

SEQ ID NO: 341004 - RNA, 20 nt, Human
agcaagaguaaggacagcga

SEQ ID NO: 341005 - RNA, 22 nt, Human
aguggcaguagaugagcugguu

SEQ ID NO: 341006 - RNA, 22 nt, Human
uucucacuauguauguagauug

SEQ ID NO: 341007 - RNA, 22 nt, Human
gaaaggccagcucacagaugag

SEQ ID NO: 341008 - RNA, 22 nt, Human
cuugaaagcacuccuuugacug

SEQ ID NO: 341009 - RNA, 22 nt, Human
uggaaauauacaaugugucucu

SEQ ID NO: 341010 - RNA, 22 nt, Human
cucuuaguaaugccaugaagca

SEQ ID NO: 341011 - RNA, 23 nt, Human
uuuauccaacucuguaaucucuc

SEQ ID NO: 341012 - RNA, 22 nt, Human
ucagguggcuuggagggggacg

SEQ ID NO: 341013 - RNA, 22 nt, Human
ucacaugaguauuauuuuccaa

SEQ ID NO: 341014 - RNA, 20 nt, Human
cccagguaggugccaugagu

SEQ ID NO: 341015 - RNA, 22 nt, Human
uucaggaugcagagguuguagu

SEQ ID NO: 341016 - RNA, 22 nt, Human
gguauaaaugaucagaucgcug

SEQ ID NO: 341017 - RNA, 22 nt, Human
uuucuucauucaccuucacccc

SEQ ID NO: 341018 - RNA, 22 nt, Human
cuucuucaaccugaaaguuuca

SEQ ID NO: 341019 - RNA, 23 nt, Human
aauguauguuaguaucuuagaga

SEQ ID NO: 341020 - RNA, 22 nt, Human
uucugucacuugcaaucaagag

SEQ ID NO: 341021 - RNA, 21 nt, Human
cuugaaagguagagucuacag

SEQ ID NO: 341022 - RNA, 22 nt, Human
agucugucuacuuaaagucugu

SEQ ID NO: 341023 - RNA, 22 nt, Human
ucauuucucccggccaaaaacu

SEQ ID NO: 341024 - RNA, 22 nt, Human
cauuguuaccaucuuuuaccua

SEQ ID NO: 341025 - RNA, 22 nt, Human
ggcaggcucagcagccaaggag

SEQ ID NO: 341026 - RNA, 22 nt, Human
aaggcaguaaaaucuaccuugc

SEQ ID NO: 341027 - RNA, 22 nt, Human
ggcagcugcaaaucugcucugu

SEQ ID NO: 341028 - RNA, 22 nt, Human
acauuucacuguucacagcagg

SEQ ID NO: 341029 - RNA, 22 nt, Human
ugcuuuggccacuagaauucag

SEQ ID NO: 341030 - RNA, 22 nt, Human
ucauauaaguuuaaaacuaucu

SEQ ID NO: 341031 - RNA, 23 nt, Human
auuugagaaaguauuuuuaagac

SEQ ID NO: 341032 - RNA, 22 nt, Human
aaaacuaaauacgcuuugccuc

SEQ ID NO: 341033 - RNA, 22 nt, Human
uugcauuuaaguagauguuaca

SEQ ID NO: 341034 - RNA, 22 nt, Human
ucagagagugcaaaauauagcu

SEQ ID NO: 341035 - RNA, 22 nt, Human
guccucuguuagaaaugugcuu

SEQ ID NO: 341036 - RNA, 22 nt, Human
aggccagcuuccagaggggcag

SEQ ID NO: 341037 - RNA, 22 nt, Human
ugaggcaggaauggggaaaagu

SEQ ID NO: 341038 - RNA, 22 nt, Human
uggaggaaguugcuggaaguca

SEQ ID NO: 341039 - RNA, 22 nt, Human
uguucauaucauuuugaaagcu

SEQ ID NO: 341040 - RNA, 22 nt, Human
aagcaccucuaugauugcuuuu

SEQ ID NO: 341041 - RNA, 23 nt, Human
uuuggacuugugacucuucuccu

SEQ ID NO: 341042 - RNA, 22 nt, Human
uguuuuaaagccauugccuuuc

SEQ ID NO: 341043 - RNA, 22 nt, Human
uaauuucacugauaugaaguca

SEQ ID NO: 341044 - RNA, 22 nt, Human
aucaggaucacugggagucuug

SEQ ID NO: 341045 - RNA, 22 nt, Human
gaaacuuacuuacucacauuuc

SEQ ID NO: 341046 - RNA, 22 nt, Human
caguugccuacuacauggcagg

SEQ ID NO: 341047 - RNA, 22 nt, Human
gucaggauuuuaaaaucccagu

SEQ ID NO: 341048 - RNA, 18 nt, Human
acacugcagcagucugcu

SEQ ID NO: 341049 - RNA, 22 nt, Human
uuauggcauauuccucauugua

SEQ ID NO: 341050 - RNA, 19 nt, Human
cccaggagcaguauugaug

SEQ ID NO: 341051 - RNA, 22 nt, Human
uugcaggaaacugagugugagc

SEQ ID NO: 341052 - RNA, 22 nt, Human
uaucuguugucuuuuacaugua

SEQ ID NO: 341053 - RNA, 22 nt, Human
aggcagccaucugcaggaagga

SEQ ID NO: 341054 - RNA, 22 nt, Human
gcucccagacugaccagaggug

SEQ ID NO: 341055 - RNA, 22 nt, Human
aggagggagcuuaagccaggca

SEQ ID NO: 341056 - RNA, 22 nt, Human
auugaaagguuuugagcagaua

SEQ ID NO: 341057 - RNA, 22 nt, Human
ucuuugcaaauguuauuaucuu

SEQ ID NO: 341058 - RNA, 21 nt, Human
cccagggaagccgcagucacc

SEQ ID NO: 341059 - RNA, 22 nt, Human
uuagaacugaagaagauuaagg

SEQ ID NO: 341060 - RNA, 19 nt, Human
uggagaggaaaugcugcuc

SEQ ID NO: 341061 - RNA, 22 nt, Human
ugaacuccaaauacugcugauu

SEQ ID NO: 341062 - RNA, 22 nt, Human
uuuggacuuagccugcagaauu

SEQ ID NO: 341063 - RNA, 22 nt, Human
uuuaaauggcauuuucccagau

SEQ ID NO: 341064 - RNA, 23 nt, Human
uccaugagaugugggcuucuagu

SEQ ID NO: 341065 - RNA, 22 nt, Human
ugcuuugggucucucuaguuuc

SEQ ID NO: 341066 - RNA, 22 nt, Human
augaaacaguguguauagcaaa

SEQ ID NO: 341067 - RNA, 22 nt, Human
caaaugauacuguuuuuagucu

SEQ ID NO: 341068 - RNA, 21 nt, Human
uugaaaguaaauucagcagcu

SEQ ID NO: 341069 - RNA, 22 nt, Human
aucuuucaguuucauaccaauu

SEQ ID NO: 341070 - RNA, 22 nt, Human
aggacagggauucaaacuccca

SEQ ID NO: 341071 - RNA, 22 nt, Human
uucacagauguauuggaacucc

SEQ ID NO: 341072 - RNA, 22 nt, Human
ccaggaugacccccacuuuccu

SEQ ID NO: 341073 - RNA, 22 nt, Human
aacaugcugccuuucuacgagu

SEQ ID NO: 341074 - RNA, 22 nt, Human
auacauacauguaugcacauac

SEQ ID NO: 341075 - RNA, 22 nt, Human
ugaggcagggaguuuaauuguc

SEQ ID NO: 341076 - RNA, 17 nt, Human
caaggccagcaucuuca

SEQ ID NO: 341077 - RNA, 22 nt, Human
uuugaaguucccccauaucaga

SEQ ID NO: 341078 - RNA, 22 nt, Human
aggggagguggcagaaaugugc

SEQ ID NO: 341079 - RNA, 22 nt, Human
uauuuccaccuauuauuuucug

SEQ ID NO: 341080 - RNA, 22 nt, Human
caaggccaguucaccaagggca

SEQ ID NO: 341081 - RNA, 22 nt, Human
ucucuguaguugggcagcugcu

SEQ ID NO: 341082 - RNA, 22 nt, Human
cagucucucugaaguauuaaga

SEQ ID NO: 341083 - RNA, 19 nt, Human
ugagaggcuuaaggcagcu

SEQ ID NO: 341084 - RNA, 22 nt, Human
acacaaauuguaggauaauugc

SEQ ID NO: 341085 - RNA, 19 nt, Human
aauacaguguuauagaauu

SEQ ID NO: 341086 - RNA, 22 nt, Human
gcagaggcuguagggaagguug

SEQ ID NO: 341087 - RNA, 16 nt, Human
auuuccagauuaugca

SEQ ID NO: 341088 - RNA, 22 nt, Human
ugaggcaggacuugcauaaagu

SEQ ID NO: 341089 - RNA, 22 nt, Human
ucaggauaaaauguaauggcaa

SEQ ID NO: 341090 - RNA, 22 nt, Human
cuauuacauuucuggacauuca

SEQ ID NO: 341091 - RNA, 22 nt, Human
ugagacaguuuuucuauuucca

SEQ ID NO: 341092 - RNA, 22 nt, Human
gagggcauaguuaaauaggagg

SEQ ID NO: 341093 - RNA, 20 nt, Human
cugagagucugugcuuaguc

SEQ ID NO: 341094 - RNA, 22 nt, Human
cucaggaucgcuugcccuaggg

SEQ ID NO: 341095 - RNA, 23 nt, Human
agaugaggcuucuccauguuggu

SEQ ID NO: 341096 - RNA, 22 nt, Human
agggagcuaggauccugaaggu

SEQ ID NO: 341097 - RNA, 22 nt, Human
ucacauucucagcaucuauaca

SEQ ID NO: 341098 - RNA, 22 nt, Human
aggagaggguggcauuaaguuu

SEQ ID NO: 341099 - RNA, 22 nt, Human
cauggagauaaacugaaauauu

SEQ ID NO: 341100 - RNA, 22 nt, Human
cccaggaggccaagguugcagu

SEQ ID NO: 341101 - RNA, 22 nt, Human
uccaugaguuugaggaaaagag

SEQ ID NO: 341102 - RNA, 22 nt, Human
ggcucagacucccaggcccucu

SEQ ID NO: 341103 - RNA, 22 nt, Human
aauguauggauucaugucugug

SEQ ID NO: 341104 - RNA, 22 nt, Human
uuaacaauagaguuucuucagg

SEQ ID NO: 341105 - RNA, 22 nt, Human
gggcagcucucacagcagccaa

SEQ ID NO: 341106 - RNA, 22 nt, Human
acaagguauccacauuaaaugu

SEQ ID NO: 341107 - RNA, 22 nt, Human
ugccaggagucaggccaggcag

SEQ ID NO: 341108 - RNA, 20 nt, Human
aucaggauucuugcuuuguu

SEQ ID NO: 341109 - RNA, 22 nt, Human
cuauuucaaggcccagauauga

SEQ ID NO: 341110 - RNA, 22 nt, Human
uucugucacuuuuuuggaaucu

SEQ ID NO: 341111 - RNA, 22 nt, Human
gaggccagaagugccucgggcu

SEQ ID NO: 341112 - RNA, 22 nt, Human
uacauucagcaaaagaaugguu

SEQ ID NO: 341113 - RNA, 22 nt, Human
aucauucuagcuguuguguuga

SEQ ID NO: 341114 - RNA, 22 nt, Human
gaaagauauuuauuggcaacag

SEQ ID NO: 341115 - RNA, 22 nt, Human
auucugucuuuuuauacaucua

SEQ ID NO: 341116 - RNA, 22 nt, Human
gaaucucaaggcuugugaggau

SEQ ID NO: 341117 - RNA, 22 nt, Human
auuugcuucugugaaaucaagu

SEQ ID NO: 341118 - RNA, 22 nt, Human
ucugcugugauuugcuaccugu

SEQ ID NO: 341119 - RNA, 17 nt, Human
caagagagaugacugga

SEQ ID NO: 341120 - RNA, 22 nt, Human
auuacucugucugccucugacc

SEQ ID NO: 341121 - RNA, 22 nt, Human
aguguuugagacacauuucacu

SEQ ID NO: 341122 - RNA, 22 nt, Human
ugaaguuauauauguugaaaau

SEQ ID NO: 341123 - RNA, 22 nt, Human
cccaagagcuucuaggacgcug

SEQ ID NO: 341124 - RNA, 22 nt, Human
uuuacauuucccucugucaguu

SEQ ID NO: 341125 - RNA, 22 nt, Human
cccaggagguggaguucacagu

SEQ ID NO: 341126 - RNA, 22 nt, Human
auuguucaaagugcuuugcaug

SEQ ID NO: 341127 - RNA, 22 nt, Human
uauaauuuggggaaaguggugu

SEQ ID NO: 341128 - RNA, 22 nt, Human
gaagcagcugccagagaugucu

SEQ ID NO: 341129 - RNA, 22 nt, Human
cggagaggugggggcagcaucu

SEQ ID NO: 341130 - RNA, 22 nt, Human
aaaauuauagaucuagugccug

SEQ ID NO: 341131 - RNA, 22 nt, Human
aaggcagccuuuguuugauuga

SEQ ID NO: 341132 - RNA, 22 nt, Human
cugcuguguuggcauuggauag

SEQ ID NO: 341133 - RNA, 22 nt, Human
uuuccuaggagauugaucacau

SEQ ID NO: 341134 - RNA, 22 nt, Human
aaugagacacgugaagcagaug

SEQ ID NO: 341135 - RNA, 22 nt, Human
cugcuguggccagccaggucaa

SEQ ID NO: 341136 - RNA, 15 nt, Human
uucaggauaugacuc

SEQ ID NO: 341137 - RNA, 22 nt, Human
agcaccaugaccuugccauuga

SEQ ID NO: 341138 - RNA, 22 nt, Human
uucaauucuaaacuaauauucu

SEQ ID NO: 341139 - RNA, 22 nt, Human
aggcuagcuuuggcucaguaaa

SEQ ID NO: 341140 - RNA, 22 nt, Human
uaucuuguaauagguccacuug

SEQ ID NO: 341141 - RNA, 22 nt, Human
ucauuucaaguucugacagcua

SEQ ID NO: 341142 - RNA, 22 nt, Human
aaaggccaagcaugagguggac

SEQ ID NO: 341143 - RNA, 22 nt, Human
aaauauagugacacuuauaguc

SEQ ID NO: 341144 - RNA, 22 nt, Human
uuuaaauuuguguuuagagggu

SEQ ID NO: 341145 - RNA, 22 nt, Human
uguccucagauaugucuacucu

SEQ ID NO: 341146 - RNA, 22 nt, Human
cuuaaaaucuggcaguuagcua

SEQ ID NO: 341147 - RNA, 22 nt, Human
cccaggaagagugaguggcauu

SEQ ID NO: 341148 - RNA, 22 nt, Human
ucugaaagaagggcagucuuuu

SEQ ID NO: 341149 - RNA, 22 nt, Human
uuugaauagcauaggauuacau

SEQ ID NO: 341150 - RNA, 22 nt, Human
uacuuuuuagcacagugugugc

SEQ ID NO: 341151 - RNA, 22 nt, Human
uuccaugaaggagacugagaag

SEQ ID NO: 341152 - RNA, 22 nt, Human
gaaacauaguugagacacugcu

SEQ ID NO: 341153 - RNA, 22 nt, Human
cuguauuucccacauucucuau

SEQ ID NO: 341154 - RNA, 22 nt, Human
cugucccuucauuauucacuac

SEQ ID NO: 341155 - RNA, 22 nt, Human
aaugucugagucucuguauccc

SEQ ID NO: 341156 - RNA, 23 nt, Human
uccaggagaauuccagggcccgg

SEQ ID NO: 341157 - RNA, 22 nt, Human
cucagugugaaugcucaguaaa

SEQ ID NO: 341158 - RNA, 21 nt, Human
uccaggagcacgggacuagga

SEQ ID NO: 341159 - RNA, 22 nt, Human
acuaaauacacacauuuguuca

SEQ ID NO: 341160 - RNA, 22 nt, Human
uguuugaaacuuugaucacuaa

SEQ ID NO: 341161 - RNA, 22 nt, Human
gaggcaguuugccaugccagga

SEQ ID NO: 341162 - RNA, 22 nt, Human
ggggggugcugaucaguggagc

SEQ ID NO: 341163 - RNA, 22 nt, Human
agcugcccuguggggaggguug

SEQ ID NO: 341164 - RNA, 22 nt, Human
ugcuguguggaugugaagaauc

SEQ ID NO: 341165 - RNA, 22 nt, Human
auuuguugcuagcagcacugau

SEQ ID NO: 341166 - RNA, 19 nt, Human
auguaugaggucuucugcu

SEQ ID NO: 341167 - RNA, 19 nt, Human
cccucuugcacaaagcaaa

SEQ ID NO: 341168 - RNA, 22 nt, Human
auucauuugcuauuguguaugg

SEQ ID NO: 341169 - RNA, 22 nt, Human
ugaguucucacccauucuucuu

SEQ ID NO: 341170 - RNA, 22 nt, Human
cuuuuauuuugaauuaagggcu

SEQ ID NO: 341171 - RNA, 17 nt, Human
agcugaccagauggacu

SEQ ID NO: 341172 - RNA, 22 nt, Human
aaggcagcaggauuuggugacu

SEQ ID NO: 341173 - RNA, 22 nt, Human
uucuucuucaagugcugcauuc

SEQ ID NO: 341174 - RNA, 22 nt, Human
caucacccggaacugugucugc

SEQ ID NO: 341175 - RNA, 22 nt, Human
aaaggugacugcagcagcuauu

SEQ ID NO: 341176 - RNA, 22 nt, Human
cauuuguagcuauuuacuguau

SEQ ID NO: 341177 - RNA, 22 nt, Human
uuuucguuuauuugacauguaa

SEQ ID NO: 341178 - RNA, 22 nt, Human
aauguaugugcaucauuuacau

SEQ ID NO: 341179 - RNA, 22 nt, Human
agacccagaaagcagcugcauu

SEQ ID NO: 341180 - RNA, 22 nt, Human
cauaauaucuccgauuacuugc

SEQ ID NO: 341181 - RNA, 22 nt, Human
uugcugaaaacaguggguauug

SEQ ID NO: 341182 - RNA, 22 nt, Human
cuccaggaaaauagggaaugag

SEQ ID NO: 341183 - RNA, 22 nt, Human
aggccagccucaggcagggacc

SEQ ID NO: 341184 - RNA, 22 nt, Human
uguauaaacuuaagcaggaacc

SEQ ID NO: 341185 - RNA, 22 nt, Human
gccaggaguguguggcuauguu

SEQ ID NO: 341186 - RNA, 22 nt, Human
uauuuuaaagugaagggucuug

SEQ ID NO: 341187 - RNA, 22 nt, Human
agcagagguguuuauuauggga

SEQ ID NO: 341188 - RNA, 22 nt, Human
gcaggagaaaugaagauugggu

SEQ ID NO: 341189 - RNA, 22 nt, Human
ugagaacugaggauuugaauuc

SEQ ID NO: 341190 - RNA, 23 nt, Human
uucuuucaagaaguucacagugc

SEQ ID NO: 341191 - RNA, 22 nt, Human
uccugagagcagcugcuuugga

SEQ ID NO: 341192 - RNA, 22 nt, Human
uuaauacaagcauaugcacaca

SEQ ID NO: 341193 - RNA, 21 nt, Human
uugaccaagggugcgugcucc

SEQ ID NO: 341194 - RNA, 22 nt, Human
ugaaaugacaaagguuuuucuu

SEQ ID NO: 341195 - RNA, 22 nt, Human
ucccaggaaugucugaaaguga

SEQ ID NO: 341196 - RNA, 22 nt, Human
uuugaaagagcugauacaugaa

SEQ ID NO: 341197 - RNA, 22 nt, Human
aguaugaagauuauaauuuuuc

SEQ ID NO: 341198 - RNA, 22 nt, Human
uuagccauuuuauacaagugua

SEQ ID NO: 341199 - RNA, 22 nt, Human
augugaggcagcacggagauua

SEQ ID NO: 341200 - RNA, 22 nt, Human
cacaugcaucugucauguuugg

SEQ ID NO: 341201 - RNA, 22 nt, Human
uucuccaacacaagcaugaugu

SEQ ID NO: 341202 - RNA, 22 nt, Human
aucuuucuauuucuaaaaacua

SEQ ID NO: 341203 - RNA, 22 nt, Human
agugcuuuaccuagauaauguu

SEQ ID NO: 341204 - RNA, 22 nt, Human
cuccccagguucaggagguggg

SEQ ID NO: 341205 - RNA, 22 nt, Human
ucucauugguauauacaugugu

SEQ ID NO: 341206 - RNA, 19 nt, Human
ccaggagagcuuggagaag

SEQ ID NO: 341207 - RNA, 16 nt, Human
ucccaggaggcggaac

SEQ ID NO: 341208 - RNA, 22 nt, Human
uagcuaucuguguccagaucca

SEQ ID NO: 341209 - RNA, 22 nt, Human
cuuagaaaucgaacucagguua

SEQ ID NO: 341210 - RNA, 22 nt, Human
aguuagaaaguaaaucauuuga

SEQ ID NO: 341211 - RNA, 22 nt, Human
gcauguguggaggagaugugcu

SEQ ID NO: 341212 - RNA, 22 nt, Human
uggcagcugcguuguguuucug

SEQ ID NO: 341213 - RNA, 22 nt, Human
uaggagaggugaauggcacacu

SEQ ID NO: 341214 - RNA, 19 nt, Human
agccuggcuuugcucugcu

SEQ ID NO: 341215 - RNA, 22 nt, Human
aguuauuacucuuuaacauauu

SEQ ID NO: 341216 - RNA, 22 nt, Human
cccaaggacacgggcagggaca

SEQ ID NO: 341217 - RNA, 23 nt, Human
uggcagcuguguaagagaaagca

SEQ ID NO: 341218 - RNA, 22 nt, Human
uucuucuucauuucugacgaug

SEQ ID NO: 341219 - RNA, 22 nt, Human
gucuucuuuaaccuacuaaagc

SEQ ID NO: 341220 - RNA, 22 nt, Human
gugaaggacuagcauggagggc

SEQ ID NO: 341221 - RNA, 22 nt, Human
gaggcagcagaacauggaagag

SEQ ID NO: 341222 - RNA, 22 nt, Human
cauguuuacuaccaggagaaug

SEQ ID NO: 341223 - RNA, 21 nt, Human
auucugucaucccagcuacuu

SEQ ID NO: 341224 - RNA, 22 nt, Human
aggguaggaacugaguggaagg

SEQ ID NO: 341225 - RNA, 22 nt, Human
auacuucuuugauguucacagg

SEQ ID NO: 341226 - RNA, 22 nt, Human
uuacaagcagcuacauaucaca

SEQ ID NO: 341227 - RNA, 22 nt, Human
cagagccauuauggagacuugc

SEQ ID NO: 341228 - RNA, 22 nt, Human
cugcuuuguaaaauagacauaa

SEQ ID NO: 341229 - RNA, 22 nt, Human
uuauacuaaaacgcauugaauu

SEQ ID NO: 341230 - RNA, 22 nt, Human
uaugaacuguacuguacuaagc

SEQ ID NO: 341231 - RNA, 22 nt, Human
gaggcugcccaacuggagugga

SEQ ID NO: 341232 - RNA, 22 nt, Human
cauacaagcguucaauagaugu

SEQ ID NO: 341233 - RNA, 22 nt, Human
aggcaccuugcgguccagugaa

SEQ ID NO: 341234 - RNA, 22 nt, Human
ggaccuggcaauuugcaucucu

SEQ ID NO: 341235 - RNA, 22 nt, Human
aaguauaagcuauucuucauga

SEQ ID NO: 341236 - RNA, 22 nt, Human
uccucagacuucccuuugugua

SEQ ID NO: 341237 - RNA, 22 nt, Human
uccauuuuucaugacuccucaa

SEQ ID NO: 341238 - RNA, 22 nt, Human
ucacaauacucacucaauggcu

SEQ ID NO: 341239 - RNA, 22 nt, Human
ccaggacagugaacauguaaga

SEQ ID NO: 341240 - RNA, 22 nt, Human
ucauauaacuggauauuuucaa

SEQ ID NO: 341241 - RNA, 22 nt, Human
auuugcuuuuacuauguuaaaa

SEQ ID NO: 341242 - RNA, 22 nt, Human
gaggggagacagggaaaucagu

SEQ ID NO: 341243 - RNA, 19 nt, Human
uuagccauccacagugaaa

SEQ ID NO: 341244 - RNA, 22 nt, Human
ucuuagaaguuuauggcacgga

SEQ ID NO: 341245 - RNA, 22 nt, Human
caguuucuuggaugccaauuuc

SEQ ID NO: 341246 - RNA, 22 nt, Human
acaaucauuccguucacaacag

SEQ ID NO: 341247 - RNA, 18 nt, Human
uaggagagaauuuauuua

SEQ ID NO: 341248 - RNA, 22 nt, Human
caugaaauugcuccuuuggugc

SEQ ID NO: 341249 - RNA, 22 nt, Human
uagcuuuccuuguugccugugc

SEQ ID NO: 341250 - RNA, 22 nt, Human
uaucauuguguuauuucuucca

SEQ ID NO: 341251 - RNA, 19 nt, Human
augucuggguaacagcugc

SEQ ID NO: 341252 - RNA, 22 nt, Human
gaaauauugggacucagagcuu

SEQ ID NO: 341253 - RNA, 22 nt, Human
gcugccagccaacuugcugugc

SEQ ID NO: 341254 - RNA, 22 nt, Human
caggacagagcccagacugugu

SEQ ID NO: 341255 - RNA, 22 nt, Human
uguuguuuucucauggagaaua

SEQ ID NO: 341256 - RNA, 22 nt, Human
cuugcugucccuugguaugaac

SEQ ID NO: 341257 - RNA, 22 nt, Human
caggcagccuucucgucucaca

SEQ ID NO: 341258 - RNA, 22 nt, Human
aggcggcuccgggagugugggc

SEQ ID NO: 341259 - RNA, 22 nt, Human
cuuugcaaacgauuaccacaug

SEQ ID NO: 341260 - RNA, 22 nt, Human
uuauuauagauuaugcaagauu

SEQ ID NO: 341261 - RNA, 22 nt, Human
aaagcagacugauuugcaucac

SEQ ID NO: 341262 - RNA, 22 nt, Human
uagcccagcaugagcagagcug

SEQ ID NO: 341263 - RNA, 22 nt, Human
uucagaaugugaccuuauuugg

SEQ ID NO: 341264 - RNA, 22 nt, Human
cagaccucaguccucaguagga

SEQ ID NO: 341265 - RNA, 23 nt, Human
ucucaagaggaagcagggcucau

SEQ ID NO: 341266 - RNA, 22 nt, Human
cuguuucaagugaagucagaca

SEQ ID NO: 341267 - RNA, 22 nt, Human
cuugcaggauuuugcugcugua

SEQ ID NO: 341268 - RNA, 19 nt, Human
agcauuuggaauucuacac

SEQ ID NO: 341269 - RNA, 21 nt, Human
ugaaaugagaaugcugagcac

SEQ ID NO: 341270 - RNA, 22 nt, Human
uuggaaagcaagcuggacauac

SEQ ID NO: 341271 - RNA, 23 nt, Human
uaugaacugcauugcuggugugu

SEQ ID NO: 341272 - RNA, 22 nt, Human
auugugcaaauauuaucuguag

SEQ ID NO: 341273 - RNA, 22 nt, Human
uccauucauucauugaugaaca

SEQ ID NO: 341274 - RNA, 22 nt, Human
caggcagcugcuggguucagcc

SEQ ID NO: 341275 - RNA, 22 nt, Human
ucuuugcaggccaaauuguuaa

SEQ ID NO: 341276 - RNA, 22 nt, Human
caauacuuccuuguuagaggca

SEQ ID NO: 341277 - RNA, 22 nt, Human
acaugauuuuuaaagagauaau

SEQ ID NO: 341278 - RNA, 22 nt, Human
gccaggagacuccauucauuug

SEQ ID NO: 341279 - RNA, 22 nt, Human
uuuaacagaugcuaugucuacc

SEQ ID NO: 341280 - RNA, 22 nt, Human
cuugaaagcuuugcgucuucua

SEQ ID NO: 341281 - RNA, 22 nt, Human
ggagagugggagcaacuguugc

SEQ ID NO: 341282 - RNA, 22 nt, Human
aggaggcacucacucucagggu

SEQ ID NO: 341283 - RNA, 20 nt, Human
augugaaagaucaguugucu

SEQ ID NO: 341284 - RNA, 22 nt, Human
gaccauuuguugaaaagauuau

SEQ ID NO: 341285 - RNA, 22 nt, Human
acugauuacacgaguucugacu

SEQ ID NO: 341286 - RNA, 21 nt, Human
ugaggcaggggugcuuuuguc

SEQ ID NO: 341287 - RNA, 19 nt, Human
gcuuuggagggagguucua

SEQ ID NO: 341288 - RNA, 22 nt, Human
ccccaggagaaaucuuaaacua

SEQ ID NO: 341289 - RNA, 22 nt, Human
ucuaaccuuugaaacugcuuuc

SEQ ID NO: 341290 - RNA, 20 nt, Human
gggagucuggaugaaagaug

SEQ ID NO: 341291 - RNA, 22 nt, Human
auggaaagugcauggaagucau

SEQ ID NO: 341292 - RNA, 22 nt, Human
uuuccuaguucuaagaaaugua

SEQ ID NO: 341293 - RNA, 22 nt, Human
uuucauugaugggugauagaaa

SEQ ID NO: 341294 - RNA, 22 nt, Human
ugcuguggcaguuuauguauag

SEQ ID NO: 341295 - RNA, 22 nt, Human
gagaggugaaggcugcccuggg

SEQ ID NO: 341296 - RNA, 22 nt, Human
gaggagagagggacugucugca

SEQ ID NO: 341297 - RNA, 20 nt, Human
acaggggcagcacaauaaug

SEQ ID NO: 341298 - RNA, 22 nt, Human
ucaucuugcugccauugcuuua

SEQ ID NO: 341299 - RNA, 22 nt, Human
ccucaggggucacugugaggag

SEQ ID NO: 341300 - RNA, 22 nt, Human
uugauacauuuuuaggauaaac

SEQ ID NO: 341301 - RNA, 18 nt, Human
acugugugaauuagcucc

SEQ ID NO: 341302 - RNA, 21 nt, Human
auacacauacacauaaaugug

SEQ ID NO: 341303 - RNA, 22 nt, Human
augcugugauuguagaaauauu

SEQ ID NO: 341304 - RNA, 22 nt, Human
aggaugaggcuggcaggucuug

SEQ ID NO: 341305 - RNA, 22 nt, Human
auacaaagacaaaucucaaucu

SEQ ID NO: 341306 - RNA, 23 nt, Human
aaacuacauuuauaguuuuucuc

SEQ ID NO: 341307 - RNA, 22 nt, Human
uggaggaaaaaaccaggcagag

SEQ ID NO: 341308 - RNA, 20 nt, Human
ccagaagagaugaucaucca

SEQ ID NO: 341309 - RNA, 22 nt, Human
uucuucuugaaacuuuagguug

SEQ ID NO: 341310 - RNA, 22 nt, Human
agggggugcccagaugaaggau

SEQ ID NO: 341311 - RNA, 22 nt, Human
uaaucuguguaccuucaucgga

SEQ ID NO: 341312 - RNA, 22 nt, Human
uccuuagagauacugucuugaa

SEQ ID NO: 341313 - RNA, 22 nt, Human
ccacagagacaggguccuugcu

SEQ ID NO: 341314 - RNA, 22 nt, Human
gucuccugagacugcagucacc

SEQ ID NO: 341315 - RNA, 22 nt, Human
aaaguucuuucucuuauuuggu

SEQ ID NO: 341316 - RNA, 22 nt, Human
auguagaauggugauuggcagg

SEQ ID NO: 341317 - RNA, 20 nt, Human
ggggcugcaugcagagaaga

SEQ ID NO: 341318 - RNA, 23 nt, Human
cuuuuaacuugaucugagaccag

SEQ ID NO: 341319 - RNA, 22 nt, Human
uucuucagucccacuagccaca

SEQ ID NO: 341320 - RNA, 22 nt, Human
gccaggaggcugcuguguaggc

SEQ ID NO: 341321 - RNA, 22 nt, Human
uaggaaauggcucaguuacugc

SEQ ID NO: 341322 - RNA, 22 nt, Human
auugucuuuccacugagaaguu

SEQ ID NO: 341323 - RNA, 22 nt, Human
ugcugaugcuguucuguuagga

SEQ ID NO: 341324 - RNA, 22 nt, Human
gcaguucuacuuauccauagac

SEQ ID NO: 341325 - RNA, 22 nt, Human
uuugcagugauucuugcaguga

SEQ ID NO: 341326 - RNA, 22 nt, Human
aaguauuucuggccugugaaag

SEQ ID NO: 341327 - RNA, 22 nt, Human
cagaagaggacuggguagcuca

SEQ ID NO: 341328 - RNA, 22 nt, Human
gaggcagagugcaccccaggag

SEQ ID NO: 341329 - RNA, 22 nt, Human
guguguuuagcauuagcagggg

SEQ ID NO: 341330 - RNA, 22 nt, Human
ugaggcagguggauuacaaggu

SEQ ID NO: 341331 - RNA, 22 nt, Human
cugccaucugagccaaaagugc

SEQ ID NO: 341332 - RNA, 22 nt, Human
ucauacaauucaaucucugauu

SEQ ID NO: 341333 - RNA, 22 nt, Human
uauuuguauguguguacauaua

SEQ ID NO: 341334 - RNA, 22 nt, Human
uuuggaaugguaccuucaguug

SEQ ID NO: 341335 - RNA, 22 nt, Human
auacaacagaaaaugauuauuc

SEQ ID NO: 341336 - RNA, 22 nt, Human
uccaggagggggagccgugccg

SEQ ID NO: 341337 - RNA, 22 nt, Human
uguaugaagacuucuucugugu

SEQ ID NO: 341338 - RNA, 22 nt, Human
auucacaguuuccucauauucu

SEQ ID NO: 341339 - RNA, 22 nt, Human
caagagagaugcagcucacuca

SEQ ID NO: 341340 - RNA, 22 nt, Human
uauauguaaauaagucuaaugu

SEQ ID NO: 341341 - RNA, 22 nt, Human
uuaguuuucccaucuuuauggu

SEQ ID NO: 341342 - RNA, 21 nt, Human
uucucagaucgaguagugaga

SEQ ID NO: 341343 - RNA, 22 nt, Human
ggauggcauguugggcucuguu

SEQ ID NO: 341344 - RNA, 22 nt, Human
gcugcugucacggugcuaaggg

SEQ ID NO: 341345 - RNA, 22 nt, Human
aggcagaggagaaugaucuucc

SEQ ID NO: 341346 - RNA, 22 nt, Human
guguaugagccuccagcugggc

SEQ ID NO: 341347 - RNA, 22 nt, Human
cccaggagcuucucucugccuc

SEQ ID NO: 341348 - RNA, 23 nt, Human
agggagcuaaaaggcuggagcag

SEQ ID NO: 341349 - RNA, 22 nt, Human
gggcagcucugcccaucagagg

SEQ ID NO: 341350 - RNA, 20 nt, Human
ggcagcuugggcagcaguua

SEQ ID NO: 341351 - RNA, 22 nt, Human
agagggauaauauguauuguaa

SEQ ID NO: 341352 - RNA, 22 nt, Human
agaccgagaaguucuccaggcc

SEQ ID NO: 341353 - RNA, 22 nt, Human
augugaggaagaaagagguaag

SEQ ID NO: 341354 - RNA, 22 nt, Human
aaugucauugguaaagauuagg

SEQ ID NO: 341355 - RNA, 22 nt, Human
ggugaagggugucauggcauuu

SEQ ID NO: 341356 - RNA, 22 nt, Human
cccaggagguggagguugcggu

SEQ ID NO: 341357 - RNA, 20 nt, Human
uuucaagucagcaauucuca

SEQ ID NO: 341358 - RNA, 22 nt, Human
ggcuuggaaaugguaaugagcu

SEQ ID NO: 341359 - RNA, 22 nt, Human
ucaguucuuuauuucacaguga

SEQ ID NO: 341360 - RNA, 22 nt, Human
ucugcuguaaagaauuucugcc

SEQ ID NO: 341361 - RNA, 22 nt, Human
ucuuugaauucaaacuguucaa

SEQ ID NO: 341362 - RNA, 22 nt, Human
cccaggaaaagcagugccagca

SEQ ID NO: 341363 - RNA, 23 nt, Human
uuucacaaugagcauuacagaau

SEQ ID NO: 341364 - RNA, 22 nt, Human
gagcagcugagcuggaaugaga

SEQ ID NO: 341365 - RNA, 22 nt, Human
ucagcugcucaaauuuauguca

SEQ ID NO: 341366 - RNA, 22 nt, Human
aggcaggcaaccaccugggaag

SEQ ID NO: 341367 - RNA, 22 nt, Human
agucugucugucacuucugcag

SEQ ID NO: 341368 - RNA, 22 nt, Human
auguuucaaugcacuuuagccu

SEQ ID NO: 341369 - RNA, 22 nt, Human
gagguggaaggcaggaacaaau

SEQ ID NO: 341370 - RNA, 22 nt, Human
uaaaguuuggcagacaauaaca

SEQ ID NO: 341371 - RNA, 22 nt, Human
uaacacauauuucaagaguagu

SEQ ID NO: 341372 - RNA, 22 nt, Human
agggcagccucucagccuaggu

SEQ ID NO: 341373 - RNA, 19 nt, Human
acaaaugauguugcacuga

SEQ ID NO: 341374 - RNA, 22 nt, Human
uuagccauuaaauuacaaggug

SEQ ID NO: 341375 - RNA, 22 nt, Human
ugaaucugauuucccuggaggc

SEQ ID NO: 341376 - RNA, 22 nt, Human
ccucaugguacuuacuguagcu

SEQ ID NO: 341377 - RNA, 22 nt, Human
aagggcagccugacucacgguc

SEQ ID NO: 341378 - RNA, 22 nt, Human
cagcugccugucuggaggcaau

SEQ ID NO: 341379 - RNA, 22 nt, Human
ugccaggauggccagggggcca

SEQ ID NO: 341380 - RNA, 22 nt, Human
gccaggagagcuccuucagguu

SEQ ID NO: 341381 - RNA, 22 nt, Human
aggcagugcugugcccugaacc

SEQ ID NO: 341382 - RNA, 22 nt, Human
uagcacaucuucuuggccugca

SEQ ID NO: 341383 - RNA, 22 nt, Human
uucuucuuuccuauaauuaauu

SEQ ID NO: 341384 - RNA, 22 nt, Human
caggcagcaggagcccugcucg

SEQ ID NO: 341385 - RNA, 22 nt, Human
cuguuaaucugcuugcaugaug

SEQ ID NO: 341386 - RNA, 22 nt, Human
aucugccuggcuccaggugagc

SEQ ID NO: 341387 - RNA, 22 nt, Human
aggcaagcauuuaaccacucau

SEQ ID NO: 341388 - RNA, 22 nt, Human
uuucuuaguccuagagugauuu

SEQ ID NO: 341389 - RNA, 22 nt, Human
aauucuguuacuaaugugaugu

SEQ ID NO: 341390 - RNA, 17 nt, Human
cccaugagcccacuccc

SEQ ID NO: 341391 - RNA, 22 nt, Human
cuguaguugaugauuucugaua

SEQ ID NO: 341392 - RNA, 23 nt, Human
uuugaaguugacugccuuccaga

SEQ ID NO: 341393 - RNA, 22 nt, Human
uagaauucauguuacuguuagc

SEQ ID NO: 341394 - RNA, 22 nt, Human
agucauaugacccuucacaaac

SEQ ID NO: 341395 - RNA, 22 nt, Human
ggccagcucugcacagcagcug

SEQ ID NO: 341396 - RNA, 22 nt, Human
ccucuucuagguuucagccugc

SEQ ID NO: 341397 - RNA, 22 nt, Human
gacccaggguauccagagcugc

SEQ ID NO: 341398 - RNA, 22 nt, Human
uacauguauguguacgugcaug

SEQ ID NO: 341399 - RNA, 22 nt, Human
gccaggagaaugcuagcagagg

SEQ ID NO: 341400 - RNA, 22 nt, Human
cucaucugauaaaucacucuua

SEQ ID NO: 341401 - RNA, 22 nt, Human
aggcugcugccuuggagagugu

SEQ ID NO: 341402 - RNA, 22 nt, Human
cucuucuugcuagacugagugc

SEQ ID NO: 341403 - RNA, 23 nt, Human
acugucugauauguuuuccauca

SEQ ID NO: 341404 - RNA, 22 nt, Human
gauuucuuuagguguaauagug

SEQ ID NO: 341405 - RNA, 22 nt, Human
acaugcauaggagaagucuuua

SEQ ID NO: 341406 - RNA, 23 nt, Human
gugagucuugccuuugcugugga

SEQ ID NO: 341407 - RNA, 22 nt, Human
gaaggccaguuuugagauaggu

SEQ ID NO: 341408 - RNA, 22 nt, Human
accauccugaaaccuucaugcu

SEQ ID NO: 341409 - RNA, 22 nt, Human
uggcagagugcagaagaggcau

SEQ ID NO: 341410 - RNA, 22 nt, Human
ucugucuucaucagcaugugau

SEQ ID NO: 341411 - RNA, 22 nt, Human
cccuggagguggagguugcagg

SEQ ID NO: 341412 - RNA, 22 nt, Human
uuugaaagucaaccuuccaguu

SEQ ID NO: 341413 - RNA, 22 nt, Human
cugcuguggugucaagcaucuc

SEQ ID NO: 341414 - RNA, 22 nt, Human
ucauuuguugcuguuaccugag

SEQ ID NO: 341415 - RNA, 22 nt, Human
ugacaguuaagguauacauuca

SEQ ID NO: 341416 - RNA, 22 nt, Human
cccaggaggacauuccauaccc

SEQ ID NO: 341417 - RNA, 22 nt, Human
agcccagggacagggcggaugu

SEQ ID NO: 341418 - RNA, 22 nt, Human
ccaggcugccgaggaaagaaag

SEQ ID NO: 341419 - RNA, 22 nt, Human
ugugugucagagucuccauggu

SEQ ID NO: 341420 - RNA, 22 nt, Human
ucaggagacaaagggugcggag

SEQ ID NO: 341421 - RNA, 22 nt, Human
ccaggagacuguacugauauuu

SEQ ID NO: 341422 - RNA, 22 nt, Human
uauaucaccaaaaacaguucug

SEQ ID NO: 341423 - RNA, 19 nt, Human
ucaucucacagggccuggc

SEQ ID NO: 341424 - RNA, 22 nt, Human
gguaugaaaugauuccauguua

SEQ ID NO: 341425 - RNA, 22 nt, Human
uguaggccuauguccagcaauu

SEQ ID NO: 341426 - RNA, 23 nt, Human
cccauuuucauguuaacuccugg

SEQ ID NO: 341427 - RNA, 22 nt, Human
ggcaugcugcguacagaugaac

SEQ ID NO: 341428 - RNA, 23 nt, Human
auggaagucacuguuuucuuguc

SEQ ID NO: 341429 - RNA, 19 nt, Human
aaacacagauuucuuacca

SEQ ID NO: 341430 - RNA, 22 nt, Human
cugcucuaauaucagauagacu

SEQ ID NO: 341431 - RNA, 22 nt, Human
auuugcuugugcuaugaaaguu

SEQ ID NO: 341432 - RNA, 22 nt, Human
aguacauauaguaauuuagcca

SEQ ID NO: 341433 - RNA, 22 nt, Human
ggugaguugggguucacagguc

SEQ ID NO: 341434 - RNA, 22 nt, Human
uucucagaauugacugggagca

SEQ ID NO: 341435 - RNA, 22 nt, Human
uccagccuaggggaacagcugc

SEQ ID NO: 341436 - RNA, 22 nt, Human
uacuaucucuucuaacuucaga

SEQ ID NO: 341437 - RNA, 22 nt, Human
aaggccagccugagagcuaaca

SEQ ID NO: 341438 - RNA, 23 nt, Human
aaugauuucaugaugauagcagc

SEQ ID NO: 341439 - RNA, 18 nt, Human
uggcagcuagguaaagaa

SEQ ID NO: 341440 - RNA, 22 nt, Human
uucugucaugcucauguaauug

SEQ ID NO: 341441 - RNA, 22 nt, Human
augaggcaucugcagucacuag

SEQ ID NO: 341442 - RNA, 22 nt, Human
ucugcaggcucuagaugagguu

SEQ ID NO: 341443 - RNA, 20 nt, Human
uuucacaaugaacaugucuc

SEQ ID NO: 341444 - RNA, 22 nt, Human
ucugggaauuuauuggcacuuu

SEQ ID NO: 341445 - RNA, 22 nt, Human
aacugcuguggccuaguacuua

SEQ ID NO: 341446 - RNA, 22 nt, Human
ugccgcagugcggggagggccc

SEQ ID NO: 341447 - RNA, 22 nt, Human
gcccaggagguugggcugugca

SEQ ID NO: 341448 - RNA, 22 nt, Human
ucugauuagagcauucuugagu

SEQ ID NO: 341449 - RNA, 21 nt, Human
cccaggagaagaaaagaugca

SEQ ID NO: 341450 - RNA, 17 nt, Human
aggcaggcagagcggga

SEQ ID NO: 341451 - RNA, 22 nt, Human
auuucauacuaaggcucaaaaa

SEQ ID NO: 341452 - RNA, 23 nt, Human
gggcaguuauguuguccuuggcu

SEQ ID NO: 341453 - RNA, 22 nt, Human
ugcuagugcaggguuuucaguu

SEQ ID NO: 341454 - RNA, 22 nt, Human
gcccaggacucagggugucgcg

SEQ ID NO: 341455 - RNA, 22 nt, Human
auuacaguaacagcuacaaugc

SEQ ID NO: 341456 - RNA, 22 nt, Human
auucaaguggcugcuauguuaa

SEQ ID NO: 341457 - RNA, 22 nt, Human
ggagugggaacaaugacauggu

SEQ ID NO: 341458 - RNA, 19 nt, Human
uggcaggcccaggauggac

SEQ ID NO: 341459 - RNA, 22 nt, Human
uugcucagcacuggagccagcu

SEQ ID NO: 341460 - RNA, 22 nt, Human
uugaagagugccuuccagacau

SEQ ID NO: 341461 - RNA, 22 nt, Human
aaacagcaggaacaucuugcca

SEQ ID NO: 341462 - RNA, 22 nt, Human
aggcagaugggagcuggaaguu

SEQ ID NO: 341463 - RNA, 22 nt, Human
ccaggauggggagcagauagaa

SEQ ID NO: 341464 - RNA, 22 nt, Human
auguggaggaaaugaguguaca

SEQ ID NO: 341465 - RNA, 22 nt, Human
cagugaaaucacaacuuuaguu

SEQ ID NO: 341466 - RNA, 22 nt, Human
ugaggcaggagaaucaccggaa

SEQ ID NO: 341467 - RNA, 23 nt, Human
cugcugugaaacaugguuuuggu

SEQ ID NO: 341468 - RNA, 22 nt, Human
cccaugagauucugaauuuggc

SEQ ID NO: 341469 - RNA, 22 nt, Human
cagcaggaccauugaggcauca

SEQ ID NO: 341470 - RNA, 22 nt, Human
guuuuauaggugaaauauuacu

SEQ ID NO: 341471 - RNA, 22 nt, Human
ugcccaggcuggaaugcagugg

SEQ ID NO: 341472 - RNA, 22 nt, Human
uugugaaacauucauggauuug

SEQ ID NO: 341473 - RNA, 22 nt, Human
aagcaaaggcaggagcuuguga

SEQ ID NO: 341474 - RNA, 22 nt, Human
uagugcuuaauaaauuucagaa

SEQ ID NO: 341475 - RNA, 21 nt, Human
agcaccuuacagcuauaaugg

SEQ ID NO: 341476 - RNA, 22 nt, Human
gaacacaugauuauaaaugcua

SEQ ID NO: 341477 - RNA, 23 nt, Human
acuauaaaguuguucugauuuac

SEQ ID NO: 341478 - RNA, 22 nt, Human
ucacaguuauagucuguagaau

SEQ ID NO: 341479 - RNA, 22 nt, Human
gucaggaugacaagugcuuuca

SEQ ID NO: 341480 - RNA, 22 nt, Human
ucucucagaggaagaggcagug

SEQ ID NO: 341481 - RNA, 22 nt, Human
gccaggagugucccacucauuu

SEQ ID NO: 341482 - RNA, 22 nt, Human
gggcagcucuuugguauccuuc

SEQ ID NO: 341483 - RNA, 22 nt, Human
uuguauuucuccacuuucuguu

SEQ ID NO: 341484 - RNA, 21 nt, Human
cucaaagaccaaaaguguaga

SEQ ID NO: 341485 - RNA, 22 nt, Human
cuucucagucaccugugagucu

SEQ ID NO: 341486 - RNA, 22 nt, Human
aaacacauuagcccuguggaaa

SEQ ID NO: 341487 - RNA, 22 nt, Human
agagguagagguugcagugagc

SEQ ID NO: 341488 - RNA, 19 nt, Human
ugaggggcucacagucuca

SEQ ID NO: 341489 - RNA, 22 nt, Human
uagugcuuuaggccugaguguc

SEQ ID NO: 341490 - RNA, 22 nt, Human
caggcagccugcggucugcaca

SEQ ID NO: 341491 - RNA, 22 nt, Human
aacaugauggggaagaacaaga

SEQ ID NO: 341492 - RNA, 23 nt, Human
ccacagagcugccaauuccugug

SEQ ID NO: 341493 - RNA, 18 nt, Human
agcuucccucugagaggg

SEQ ID NO: 341494 - RNA, 22 nt, Human
uguauaaaccauggacagcuuu

SEQ ID NO: 341495 - RNA, 22 nt, Human
gcuccucuucucccacugaaug

SEQ ID NO: 341496 - RNA, 22 nt, Human
aggugagggugccagugcaugg

SEQ ID NO: 341497 - RNA, 19 nt, Human
aggcagcaggccagggaug

SEQ ID NO: 341498 - RNA, 22 nt, Human
ugcccaggguuucuaagagcag

SEQ ID NO: 341499 - RNA, 22 nt, Human
gcaugucaugucauguaggaau

SEQ ID NO: 341500 - RNA, 22 nt, Human
ucauaaaucauacuccauuugc

SEQ ID NO: 341501 - RNA, 22 nt, Human
uagcauuaucugucuuaucauu

SEQ ID NO: 341502 - RNA, 22 nt, Human
cccaggagaucuggaucucguc

SEQ ID NO: 341503 - RNA, 22 nt, Human
uacaauauguggccuuuuguga

SEQ ID NO: 341504 - RNA, 20 nt, Human
gaugggaaucggagcuggua

SEQ ID NO: 341505 - RNA, 22 nt, Human
gcuccucugucaaaugagagug

SEQ ID NO: 341506 - RNA, 22 nt, Human
uggugguuaugcgcuuuguggg

SEQ ID NO: 341507 - RNA, 22 nt, Human
accaggaggcuacacuguccca

SEQ ID NO: 341508 - RNA, 22 nt, Human
uuccuugaaugagucauggaaa

SEQ ID NO: 341509 - RNA, 22 nt, Human
uggcagcugguacagugggucu

SEQ ID NO: 341510 - RNA, 22 nt, Human
uuuccaagagcuuauuucugaa

SEQ ID NO: 341511 - RNA, 22 nt, Human
uuccuuaggcuguuugcagugc

SEQ ID NO: 341512 - RNA, 21 nt, Human
agccuguugguuuacugcuca

SEQ ID NO: 341513 - RNA, 22 nt, Human
aggcaagcccccagugaggcuc

SEQ ID NO: 341514 - RNA, 21 nt, Human
acagucuccccagaucucucc

SEQ ID NO: 341515 - RNA, 22 nt, Human
auugaggcagcauaguucaggg

SEQ ID NO: 341516 - RNA, 18 nt, Human
ggcaucugcacagcagcc

SEQ ID NO: 341517 - RNA, 22 nt, Human
aucugccugagucuagguuuuc

SEQ ID NO: 341518 - RNA, 22 nt, Human
ucuuuggaucccaacuggcugg

SEQ ID NO: 341519 - RNA, 22 nt, Human
gaagcagcuggugagauggagc

SEQ ID NO: 341520 - RNA, 22 nt, Human
agggacuuguguccuauguaug

SEQ ID NO: 341521 - RNA, 22 nt, Human
ccaggaguggcuggugaccuuc

SEQ ID NO: 341522 - RNA, 22 nt, Human
uaacacaugguuaguacacaau

SEQ ID NO: 341523 - RNA, 22 nt, Human
auuacaaucgagagaaacaaau

SEQ ID NO: 341524 - RNA, 22 nt, Human
cuuaagauuugcgauaccuaau

SEQ ID NO: 341525 - RNA, 22 nt, Human
uagaaaugaauguuuaaaaguc

SEQ ID NO: 341526 - RNA, 22 nt, Human
ccccaggagauuugggagcaca

SEQ ID NO: 341527 - RNA, 22 nt, Human
ucuuugaauuucugacugucuu

SEQ ID NO: 341528 - RNA, 22 nt, Human
ccuggauucaagucuuucuuuc

SEQ ID NO: 341529 - RNA, 22 nt, Human
ucaugaacauggaauaucuuuu

SEQ ID NO: 341530 - RNA, 22 nt, Human
uuucauugucuacauaugacau

SEQ ID NO: 341531 - RNA, 22 nt, Human
gauauuuugagaaauccuauga

SEQ ID NO: 341532 - RNA, 22 nt, Human
cuacaaugacagaauugaguag

SEQ ID NO: 341533 - RNA, 22 nt, Human
ucugcaggcuuggaguggcagc

SEQ ID NO: 341534 - RNA, 22 nt, Human
aaggcagccaugugcuuugggu

SEQ ID NO: 341535 - RNA, 22 nt, Human
aaggcagccucugccagccggg

SEQ ID NO: 341536 - RNA, 19 nt, Human
aggguggcaaaggagggug

SEQ ID NO: 341537 - RNA, 22 nt, Human
acuuucugcaguguuggaaaug

SEQ ID NO: 341538 - RNA, 22 nt, Human
augcuguguuuuaaauggaaau

SEQ ID NO: 341539 - RNA, 22 nt, Human
ugucaagucucugaaugaaaug

SEQ ID NO: 341540 - RNA, 22 nt, Human
aggcagacugugcgggaagagu

SEQ ID NO: 341541 - RNA, 22 nt, Human
cuguggaaauaaacaaugcuaa

SEQ ID NO: 341542 - RNA, 22 nt, Human
agaggccagguccagaguuugu

SEQ ID NO: 341543 - RNA, 22 nt, Human
ccaggagagcucuaaauggcug

SEQ ID NO: 341544 - RNA, 22 nt, Human
uuucaaaccuacuuguauguuu

SEQ ID NO: 341545 - RNA, 22 nt, Human
augcugugguagacagcauucc

SEQ ID NO: 341546 - RNA, 22 nt, Human
uucccaugccuggccccuaucc

SEQ ID NO: 341547 - RNA, 22 nt, Human
acauuguuugagaauacagaug

SEQ ID NO: 341548 - RNA, 22 nt, Human
uccauguguuuuccuguccaca

SEQ ID NO: 341549 - RNA, 22 nt, Human
cuuguccccagcagguugguuu

SEQ ID NO: 341550 - RNA, 22 nt, Human
ucaauucugguccucaggaacu

SEQ ID NO: 341551 - RNA, 20 nt, Human
agcauuugaaauaugacuau

SEQ ID NO: 341552 - RNA, 22 nt, Human
uucugucauccuuucuagaugu

SEQ ID NO: 341553 - RNA, 22 nt, Human
gcugauguuuaguugauguuac

SEQ ID NO: 341554 - RNA, 22 nt, Human
ucucuucuaauuaggguccaug

SEQ ID NO: 341555 - RNA, 22 nt, Human
gggcagcuggccagguauucug

SEQ ID NO: 341556 - RNA, 20 nt, Human
augugucuguaaacaacucu

SEQ ID NO: 341557 - RNA, 22 nt, Human
gacagcuguggagaggcaugug

SEQ ID NO: 341558 - RNA, 22 nt, Human
uucagugucaauuuuuaaauau

SEQ ID NO: 341559 - RNA, 22 nt, Human
ugaaggcccuaucuccauauac

SEQ ID NO: 341560 - RNA, 22 nt, Human
uugacacaguuuucucauuaag

SEQ ID NO: 341561 - RNA, 22 nt, Human
augacacuuggugauacuuugu

SEQ ID NO: 341562 - RNA, 22 nt, Human
auugcuguggaaauauaagaug

SEQ ID NO: 341563 - RNA, 22 nt, Human
aguccaugguucugacucaucu

SEQ ID NO: 341564 - RNA, 22 nt, Human
aguuagaauauaauuauguuaa

SEQ ID NO: 341565 - RNA, 22 nt, Human
cugagcugggaguagagacucu

SEQ ID NO: 341566 - RNA, 23 nt, Human
uggaggaaacacaucagaagacc

SEQ ID NO: 341567 - RNA, 22 nt, Human
uuucugaacaaagccauuauca

SEQ ID NO: 341568 - RNA, 22 nt, Human
uccaugucuucaugugucuaac

SEQ ID NO: 341569 - RNA, 22 nt, Human
ugaaaugauaucugauaacaaa

SEQ ID NO: 341570 - RNA, 22 nt, Human
cauaauuuuuuuaagucagaac

SEQ ID NO: 341571 - RNA, 22 nt, Human
gcucaggaaauaguuuaguguu

SEQ ID NO: 341572 - RNA, 22 nt, Human
ucacauuuucuacuacuguacg

SEQ ID NO: 341573 - RNA, 23 nt, Human
aggcgagcucuucuccagcacgu

SEQ ID NO: 341574 - RNA, 22 nt, Human
uaugacauugcuuuuuagaacu

SEQ ID NO: 341575 - RNA, 22 nt, Human
uguggaaaauuggaacguuccu

SEQ ID NO: 341576 - RNA, 22 nt, Human
uguuagaaguuaaucacuaauu

SEQ ID NO: 341577 - RNA, 22 nt, Human
acuuuugguucuguaacuguga

SEQ ID NO: 341578 - RNA, 22 nt, Human
ugaacucucucaagugacagaa

SEQ ID NO: 341579 - RNA, 22 nt, Human
uggccaggcagguagaacggcc

SEQ ID NO: 341580 - RNA, 22 nt, Human
ucugucucaaguucuugcacuc

SEQ ID NO: 341581 - RNA, 22 nt, Human
uaacacauuuuaagccauuuua

SEQ ID NO: 341582 - RNA, 22 nt, Human
gaggagaggccaucguuguuau

SEQ ID NO: 341583 - RNA, 22 nt, Human
aucugccuccaaguccaugugu

SEQ ID NO: 341584 - RNA, 22 nt, Human
aggaagcuagagccaccggacu

SEQ ID NO: 341585 - RNA, 22 nt, Human
cugcuguguggauucaauggcu

SEQ ID NO: 341586 - RNA, 22 nt, Human
auggagggugucagagagcgaa

SEQ ID NO: 341587 - RNA, 22 nt, Human
guugacagcuggugagcugcua

SEQ ID NO: 341588 - RNA, 22 nt, Human
aaaaauaggucaaccguguaug

SEQ ID NO: 341589 - RNA, 22 nt, Human
uuaaaauagccagugccccucu

SEQ ID NO: 341590 - RNA, 21 nt, Human
ccaggaaggacugagcucccu

SEQ ID NO: 341591 - RNA, 22 nt, Human
gguggagcuggaccaggagagg

SEQ ID NO: 341592 - RNA, 22 nt, Human
uugcauuuuuagaugcuucugu

SEQ ID NO: 341593 - RNA, 22 nt, Human
auuacaauaagguuuauuugua

SEQ ID NO: 341594 - RNA, 22 nt, Human
aucuuucaaucaggaaaaaucu

SEQ ID NO: 341595 - RNA, 22 nt, Human
uuaacacaucccugcucuaccc

SEQ ID NO: 341596 - RNA, 22 nt, Human
uucaguaaaacacugcaauguc

SEQ ID NO: 341597 - RNA, 19 nt, Human
acauauguggauauacaug

SEQ ID NO: 341598 - RNA, 22 nt, Human
uaaugucaaggugauagauuug

SEQ ID NO: 341599 - RNA, 22 nt, Human
uauuuccagcaguaagaagaca

SEQ ID NO: 341600 - RNA, 22 nt, Human
cagaggcaggaagaugggcagu

SEQ ID NO: 341601 - RNA, 23 nt, Human
auguuauuauuagcagucuugcc

SEQ ID NO: 341602 - RNA, 22 nt, Human
aggcagcauccagaggagaaug

SEQ ID NO: 341603 - RNA, 22 nt, Human
ugucucaguacacuccgauguu

SEQ ID NO: 341604 - RNA, 22 nt, Human
ugaacaguuucaagaaaacuuu

SEQ ID NO: 341605 - RNA, 22 nt, Human
ucaugcuuauugcauauuugga

SEQ ID NO: 341606 - RNA, 22 nt, Human
ccucacugaagaggugacauuu

SEQ ID NO: 341607 - RNA, 22 nt, Human
cagggaggaugggcuguuuugc

SEQ ID NO: 341608 - RNA, 22 nt, Human
agugcuuuauguuguugugcaa

SEQ ID NO: 341609 - RNA, 22 nt, Human
uaaguggaagguuauaugcuaa

SEQ ID NO: 341610 - RNA, 19 nt, Human
ugcaagcuuuuucuuguua

SEQ ID NO: 341611 - RNA, 22 nt, Human
uuucaaagaguuguaaauuacu

SEQ ID NO: 341612 - RNA, 21 nt, Human
auacauucuauuaagcauuua

SEQ ID NO: 341613 - RNA, 22 nt, Human
agugauggugagugagaagcuc

SEQ ID NO: 341614 - RNA, 23 nt, Human
acauacauggagauaaagugaug

SEQ ID NO: 341615 - RNA, 22 nt, Human
uuuauuugaaucaggggagaau

SEQ ID NO: 341616 - RNA, 22 nt, Human
agauauguuuguauauauuugu

SEQ ID NO: 341617 - RNA, 22 nt, Human
gugauuuugagaccuauauagu

SEQ ID NO: 341618 - RNA, 22 nt, Human
ugugccagccucuggcuguguc

SEQ ID NO: 341619 - RNA, 22 nt, Human
aguggcagagguugacugcagu

SEQ ID NO: 341620 - RNA, 22 nt, Human
uuauccaagcagaagcugcaca

SEQ ID NO: 341621 - RNA, 22 nt, Human
uacauaguauucacauuguuuu

SEQ ID NO: 341622 - RNA, 22 nt, Human
uuccaugaaagugaaauggagc

SEQ ID NO: 341623 - RNA, 22 nt, Human
cacucaggcugugucaggagga

SEQ ID NO: 341624 - RNA, 22 nt, Human
gagagcaggaggcagcgggacg

SEQ ID NO: 341625 - RNA, 21 nt, Human
ucuagaauccuguauaagacu

SEQ ID NO: 341626 - RNA, 22 nt, Human
agugcugucaguuuuauagaua

SEQ ID NO: 341627 - RNA, 22 nt, Human
ugucuucagcaaaugccuuucu

SEQ ID NO: 341628 - RNA, 22 nt, Human
uaucuguucaauggaagaugac

SEQ ID NO: 341629 - RNA, 18 nt, Human
caugucugcgccacaagg

SEQ ID NO: 341630 - RNA, 22 nt, Human
gcugcccagacauugaaucagg

SEQ ID NO: 341631 - RNA, 22 nt, Human
uuugaaagggaaauaaacuccu

SEQ ID NO: 341632 - RNA, 22 nt, Human
cccuggaggcaaagguugcagu

SEQ ID NO: 341633 - RNA, 18 nt, Human
ugaauagggguuugcaga

SEQ ID NO: 341634 - RNA, 22 nt, Human
ggagauggaauagauucugacu

SEQ ID NO: 341635 - RNA, 22 nt, Human
ccugucacgaugacugcacucu

SEQ ID NO: 341636 - RNA, 22 nt, Human
ucaaucacguguuccauguucu

SEQ ID NO: 341637 - RNA, 19 nt, Human
cuucuucuuggcagccaag

SEQ ID NO: 341638 - RNA, 22 nt, Human
aggcaggcccucuggaaaggua

SEQ ID NO: 341639 - RNA, 22 nt, Human
ucugcaggcuguacaggaagca

SEQ ID NO: 341640 - RNA, 22 nt, Human
ggugaagguggaacgcagagca

SEQ ID NO: 341641 - RNA, 22 nt, Human
cuucucagaucucagcuuugag

SEQ ID NO: 341642 - RNA, 22 nt, Human
gcugcccacaaugauuacaugg

SEQ ID NO: 341643 - RNA, 18 nt, Human
aauuuccauaugaauugc

SEQ ID NO: 341644 - RNA, 22 nt, Human
gggaagcaggugcagcucgccu

SEQ ID NO: 341645 - RNA, 22 nt, Human
aacauucugguucuaaaaaccu

SEQ ID NO: 341646 - RNA, 22 nt, Human
uuugacaucaauacccuagaau

SEQ ID NO: 341647 - RNA, 22 nt, Human
ugaaggccagggauuugcagcc

SEQ ID NO: 341648 - RNA, 22 nt, Human
uccaugagaacccuuggagaua

SEQ ID NO: 341649 - RNA, 20 nt, Human
uuaucugucaaucugucuca

SEQ ID NO: 341650 - RNA, 22 nt, Human
gaggcagcauucgcauagacag

SEQ ID NO: 341651 - RNA, 22 nt, Human
caggaaaggugugucaugaugg

SEQ ID NO: 341652 - RNA, 22 nt, Human
caggcagccugagggaucuggg

SEQ ID NO: 341653 - RNA, 22 nt, Human
ugcuacaauucacaucuggaua

SEQ ID NO: 341654 - RNA, 22 nt, Human
aggagaggcaucaagaaaaucg

SEQ ID NO: 341655 - RNA, 22 nt, Human
uaucuaaauggaauauuccaga

SEQ ID NO: 341656 - RNA, 22 nt, Human
cucccaggcacagggaggagcc

SEQ ID NO: 341657 - RNA, 22 nt, Human
gcccaggaagugacucagaugu

SEQ ID NO: 341658 - RNA, 22 nt, Human
ucucaguguguuuucucucaga

SEQ ID NO: 341659 - RNA, 22 nt, Human
aaucuuucccuauuaaaugugg

SEQ ID NO: 341660 - RNA, 22 nt, Human
augaaggcaguuaaacgucauc

SEQ ID NO: 341661 - RNA, 22 nt, Human
augaaacagugaauuagucaag

SEQ ID NO: 341662 - RNA, 22 nt, Human
uacaguaagaugaaauagcaau

SEQ ID NO: 341663 - RNA, 22 nt, Human
uuuucaguuccaucucugcucu

SEQ ID NO: 341664 - RNA, 22 nt, Human
ucugggaagcugguccuguucu

SEQ ID NO: 341665 - RNA, 19 nt, Human
uucacaauuaugaaauuag

SEQ ID NO: 341666 - RNA, 19 nt, Human
uugaaagauuagcuuucua

SEQ ID NO: 341667 - RNA, 22 nt, Human
caacugcugacaccaucacucc

SEQ ID NO: 341668 - RNA, 22 nt, Human
acaauacuuaccaauguuuuug

SEQ ID NO: 341669 - RNA, 22 nt, Human
aggaagcuccuggagagccagu

SEQ ID NO: 341670 - RNA, 22 nt, Human
gggcagcuguaucugagcuuau

SEQ ID NO: 341671 - RNA, 22 nt, Human
ugacauaauaauccaaacauac

SEQ ID NO: 341672 - RNA, 22 nt, Human
aucauucuauuguugagcugcc

SEQ ID NO: 341673 - RNA, 22 nt, Human
ucacaauuuggauacagcuaug

SEQ ID NO: 341674 - RNA, 22 nt, Human
gaaauuauugcuagagacugca

SEQ ID NO: 341675 - RNA, 22 nt, Human
uauuuccaggccccacucuaga

SEQ ID NO: 341676 - RNA, 22 nt, Human
ccaggagacaaagaugacugcu

SEQ ID NO: 341677 - RNA, 22 nt, Human
aaagcagaggugauaugacuua

SEQ ID NO: 341678 - RNA, 22 nt, Human
uaaaugagggcugacaugauug

SEQ ID NO: 341679 - RNA, 22 nt, Human
aggcagcuuucuguaggggugu

SEQ ID NO: 341680 - RNA, 22 nt, Human
aaaauugaagugaucaggaacu

SEQ ID NO: 341681 - RNA, 22 nt, Human
caaggccagggaauuuuucugg

SEQ ID NO: 341682 - RNA, 22 nt, Human
cuucucaguugcaagugucaga

SEQ ID NO: 341683 - RNA, 20 nt, Human
aggagggaccuggauuggcg

SEQ ID NO: 341684 - RNA, 22 nt, Human
aaugcuuuuugcgaaaugugca

SEQ ID NO: 341685 - RNA, 20 nt, Human
gucaggauuaguaaacucug

SEQ ID NO: 341686 - RNA, 20 nt, Human
uaguauuugcauaaggauag

SEQ ID NO: 341687 - RNA, 22 nt, Human
cugcagagcaaguaacauccuc

SEQ ID NO: 341688 - RNA, 22 nt, Human
aggccagaaaugucagggagug

SEQ ID NO: 341689 - RNA, 22 nt, Human
gcaagcugaugugauagugaaa

SEQ ID NO: 341690 - RNA, 22 nt, Human
uacaucauaauaauacuuagaa

SEQ ID NO: 341691 - RNA, 22 nt, Human
gcuggcuugauaguuucugcuu

SEQ ID NO: 341692 - RNA, 22 nt, Human
acauuucuaguuguucaucucc

SEQ ID NO: 341693 - RNA, 22 nt, Human
uggcagcuguguccagguagaa

SEQ ID NO: 341694 - RNA, 22 nt, Human
uuuucauuguuacuaugagcua

SEQ ID NO: 341695 - RNA, 22 nt, Human
ggaggcugagaaguccaagauc

SEQ ID NO: 341696 - RNA, 23 nt, Human
accaggaguugucucaggaaaca

SEQ ID NO: 341697 - RNA, 17 nt, Human
gagagcugcugcuuccg

SEQ ID NO: 341698 - RNA, 22 nt, Human
aggucagcaggccaggggcgaa

SEQ ID NO: 341699 - RNA, 22 nt, Human
uugaagaggacuuugcagcugu

SEQ ID NO: 341700 - RNA, 22 nt, Human
cucugucagaguguugucccca

SEQ ID NO: 341701 - RNA, 22 nt, Human
cuuaacagagagaaguguugcu

SEQ ID NO: 341702 - RNA, 22 nt, Human
ucuucagacuccaaauguuuua

SEQ ID NO: 341703 - RNA, 23 nt, Human
ggagugcaauggcgccaucucgg

SEQ ID NO: 341704 - RNA, 22 nt, Human
cauucacaucuuguuccaucac

SEQ ID NO: 341705 - RNA, 22 nt, Human
auucuucagcaggggacacuau

SEQ ID NO: 341706 - RNA, 22 nt, Human
accaggaggccuugguucugag

SEQ ID NO: 341707 - RNA, 17 nt, Human
uggcagcugaaagcucu

SEQ ID NO: 341708 - RNA, 22 nt, Human
caggaugagguagaggcagaua

SEQ ID NO: 341709 - RNA, 22 nt, Human
cccaggagguggagcuugcagu

SEQ ID NO: 341710 - RNA, 22 nt, Human
uagcacauuguugaccagaagg

SEQ ID NO: 341711 - RNA, 22 nt, Human
ucaaauaccagcaauuucaugu

SEQ ID NO: 341712 - RNA, 22 nt, Human
cagcuuucaucagugacacuca

SEQ ID NO: 341713 - RNA, 23 nt, Human
gagugcagaauagacaugcagug

SEQ ID NO: 341714 - RNA, 22 nt, Human
gaucauuugcaggaaacauuaa

SEQ ID NO: 341715 - RNA, 22 nt, Human
cugguacaaaaugcugauauca

SEQ ID NO: 341716 - RNA, 22 nt, Human
cccaggaggguggccucugccc

SEQ ID NO: 341717 - RNA, 22 nt, Human
ugaggcaggaugcuugcacagg

SEQ ID NO: 341718 - RNA, 17 nt, Human
cucacggaggaugaauc

SEQ ID NO: 341719 - RNA, 19 nt, Human
ccauggagagagaugcauu

SEQ ID NO: 341720 - RNA, 22 nt, Human
cggagaggaccugcaacucgcu

SEQ ID NO: 341721 - RNA, 23 nt, Human
cuuugccacccagagccugacag

SEQ ID NO: 341722 - RNA, 22 nt, Human
cuuugcaauagaggcacacaug

SEQ ID NO: 341723 - RNA, 22 nt, Human
gaaauaagaguccaugccaggu

SEQ ID NO: 341724 - RNA, 20 nt, Human
ccacaggaguccagucgacc

SEQ ID NO: 341725 - RNA, 22 nt, Human
ucauuuaauaauuuuugaguag

SEQ ID NO: 341726 - RNA, 22 nt, Human
ucagagaguuggaaagaauuaa

SEQ ID NO: 341727 - RNA, 22 nt, Human
guucuucaggccauccucccag

SEQ ID NO: 341728 - RNA, 22 nt, Human
agcugaugccauguggaacagu

SEQ ID NO: 341729 - RNA, 22 nt, Human
gauguagagggaagauuuuaaa

SEQ ID NO: 341730 - RNA, 22 nt, Human
acagucuugcuguauggucagg

SEQ ID NO: 341731 - RNA, 22 nt, Human
acuauaaaaggauaaaccagaa

SEQ ID NO: 341732 - RNA, 22 nt, Human
aggcaagcugcagagaguccuu

SEQ ID NO: 341733 - RNA, 22 nt, Human
ggcuuggaccagucacaguggu

SEQ ID NO: 341734 - RNA, 22 nt, Human
uugaacugguaguuggaaaucu

SEQ ID NO: 341735 - RNA, 22 nt, Human
cuccaggagggggauggcugua

SEQ ID NO: 341736 - RNA, 22 nt, Human
gcagcugaauguccauugcugc

SEQ ID NO: 341737 - RNA, 15 nt, Human
cuccaugauuuugca

SEQ ID NO: 341738 - RNA, 22 nt, Human
uugagaagaaauaguuugcaau

SEQ ID NO: 341739 - RNA, 22 nt, Human
gcauguguugguuuaugcaugu

SEQ ID NO: 341740 - RNA, 22 nt, Human
gcagagaagaugcccaggcuuc

SEQ ID NO: 341741 - RNA, 22 nt, Human
ucucuucuaauuuucccgagua

SEQ ID NO: 341742 - RNA, 22 nt, Human
cccauucauccucgcuuccuuc

SEQ ID NO: 341743 - RNA, 22 nt, Human
uugcagcuucgagucuaucugu

SEQ ID NO: 341744 - RNA, 19 nt, Human
auauauguauacaaugugg

SEQ ID NO: 341745 - RNA, 22 nt, Human
ggaggggaggauuaaugacaaa

SEQ ID NO: 341746 - RNA, 22 nt, Human
gacagcuggcaguggaaaggug

SEQ ID NO: 341747 - RNA, 21 nt, Human
ucucugugucuuuaagcugga

SEQ ID NO: 341748 - RNA, 19 nt, Human
auacagauguauccaugau

SEQ ID NO: 341749 - RNA, 22 nt, Human
aaauuucaguuggaaugagcuc

SEQ ID NO: 341750 - RNA, 22 nt, Human
agagagagggaaacugcuaaac

SEQ ID NO: 341751 - RNA, 17 nt, Human
agagagagcaugccacc

SEQ ID NO: 341752 - RNA, 20 nt, Human
uugagcuuuuaguacagaca

SEQ ID NO: 341753 - RNA, 22 nt, Human
uuucacaaucaaauggugaaau

SEQ ID NO: 341754 - RNA, 21 nt, Human
aggcagcucaggcccagagag

SEQ ID NO: 341755 - RNA, 22 nt, Human
ucucaggaucuaauacauggua

SEQ ID NO: 341756 - RNA, 22 nt, Human
uuauucuuuaaacauauauguu

SEQ ID NO: 341757 - RNA, 22 nt, Human
cucaggaugucggugacuauug

SEQ ID NO: 341758 - RNA, 17 nt, Human
cccacggaggugugaaa

SEQ ID NO: 341759 - RNA, 22 nt, Human
uucaacuaauguuuauuuuaug

SEQ ID NO: 341760 - RNA, 22 nt, Human
cauuuccacuucugaaaacugg

SEQ ID NO: 341761 - RNA, 22 nt, Human
agagugcaaccgaaacaagcag

SEQ ID NO: 341762 - RNA, 22 nt, Human
ggagaggauguuuuaguaacuu

SEQ ID NO: 341763 - RNA, 19 nt, Human
aaggcagcaguagcaucca

SEQ ID NO: 341764 - RNA, 22 nt, Human
ccuugcguuuuacagcuucuag

SEQ ID NO: 341765 - RNA, 22 nt, Human
cugcugugugaccauggacagg

SEQ ID NO: 341766 - RNA, 22 nt, Human
agguaggggguuugggaacugc

SEQ ID NO: 341767 - RNA, 22 nt, Human
cagaaccaggaacugauggaga

SEQ ID NO: 341768 - RNA, 22 nt, Human
aaucauaauuguauacauucau

SEQ ID NO: 341769 - RNA, 18 nt, Human
ggucuuuaggucaguguc

SEQ ID NO: 341770 - RNA, 22 nt, Human
ugaaaucaaugucuucugucuc

SEQ ID NO: 341771 - RNA, 22 nt, Human
aggcagcccacaggacacagga

SEQ ID NO: 341772 - RNA, 23 nt, Human
cugcccugaucuugaucuauugu

SEQ ID NO: 341773 - RNA, 22 nt, Human
gaggagagggcugcgggcccac

SEQ ID NO: 341774 - RNA, 22 nt, Human
uaugccugauaacugugucucu

SEQ ID NO: 341775 - RNA, 22 nt, Human
aagagaggacauggugaaccug

SEQ ID NO: 341776 - RNA, 22 nt, Human
caucaucaaaacaaauggaguc

SEQ ID NO: 341777 - RNA, 22 nt, Human
ucuuagcacagcuauauaaguu

SEQ ID NO: 341778 - RNA, 22 nt, Human
uauugaugcuuggauugggcca

SEQ ID NO: 341779 - RNA, 22 nt, Human
cucaggauugugccuagggaga

SEQ ID NO: 341780 - RNA, 22 nt, Human
cuguguuggcuuuucucuugua

SEQ ID NO: 341781 - RNA, 22 nt, Human
uccaugagggacacuggaugcu

SEQ ID NO: 341782 - RNA, 18 nt, Human
ugcuuggagcauuuacca

SEQ ID NO: 341783 - RNA, 19 nt, Human
uugaaauuguuugauaugg

SEQ ID NO: 341784 - RNA, 22 nt, Human
cauuuccagcuccugcaucaug

SEQ ID NO: 341785 - RNA, 22 nt, Human
cauuuccugucuggaggucaaa

SEQ ID NO: 341786 - RNA, 22 nt, Human
aucugucaggagcaaggacuac

SEQ ID NO: 341787 - RNA, 22 nt, Human
cauucucaauaguagaugagua

SEQ ID NO: 341788 - RNA, 22 nt, Human
ugaaagauugugauucaauaug

SEQ ID NO: 341789 - RNA, 22 nt, Human
agauauauuuaagguaauaagu

SEQ ID NO: 341790 - RNA, 22 nt, Human
agggcagcucucaccucuggcc

SEQ ID NO: 341791 - RNA, 22 nt, Human
cuuuccaaugcauuuccaaugu

SEQ ID NO: 341792 - RNA, 22 nt, Human
ucagagaguuacacaaauuguu

SEQ ID NO: 341793 - RNA, 22 nt, Human
auaguuugugaaacacagcagu

SEQ ID NO: 341794 - RNA, 22 nt, Human
ucuacugugguccuuguaacca

SEQ ID NO: 341795 - RNA, 22 nt, Human
auucaaguccagcuucucuaca

SEQ ID NO: 341796 - RNA, 22 nt, Human
uccauuuucuugcucuagguaa

SEQ ID NO: 341797 - RNA, 22 nt, Human
agcagccuuugaucaucuggga

SEQ ID NO: 341798 - RNA, 22 nt, Human
uuaucauugucgcagucuaauu

SEQ ID NO: 341799 - RNA, 22 nt, Human
uuuaucuuuaggacuuugcaga

SEQ ID NO: 341800 - RNA, 22 nt, Human
caggcgagugaacagacucuca

SEQ ID NO: 341801 - RNA, 22 nt, Human
uucucagaggagucgggagcug

SEQ ID NO: 341802 - RNA, 22 nt, Human
cccaguuucaacuuuccagugg

SEQ ID NO: 341803 - RNA, 22 nt, Human
ccacagcugaccgcaggugagc

SEQ ID NO: 341804 - RNA, 22 nt, Human
aagccgaggccacacagcagga

SEQ ID NO: 341805 - RNA, 22 nt, Human
ucaggagaaggcaauguggaaa

SEQ ID NO: 341806 - RNA, 22 nt, Human
ccuacucugagcgccuccgcau

SEQ ID NO: 341807 - RNA, 22 nt, Human
acuagauaauuauaaaagguag

SEQ ID NO: 341808 - RNA, 22 nt, Human
ugguaauuuacgcauuucugua

SEQ ID NO: 341809 - RNA, 22 nt, Human
ggacaagccugugaguggguuu

SEQ ID NO: 341810 - RNA, 22 nt, Human
auucuucacaaauauauagaag

SEQ ID NO: 341811 - RNA, 22 nt, Human
uugaaagaagaagcugcgaugu

SEQ ID NO: 341812 - RNA, 22 nt, Human
ugccuugcgggcguuucuguug

SEQ ID NO: 341813 - RNA, 22 nt, Human
agcaccauugcaaauauggcag

SEQ ID NO: 341814 - RNA, 22 nt, Human
ucugggaacacacgucacuuca

SEQ ID NO: 341815 - RNA, 22 nt, Human
gcagcugaaagggaucucuaca

SEQ ID NO: 341816 - RNA, 22 nt, Human
aagcgccaugguuccugcgcag

SEQ ID NO: 341817 - RNA, 22 nt, Human
gcccaggagguggaggugcagu

SEQ ID NO: 341818 - RNA, 21 nt, Human
ggauggauagggaagagauuu

SEQ ID NO: 341819 - RNA, 22 nt, Human
ccagggaguuuccaaucugaga

SEQ ID NO: 341820 - RNA, 22 nt, Human
uaacaauaguguuugcuaguca

SEQ ID NO: 341821 - RNA, 22 nt, Human
gaggcaguguugaaaaggagag

SEQ ID NO: 341822 - RNA, 22 nt, Human
uuucucugcugccugugucgau

SEQ ID NO: 341823 - RNA, 22 nt, Human
uaacacauagauauuuuaacuu

SEQ ID NO: 341824 - RNA, 22 nt, Human
ucuuagaaguucauguuccagc

SEQ ID NO: 341825 - RNA, 22 nt, Human
gauggcaggcaggugaguagag

SEQ ID NO: 341826 - RNA, 22 nt, Human
uggaagggagugacagucagag

SEQ ID NO: 341827 - RNA, 22 nt, Human
auuguuaugaaaauaagauguu

SEQ ID NO: 341828 - RNA, 22 nt, Human
ucuucucuacaccagcagcccc

SEQ ID NO: 341829 - RNA, 17 nt, Human
guccuacccauggucua

SEQ ID NO: 341830 - RNA, 22 nt, Human
uugcaaaggggaauaaagcaau

SEQ ID NO: 341831 - RNA, 22 nt, Human
cuuugaaaggaagccacacagc

SEQ ID NO: 341832 - RNA, 22 nt, Human
aauugcaacagguagacuuuuc

SEQ ID NO: 341833 - RNA, 22 nt, Human
gcagaggccaggccaccagcaa

SEQ ID NO: 341834 - RNA, 22 nt, Human
aggacagcccuugagagcacau

SEQ ID NO: 341835 - RNA, 22 nt, Human
ucugguaaccuuuaucccuccu

SEQ ID NO: 341836 - RNA, 22 nt, Human
uuucuugacugcuuaggaaugc

SEQ ID NO: 341837 - RNA, 22 nt, Human
cagcuucugcuaucgaacaucu

SEQ ID NO: 341838 - RNA, 22 nt, Human
uuuucauuguuccucgagcauu

SEQ ID NO: 341839 - RNA, 22 nt, Human
aucucauaacucauuugaagac

SEQ ID NO: 341840 - RNA, 22 nt, Human
gaggcauggccugaggcuagga

SEQ ID NO: 341841 - RNA, 22 nt, Human
guaaaauagaauaacguggcua

SEQ ID NO: 341842 - RNA, 22 nt, Human
aaaggcaggcuuucacaucuca

SEQ ID NO: 341843 - RNA, 22 nt, Human
aucaggaucagggcuagcagag

SEQ ID NO: 341844 - RNA, 22 nt, Human
ggcagcauauauucagugggca

SEQ ID NO: 341845 - RNA, 22 nt, Human
agaggggaaguaaugaaugaua

SEQ ID NO: 341846 - RNA, 22 nt, Human
caggaugggauguagugggccc

SEQ ID NO: 341847 - RNA, 20 nt, Human
ucaggaugugcugagugaag

SEQ ID NO: 341848 - RNA, 16 nt, Human
cuuccucuucacuggc

SEQ ID NO: 341849 - RNA, 22 nt, Human
cccaagagguggagguugcagu

SEQ ID NO: 341850 - RNA, 22 nt, Human
aguggcaggcggagauguagga

SEQ ID NO: 341851 - RNA, 22 nt, Human
ccaggagaagcaucugagugua

SEQ ID NO: 341852 - RNA, 22 nt, Human
cauucauuuaugaaauaucuau

SEQ ID NO: 341853 - RNA, 22 nt, Human
aagcuggaacaucuugaggaag

SEQ ID NO: 341854 - RNA, 22 nt, Human
cccaggagaauauaauguucuu

SEQ ID NO: 341855 - RNA, 23 nt, Human
ggcagcucucaucugaugacuga

SEQ ID NO: 341856 - RNA, 21 nt, Human
uaugaacaugaccaauagucc

SEQ ID NO: 341857 - RNA, 22 nt, Human
cccaggaggcagagauagcagu

SEQ ID NO: 341858 - RNA, 22 nt, Human
acuaagugauucuaagcaucuu

SEQ ID NO: 341859 - RNA, 22 nt, Human
gaggggaaagugugaggcugcg

SEQ ID NO: 341860 - RNA, 22 nt, Human
ugaguuuuuucaacauaugaag

SEQ ID NO: 341861 - RNA, 22 nt, Human
ugaguaauaaacugucuugcuc

SEQ ID NO: 341862 - RNA, 21 nt, Human
ucucugguuggaguugugcca

SEQ ID NO: 341863 - RNA, 22 nt, Human
gaaacaauuuuuguugucuaag

SEQ ID NO: 341864 - RNA, 22 nt, Human
gugcuuuuaaaggcaauuagua

SEQ ID NO: 341865 - RNA, 22 nt, Human
uugcugaaguuaaugcuugcaa

SEQ ID NO: 341866 - RNA, 22 nt, Human
aaggcaguagguguuucaaacu

SEQ ID NO: 341867 - RNA, 22 nt, Human
gaagcagccacggggagacaga

SEQ ID NO: 341868 - RNA, 22 nt, Human
gcaggcagagguggaggagaca

SEQ ID NO: 341869 - RNA, 22 nt, Human
ccauggcaauggucagucuauu

SEQ ID NO: 341870 - RNA, 22 nt, Human
ccagcagagcauggggaggaag

SEQ ID NO: 341871 - RNA, 22 nt, Human
cgaggcagggaagcugcaaaag

SEQ ID NO: 341872 - RNA, 22 nt, Human
uugcaggauuuuagagaugaca

SEQ ID NO: 341873 - RNA, 22 nt, Human
uccagaaacuuuuccagucuca

SEQ ID NO: 341874 - RNA, 22 nt, Human
aaauuauucucauguguuucuu

SEQ ID NO: 341875 - RNA, 22 nt, Human
agaaaugacacacaugagacau

SEQ ID NO: 341876 - RNA, 22 nt, Human
agccagcucccuccccugcagg

SEQ ID NO: 341877 - RNA, 22 nt, Human
caguaaagcauguaugucuuca

SEQ ID NO: 341878 - RNA, 23 nt, Human
gaauaguuuuagaaauuggagaa

SEQ ID NO: 341879 - RNA, 22 nt, Human
aucaggaucugcaucauaagaa

SEQ ID NO: 341880 - RNA, 21 nt, Human
aggcagcaggauccagggaca

SEQ ID NO: 341881 - RNA, 22 nt, Human
uagauauggccgucuguuuuaa

SEQ ID NO: 341882 - RNA, 22 nt, Human
ucacaucucccuggaggacaca

SEQ ID NO: 341883 - RNA, 22 nt, Human
aggagaggucucccuuccccag

SEQ ID NO: 341884 - RNA, 22 nt, Human
ccacugaggcaggcaguaucua

SEQ ID NO: 341885 - RNA, 22 nt, Human
aaggagaguacaggaguuggua

SEQ ID NO: 341886 - RNA, 22 nt, Human
uuuucaguaaugucuacauaau

SEQ ID NO: 341887 - RNA, 22 nt, Human
uauuuccauguuagaacuaagu

SEQ ID NO: 341888 - RNA, 22 nt, Human
uaaauuauguuccauguccuuu

SEQ ID NO: 341889 - RNA, 22 nt, Human
aagcuggcaugucaccugagaa

SEQ ID NO: 341890 - RNA, 22 nt, Human
ggcagggaagcuggcaucacgg

SEQ ID NO: 341891 - RNA, 22 nt, Human
cuggccagaguuggagggugug

SEQ ID NO: 341892 - RNA, 22 nt, Human
gagaggaguuacuauuuccgag

SEQ ID NO: 341893 - RNA, 22 nt, Human
augcuguguccuagugaaagaa

SEQ ID NO: 341894 - RNA, 22 nt, Human
uuucaguuuuugcucgauguau

SEQ ID NO: 341895 - RNA, 22 nt, Human
cucagaagccuucagucuuggc

SEQ ID NO: 341896 - RNA, 21 nt, Human
aaucauacaaaacaugucagg

SEQ ID NO: 341897 - RNA, 22 nt, Human
uuucacagguacaaacacuccu

SEQ ID NO: 341898 - RNA, 22 nt, Human
ucucucuugucaccccaucugc

SEQ ID NO: 341899 - RNA, 22 nt, Human
acaguuaucuuugaaauagaga

SEQ ID NO: 341900 - RNA, 22 nt, Human
ugagccugguugcagugucugg

SEQ ID NO: 341901 - RNA, 22 nt, Human
aaaguuugucacuuggcuagaa

SEQ ID NO: 341902 - RNA, 22 nt, Human
uuggaaauacagcaguuacuuu

SEQ ID NO: 341903 - RNA, 22 nt, Human
uaaagcacauaucuuacaauaa

SEQ ID NO: 341904 - RNA, 22 nt, Human
aggaugagaagauuggaaucuu

SEQ ID NO: 341905 - RNA, 20 nt, Human
uccaggagaacugggagccg

SEQ ID NO: 341906 - RNA, 22 nt, Human
uggagaggaaagugcaguuuug

SEQ ID NO: 341907 - RNA, 22 nt, Human
uauaauuuaucaugucacaguu

SEQ ID NO: 341908 - RNA, 22 nt, Human
ggguggaguagaaagaugaauu

SEQ ID NO: 341909 - RNA, 22 nt, Human
aaauacauaaagguuguaccag

SEQ ID NO: 341910 - RNA, 22 nt, Human
caggcagcucugcuuuuccuaa

SEQ ID NO: 341911 - RNA, 22 nt, Human
uuucucuguucucuaacuguaa

SEQ ID NO: 341912 - RNA, 22 nt, Human
guguuuuaagaaagaagcucag

SEQ ID NO: 341913 - RNA, 22 nt, Human
ucaggagauguaaccuuagcug

SEQ ID NO: 341914 - RNA, 22 nt, Human
uccaggaggacugagggggcug

SEQ ID NO: 341915 - RNA, 22 nt, Human
gugugaaaaugugcacaauaug

SEQ ID NO: 341916 - RNA, 22 nt, Human
aggccagaaauuuggaguaugu

SEQ ID NO: 341917 - RNA, 22 nt, Human
uauguuauuuucauacaacaga

SEQ ID NO: 341918 - RNA, 22 nt, Human
agggaagcccuggcugagaccc

SEQ ID NO: 341919 - RNA, 22 nt, Human
uauacaaugaguacauucuggg

SEQ ID NO: 341920 - RNA, 22 nt, Human
acccaggacucucuuccaguag

SEQ ID NO: 341921 - RNA, 22 nt, Human
aggagagaauguuccaggcuug

SEQ ID NO: 341922 - RNA, 22 nt, Human
uacauauguaaacauguauaaa

SEQ ID NO: 341923 - RNA, 22 nt, Human
ugggagcccaagggagcugccg

SEQ ID NO: 341924 - RNA, 22 nt, Human
gaaauauuucucuugagccccu

SEQ ID NO: 341925 - RNA, 22 nt, Human
cccaggaguucgaggcuguagu

SEQ ID NO: 341926 - RNA, 22 nt, Human
cugcuguggaugcaggaccuca

SEQ ID NO: 341927 - RNA, 22 nt, Human
aaaggaagaugccaggacucug

SEQ ID NO: 341928 - RNA, 21 nt, Human
ggagggcagcccagacuggcu

SEQ ID NO: 341929 - RNA, 17 nt, Human
agagggaaaaugcgguu

SEQ ID NO: 341930 - RNA, 22 nt, Human
uuuggaauauuaaaaugucuca

SEQ ID NO: 341931 - RNA, 22 nt, Human
cacaaaugugcagaaaugugag

SEQ ID NO: 341932 - RNA, 22 nt, Human
gucaggauuuacaaacuucagu

SEQ ID NO: 341933 - RNA, 22 nt, Human
ucaggaauccagacagggcaca

SEQ ID NO: 341934 - RNA, 22 nt, Human
uuuuaucuucauuccuaucuac

SEQ ID NO: 341935 - RNA, 22 nt, Human
aguauugugacucaaguauucu

SEQ ID NO: 341936 - RNA, 18 nt, Human
cgaggcaggcggaucacg

SEQ ID NO: 341937 - RNA, 21 nt, Human
uggcaggcagcuggaagcuug

SEQ ID NO: 341938 - RNA, 22 nt, Human
uucauucuuugaaucugaggua

SEQ ID NO: 341939 - RNA, 22 nt, Human
ucugggaacugagcuccccuag

SEQ ID NO: 341940 - RNA, 22 nt, Human
gcagcucccagcuugaaagguc

SEQ ID NO: 341941 - RNA, 22 nt, Human
uguaaaaccaaaucaaucuagu

SEQ ID NO: 341942 - RNA, 22 nt, Human
cuugaaagaagggucuuuuaau

SEQ ID NO: 341943 - RNA, 22 nt, Human
cugcuguguaucauuuuagaug

SEQ ID NO: 341944 - RNA, 22 nt, Human
ucuuugcaaaauacaacaaugg

SEQ ID NO: 341945 - RNA, 22 nt, Human
cccucuacagggaagcgcuuuc

SEQ ID NO: 341946 - RNA, 22 nt, Human
auauaauuguucugaaguguuu

SEQ ID NO: 341947 - RNA, 22 nt, Human
ucaggagaguguucaguggagg

SEQ ID NO: 341948 - RNA, 22 nt, Human
cugcuuugcauagcugccagag

SEQ ID NO: 341949 - RNA, 22 nt, Human
auggagacgcaagggaccuagg

SEQ ID NO: 341950 - RNA, 22 nt, Human
agaggccggccgagcccauggg

SEQ ID NO: 341951 - RNA, 22 nt, Human
ggaggggagguccagcugaucu

SEQ ID NO: 341952 - RNA, 22 nt, Human
uggcaguccccugugccuggaa

SEQ ID NO: 341953 - RNA, 22 nt, Human
aguccuuugggaaaaaugacua

SEQ ID NO: 341954 - RNA, 22 nt, Human
cauuguuauagcauuacacacc

SEQ ID NO: 341955 - RNA, 22 nt, Human
auugcuguaaauuaucuuauua

SEQ ID NO: 341956 - RNA, 22 nt, Human
ugcuucuggaaacaguggcugu

SEQ ID NO: 341957 - RNA, 22 nt, Human
cccuuagcuccaagggguuugg

SEQ ID NO: 341958 - RNA, 22 nt, Human
cagcagagaaauuaaacuucug

SEQ ID NO: 341959 - RNA, 22 nt, Human
uuugaagucagacacugcuuug

SEQ ID NO: 341960 - RNA, 22 nt, Human
uuucagggagccuagaagagcu

SEQ ID NO: 341961 - RNA, 22 nt, Human
caaggccacuccagagacuggu

SEQ ID NO: 341962 - RNA, 22 nt, Human
agucuugcauuuucugaagaug

SEQ ID NO: 341963 - RNA, 22 nt, Human
caggagauguaagacuucuguu

SEQ ID NO: 341964 - RNA, 22 nt, Human
aggcagugcaugcaaaggucgg

SEQ ID NO: 341965 - RNA, 22 nt, Human
aguuauaugugaaaacacguau

SEQ ID NO: 341966 - RNA, 22 nt, Human
ucauuucuccgaccugcugucc

SEQ ID NO: 341967 - RNA, 22 nt, Human
gcuguucucuguaacaugcauu

SEQ ID NO: 341968 - RNA, 22 nt, Human
cucucagacugaagggccugug

SEQ ID NO: 341969 - RNA, 22 nt, Human
uugcuuuguggugguucuucca

SEQ ID NO: 341970 - RNA, 22 nt, Human
cagugauggauauggagaaguc

SEQ ID NO: 341971 - RNA, 22 nt, Human
uucaggauaugugauaucugaa

SEQ ID NO: 341972 - RNA, 22 nt, Human
uuagccauguugaagauuuaga

SEQ ID NO: 341973 - RNA, 22 nt, Human
cuagaauugcauucuaugaaua

SEQ ID NO: 341974 - RNA, 22 nt, Human
cauuuguaguuaaaaaugucuc

SEQ ID NO: 341975 - RNA, 21 nt, Human
gagacagcccagugccagggc

SEQ ID NO: 341976 - RNA, 22 nt, Human
uuugcauaggauggacauuuua

SEQ ID NO: 341977 - RNA, 22 nt, Human
uuuaaauucugucugccgcuua

SEQ ID NO: 341978 - RNA, 22 nt, Human
uggaaauggaucugaugagucu

SEQ ID NO: 341979 - RNA, 23 nt, Human
uguugaaguaacuguuacauaga

SEQ ID NO: 341980 - RNA, 22 nt, Human
uaaggccaaggggccauagucu

SEQ ID NO: 341981 - RNA, 22 nt, Human
ucagaaagaacacaggcaguag

SEQ ID NO: 341982 - RNA, 22 nt, Human
ucauuuguacuugugugcuugu

SEQ ID NO: 341983 - RNA, 21 nt, Human
uuucuuaggcucuaaaaugac

SEQ ID NO: 341984 - RNA, 22 nt, Human
aggcagucuaguccccaggcaa

SEQ ID NO: 341985 - RNA, 22 nt, Human
uaauuccaaguugagacaugca

SEQ ID NO: 341986 - RNA, 22 nt, Human
aaguuucaugauguaauuauug

SEQ ID NO: 341987 - RNA, 22 nt, Human
uucuucuccuaaggagaguccu

SEQ ID NO: 341988 - RNA, 22 nt, Human
uugauacaggcucuauuucauc

SEQ ID NO: 341989 - RNA, 22 nt, Human
caaggccaagucucugugaaga

SEQ ID NO: 341990 - RNA, 22 nt, Human
aucugcuuuugagaauuuacuu

SEQ ID NO: 341991 - RNA, 22 nt, Human
uugcugaauugaauccuuuggu

SEQ ID NO: 341992 - RNA, 22 nt, Human
cagaggcagccgggggagaacg

SEQ ID NO: 341993 - RNA, 22 nt, Human
gaaggggacuggcagcugcaga

SEQ ID NO: 341994 - RNA, 22 nt, Human
agucucagaaaagaagcaugga

SEQ ID NO: 341995 - RNA, 22 nt, Human
uucacauuggugauauguuucu

SEQ ID NO: 341996 - RNA, 22 nt, Human
uugcuguguaacuccuggccug

SEQ ID NO: 341997 - RNA, 19 nt, Human
uccaggaggcugccauuga

SEQ ID NO: 341998 - RNA, 22 nt, Human
augcugugccuucucugugcca

SEQ ID NO: 341999 - RNA, 20 nt, Human
aggcucagcugagcucuugg

SEQ ID NO: 342000 - RNA, 22 nt, Human
cucauaaugugacuguauuuga

SEQ ID NO: 342001 - RNA, 22 nt, Human
ucauuguuauguuuugcugucu

SEQ ID NO: 342002 - RNA, 22 nt, Human
ggccagcucuuguccacggagg

SEQ ID NO: 342003 - RNA, 22 nt, Human
aggcagauuuaggagaaaagaa

SEQ ID NO: 342004 - RNA, 20 nt, Human
aggaagcugagauguagagg

SEQ ID NO: 342005 - RNA, 20 nt, Human
agcugccccugggcacugcc

SEQ ID NO: 342006 - RNA, 22 nt, Human
aauacuauguagccaaaauaau

SEQ ID NO: 342007 - RNA, 22 nt, Human
ucugggaaccagugcggcuggg

SEQ ID NO: 342008 - RNA, 22 nt, Human
ugcuugaaagggguuucccagu

SEQ ID NO: 342009 - RNA, 22 nt, Human
gugcagcugcaggagucagguc

SEQ ID NO: 342010 - RNA, 22 nt, Human
aguaaaaauugaggugcaaaau

SEQ ID NO: 342011 - RNA, 22 nt, Human
gcccaguaguucaagguugcag

SEQ ID NO: 342012 - RNA, 22 nt, Human
gagccaaggguugccauggaga

SEQ ID NO: 342013 - RNA, 22 nt, Human
uauuucagcaagaagaaugugg

SEQ ID NO: 342014 - RNA, 22 nt, Human
cugcuguguggugaaacucagu

SEQ ID NO: 342015 - RNA, 22 nt, Human
ggaggcgauccugggaaacacc

SEQ ID NO: 342016 - RNA, 22 nt, Human
aggcagcauuugaauccagguc

SEQ ID NO: 342017 - RNA, 22 nt, Human
ugcaggaaucagaggggaagcg

SEQ ID NO: 342018 - RNA, 23 nt, Human
agcacacuuguacaaugcccuag

SEQ ID NO: 342019 - RNA, 22 nt, Human
gggcaguuuauucuagaugguu

SEQ ID NO: 342020 - RNA, 20 nt, Human
auuuggcaugaaguauugau

SEQ ID NO: 342021 - RNA, 22 nt, Human
uuuucagugggcaaugauguga

SEQ ID NO: 342022 - RNA, 22 nt, Human
acacaaguucuaaagauugcgc

SEQ ID NO: 342023 - RNA, 22 nt, Human
ugcuggaauaauuucauguuaa

SEQ ID NO: 342024 - RNA, 22 nt, Human
uucuucaugcuguugcugcuug

SEQ ID NO: 342025 - RNA, 22 nt, Human
gcaucuaaauaaacgugggagu

SEQ ID NO: 342026 - RNA, 22 nt, Human
accauuuuggguauuuucagag

SEQ ID NO: 342027 - RNA, 21 nt, Human
agcagaggggacauguuugau

SEQ ID NO: 342028 - RNA, 22 nt, Human
gacagcugugcaggagaagggg

SEQ ID NO: 342029 - RNA, 22 nt, Human
guguaugaggggagaauguuuu

SEQ ID NO: 342030 - RNA, 22 nt, Human
gaaauauucuugucuuguuuuc

SEQ ID NO: 342031 - RNA, 22 nt, Human
cccaggagacugagcuguaacc

SEQ ID NO: 342032 - RNA, 22 nt, Human
uucauucugcaguucucagcuc

SEQ ID NO: 342033 - RNA, 22 nt, Human
ucuggcaggucaaucauucuuu

SEQ ID NO: 342034 - RNA, 22 nt, Human
auucuucacauggauaggaucu

SEQ ID NO: 342035 - RNA, 23 nt, Human
aggcagcuggguagcaucuuucu

SEQ ID NO: 342036 - RNA, 22 nt, Human
aauacaguagguaauaguucau

SEQ ID NO: 342037 - RNA, 22 nt, Human
cuaucauuuuacaugguuggug

SEQ ID NO: 342038 - RNA, 22 nt, Human
ugaggcagggagaguggauaug

SEQ ID NO: 342039 - RNA, 22 nt, Human
guaggcagauaggagugcagcc

SEQ ID NO: 342040 - RNA, 22 nt, Human
gcuguggucugugagcuccaaa

SEQ ID NO: 342041 - RNA, 22 nt, Human
acaauacaggcuucuggacuua

SEQ ID NO: 342042 - RNA, 20 nt, Human
uggcaucucucaauuguagg

SEQ ID NO: 342043 - RNA, 22 nt, Human
uauucaaaguaccuucauugcc

SEQ ID NO: 342044 - RNA, 22 nt, Human
aauuaugagguagauaucacau

SEQ ID NO: 342045 - RNA, 18 nt, Human
gagucuuuguuacugcug

SEQ ID NO: 342046 - RNA, 22 nt, Human
guucuucaucauuuuagauagg

SEQ ID NO: 342047 - RNA, 22 nt, Human
ugaaagcacaaguucuaacagg

SEQ ID NO: 342048 - RNA, 22 nt, Human
cuuuggcacagucucauuugau

SEQ ID NO: 342049 - RNA, 22 nt, Human
auaaaguuuaaaagucaauagu

SEQ ID NO: 342050 - RNA, 22 nt, Human
cauucauuagaauagauaugua

SEQ ID NO: 342051 - RNA, 22 nt, Human
auggagggugguaagacagaga

SEQ ID NO: 342052 - RNA, 20 nt, Human
cccaggagcugugccccauc

SEQ ID NO: 342053 - RNA, 19 nt, Human
ggcagucucaagcagcaca

SEQ ID NO: 342054 - RNA, 22 nt, Human
ugucucugauaaguaguucagu

SEQ ID NO: 342055 - RNA, 22 nt, Human
uucugucaaacucacaggccga

SEQ ID NO: 342056 - RNA, 22 nt, Human
aggagcagaacugauucugacu

SEQ ID NO: 342057 - RNA, 22 nt, Human
auucuucacuguuucagaauga

SEQ ID NO: 342058 - RNA, 22 nt, Human
cauuuguaucugggcugcugug

SEQ ID NO: 342059 - RNA, 22 nt, Human
auguagaaauuaggaugauagu

SEQ ID NO: 342060 - RNA, 22 nt, Human
ucucaggaaauaggauuugagu

SEQ ID NO: 342061 - RNA, 22 nt, Human
aauugucaaacacaaauaagag

SEQ ID NO: 342062 - RNA, 22 nt, Human
ugaggggagcuagcaugccuug

SEQ ID NO: 342063 - RNA, 22 nt, Human
aaaaacugcaauuacuuuuguc

SEQ ID NO: 342064 - RNA, 22 nt, Human
uggcagcagacaaaaggccauu

SEQ ID NO: 342065 - RNA, 22 nt, Human
aaguguauauaugacuuauaaa

SEQ ID NO: 342066 - RNA, 22 nt, Human
aauauuguuucaagaucacaga

SEQ ID NO: 342067 - RNA, 22 nt, Human
auauucuugugauuauaaagua

SEQ ID NO: 342068 - RNA, 22 nt, Human
uuaaaaugaauauugauuagca

SEQ ID NO: 342069 - RNA, 22 nt, Human
uuaauuaaauucaugagcauug

SEQ ID NO: 342070 - RNA, 22 nt, Human
ugaggcaguugagcuuccugag

SEQ ID NO: 342071 - RNA, 22 nt, Human
acucaggaaaugagaggcucuc

SEQ ID NO: 342072 - RNA, 22 nt, Human
uaaggccaauuaacaaccaggg

SEQ ID NO: 342073 - RNA, 22 nt, Human
uguguuauugccacugaagacc

SEQ ID NO: 342074 - RNA, 22 nt, Human
aauauaugugguauugaccagc

SEQ ID NO: 342075 - RNA, 22 nt, Human
agguauaagucucauuucuguu

SEQ ID NO: 342076 - RNA, 22 nt, Human
gcagaggggaagcugaggaauu

SEQ ID NO: 342077 - RNA, 22 nt, Human
aguggcagagccaaguagagcc

SEQ ID NO: 342078 - RNA, 22 nt, Human
auguuugacugaguuuggcaga

SEQ ID NO: 342079 - RNA, 22 nt, Human
acaccauacucauguugguucc

SEQ ID NO: 342080 - RNA, 22 nt, Human
ucucccaggcugcccuguggac

SEQ ID NO: 342081 - RNA, 22 nt, Human
gugugaaagcuuguccucugua

SEQ ID NO: 342082 - RNA, 22 nt, Human
uuucaaacuuuacucuugaauc

SEQ ID NO: 342083 - RNA, 22 nt, Human
cagucccuaguggagcucacag

SEQ ID NO: 342084 - RNA, 22 nt, Human
cugcgcagcaaucagagaggag

SEQ ID NO: 342085 - RNA, 22 nt, Human
aucaggauagugguuaccuggg

SEQ ID NO: 342086 - RNA, 22 nt, Human
ucuuuguaaaugccuagcauaa

SEQ ID NO: 342087 - RNA, 22 nt, Human
cagaguggcacucugcuggaug

SEQ ID NO: 342088 - RNA, 22 nt, Human
cccaggaguuugaguucagcau

SEQ ID NO: 342089 - RNA, 22 nt, Human
uaacacaugaaagcaccuucuu

SEQ ID NO: 342090 - RNA, 22 nt, Human
guuuuauaauugcuucauaaga

SEQ ID NO: 342091 - RNA, 22 nt, Human
aguaaaucagaccucauuaugu

SEQ ID NO: 342092 - RNA, 22 nt, Human
acuugcugguggcauuuacagu

SEQ ID NO: 342093 - RNA, 22 nt, Human
uguuugaacugaauaacauagu

SEQ ID NO: 342094 - RNA, 22 nt, Human
accaggagagauuuuauugaga

SEQ ID NO: 342095 - RNA, 22 nt, Human
gccaggaguucagaugcauguu

SEQ ID NO: 342096 - RNA, 22 nt, Human
aggcagcuagagagugaaacug

SEQ ID NO: 342097 - RNA, 22 nt, Human
caagaugggcaccccagcaccu

SEQ ID NO: 342098 - RNA, 20 nt, Human
aggcagcuggccaggcaggu

SEQ ID NO: 342099 - RNA, 22 nt, Human
cagagagagucaaaucuuugcu

SEQ ID NO: 342100 - RNA, 22 nt, Human
agaccaagaaaggaugaggauc

SEQ ID NO: 342101 - RNA, 22 nt, Human
cuuguaauuauaauguacuguu

SEQ ID NO: 342102 - RNA, 22 nt, Human
gaggagaggggcucccaagagc

SEQ ID NO: 342103 - RNA, 22 nt, Human
uguugagacugagggagucagc

SEQ ID NO: 342104 - RNA, 22 nt, Human
uaugagaaucugcaguaugcuu

SEQ ID NO: 342105 - RNA, 22 nt, Human
uaguuaaaauaauggagauguu

SEQ ID NO: 342106 - RNA, 22 nt, Human
ccucuucugcuucaggagcacu

SEQ ID NO: 342107 - RNA, 22 nt, Human
aggcacagagaaugcccuccau

SEQ ID NO: 342108 - RNA, 22 nt, Human
uucuacaugguugcucagaggg

SEQ ID NO: 342109 - RNA, 22 nt, Human
uccaggagauacacugcaccag

SEQ ID NO: 342110 - RNA, 22 nt, Human
uugaauaguguuuucaguauac

SEQ ID NO: 342111 - RNA, 22 nt, Human
caaauaguaugagcaaugauuc

SEQ ID NO: 342112 - RNA, 22 nt, Human
ggagggaaugucuagcauucuu

SEQ ID NO: 342113 - RNA, 22 nt, Human
ugaaguuguuaagguugccauu

SEQ ID NO: 342114 - RNA, 22 nt, Human
cagcauuuagaauuugaagugu

SEQ ID NO: 342115 - RNA, 22 nt, Human
gugacaguggucacuuguaguu

SEQ ID NO: 342116 - RNA, 22 nt, Human
cauuuguuaauuacuauuaucu

SEQ ID NO: 342117 - RNA, 22 nt, Human
gaggagagaagcuaacggugcu

SEQ ID NO: 342118 - RNA, 22 nt, Human
ucccaggaauccguccucuaga

SEQ ID NO: 342119 - RNA, 22 nt, Human
aaagccauuacaaaauuucaua

SEQ ID NO: 342120 - RNA, 22 nt, Human
uugcugaaaucuaugacauccu

SEQ ID NO: 342121 - RNA, 22 nt, Human
uauuugcaacauaaaacucuga

SEQ ID NO: 342122 - RNA, 22 nt, Human
uuucaaacauaucuucauuacu

SEQ ID NO: 342123 - RNA, 22 nt, Human
ggaguaggaguagaacucauca

SEQ ID NO: 342124 - RNA, 22 nt, Human
agcagcauuaugauauaucuua

SEQ ID NO: 342125 - RNA, 22 nt, Human
cuucccagaccuuagagugcag

SEQ ID NO: 342126 - RNA, 22 nt, Human
auguaugauauuuccaguauca

SEQ ID NO: 342127 - RNA, 22 nt, Human
aggcagcagugauaagauagga

SEQ ID NO: 342128 - RNA, 22 nt, Human
cccagaaggucgaggcugcagu

SEQ ID NO: 342129 - RNA, 22 nt, Human
cccaggaggucgaagcugcagu

SEQ ID NO: 342130 - RNA, 22 nt, Human
uguccucuuccagugcuccuuc

SEQ ID NO: 342131 - RNA, 22 nt, Human
aagauaaacucuugauuucuga

SEQ ID NO: 342132 - RNA, 22 nt, Human
cucaggauuuacuaauuucaag

SEQ ID NO: 342133 - RNA, 22 nt, Human
auugaaaguccuaucuaaggga

SEQ ID NO: 342134 - RNA, 22 nt, Human
aggcuggagggcaauggcaaga

SEQ ID NO: 342135 - RNA, 22 nt, Human
guaucacuuuugagagugagaa

SEQ ID NO: 342136 - RNA, 22 nt, Human
uuugaaguggaaaaggauuuaa

SEQ ID NO: 342137 - RNA, 22 nt, Human
uucaggauucuuucagacuggg

SEQ ID NO: 342138 - RNA, 19 nt, Human
uggagacugagagugagca

SEQ ID NO: 342139 - RNA, 22 nt, Human
cuucaggauuuaggaagaugaa

SEQ ID NO: 342140 - RNA, 22 nt, Human
gucuauauauugcuugaauaau

SEQ ID NO: 342141 - RNA, 21 nt, Human
ugcugaugucagagaagcaag

SEQ ID NO: 342142 - RNA, 22 nt, Human
uggcagagcaaaaagauagaau

SEQ ID NO: 342143 - RNA, 22 nt, Human
aucuacauaaaacgaauacaua

SEQ ID NO: 342144 - RNA, 22 nt, Human
cagcuacuccucccaugacuuc

SEQ ID NO: 342145 - RNA, 22 nt, Human
uuugagauggagucuugcucug

SEQ ID NO: 342146 - RNA, 22 nt, Human
ggccagaggugguacauagcuu

SEQ ID NO: 342147 - RNA, 22 nt, Human
gaacuguaguuaauacuacaca

SEQ ID NO: 342148 - RNA, 22 nt, Human
auucauaacggcaaaugucacc

SEQ ID NO: 342149 - RNA, 22 nt, Human
cuuuccaagaaugcagauaccu

SEQ ID NO: 342150 - RNA, 22 nt, Human
uaucuguuugcucacagguguu

SEQ ID NO: 342151 - RNA, 22 nt, Human
gagggaggcaucaugaauccag

SEQ ID NO: 342152 - RNA, 22 nt, Human
auuuccagugcacugaauagaa

SEQ ID NO: 342153 - RNA, 20 nt, Human
gcucccagccugcagucccc

SEQ ID NO: 342154 - RNA, 22 nt, Human
cccaggaggcagagguugcagu

SEQ ID NO: 342155 - RNA, 22 nt, Human
gcagcuaccacccaggaaggac

SEQ ID NO: 342156 - RNA, 22 nt, Human
uuagaacuuaagaauacugucu

SEQ ID NO: 342157 - RNA, 22 nt, Human
aagcaccuggguuauaucuuag

SEQ ID NO: 342158 - RNA, 22 nt, Human
uguucucacuggaugcuucaca

SEQ ID NO: 342159 - RNA, 22 nt, Human
cucaacagcucugccauacucc

SEQ ID NO: 342160 - RNA, 23 nt, Human
acagaaaucauuuguaagguacc

SEQ ID NO: 342161 - RNA, 22 nt, Human
augaaacacacacgcgcauacu

SEQ ID NO: 342162 - RNA, 22 nt, Human
uguucauuuggcccuuuuguau

SEQ ID NO: 342163 - RNA, 22 nt, Human
gaggccaggacaugaaagcuga

SEQ ID NO: 342164 - RNA, 22 nt, Human
gagcauuuuugucugcauuuua

SEQ ID NO: 342165 - RNA, 22 nt, Human
auguuagaaucucugaaugugg

SEQ ID NO: 342166 - RNA, 22 nt, Human
uucuuacagaguuuacagagcc

SEQ ID NO: 342167 - RNA, 22 nt, Human
uggcagcuggaucccaaggcag

SEQ ID NO: 342168 - RNA, 22 nt, Human
ggauguugauugaauggccauu

SEQ ID NO: 342169 - RNA, 22 nt, Human
aggcucagaggugagcaucugc

SEQ ID NO: 342170 - RNA, 22 nt, Human
auugaaagaguuuucugcugca

SEQ ID NO: 342171 - RNA, 22 nt, Human
uccaggaggccucauuuccugu

SEQ ID NO: 342172 - RNA, 22 nt, Human
augcuguguuugagaaccuagg

SEQ ID NO: 342173 - RNA, 22 nt, Human
ugccaggauauaagagugcgau

SEQ ID NO: 342174 - RNA, 22 nt, Human
cagcauuuaucuuguagcagga

SEQ ID NO: 342175 - RNA, 22 nt, Human
agcucccagagcucgagaguaa

SEQ ID NO: 342176 - RNA, 22 nt, Human
ugugaaauucuugaaaugcaca

SEQ ID NO: 342177 - RNA, 22 nt, Human
caggcagccaggggaccugucc

SEQ ID NO: 342178 - RNA, 22 nt, Human
aggagcagcuucugaaccaugu

SEQ ID NO: 342179 - RNA, 22 nt, Human
agagagcauugaggaaaucuuc

SEQ ID NO: 342180 - RNA, 20 nt, Human
uuucacagucccuguuuccu

SEQ ID NO: 342181 - RNA, 22 nt, Human
guuuuucuuugugugaagacaa

SEQ ID NO: 342182 - RNA, 22 nt, Human
aacaaaugaccugauuucuucc

SEQ ID NO: 342183 - RNA, 22 nt, Human
guaggcagguggaggagugaag

SEQ ID NO: 342184 - RNA, 22 nt, Human
auuaaaauuccaagguaugcca

SEQ ID NO: 342185 - RNA, 22 nt, Human
augcuuuuccaggagaaauaua

SEQ ID NO: 342186 - RNA, 22 nt, Human
gcccaggauaaugcugucccug

SEQ ID NO: 342187 - RNA, 22 nt, Human
cccgggaggaggaaguugcagu

SEQ ID NO: 342188 - RNA, 22 nt, Human
cuacccaggcuuagagggcugg

SEQ ID NO: 342189 - RNA, 22 nt, Human
augucaaaucaguuuuaucaga

SEQ ID NO: 342190 - RNA, 22 nt, Human
uuuguuuagaaagagauuggug

SEQ ID NO: 342191 - RNA, 20 nt, Human
ucagugauuuugaagaggaa

SEQ ID NO: 342192 - RNA, 22 nt, Human
cagauccacccuuguagugaca

SEQ ID NO: 342193 - RNA, 22 nt, Human
acagugacguuuauuugagacg

SEQ ID NO: 342194 - RNA, 22 nt, Human
guccucuggaagaugaguucuu

SEQ ID NO: 342195 - RNA, 18 nt, Human
ugcuggguaacuguaugg

SEQ ID NO: 342196 - RNA, 22 nt, Human
ucaguucugcuagaaaaacagu

SEQ ID NO: 342197 - RNA, 22 nt, Human
uauuuccaaaagccuauuauga

SEQ ID NO: 342198 - RNA, 22 nt, Human
aggcagguccccuggaaggcac

SEQ ID NO: 342199 - RNA, 22 nt, Human
cugccagucuaugcugcucggc

SEQ ID NO: 342200 - RNA, 22 nt, Human
uccaggaggguuuucugccuuc

SEQ ID NO: 342201 - RNA, 22 nt, Human
gaccauuugcuaguaaauugca

SEQ ID NO: 342202 - RNA, 22 nt, Human
augaggcauuccacucaaacuc

SEQ ID NO: 342203 - RNA, 22 nt, Human
aaaagucugcucucauuucaga

SEQ ID NO: 342204 - RNA, 22 nt, Human
cccaucacagacacuggguuau

SEQ ID NO: 342205 - RNA, 22 nt, Human
uucaaauacauucuuugccacu

SEQ ID NO: 342206 - RNA, 22 nt, Human
ucauacaucuguccuggagcuc

SEQ ID NO: 342207 - RNA, 20 nt, Human
cauuuguuagcuuucuacug

SEQ ID NO: 342208 - RNA, 22 nt, Human
agaccauggccauccuaggaaa

SEQ ID NO: 342209 - RNA, 22 nt, Human
uugaaaggguuaaagugguaaa

SEQ ID NO: 342210 - RNA, 22 nt, Human
guuuuauaggcuguugcuauau

SEQ ID NO: 342211 - RNA, 22 nt, Human
ugaggcaggagguugagaacug

SEQ ID NO: 342212 - RNA, 22 nt, Human
caaggccacugcucagguuucc

SEQ ID NO: 342213 - RNA, 22 nt, Human
gagugucugaauuagagcacaa

SEQ ID NO: 342214 - RNA, 16 nt, Human
uguaugaacgucucca

SEQ ID NO: 342215 - RNA, 19 nt, Human
caggagagcaugcacuuug

SEQ ID NO: 342216 - RNA, 22 nt, Human
gauggcagucaaccaggugagg

SEQ ID NO: 342217 - RNA, 22 nt, Human
uagauauguguuuauuaugcug

SEQ ID NO: 342218 - RNA, 22 nt, Human
aagggcagagggaaucccacau

SEQ ID NO: 342219 - RNA, 22 nt, Human
agaggggagagcuaagcaauuc

SEQ ID NO: 342220 - RNA, 22 nt, Human
uauuuucuggacagucuugcuu

SEQ ID NO: 342221 - RNA, 22 nt, Human
aaccauuugcaguuacugagac

SEQ ID NO: 342222 - RNA, 22 nt, Human
agggagugguuaagaaggugca

SEQ ID NO: 342223 - RNA, 22 nt, Human
aggcaccuugagagcaggagcu

SEQ ID NO: 342224 - RNA, 22 nt, Human
aagcuggagaguuaggugaaua

SEQ ID NO: 342225 - RNA, 22 nt, Human
caaaugauagagccgauuauca

SEQ ID NO: 342226 - RNA, 22 nt, Human
guuauacauauguguuaacaaa

SEQ ID NO: 342227 - RNA, 22 nt, Human
accuugaugccuuuccaagaug

SEQ ID NO: 342228 - RNA, 22 nt, Human
gaggccaggaagcccaagauca

SEQ ID NO: 342229 - RNA, 17 nt, Human
aggcagcucagaacauc

SEQ ID NO: 342230 - RNA, 22 nt, Human
cagaaggcuuuguggaguagac

SEQ ID NO: 342231 - RNA, 22 nt, Human
acuuaaaaagaaucuuuucacg

SEQ ID NO: 342232 - RNA, 22 nt, Human
ucaaaguuacuugugguuuucu

SEQ ID NO: 342233 - RNA, 22 nt, Human
agucuccuuggccucaaugccu

SEQ ID NO: 342234 - RNA, 22 nt, Human
uuucuucagccuucacaaccug

SEQ ID NO: 342235 - RNA, 23 nt, Human
uagaaugucauucaaugauaugg

SEQ ID NO: 342236 - RNA, 22 nt, Human
caggauggccccggggcugugc

SEQ ID NO: 342237 - RNA, 22 nt, Human
auuugcuuaucuccacaguugu

SEQ ID NO: 342238 - RNA, 22 nt, Human
gagacagcacaggccacuggga

SEQ ID NO: 342239 - RNA, 23 nt, Human
cuccccaguguccucaugcaucu

SEQ ID NO: 342240 - RNA, 22 nt, Human
guucuucaucauuaacacucug

SEQ ID NO: 342241 - RNA, 22 nt, Human
ugaaaggugacauuucuuggau

SEQ ID NO: 342242 - RNA, 22 nt, Human
gcuuuggagccuguguucugcc

SEQ ID NO: 342243 - RNA, 22 nt, Human
aguaccaugcuuccugacuggu

SEQ ID NO: 342244 - RNA, 22 nt, Human
auucuucagaauaucuggcacu

SEQ ID NO: 342245 - RNA, 22 nt, Human
auucaaguucuucugucuuugc

SEQ ID NO: 342246 - RNA, 22 nt, Human
aauacugucuuucacagauauu

SEQ ID NO: 342247 - RNA, 22 nt, Human
cucaggauguacuacagaaggc

SEQ ID NO: 342248 - RNA, 22 nt, Human
aucaggauagucuguaaauugu

SEQ ID NO: 342249 - RNA, 22 nt, Human
acagauguacacucauauauaa

SEQ ID NO: 342250 - RNA, 23 nt, Human
acuuuauugaccccaggucaguu

SEQ ID NO: 342251 - RNA, 22 nt, Human
uaugaacucuggagucugagug

SEQ ID NO: 342252 - RNA, 23 nt, Human
aucauucuccaaucuggagcagg

SEQ ID NO: 342253 - RNA, 22 nt, Human
uuucacaagacagcuacuguug

SEQ ID NO: 342254 - RNA, 22 nt, Human
cccauugugguuguugaggaua

SEQ ID NO: 342255 - RNA, 22 nt, Human
uauugacaauuugugaaacuau

SEQ ID NO: 342256 - RNA, 22 nt, Human
uucuuucucaacaugaauguuu

SEQ ID NO: 342257 - RNA, 22 nt, Human
accaggaguugggggugggacc

SEQ ID NO: 342258 - RNA, 22 nt, Human
aauaugcauuaacuguguacau

SEQ ID NO: 342259 - RNA, 22 nt, Human
ucagauggcacacagagccugc

SEQ ID NO: 342260 - RNA, 22 nt, Human
agaggauguucuaggcacucau

SEQ ID NO: 342261 - RNA, 22 nt, Human
ucacuucacacccacuaucaug

SEQ ID NO: 342262 - RNA, 22 nt, Human
uucugucagaagcuagcuccug

SEQ ID NO: 342263 - RNA, 23 nt, Human
aaauaugucugagggcaaagaau

SEQ ID NO: 342264 - RNA, 22 nt, Human
cauuuucaugaguuucuguuca

SEQ ID NO: 342265 - RNA, 22 nt, Human
auauaauacaaccugcuaagug

SEQ ID NO: 342266 - RNA, 22 nt, Human
caggaugguggcaugaucagaa

SEQ ID NO: 342267 - RNA, 22 nt, Human
uucacauugugcagauuauggu

SEQ ID NO: 342268 - RNA, 22 nt, Human
uaacaucuuuagcagcucgaac

SEQ ID NO: 342269 - RNA, 22 nt, Human
agcuacccgaggacaggcuaag

SEQ ID NO: 342270 - RNA, 22 nt, Human
uuuguaaaggccugaauuucag

SEQ ID NO: 342271 - RNA, 22 nt, Human
cacaggagagcugggaggugcc

SEQ ID NO: 342272 - RNA, 22 nt, Human
augcuacagaguuugaauaugu

SEQ ID NO: 342273 - RNA, 20 nt, Human
gagauggacagaugaagggg

SEQ ID NO: 342274 - RNA, 22 nt, Human
ugcaggaacugggagggauagu

SEQ ID NO: 342275 - RNA, 22 nt, Human
uucaggaugacaccauguccag

SEQ ID NO: 342276 - RNA, 22 nt, Human
cagaguggcgacccccucagcu

SEQ ID NO: 342277 - RNA, 22 nt, Human
uuauuacacugaaagaauugcg

SEQ ID NO: 342278 - RNA, 21 nt, Human
acagauauuucauugaacauu

SEQ ID NO: 342279 - RNA, 22 nt, Human
ucuuuguaacugucuauugaga

SEQ ID NO: 342280 - RNA, 22 nt, Human
aaagaauagccuuuguccaaau

SEQ ID NO: 342281 - RNA, 22 nt, Human
uaauuucaauagcuugcauaau

SEQ ID NO: 342282 - RNA, 22 nt, Human
uaucaauacauguuaucagugu

SEQ ID NO: 342283 - RNA, 22 nt, Human
ccugcugugaagccaggccugu

SEQ ID NO: 342284 - RNA, 17 nt, Human
ugaauucaaucugcacu

SEQ ID NO: 342285 - RNA, 22 nt, Human
uuugcagucuggccugcuuugg

SEQ ID NO: 342286 - RNA, 22 nt, Human
cacaaauggccguguucaaaga

SEQ ID NO: 342287 - RNA, 20 nt, Human
uauuuguauuugggaaaguu

SEQ ID NO: 342288 - RNA, 20 nt, Human
gggugggagagucugagggu

SEQ ID NO: 342289 - RNA, 22 nt, Human
cuccaugaauuugagcuuugug

SEQ ID NO: 342290 - RNA, 22 nt, Human
cggcagcugauugcagagcacc

SEQ ID NO: 342291 - RNA, 22 nt, Human
uuacacaacaucuguauuauua

SEQ ID NO: 342292 - RNA, 17 nt, Human
uuucuccuuccaucuca

SEQ ID NO: 342293 - RNA, 22 nt, Human
gucaggauuauaauccccaugg

SEQ ID NO: 342294 - RNA, 22 nt, Human
uucauucuugucuuuguauagu

SEQ ID NO: 342295 - RNA, 22 nt, Human
cuggaguuagaguagacacuga

SEQ ID NO: 342296 - RNA, 22 nt, Human
ucuccuccuuuuuucaacauag

SEQ ID NO: 342297 - RNA, 22 nt, Human
cucaggauagcugcgcagccug

SEQ ID NO: 342298 - RNA, 22 nt, Human
uuucacagcuggguggcagagu

SEQ ID NO: 342299 - RNA, 22 nt, Human
cucacugacgaggaagcugaga

SEQ ID NO: 342300 - RNA, 22 nt, Human
agugcuuugagcguuugaaaag

SEQ ID NO: 342301 - RNA, 22 nt, Human
ugaaauuaugcauuguuguacc

SEQ ID NO: 342302 - RNA, 22 nt, Human
agaaaugaaaccaaagccuaga

SEQ ID NO: 342303 - RNA, 22 nt, Human
aggacuuagaacauuauguacu

SEQ ID NO: 342304 - RNA, 23 nt, Human
uugauuucaaaugcagagaacac

SEQ ID NO: 342305 - RNA, 22 nt, Human
gggcagcugcagggauggugac

SEQ ID NO: 342306 - RNA, 22 nt, Human
uaaauuguuuucuagaaguugu

SEQ ID NO: 342307 - RNA, 22 nt, Human
cccaggaccgcgcggcugagcg

SEQ ID NO: 342308 - RNA, 22 nt, Human
ucccaggacaugggcucugcuc

SEQ ID NO: 342309 - RNA, 22 nt, Human
caggagaucuuaggaauucuua

SEQ ID NO: 342310 - RNA, 22 nt, Human
gggcaguugauggaggucugga

SEQ ID NO: 342311 - RNA, 22 nt, Human
cuugcuucauuagugucuuagu

SEQ ID NO: 342312 - RNA, 22 nt, Human
ugcuggguuaccuaagccuaaa

SEQ ID NO: 342313 - RNA, 22 nt, Human
cucaggauggaagccuacagga

SEQ ID NO: 342314 - RNA, 22 nt, Human
cugcugugauugggagaaaccg

SEQ ID NO: 342315 - RNA, 20 nt, Human
ugcugucguguuuucugcuu

SEQ ID NO: 342316 - RNA, 22 nt, Human
gaggcugcuuugaugacaggag

SEQ ID NO: 342317 - RNA, 22 nt, Human
ucccaggauuuuaggcucucag

SEQ ID NO: 342318 - RNA, 22 nt, Human
guagggagcccagagcccagug

SEQ ID NO: 342319 - RNA, 17 nt, Human
gccucugcuugugucau

SEQ ID NO: 342320 - RNA, 22 nt, Human
uaaauuaugucacaugacucug

SEQ ID NO: 342321 - RNA, 21 nt, Human
agcagaggcagaauguaugca

SEQ ID NO: 342322 - RNA, 22 nt, Human
ggccaggaagggaagaucagca

SEQ ID NO: 342323 - RNA, 22 nt, Human
aacuacauuguccuuucugaag

SEQ ID NO: 342324 - RNA, 22 nt, Human
uuucaugaggggcaaaaucuca

SEQ ID NO: 342325 - RNA, 23 nt, Human
agggugagcaagcuauggagacc

SEQ ID NO: 342326 - RNA, 22 nt, Human
agguaugagauaaaucaaugaa

SEQ ID NO: 342327 - RNA, 22 nt, Human
ugcauguguguguauuuauaaa

SEQ ID NO: 342328 - RNA, 22 nt, Human
aggguagguguaagauagcccu

SEQ ID NO: 342329 - RNA, 22 nt, Human
acuugcauuauauuuaucacaa

SEQ ID NO: 342330 - RNA, 22 nt, Human
uagggauguggugagaacugag

SEQ ID NO: 342331 - RNA, 22 nt, Human
cccagcaguaaccaguggaaau

SEQ ID NO: 342332 - RNA, 22 nt, Human
gccugcagauauauaggauggu

SEQ ID NO: 342333 - RNA, 22 nt, Human
cuuaacauccugcauuuuucuu

SEQ ID NO: 342334 - RNA, 22 nt, Human
ggagaggagauuguggcauuuu

SEQ ID NO: 342335 - RNA, 17 nt, Human
uagcuguguuucagcua

SEQ ID NO: 342336 - RNA, 22 nt, Human
acgagagguccuuagaaucugu

SEQ ID NO: 342337 - RNA, 22 nt, Human
uucucagguagugcugaugcug

SEQ ID NO: 342338 - RNA, 22 nt, Human
ggaggacaggggcugcagcaca

SEQ ID NO: 342339 - RNA, 21 nt, Human
gccaggaguagauuacauuua

SEQ ID NO: 342340 - RNA, 22 nt, Human
auguucuuguucaaaugucagu

SEQ ID NO: 342341 - RNA, 22 nt, Human
cuguauuuguccucuauuuauu

SEQ ID NO: 342342 - RNA, 22 nt, Human
ucauuuauaaggaugcaauuaa

SEQ ID NO: 342343 - RNA, 22 nt, Human
uagggcagaguccaggaugggc

SEQ ID NO: 342344 - RNA, 22 nt, Human
augcugugagugugccgcagag

SEQ ID NO: 342345 - RNA, 22 nt, Human
uuguugguggaauugaugcuag

SEQ ID NO: 342346 - RNA, 22 nt, Human
uaaggccaggcuguggucggca

SEQ ID NO: 342347 - RNA, 23 nt, Human
cagaaaacccagagcucaguccc

SEQ ID NO: 342348 - RNA, 22 nt, Human
gaaacauacgauuuaggagaaa

SEQ ID NO: 342349 - RNA, 22 nt, Human
ucucaaaucaaacuuugagcuu

SEQ ID NO: 342350 - RNA, 22 nt, Human
ucauucuuuaccaaguugucac

SEQ ID NO: 342351 - RNA, 22 nt, Human
agaaaauauucauugagaggcu

SEQ ID NO: 342352 - RNA, 17 nt, Human
gcuguaguuugauaaga

SEQ ID NO: 342353 - RNA, 22 nt, Human
cuguggaaggccuguccugaaa

SEQ ID NO: 342354 - RNA, 22 nt, Human
uugaaaguuuauggagucugca

SEQ ID NO: 342355 - RNA, 22 nt, Human
gaaauauuacaguggaggggau

SEQ ID NO: 342356 - RNA, 22 nt, Human
cucaggauauugggcuggagca

SEQ ID NO: 342357 - RNA, 22 nt, Human
cugcauuagucaugcuuugcag

SEQ ID NO: 342358 - RNA, 22 nt, Human
gaaaacuauuggccuagaacaa

SEQ ID NO: 342359 - RNA, 22 nt, Human
guucucucugcuuccaagaugg

SEQ ID NO: 342360 - RNA, 22 nt, Human
ugcugcugauggcaccuaggca

SEQ ID NO: 342361 - RNA, 22 nt, Human
cacagucacauaucuaugugug

SEQ ID NO: 342362 - RNA, 23 nt, Human
uuucuucagaagccuugcgaggc

SEQ ID NO: 342363 - RNA, 22 nt, Human
cacucuccagcacaccccauuu

SEQ ID NO: 342364 - RNA, 20 nt, Human
aauuuacucacagaaugaau

SEQ ID NO: 342365 - RNA, 19 nt, Human
uggagggguuugaaugugg

SEQ ID NO: 342366 - RNA, 22 nt, Human
ucugggaaguccucugucaugc

SEQ ID NO: 342367 - RNA, 22 nt, Human
auaucacaguaguuguuuaguu

SEQ ID NO: 342368 - RNA, 22 nt, Human
aagcacauuguacauuugugcu

SEQ ID NO: 342369 - RNA, 22 nt, Human
uguaugaauauguauuuucaua

SEQ ID NO: 342370 - RNA, 22 nt, Human
ggauggagguucucagaugcuc

SEQ ID NO: 342371 - RNA, 22 nt, Human
ucccaggagcaccuuuugagcc

SEQ ID NO: 342372 - RNA, 19 nt, Human
ggcagcuugggaagguagc

SEQ ID NO: 342373 - RNA, 22 nt, Human
acccaggaaaacauggugcaga

SEQ ID NO: 342374 - RNA, 22 nt, Human
cgccucagccguggucaucuuc

SEQ ID NO: 342375 - RNA, 22 nt, Human
agccagcugugggcucaggcgg

SEQ ID NO: 342376 - RNA, 22 nt, Human
aauguaugugauuauuccucua

SEQ ID NO: 342377 - RNA, 22 nt, Human
aaaggccaugguuggaguguuu

SEQ ID NO: 342378 - RNA, 22 nt, Human
cugcugugagugguucuugccu

SEQ ID NO: 342379 - RNA, 22 nt, Human
gagguggugguggaggcauagc

SEQ ID NO: 342380 - RNA, 22 nt, Human
guuuuaguggguggccacugau

SEQ ID NO: 342381 - RNA, 22 nt, Human
cacacucauuagucauuucucu

SEQ ID NO: 342382 - RNA, 22 nt, Human
ucacaaaugaggaaaucgagca

SEQ ID NO: 342383 - RNA, 22 nt, Human
gcauguguuauuuuauguauga

SEQ ID NO: 342384 - RNA, 22 nt, Human
cccaggaagaaauucugauuug

SEQ ID NO: 342385 - RNA, 15 nt, Human
cccaggaguucgaga

SEQ ID NO: 342386 - RNA, 22 nt, Human
aucugccugcaguggagguggg

SEQ ID NO: 342387 - RNA, 22 nt, Human
uacagcuaggcaaaaaugacau

SEQ ID NO: 342388 - RNA, 22 nt, Human
aauauccacacugugucccugc

SEQ ID NO: 342389 - RNA, 22 nt, Human
auucugucauuucaagaaaaac

SEQ ID NO: 342390 - RNA, 21 nt, Human
cccaggaguccuauuuaaaug

SEQ ID NO: 342391 - RNA, 22 nt, Human
cucccaggggaacuaucaagua

SEQ ID NO: 342392 - RNA, 19 nt, Human
caggaugaucccaugacac

SEQ ID NO: 342393 - RNA, 22 nt, Human
gucccauaaguagugcaacuug

SEQ ID NO: 342394 - RNA, 22 nt, Human
cucccaggacucagaggagaag

SEQ ID NO: 342395 - RNA, 22 nt, Human
gaggcagcaauaaaaagaauuu

SEQ ID NO: 342396 - RNA, 22 nt, Human
auguauuucuauguagugaaga

SEQ ID NO: 342397 - RNA, 22 nt, Human
auaugugaaugauaucacuuug

SEQ ID NO: 342398 - RNA, 20 nt, Human
ugugaaagcaguagaaugac

SEQ ID NO: 342399 - RNA, 22 nt, Human
augugucuuugagacucugcua

SEQ ID NO: 342400 - RNA, 22 nt, Human
cagcaggagcagucagacuccu

SEQ ID NO: 342401 - RNA, 22 nt, Human
uucucugaguacguuucagugu

SEQ ID NO: 342402 - RNA, 22 nt, Human
gugcugugcgcuuuuucuguau

SEQ ID NO: 342403 - RNA, 22 nt, Human
aaaguaguuagucaugugaaaa

SEQ ID NO: 342404 - RNA, 22 nt, Human
uuucaguuguccuguuaauagc

SEQ ID NO: 342405 - RNA, 22 nt, Human
caguggagagacuuuuacucuu

SEQ ID NO: 342406 - RNA, 22 nt, Human
uggcagcuaucuuuaaugagau

SEQ ID NO: 342407 - RNA, 22 nt, Human
gcaggcaguuauuuaguagaau

SEQ ID NO: 342408 - RNA, 19 nt, Human
aucugccuuagugcugcug

SEQ ID NO: 342409 - RNA, 22 nt, Human
uuugaaagcaccauuugaguag

SEQ ID NO: 342410 - RNA, 22 nt, Human
ugugaaaagcaggcuacuuucu

SEQ ID NO: 342411 - RNA, 22 nt, Human
ucuuugaaagcuguucuagagu

SEQ ID NO: 342412 - RNA, 22 nt, Human
caagauggacauaaggagagaa

SEQ ID NO: 342413 - RNA, 23 nt, Human
guaaaauacgcagugcaguguga

SEQ ID NO: 342414 - RNA, 22 nt, Human
uccaggagucuagccucaggcc

SEQ ID NO: 342415 - RNA, 22 nt, Human
cauuuuaaaugauuuaagccaa

SEQ ID NO: 342416 - RNA, 23 nt, Human
uggacgccgacuuuggaggcgcu

SEQ ID NO: 342417 - RNA, 22 nt, Human
aaguaugaaucaaagacuaucu

SEQ ID NO: 342418 - RNA, 22 nt, Human
cccaggaaacccgaaggcgacc

SEQ ID NO: 342419 - RNA, 22 nt, Human
agcuucccaagguuggaagguu

SEQ ID NO: 342420 - RNA, 22 nt, Human
aauaaucucccuuuuuguaugu

SEQ ID NO: 342421 - RNA, 22 nt, Human
uugacacagaucaauauucaac

SEQ ID NO: 342422 - RNA, 22 nt, Human
aagugagugguaaggagcaugg

SEQ ID NO: 342423 - RNA, 22 nt, Human
gauauguauugaaugaucauuu

SEQ ID NO: 342424 - RNA, 22 nt, Human
uggcagcuagauaguguguuua

SEQ ID NO: 342425 - RNA, 22 nt, Human
ucaucucaaaacccaaggggca

SEQ ID NO: 342426 - RNA, 22 nt, Human
gcuuugaagucugugucuuuug

SEQ ID NO: 342427 - RNA, 22 nt, Human
aucuuguuauaagagauaaugg

SEQ ID NO: 342428 - RNA, 22 nt, Human
ccaggagacccagggaaggagc

SEQ ID NO: 342429 - RNA, 22 nt, Human
uuacuuugcuuucucauuacag

SEQ ID NO: 342430 - RNA, 17 nt, Human
aaucuguuuacagucag

SEQ ID NO: 342431 - RNA, 22 nt, Human
uugugaaauguuucaaaauagu

SEQ ID NO: 342432 - RNA, 22 nt, Human
agcuagccuaggcagagugcau

SEQ ID NO: 342433 - RNA, 22 nt, Human
aggcagugcucaagacagcagc

SEQ ID NO: 342434 - RNA, 22 nt, Human
ggaggcagaauagagugugggu

SEQ ID NO: 342435 - RNA, 22 nt, Human
ugaggcaggacugagcgggaug

SEQ ID NO: 342436 - RNA, 22 nt, Human
aaaguuagacagcaucauuucu

SEQ ID NO: 342437 - RNA, 22 nt, Human
ucaggagauggucuuuauaggc

SEQ ID NO: 342438 - RNA, 22 nt, Human
ugugaaggagaugaagggagug

SEQ ID NO: 342439 - RNA, 20 nt, Human
guugaaaguaauaugaugcu

SEQ ID NO: 342440 - RNA, 21 nt, Human
uucuucaugaugauuaauggc

SEQ ID NO: 342441 - RNA, 22 nt, Human
uuaacauuguccuuagcagauu

SEQ ID NO: 342442 - RNA, 22 nt, Human
acaaauaugguacucggagaaa

SEQ ID NO: 342443 - RNA, 22 nt, Human
aaguuugcauagauuaagcauu

SEQ ID NO: 342444 - RNA, 22 nt, Human
caggauagaaaggccauggagu

SEQ ID NO: 342445 - RNA, 22 nt, Human
gucaggauguuuauucuccagu

SEQ ID NO: 342446 - RNA, 22 nt, Human
gagaggcaggcgcugcaauggu

SEQ ID NO: 342447 - RNA, 22 nt, Human
cuacccagauccaggauggcua

SEQ ID NO: 342448 - RNA, 22 nt, Human
ugagauguaagguaugcuuacu

SEQ ID NO: 342449 - RNA, 22 nt, Human
ggcagcuguaagaugagugaau

SEQ ID NO: 342450 - RNA, 22 nt, Human
ucugcaggcuuauaggaugggu

SEQ ID NO: 342451 - RNA, 19 nt, Human
caaggccaccauuucuccg

SEQ ID NO: 342452 - RNA, 22 nt, Human
ucacugcucuccaauguggagu

SEQ ID NO: 342453 - RNA, 22 nt, Human
uuugaacuucuaccugucauau

SEQ ID NO: 342454 - RNA, 18 nt, Human
ucauuuguuuugcaugaa

SEQ ID NO: 342455 - RNA, 20 nt, Human
guggcaggcagugaaggagc

SEQ ID NO: 342456 - RNA, 22 nt, Human
uuugaaaggugucgagaugugu

SEQ ID NO: 342457 - RNA, 22 nt, Human
uugcugugucauuuguuuaauc

SEQ ID NO: 342458 - RNA, 22 nt, Human
ucuuuuggaaaugaugugcagg

SEQ ID NO: 342459 - RNA, 22 nt, Human
ucuaaagaagaggguucugcgg

SEQ ID NO: 342460 - RNA, 21 nt, Human
uucuucaaagaagaaggcaca

SEQ ID NO: 342461 - RNA, 22 nt, Human
gccucugcaauuacauugugcc

SEQ ID NO: 342462 - RNA, 22 nt, Human
guugaaagagcauggacuugaa

SEQ ID NO: 342463 - RNA, 22 nt, Human
ggaggaggggcgcuuugucuau

SEQ ID NO: 342464 - RNA, 22 nt, Human
agaccauagggaccucagguug

SEQ ID NO: 342465 - RNA, 22 nt, Human
uuuacaaccucauauucugaug

SEQ ID NO: 342466 - RNA, 22 nt, Human
aaugaaauguagcuuauccaua

SEQ ID NO: 342467 - RNA, 22 nt, Human
uugcagcuucuaccacuguuuc

SEQ ID NO: 342468 - RNA, 22 nt, Human
aggccagcacgacagccgcagg

SEQ ID NO: 342469 - RNA, 22 nt, Human
agcacauucugccuugcuuugc

SEQ ID NO: 342470 - RNA, 18 nt, Human
cugcccagagcauuucau

SEQ ID NO: 342471 - RNA, 22 nt, Human
uuuaacagguaaaguaaaugug

SEQ ID NO: 342472 - RNA, 22 nt, Human
gaucauuuugaugcccuuuuag

SEQ ID NO: 342473 - RNA, 22 nt, Human
aucuuucagggccauuuguauu

SEQ ID NO: 342474 - RNA, 22 nt, Human
cacaauguauauguauaucaaa

SEQ ID NO: 342475 - RNA, 22 nt, Human
ggagguggcagagggacauucu

SEQ ID NO: 342476 - RNA, 22 nt, Human
cagcagagaccaagugauuuga

SEQ ID NO: 342477 - RNA, 22 nt, Human
cuguaugaggaucagacuggac

SEQ ID NO: 342478 - RNA, 22 nt, Human
ugaggcagaaauuccuguuuuc

SEQ ID NO: 342479 - RNA, 22 nt, Human
uuggaaagauuauuauuaugaa

SEQ ID NO: 342480 - RNA, 22 nt, Human
cagggaggcugucuuaugccug

SEQ ID NO: 342481 - RNA, 22 nt, Human
ugucucugaggugagggucagc

SEQ ID NO: 342482 - RNA, 22 nt, Human
aaagccagagcaagcugucaca

SEQ ID NO: 342483 - RNA, 22 nt, Human
ggccaggagcugcacagggcuc

SEQ ID NO: 342484 - RNA, 22 nt, Human
auuuagaacuuuguuugccaau

SEQ ID NO: 342485 - RNA, 17 nt, Human
agaacuguaguagcucc

SEQ ID NO: 342486 - RNA, 22 nt, Human
agggcaguucaacuucauagug

SEQ ID NO: 342487 - RNA, 22 nt, Human
agaauccucuucaguaaauucu

SEQ ID NO: 342488 - RNA, 22 nt, Human
cauuucacaaauggccacauca

SEQ ID NO: 342489 - RNA, 22 nt, Human
guucuucaucuuaaccaucugu

SEQ ID NO: 342490 - RNA, 22 nt, Human
cugcaucacagcaggaggcaca

SEQ ID NO: 342491 - RNA, 22 nt, Human
auuuccuuugcaaagacugugc

SEQ ID NO: 342492 - RNA, 22 nt, Human
ucaauucaacacaugcacauug

SEQ ID NO: 342493 - RNA, 22 nt, Human
gauuuuaauuauaggagguccu

SEQ ID NO: 342494 - RNA, 22 nt, Human
uuugaaaucuaaucaaggaaca

SEQ ID NO: 342495 - RNA, 22 nt, Human
agguauaagaagauuauuuaua

SEQ ID NO: 342496 - RNA, 22 nt, Human
ccugcuguaaugugucuuuauu

SEQ ID NO: 342497 - RNA, 22 nt, Human
uuauuauuggugaguuaaggaa

SEQ ID NO: 342498 - RNA, 20 nt, Human
gggcagcuccccucauucug

SEQ ID NO: 342499 - RNA, 22 nt, Human
uugaaaguuaucuagauucuga

SEQ ID NO: 342500 - RNA, 22 nt, Human
gagagggauacugaguuuuggu

SEQ ID NO: 342501 - RNA, 20 nt, Human
cucuccucacccgugucagg

SEQ ID NO: 342502 - RNA, 22 nt, Human
uucucugaucuugcuagacuga

SEQ ID NO: 342503 - RNA, 22 nt, Human
aaagauaauguuuccuuauucu

SEQ ID NO: 342504 - RNA, 22 nt, Human
uaugaacuguaacccucaccgc

SEQ ID NO: 342505 - RNA, 22 nt, Human
aggcacaguggcucacaccugu

SEQ ID NO: 342506 - RNA, 22 nt, Human
ugauuuccccagucuugcugcu

SEQ ID NO: 342507 - RNA, 22 nt, Human
aucuucucaagcagcauccugu

SEQ ID NO: 342508 - RNA, 22 nt, Human
gcagagcuccccaagacaccaa

SEQ ID NO: 342509 - RNA, 22 nt, Human
gacccaggaagcuacuucuggu

SEQ ID NO: 342510 - RNA, 22 nt, Human
guucuucagcauuagaagucau

SEQ ID NO: 342511 - RNA, 18 nt, Human
aggcaggugcuggaaguc

SEQ ID NO: 342512 - RNA, 22 nt, Human
guacauuucucuuguucuuauu

SEQ ID NO: 342513 - RNA, 22 nt, Human
ugaggggagaagcagcagccug

SEQ ID NO: 342514 - RNA, 22 nt, Human
cuucuucauguauugauagucu

SEQ ID NO: 342515 - RNA, 20 nt, Human
ugugcaggagagugaggcug

SEQ ID NO: 342516 - RNA, 22 nt, Human
ucauuuuucacacagggucacc

SEQ ID NO: 342517 - RNA, 22 nt, Human
cggaggggauacauuuucugaa

SEQ ID NO: 342518 - RNA, 22 nt, Human
uuauucuuuucuccagaauccc

SEQ ID NO: 342519 - RNA, 22 nt, Human
auucacagaauaguuuuaccag

SEQ ID NO: 342520 - RNA, 20 nt, Human
agauuauuccuaagauuucu

SEQ ID NO: 342521 - RNA, 20 nt, Human
cagaggcaaggagacuugga

SEQ ID NO: 342522 - RNA, 22 nt, Human
ucaggauggcuucugcaucaaa

SEQ ID NO: 342523 - RNA, 23 nt, Human
cccaggaguuucacugcaaaggu

SEQ ID NO: 342524 - RNA, 22 nt, Human
gaggccaggggccuggagauga

SEQ ID NO: 342525 - RNA, 22 nt, Human
cuggcugggagcgagcugcuca

SEQ ID NO: 342526 - RNA, 22 nt, Human
ucuacuguagugaugcugcagu

SEQ ID NO: 342527 - RNA, 22 nt, Human
uucaugugaauauauuugucuu

SEQ ID NO: 342528 - RNA, 21 nt, Human
aaaggccauaaucacggagca

SEQ ID NO: 342529 - RNA, 22 nt, Human
aagagggcugcaaucuuauugc

SEQ ID NO: 342530 - RNA, 22 nt, Human
ucaucugucccaggcuuuuuuc

SEQ ID NO: 342531 - RNA, 22 nt, Human
gcaaauauucaagacuuuucca

SEQ ID NO: 342532 - RNA, 22 nt, Human
cauggcugcgagaagagugggu

SEQ ID NO: 342533 - RNA, 22 nt, Human
aucugcuugaguuugaagucag

SEQ ID NO: 342534 - RNA, 22 nt, Human
auucuucauuguugauucaugu

SEQ ID NO: 342535 - RNA, 22 nt, Human
agugcuguaacaacuuauuugg

SEQ ID NO: 342536 - RNA, 22 nt, Human
aggcagcuuucagugucucuca

SEQ ID NO: 342537 - RNA, 22 nt, Human
aggcugcugaggccaccacgcu

SEQ ID NO: 342538 - RNA, 23 nt, Human
ucguugaauagcaauagcacaac

SEQ ID NO: 342539 - RNA, 22 nt, Human
uccaugagacagauacuguaag

SEQ ID NO: 342540 - RNA, 22 nt, Human
cuuucauaaaggaaaugaugag

SEQ ID NO: 342541 - RNA, 22 nt, Human
ggcagccuugagggaggccugg

SEQ ID NO: 342542 - RNA, 22 nt, Human
ccaggagaugauguuggggauu

SEQ ID NO: 342543 - RNA, 22 nt, Human
cagcugacuucauaggaagaca

SEQ ID NO: 342544 - RNA, 22 nt, Human
accaggagacaugaccaaugag

SEQ ID NO: 342545 - RNA, 22 nt, Human
ucccaggaucugagggcagaga

SEQ ID NO: 342546 - RNA, 22 nt, Human
aggguggcugaguagauggaag

SEQ ID NO: 342547 - RNA, 18 nt, Human
aagaggaggagcagguug

SEQ ID NO: 342548 - RNA, 22 nt, Human
agcuaccuggcuuaucacuguc

SEQ ID NO: 342549 - RNA, 22 nt, Human
uagggauguccugagacuuggc

SEQ ID NO: 342550 - RNA, 22 nt, Human
augacaguucuacacuuaaucu

SEQ ID NO: 342551 - RNA, 23 nt, Human
gaggcacucaggaaaugugagug

SEQ ID NO: 342552 - RNA, 22 nt, Human
auauuguugacuauaagaguaa

SEQ ID NO: 342553 - RNA, 22 nt, Human
cccaggaggcgcagguugcggu

SEQ ID NO: 342554 - RNA, 22 nt, Human
ccccggaggcggagguugcagu

SEQ ID NO: 342555 - RNA, 22 nt, Human
gcugcccaggguggagccggcu

SEQ ID NO: 342556 - RNA, 22 nt, Human
gcaggaagcauagaagaaugcc

SEQ ID NO: 342557 - RNA, 22 nt, Human
auuaaauuggacgcugggggaa

SEQ ID NO: 342558 - RNA, 22 nt, Human
gcuuuggaugugugccugaggu

SEQ ID NO: 342559 - RNA, 22 nt, Human
ccccaggagcuuguuuuagaga

SEQ ID NO: 342560 - RNA, 22 nt, Human
ugucuucaguaaaauacacuau

SEQ ID NO: 342561 - RNA, 22 nt, Human
uaacacauaucuacaacaugug

SEQ ID NO: 342562 - RNA, 19 nt, Human
gugcuuuuuaagagcucag

SEQ ID NO: 342563 - RNA, 22 nt, Human
ucuacugcacuggugucucauc

SEQ ID NO: 342564 - RNA, 22 nt, Human
aguucacauaucuguuuuauuu

SEQ ID NO: 342565 - RNA, 22 nt, Human
uagugcuuggcccuaccagaua

SEQ ID NO: 342566 - RNA, 22 nt, Human
uucucuuuucaccaguugcuaa

SEQ ID NO: 342567 - RNA, 22 nt, Human
uugaauuagacuuugcuacagg

SEQ ID NO: 342568 - RNA, 20 nt, Human
auccaugagagucuggauuc

SEQ ID NO: 342569 - RNA, 22 nt, Human
auugaaagagaauguagcucuu

SEQ ID NO: 342570 - RNA, 21 nt, Human
augugaaaccuuccacgcuga

SEQ ID NO: 342571 - RNA, 22 nt, Human
ugagaauuuucaguuucacuuu

SEQ ID NO: 342572 - RNA, 22 nt, Human
uauuugaaaguguacaaaaacu

SEQ ID NO: 342573 - RNA, 22 nt, Human
uucagggagagcgggacgggug

SEQ ID NO: 342574 - RNA, 22 nt, Human
gaacacauuagucugaguuggc

SEQ ID NO: 342575 - RNA, 22 nt, Human
augugaaauagcuggauaugaa

SEQ ID NO: 342576 - RNA, 22 nt, Human
uuuugugagcccauaaaugcca

SEQ ID NO: 342577 - RNA, 19 nt, Human
uguguguuuauauauguau

SEQ ID NO: 342578 - RNA, 22 nt, Human
ucuacagacagagcagguggga

SEQ ID NO: 342579 - RNA, 22 nt, Human
ggagaggggcaaguuuaucuag

SEQ ID NO: 342580 - RNA, 22 nt, Human
ugaugaauaaacuugagaguca

SEQ ID NO: 342581 - RNA, 22 nt, Human
guaguucugcagugucaccuga

SEQ ID NO: 342582 - RNA, 22 nt, Human
cauauaaauacaacauguguua

SEQ ID NO: 342583 - RNA, 17 nt, Human
uucaaagcuuaucaagg

SEQ ID NO: 342584 - RNA, 22 nt, Human
aucacuguguauguauaugcag

SEQ ID NO: 342585 - RNA, 19 nt, Human
uagaggagaagggaagugg

SEQ ID NO: 342586 - RNA, 22 nt, Human
guggcagcggugugcaaggagg

SEQ ID NO: 342587 - RNA, 22 nt, Human
aaagcagagcagggcacuuaug

SEQ ID NO: 342588 - RNA, 22 nt, Human
gauucacucauauuuuacguuu

SEQ ID NO: 342589 - RNA, 22 nt, Human
uucuuaacuggaaaaugucaga

SEQ ID NO: 342590 - RNA, 22 nt, Human
acccaggauagagugcugcagu

SEQ ID NO: 342591 - RNA, 22 nt, Human
cucuuucugauucgcugggacc

SEQ ID NO: 342592 - RNA, 22 nt, Human
cagcuggcugcaugaugccaaa

SEQ ID NO: 342593 - RNA, 22 nt, Human
uggcagcuauggucuaagggcc

SEQ ID NO: 342594 - RNA, 22 nt, Human
aauauuuguuaguguuuuaaug

SEQ ID NO: 342595 - RNA, 22 nt, Human
cagagccaggucuaggagucuc

SEQ ID NO: 342596 - RNA, 22 nt, Human
aauguauguguauaucaaauca

SEQ ID NO: 342597 - RNA, 22 nt, Human
ccagaagaccccguccaccucc

SEQ ID NO: 342598 - RNA, 20 nt, Human
ucugugcaccugcuacaagg

SEQ ID NO: 342599 - RNA, 22 nt, Human
caucaaauaggaauauuuggca

SEQ ID NO: 342600 - RNA, 22 nt, Human
auuauuauuguugauguuaggg

SEQ ID NO: 342601 - RNA, 22 nt, Human
aagacaauuugauacuaguugc

SEQ ID NO: 342602 - RNA, 22 nt, Human
cagaggcaaaagagguggaggu

SEQ ID NO: 342603 - RNA, 22 nt, Human
acaauauuguacccagaaguuu

SEQ ID NO: 342604 - RNA, 18 nt, Human
uugcuuuguaagcuugca

SEQ ID NO: 342605 - RNA, 22 nt, Human
gaauacaugauacaugaacugc

SEQ ID NO: 342606 - RNA, 20 nt, Human
gcaaaauaggcucuguuggu

SEQ ID NO: 342607 - RNA, 22 nt, Human
uugcuuugccaccagaagucua

SEQ ID NO: 342608 - RNA, 22 nt, Human
aucauuucccuuuagaucacaa

SEQ ID NO: 342609 - RNA, 22 nt, Human
gaggccagaguuccccgaguca

SEQ ID NO: 342610 - RNA, 22 nt, Human
ugaaaugaucaguuugguuacu

SEQ ID NO: 342611 - RNA, 22 nt, Human
uuucauaauauccagagauuuu

SEQ ID NO: 342612 - RNA, 22 nt, Human
uaguauuuaaucacuuuugucu

SEQ ID NO: 342613 - RNA, 22 nt, Human
uagacauuucugguuauugaca

SEQ ID NO: 342614 - RNA, 22 nt, Human
gcagcuucaguaggugaagaca

SEQ ID NO: 342615 - RNA, 20 nt, Human
gaagcagcuucauguagaca

SEQ ID NO: 342616 - RNA, 22 nt, Human
cagcagaggugguucacauugu

SEQ ID NO: 342617 - RNA, 22 nt, Human
uuugacauggaauaacucauuu

SEQ ID NO: 342618 - RNA, 22 nt, Human
ucacauuucugauuauaccaaa

SEQ ID NO: 342619 - RNA, 22 nt, Human
caugcugugugguuagaacugu

SEQ ID NO: 342620 - RNA, 22 nt, Human
uucuuauagaagcaaccauugu

SEQ ID NO: 342621 - RNA, 22 nt, Human
uagggaugacgaaaggacagag

SEQ ID NO: 342622 - RNA, 22 nt, Human
cuugcuggugguguuuucuaug

SEQ ID NO: 342623 - RNA, 23 nt, Human
cccaggagccugaguccucucug

SEQ ID NO: 342624 - RNA, 22 nt, Human
ggaggccagggacccagucagc

SEQ ID NO: 342625 - RNA, 22 nt, Human
uuauccuggauuauauauguga

SEQ ID NO: 342626 - RNA, 22 nt, Human
acccaggagccgugagagguua

SEQ ID NO: 342627 - RNA, 22 nt, Human
ugaggcaggaggauugcaggau

SEQ ID NO: 342628 - RNA, 22 nt, Human
ugagccuguccugugcauguga

SEQ ID NO: 342629 - RNA, 22 nt, Human
gaggagcuugaggcuaggagcc

SEQ ID NO: 342630 - RNA, 22 nt, Human
gcaggagagccagcaggcuucc

SEQ ID NO: 342631 - RNA, 20 nt, Human
uuucaguugguuaauggcau

SEQ ID NO: 342632 - RNA, 22 nt, Human
agugcuuucccugaaaccuucc

SEQ ID NO: 342633 - RNA, 22 nt, Human
ucugcagggaugugagggguga

SEQ ID NO: 342634 - RNA, 19 nt, Human
uucauucucuuauuguugu

SEQ ID NO: 342635 - RNA, 22 nt, Human
agcaccugccugcauuggcuau

SEQ ID NO: 342636 - RNA, 22 nt, Human
gcacaauuauuuaugcaguaug

SEQ ID NO: 342637 - RNA, 22 nt, Human
uggcagcugcaggccuccugag

SEQ ID NO: 342638 - RNA, 22 nt, Human
agaaguuguagguuugcauauu

SEQ ID NO: 342639 - RNA, 22 nt, Human
ugccuguguccccuucuuggca

SEQ ID NO: 342640 - RNA, 20 nt, Human
uuucugugagaaacacuguu

SEQ ID NO: 342641 - RNA, 22 nt, Human
uuuggaauuggcauucuauucu

SEQ ID NO: 342642 - RNA, 22 nt, Human
ccucaggauccgcaggugcagu

SEQ ID NO: 342643 - RNA, 22 nt, Human
uggcagcugauuagauggugcc

SEQ ID NO: 342644 - RNA, 22 nt, Human
cuguggaaaauuuguauguaau

SEQ ID NO: 342645 - RNA, 22 nt, Human
uugcauuugagaaaguucuccu

SEQ ID NO: 342646 - RNA, 22 nt, Human
gguggaaggccuggaaggaggc

SEQ ID NO: 342647 - RNA, 22 nt, Human
gaacacaucacauuuuacagug

SEQ ID NO: 342648 - RNA, 21 nt, Human
acagcauguuuguguguuugc

SEQ ID NO: 342649 - RNA, 22 nt, Human
agaggacaaaaugagaagugcu

SEQ ID NO: 342650 - RNA, 22 nt, Human
uccaugagagguaacuuuacaa

SEQ ID NO: 342651 - RNA, 22 nt, Human
uaucuaaaggauuuaauuuagu

SEQ ID NO: 342652 - RNA, 22 nt, Human
ucuucauuccguagauauuuau

SEQ ID NO: 342653 - RNA, 22 nt, Human
ugaggcaguauuuuagugacuu

SEQ ID NO: 342654 - RNA, 22 nt, Human
cccaggaaugagcaggcagggg

SEQ ID NO: 342655 - RNA, 22 nt, Human
ucuucauuuuauagcaucugug

SEQ ID NO: 342656 - RNA, 22 nt, Human
gcugccagcuuuccuuggcuga

SEQ ID NO: 342657 - RNA, 19 nt, Human
cuggccaggccaggggccc

SEQ ID NO: 342658 - RNA, 22 nt, Human
ggagcuguucaggacugcuuca

SEQ ID NO: 342659 - RNA, 22 nt, Human
cagaggauucccuagugaccug

SEQ ID NO: 342660 - RNA, 22 nt, Human
augcagcugugggcaagaaaug

SEQ ID NO: 342661 - RNA, 22 nt, Human
ggacagcucugccaggagcuca

SEQ ID NO: 342662 - RNA, 22 nt, Human
gucuucuuuucagucugcuugu

SEQ ID NO: 342663 - RNA, 22 nt, Human
uucuucucucauagauuaaggu

SEQ ID NO: 342664 - RNA, 22 nt, Human
uaguuuuacuugcgaugauaau

SEQ ID NO: 342665 - RNA, 22 nt, Human
aauugcaauuuucuuaaggucu

SEQ ID NO: 342666 - RNA, 22 nt, Human
ucugcucugggccagcuauuaa

SEQ ID NO: 342667 - RNA, 22 nt, Human
auguuugaaauuguaaguauau

SEQ ID NO: 342668 - RNA, 22 nt, Human
cuguggaauugaugcuuagugu

SEQ ID NO: 342669 - RNA, 23 nt, Human
uacaugcuauaauuucacccuca

SEQ ID NO: 342670 - RNA, 22 nt, Human
acagaauugaaaguauaaucug

SEQ ID NO: 342671 - RNA, 22 nt, Human
acccaggagacggaggugcagu

SEQ ID NO: 342672 - RNA, 22 nt, Human
aggcagguuggugagaagacug

SEQ ID NO: 342673 - RNA, 22 nt, Human
auuauucuuaugucaucauggc

SEQ ID NO: 342674 - RNA, 22 nt, Human
cagaagaguagcugaacaaguu

SEQ ID NO: 342675 - RNA, 22 nt, Human
cuggccagcugacagcagggcu

SEQ ID NO: 342676 - RNA, 22 nt, Human
gaauauuuucaguacagauggu

SEQ ID NO: 342677 - RNA, 22 nt, Human
gcugcugugaauuuuuuaaaug

SEQ ID NO: 342678 - RNA, 22 nt, Human
aaggcaguuaauuuggcuagaa

SEQ ID NO: 342679 - RNA, 22 nt, Human
gggagagguuacccgagcaacu

SEQ ID NO: 342680 - RNA, 22 nt, Human
auucuuaauugccaugcuguau

SEQ ID NO: 342681 - RNA, 22 nt, Human
auuauauaggacuugcccuucc

SEQ ID NO: 342682 - RNA, 22 nt, Human
acauuuagcuguacaaucuaug

SEQ ID NO: 342683 - RNA, 22 nt, Human
ccaggagaugggagcaucuaaa

SEQ ID NO: 342684 - RNA, 22 nt, Human
ccaggagaauaauggcagauua

SEQ ID NO: 342685 - RNA, 22 nt, Human
aggccagcagcaugacggcauc

SEQ ID NO: 342686 - RNA, 22 nt, Human
auguuuccauuuucuuguauca

SEQ ID NO: 342687 - RNA, 22 nt, Human
uugaacaguccuaagagacccu

SEQ ID NO: 342688 - RNA, 22 nt, Human
agguccagcuguugcagccucc

SEQ ID NO: 342689 - RNA, 17 nt, Human
gcugacccuggagaagu

SEQ ID NO: 342690 - RNA, 22 nt, Human
augaggcaguacacacaaagcc

SEQ ID NO: 342691 - RNA, 22 nt, Human
ucucugaguaagugacaguuca

SEQ ID NO: 342692 - RNA, 22 nt, Human
cuacagacccaccuuggaagaa

SEQ ID NO: 342693 - RNA, 23 nt, Human
uugcauagacauccucauagauu

SEQ ID NO: 342694 - RNA, 22 nt, Human
agaggcaggaagagcugauuuu

SEQ ID NO: 342695 - RNA, 22 nt, Human
agugcagccgagaucaggugcu

SEQ ID NO: 342696 - RNA, 22 nt, Human
uucugucagcugcuuugucuca

SEQ ID NO: 342697 - RNA, 22 nt, Human
cugcucuaacugcauuaguuuu

SEQ ID NO: 342698 - RNA, 22 nt, Human
agaggccacuuugccugugaug

SEQ ID NO: 342699 - RNA, 22 nt, Human
cugacuguaauucuguucuuaa

SEQ ID NO: 342700 - RNA, 22 nt, Human
ggccaggagaggagggcacuga

SEQ ID NO: 342701 - RNA, 22 nt, Human
uguaugaaagaacaagggcuua

SEQ ID NO: 342702 - RNA, 22 nt, Human
uugcuagcugguguaugcauug

SEQ ID NO: 342703 - RNA, 22 nt, Human
uggaaugacagagagucugaau

SEQ ID NO: 342704 - RNA, 22 nt, Human
auucuucauuuacuguuacuug

SEQ ID NO: 342705 - RNA, 22 nt, Human
aaggcagcccuggcucagccug

SEQ ID NO: 342706 - RNA, 22 nt, Human
ggcucagaccucccagcuccag

SEQ ID NO: 342707 - RNA, 22 nt, Human
gguuauauaauucagugcuuuc

SEQ ID NO: 342708 - RNA, 22 nt, Human
gccauuuucugucuuguuuauu

SEQ ID NO: 342709 - RNA, 22 nt, Human
agucuugcucuugcaucugcuu

SEQ ID NO: 342710 - RNA, 22 nt, Human
caggcagcugaggacuuugcua

SEQ ID NO: 342711 - RNA, 22 nt, Human
auguagaagcugacagugcugu

SEQ ID NO: 342712 - RNA, 22 nt, Human
aaucuucauuuugacaagauuc

SEQ ID NO: 342713 - RNA, 22 nt, Human
aguucuucauaaccuuacugug

SEQ ID NO: 342714 - RNA, 22 nt, Human
uggcuguguuaccacuucaugu

SEQ ID NO: 342715 - RNA, 22 nt, Human
cccaggaagaggggucaggugu

SEQ ID NO: 342716 - RNA, 19 nt, Human
uccaggagcaaagccaguu

SEQ ID NO: 342717 - RNA, 22 nt, Human
gucuucaacaauaacuaccacu

SEQ ID NO: 342718 - RNA, 22 nt, Human
uuucaguguaucuuccaaaagc

SEQ ID NO: 342719 - RNA, 22 nt, Human
gaggcagcagggcugguuccuu

SEQ ID NO: 342720 - RNA, 22 nt, Human
aaaauauuuuagggccaggaga

SEQ ID NO: 342721 - RNA, 22 nt, Human
gaaacauauuaauccagugaaa

SEQ ID NO: 342722 - RNA, 19 nt, Human
cuugcugggugguuucugc

SEQ ID NO: 342723 - RNA, 22 nt, Human
aggcaagcgcagaagcggagga

SEQ ID NO: 342724 - RNA, 22 nt, Human
gaggccagcuaguccaggaagu

SEQ ID NO: 342725 - RNA, 22 nt, Human
gagggaauggugugcaagaggu

SEQ ID NO: 342726 - RNA, 22 nt, Human
ggcagcuaggggcagggaauuc

SEQ ID NO: 342727 - RNA, 22 nt, Human
aggcagauuacuugaggccagg

SEQ ID NO: 342728 - RNA, 22 nt, Human
caaauguauaaauguacuuucu

SEQ ID NO: 342729 - RNA, 22 nt, Human
acugccauuggucaaaugagug

SEQ ID NO: 342730 - RNA, 18 nt, Human
ugucauaauauaucaccu

SEQ ID NO: 342731 - RNA, 22 nt, Human
gaggcacuggaggaaaggagaa

SEQ ID NO: 342732 - RNA, 22 nt, Human
cagugguuauacuuacuguuuc

SEQ ID NO: 342733 - RNA, 22 nt, Human
cucagaagaacaaaggcucuac

SEQ ID NO: 342734 - RNA, 22 nt, Human
auggaaagggaagcaaggaaca

SEQ ID NO: 342735 - RNA, 22 nt, Human
uucagcaagaccaccauguacc

SEQ ID NO: 342736 - RNA, 22 nt, Human
aauuuuaagcauaugacugguu

SEQ ID NO: 342737 - RNA, 22 nt, Human
uaauaguuucauaaugugcuuc

SEQ ID NO: 342738 - RNA, 22 nt, Human
ccagaccacccuggccaugcac

SEQ ID NO: 342739 - RNA, 22 nt, Human
cauucuuauauuuacucauuca

SEQ ID NO: 342740 - RNA, 22 nt, Human
ugaggcaggagaauggcgggaa

SEQ ID NO: 342741 - RNA, 22 nt, Human
ugguuuugcuaaaauagaaaga

SEQ ID NO: 342742 - RNA, 22 nt, Human
aacaucuacuaagugccaggca

SEQ ID NO: 342743 - RNA, 22 nt, Human
aagauauagauaaaacuaugca

SEQ ID NO: 342744 - RNA, 22 nt, Human
gcagcugagcgugaggaagagu

SEQ ID NO: 342745 - RNA, 22 nt, Human
gcagcugcagacccucagugcu

SEQ ID NO: 342746 - RNA, 22 nt, Human
gcgcaggagccgcggagggccg

SEQ ID NO: 342747 - RNA, 22 nt, Human
ggagcugugcagugacuacaga

SEQ ID NO: 342748 - RNA, 20 nt, Human
auacacauucauagaaaaau

SEQ ID NO: 342749 - RNA, 22 nt, Human
aguaugaagaauacauagauga

SEQ ID NO: 342750 - RNA, 22 nt, Human
uccacauccauugcuugacuuu

SEQ ID NO: 342751 - RNA, 22 nt, Human
agagagggcauagaaaaaggga

SEQ ID NO: 342752 - RNA, 22 nt, Human
ucaggaugguguggaggaaaua

SEQ ID NO: 342753 - RNA, 22 nt, Human
agucucugcaugccugcugugc

SEQ ID NO: 342754 - RNA, 22 nt, Human
ccaugagacagcaacugaaagu

SEQ ID NO: 342755 - RNA, 22 nt, Human
auguucuguuuuguaauucaua

SEQ ID NO: 342756 - RNA, 22 nt, Human
gcugcugugccuggcguccugu

SEQ ID NO: 342757 - RNA, 22 nt, Human
aggccagcccugggcugagaga

SEQ ID NO: 342758 - RNA, 22 nt, Human
uucuuugaguuaguacagucca

SEQ ID NO: 342759 - RNA, 22 nt, Human
aaauuguugaucuacaguaagg

SEQ ID NO: 342760 - RNA, 22 nt, Human
guguauaaugcuguuuguacau

SEQ ID NO: 342761 - RNA, 22 nt, Human
cuauugaauuaacuauuaaagu

SEQ ID NO: 342762 - RNA, 22 nt, Human
augugaaagagguguucagugg

SEQ ID NO: 342763 - RNA, 22 nt, Human
auuuaaaugcuuaagaggguuu

SEQ ID NO: 342764 - RNA, 22 nt, Human
gaggucaggcuugcagcagggu

SEQ ID NO: 342765 - RNA, 22 nt, Human
agcugcccuuuaugaugcugaa

SEQ ID NO: 342766 - RNA, 22 nt, Human
gagggaggggagcuccacccuc

SEQ ID NO: 342767 - RNA, 22 nt, Human
aaggcagcaugaaucccuguac

SEQ ID NO: 342768 - RNA, 22 nt, Human
auuauuauauagggaaaguccc

SEQ ID NO: 342769 - RNA, 22 nt, Human
aauguaugaagguuccaguuuc

SEQ ID NO: 342770 - RNA, 17 nt, Human
uuucaucugggaccacc

SEQ ID NO: 342771 - RNA, 22 nt, Human
ucaagugcuugugagguauuug

SEQ ID NO: 342772 - RNA, 22 nt, Human
gaggcagcaaaauauaucauaa

SEQ ID NO: 342773 - RNA, 22 nt, Human
acugcuuacccggccugacuuc

SEQ ID NO: 342774 - RNA, 22 nt, Human
cucugucaggcugcagaugcuc

SEQ ID NO: 342775 - RNA, 22 nt, Human
auccugucaucauaguacuuga

SEQ ID NO: 342776 - RNA, 22 nt, Human
cgaggcagacaaaaguuggaag

SEQ ID NO: 342777 - RNA, 17 nt, Human
gcccaggaaggacggcc

SEQ ID NO: 342778 - RNA, 22 nt, Human
cuccaggaaagccugaggcccg

SEQ ID NO: 342779 - RNA, 22 nt, Human
ucauuauuuuggacuggagugu

SEQ ID NO: 342780 - RNA, 18 nt, Human
gaugggagcaagagaaga

SEQ ID NO: 342781 - RNA, 22 nt, Human
guuaucaugcuucaucaucacu

SEQ ID NO: 342782 - RNA, 22 nt, Human
ucaugaacaucucaaauaacca

SEQ ID NO: 342783 - RNA, 22 nt, Human
uagugcuuaacacaaagugauu

SEQ ID NO: 342784 - RNA, 22 nt, Human
uugcauuugaucuuggguucuc

SEQ ID NO: 342785 - RNA, 22 nt, Human
cugcuuugauuagaagaguaca

SEQ ID NO: 342786 - RNA, 17 nt, Human
uauauguaugccucucc

SEQ ID NO: 342787 - RNA, 22 nt, Human
aggagcagaauuuaaugugcag

SEQ ID NO: 342788 - RNA, 22 nt, Human
uguuuuaagagcgcacuuuaua

SEQ ID NO: 342789 - RNA, 22 nt, Human
gagcagcucugggugacccagu

SEQ ID NO: 342790 - RNA, 22 nt, Human
uuucaugauuaacuuagugaau

SEQ ID NO: 342791 - RNA, 22 nt, Human
ugaggcagcccacuuuccuuag

SEQ ID NO: 342792 - RNA, 22 nt, Human
ggcagcacugcagcuuguuggg

SEQ ID NO: 342793 - RNA, 22 nt, Human
uuugaaagaaaccagugaguga

SEQ ID NO: 342794 - RNA, 22 nt, Human
aaaaugacauuccagugauauu

SEQ ID NO: 342795 - RNA, 22 nt, Human
cugccaggcgauggauuggcug

SEQ ID NO: 342796 - RNA, 22 nt, Human
uucuucuuucccccugugguac

SEQ ID NO: 342797 - RNA, 22 nt, Human
uuaaauuuuagaaacagacucu

SEQ ID NO: 342798 - RNA, 22 nt, Human
caggcagcaucagucugcugua

SEQ ID NO: 342799 - RNA, 22 nt, Human
aaaauuauucauggcuuuugga

SEQ ID NO: 342800 - RNA, 19 nt, Human
uucuccaggcugcagaggg

SEQ ID NO: 342801 - RNA, 22 nt, Human
gcucagagcuugaaguuccacu

SEQ ID NO: 342802 - RNA, 23 nt, Human
cugcuguguuggucucgauggga

SEQ ID NO: 342803 - RNA, 22 nt, Human
auuugcaaagucguaucuguga

SEQ ID NO: 342804 - RNA, 19 nt, Human
gcagcugcuugaaaagaaa

SEQ ID NO: 342805 - RNA, 22 nt, Human
acacauuucucuuuuuguaagu

SEQ ID NO: 342806 - RNA, 21 nt, Human
uccaggaguucuaauaggugu

SEQ ID NO: 342807 - RNA, 22 nt, Human
ugcuucugggcaaaugugugug

SEQ ID NO: 342808 - RNA, 22 nt, Human
aggaagcuggugugaggaugaa

SEQ ID NO: 342809 - RNA, 18 nt, Human
gagagggaucccucagga

SEQ ID NO: 342810 - RNA, 22 nt, Human
aggucagcaugaguagaaggua

SEQ ID NO: 342811 - RNA, 22 nt, Human
uggcagcuauuacaaggaaguc

SEQ ID NO: 342812 - RNA, 22 nt, Human
uucuugcaggucacucacugag

SEQ ID NO: 342813 - RNA, 22 nt, Human
aaucuguuuaguucugcguaug

SEQ ID NO: 342814 - RNA, 23 nt, Human
acaagauagggauaaaaagauaa

SEQ ID NO: 342815 - RNA, 22 nt, Human
augugaaaauccaauggcagca

SEQ ID NO: 342816 - RNA, 22 nt, Human
ggaggggaacuaaucccgugac

SEQ ID NO: 342817 - RNA, 22 nt, Human
gagugcaggccugagcaccauc

SEQ ID NO: 342818 - RNA, 22 nt, Human
uuccaagaguaaauucaaauug

SEQ ID NO: 342819 - RNA, 22 nt, Human
ucaggagagagaaauuggggcu

SEQ ID NO: 342820 - RNA, 22 nt, Human
aggcagcuucugauuagcagcg

SEQ ID NO: 342821 - RNA, 22 nt, Human
cugccaggcacgugcagcauca

SEQ ID NO: 342822 - RNA, 22 nt, Human
aaauauaguaaaugcauaguuc

SEQ ID NO: 342823 - RNA, 22 nt, Human
uuugaauguuuuagguacuuaa

SEQ ID NO: 342824 - RNA, 22 nt, Human
ucucagucagccuugauguccc

SEQ ID NO: 342825 - RNA, 22 nt, Human
uaggagagcugaacuauugucu

SEQ ID NO: 342826 - RNA, 22 nt, Human
uucugucaaaugccaguagaga

SEQ ID NO: 342827 - RNA, 22 nt, Human
uucaggauccccuugaugggcu

SEQ ID NO: 342828 - RNA, 22 nt, Human
cugcuguguuagcagguuuagu

SEQ ID NO: 342829 - RNA, 22 nt, Human
agucucuuuguggacucugccu

SEQ ID NO: 342830 - RNA, 22 nt, Human
ccaggcugggcuacaaguugag

SEQ ID NO: 342831 - RNA, 21 nt, Human
agggagcuuuagguagaaguu

SEQ ID NO: 342832 - RNA, 22 nt, Human
ucugaaggugcuagagaaagcu

SEQ ID NO: 342833 - RNA, 22 nt, Human
aucaggauuacacggggaugcu

SEQ ID NO: 342834 - RNA, 22 nt, Human
ggcaucuccaaaacaugaacuc

SEQ ID NO: 342835 - RNA, 22 nt, Human
aaucuucuacuugacaguucuc

SEQ ID NO: 342836 - RNA, 22 nt, Human
cagcagagcugggcuuugaauu

SEQ ID NO: 342837 - RNA, 22 nt, Human
ggaugggagcagaggacgacca

SEQ ID NO: 342838 - RNA, 22 nt, Human
uuguaugaauguauccuaauuu

SEQ ID NO: 342839 - RNA, 20 nt, Human
uucuucucuaguuaucuuca

SEQ ID NO: 342840 - RNA, 22 nt, Human
cugaacuuauugagugcuugcu

SEQ ID NO: 342841 - RNA, 23 nt, Human
cuugcaggaagcagauggcacac

SEQ ID NO: 342842 - RNA, 22 nt, Human
cauuugcagagggugacacucu

SEQ ID NO: 342843 - RNA, 22 nt, Human
gaauacauuggaaaucagaaua

SEQ ID NO: 342844 - RNA, 22 nt, Human
uucccucucacuuaaagcuugg

SEQ ID NO: 342845 - RNA, 22 nt, Human
auuuggcaacauuaauugaauc

SEQ ID NO: 342846 - RNA, 22 nt, Human
aagacauugucauuuuauaauu

SEQ ID NO: 342847 - RNA, 22 nt, Human
gagcagcucgagaaggaagcag

SEQ ID NO: 342848 - RNA, 22 nt, Human
gaggcugaggguuagagaguca

SEQ ID NO: 342849 - RNA, 22 nt, Human
cagcuggcgggcagagccgcca

SEQ ID NO: 342850 - RNA, 20 nt, Human
ucagaugggagugagccauc

SEQ ID NO: 342851 - RNA, 22 nt, Human
ucaaauaaugccauucaucauc

SEQ ID NO: 342852 - RNA, 22 nt, Human
gugauaaaauucaaauagcucu

SEQ ID NO: 342853 - RNA, 22 nt, Human
cugcuucugggaugauggagua

SEQ ID NO: 342854 - RNA, 22 nt, Human
cccaggaggcagagguuggagc

SEQ ID NO: 342855 - RNA, 22 nt, Human
caggcagcagaggaguguggga

SEQ ID NO: 342856 - RNA, 22 nt, Human
ucaggagaacuuccuucuaccc

SEQ ID NO: 342857 - RNA, 22 nt, Human
gcugcccauuccacuggauggu

SEQ ID NO: 342858 - RNA, 22 nt, Human
aucacugucgucaucugagauu

SEQ ID NO: 342859 - RNA, 22 nt, Human
ucugcugugggucuauauuuua

SEQ ID NO: 342860 - RNA, 22 nt, Human
ucacaguaaaagcauggaagag

SEQ ID NO: 342861 - RNA, 22 nt, Human
uaucaucuuguugucaugcagc

SEQ ID NO: 342862 - RNA, 22 nt, Human
auuuucagagacaucuggacuu

SEQ ID NO: 342863 - RNA, 22 nt, Human
ucugggaacucugucauuuccc

SEQ ID NO: 342864 - RNA, 22 nt, Human
agcuagaauauugaucugaaau

SEQ ID NO: 342865 - RNA, 20 nt, Human
cccagugaagcauggaagag

SEQ ID NO: 342866 - RNA, 19 nt, Human
uggggcuguguuuugaccc

SEQ ID NO: 342867 - RNA, 22 nt, Human
gcccaggaagccaccgggaagu

SEQ ID NO: 342868 - RNA, 22 nt, Human
uauggaaacuaauucauuuuuc

SEQ ID NO: 342869 - RNA, 22 nt, Human
uauuucagcccuacuacuuggc

SEQ ID NO: 342870 - RNA, 22 nt, Human
auacagauguugaauguuauau

SEQ ID NO: 342871 - RNA, 22 nt, Human
gaggcaucugggcacagaagug

SEQ ID NO: 342872 - RNA, 23 nt, Human
uggagcugacagucagagggagg

SEQ ID NO: 342873 - RNA, 22 nt, Human
uguaugaagguuuaccugcugu

SEQ ID NO: 342874 - RNA, 22 nt, Human
uugguuuaggaacuggcuugga

SEQ ID NO: 342875 - RNA, 22 nt, Human
aggcaguguguagcuggaagag

SEQ ID NO: 342876 - RNA, 18 nt, Human
gcagcuagccaggggggc

SEQ ID NO: 342877 - RNA, 22 nt, Human
auuucagaugaccaaauggaaa

SEQ ID NO: 342878 - RNA, 22 nt, Human
caguucuuaauaccaugugguu

SEQ ID NO: 342879 - RNA, 22 nt, Human
agagggaucacccuguuucugg

SEQ ID NO: 342880 - RNA, 22 nt, Human
cauuuguauguuccuccuuagg

SEQ ID NO: 342881 - RNA, 22 nt, Human
aaggaguuuggguagucauaca

SEQ ID NO: 342882 - RNA, 22 nt, Human
cugcugugagcacuccagccug

SEQ ID NO: 342883 - RNA, 22 nt, Human
cauauguauuucucauaauuag

SEQ ID NO: 342884 - RNA, 22 nt, Human
uugguuuacuaggauucaaauu

SEQ ID NO: 342885 - RNA, 22 nt, Human
ucaggaugguccuuuaugagaa

SEQ ID NO: 342886 - RNA, 22 nt, Human
agcugccccaugagaggcaggu

SEQ ID NO: 342887 - RNA, 22 nt, Human
cccaggaacagggcucagaccc

SEQ ID NO: 342888 - RNA, 22 nt, Human
cagcagagggagccauugaaau

SEQ ID NO: 342889 - RNA, 18 nt, Human
ugagaggcagguagagga

SEQ ID NO: 342890 - RNA, 22 nt, Human
acauaccauacauggugagaug

SEQ ID NO: 342891 - RNA, 22 nt, Human
gcagcuccuccugggcuggaga

SEQ ID NO: 342892 - RNA, 22 nt, Human
ucaacugcaaguuugcuuaguu

SEQ ID NO: 342893 - RNA, 21 nt, Human
cccacggaaugaugaggcacu

SEQ ID NO: 342894 - RNA, 22 nt, Human
gaaggccauuuuuagguagaau

SEQ ID NO: 342895 - RNA, 22 nt, Human
cuggcugugcugcaggcuuugg

SEQ ID NO: 342896 - RNA, 22 nt, Human
uuuuagcacuaagugauaugcu

SEQ ID NO: 342897 - RNA, 22 nt, Human
ggaggcagaacuucccgucagu

SEQ ID NO: 342898 - RNA, 22 nt, Human
gggacuucauagcuaggcacuu

SEQ ID NO: 342899 - RNA, 22 nt, Human
uccaggaguuugagacugcagu

SEQ ID NO: 342900 - RNA, 22 nt, Human
ccuugcugcgugcuagcacaga

SEQ ID NO: 342901 - RNA, 22 nt, Human
ugucuucaucuccaugcacaga

SEQ ID NO: 342902 - RNA, 22 nt, Human
agauggagaaugacaauuaagg

SEQ ID NO: 342903 - RNA, 22 nt, Human
gagggaggugauacugaacgua

SEQ ID NO: 342904 - RNA, 22 nt, Human
cucuccucugaaguggugaccc

SEQ ID NO: 342905 - RNA, 22 nt, Human
ggcaggcugcuugggucauguc

SEQ ID NO: 342906 - RNA, 22 nt, Human
aggaagcugcuggaguagugug

SEQ ID NO: 342907 - RNA, 22 nt, Human
aaagccaugggucuuuggcaua

SEQ ID NO: 342908 - RNA, 22 nt, Human
cccagcaggaggagguugcagu

SEQ ID NO: 342909 - RNA, 22 nt, Human
gaggcagcaucuauggugggaa

SEQ ID NO: 342910 - RNA, 22 nt, Human
gaucuucucuuuaguagaaaca

SEQ ID NO: 342911 - RNA, 22 nt, Human
auuuccaggagaaaggauuuua

SEQ ID NO: 342912 - RNA, 22 nt, Human
gcugguuuccuuaucuauaaag

SEQ ID NO: 342913 - RNA, 22 nt, Human
guugaaagaucauguggcugcc

SEQ ID NO: 342914 - RNA, 22 nt, Human
aaauauagcaauuaugccuacu

SEQ ID NO: 342915 - RNA, 22 nt, Human
acagcagcuugcgugucugguc

SEQ ID NO: 342916 - RNA, 22 nt, Human
ugaggcaggacauggacaacug

SEQ ID NO: 342917 - RNA, 22 nt, Human
caagaugugccuaaucagaccu

SEQ ID NO: 342918 - RNA, 22 nt, Human
ggggcagcucccgagggcagga

SEQ ID NO: 342919 - RNA, 22 nt, Human
ucucucuucaacccuuaacuag

SEQ ID NO: 342920 - RNA, 22 nt, Human
auuucccagcuuugaucaguuu

SEQ ID NO: 342921 - RNA, 22 nt, Human
aauguaugacaguucuaguggu

SEQ ID NO: 342922 - RNA, 22 nt, Human
aaauuuucagagcacuagagaa

SEQ ID NO: 342923 - RNA, 22 nt, Human
auuucagguaccugugggaucc

SEQ ID NO: 342924 - RNA, 20 nt, Human
gccaggagggugugaugagc

SEQ ID NO: 342925 - RNA, 22 nt, Human
cugcugugggcaggguagcugg

SEQ ID NO: 342926 - RNA, 22 nt, Human
aucaguuauuuuuaagcuauaa

SEQ ID NO: 342927 - RNA, 22 nt, Human
uucuucaaaacaacacuggccu

SEQ ID NO: 342928 - RNA, 18 nt, Human
ggcagggaaaagauaggg

SEQ ID NO: 342929 - RNA, 22 nt, Human
uuuaacagaugugaaauuuuca

SEQ ID NO: 342930 - RNA, 22 nt, Human
uucugugaaucuuuuuucccac

SEQ ID NO: 342931 - RNA, 22 nt, Human
caggcagcgcucguggccuggc

SEQ ID NO: 342932 - RNA, 20 nt, Human
acuugcugggcuuuguuacc

SEQ ID NO: 342933 - RNA, 22 nt, Human
cucaugauguagcgaaugagaa

SEQ ID NO: 342934 - RNA, 22 nt, Human
ucuuugcacugugcaagcagaa

SEQ ID NO: 342935 - RNA, 22 nt, Human
uggcagcuggcucugcgcaggc

SEQ ID NO: 342936 - RNA, 22 nt, Human
ucugcaucauuuuucagagccg

SEQ ID NO: 342937 - RNA, 22 nt, Human
aauaacuuuuaaaagacccugg

SEQ ID NO: 342938 - RNA, 22 nt, Human
auguuauaguuauaaaaugagg

SEQ ID NO: 342939 - RNA, 19 nt, Human
aaaaacuuaguccagaaag

SEQ ID NO: 342940 - RNA, 22 nt, Human
aucaggaugaagcuguagcgaa

SEQ ID NO: 342941 - RNA, 22 nt, Human
auagcuguuagauuggggucga

SEQ ID NO: 342942 - RNA, 22 nt, Human
uaucuguuguaguacagaugau

SEQ ID NO: 342943 - RNA, 22 nt, Human
ggguggagcuuggacaccagua

SEQ ID NO: 342944 - RNA, 22 nt, Human
ugcuauaaguagacauucaaca

SEQ ID NO: 342945 - RNA, 22 nt, Human
aaauuaguacauugcaaagucc

SEQ ID NO: 342946 - RNA, 22 nt, Human
uugauuaaacaggcauauucaa

SEQ ID NO: 342947 - RNA, 20 nt, Human
ccucaggaugagggugagca

SEQ ID NO: 342948 - RNA, 22 nt, Human
cagcuggccccacaguagaggc

SEQ ID NO: 342949 - RNA, 23 nt, Human
ucuugaaaagccuacagcaguuc

SEQ ID NO: 342950 - RNA, 22 nt, Human
ucuuuccaaggacucuguagca

SEQ ID NO: 342951 - RNA, 22 nt, Human
uaugucaaaguuaagaaauagg

SEQ ID NO: 342952 - RNA, 22 nt, Human
cacaaaugguuguagacauuaa

SEQ ID NO: 342953 - RNA, 22 nt, Human
aggguggccaugagggagagau

SEQ ID NO: 342954 - RNA, 22 nt, Human
ucucaggaagauuagggcuaag

SEQ ID NO: 342955 - RNA, 23 nt, Human
uucuucucaauuaguugauucag

SEQ ID NO: 342956 - RNA, 22 nt, Human
caagauggguguugugaugguu

SEQ ID NO: 342957 - RNA, 18 nt, Human
gaggcagcuagcaauuuu

SEQ ID NO: 342958 - RNA, 22 nt, Human
aaaggccaauaaagacaagcug

SEQ ID NO: 342959 - RNA, 22 nt, Human
uuuaaauuuagaagaaacacug

SEQ ID NO: 342960 - RNA, 22 nt, Human
uuuuagauaguuuaacugcacu

SEQ ID NO: 342961 - RNA, 22 nt, Human
gcugcugucagugguggcaguu

SEQ ID NO: 342962 - RNA, 22 nt, Human
augcuguguggccaccuccaug

SEQ ID NO: 342963 - RNA, 22 nt, Human
cugaaugaggaaaagagugagg

SEQ ID NO: 342964 - RNA, 22 nt, Human
gucugucaucugagauggagug

SEQ ID NO: 342965 - RNA, 20 nt, Human
ccucaguguccuggacuggg

SEQ ID NO: 342966 - RNA, 22 nt, Human
ugaaggccacuuccugugagcu

SEQ ID NO: 342967 - RNA, 22 nt, Human
uuugcagucaaauuugcuaaau

SEQ ID NO: 342968 - RNA, 17 nt, Human
uucucugagcuguauug

SEQ ID NO: 342969 - RNA, 22 nt, Human
cugcugugccucuuuucacgug

SEQ ID NO: 342970 - RNA, 22 nt, Human
accaggagucuagccuagucaa

SEQ ID NO: 342971 - RNA, 22 nt, Human
ucucuucuauuugagacuauuu

SEQ ID NO: 342972 - RNA, 22 nt, Human
ccuggagaccagaggauacuuc

SEQ ID NO: 342973 - RNA, 22 nt, Human
gcuucccacagcuggacugggg

SEQ ID NO: 342974 - RNA, 22 nt, Human
uuucaggguacauggagcaaau

SEQ ID NO: 342975 - RNA, 22 nt, Human
ucgagcucuggagccaaggaug

SEQ ID NO: 342976 - RNA, 22 nt, Human
uccaggaguccugggagugauu

SEQ ID NO: 342977 - RNA, 22 nt, Human
guugaaaguggagaaccugguu

SEQ ID NO: 342978 - RNA, 22 nt, Human
uuugcagugucagcuucugugu

SEQ ID NO: 342979 - RNA, 21 nt, Human
ucacuagugccuucugucauu

SEQ ID NO: 342980 - RNA, 22 nt, Human
gaacaucagucauaauuuaacg

SEQ ID NO: 342981 - RNA, 22 nt, Human
uugcaucuaccauaucaaagau

SEQ ID NO: 342982 - RNA, 22 nt, Human
uuuaaaaucagaugggaguugg

SEQ ID NO: 342983 - RNA, 22 nt, Human
ccaggagagcaaaggucacucu

SEQ ID NO: 342984 - RNA, 22 nt, Human
cagaggcaggauaagaacugcg

SEQ ID NO: 342985 - RNA, 22 nt, Human
ccucaggaaccacauugcugcu

SEQ ID NO: 342986 - RNA, 22 nt, Human
aguucucaagacaauuaccugu

SEQ ID NO: 342987 - RNA, 22 nt, Human
uuucccagagguaugaauaagu

SEQ ID NO: 342988 - RNA, 22 nt, Human
uugcauuugacaaauuauuuaa

SEQ ID NO: 342989 - RNA, 22 nt, Human
auuuagcaaaaaaugaugaagc

SEQ ID NO: 342990 - RNA, 22 nt, Human
ccuccuuuccuguuuuccugag

SEQ ID NO: 342991 - RNA, 22 nt, Human
agaggagguccuuuucugaugu

SEQ ID NO: 342992 - RNA, 22 nt, Human
acucaggaauggggcugggacu

SEQ ID NO: 342993 - RNA, 22 nt, Human
auucuucacaccuguuccuguu

SEQ ID NO: 342994 - RNA, 22 nt, Human
guggaauguccuugaucauaag

SEQ ID NO: 342995 - RNA, 22 nt, Human
ugaggcagguaagcaaguuuug

SEQ ID NO: 342996 - RNA, 22 nt, Human
caaguaaacaauaugugauuca

SEQ ID NO: 342997 - RNA, 22 nt, Human
gggugggacugaagucugaggg

SEQ ID NO: 342998 - RNA, 22 nt, Human
aaaggccacugcaagggaaggu

SEQ ID NO: 342999 - RNA, 22 nt, Human
uuaaauauuuucagcaggguca

SEQ ID NO: 343000 - RNA, 21 nt, Human
agcagaggcugccuggugacu

SEQ ID NO: 343001 - RNA, 22 nt, Human
ugcaggaaauuccaggguggcc

SEQ ID NO: 343002 - RNA, 22 nt, Human
ggcuuugccuggaauuuccuug

SEQ ID NO: 343003 - RNA, 22 nt, Human
ucaggagggugacaggcccugg

SEQ ID NO: 343004 - RNA, 22 nt, Human
cugcugugcacccaggaaggcu

SEQ ID NO: 343005 - RNA, 22 nt, Human
gagcauuugguuauaguaauuu

SEQ ID NO: 343006 - RNA, 22 nt, Human
gagggccagcagccucagcaug

SEQ ID NO: 343007 - RNA, 22 nt, Human
agggcagcagcuccuccuagcu

SEQ ID NO: 343008 - RNA, 21 nt, Human
cuguggaagggaacuagaggg

SEQ ID NO: 343009 - RNA, 22 nt, Human
uugaacauuggcaauuucauau

SEQ ID NO: 343010 - RNA, 22 nt, Human
aaucacuuuucucuaauguagc

SEQ ID NO: 343011 - RNA, 22 nt, Human
aagaggagacuucagcaacuug

SEQ ID NO: 343012 - RNA, 23 nt, Human
ugcaugugaauucauacuuguuu

SEQ ID NO: 343013 - RNA, 22 nt, Human
aggcagcuggcagcacccaggg

SEQ ID NO: 343014 - RNA, 21 nt, Human
augugaaauaucaucagagca

SEQ ID NO: 343015 - RNA, 22 nt, Human
auuuucaaaacaucugcugugu

SEQ ID NO: 343016 - RNA, 19 nt, Human
uaucuguuuccugcuuguc

SEQ ID NO: 343017 - RNA, 23 nt, Human
ccacuagcaccuguucaacuucu

SEQ ID NO: 343018 - RNA, 22 nt, Human
gauguguuuccaggauuuguuu

SEQ ID NO: 343019 - RNA, 22 nt, Human
cagugucuccagaugcuccaau

SEQ ID NO: 343020 - RNA, 22 nt, Human
ucccuucacagaugcgauguuu

SEQ ID NO: 343021 - RNA, 22 nt, Human
caguuuuugccauuaagaguaa

SEQ ID NO: 343022 - RNA, 22 nt, Human
uuuuuauaacucuuuugugaca

SEQ ID NO: 343023 - RNA, 22 nt, Human
cuuaaagaaauugaggagagga

SEQ ID NO: 343024 - RNA, 22 nt, Human
auucuucaaagagugucaaagu

SEQ ID NO: 343025 - RNA, 22 nt, Human
auguaaacaagguuauugucca

SEQ ID NO: 343026 - RNA, 22 nt, Human
uagcauuucacugaucuucacu

SEQ ID NO: 343027 - RNA, 22 nt, Human
ggugaaggucagagcaggaaaa

SEQ ID NO: 343028 - RNA, 22 nt, Human
gggcagcugucuugguucucaa

SEQ ID NO: 343029 - RNA, 22 nt, Human
aaagcagauucugaugcaguag

SEQ ID NO: 343030 - RNA, 22 nt, Human
auacaacuuuaucuguaaugag

SEQ ID NO: 343031 - RNA, 22 nt, Human
cuagccugggauuugaacuuau

SEQ ID NO: 343032 - RNA, 22 nt, Human
ucuccucuauuucuguauguau

SEQ ID NO: 343033 - RNA, 22 nt, Human
aagagagggguugcauggaaau

SEQ ID NO: 343034 - RNA, 22 nt, Human
aggaugagccgcgcaagcugac

SEQ ID NO: 343035 - RNA, 22 nt, Human
acccaggauaaucuguguaucu

SEQ ID NO: 343036 - RNA, 22 nt, Human
uuucaucuuccuuggcauaggu

SEQ ID NO: 343037 - RNA, 22 nt, Human
cuaaucaucuuucucuuaaagc

SEQ ID NO: 343038 - RNA, 22 nt, Human
uacuuccuguuuccaugucugu

SEQ ID NO: 343039 - RNA, 22 nt, Human
agugcuuuagcauccaacuguc

SEQ ID NO: 343040 - RNA, 22 nt, Human
uucaggauccccaccgcguuua

SEQ ID NO: 343041 - RNA, 22 nt, Human
uuucacaaaugucuuuaacuug

SEQ ID NO: 343042 - RNA, 22 nt, Human
uuucuaggucuuccauacugcc

SEQ ID NO: 343043 - RNA, 22 nt, Human
gcccaggaggcagagguugugg

SEQ ID NO: 343044 - RNA, 22 nt, Human
uguuuuuaaauaaugauagaaa

SEQ ID NO: 343045 - RNA, 22 nt, Human
aaaguucuggggguguuucugg

SEQ ID NO: 343046 - RNA, 22 nt, Human
uccaggagcauccaggugaagc

SEQ ID NO: 343047 - RNA, 22 nt, Human
gaggagagaugguagauugggu

SEQ ID NO: 343048 - RNA, 22 nt, Human
uacauaugaacuuuauaacuug

SEQ ID NO: 343049 - RNA, 22 nt, Human
ggucagagggugggcugccugu

SEQ ID NO: 343050 - RNA, 20 nt, Human
caggagggacauuucagcau

SEQ ID NO: 343051 - RNA, 22 nt, Human
cccaggaugucgaggcugcagu

SEQ ID NO: 343052 - RNA, 22 nt, Human
acaugauuuuaguaucauaaua

SEQ ID NO: 343053 - RNA, 22 nt, Human
ugaggcagcuuuuucugugugu

SEQ ID NO: 343054 - RNA, 22 nt, Human
aagugggaauagaaaugaaggu

SEQ ID NO: 343055 - RNA, 22 nt, Human
acccaggacuuggcaaccucau

SEQ ID NO: 343056 - RNA, 22 nt, Human
aaacaugaauagauauuaaaca

SEQ ID NO: 343057 - RNA, 22 nt, Human
gucugucacucaggggcuggag

SEQ ID NO: 343058 - RNA, 22 nt, Human
ugaacucgggaggaggcugcag

SEQ ID NO: 343059 - RNA, 22 nt, Human
uucuucuugucugcccucacau

SEQ ID NO: 343060 - RNA, 22 nt, Human
uccaggaggugaggggaccaaa

SEQ ID NO: 343061 - RNA, 20 nt, Human
augcuuucuugugugcugcu

SEQ ID NO: 343062 - RNA, 22 nt, Human
cugcugugcauauuuaucuagg

SEQ ID NO: 343063 - RNA, 22 nt, Human
uccccagggcugcagagggugu

SEQ ID NO: 343064 - RNA, 20 nt, Human
uacagaaugcaauaaaaugg

SEQ ID NO: 343065 - RNA, 17 nt, Human
agaggcagauacuugga

SEQ ID NO: 343066 - RNA, 22 nt, Human
aagacugucuuuucugagugac

SEQ ID NO: 343067 - RNA, 22 nt, Human
acuggcaguagagggagcgcau

SEQ ID NO: 343068 - RNA, 22 nt, Human
caaugugguggcagaugucagu

SEQ ID NO: 343069 - RNA, 22 nt, Human
gcagagaacccagcagauuggc

SEQ ID NO: 343070 - RNA, 21 nt, Human
ggcagcguguggacaggaagg

SEQ ID NO: 343071 - RNA, 22 nt, Human
uaugaacauguucauugacuua

SEQ ID NO: 343072 - RNA, 22 nt, Human
ccauccugcauugcuauucaga

SEQ ID NO: 343073 - RNA, 22 nt, Human
acaacauuauacauagaaagcu

SEQ ID NO: 343074 - RNA, 19 nt, Human
uuuuccuucuauauguuuc

SEQ ID NO: 343075 - RNA, 22 nt, Human
cuucagagugcagaagauuggg

SEQ ID NO: 343076 - RNA, 22 nt, Human
aggcagcucuguggccucccag

SEQ ID NO: 343077 - RNA, 22 nt, Human
uauuucuucgggauucaagcua

SEQ ID NO: 343078 - RNA, 22 nt, Human
ucaggaggccaccaggaccugu

SEQ ID NO: 343079 - RNA, 16 nt, Human
aggaggggaauuagga

SEQ ID NO: 343080 - RNA, 22 nt, Human
gaggccaggagugcuguaaguu

SEQ ID NO: 343081 - RNA, 22 nt, Human
gaggagcugggucagggagaca

SEQ ID NO: 343082 - RNA, 22 nt, Human
acaacauucuuaaauacacuga

SEQ ID NO: 343083 - RNA, 22 nt, Human
ucaggagagaguuggguaggcu

SEQ ID NO: 343084 - RNA, 22 nt, Human
uuucuucauagaccuugucuug

SEQ ID NO: 343085 - RNA, 22 nt, Human
uuugaaauuaagauauugucca

SEQ ID NO: 343086 - RNA, 22 nt, Human
acaagauagcuuagaagauuca

SEQ ID NO: 343087 - RNA, 22 nt, Human
ccagugcuuccaggaauacggu

SEQ ID NO: 343088 - RNA, 22 nt, Human
auguaugagagauucuuuuauu

SEQ ID NO: 343089 - RNA, 22 nt, Human
aggaagcuuagugaaaggacca

SEQ ID NO: 343090 - RNA, 22 nt, Human
aaucuucuuucuuaacaguaca

SEQ ID NO: 343091 - RNA, 22 nt, Human
gcggagggcgagcccgcggagc

SEQ ID NO: 343092 - RNA, 22 nt, Human
gugcauuugugcaugcacaugu

SEQ ID NO: 343093 - RNA, 23 nt, Human
uuucaacuccugccauuauuucu

SEQ ID NO: 343094 - RNA, 22 nt, Human
aaguccaugaucaagauguggc

SEQ ID NO: 343095 - RNA, 22 nt, Human
aagggcaggagaagacggauau

SEQ ID NO: 343096 - RNA, 22 nt, Human
agacagcuaauaaaugagugug

SEQ ID NO: 343097 - RNA, 22 nt, Human
uaaauuauggcuggcagagcag

SEQ ID NO: 343098 - RNA, 22 nt, Human
caguuucuauggcugggcucug

SEQ ID NO: 343099 - RNA, 22 nt, Human
uuauuuacaacucuucucuucc

SEQ ID NO: 343100 - RNA, 22 nt, Human
aauguaugagcgugaaagcacu

SEQ ID NO: 343101 - RNA, 22 nt, Human
gaggcagcaugguaccuuggag

SEQ ID NO: 343102 - RNA, 22 nt, Human
ugucaaagccugaaucacauag

SEQ ID NO: 343103 - RNA, 22 nt, Human
cagaggaugaucuggccucucu

SEQ ID NO: 343104 - RNA, 22 nt, Human
cuucuucacacuggucugaagc

SEQ ID NO: 343105 - RNA, 21 nt, Human
uacugagaccucacagugugc

SEQ ID NO: 343106 - RNA, 22 nt, Human
aucaggauucaguaucuccagc

SEQ ID NO: 343107 - RNA, 22 nt, Human
aacauuuaugauugagguaaau

SEQ ID NO: 343108 - RNA, 22 nt, Human
ucaggagacuuaugucacagug

SEQ ID NO: 343109 - RNA, 22 nt, Human
gauuuuauuagcccaaacuuug

SEQ ID NO: 343110 - RNA, 22 nt, Human
aaguaaaauguuuccuuuauua

SEQ ID NO: 343111 - RNA, 22 nt, Human
uucugucacagugcugguauca

SEQ ID NO: 343112 - RNA, 19 nt, Human
uucuccagccugaccugag

SEQ ID NO: 343113 - RNA, 22 nt, Human
ugaacaaacugcauucuucacu

SEQ ID NO: 343114 - RNA, 22 nt, Human
cccaggagagggaaccaaaugu

SEQ ID NO: 343115 - RNA, 22 nt, Human
acaauacuauuuucaguauccu

SEQ ID NO: 343116 - RNA, 22 nt, Human
ucaggauguccaaaauccagcc

SEQ ID NO: 343117 - RNA, 22 nt, Human
uccaggagcucauccacgucaa

SEQ ID NO: 343118 - RNA, 23 nt, Human
acagaaaguucugcuggacagag

SEQ ID NO: 343119 - RNA, 22 nt, Human
cugcuuccauaaauaaugugcu

SEQ ID NO: 343120 - RNA, 22 nt, Human
ucacugcucagucuguacuaca

SEQ ID NO: 343121 - RNA, 22 nt, Human
aggagagggguaggauuaauuu

SEQ ID NO: 343122 - RNA, 22 nt, Human
ugagaauuuuuugucaugcauu

SEQ ID NO: 343123 - RNA, 22 nt, Human
accaggagccauagagucaggc

SEQ ID NO: 343124 - RNA, 22 nt, Human
gcagaagucagaccaucugaau

SEQ ID NO: 343125 - RNA, 22 nt, Human
ucucaagaucucaagauggccc

SEQ ID NO: 343126 - RNA, 22 nt, Human
aaggcagccuuuugaguugauu

SEQ ID NO: 343127 - RNA, 22 nt, Human
aaguauuucguucugaaaaagu

SEQ ID NO: 343128 - RNA, 22 nt, Human
auucuucaccauggauaauuug

SEQ ID NO: 343129 - RNA, 19 nt, Human
uuugaaaggauuguuauuu

SEQ ID NO: 343130 - RNA, 18 nt, Human
ugaggcagucagugaugg

SEQ ID NO: 343131 - RNA, 22 nt, Human
cccaugagaccugguuuaaggc

SEQ ID NO: 343132 - RNA, 22 nt, Human
aucugccucuucuucauugcga

SEQ ID NO: 343133 - RNA, 21 nt, Human
ggcagcucagcagauggggac

SEQ ID NO: 343134 - RNA, 22 nt, Human
caaauauuccagguacaucccu

SEQ ID NO: 343135 - RNA, 22 nt, Human
uauuauuaaauggcagaauuuu

SEQ ID NO: 343136 - RNA, 22 nt, Human
cuuucauucuuagauauuagug

SEQ ID NO: 343137 - RNA, 22 nt, Human
agucuacaaagaaaaguuauug

SEQ ID NO: 343138 - RNA, 22 nt, Human
ugcauaguucuccuuccuccuc

SEQ ID NO: 343139 - RNA, 22 nt, Human
cauuguuaauugguaucuuaca

SEQ ID NO: 343140 - RNA, 22 nt, Human
agacaaauggaguaugagcaac

SEQ ID NO: 343141 - RNA, 22 nt, Human
ggcaugcucuuuguccacagua

SEQ ID NO: 343142 - RNA, 22 nt, Human
ugaggcagccugcauuaaagag

SEQ ID NO: 343143 - RNA, 22 nt, Human
agauggaguuaguaccagaguc

SEQ ID NO: 343144 - RNA, 22 nt, Human
uugcaauagccuuauuuccaaa

SEQ ID NO: 343145 - RNA, 18 nt, Human
acucaggaaaugaugaca

SEQ ID NO: 343146 - RNA, 20 nt, Human
aggcaccugucacaggugag

SEQ ID NO: 343147 - RNA, 22 nt, Human
uacccaggaggaaacugaggcu

SEQ ID NO: 343148 - RNA, 22 nt, Human
auuuucaucauggguuuaacau

SEQ ID NO: 343149 - RNA, 22 nt, Human
aucaggaucaugcuggguggga

SEQ ID NO: 343150 - RNA, 22 nt, Human
gucaggaucucccaguacauau

SEQ ID NO: 343151 - RNA, 20 nt, Human
guaaaauauggucuuugggu

SEQ ID NO: 343152 - RNA, 22 nt, Human
uacugcauaacuggcauguggg

SEQ ID NO: 343153 - RNA, 22 nt, Human
uguaugaaucucauuuguuuaa

SEQ ID NO: 343154 - RNA, 22 nt, Human
cuuaagaugaggucaugcuaua

SEQ ID NO: 343155 - RNA, 22 nt, Human
ucauuuguaccauuuuuuaaga

SEQ ID NO: 343156 - RNA, 22 nt, Human
gaggacaggagacucacuguuu

SEQ ID NO: 343157 - RNA, 22 nt, Human
agcagaggaggauuuaguuagg

SEQ ID NO: 343158 - RNA, 22 nt, Human
ucucucuuuuuaaucauguaau

SEQ ID NO: 343159 - RNA, 22 nt, Human
gcugauguaagacuuuugguuu

SEQ ID NO: 343160 - RNA, 22 nt, Human
cccaggaguuagagguuguggu

SEQ ID NO: 343161 - RNA, 22 nt, Human
uacaacauuguguugcuucaua

SEQ ID NO: 343162 - RNA, 22 nt, Human
ggcagacuguaauaggagaauu

SEQ ID NO: 343163 - RNA, 22 nt, Human
uggcagcuagcuguuuucaugc

SEQ ID NO: 343164 - RNA, 22 nt, Human
ucaauauauuccauguuuucuc

SEQ ID NO: 343165 - RNA, 19 nt, Human
ucccaggaaccuuuuauuu

SEQ ID NO: 343166 - RNA, 22 nt, Human
cucuccucagaacaggcccucu

SEQ ID NO: 343167 - RNA, 22 nt, Human
cuucagaagaaaagcagugugu

SEQ ID NO: 343168 - RNA, 20 nt, Human
ucuguacacucaucuucugc

SEQ ID NO: 343169 - RNA, 22 nt, Human
uccaugagcuagggauucauca

SEQ ID NO: 343170 - RNA, 22 nt, Human
augaaggcuguguggagccccc

SEQ ID NO: 343171 - RNA, 22 nt, Human
gaaccucagugaaacuggaggu

SEQ ID NO: 343172 - RNA, 22 nt, Human
cauaauuugauaugcuugaugg

SEQ ID NO: 343173 - RNA, 23 nt, Human
acucacaaagcaggaucauguug

SEQ ID NO: 343174 - RNA, 22 nt, Human
auugcuaggaacagguugcacc

SEQ ID NO: 343175 - RNA, 22 nt, Human
uccaggagucagacagauggug

SEQ ID NO: 343176 - RNA, 22 nt, Human
aggccagacagcuagaaacagg

SEQ ID NO: 343177 - RNA, 18 nt, Human
gugcugugggcaguggcc

SEQ ID NO: 343178 - RNA, 21 nt, Human
uguaaguuucaucugaauugg

SEQ ID NO: 343179 - RNA, 22 nt, Human
uuagaaagcuuuccauagucaa

SEQ ID NO: 343180 - RNA, 22 nt, Human
uaacacauuuuccucauacgga

SEQ ID NO: 343181 - RNA, 22 nt, Human
augacucuuagcuaaagguaag

SEQ ID NO: 343182 - RNA, 22 nt, Human
cugcccaggaaggagaggaugg

SEQ ID NO: 343183 - RNA, 22 nt, Human
cuguaugaguugggaauagaau

SEQ ID NO: 343184 - RNA, 21 nt, Human
acucaggagacuaacuauguc

SEQ ID NO: 343185 - RNA, 22 nt, Human
cccaggagguagagguugcagu

SEQ ID NO: 343186 - RNA, 22 nt, Human
uggaaggaaagguagcagagaa

SEQ ID NO: 343187 - RNA, 22 nt, Human
gagaaaugcaugcaugucauca

SEQ ID NO: 343188 - RNA, 22 nt, Human
uuucaaagucaauaucauuacc

SEQ ID NO: 343189 - RNA, 22 nt, Human
auugaaagcacaaagaacaagu

SEQ ID NO: 343190 - RNA, 22 nt, Human
uuggaaaaacacgauagugguu

SEQ ID NO: 343191 - RNA, 22 nt, Human
aggcaguggaugucaggaaugg

SEQ ID NO: 343192 - RNA, 22 nt, Human
uaaggccagcaugaaugcagca

SEQ ID NO: 343193 - RNA, 22 nt, Human
augggaggaugcucgggugcuc

SEQ ID NO: 343194 - RNA, 22 nt, Human
uucuucuuuaucucaguauccu

SEQ ID NO: 343195 - RNA, 22 nt, Human
uuauuuugguaaauguuugccu

SEQ ID NO: 343196 - RNA, 22 nt, Human
caaggccauaagagauacaaaa

SEQ ID NO: 343197 - RNA, 22 nt, Human
cuuaagauuugagauaccuaau

SEQ ID NO: 343198 - RNA, 22 nt, Human
auguucuuccaaaucuguaaca

SEQ ID NO: 343199 - RNA, 22 nt, Human
auacuguuucucuucuacauga

SEQ ID NO: 343200 - RNA, 22 nt, Human
agaggcggagguugcagugagc

SEQ ID NO: 343201 - RNA, 22 nt, Human
uucuuuuccuacacagcgauuu

SEQ ID NO: 343202 - RNA, 20 nt, Human
uuuuccagaaaguaucauug

SEQ ID NO: 343203 - RNA, 22 nt, Human
agucucugcugguugugccuau

SEQ ID NO: 343204 - RNA, 22 nt, Human
cuucugugcuucacaguugcca

SEQ ID NO: 343205 - RNA, 18 nt, Human
agucuucugauccauuuu

SEQ ID NO: 343206 - RNA, 22 nt, Human
cagcaggaggugaguagcaggu

SEQ ID NO: 343207 - RNA, 23 nt, Human
aucuguucaucugacacagauuc

SEQ ID NO: 343208 - RNA, 22 nt, Human
gaggcagcugggcuggugguuu

SEQ ID NO: 343209 - RNA, 22 nt, Human
cagcugccccuccagggcuggg

SEQ ID NO: 343210 - RNA, 22 nt, Human
aucaggaugacaacugcugggu

SEQ ID NO: 343211 - RNA, 22 nt, Human
aguccaaggagagacagcauuu

SEQ ID NO: 343212 - RNA, 22 nt, Human
agucaauuaucucuaggucauc

SEQ ID NO: 343213 - RNA, 22 nt, Human
ucccaggaauugaagccagugu

SEQ ID NO: 343214 - RNA, 21 nt, Human
acauucacaggauauuaucau

SEQ ID NO: 343215 - RNA, 19 nt, Human
cucucacucgccacauccu

SEQ ID NO: 343216 - RNA, 22 nt, Human
uuagccauauagaaaaagagcu

SEQ ID NO: 343217 - RNA, 22 nt, Human
aagauaauauucauuaacuaga

SEQ ID NO: 343218 - RNA, 22 nt, Human
guuuuccugaaacugauggugu

SEQ ID NO: 343219 - RNA, 22 nt, Human
augcuguguauuuuacucuuuc

SEQ ID NO: 343220 - RNA, 22 nt, Human
gaaggccaagaggcuccaagau

SEQ ID NO: 343221 - RNA, 22 nt, Human
gucaggaugggcagccaaacua

SEQ ID NO: 343222 - RNA, 18 nt, Human
aguaaagcuuauuacaug

SEQ ID NO: 343223 - RNA, 22 nt, Human
agacucaagacugcagaagacg

SEQ ID NO: 343224 - RNA, 22 nt, Human
auaugagaauuggaaaauauca

SEQ ID NO: 343225 - RNA, 22 nt, Human
cucaaauauaagcuaaaugugg

SEQ ID NO: 343226 - RNA, 22 nt, Human
uugcauuucccauugaguaaug

SEQ ID NO: 343227 - RNA, 22 nt, Human
gauuucuuuaugaaguacagaa

SEQ ID NO: 343228 - RNA, 22 nt, Human
aggguagggccguagggccaug

SEQ ID NO: 343229 - RNA, 22 nt, Human
gugcagcugugguggagccagg

SEQ ID NO: 343230 - RNA, 22 nt, Human
uucagaauauuuguuuuacaug

SEQ ID NO: 343231 - RNA, 20 nt, Human
uucugucagauuauauggga

SEQ ID NO: 343232 - RNA, 22 nt, Human
uguuuuaaucucccauugcucu

SEQ ID NO: 343233 - RNA, 22 nt, Human
auguagaauuccuucuacuuug

SEQ ID NO: 343234 - RNA, 22 nt, Human
uuugacaaaggaaaaaugcaca

SEQ ID NO: 343235 - RNA, 22 nt, Human
gcugcuguugauuuaguccaau

SEQ ID NO: 343236 - RNA, 22 nt, Human
acuucuucuucagcugggggau

SEQ ID NO: 343237 - RNA, 22 nt, Human
gggcagcucagccaccaugcag

SEQ ID NO: 343238 - RNA, 22 nt, Human
cccaggaggaggaaaaagcucg

SEQ ID NO: 343239 - RNA, 22 nt, Human
auagucuuagaucagauaaagu

SEQ ID NO: 343240 - RNA, 22 nt, Human
uucucagauccaucagaagucc

SEQ ID NO: 343241 - RNA, 17 nt, Human
cauuuguugaucaguug

SEQ ID NO: 343242 - RNA, 22 nt, Human
agaccuggauuccaauccuacc

SEQ ID NO: 343243 - RNA, 22 nt, Human
ggaggugguggcagugacaauu

SEQ ID NO: 343244 - RNA, 22 nt, Human
aagggaggggauguaagccugg

SEQ ID NO: 343245 - RNA, 22 nt, Human
uuuugaauaauucagaaacagc

SEQ ID NO: 343246 - RNA, 22 nt, Human
gaggcagugcauugucuagggg

SEQ ID NO: 343247 - RNA, 22 nt, Human
auugaaagauaggcuacugugg

SEQ ID NO: 343248 - RNA, 20 nt, Human
agaggccaguuaggagucua

SEQ ID NO: 343249 - RNA, 22 nt, Human
ugaggggagacagaguggacuc

SEQ ID NO: 343250 - RNA, 22 nt, Human
uucauucugggcucuaaggaac

SEQ ID NO: 343251 - RNA, 22 nt, Human
ugcacauuaguguuugagaugc

SEQ ID NO: 343252 - RNA, 22 nt, Human
agucucuuccuucaaggcuggu

SEQ ID NO: 343253 - RNA, 18 nt, Human
cugcugugucgucugggc

SEQ ID NO: 343254 - RNA, 22 nt, Human
uauagccauuuccaguggcauc

SEQ ID NO: 343255 - RNA, 22 nt, Human
uacccagggcuuuucugaugca

SEQ ID NO: 343256 - RNA, 19 nt, Human
ugcuagaaauucugugacu

SEQ ID NO: 343257 - RNA, 22 nt, Human
ucacaauauuuaucuuccaauu

SEQ ID NO: 343258 - RNA, 22 nt, Human
aggacagcagugcuggcacuug

SEQ ID NO: 343259 - RNA, 22 nt, Human
ugaaacauugcacuguaugaau

SEQ ID NO: 343260 - RNA, 22 nt, Human
agcuggcaguaugacuggugac

SEQ ID NO: 343261 - RNA, 22 nt, Human
aggcaggcacacuuccuccagg

SEQ ID NO: 343262 - RNA, 22 nt, Human
ucagggugaaccaggcaggaau

SEQ ID NO: 343263 - RNA, 22 nt, Human
cgaggcaggcaggcggaggaua

SEQ ID NO: 343264 - RNA, 22 nt, Human
aggcagcuggcaaauucuagag

SEQ ID NO: 343265 - RNA, 22 nt, Human
ggacagaggguugacagaguau

SEQ ID NO: 343266 - RNA, 22 nt, Human
ucaggagacauucuuaaaguag

SEQ ID NO: 343267 - RNA, 22 nt, Human
aucuacccacugaacacaauau

SEQ ID NO: 343268 - RNA, 20 nt, Human
auaaaauaacugccacaaga

SEQ ID NO: 343269 - RNA, 22 nt, Human
cagucuuuguucccauuacuga

SEQ ID NO: 343270 - RNA, 22 nt, Human
cauuaaaauaucucaugguguu

SEQ ID NO: 343271 - RNA, 22 nt, Human
ucugcagguguuggaaggguca

SEQ ID NO: 343272 - RNA, 22 nt, Human
cagcauuuaaugcagugcuucc

SEQ ID NO: 343273 - RNA, 22 nt, Human
auaucauucugauguauaucuu

SEQ ID NO: 343274 - RNA, 22 nt, Human
uuggcagugaugcagcuuguuc

SEQ ID NO: 343275 - RNA, 22 nt, Human
acaaauauuuacugaauccacu

SEQ ID NO: 343276 - RNA, 22 nt, Human
guuugcauauuugcacaggaau

SEQ ID NO: 343277 - RNA, 22 nt, Human
ugcugaugaguccuucuaucgc

SEQ ID NO: 343278 - RNA, 22 nt, Human
ccaggagauaagcugaguuuau

SEQ ID NO: 343279 - RNA, 22 nt, Human
cuuaaauuggaugaguuaaguu

SEQ ID NO: 343280 - RNA, 22 nt, Human
ugauuuuuagcuauucugaaga

SEQ ID NO: 343281 - RNA, 22 nt, Human
uuuuguuguaauauaccuaucc

SEQ ID NO: 343282 - RNA, 16 nt, Human
ccccaggacuuggcac

SEQ ID NO: 343283 - RNA, 22 nt, Human
cccaggagauggagguugcagu

SEQ ID NO: 343284 - RNA, 22 nt, Human
uucacagucacccuucuccaug

SEQ ID NO: 343285 - RNA, 22 nt, Human
uuugaaagcuacuuucggguca

SEQ ID NO: 343286 - RNA, 22 nt, Human
ugaaucauggauaaauagcuua

SEQ ID NO: 343287 - RNA, 22 nt, Human
gggaggugauuaggaccaugua

SEQ ID NO: 343288 - RNA, 19 nt, Human
aucugccuguuaucacaua

SEQ ID NO: 343289 - RNA, 19 nt, Human
uggcaucuguaaaauggug

SEQ ID NO: 343290 - RNA, 22 nt, Human
caaggccacguucugcaugcgg

SEQ ID NO: 343291 - RNA, 22 nt, Human
gucaggauuugaacucaggucu

SEQ ID NO: 343292 - RNA, 22 nt, Human
uguuuucagucauauagcaggu

SEQ ID NO: 343293 - RNA, 22 nt, Human
auuaucuauguagaaugauuuu

SEQ ID NO: 343294 - RNA, 22 nt, Human
guccaugacugugacucacaug

SEQ ID NO: 343295 - RNA, 20 nt, Human
cuucuucaguaguuuguucu

SEQ ID NO: 343296 - RNA, 22 nt, Human
gcaggagacuggcugugguagu

SEQ ID NO: 343297 - RNA, 22 nt, Human
auguuuccagguucuuccuaug

SEQ ID NO: 343298 - RNA, 22 nt, Human
aguaugaauugcuuugccugua

SEQ ID NO: 343299 - RNA, 22 nt, Human
uagggaggcuacuucuuguagg

SEQ ID NO: 343300 - RNA, 22 nt, Human
caggguggggaaauagcgcccu

SEQ ID NO: 343301 - RNA, 22 nt, Human
agauuuauguggucacacucag

SEQ ID NO: 343302 - RNA, 23 nt, Human
gccaggaguggguagacuaaugc

SEQ ID NO: 343303 - RNA, 22 nt, Human
ucuucaucucagauuaacagga

SEQ ID NO: 343304 - RNA, 22 nt, Human
ccugcuguucuguuuagugaac

SEQ ID NO: 343305 - RNA, 22 nt, Human
caaggccauauugccuguaugu

SEQ ID NO: 343306 - RNA, 22 nt, Human
agggagcucaguuggaagcggu

SEQ ID NO: 343307 - RNA, 22 nt, Human
guguaugauuucaaauggcuag

SEQ ID NO: 343308 - RNA, 22 nt, Human
aauacaguaauuuugaugaguu

SEQ ID NO: 343309 - RNA, 22 nt, Human
uucugucuguaaacuucucaau

SEQ ID NO: 343310 - RNA, 22 nt, Human
ggagaagggacagacucagcuu

SEQ ID NO: 343311 - RNA, 22 nt, Human
caggauggucuucauuuggcuc

SEQ ID NO: 343312 - RNA, 22 nt, Human
aaaguuugcaauuuauguuaau

SEQ ID NO: 343313 - RNA, 22 nt, Human
uuucucaguuacuagcuguggu

SEQ ID NO: 343314 - RNA, 22 nt, Human
aggagagcuggugucuggaauc

SEQ ID NO: 343315 - RNA, 22 nt, Human
aggcagcugaccacaguaugau

SEQ ID NO: 343316 - RNA, 22 nt, Human
gaggcagcaggcugaggaggau

SEQ ID NO: 343317 - RNA, 22 nt, Human
auauucuucuuguucagacuau

SEQ ID NO: 343318 - RNA, 19 nt, Human
gacagugcaguuguaguac

SEQ ID NO: 343319 - RNA, 21 nt, Human
cucaggaucuuauauauuagu

SEQ ID NO: 343320 - RNA, 22 nt, Human
cacucugaugguuucuguucaa

SEQ ID NO: 343321 - RNA, 22 nt, Human
uuagagucaaaauggcauguua

SEQ ID NO: 343322 - RNA, 22 nt, Human
uuucaguucaguuuauuauauc

SEQ ID NO: 343323 - RNA, 22 nt, Human
aaucuucagugucuaaaaagca

SEQ ID NO: 343324 - RNA, 22 nt, Human
augaacuuauuucugaacuuuu

SEQ ID NO: 343325 - RNA, 22 nt, Human
uucugagacaauugagagucua

SEQ ID NO: 343326 - RNA, 22 nt, Human
aaaggagacuucagaucuccuu

SEQ ID NO: 343327 - RNA, 18 nt, Human
ucaggagacacagacgca

SEQ ID NO: 343328 - RNA, 22 nt, Human
ucugcuguucauucuuuuagcu

SEQ ID NO: 343329 - RNA, 22 nt, Human
auguuucagauacagaucaaau

SEQ ID NO: 343330 - RNA, 22 nt, Human
acauucuuaacaguuaaaaacu

SEQ ID NO: 343331 - RNA, 22 nt, Human
ucuuugaugugguuaauuauga

SEQ ID NO: 343332 - RNA, 22 nt, Human
ggcugaaggaugaaagcugcag

SEQ ID NO: 343333 - RNA, 22 nt, Human
cccuggaguccuggcaguugau

SEQ ID NO: 343334 - RNA, 22 nt, Human
ucuguggauuuuaguguucaug

SEQ ID NO: 343335 - RNA, 22 nt, Human
ucuuagaaauuccccaguggcu

SEQ ID NO: 343336 - RNA, 22 nt, Human
uucuuuuacauuaagauuucag

SEQ ID NO: 343337 - RNA, 22 nt, Human
uguuuauuacaguucuuggaau

SEQ ID NO: 343338 - RNA, 22 nt, Human
uggaguuccuuugaaaggcucu

SEQ ID NO: 343339 - RNA, 22 nt, Human
ccaggagagcucucguucagug

SEQ ID NO: 343340 - RNA, 22 nt, Human
ccuucauugcaucuuuaagaga

SEQ ID NO: 343341 - RNA, 22 nt, Human
uucuuuugggaauuacguaugc

SEQ ID NO: 343342 - RNA, 18 nt, Human
cauuguacaaugcuuuau

SEQ ID NO: 343343 - RNA, 22 nt, Human
cagcauuuggaggagaggcuuu

SEQ ID NO: 343344 - RNA, 22 nt, Human
cugcuguggguuaagacacugu

SEQ ID NO: 343345 - RNA, 22 nt, Human
aauacuuuccuauauaaggugc

SEQ ID NO: 343346 - RNA, 22 nt, Human
cugugauuguuaguuccuauac

SEQ ID NO: 343347 - RNA, 22 nt, Human
uauguacuaacuuucauucuag

SEQ ID NO: 343348 - RNA, 22 nt, Human
uuucaacaccagagaccaugcg

SEQ ID NO: 343349 - RNA, 22 nt, Human
aggcagcugaggucuggcgccc

SEQ ID NO: 343350 - RNA, 22 nt, Human
agcugcccugguaagauugaug

SEQ ID NO: 343351 - RNA, 21 nt, Human
uuucacaaaaguaugugacaa

SEQ ID NO: 343352 - RNA, 22 nt, Human
cugaaaauguuacacaggaaga

SEQ ID NO: 343353 - RNA, 22 nt, Human
ccaggagauuuuuccauagcac

SEQ ID NO: 343354 - RNA, 22 nt, Human
uuagaacuuaaacuucagaaag

SEQ ID NO: 343355 - RNA, 22 nt, Human
aagauuauuuaagacaggaacc

SEQ ID NO: 343356 - RNA, 22 nt, Human
agauaugugcgucuuagauuga

SEQ ID NO: 343357 - RNA, 22 nt, Human
auuaaauuuucacuaggcuccc

SEQ ID NO: 343358 - RNA, 22 nt, Human
uuugcaauuugugcugcaaaug

SEQ ID NO: 343359 - RNA, 22 nt, Human
aggcugcuucaauggauaagau

SEQ ID NO: 343360 - RNA, 22 nt, Human
uugaaagugccaaguccuagug

SEQ ID NO: 343361 - RNA, 23 nt, Human
ucuguacaauugagaagagaaca

SEQ ID NO: 343362 - RNA, 22 nt, Human
uggaggaaguggcuggccagaa

SEQ ID NO: 343363 - RNA, 22 nt, Human
ucagagaguuagugucuuagcu

SEQ ID NO: 343364 - RNA, 22 nt, Human
aucacaaaggcugcuucaugau

SEQ ID NO: 343365 - RNA, 22 nt, Human
auaucauuauguuaugagcaca

SEQ ID NO: 343366 - RNA, 22 nt, Human
uuuuucuugugcuggaucuaau

SEQ ID NO: 343367 - RNA, 22 nt, Human
uuagccauggacugaauugacu

SEQ ID NO: 343368 - RNA, 22 nt, Human
gggacgggcaguccaagggguc

SEQ ID NO: 343369 - RNA, 22 nt, Human
gcuuugaagacuuuuccagggu

SEQ ID NO: 343370 - RNA, 19 nt, Human
ugaguucugugguucucaa

SEQ ID NO: 343371 - RNA, 22 nt, Human
cuucagaaugggacuguguuug

SEQ ID NO: 343372 - RNA, 22 nt, Human
uaggagggcccugaaaauggca

SEQ ID NO: 343373 - RNA, 22 nt, Human
aaacugcuuuccacaguggcua

SEQ ID NO: 343374 - RNA, 22 nt, Human
ggagcaggagucucuugaauuu

SEQ ID NO: 343375 - RNA, 22 nt, Human
uccugaggcucacuuugaaugu

SEQ ID NO: 343376 - RNA, 22 nt, Human
agaggggaggcgaaccagaguc

SEQ ID NO: 343377 - RNA, 22 nt, Human
uucacagaugccugaugugugg

SEQ ID NO: 343378 - RNA, 22 nt, Human
guuuauaaggcccaauauuucu

SEQ ID NO: 343379 - RNA, 22 nt, Human
uggagucugugaugcucugggu

SEQ ID NO: 343380 - RNA, 22 nt, Human
gucuucuguaagaugagguccc

SEQ ID NO: 343381 - RNA, 22 nt, Human
cagaggcagugggguugcuccu

SEQ ID NO: 343382 - RNA, 21 nt, Human
uuccagagauuguuucaccug

SEQ ID NO: 343383 - RNA, 22 nt, Human
aggcaggcucaaugcccagucu

SEQ ID NO: 343384 - RNA, 22 nt, Human
gucacuguauccagguuccagc

SEQ ID NO: 343385 - RNA, 22 nt, Human
agcccaggcagagggaugcuug

SEQ ID NO: 343386 - RNA, 22 nt, Human
auucuuauuauaguaaaacagu

SEQ ID NO: 343387 - RNA, 22 nt, Human
gcugcccaggagagguggggcu

SEQ ID NO: 343388 - RNA, 21 nt, Human
gcugcccaacccugcaucucc

SEQ ID NO: 343389 - RNA, 22 nt, Human
ccacaucucgguccccucuuug

SEQ ID NO: 343390 - RNA, 22 nt, Human
aggcagacaaggucccuggucu

SEQ ID NO: 343391 - RNA, 22 nt, Human
aggaggggcauagaaauguaau

SEQ ID NO: 343392 - RNA, 22 nt, Human
uuugaaagcaggugugggaggg

SEQ ID NO: 343393 - RNA, 22 nt, Human
aaacacauuuuaggaaaaucua

SEQ ID NO: 343394 - RNA, 22 nt, Human
cuggaaauuggagaugauguuu

SEQ ID NO: 343395 - RNA, 22 nt, Human
uagggaugagccaguggguagu

SEQ ID NO: 343396 - RNA, 22 nt, Human
cuucuucaauagcaagcgcaua

SEQ ID NO: 343397 - RNA, 22 nt, Human
gugagggguggcugagcaguuu

SEQ ID NO: 343398 - RNA, 22 nt, Human
uucuucuccgaggagggcuggu

SEQ ID NO: 343399 - RNA, 22 nt, Human
acucaggaaauugagauaaugg

SEQ ID NO: 343400 - RNA, 22 nt, Human
caaauagugucacauugugagg

SEQ ID NO: 343401 - RNA, 22 nt, Human
gaggcaccucgcgggaggaggc

SEQ ID NO: 343402 - RNA, 22 nt, Human
agcauucauugcuagaauguaa

SEQ ID NO: 343403 - RNA, 22 nt, Human
uuucuucacaggguauugggug

SEQ ID NO: 343404 - RNA, 22 nt, Human
augcugugaaaaagaaggcuga

SEQ ID NO: 343405 - RNA, 22 nt, Human
ucuuuauugcuacugguuuguc

SEQ ID NO: 343406 - RNA, 22 nt, Human
cagagcucuauguucauggagg

SEQ ID NO: 343407 - RNA, 22 nt, Human
ugcccacauggugccauggcca

SEQ ID NO: 343408 - RNA, 22 nt, Human
auguuagaaggaauguuaaaag

SEQ ID NO: 343409 - RNA, 22 nt, Human
auuguauaacagcauguauuuu

SEQ ID NO: 343410 - RNA, 22 nt, Human
ugcuuggccuacuuguccuuug

SEQ ID NO: 343411 - RNA, 22 nt, Human
ugaaagguuaaaaguaguauug

SEQ ID NO: 343412 - RNA, 22 nt, Human
cagaccagcucuaugaacccaa

SEQ ID NO: 343413 - RNA, 21 nt, Human
ccauaccuaccucaccugguu

SEQ ID NO: 343414 - RNA, 22 nt, Human
uucuacagacuauaacugugau

SEQ ID NO: 343415 - RNA, 22 nt, Human
ggcacagagcccagcuuccuag

SEQ ID NO: 343416 - RNA, 22 nt, Human
caugauuuugucuuguguuaau

SEQ ID NO: 343417 - RNA, 22 nt, Human
agucaauucuuuucaacucaag

SEQ ID NO: 343418 - RNA, 22 nt, Human
agcuggcagucauccuagugag

SEQ ID NO: 343419 - RNA, 22 nt, Human
cccaggagauggugcguggucu

SEQ ID NO: 343420 - RNA, 22 nt, Human
agaaggggagaagcuaccagga

SEQ ID NO: 343421 - RNA, 22 nt, Human
cuucucaaaguugugaaucagg

SEQ ID NO: 343422 - RNA, 22 nt, Human
ucugucuccucugaggugccag

SEQ ID NO: 343423 - RNA, 22 nt, Human
acuggcagcagcagcccuuggg

SEQ ID NO: 343424 - RNA, 19 nt, Human
uuucuuaggccuuuggccu

SEQ ID NO: 343425 - RNA, 22 nt, Human
agaggcaguauacaauccgagc

SEQ ID NO: 343426 - RNA, 22 nt, Human
ugaauaguccuuggaauaacug

SEQ ID NO: 343427 - RNA, 22 nt, Human
gcucaggagcucuugguggcgc

SEQ ID NO: 343428 - RNA, 22 nt, Human
gucuucaauagagccucaauuu

SEQ ID NO: 343429 - RNA, 22 nt, Human
uuuuaacuuaaaauacauagau

SEQ ID NO: 343430 - RNA, 22 nt, Human
ugaugaaaauaugauucugagg

SEQ ID NO: 343431 - RNA, 22 nt, Human
gaaacugugaggaucuuaacuu

SEQ ID NO: 343432 - RNA, 23 nt, Human
gggcagcuuaagcuuguuuuucu

SEQ ID NO: 343433 - RNA, 21 nt, Human
agggagcuggccacacagccu

SEQ ID NO: 343434 - RNA, 22 nt, Human
cagugguugguagauacuugag

SEQ ID NO: 343435 - RNA, 22 nt, Human
aaauauaauuucugccucaaua

SEQ ID NO: 343436 - RNA, 22 nt, Human
gugacagucaaagacaugacuu

SEQ ID NO: 343437 - RNA, 22 nt, Human
aaaggccaccaacaugaagcau

SEQ ID NO: 343438 - RNA, 22 nt, Human
cuuccuucugaagcauagaagc

SEQ ID NO: 343439 - RNA, 20 nt, Human
cugcugugugugccucagcc

SEQ ID NO: 343440 - RNA, 22 nt, Human
gaggcagaaguugcagugagca

SEQ ID NO: 343441 - RNA, 17 nt, Human
uuugaaaggaugucagu

SEQ ID NO: 343442 - RNA, 22 nt, Human
aguuugaaaguauugacagaag

SEQ ID NO: 343443 - RNA, 22 nt, Human
ucucuuucuauaugugagucuu

SEQ ID NO: 343444 - RNA, 22 nt, Human
cucaggaugcaggucacaggac

SEQ ID NO: 343445 - RNA, 22 nt, Human
uugcagcuuagugauguuaucu

SEQ ID NO: 343446 - RNA, 22 nt, Human
ucccaggauguuuauggcuggu

SEQ ID NO: 343447 - RNA, 17 nt, Human
aagacagaagccaugag

SEQ ID NO: 343448 - RNA, 21 nt, Human
ggcagccugacccccagagag

SEQ ID NO: 343449 - RNA, 22 nt, Human
guucuucacauuucauugagga

SEQ ID NO: 343450 - RNA, 22 nt, Human
auuucccaugugaaucaauugg

SEQ ID NO: 343451 - RNA, 22 nt, Human
ucucacugcaaauauuauguau

SEQ ID NO: 343452 - RNA, 22 nt, Human
aaggagagguuguccguguugu

SEQ ID NO: 343453 - RNA, 22 nt, Human
cagcuggcuggucagugcacaa

SEQ ID NO: 343454 - RNA, 22 nt, Human
uugcugugaaaccaugggaagu

SEQ ID NO: 343455 - RNA, 22 nt, Human
aaauaguucagcuuguaaaccc

SEQ ID NO: 343456 - RNA, 22 nt, Human
gagguagcgaguggacagugca

SEQ ID NO: 343457 - RNA, 17 nt, Human
aaggccauuuccaccca

SEQ ID NO: 343458 - RNA, 22 nt, Human
auacaacuuuacaugcaauucc

SEQ ID NO: 343459 - RNA, 21 nt, Human
gcaaauguucaggaaaaaaga

SEQ ID NO: 343460 - RNA, 22 nt, Human
caggagggcccgagacucuucc

SEQ ID NO: 343461 - RNA, 22 nt, Human
gagcgauguggguauguagaag

SEQ ID NO: 343462 - RNA, 22 nt, Human
uggcagcugaauggcuggaugg

SEQ ID NO: 343463 - RNA, 22 nt, Human
gcagaggagcaaguugcuacag

SEQ ID NO: 343464 - RNA, 22 nt, Human
cugcuuugggcagcuuuguggc

SEQ ID NO: 343465 - RNA, 22 nt, Human
uuucuuguaagauguuuauuaa

SEQ ID NO: 343466 - RNA, 22 nt, Human
aacauucuauuuugcuaaaaca

SEQ ID NO: 343467 - RNA, 22 nt, Human
caacacauugaagcuaugauga

SEQ ID NO: 343468 - RNA, 22 nt, Human
acagagagaaacaaucagcagc

SEQ ID NO: 343469 - RNA, 22 nt, Human
uucaugugaucacagauuguaa

SEQ ID NO: 343470 - RNA, 22 nt, Human
ucacagacauggugagguaaca

SEQ ID NO: 343471 - RNA, 22 nt, Human
uuauuucauguaaaauuuaugu

SEQ ID NO: 343472 - RNA, 22 nt, Human
cuugaaguugcaaaacauuaau

SEQ ID NO: 343473 - RNA, 22 nt, Human
aaagacuuggcuuaugauuugc

SEQ ID NO: 343474 - RNA, 22 nt, Human
auaaagauuucuuuuucucuac

SEQ ID NO: 343475 - RNA, 22 nt, Human
guucuucagucacaucacagaa

SEQ ID NO: 343476 - RNA, 22 nt, Human
uucuccucuguuggccuucccu

SEQ ID NO: 343477 - RNA, 22 nt, Human
aaggccagcuuguagggcuggu

SEQ ID NO: 343478 - RNA, 22 nt, Human
uugauguacagaauuguucaca

SEQ ID NO: 343479 - RNA, 22 nt, Human
ucuucucucauguaggagggaa

SEQ ID NO: 343480 - RNA, 22 nt, Human
ucuuuucaucauuuaauaggua

SEQ ID NO: 343481 - RNA, 19 nt, Human
gaggcgaggcgugcaggag

SEQ ID NO: 343482 - RNA, 18 nt, Human
ugugaacacauuuuucug

SEQ ID NO: 343483 - RNA, 22 nt, Human
uuuuaguguagucaccgugggu

SEQ ID NO: 343484 - RNA, 22 nt, Human
aaaccgcaauuacuuuugcguc

SEQ ID NO: 343485 - RNA, 22 nt, Human
ggaggggaugguuugacccugg

SEQ ID NO: 343486 - RNA, 21 nt, Human
ccugcugugaucuuagugagu

SEQ ID NO: 343487 - RNA, 22 nt, Human
ugaggcaguauucuccauucca

SEQ ID NO: 343488 - RNA, 22 nt, Human
aaauaguuuagcucucauuuca

SEQ ID NO: 343489 - RNA, 22 nt, Human
gaggagagaacauuccuccaua

SEQ ID NO: 343490 - RNA, 22 nt, Human
uacugccuggagcauuggugcu

SEQ ID NO: 343491 - RNA, 22 nt, Human
ucaccgccuugcccggccgggc

SEQ ID NO: 343492 - RNA, 22 nt, Human
cucugaaagaguuuaguauuau

SEQ ID NO: 343493 - RNA, 22 nt, Human
cugagacuuucaugugcuuuua

SEQ ID NO: 343494 - RNA, 22 nt, Human
gacccaggguggucaccugaaa

SEQ ID NO: 343495 - RNA, 22 nt, Human
gggcagcuagcccucuagccca

SEQ ID NO: 343496 - RNA, 22 nt, Human
uaauuucuagggacuaaggugc

SEQ ID NO: 343497 - RNA, 22 nt, Human
ucacaaauagcuauauuaagga

SEQ ID NO: 343498 - RNA, 22 nt, Human
uauuucuaagagauaucuguac

SEQ ID NO: 343499 - RNA, 22 nt, Human
aggccagaugucgggcuagaag

SEQ ID NO: 343500 - RNA, 22 nt, Human
uuggaauucaaguuguagcuua

SEQ ID NO: 343501 - RNA, 22 nt, Human
cagaugaggcaaccucauugcu

SEQ ID NO: 343502 - RNA, 22 nt, Human
gccaggaggucagccccucaac

SEQ ID NO: 343503 - RNA, 22 nt, Human
aggaaagguagcgugccagcag

SEQ ID NO: 343504 - RNA, 22 nt, Human
ugcauggaggaagaugaaugca

SEQ ID NO: 343505 - RNA, 19 nt, Human
aggcaggugcagagguccc

SEQ ID NO: 343506 - RNA, 22 nt, Human
auucuucauacagacaaguccu

SEQ ID NO: 343507 - RNA, 20 nt, Human
aagggcagagggaacagacu

SEQ ID NO: 343508 - RNA, 22 nt, Human
aaaggccacacugcucuuucuc

SEQ ID NO: 343509 - RNA, 20 nt, Human
uuucaguuaucuugaccuuc

SEQ ID NO: 343510 - RNA, 18 nt, Human
augggaggggccaagaga

SEQ ID NO: 343511 - RNA, 22 nt, Human
ugaaaugauuauaugguguuug

SEQ ID NO: 343512 - RNA, 22 nt, Human
ucuuaaagagcgcaauuugagg

SEQ ID NO: 343513 - RNA, 22 nt, Human
ugaggcagcaauugauuauuca

SEQ ID NO: 343514 - RNA, 22 nt, Human
gaggcugauucggggaacagca

SEQ ID NO: 343515 - RNA, 22 nt, Human
cacagcauaaugaaauauacuu

SEQ ID NO: 343516 - RNA, 22 nt, Human
aguaugaacggaaggccuggga

SEQ ID NO: 343517 - RNA, 22 nt, Human
cacauuuaauccuuuauaagua

SEQ ID NO: 343518 - RNA, 22 nt, Human
acaggagaauuaucuggaacaa

SEQ ID NO: 343519 - RNA, 22 nt, Human
agggcagcagcggcccaggccu

SEQ ID NO: 343520 - RNA, 22 nt, Human
uucaggaucacuaaacccucca

SEQ ID NO: 343521 - RNA, 22 nt, Human
uuucacaucagagguagauuag

SEQ ID NO: 343522 - RNA, 22 nt, Human
cuucuucaguugcauguauugg

SEQ ID NO: 343523 - RNA, 22 nt, Human
cucugucacuucuccagcugag

SEQ ID NO: 343524 - RNA, 17 nt, Human
ugaaggccaugaccacg

SEQ ID NO: 343525 - RNA, 22 nt, Human
uccaggagggguaggcaguaug

SEQ ID NO: 343526 - RNA, 22 nt, Human
aaaaguauuuauggcuauguaa

SEQ ID NO: 343527 - RNA, 22 nt, Human
cugcaucaguggauaugauggu

SEQ ID NO: 343528 - RNA, 22 nt, Human
gcuuggcauugaccauuaucau

SEQ ID NO: 343529 - RNA, 22 nt, Human
aauccugugugacucuggggag

SEQ ID NO: 343530 - RNA, 22 nt, Human
uaagaacuucggacauguuauc

SEQ ID NO: 343531 - RNA, 22 nt, Human
uuucuagggcucuugucuucug

SEQ ID NO: 343532 - RNA, 22 nt, Human
uuuuucagccaugaauuacacu

SEQ ID NO: 343533 - RNA, 22 nt, Human
aaaggccacuugaaggauuuuu

SEQ ID NO: 343534 - RNA, 22 nt, Human
aagaagagaacuggcauccuaa

SEQ ID NO: 343535 - RNA, 22 nt, Human
accaggagcauuuuuuauuagu

SEQ ID NO: 343536 - RNA, 22 nt, Human
acaggccacaguggagucucug

SEQ ID NO: 343537 - RNA, 22 nt, Human
uaaggccaaguucauauacaac

SEQ ID NO: 343538 - RNA, 22 nt, Human
ugcccaggauugugaggucagg

SEQ ID NO: 343539 - RNA, 22 nt, Human
gaaacuguauguaguuuuuggg

SEQ ID NO: 343540 - RNA, 21 nt, Human
agaggcaggcauuaaguacac

SEQ ID NO: 343541 - RNA, 22 nt, Human
cagggagggacaauugucaccu

SEQ ID NO: 343542 - RNA, 22 nt, Human
uucaggaucaaguugccaguag

SEQ ID NO: 343543 - RNA, 22 nt, Human
auguagaacagguuaaugacag

SEQ ID NO: 343544 - RNA, 22 nt, Human
cccaggaggugugcccaacucg

SEQ ID NO: 343545 - RNA, 17 nt, Human
acagagcacaucaagau

SEQ ID NO: 343546 - RNA, 22 nt, Human
aaggcagucugguuucaaagca

SEQ ID NO: 343547 - RNA, 22 nt, Human
aucugcagaggacaggcgagga

SEQ ID NO: 343548 - RNA, 22 nt, Human
uuuacacaaaagauagcacacc

SEQ ID NO: 343549 - RNA, 22 nt, Human
uacucagagucauugcccuucu

SEQ ID NO: 343550 - RNA, 19 nt, Human
agaaguuagacauugcaau

SEQ ID NO: 343551 - RNA, 23 nt, Human
aguaaagcaauuguuggcgagag

SEQ ID NO: 343552 - RNA, 22 nt, Human
uggaggggcaauggagcgcgga

SEQ ID NO: 343553 - RNA, 22 nt, Human
uuaaauuagucaagcuucucug

SEQ ID NO: 343554 - RNA, 22 nt, Human
gaagcagcaaguauaggacagg

SEQ ID NO: 343555 - RNA, 21 nt, Human
ucuuccuccacagcgugccac

SEQ ID NO: 343556 - RNA, 22 nt, Human
cagcugacccagugaggaggca

SEQ ID NO: 343557 - RNA, 21 nt, Human
gaauaguucuguggcagcagu

SEQ ID NO: 343558 - RNA, 22 nt, Human
ucacagacacagggagaagcau

SEQ ID NO: 343559 - RNA, 20 nt, Human
aguuauaguaucuagccaug

SEQ ID NO: 343560 - RNA, 21 nt, Human
aggcagcuggaaggccuggcu

SEQ ID NO: 343561 - RNA, 22 nt, Human
aggcaggcacuccggaaguguc

SEQ ID NO: 343562 - RNA, 22 nt, Human
ugaaaugagauaauuuaagugc

SEQ ID NO: 343563 - RNA, 22 nt, Human
uguagggaggaaggguuggaaa

SEQ ID NO: 343564 - RNA, 22 nt, Human
aagcaauauacugauaugauua

SEQ ID NO: 343565 - RNA, 22 nt, Human
ccuggagagagaggccaacugc

SEQ ID NO: 343566 - RNA, 20 nt, Human
uuucugugcccaggucuguu

SEQ ID NO: 343567 - RNA, 22 nt, Human
acuucacagaaauuuuaugagg

SEQ ID NO: 343568 - RNA, 22 nt, Human
agcuucuuggcucagcacuugg

SEQ ID NO: 343569 - RNA, 22 nt, Human
uggcagcuugaaugcagucuuu

SEQ ID NO: 343570 - RNA, 22 nt, Human
cagcauuuucuuaauguaggug

SEQ ID NO: 343571 - RNA, 22 nt, Human
gcagaggagaugaagauacuuu

SEQ ID NO: 343572 - RNA, 22 nt, Human
cugcugugucagaguccagggg

SEQ ID NO: 343573 - RNA, 22 nt, Human
uccaugaggaccaaauucguag

SEQ ID NO: 343574 - RNA, 22 nt, Human
aagucuguuugagugucacacu

SEQ ID NO: 343575 - RNA, 22 nt, Human
ucuucuuaugugccauuaucuc

SEQ ID NO: 343576 - RNA, 22 nt, Human
ucugcuguauuagguugaacug

SEQ ID NO: 343577 - RNA, 22 nt, Human
ucaggagagaaagaauacaauu

SEQ ID NO: 343578 - RNA, 22 nt, Human
auuggcaggaaccgaggagggg

SEQ ID NO: 343579 - RNA, 17 nt, Human
uccaugagacaugaaga

SEQ ID NO: 343580 - RNA, 20 nt, Human
cagaggcauuuucagacucu

SEQ ID NO: 343581 - RNA, 22 nt, Human
acaggagacccugcugguucug

SEQ ID NO: 343582 - RNA, 22 nt, Human
aacuuucuuggaugucucaaca

SEQ ID NO: 343583 - RNA, 22 nt, Human
caugcuguguguuuuagcucca

SEQ ID NO: 343584 - RNA, 22 nt, Human
cuugauguauaaguugauaugu

SEQ ID NO: 343585 - RNA, 23 nt, Human
ucucuuucaagagcuuaaugugc

SEQ ID NO: 343586 - RNA, 19 nt, Human
uucccaggaaaggggugca

SEQ ID NO: 343587 - RNA, 22 nt, Human
ugaggcagaaaauagcaguuca

SEQ ID NO: 343588 - RNA, 22 nt, Human
gaucuucuauguaaugaagugu

SEQ ID NO: 343589 - RNA, 22 nt, Human
cuuaaauucuuaaugcccucau

SEQ ID NO: 343590 - RNA, 22 nt, Human
uuuaagauucaguaaggcaaac

SEQ ID NO: 343591 - RNA, 21 nt, Human
uccuuccuugagguccuuucc

SEQ ID NO: 343592 - RNA, 22 nt, Human
gcucacugccauucucuagaug

SEQ ID NO: 343593 - RNA, 22 nt, Human
caggaugagaggcccagggaag

SEQ ID NO: 343594 - RNA, 22 nt, Human
uccauuuucuaaguaucacuua

SEQ ID NO: 343595 - RNA, 22 nt, Human
ggugagggaguggaacgaggug

SEQ ID NO: 343596 - RNA, 22 nt, Human
ucagccucucugaguccagacc

SEQ ID NO: 343597 - RNA, 22 nt, Human
uccaggagugugugcuaauggg

SEQ ID NO: 343598 - RNA, 22 nt, Human
ugcuucagaggaaaggcaaaag

SEQ ID NO: 343599 - RNA, 22 nt, Human
ggcagcugucucugaguuagca

SEQ ID NO: 343600 - RNA, 22 nt, Human
ucaucugucauccacaaagcug

SEQ ID NO: 343601 - RNA, 22 nt, Human
ugcuuagacgucaaguacagcc

SEQ ID NO: 343602 - RNA, 22 nt, Human
uguagaaacuacacaugcaaca

SEQ ID NO: 343603 - RNA, 19 nt, Human
ucauuguugguuugucggg

SEQ ID NO: 343604 - RNA, 22 nt, Human
ucuagaauuuugccauauagcu

SEQ ID NO: 343605 - RNA, 22 nt, Human
ucuacccagagcuaugaccuga

SEQ ID NO: 343606 - RNA, 22 nt, Human
ccaggagagcauugcacagagg

SEQ ID NO: 343607 - RNA, 22 nt, Human
aggagaaggaagugcaucacua

SEQ ID NO: 343608 - RNA, 22 nt, Human
agggcagcacaaggcauggacu

SEQ ID NO: 343609 - RNA, 22 nt, Human
uggucuuuaagguagcugucau

SEQ ID NO: 343610 - RNA, 22 nt, Human
uucaggaucauuuguuuuaucu

SEQ ID NO: 343611 - RNA, 22 nt, Human
auguaugaugcuaggcucucag

SEQ ID NO: 343612 - RNA, 22 nt, Human
aauguauuccucaugcaagagu

SEQ ID NO: 343613 - RNA, 22 nt, Human
ggggcagccuccaggaaagcug

SEQ ID NO: 343614 - RNA, 22 nt, Human
gaggcacugcaguacagugacu

SEQ ID NO: 343615 - RNA, 22 nt, Human
ugguauaaaacuuuuuauugaa

SEQ ID NO: 343616 - RNA, 21 nt, Human
uuucuucacuuugccccaugu

SEQ ID NO: 343617 - RNA, 22 nt, Human
uuugaaauaugaggcauuauga

SEQ ID NO: 343618 - RNA, 22 nt, Human
aagcagaggguauggccagguu

SEQ ID NO: 343619 - RNA, 22 nt, Human
gagggugggccagauaugaggg

SEQ ID NO: 343620 - RNA, 22 nt, Human
ugaccuuauuugaaaauagaga

SEQ ID NO: 343621 - RNA, 22 nt, Human
cucuggcuucuaccuugcaguu

SEQ ID NO: 343622 - RNA, 22 nt, Human
gccaggagccagcuucuuagca

SEQ ID NO: 343623 - RNA, 22 nt, Human
uuggaaauggcuguaguuauga

SEQ ID NO: 343624 - RNA, 21 nt, Human
auugaaagucaacaaucaguu

SEQ ID NO: 343625 - RNA, 22 nt, Human
ggagaggacauggcucccacag

SEQ ID NO: 343626 - RNA, 22 nt, Human
uucauugugauucuuggcuagc

SEQ ID NO: 343627 - RNA, 22 nt, Human
aaauauguaagauuagcacuag

SEQ ID NO: 343628 - RNA, 22 nt, Human
guucuucagaggggaaagaacc

SEQ ID NO: 343629 - RNA, 22 nt, Human
aacuagucagugauucucagaa

SEQ ID NO: 343630 - RNA, 22 nt, Human
aggcaggcugcuauggaguaga

SEQ ID NO: 343631 - RNA, 22 nt, Human
uauuucagguauggugugaaau

SEQ ID NO: 343632 - RNA, 22 nt, Human
cuucucagcaugguuacuguga

SEQ ID NO: 343633 - RNA, 23 nt, Human
uaauucacauauacauugcuuca

SEQ ID NO: 343634 - RNA, 22 nt, Human
gaggaggcacuugagcagaugu

SEQ ID NO: 343635 - RNA, 22 nt, Human
auguuucaccagcaaauuaccu

SEQ ID NO: 343636 - RNA, 22 nt, Human
gcccaggaucugcucagaucau

SEQ ID NO: 343637 - RNA, 22 nt, Human
auguuucaccaguuuuauaaga

SEQ ID NO: 343638 - RNA, 22 nt, Human
ugaggcagcaauuguauuguau

SEQ ID NO: 343639 - RNA, 22 nt, Human
acagucucuccacacugcaggg

SEQ ID NO: 343640 - RNA, 22 nt, Human
uugaaagucacaauggcauuaa

SEQ ID NO: 343641 - RNA, 17 nt, Human
ggcagccucaggcguuu

SEQ ID NO: 343642 - RNA, 22 nt, Human
gugcugugugauccaugcuggc

SEQ ID NO: 343643 - RNA, 22 nt, Human
ucccaggaggugcuuccuagga

SEQ ID NO: 343644 - RNA, 22 nt, Human
ucuucacauggaacaugaagcu

SEQ ID NO: 343645 - RNA, 21 nt, Human
caauaaacugcacauugagac

SEQ ID NO: 343646 - RNA, 22 nt, Human
aaguaugacauuuaagacaauu

SEQ ID NO: 343647 - RNA, 22 nt, Human
augaaggcuguguagauggaug

SEQ ID NO: 343648 - RNA, 22 nt, Human
gagucuuugguaaagucugcug

SEQ ID NO: 343649 - RNA, 22 nt, Human
cauuuguaauacugacuugcag

SEQ ID NO: 343650 - RNA, 22 nt, Human
agcagagccugggcuaggggug

SEQ ID NO: 343651 - RNA, 22 nt, Human
aagauggaguaguguaaugguu

SEQ ID NO: 343652 - RNA, 22 nt, Human
uuccuuaguugacugucuuagu

SEQ ID NO: 343653 - RNA, 17 nt, Human
gcgcagcuccuggcgcg

SEQ ID NO: 343654 - RNA, 22 nt, Human
cucaggauuuaaaggggcacuc

SEQ ID NO: 343655 - RNA, 22 nt, Human
cuucugcaauaaguuuuggucc

SEQ ID NO: 343656 - RNA, 18 nt, Human
ccagguggugacagagau

SEQ ID NO: 343657 - RNA, 22 nt, Human
ggcagaggagcuggaaacaugg

SEQ ID NO: 343658 - RNA, 22 nt, Human
caggcagcugcgacaagagagc

SEQ ID NO: 343659 - RNA, 22 nt, Human
cuacccaggcuggagugcagua

SEQ ID NO: 343660 - RNA, 22 nt, Human
aaaaugaugcuguaauuuggca

SEQ ID NO: 343661 - RNA, 22 nt, Human
gggcagcucuggcugugggaag

SEQ ID NO: 343662 - RNA, 22 nt, Human
ggcucagagaccugcgaucuga

SEQ ID NO: 343663 - RNA, 22 nt, Human
uaugaacugugagugugauggg

SEQ ID NO: 343664 - RNA, 18 nt, Human
ccucagggagagagacgc

SEQ ID NO: 343665 - RNA, 22 nt, Human
aggcaggcucaggcccaugcuu

SEQ ID NO: 343666 - RNA, 19 nt, Human
ggcaggcuggauagagagg

SEQ ID NO: 343667 - RNA, 22 nt, Human
aaaguuuguugcuuacaaagaa

SEQ ID NO: 343668 - RNA, 22 nt, Human
aagacuguacauuuuccagucu

SEQ ID NO: 343669 - RNA, 22 nt, Human
gaggcagcucuucugaaugggg

SEQ ID NO: 343670 - RNA, 22 nt, Human
uaacauuagguagacauaagcc

SEQ ID NO: 343671 - RNA, 22 nt, Human
gaggcagcuuggggcugugggu

SEQ ID NO: 343672 - RNA, 22 nt, Human
auuucagauucagaaauguagg

SEQ ID NO: 343673 - RNA, 21 nt, Human
gauuugcagaaacuagacagg

SEQ ID NO: 343674 - RNA, 22 nt, Human
uucauacacgaaaaugcaugca

SEQ ID NO: 343675 - RNA, 22 nt, Human
uagcaauagaaacauauaaagu

SEQ ID NO: 343676 - RNA, 22 nt, Human
auccaugaagguacuucucagg

SEQ ID NO: 343677 - RNA, 22 nt, Human
aggcaacuuuuggggaugaugg

SEQ ID NO: 343678 - RNA, 22 nt, Human
aauaguauuuauuuggaaaaag

SEQ ID NO: 343679 - RNA, 22 nt, Human
gccaucacauccaggcuaccuc

SEQ ID NO: 343680 - RNA, 17 nt, Human
ucaggauguagcaguag

SEQ ID NO: 343681 - RNA, 20 nt, Human
gcagcuacucugucucgcuc

SEQ ID NO: 343682 - RNA, 22 nt, Human
ggaggugggauuaggaccuaaa

SEQ ID NO: 343683 - RNA, 22 nt, Human
aacaguaaagacagaauuuauc

SEQ ID NO: 343684 - RNA, 22 nt, Human
cugccaggcagggagauggcug

SEQ ID NO: 343685 - RNA, 22 nt, Human
augucaaacacaacaccagugg

SEQ ID NO: 343686 - RNA, 22 nt, Human
ccucugcucugguccaugugcu

SEQ ID NO: 343687 - RNA, 19 nt, Human
caggaaugagguaauggcu

SEQ ID NO: 343688 - RNA, 19 nt, Human
ucucugcuucucuuggcau

SEQ ID NO: 343689 - RNA, 22 nt, Human
uagcuguguaagcuugguaaga

SEQ ID NO: 343690 - RNA, 22 nt, Human
ccaugagcuucaacugacacag

SEQ ID NO: 343691 - RNA, 22 nt, Human
uuucauugcagagucugugugc

SEQ ID NO: 343692 - RNA, 22 nt, Human
ucauucuugaucacuaguuagu

SEQ ID NO: 343693 - RNA, 22 nt, Human
acacaaugcauauuuuuccaga

SEQ ID NO: 343694 - RNA, 22 nt, Human
uggcagcuuccugcucauagga

SEQ ID NO: 343695 - RNA, 22 nt, Human
uuaacauacaucaugaacaaug

SEQ ID NO: 343696 - RNA, 22 nt, Human
uuucugaagauacagcuuugcu

SEQ ID NO: 343697 - RNA, 22 nt, Human
gagugcagaugaacagaagauu

SEQ ID NO: 343698 - RNA, 22 nt, Human
ugcugugagguugagaaggaag

SEQ ID NO: 343699 - RNA, 20 nt, Human
cgugcugugaccuugagcau

SEQ ID NO: 343700 - RNA, 22 nt, Human
acuggaaaacacuacuacaugc

SEQ ID NO: 343701 - RNA, 22 nt, Human
uugcccagaguccacagcguac

SEQ ID NO: 343702 - RNA, 22 nt, Human
gcccaggaaagauagggccuca

SEQ ID NO: 343703 - RNA, 22 nt, Human
aggcagcuaagauggauaauga

SEQ ID NO: 343704 - RNA, 22 nt, Human
uuuucuuauggugaagcacaaa

SEQ ID NO: 343705 - RNA, 22 nt, Human
uugauagguuuuauguauaguu

SEQ ID NO: 343706 - RNA, 22 nt, Human
gaagcagcagcuggggacaguu

SEQ ID NO: 343707 - RNA, 22 nt, Human
gaauauuuuuaaagggacuaau

SEQ ID NO: 343708 - RNA, 22 nt, Human
agaggggaguccuaaucugauu

SEQ ID NO: 343709 - RNA, 22 nt, Human
ccaggaaauggcuugcuucuuu

SEQ ID NO: 343710 - RNA, 22 nt, Human
aucaggaugcugucaguuacca

SEQ ID NO: 343711 - RNA, 22 nt, Human
ggagugucagaaacaguguccu

SEQ ID NO: 343712 - RNA, 22 nt, Human
aauaucaguauauuguaucagu

SEQ ID NO: 343713 - RNA, 22 nt, Human
uaucaauugggccaaaugguac

SEQ ID NO: 343714 - RNA, 22 nt, Human
aaaugauugucaaaguucuguu

SEQ ID NO: 343715 - RNA, 22 nt, Human
gugauuuucuccuccuagaagu

SEQ ID NO: 343716 - RNA, 22 nt, Human
agucccuguacuuuccacugcc

SEQ ID NO: 343717 - RNA, 22 nt, Human
ugaggcagauauuuauuggguu

SEQ ID NO: 343718 - RNA, 22 nt, Human
caguugcuggaugugcagcucu

SEQ ID NO: 343719 - RNA, 22 nt, Human
uggcagcagccauggaaggccc

SEQ ID NO: 343720 - RNA, 22 nt, Human
ucagucuucccuccagugcaac

SEQ ID NO: 343721 - RNA, 22 nt, Human
gaagcagcgaaguggaagggac

SEQ ID NO: 343722 - RNA, 22 nt, Human
uugaaaggugaacaugaugcac

SEQ ID NO: 343723 - RNA, 22 nt, Human
aaaggccagguuggcugguauu

SEQ ID NO: 343724 - RNA, 22 nt, Human
aauauaaugcuguuuuaugcca

SEQ ID NO: 343725 - RNA, 22 nt, Human
cccaaggaagacgcuugugaua

SEQ ID NO: 343726 - RNA, 22 nt, Human
aguaugaaccuggguucuggau

SEQ ID NO: 343727 - RNA, 22 nt, Human
uuuguuuagaugguaaaucagu

SEQ ID NO: 343728 - RNA, 22 nt, Human
agcaccuugcucuuggccuucc

SEQ ID NO: 343729 - RNA, 22 nt, Human
uucagcaaauggacuguucagg

SEQ ID NO: 343730 - RNA, 20 nt, Human
aucugcuugccuguccucgg

SEQ ID NO: 343731 - RNA, 20 nt, Human
cuucuucagccuaugcuuca

SEQ ID NO: 343732 - RNA, 22 nt, Human
acaggagaaaucuggucaaaag

SEQ ID NO: 343733 - RNA, 22 nt, Human
gaggggaagacuucuggacagu

SEQ ID NO: 343734 - RNA, 22 nt, Human
cugacagucucauugauuugcu

SEQ ID NO: 343735 - RNA, 22 nt, Human
gccucugcccuccugggacugc

SEQ ID NO: 343736 - RNA, 22 nt, Human
aucucuguaaaccauaaauuga

SEQ ID NO: 343737 - RNA, 22 nt, Human
aguuagaauagucagauuguag

SEQ ID NO: 343738 - RNA, 22 nt, Human
ucuucuuccucauuuauacaua

SEQ ID NO: 343739 - RNA, 22 nt, Human
agaccaugggcucugaagagca

SEQ ID NO: 343740 - RNA, 22 nt, Human
guugaaaguagaugcuauuugg

SEQ ID NO: 343741 - RNA, 19 nt, Human
accaggaguaucagagcug

SEQ ID NO: 343742 - RNA, 22 nt, Human
uuaugauuugccacagauuggu

SEQ ID NO: 343743 - RNA, 22 nt, Human
uaucuguuaggaucagagcugg

SEQ ID NO: 343744 - RNA, 22 nt, Human
uagcacauacauaauagauaga

SEQ ID NO: 343745 - RNA, 22 nt, Human
ggccagcugggccaccaggugc

SEQ ID NO: 343746 - RNA, 23 nt, Human
uugcuuucaucaugagaugcucc

SEQ ID NO: 343747 - RNA, 22 nt, Human
uaccauuucauucuuuccucau

SEQ ID NO: 343748 - RNA, 22 nt, Human
caggcagcucaaccuugggagc

SEQ ID NO: 343749 - RNA, 22 nt, Human
auucauuuagguauucacuuac

SEQ ID NO: 343750 - RNA, 22 nt, Human
gcaggagagucugugccagguu

SEQ ID NO: 343751 - RNA, 22 nt, Human
uuauacauguguuuugagauga

SEQ ID NO: 343752 - RNA, 22 nt, Human
cuggcagucugccucuucacug

SEQ ID NO: 343753 - RNA, 22 nt, Human
aauucuguaacuuuacugaauu

SEQ ID NO: 343754 - RNA, 22 nt, Human
gcccaggaaauaaaagugggcu

SEQ ID NO: 343755 - RNA, 22 nt, Human
cucacuguccaacaggcuuuac

SEQ ID NO: 343756 - RNA, 22 nt, Human
uagaaacaucagcuaaccaaaa

SEQ ID NO: 343757 - RNA, 22 nt, Human
cuggcaaguacugggccagcuc

SEQ ID NO: 343758 - RNA, 22 nt, Human
aauagcucacugauuucucuuu

SEQ ID NO: 343759 - RNA, 22 nt, Human
uccaggagacacccuugugugu

SEQ ID NO: 343760 - RNA, 22 nt, Human
acucaggaaaugaagacugguu

SEQ ID NO: 343761 - RNA, 22 nt, Human
cuugcaggccuuucuagcucua

SEQ ID NO: 343762 - RNA, 19 nt, Human
ugcugcuguccuugcaggg

SEQ ID NO: 343763 - RNA, 22 nt, Human
uguccauggauagagcugcucg

SEQ ID NO: 343764 - RNA, 22 nt, Human
ucugucaaaugagcaaguaacu

SEQ ID NO: 343765 - RNA, 22 nt, Human
aggccagcucuacccuuggacu

SEQ ID NO: 343766 - RNA, 22 nt, Human
gggcagcucggaagugggaaag

SEQ ID NO: 343767 - RNA, 22 nt, Human
cuucagaggggacucaaaguca

SEQ ID NO: 343768 - RNA, 22 nt, Human
gcucaggacuggaggagcgggg

SEQ ID NO: 343769 - RNA, 22 nt, Human
agcuggcagcucucagggguac

SEQ ID NO: 343770 - RNA, 22 nt, Human
uugggcucaggaguuugagacc

SEQ ID NO: 343771 - RNA, 21 nt, Human
ggcagccucuguggaagggga

SEQ ID NO: 343772 - RNA, 22 nt, Human
uggcagcuuuuuguuucaggcu

SEQ ID NO: 343773 - RNA, 22 nt, Human
acccaggagacagguugcagug

SEQ ID NO: 343774 - RNA, 22 nt, Human
uuggcaggaauauugcagaggu

SEQ ID NO: 343775 - RNA, 22 nt, Human
ggagcagggcagugaauucugg

SEQ ID NO: 343776 - RNA, 22 nt, Human
gaagaggaugacaggagccggu

SEQ ID NO: 343777 - RNA, 22 nt, Human
gaggcgagaagcuggagauggu

SEQ ID NO: 343778 - RNA, 22 nt, Human
cucaggauagauuguccucuca

SEQ ID NO: 343779 - RNA, 23 nt, Human
uuccagaguccacaucugccacc

SEQ ID NO: 343780 - RNA, 22 nt, Human
aagauggagcacgagcagaagc

SEQ ID NO: 343781 - RNA, 21 nt, Human
ggacagcugcgcgcagggcuc

SEQ ID NO: 343782 - RNA, 22 nt, Human
uauuuguugaguuguuaugucu

SEQ ID NO: 343783 - RNA, 22 nt, Human
aaggcagcaccgccuccugaaa

SEQ ID NO: 343784 - RNA, 22 nt, Human
uuacuuuggguccugcuuauaa

SEQ ID NO: 343785 - RNA, 22 nt, Human
auuucucuuagcaagacauuac

SEQ ID NO: 343786 - RNA, 22 nt, Human
agggagcucuaaguagagggac

SEQ ID NO: 343787 - RNA, 22 nt, Human
guuguuuuuguucucuauagcu

SEQ ID NO: 343788 - RNA, 22 nt, Human
cacaugaagagagucuaguaau

SEQ ID NO: 343789 - RNA, 22 nt, Human
gagaggauccacaaaccaggaa

SEQ ID NO: 343790 - RNA, 22 nt, Human
uccaggagacacaagguacaua

SEQ ID NO: 343791 - RNA, 22 nt, Human
uccuucuuucccccuagucauu

SEQ ID NO: 343792 - RNA, 22 nt, Human
gugguaauuuaauccuacacug

SEQ ID NO: 343793 - RNA, 22 nt, Human
ucauuuaauagcuuuugucuuu

SEQ ID NO: 343794 - RNA, 22 nt, Human
gcagaggacagggauuuagauu

SEQ ID NO: 343795 - RNA, 22 nt, Human
cucuucuugccugaugaggcag

SEQ ID NO: 343796 - RNA, 22 nt, Human
cauucacaaagcugauugaugg

SEQ ID NO: 343797 - RNA, 22 nt, Human
uguuugaauuuugcuaacgugu

SEQ ID NO: 343798 - RNA, 18 nt, Human
gagaggagccagaauuuu

SEQ ID NO: 343799 - RNA, 22 nt, Human
ccccaggacguggcccucauag

SEQ ID NO: 343800 - RNA, 22 nt, Human
uucuucaguguagcaacuguau

SEQ ID NO: 343801 - RNA, 22 nt, Human
gggagggguugcauguuugagu

SEQ ID NO: 343802 - RNA, 22 nt, Human
uaugacuuauuucaucaguucu

SEQ ID NO: 343803 - RNA, 19 nt, Human
ugugaaagcuaguguucuu

SEQ ID NO: 343804 - RNA, 22 nt, Human
cugcuguguuccuccugcaucu

SEQ ID NO: 343805 - RNA, 22 nt, Human
uaacaguguggacuugagaucu

SEQ ID NO: 343806 - RNA, 21 nt, Human
cucuugugucagagccagagg

SEQ ID NO: 343807 - RNA, 22 nt, Human
gcuucccagcagaggaaagacu

SEQ ID NO: 343808 - RNA, 22 nt, Human
ucgcugugguuucuguacaugg

SEQ ID NO: 343809 - RNA, 22 nt, Human
gagagcuggguucaaguagcug

SEQ ID NO: 343810 - RNA, 22 nt, Human
uugaaauacugcauuguucagu

SEQ ID NO: 343811 - RNA, 22 nt, Human
uggaaagcgaggaguuggcauu

SEQ ID NO: 343812 - RNA, 22 nt, Human
agcccagggaaccaggaagugg

SEQ ID NO: 343813 - RNA, 22 nt, Human
cagaaauguacugacaugcagu

SEQ ID NO: 343814 - RNA, 22 nt, Human
uggcagcuccuggggccagcac

SEQ ID NO: 343815 - RNA, 22 nt, Human
ugaugaaacugagguuccaaga

SEQ ID NO: 343816 - RNA, 22 nt, Human
acaauucugaugguuucccagu

SEQ ID NO: 343817 - RNA, 22 nt, Human
aaaaaucuaugacugcuucucc

SEQ ID NO: 343818 - RNA, 22 nt, Human
uuugaauagaggccccucagaa

SEQ ID NO: 343819 - RNA, 22 nt, Human
cauaauuugugguaguggggga

SEQ ID NO: 343820 - RNA, 22 nt, Human
ugacccauggucugaucauagg

SEQ ID NO: 343821 - RNA, 22 nt, Human
uucuucuuaauguccugggaac

SEQ ID NO: 343822 - RNA, 22 nt, Human
uuuccagagcaugucugcucag

SEQ ID NO: 343823 - RNA, 22 nt, Human
aggcagcugugaggacuggauu

SEQ ID NO: 343824 - RNA, 22 nt, Human
gaggguggguuucuugcacguc

SEQ ID NO: 343825 - RNA, 22 nt, Human
aaaguugugaaaccgaacaugu

SEQ ID NO: 343826 - RNA, 22 nt, Human
agagugucugguagcugcucug

SEQ ID NO: 343827 - RNA, 22 nt, Human
gucaggauuaaugggaguaugc

SEQ ID NO: 343828 - RNA, 22 nt, Human
uucauucuuauuugugaucugg

SEQ ID NO: 343829 - RNA, 22 nt, Human
uuaauuuuaaccuguuuguguc

SEQ ID NO: 343830 - RNA, 22 nt, Human
gcccaggagaggccagggcuga

SEQ ID NO: 343831 - RNA, 22 nt, Human
gagagaaaugugcaguuugggc

SEQ ID NO: 343832 - RNA, 22 nt, Human
uggagaggagcaccauggccau

SEQ ID NO: 343833 - RNA, 22 nt, Human
uaacuuucacaucacacugacu

SEQ ID NO: 343834 - RNA, 22 nt, Human
uuuuauagcugaauaguauucc

SEQ ID NO: 343835 - RNA, 22 nt, Human
gagggcaguagccucguacccu

SEQ ID NO: 343836 - RNA, 22 nt, Human
auacacauguguaugugcaugc

SEQ ID NO: 343837 - RNA, 22 nt, Human
uauucacaguugauuuacaguu

SEQ ID NO: 343838 - RNA, 22 nt, Human
ucugggaagcugcgugccuguu

SEQ ID NO: 343839 - RNA, 22 nt, Human
gcuaugcaggagccuaaugaca

SEQ ID NO: 343840 - RNA, 22 nt, Human
guucuucaggcugugcucuaga

SEQ ID NO: 343841 - RNA, 22 nt, Human
agacgagggccuggcacacagu

SEQ ID NO: 343842 - RNA, 19 nt, Human
uggcagggagaguuugaag

SEQ ID NO: 343843 - RNA, 22 nt, Human
uggggcuccuccuggcaggagg

SEQ ID NO: 343844 - RNA, 22 nt, Human
uuuuccagauuggacuuagucc

SEQ ID NO: 343845 - RNA, 17 nt, Human
caggcagacauguaagc

SEQ ID NO: 343846 - RNA, 22 nt, Human
augcuacagcaucucucaucag

SEQ ID NO: 343847 - RNA, 22 nt, Human
ucauuuguucaucugcucuucu

SEQ ID NO: 343848 - RNA, 22 nt, Human
uguaugaaugggaaaaggaaac

SEQ ID NO: 343849 - RNA, 22 nt, Human
aggcagcuuucuggugcaccau

SEQ ID NO: 343850 - RNA, 22 nt, Human
caugucuguguacacaugcaca

SEQ ID NO: 343851 - RNA, 22 nt, Human
cuugcacacauguacaugugua

SEQ ID NO: 343852 - RNA, 23 nt, Human
ucuccuccuagauacagucaugg

SEQ ID NO: 343853 - RNA, 22 nt, Human
agcgagggaggucugaggacag

SEQ ID NO: 343854 - RNA, 22 nt, Human
aggcacaggccucagcacccag

SEQ ID NO: 343855 - RNA, 19 nt, Human
ggcagcuggacgcuguuca

SEQ ID NO: 343856 - RNA, 22 nt, Human
uaggcagcgcuuggcugugcuu

SEQ ID NO: 343857 - RNA, 22 nt, Human
cagugauguuucugcaucagag

SEQ ID NO: 343858 - RNA, 22 nt, Human
cuaauguaucauggcucucagc

SEQ ID NO: 343859 - RNA, 22 nt, Human
accaggagaggcacuugcaaug

SEQ ID NO: 343860 - RNA, 21 nt, Human
auggagggaccagggaagcag

SEQ ID NO: 343861 - RNA, 22 nt, Human
aggcaguggcugagaccagggg

SEQ ID NO: 343862 - RNA, 22 nt, Human
aucauuuuuaagagacucuucu

SEQ ID NO: 343863 - RNA, 20 nt, Human
caguccaaucagaggccacc

SEQ ID NO: 343864 - RNA, 22 nt, Human
agugcuuugguauagaacuauu

SEQ ID NO: 343865 - RNA, 21 nt, Human
uuugaaagugggugauucuuu

SEQ ID NO: 343866 - RNA, 22 nt, Human
aaauguuucuacuugugagcau

SEQ ID NO: 343867 - RNA, 22 nt, Human
ccaugagccaggcugaggaagc

SEQ ID NO: 343868 - RNA, 22 nt, Human
agagggcagucucagauuggga

SEQ ID NO: 343869 - RNA, 22 nt, Human
gauuucuugaccccugucucag

SEQ ID NO: 343870 - RNA, 22 nt, Human
uaugaacuuuugaugugacaug

SEQ ID NO: 343871 - RNA, 22 nt, Human
cuuacagagaagaaaauguagu

SEQ ID NO: 343872 - RNA, 22 nt, Human
gcaggagacaacuguaaggaga

SEQ ID NO: 343873 - RNA, 22 nt, Human
ccagcagagucuaggaaggagg

SEQ ID NO: 343874 - RNA, 22 nt, Human
aauuuccagaucagaugacuca

SEQ ID NO: 343875 - RNA, 22 nt, Human
uuucacauuagauaugucauuu

SEQ ID NO: 343876 - RNA, 21 nt, Human
agagagggagaugaaacaucc

SEQ ID NO: 343877 - RNA, 22 nt, Human
uaggcagcauggauucugaaua

SEQ ID NO: 343878 - RNA, 22 nt, Human
gcucaggaaaacagucuaguaa

SEQ ID NO: 343879 - RNA, 19 nt, Human
ugcauaaauuauauacuuu

SEQ ID NO: 343880 - RNA, 22 nt, Human
gucuccugagccuugacugcaa

SEQ ID NO: 343881 - RNA, 22 nt, Human
aaauguuuugcucccauguggu

SEQ ID NO: 343882 - RNA, 22 nt, Human
ccaggaaaauaccaagcuuuaa

SEQ ID NO: 343883 - RNA, 22 nt, Human
cccaggagacagaaacagaggu

SEQ ID NO: 343884 - RNA, 22 nt, Human
agcccaggagguggagguugca

SEQ ID NO: 343885 - RNA, 22 nt, Human
uagaacauaagucauucauuug

SEQ ID NO: 343886 - RNA, 22 nt, Human
auuccaguuggguucuaauaca

SEQ ID NO: 343887 - RNA, 22 nt, Human
gcagagcuucuguccuucagga

SEQ ID NO: 343888 - RNA, 22 nt, Human
cccaggaaaguggaggcggcug

SEQ ID NO: 343889 - RNA, 22 nt, Human
aacauacauauuucagugucca

SEQ ID NO: 343890 - RNA, 22 nt, Human
cccaggauggggcugcaguuau

SEQ ID NO: 343891 - RNA, 22 nt, Human
aauugcuaaagauuauguuuuc

SEQ ID NO: 343892 - RNA, 22 nt, Human
ucaggaugaccacgagccucua

SEQ ID NO: 343893 - RNA, 22 nt, Human
acccaggaugauaauguucaca

SEQ ID NO: 343894 - RNA, 22 nt, Human
aaagauuugaguucugcuuaua

SEQ ID NO: 343895 - RNA, 22 nt, Human
aagggaggccagagguuuugca

SEQ ID NO: 343896 - RNA, 22 nt, Human
uuacaagauaaccugaugcugu

SEQ ID NO: 343897 - RNA, 22 nt, Human
aaaacaguuuaggcaucacagu

SEQ ID NO: 343898 - RNA, 22 nt, Human
augcuguggaugccuugcccca

SEQ ID NO: 343899 - RNA, 22 nt, Human
aggcagcuggacauaacuaacc

SEQ ID NO: 343900 - RNA, 22 nt, Human
gaggcagcugggauacaaggga

SEQ ID NO: 343901 - RNA, 22 nt, Human
uauuuucuguggaggaccagau

SEQ ID NO: 343902 - RNA, 22 nt, Human
gggcagcugccagaggccaugg

SEQ ID NO: 343903 - RNA, 22 nt, Human
gagagguccauuccccugucag

SEQ ID NO: 343904 - RNA, 22 nt, Human
aacaugcucuguuucuuggaug

SEQ ID NO: 343905 - RNA, 22 nt, Human
cuuaaauuuucaucuacaagaa

SEQ ID NO: 343906 - RNA, 22 nt, Human
auucugucuaagcuggcuacgu

SEQ ID NO: 343907 - RNA, 22 nt, Human
aucaggauccaccuugagccug

SEQ ID NO: 343908 - RNA, 22 nt, Human
ugccuguguugauuacuuuguc

SEQ ID NO: 343909 - RNA, 22 nt, Human
aucugucuugccuugcauauuu

SEQ ID NO: 343910 - RNA, 20 nt, Human
augugagggguugaaguggg

SEQ ID NO: 343911 - RNA, 22 nt, Human
uacaaaguaauguauaauaucg

SEQ ID NO: 343912 - RNA, 22 nt, Human
auaucaaacgaaguuauuuuaa

SEQ ID NO: 343913 - RNA, 22 nt, Human
gagccagcuauguagcaagagg

SEQ ID NO: 343914 - RNA, 22 nt, Human
ucauaaaugcagugucauaaau

SEQ ID NO: 343915 - RNA, 22 nt, Human
aguggcagagugcacucaggca

SEQ ID NO: 343916 - RNA, 22 nt, Human
uaacacauuaguucuccuagau

SEQ ID NO: 343917 - RNA, 22 nt, Human
acagauauuuggggaaagacgu

SEQ ID NO: 343918 - RNA, 22 nt, Human
cauuuauuggcauguaguaggu

SEQ ID NO: 343919 - RNA, 22 nt, Human
gcaaguuauuuccauuuaaagc

SEQ ID NO: 343920 - RNA, 22 nt, Human
cagaaggcuggcagauugagau

SEQ ID NO: 343921 - RNA, 22 nt, Human
aguaaagcagaguugcaguaca

SEQ ID NO: 343922 - RNA, 22 nt, Human
aauaacuucaguucuuacauua

SEQ ID NO: 343923 - RNA, 22 nt, Human
gcaggagaacaaagcaagcugc

SEQ ID NO: 343924 - RNA, 22 nt, Human
gugaaacacccuccaaugcaca

SEQ ID NO: 343925 - RNA, 22 nt, Human
gccaggaggcuuaacuggacag

SEQ ID NO: 343926 - RNA, 22 nt, Human
cugcugugcuuguggccacccg

SEQ ID NO: 343927 - RNA, 22 nt, Human
auaaucuuucuuuuccagauag

SEQ ID NO: 343928 - RNA, 20 nt, Human
uccaggagguuaguguggcu

SEQ ID NO: 343929 - RNA, 22 nt, Human
aggagaggcucuaacucugugu

SEQ ID NO: 343930 - RNA, 22 nt, Human
aaggcagcacagcaacugcuca

SEQ ID NO: 343931 - RNA, 22 nt, Human
uuccagcaggcagacaggagau

SEQ ID NO: 343932 - RNA, 22 nt, Human
caggcagcucgaugccuuguug

SEQ ID NO: 343933 - RNA, 22 nt, Human
guuuagaacacggaaauacuga

SEQ ID NO: 343934 - RNA, 22 nt, Human
cuuuguagcugcuucugauuua

SEQ ID NO: 343935 - RNA, 22 nt, Human
gagcaccucaauuugcuauuug

SEQ ID NO: 343936 - RNA, 22 nt, Human
agugugagcccuggaguggugc

SEQ ID NO: 343937 - RNA, 22 nt, Human
gcgucugaguugcgggggcuca

SEQ ID NO: 343938 - RNA, 22 nt, Human
guaggcagggcuguggggagaa

SEQ ID NO: 343939 - RNA, 22 nt, Human
aucuugcauuugcuaaaaugca

SEQ ID NO: 343940 - RNA, 22 nt, Human
ggaggacacuggcucugccuuc

SEQ ID NO: 343941 - RNA, 21 nt, Human
ugaaugaggaggauggcauuu

SEQ ID NO: 343942 - RNA, 22 nt, Human
uguacaaagguacuuugauguu

SEQ ID NO: 343943 - RNA, 22 nt, Human
auucuucaccugagucagucua

SEQ ID NO: 343944 - RNA, 22 nt, Human
agaaaugaagagagucaagguu

SEQ ID NO: 343945 - RNA, 22 nt, Human
agagacagaggcaauauagcuu

SEQ ID NO: 343946 - RNA, 22 nt, Human
auguagaaaguucauagaugcg

SEQ ID NO: 343947 - RNA, 22 nt, Human
ugaggcaggaguucaggcugcg

SEQ ID NO: 343948 - RNA, 21 nt, Human
auuucagagcacacaaguaaa

SEQ ID NO: 343949 - RNA, 19 nt, Human
ucuuucauuucuagcucug

SEQ ID NO: 343950 - RNA, 22 nt, Human
gcucaggaucccaggggugugc

SEQ ID NO: 343951 - RNA, 22 nt, Human
aaggcaguacuuuauguccaua

SEQ ID NO: 343952 - RNA, 22 nt, Human
auuuccauagagcgucucacag

SEQ ID NO: 343953 - RNA, 22 nt, Human
ugaaaugacagucuuaagcucu

SEQ ID NO: 343954 - RNA, 22 nt, Human
aauguaugcugugguaucuucu

SEQ ID NO: 343955 - RNA, 22 nt, Human
ggagggacccacucuagaggug

SEQ ID NO: 343956 - RNA, 21 nt, Human
uaaggccaagucuauuucugu

SEQ ID NO: 343957 - RNA, 22 nt, Human
uucauguguauggaacauuuuu

SEQ ID NO: 343958 - RNA, 22 nt, Human
ucagaaaagguagcugugacaa

SEQ ID NO: 343959 - RNA, 22 nt, Human
ggaggaggcggcagaaguuccu

SEQ ID NO: 343960 - RNA, 22 nt, Human
uuugaaguguuauuucuaucac

SEQ ID NO: 343961 - RNA, 22 nt, Human
cuuugcaaacugucacacuuuc

SEQ ID NO: 343962 - RNA, 22 nt, Human
uauuuccaagcugaauccaaug

SEQ ID NO: 343963 - RNA, 22 nt, Human
gagggagggacuagcauucucu

SEQ ID NO: 343964 - RNA, 22 nt, Human
aucuucucauguguaaugaggu

SEQ ID NO: 343965 - RNA, 20 nt, Human
uaacuuucuaugcuuucagc

SEQ ID NO: 343966 - RNA, 22 nt, Human
agucucugccagcuuguccucu

SEQ ID NO: 343967 - RNA, 22 nt, Human
caggguggcacaucacagcauu

SEQ ID NO: 343968 - RNA, 22 nt, Human
uauuuuaucugccagaguggag

SEQ ID NO: 343969 - RNA, 22 nt, Human
agagggcaaguguaguccagua

SEQ ID NO: 343970 - RNA, 22 nt, Human
uugaauuauaagugugucuacu

SEQ ID NO: 343971 - RNA, 22 nt, Human
uuuauauuucccaggauuggcc

SEQ ID NO: 343972 - RNA, 18 nt, Human
ucuuuggacaacuacugg

SEQ ID NO: 343973 - RNA, 22 nt, Human
gcucaggaucagccaccucuuu

SEQ ID NO: 343974 - RNA, 22 nt, Human
uuugacauugccaauuugcuca

SEQ ID NO: 343975 - RNA, 22 nt, Human
gcccaggaaaugccccguggug

SEQ ID NO: 343976 - RNA, 22 nt, Human
cacaugaguccugccagguaug

SEQ ID NO: 343977 - RNA, 22 nt, Human
gaaggucaccuccccucucugg

SEQ ID NO: 343978 - RNA, 22 nt, Human
uaaucuguauuccuacuuugca

SEQ ID NO: 343979 - RNA, 22 nt, Human
aguggaccagaagacugaagcu

SEQ ID NO: 343980 - RNA, 21 nt, Human
acaggagaccgccuggcaguc

SEQ ID NO: 343981 - RNA, 22 nt, Human
aaucugucguaguaaaaagcag

SEQ ID NO: 343982 - RNA, 22 nt, Human
cccaggaacagcacagaacagc

SEQ ID NO: 343983 - RNA, 22 nt, Human
gcucucuuuuuccagugguggu

SEQ ID NO: 343984 - RNA, 22 nt, Human
cagcugccccgcuggcugacca

SEQ ID NO: 343985 - RNA, 22 nt, Human
agagggagcccagucauagcug

SEQ ID NO: 343986 - RNA, 22 nt, Human
uuuggaauguaguuuaaucauc

SEQ ID NO: 343987 - RNA, 22 nt, Human
ggcagcuggguuggccagaaac

SEQ ID NO: 343988 - RNA, 22 nt, Human
gauuucuugauaaguaguguga

SEQ ID NO: 343989 - RNA, 22 nt, Human
ggauggcaggacaaggacccag

SEQ ID NO: 343990 - RNA, 22 nt, Human
ucaggauguuaauauagcauua

SEQ ID NO: 343991 - RNA, 22 nt, Human
ugugaaauauuuauauacucaa

SEQ ID NO: 343992 - RNA, 22 nt, Human
uaauaguuaugguugguucuca

SEQ ID NO: 343993 - RNA, 19 nt, Human
agggaguuuauauuugcac

SEQ ID NO: 343994 - RNA, 22 nt, Human
aagauuauggcagauaacaauu

SEQ ID NO: 343995 - RNA, 22 nt, Human
augugaaaaauuucuuauuaca

SEQ ID NO: 343996 - RNA, 22 nt, Human
ggugagaggcagaggacagcuu

SEQ ID NO: 343997 - RNA, 22 nt, Human
ggauggcagucugcaugagaaa

SEQ ID NO: 343998 - RNA, 22 nt, Human
agagcagcugugacauggacag

SEQ ID NO: 343999 - RNA, 22 nt, Human
uaacacauauuugcaguaagca

SEQ ID NO: 344000 - RNA, 22 nt, Human
ugcuuuggaucuauuugcugag

SEQ ID NO: 344001 - RNA, 22 nt, Human
aggcagagcuggguuuugaaau

SEQ ID NO: 344002 - RNA, 22 nt, Human
gauaaugaugacaaugacaacc

SEQ ID NO: 344003 - RNA, 22 nt, Human
caggaaugaggucguaaguguc

SEQ ID NO: 344004 - RNA, 22 nt, Human
agaaaugaagcaggaguuauua

SEQ ID NO: 344005 - RNA, 20 nt, Human
accaauguuagcuuaguacu

SEQ ID NO: 344006 - RNA, 22 nt, Human
guucuucaguaaaauuaaaugu

SEQ ID NO: 344007 - RNA, 22 nt, Human
gaucauuuacuuguucuggacu

SEQ ID NO: 344008 - RNA, 22 nt, Human
uggcaucucaaacaggcagauu

SEQ ID NO: 344009 - RNA, 22 nt, Human
agacgagggcccccaggacagc

SEQ ID NO: 344010 - RNA, 20 nt, Human
acaggagaucugaggaaagg

SEQ ID NO: 344011 - RNA, 22 nt, Human
uugauuucuauucagauguaga

SEQ ID NO: 344012 - RNA, 22 nt, Human
aucccaugagaccacguuggcu

SEQ ID NO: 344013 - RNA, 22 nt, Human
gugguuuugccauuacaaguaa

SEQ ID NO: 344014 - RNA, 22 nt, Human
gucuucuuguguugccugucuu

SEQ ID NO: 344015 - RNA, 22 nt, Human
aaccauuugccauuaucuuaag

SEQ ID NO: 344016 - RNA, 20 nt, Human
caggaugauuggacacgaug

SEQ ID NO: 344017 - RNA, 22 nt, Human
uccaggaguggggcagaggucu

SEQ ID NO: 344018 - RNA, 22 nt, Human
ucucgacagccuggcacagugg

SEQ ID NO: 344019 - RNA, 22 nt, Human
guccucugaaguugugcaaugc

SEQ ID NO: 344020 - RNA, 22 nt, Human
caugugguucaaguacuccaca

SEQ ID NO: 344021 - RNA, 22 nt, Human
ucuucauauauaaaguggaaua

SEQ ID NO: 344022 - RNA, 22 nt, Human
gcauucuuuuuaggagguuccu

SEQ ID NO: 344023 - RNA, 22 nt, Human
ugaaggcccagccacagaaugg

SEQ ID NO: 344024 - RNA, 19 nt, Human
agcuuccauauucucuagu

SEQ ID NO: 344025 - RNA, 22 nt, Human
uucucagauauuuacugagcau

SEQ ID NO: 344026 - RNA, 22 nt, Human
agagcagcacguuguccccaca

SEQ ID NO: 344027 - RNA, 22 nt, Human
cuacccagagugaaucucuuaa

SEQ ID NO: 344028 - RNA, 22 nt, Human
ggcagccuugacuagugacuua

SEQ ID NO: 344029 - RNA, 22 nt, Human
auucuucaucagagaugcacua

SEQ ID NO: 344030 - RNA, 22 nt, Human
cuagggaguggcagagcuggga

SEQ ID NO: 344031 - RNA, 22 nt, Human
ggaggaugccaagcugugcaca

SEQ ID NO: 344032 - RNA, 22 nt, Human
ucauggauggccgggaggugau

SEQ ID NO: 344033 - RNA, 22 nt, Human
aacauucaaaacccaguucagu

SEQ ID NO: 344034 - RNA, 22 nt, Human
guuauaaaaugcacaguuguuu

SEQ ID NO: 344035 - RNA, 22 nt, Human
gagugcagaugccagccccagu

SEQ ID NO: 344036 - RNA, 22 nt, Human
accauguguuuuacacauggua

SEQ ID NO: 344037 - RNA, 22 nt, Human
acccaggagagagcuauaaaau

SEQ ID NO: 344038 - RNA, 22 nt, Human
uuuucucuuguuaauguacuga

SEQ ID NO: 344039 - RNA, 22 nt, Human
ccagaggaaaaauaucucccua

SEQ ID NO: 344040 - RNA, 22 nt, Human
ucuuagaaugucaacugauguu

SEQ ID NO: 344041 - RNA, 22 nt, Human
caggcagcguccugcuuccugu

SEQ ID NO: 344042 - RNA, 22 nt, Human
accaggagccacaggaggagcc

SEQ ID NO: 344043 - RNA, 22 nt, Human
cauaauauacuacauugaugaa

SEQ ID NO: 344044 - RNA, 22 nt, Human
caggagaggcuguacguuucuc

SEQ ID NO: 344045 - RNA, 22 nt, Human
uguacauacauagauauacaca

SEQ ID NO: 344046 - RNA, 21 nt, Human
gcugcaucaaucuacccaggg

SEQ ID NO: 344047 - RNA, 22 nt, Human
ccaugagcuuccuauauagggu

SEQ ID NO: 344048 - RNA, 22 nt, Human
agaagucauuuauguuagauga

SEQ ID NO: 344049 - RNA, 22 nt, Human
uuuuuauaugaaggauagugcg

SEQ ID NO: 344050 - RNA, 22 nt, Human
cagcagaggcacgucugugaau

SEQ ID NO: 344051 - RNA, 22 nt, Human
uaaacauuuguuauucuuguuu

SEQ ID NO: 344052 - RNA, 22 nt, Human
gucaggaugcuauuguuauuaa

SEQ ID NO: 344053 - RNA, 22 nt, Human
ugaaaugagcauuuauucuuua

SEQ ID NO: 344054 - RNA, 22 nt, Human
uuucuagucucgaucucuuaau

SEQ ID NO: 344055 - RNA, 18 nt, Human
agggagagaccgcggguc

SEQ ID NO: 344056 - RNA, 22 nt, Human
ugaggcaggagaaucacaugaa

SEQ ID NO: 344057 - RNA, 22 nt, Human
uacugcaugguggaguggagcu

SEQ ID NO: 344058 - RNA, 22 nt, Human
cagucucagaggugggaguggg

SEQ ID NO: 344059 - RNA, 21 nt, Human
ucauuugugaucugauuucca

SEQ ID NO: 344060 - RNA, 19 nt, Human
uucaggauugacccuacug

SEQ ID NO: 344061 - RNA, 22 nt, Human
caaggccaugagcagcgagugu

SEQ ID NO: 344062 - RNA, 22 nt, Human
ggaggcaggaaagacagguuca

SEQ ID NO: 344063 - RNA, 22 nt, Human
uuugcauaaaggagcauuucuc

SEQ ID NO: 344064 - RNA, 22 nt, Human
gaggaacccagcugggguugcc

SEQ ID NO: 344065 - RNA, 17 nt, Human
ccuguguuugcuccuuc

SEQ ID NO: 344066 - RNA, 22 nt, Human
ccaggagagcaggcgugcagcu

SEQ ID NO: 344067 - RNA, 22 nt, Human
ugaggggauacgguacacauug

SEQ ID NO: 344068 - RNA, 22 nt, Human
aauuuccaaauuucugucacac

SEQ ID NO: 344069 - RNA, 22 nt, Human
gcaucuaaacuugcaucauugu

SEQ ID NO: 344070 - RNA, 22 nt, Human
agggaguuagaaauccaggaua

SEQ ID NO: 344071 - RNA, 22 nt, Human
ggagcggagggagggccacugu

SEQ ID NO: 344072 - RNA, 22 nt, Human
gcaagcugcucuuauguggagg

SEQ ID NO: 344073 - RNA, 22 nt, Human
gagugcaguuggggugagggga

SEQ ID NO: 344074 - RNA, 22 nt, Human
aggcagcuuuguaguaaagcua

SEQ ID NO: 344075 - RNA, 22 nt, Human
ucacccuugauaauguucuucu

SEQ ID NO: 344076 - RNA, 22 nt, Human
acaaaugucuccucuuuuguua

SEQ ID NO: 344077 - RNA, 22 nt, Human
gucccaggugggcuccaccucu

SEQ ID NO: 344078 - RNA, 22 nt, Human
auguagaagugggcauuauaga

SEQ ID NO: 344079 - RNA, 22 nt, Human
caauaguucgguccugaaggcc

SEQ ID NO: 344080 - RNA, 22 nt, Human
ugcuagaagauagcuagaagau

SEQ ID NO: 344081 - RNA, 22 nt, Human
uuucaugagauuccuccacauc

SEQ ID NO: 344082 - RNA, 22 nt, Human
auacuuucugaccaauuaauug

SEQ ID NO: 344083 - RNA, 22 nt, Human
uacacacagaggccaugggauu

SEQ ID NO: 344084 - RNA, 22 nt, Human
guccaugauucugugacacccu

SEQ ID NO: 344085 - RNA, 22 nt, Human
ggaagaggcugaggccaugcug

SEQ ID NO: 344086 - RNA, 22 nt, Human
agucacuguucugucaugucaa

SEQ ID NO: 344087 - RNA, 22 nt, Human
gaggucagucagaccaggguuu

SEQ ID NO: 344088 - RNA, 22 nt, Human
gaaauauuguacuggagauguu

SEQ ID NO: 344089 - RNA, 22 nt, Human
ucugggaaaugcuguuccuugu

SEQ ID NO: 344090 - RNA, 22 nt, Human
ugaggcagugauguuuaagcac

SEQ ID NO: 344091 - RNA, 22 nt, Human
uugaaaguccuucuugaguuac

SEQ ID NO: 344092 - RNA, 22 nt, Human
ggagaggagcuauugggggcuc

SEQ ID NO: 344093 - RNA, 22 nt, Human
uuucccaguucccugcucuaua

SEQ ID NO: 344094 - RNA, 22 nt, Human
gaggaggcuuccgggaggcacg

SEQ ID NO: 344095 - RNA, 22 nt, Human
gaggcagcggcucacagagaaa

SEQ ID NO: 344096 - RNA, 22 nt, Human
agggaagcuuguuacugagaag

SEQ ID NO: 344097 - RNA, 22 nt, Human
aaauaguuguuuggaucaauaa

SEQ ID NO: 344098 - RNA, 22 nt, Human
uccaggagaggccugaccaggu

SEQ ID NO: 344099 - RNA, 22 nt, Human
gaggcaguguuuacugcccugu

SEQ ID NO: 344100 - RNA, 22 nt, Human
uggaaauacuugccauaaaacu

SEQ ID NO: 344101 - RNA, 21 nt, Human
uuucugaaggcaacaucuauc

SEQ ID NO: 344102 - RNA, 22 nt, Human
caggcagcugacugucagauau

SEQ ID NO: 344103 - RNA, 22 nt, Human
uuuuuguagucauuagaagagg

SEQ ID NO: 344104 - RNA, 21 nt, Human
gauuuuaaagagacugccaca

SEQ ID NO: 344105 - RNA, 22 nt, Human
agggauggaagacuugaagacc

SEQ ID NO: 344106 - RNA, 22 nt, Human
uuauuugcccauguuuagcaga

SEQ ID NO: 344107 - RNA, 22 nt, Human
augaagcugaaaaaggcauaua

SEQ ID NO: 344108 - RNA, 22 nt, Human
aaggcagcaagaauuccagguu

SEQ ID NO: 344109 - RNA, 22 nt, Human
cccaggcagccugcagggaagg

SEQ ID NO: 344110 - RNA, 22 nt, Human
ucucagaguuuagagcugagcc

SEQ ID NO: 344111 - RNA, 22 nt, Human
gagagucuaggaaccucauaua

SEQ ID NO: 344112 - RNA, 22 nt, Human
aaacacagggauauauauucca

SEQ ID NO: 344113 - RNA, 22 nt, Human
ugaaugaguuuggcugcuguuc

SEQ ID NO: 344114 - RNA, 22 nt, Human
gugcuaaaggguuaugaacaag

SEQ ID NO: 344115 - RNA, 22 nt, Human
auuaaauuagcaaacugugaaa

SEQ ID NO: 344116 - RNA, 22 nt, Human
ucugggaaugaauaagaccugu

SEQ ID NO: 344117 - RNA, 22 nt, Human
caggcagcugggucaccguccc

SEQ ID NO: 344118 - RNA, 22 nt, Human
agaggcagaaguguucaaaccc

SEQ ID NO: 344119 - RNA, 22 nt, Human
ucaggagaaagccaauuagagu

SEQ ID NO: 344120 - RNA, 22 nt, Human
uggcagcugaggggaggcuuug

SEQ ID NO: 344121 - RNA, 22 nt, Human
ucuucagauaaagggagaguau

SEQ ID NO: 344122 - RNA, 22 nt, Human
ucacuguugaccuggaaguggg

SEQ ID NO: 344123 - RNA, 22 nt, Human
uucuucucggcugucagauagu

SEQ ID NO: 344124 - RNA, 23 nt, Human
uggcaaggaaugggauggagacu

SEQ ID NO: 344125 - RNA, 22 nt, Human
ucuuccucuagaucugaggccc

SEQ ID NO: 344126 - RNA, 22 nt, Human
guugaaagaugucuugguuccc

SEQ ID NO: 344127 - RNA, 18 nt, Human
ggcagcuugacuagcaac

SEQ ID NO: 344128 - RNA, 22 nt, Human
aucuagcaguguuauaauugga

SEQ ID NO: 344129 - RNA, 22 nt, Human
ggagaggaaaugccagcacuuc

SEQ ID NO: 344130 - RNA, 22 nt, Human
cccaggagaccugugaaaggac

SEQ ID NO: 344131 - RNA, 22 nt, Human
agaguucugcucuucucaguga

SEQ ID NO: 344132 - RNA, 22 nt, Human
uggaaggagacugggaagugug

SEQ ID NO: 344133 - RNA, 22 nt, Human
aagaauacguaucaacaauggu

SEQ ID NO: 344134 - RNA, 22 nt, Human
aggaagcucaaagccaugaugu

SEQ ID NO: 344135 - RNA, 22 nt, Human
ccaggcugugguuuagauagag

SEQ ID NO: 344136 - RNA, 23 nt, Human
auuucuaggggauuuucuggugc

SEQ ID NO: 344137 - RNA, 22 nt, Human
auuuuacuuugugaauauugac

SEQ ID NO: 344138 - RNA, 22 nt, Human
ggcagcuucuuaauauggagac

SEQ ID NO: 344139 - RNA, 22 nt, Human
uuucagaaagcugaacauauga

SEQ ID NO: 344140 - RNA, 22 nt, Human
ucuccucucuuaccugguacaa

SEQ ID NO: 344141 - RNA, 19 nt, Human
agacagagcucaguggguu

SEQ ID NO: 344142 - RNA, 20 nt, Human
ucauuguguugccaauuccc

SEQ ID NO: 344143 - RNA, 22 nt, Human
cuugaacucaaugugaggaaga

SEQ ID NO: 344144 - RNA, 22 nt, Human
gagaggagguggcuaugacagc

SEQ ID NO: 344145 - RNA, 22 nt, Human
agucuuuccugcuugacuguuc

SEQ ID NO: 344146 - RNA, 22 nt, Human
uuugcaguagacaucuuauuuu

SEQ ID NO: 344147 - RNA, 22 nt, Human
agaggcagccguauuucaaagg

SEQ ID NO: 344148 - RNA, 22 nt, Human
aucaggauguuuggcugucaua

SEQ ID NO: 344149 - RNA, 22 nt, Human
cccaggaaaucaggcuuucuag

SEQ ID NO: 344150 - RNA, 22 nt, Human
caaggccaguccauuuuggaag

SEQ ID NO: 344151 - RNA, 22 nt, Human
ugaaaugaaacagaacauauca

SEQ ID NO: 344152 - RNA, 22 nt, Human
guggaaugaauagauuugcauu

SEQ ID NO: 344153 - RNA, 22 nt, Human
gagggucccugcucagggccag

SEQ ID NO: 344154 - RNA, 22 nt, Human
uuugaaagaauuuauguacuuu

SEQ ID NO: 344155 - RNA, 22 nt, Human
uucucugagauagacuaagugg

SEQ ID NO: 344156 - RNA, 22 nt, Human
caaaucuauauguugauauucu

SEQ ID NO: 344157 - RNA, 22 nt, Human
gcccaggaguucaagucuagug

SEQ ID NO: 344158 - RNA, 21 nt, Human
cacucaggguaugugccaggc

SEQ ID NO: 344159 - RNA, 20 nt, Human
ucacaucuggcagcugauga

SEQ ID NO: 344160 - RNA, 23 nt, Human
uagggcagcugggagggacaugc

SEQ ID NO: 344161 - RNA, 22 nt, Human
ccuuaaauucuccauuugaaag

SEQ ID NO: 344162 - RNA, 22 nt, Human
ggcagcucugcuccacaugagu

SEQ ID NO: 344163 - RNA, 22 nt, Human
cuaauacacccuauugcuuguu

SEQ ID NO: 344164 - RNA, 23 nt, Human
gaggcagcuccugcagugcccug

SEQ ID NO: 344165 - RNA, 19 nt, Human
aguggcagaucuggaagua

SEQ ID NO: 344166 - RNA, 22 nt, Human
cggagccugcuuguugcagcug

SEQ ID NO: 344167 - RNA, 22 nt, Human
uuuguagaggguaauugacaga

SEQ ID NO: 344168 - RNA, 22 nt, Human
uagcuagaaugcuucgugauau

SEQ ID NO: 344169 - RNA, 22 nt, Human
ugguaauuaauuugauagguuc

SEQ ID NO: 344170 - RNA, 22 nt, Human
acuuggcaaguaucuauaaagu

SEQ ID NO: 344171 - RNA, 22 nt, Human
ugacaaaacugcaauuacuuuu

SEQ ID NO: 344172 - RNA, 22 nt, Human
agcuagaaguacagccauauga

SEQ ID NO: 344173 - RNA, 17 nt, Human
uuuagaauacaauguuu

SEQ ID NO: 344174 - RNA, 20 nt, Human
cccaggagugagcagcuuua

SEQ ID NO: 344175 - RNA, 22 nt, Human
uuuuccuucuagagcagauuuc

SEQ ID NO: 344176 - RNA, 22 nt, Human
uaagcugugggagauuggcaua

SEQ ID NO: 344177 - RNA, 20 nt, Human
uaggcagcuugacccuuggu

SEQ ID NO: 344178 - RNA, 22 nt, Human
gcuugaaaauucauagguauuu

SEQ ID NO: 344179 - RNA, 22 nt, Human
aucacauucuuucaaagcaguc

SEQ ID NO: 344180 - RNA, 22 nt, Human
uuaacaugucuugacuucaucu

SEQ ID NO: 344181 - RNA, 23 nt, Human
ucagagagcuguugagagcugcc

SEQ ID NO: 344182 - RNA, 22 nt, Human
auuucaaggcuauuaauauaaa

SEQ ID NO: 344183 - RNA, 22 nt, Human
aaacugcugguugcuggccagc

SEQ ID NO: 344184 - RNA, 22 nt, Human
uccaggagguaugaguggcccc

SEQ ID NO: 344185 - RNA, 22 nt, Human
caggcagaguuagagcaacugg

SEQ ID NO: 344186 - RNA, 22 nt, Human
gauuucuuugcaagcuguguuc

SEQ ID NO: 344187 - RNA, 19 nt, Human
ugccuggacaaaugugggg

SEQ ID NO: 344188 - RNA, 22 nt, Human
uuucuaggcacagugucuuccc

SEQ ID NO: 344189 - RNA, 22 nt, Human
gauggcaggugauagccgaguc

SEQ ID NO: 344190 - RNA, 22 nt, Human
uguaugaaaaggaauagauuga

SEQ ID NO: 344191 - RNA, 22 nt, Human
cauuuguuggucagauuguagu

SEQ ID NO: 344192 - RNA, 22 nt, Human
uguaugaaguuacugagccucu

SEQ ID NO: 344193 - RNA, 21 nt, Human
cccaggaggagcuccggcucc

SEQ ID NO: 344194 - RNA, 22 nt, Human
aagcaauagcaacaacuuuaca

SEQ ID NO: 344195 - RNA, 22 nt, Human
cccaggagguggagguugcagc

SEQ ID NO: 344196 - RNA, 22 nt, Human
aggguccugggugcaguugcuu

SEQ ID NO: 344197 - RNA, 22 nt, Human
cugccaggcagcagagggagaa

SEQ ID NO: 344198 - RNA, 22 nt, Human
aaggagaaaugguagaugugca

SEQ ID NO: 344199 - RNA, 22 nt, Human
ccaggagcagauauggacauaa

SEQ ID NO: 344200 - RNA, 22 nt, Human
uuuccucacuucaugagaguuu

SEQ ID NO: 344201 - RNA, 22 nt, Human
aaauguauugcauaggauauuu

SEQ ID NO: 344202 - RNA, 19 nt, Human
ugaggggaggagaggccug

SEQ ID NO: 344203 - RNA, 22 nt, Human
aaggcagccgugugacugcaug

SEQ ID NO: 344204 - RNA, 19 nt, Human
caagugaagccugggaugg

SEQ ID NO: 344205 - RNA, 22 nt, Human
cauugcuuccuaugucccuucu

SEQ ID NO: 344206 - RNA, 22 nt, Human
uccaggagguugagacugcagu

SEQ ID NO: 344207 - RNA, 21 nt, Human
uuugaaagcccuauguuuuca

SEQ ID NO: 344208 - RNA, 22 nt, Human
aaaguuugagugauuugacaca

SEQ ID NO: 344209 - RNA, 20 nt, Human
aagcacauuucuacaauaau

SEQ ID NO: 344210 - RNA, 22 nt, Human
gggagacacgcugcaggcauaa

SEQ ID NO: 344211 - RNA, 22 nt, Human
aggaaacuccccuacaucucaa

SEQ ID NO: 344212 - RNA, 19 nt, Human
agucuuucccacucgucuu

SEQ ID NO: 344213 - RNA, 22 nt, Human
auuucacucauucauguuacuu

SEQ ID NO: 344214 - RNA, 22 nt, Human
ggaggaggggugacugaaugcu

SEQ ID NO: 344215 - RNA, 22 nt, Human
aggguagggcccggagacagac

SEQ ID NO: 344216 - RNA, 21 nt, Human
uucuccccagcgaauccucgg

SEQ ID NO: 344217 - RNA, 22 nt, Human
ccugcugugaccggggagcagg

SEQ ID NO: 344218 - RNA, 22 nt, Human
gaacacauguccuccuuggauu

SEQ ID NO: 344219 - RNA, 17 nt, Human
gaggagcuccaguaggu

SEQ ID NO: 344220 - RNA, 22 nt, Human
ggcagcuuucucacccaugacc

SEQ ID NO: 344221 - RNA, 22 nt, Human
cccaggcagugugugcaugcgu

SEQ ID NO: 344222 - RNA, 21 nt, Human
uagggcaggcauuggaagaga

SEQ ID NO: 344223 - RNA, 22 nt, Human
uagugcuuuaaguuuacagaga

SEQ ID NO: 344224 - RNA, 22 nt, Human
ggccagcuuugagcugcaggaa

SEQ ID NO: 344225 - RNA, 22 nt, Human
ugaaggccucugguacaugcca

SEQ ID NO: 344226 - RNA, 22 nt, Human
auuuugaugcuaucuaaugaau

SEQ ID NO: 344227 - RNA, 22 nt, Human
cugcugugaguuuggaggucua

SEQ ID NO: 344228 - RNA, 22 nt, Human
gaggcagcugaaggagugacag

SEQ ID NO: 344229 - RNA, 22 nt, Human
uagggcaggugaagaaaagcua

SEQ ID NO: 344230 - RNA, 22 nt, Human
agcccaggaaguugaggcuugc

SEQ ID NO: 344231 - RNA, 22 nt, Human
gaaggccacuuuguguugagaa

SEQ ID NO: 344232 - RNA, 22 nt, Human
uugcaucuagggcaacccagag

SEQ ID NO: 344233 - RNA, 22 nt, Human
gaaguacaguuuuaucuagcca

SEQ ID NO: 344234 - RNA, 21 nt, Human
gagugcagcaagguagagucu

SEQ ID NO: 344235 - RNA, 22 nt, Human
caggauggucucgaucuccuga

SEQ ID NO: 344236 - RNA, 22 nt, Human
uuugcaaagaaauuauugcugu

SEQ ID NO: 344237 - RNA, 22 nt, Human
uccucagaaaccccugugaggu

SEQ ID NO: 344238 - RNA, 22 nt, Human
acagugcuaaacacuucuugaa

SEQ ID NO: 344239 - RNA, 22 nt, Human
ucccaggacaggccacauggaa

SEQ ID NO: 344240 - RNA, 22 nt, Human
ucuacuauguuucuuaaauaga

SEQ ID NO: 344241 - RNA, 22 nt, Human
ucauuauccuaguaucuugaau

SEQ ID NO: 344242 - RNA, 22 nt, Human
gaagcagcuuucuggugaggag

SEQ ID NO: 344243 - RNA, 22 nt, Human
aggaagcugccugggaugggaa

SEQ ID NO: 344244 - RNA, 22 nt, Human
aaagcagaacugagagagcugg

SEQ ID NO: 344245 - RNA, 22 nt, Human
uggcaaggcugugggggcagag

SEQ ID NO: 344246 - RNA, 22 nt, Human
aauucugugcaggcagagcuau

SEQ ID NO: 344247 - RNA, 18 nt, Human
gcagcugacacuggaguu

SEQ ID NO: 344248 - RNA, 22 nt, Human
acagauauaaacuauaguagug

SEQ ID NO: 344249 - RNA, 22 nt, Human
gaaaggcaguacagcugagccu

SEQ ID NO: 344250 - RNA, 22 nt, Human
aagcagaguccccuucccaugg

SEQ ID NO: 344251 - RNA, 19 nt, Human
cauuuuaagcauccccagu

SEQ ID NO: 344252 - RNA, 20 nt, Human
caucaucacaugagccaauu

SEQ ID NO: 344253 - RNA, 22 nt, Human
auaugagaguaaaugccgaucu

SEQ ID NO: 344254 - RNA, 21 nt, Human
gggugggaggacacagcaggc

SEQ ID NO: 344255 - RNA, 22 nt, Human
uucaggauaguggugaguggca

SEQ ID NO: 344256 - RNA, 22 nt, Human
aauaucuucuaaggauagaacu

SEQ ID NO: 344257 - RNA, 22 nt, Human
auacuaaaguauagaacuuagu

SEQ ID NO: 344258 - RNA, 22 nt, Human
uguaggaaaaacaaugaucugc

SEQ ID NO: 344259 - RNA, 22 nt, Human
aaacacagauuucuuuguccca

SEQ ID NO: 344260 - RNA, 22 nt, Human
cagagggcucuuggcugccugc

SEQ ID NO: 344261 - RNA, 22 nt, Human
guggcagcaaaugccuggacua

SEQ ID NO: 344262 - RNA, 22 nt, Human
cagcucccgccaucgggaggca

SEQ ID NO: 344263 - RNA, 22 nt, Human
aggcaguuuauccccagagccu

SEQ ID NO: 344264 - RNA, 22 nt, Human
gcucccagcaauugaggcagcc

SEQ ID NO: 344265 - RNA, 23 nt, Human
aaggccagaauuucaauggugcc

SEQ ID NO: 344266 - RNA, 22 nt, Human
agaggcagcagucauacuacag

SEQ ID NO: 344267 - RNA, 22 nt, Human
cugacccauauaagaguggagg

SEQ ID NO: 344268 - RNA, 22 nt, Human
aggaggggcaaugauagucugg

SEQ ID NO: 344269 - RNA, 22 nt, Human
uuugaaaguccuaggagagucc

SEQ ID NO: 344270 - RNA, 22 nt, Human
gaaacugugaucguguucuggg

SEQ ID NO: 344271 - RNA, 21 nt, Human
aaugaaguggcuauuuugagg

SEQ ID NO: 344272 - RNA, 22 nt, Human
uuuguuuacucauucauugaug

SEQ ID NO: 344273 - RNA, 22 nt, Human
gcauuuccugugcuuggcauau

SEQ ID NO: 344274 - RNA, 22 nt, Human
ggcagcaucucuggcagcagcu

SEQ ID NO: 344275 - RNA, 22 nt, Human
ccagaggaggggggucuuucug

SEQ ID NO: 344276 - RNA, 22 nt, Human
ugcauggacucaucagacaaga

SEQ ID NO: 344277 - RNA, 22 nt, Human
aagggaggaggauuuauuguac

SEQ ID NO: 344278 - RNA, 22 nt, Human
cugcuguguuucugcuagaaaa

SEQ ID NO: 344279 - RNA, 22 nt, Human
gauggcagguaguggucucauc

SEQ ID NO: 344280 - RNA, 22 nt, Human
guugaaugaaucauucuaugua

SEQ ID NO: 344281 - RNA, 22 nt, Human
gcagaggauagcauaugaaccu

SEQ ID NO: 344282 - RNA, 22 nt, Human
gaaggaggugucaguuggacug

SEQ ID NO: 344283 - RNA, 22 nt, Human
uguguucuggaaagcucacuga

SEQ ID NO: 344284 - RNA, 22 nt, Human
uuguaugagcuccaggaacuca

SEQ ID NO: 344285 - RNA, 22 nt, Human
gcccaggaugguguguaguggu

SEQ ID NO: 344286 - RNA, 22 nt, Human
uguacauagaucuugaaaauua

SEQ ID NO: 344287 - RNA, 22 nt, Human
caucucaugggcaugccaagcu

SEQ ID NO: 344288 - RNA, 15 nt, Human
uggcagcuuguuaag

SEQ ID NO: 344289 - RNA, 22 nt, Human
gaacccaggcuuuugaggcugu

SEQ ID NO: 344290 - RNA, 22 nt, Human
cucugcauuuuaacagaugauu

SEQ ID NO: 344291 - RNA, 22 nt, Human
ucaggagaaaauaucaggaagu

SEQ ID NO: 344292 - RNA, 22 nt, Human
uagaaauaaaucugcagcuggg

SEQ ID NO: 344293 - RNA, 22 nt, Human
acucagaaugacugaugcugug

SEQ ID NO: 344294 - RNA, 22 nt, Human
uccaggagagguguggggacug

SEQ ID NO: 344295 - RNA, 22 nt, Human
cuugcugugugguguucucaga

SEQ ID NO: 344296 - RNA, 22 nt, Human
uacaaaugaguuguaugaacca

SEQ ID NO: 344297 - RNA, 22 nt, Human
cccaggagaauauuuuuggguc

SEQ ID NO: 344298 - RNA, 22 nt, Human
ucuucagagugaaagucuguga

SEQ ID NO: 344299 - RNA, 22 nt, Human
guuaacacaggacucucugccu

SEQ ID NO: 344300 - RNA, 22 nt, Human
uuuagaaguucacacauuuaaa

SEQ ID NO: 344301 - RNA, 22 nt, Human
ucuuccaagguugcacacuauc

SEQ ID NO: 344302 - RNA, 22 nt, Human
uuugaaaggaauuaggaugaca

SEQ ID NO: 344303 - RNA, 22 nt, Human
cugcugugcaacauugcaccua

SEQ ID NO: 344304 - RNA, 20 nt, Human
aguguacagacacuagaaau

SEQ ID NO: 344305 - RNA, 22 nt, Human
caaugaaaauuuaaguugcagc

SEQ ID NO: 344306 - RNA, 22 nt, Human
ggaggggucucuagcgaggaga

SEQ ID NO: 344307 - RNA, 22 nt, Human
cccaggaaaugggcucuugccu

SEQ ID NO: 344308 - RNA, 22 nt, Human
uggcagcugucuguggggucuc

SEQ ID NO: 344309 - RNA, 22 nt, Human
guguaugaacgaaagaauggau

SEQ ID NO: 344310 - RNA, 22 nt, Human
acacauuucuaaauuuuuaccg

SEQ ID NO: 344311 - RNA, 20 nt, Human
ucucagcauaagaacccuuc

SEQ ID NO: 344312 - RNA, 22 nt, Human
ugaaaugaagggcuuguucugg

SEQ ID NO: 344313 - RNA, 22 nt, Human
uaucuguuccaggcacucagcu

SEQ ID NO: 344314 - RNA, 22 nt, Human
uucauugucucuguuugccuuc

SEQ ID NO: 344315 - RNA, 23 nt, Human
uuucaaauuacucugcagaugac

SEQ ID NO: 344316 - RNA, 21 nt, Human
aucacauuggcuguuauuauu

SEQ ID NO: 344317 - RNA, 22 nt, Human
uuuccaagacuccaguucuccc

SEQ ID NO: 344318 - RNA, 21 nt, Human
auaagcaugcugauuacauuu

SEQ ID NO: 344319 - RNA, 22 nt, Human
guuuucaaggggauuuaacuga

SEQ ID NO: 344320 - RNA, 22 nt, Human
caggaugaagggcaaaggcaag

SEQ ID NO: 344321 - RNA, 22 nt, Human
uuguuugaggucacugauauuu

SEQ ID NO: 344322 - RNA, 22 nt, Human
gcucucuugguggcuguccugg

SEQ ID NO: 344323 - RNA, 22 nt, Human
ugauugaacugagcuucaagau

SEQ ID NO: 344324 - RNA, 22 nt, Human
ucacugucugaaagaaauggcc

SEQ ID NO: 344325 - RNA, 22 nt, Human
guuaugaaauaaauauagauca

SEQ ID NO: 344326 - RNA, 22 nt, Human
gaauagcuuccuuuuuuccaaa

SEQ ID NO: 344327 - RNA, 22 nt, Human
ugaaggccagcagagugaaggc

SEQ ID NO: 344328 - RNA, 22 nt, Human
cugcugugcaggugccuaugau

SEQ ID NO: 344329 - RNA, 22 nt, Human
gcccaggaguugaaugcagcag

SEQ ID NO: 344330 - RNA, 22 nt, Human
uggcagcuacagacagagguga

SEQ ID NO: 344331 - RNA, 22 nt, Human
ugucucugggugauucaguccu

SEQ ID NO: 344332 - RNA, 22 nt, Human
aucuuucuccauauacaucuuu

SEQ ID NO: 344333 - RNA, 22 nt, Human
ggguacuuaauauuuacggggu

SEQ ID NO: 344334 - RNA, 22 nt, Human
aauuuccagaccccauccacag

SEQ ID NO: 344335 - RNA, 22 nt, Human
acaaauguggacauggauaaug

SEQ ID NO: 344336 - RNA, 22 nt, Human
aggcaguuucugggacagcaua

SEQ ID NO: 344337 - RNA, 20 nt, Human
ggaggguggaagaaagcaag

SEQ ID NO: 344338 - RNA, 22 nt, Human
aguggacucuucccagugcuug

SEQ ID NO: 344339 - RNA, 22 nt, Human
aggcagaucacuugaggccagg

SEQ ID NO: 344340 - RNA, 22 nt, Human
gacuucuauuaauaccucuacu

SEQ ID NO: 344341 - RNA, 22 nt, Human
augcuguguggucaaguuaauu

SEQ ID NO: 344342 - RNA, 22 nt, Human
uuuauuguuaucaugggugagu

SEQ ID NO: 344343 - RNA, 22 nt, Human
gccaggagcccugggcaaguuc

SEQ ID NO: 344344 - RNA, 22 nt, Human
uuucagcugguaaaggaguagc

SEQ ID NO: 344345 - RNA, 18 nt, Human
acaaaugugucacaggaa

SEQ ID NO: 344346 - RNA, 22 nt, Human
cccaugagguggagguugcagu

SEQ ID NO: 344347 - RNA, 23 nt, Human
uugcacauuggagcuggucuucu

SEQ ID NO: 344348 - RNA, 22 nt, Human
ccaaaugugccuguuucaacaa

SEQ ID NO: 344349 - RNA, 22 nt, Human
ucucuguacaguacaugccgug

SEQ ID NO: 344350 - RNA, 22 nt, Human
cagaggcacaagaaagcaaggc

SEQ ID NO: 344351 - RNA, 22 nt, Human
gaggagcugggcugagaggguc

SEQ ID NO: 344352 - RNA, 22 nt, Human
gaggaaccaaaucagcuugcac

SEQ ID NO: 344353 - RNA, 22 nt, Human
cuuagcaugugguguccuugua

SEQ ID NO: 344354 - RNA, 22 nt, Human
agcugcuacugcucugccagag

SEQ ID NO: 344355 - RNA, 22 nt, Human
ugaggcagcauucuucaagaca

SEQ ID NO: 344356 - RNA, 22 nt, Human
agcccaggucucaaaguacagg

SEQ ID NO: 344357 - RNA, 22 nt, Human
cucacugugccuuuucccaaac

SEQ ID NO: 344358 - RNA, 22 nt, Human
accaggagggacccugguggcc

SEQ ID NO: 344359 - RNA, 17 nt, Human
ccaggagagaugcuugu

SEQ ID NO: 344360 - RNA, 22 nt, Human
gucugucauacggcuuauguaa

SEQ ID NO: 344361 - RNA, 22 nt, Human
uccaggagugcugguuagagua

SEQ ID NO: 344362 - RNA, 22 nt, Human
uaauuauuugaagacauuagag

SEQ ID NO: 344363 - RNA, 22 nt, Human
uugagaagaauguguugaguuu

SEQ ID NO: 344364 - RNA, 22 nt, Human
uucaggauggaguaccuuuuau

SEQ ID NO: 344365 - RNA, 22 nt, Human
aagggagguaaagcuauuuaaa

SEQ ID NO: 344366 - RNA, 22 nt, Human
cucucuguuaugcuuucaugaa

SEQ ID NO: 344367 - RNA, 22 nt, Human
gaugccucuuuuggcugaauua

SEQ ID NO: 344368 - RNA, 22 nt, Human
cuguucucuggcgguggcuguu

SEQ ID NO: 344369 - RNA, 22 nt, Human
aguaugaaaguuaaucaauuua

SEQ ID NO: 344370 - RNA, 22 nt, Human
aggccagcgcugcuagcucccg

SEQ ID NO: 344371 - RNA, 22 nt, Human
augcuguggaaguuccugaagc

SEQ ID NO: 344372 - RNA, 22 nt, Human
ugccuggauucgguuguuguca

SEQ ID NO: 344373 - RNA, 22 nt, Human
ucaggaugagcucauaacuaug

SEQ ID NO: 344374 - RNA, 22 nt, Human
cucccagggucuaggcugcugg

SEQ ID NO: 344375 - RNA, 19 nt, Human
aaagcagaggagcaucuga

SEQ ID NO: 344376 - RNA, 22 nt, Human
uuuacuuuugguaaggucauuu

SEQ ID NO: 344377 - RNA, 22 nt, Human
acccaggaggcagagguugcag

SEQ ID NO: 344378 - RNA, 22 nt, Human
aauggccagcugggagaguuga

SEQ ID NO: 344379 - RNA, 23 nt, Human
aaaguuugaagcaacaguaguug

SEQ ID NO: 344380 - RNA, 22 nt, Human
cagcuuccgaccgggggcugca

SEQ ID NO: 344381 - RNA, 22 nt, Human
acauauauuacuaguaaagaca

SEQ ID NO: 344382 - RNA, 22 nt, Human
ggcagaggaaggaugaauucac

SEQ ID NO: 344383 - RNA, 22 nt, Human
ugcuuggcuuucugagcuucug

SEQ ID NO: 344384 - RNA, 22 nt, Human
cagcaggauuugaaaggaagag

SEQ ID NO: 344385 - RNA, 22 nt, Human
agggggugucucugauuggguu

SEQ ID NO: 344386 - RNA, 22 nt, Human
uaggcagcuuagguuagaagug

SEQ ID NO: 344387 - RNA, 22 nt, Human
uucacagacauugcagacugaa

SEQ ID NO: 344388 - RNA, 22 nt, Human
uaugaccuuaggaagcaagaag

SEQ ID NO: 344389 - RNA, 22 nt, Human
ccauccuaucugaccuacuugu

SEQ ID NO: 344390 - RNA, 22 nt, Human
aggccagcaagaaagagagucu

SEQ ID NO: 344391 - RNA, 22 nt, Human
gaagcacauggcuauagcuauu

SEQ ID NO: 344392 - RNA, 22 nt, Human
uucuucaaugugcccuguuuuc

SEQ ID NO: 344393 - RNA, 22 nt, Human
uucucagaugauucagauaaac

SEQ ID NO: 344394 - RNA, 22 nt, Human
gaggccagggaugcaaugagag

SEQ ID NO: 344395 - RNA, 22 nt, Human
ucauuucuauugcuacugucug

SEQ ID NO: 344396 - RNA, 22 nt, Human
cugagagugcucuuugauguca

SEQ ID NO: 344397 - RNA, 22 nt, Human
aaguggacuaauacaaggacua

SEQ ID NO: 344398 - RNA, 22 nt, Human
auaagcauguuagaauauuuga

SEQ ID NO: 344399 - RNA, 22 nt, Human
ucugugcauuguaacaacuaaa

SEQ ID NO: 344400 - RNA, 22 nt, Human
uuccaagagcuuuaauuguuga

SEQ ID NO: 344401 - RNA, 21 nt, Human
aauguauguuuaucucacagu

SEQ ID NO: 344402 - RNA, 22 nt, Human
ggacagcugcuuucaggccaca

SEQ ID NO: 344403 - RNA, 20 nt, Human
ucucuucuggggagauaaaa

SEQ ID NO: 344404 - RNA, 22 nt, Human
auucugauaucuuauucuagcu

SEQ ID NO: 344405 - RNA, 22 nt, Human
ucuuagcauuucauaacaacug

SEQ ID NO: 344406 - RNA, 22 nt, Human
aggcagcagucaugaggaaaga

SEQ ID NO: 344407 - RNA, 22 nt, Human
cagcuuccauaagagauggaga

SEQ ID NO: 344408 - RNA, 22 nt, Human
uuguuuuaucuuucuacagacu

SEQ ID NO: 344409 - RNA, 22 nt, Human
uuugaaaggaaguuaauacuuu

SEQ ID NO: 344410 - RNA, 22 nt, Human
cugcugugugcuuacuuggguu

SEQ ID NO: 344411 - RNA, 22 nt, Human
uucccucuccuacucaggaaag

SEQ ID NO: 344412 - RNA, 22 nt, Human
ucccaggaaaacacucgaggac

SEQ ID NO: 344413 - RNA, 22 nt, Human
gucaggauuggggucaugaguc

SEQ ID NO: 344414 - RNA, 22 nt, Human
ugcauauuguccuugauauuau

SEQ ID NO: 344415 - RNA, 23 nt, Human
aaacugcuuccaauuccugccau

SEQ ID NO: 344416 - RNA, 22 nt, Human
aauuuguuaaaagugagugaca

SEQ ID NO: 344417 - RNA, 22 nt, Human
ccucaggauacaggagccacag

SEQ ID NO: 344418 - RNA, 22 nt, Human
aaggccagaguacuagaggcug

SEQ ID NO: 344419 - RNA, 18 nt, Human
agggaguuuuagggaagg

SEQ ID NO: 344420 - RNA, 22 nt, Human
gacagugcauuuccuggcaugg

SEQ ID NO: 344421 - RNA, 22 nt, Human
agaaaugacaagacugaucagg

SEQ ID NO: 344422 - RNA, 22 nt, Human
aaaguuaguuucuuauaugucu

SEQ ID NO: 344423 - RNA, 22 nt, Human
gacccaggcccaaggcugccag

SEQ ID NO: 344424 - RNA, 22 nt, Human
auaguuugaaggcuguucuacu

SEQ ID NO: 344425 - RNA, 19 nt, Human
cuuugucagaacaugcuuc

SEQ ID NO: 344426 - RNA, 17 nt, Human
ggcagcugugugcaugc

SEQ ID NO: 344427 - RNA, 22 nt, Human
uugaaaguagcagcugcauaug

SEQ ID NO: 344428 - RNA, 21 nt, Human
aucauucuggaaaauucaagc

SEQ ID NO: 344429 - RNA, 22 nt, Human
cugcuuugacuguuaagaacca

SEQ ID NO: 344430 - RNA, 19 nt, Human
uaaggccaaaaguaagugu

SEQ ID NO: 344431 - RNA, 22 nt, Human
ucuucagacccuuagcugugau

SEQ ID NO: 344432 - RNA, 22 nt, Human
gaaguucuuagucucauuugca

SEQ ID NO: 344433 - RNA, 20 nt, Human
agagcagcaguuggugaggu

SEQ ID NO: 344434 - RNA, 22 nt, Human
uucacacacagcuuccuauugu

SEQ ID NO: 344435 - RNA, 22 nt, Human
cagggagggaggaaaauuugcu

SEQ ID NO: 344436 - RNA, 22 nt, Human
acuggcagagacccugauggcc

SEQ ID NO: 344437 - RNA, 22 nt, Human
ugaaagcagcaccaauaccauu

SEQ ID NO: 344438 - RNA, 22 nt, Human
caagauggagaagcagcaaggg

SEQ ID NO: 344439 - RNA, 22 nt, Human
ugaaaugagauagauaaucagg

SEQ ID NO: 344440 - RNA, 22 nt, Human
cuuugaagagauuacugugcuc

SEQ ID NO: 344441 - RNA, 22 nt, Human
uugugguuaaccgcacauuuuu

SEQ ID NO: 344442 - RNA, 22 nt, Human
uuuguuaaauauuuauugagug

SEQ ID NO: 344443 - RNA, 20 nt, Human
augauuuugcacuaacuuca

SEQ ID NO: 344444 - RNA, 22 nt, Human
ucugaacuccagcccugcucuc

SEQ ID NO: 344445 - RNA, 22 nt, Human
gaccuggaggauccucuucuug

SEQ ID NO: 344446 - RNA, 22 nt, Human
cagaguucaaagccugcuggga

SEQ ID NO: 344447 - RNA, 22 nt, Human
cugcugugccuuaaaaugcaag

SEQ ID NO: 344448 - RNA, 19 nt, Human
agauggcaaaaugcaaaga

SEQ ID NO: 344449 - RNA, 22 nt, Human
aggagggaccuaggaauauugc

SEQ ID NO: 344450 - RNA, 19 nt, Human
ugaaauggcaguugcuaaa

SEQ ID NO: 344451 - RNA, 22 nt, Human
ucuuugaauccuuuacaucuga

SEQ ID NO: 344452 - RNA, 22 nt, Human
cuggaggcacccuuagagaggc

SEQ ID NO: 344453 - RNA, 22 nt, Human
ucugggaacagccuggcugugu

SEQ ID NO: 344454 - RNA, 22 nt, Human
ggcuuggaaauugcaggacaca

SEQ ID NO: 344455 - RNA, 22 nt, Human
ugcauaaagugccauaguauua

SEQ ID NO: 344456 - RNA, 22 nt, Human
uucucuuugacauuauucaggu

SEQ ID NO: 344457 - RNA, 22 nt, Human
augugaaacugaagcauccaua

SEQ ID NO: 344458 - RNA, 22 nt, Human
aaagauuauggcauugaaauac

SEQ ID NO: 344459 - RNA, 22 nt, Human
uauaauguuuuccauggacuga

SEQ ID NO: 344460 - RNA, 22 nt, Human
caggaugagaagggcucuuacg

SEQ ID NO: 344461 - RNA, 22 nt, Human
cugcugugcagacagacucucu

SEQ ID NO: 344462 - RNA, 22 nt, Human
cucaggaaaggccaugcaaggg

SEQ ID NO: 344463 - RNA, 21 nt, Human
gggcagcucuguuuuauuuuc

SEQ ID NO: 344464 - RNA, 22 nt, Human
auacacauauguguguauaugu

SEQ ID NO: 344465 - RNA, 22 nt, Human
auauacuuggagacuaucauug

SEQ ID NO: 344466 - RNA, 22 nt, Human
uuagaaagaacuuuagauauca

SEQ ID NO: 344467 - RNA, 22 nt, Human
cuugaaagucagcagaguggau

SEQ ID NO: 344468 - RNA, 17 nt, Human
uccaggagaggcaaugg

SEQ ID NO: 344469 - RNA, 22 nt, Human
uuagacauagaauauugucuag

SEQ ID NO: 344470 - RNA, 22 nt, Human
gcagcugagagaagaacagggc

SEQ ID NO: 344471 - RNA, 22 nt, Human
acaagcaugggcuuugacauca

SEQ ID NO: 344472 - RNA, 22 nt, Human
ugaugaaauguugaggcaguga

SEQ ID NO: 344473 - RNA, 22 nt, Human
aggcagcuggaaaacuccaggc

SEQ ID NO: 344474 - RNA, 22 nt, Human
caacugugaauuuuaugauacc

SEQ ID NO: 344475 - RNA, 22 nt, Human
cccaggaguaagugacauuguu

SEQ ID NO: 344476 - RNA, 22 nt, Human
uuccucagcuggccugauuggg

SEQ ID NO: 344477 - RNA, 22 nt, Human
cacucaggguacaauggagggc

SEQ ID NO: 344478 - RNA, 22 nt, Human
agaauaugaugguuggagaauu

SEQ ID NO: 344479 - RNA, 22 nt, Human
uucagaaguagcuaagcaguca

SEQ ID NO: 344480 - RNA, 22 nt, Human
aaaggugacacucugccagcug

SEQ ID NO: 344481 - RNA, 22 nt, Human
uggaguucauccaugacagcuu

SEQ ID NO: 344482 - RNA, 22 nt, Human
aauacugccugugagguaacuc

SEQ ID NO: 344483 - RNA, 20 nt, Human
cugcccagccacugagggau

SEQ ID NO: 344484 - RNA, 22 nt, Human
ugaaaugaaugugauucgauag

SEQ ID NO: 344485 - RNA, 22 nt, Human
cccaggaauuggaggcugcagu

SEQ ID NO: 344486 - RNA, 21 nt, Human
augucaaaugcuuuauuuuau

SEQ ID NO: 344487 - RNA, 22 nt, Human
aaugucugcucuacucaggagg

SEQ ID NO: 344488 - RNA, 22 nt, Human
cccuugcacauuugucuuuaau

SEQ ID NO: 344489 - RNA, 22 nt, Human
cuucagaauccagaaucagaau

SEQ ID NO: 344490 - RNA, 22 nt, Human
gaggcagcuggguccggucggg

SEQ ID NO: 344491 - RNA, 22 nt, Human
gcugaaugaauguauuuuaaaa

SEQ ID NO: 344492 - RNA, 22 nt, Human
aggcagcugcccucuccuuccu

SEQ ID NO: 344493 - RNA, 22 nt, Human
aggagaggaaucauuauuacaa

SEQ ID NO: 344494 - RNA, 22 nt, Human
cccaggaaugggaaggaggaau

SEQ ID NO: 344495 - RNA, 22 nt, Human
uagcacaucuggcgcuuauagg

SEQ ID NO: 344496 - RNA, 22 nt, Human
gugguaauagagcuccaaacua

SEQ ID NO: 344497 - RNA, 22 nt, Human
gaggaggccaguggaaggaagc

SEQ ID NO: 344498 - RNA, 22 nt, Human
cucuucucugcagccuuugaag

SEQ ID NO: 344499 - RNA, 22 nt, Human
aaaguucuggcauuuucugucu

SEQ ID NO: 344500 - RNA, 22 nt, Human
ccagguaggagagagggauccu

SEQ ID NO: 344501 - RNA, 20 nt, Human
cugcuguguuauuguagaac

SEQ ID NO: 344502 - RNA, 22 nt, Human
agggagcugagcugugagcagc

SEQ ID NO: 344503 - RNA, 22 nt, Human
aaauacagaguugcuuaaaagc

SEQ ID NO: 344504 - RNA, 22 nt, Human
uugcauuuccuguacuguuuga

SEQ ID NO: 344505 - RNA, 22 nt, Human
uucugucaaagacuuuuucagg

SEQ ID NO: 344506 - RNA, 22 nt, Human
cagucuucuaaccuagcagccu

SEQ ID NO: 344507 - RNA, 22 nt, Human
uauaaaguuucgaaagauguau

SEQ ID NO: 344508 - RNA, 22 nt, Human
aggcagcguagcaaggcuagua

SEQ ID NO: 344509 - RNA, 22 nt, Human
cucuucuugucucugguuagaa

SEQ ID NO: 344510 - RNA, 22 nt, Human
gggcagcuggauaguuuuaaau

SEQ ID NO: 344511 - RNA, 17 nt, Human
gaggacagggaaguagg

SEQ ID NO: 344512 - RNA, 22 nt, Human
auauauuugagaauauucauga

SEQ ID NO: 344513 - RNA, 22 nt, Human
gucaaaaaguagucauuucugu

SEQ ID NO: 344514 - RNA, 22 nt, Human
aaauuauaggugccaccuugga

SEQ ID NO: 344515 - RNA, 22 nt, Human
agaggaugguugaggaagaccu

SEQ ID NO: 344516 - RNA, 22 nt, Human
ucccaggaugaagacaguguug

SEQ ID NO: 344517 - RNA, 22 nt, Human
ggcaggcugggugucauggagu

SEQ ID NO: 344518 - RNA, 22 nt, Human
ucugucccugagagcucaggag

SEQ ID NO: 344519 - RNA, 22 nt, Human
uaaaauagcaugugcagugaaa

SEQ ID NO: 344520 - RNA, 22 nt, Human
cucagaauuuagggcucugagg

SEQ ID NO: 344521 - RNA, 22 nt, Human
gugucccaggccucuggaauua

SEQ ID NO: 344522 - RNA, 22 nt, Human
cucugauuuccuuauucuguca

SEQ ID NO: 344523 - RNA, 22 nt, Human
auuuguagugaagugaaaauaa

SEQ ID NO: 344524 - RNA, 22 nt, Human
ccucagggaaugggaggcuggg

SEQ ID NO: 344525 - RNA, 22 nt, Human
cuugaaagucacaugcagcccu

SEQ ID NO: 344526 - RNA, 22 nt, Human
uuuugcuugagugcacaaaaug

SEQ ID NO: 344527 - RNA, 22 nt, Human
agggcagccauugagggauucu

SEQ ID NO: 344528 - RNA, 22 nt, Human
ucugcugucacucauuugcuuc

SEQ ID NO: 344529 - RNA, 22 nt, Human
ggacuucuaagugccagacacu

SEQ ID NO: 344530 - RNA, 22 nt, Human
caguucuuuguggggaguucuc

SEQ ID NO: 344531 - RNA, 22 nt, Human
auuugcuuucagguauaaaagg

SEQ ID NO: 344532 - RNA, 22 nt, Human
ugucccucugaggcuucccugg

SEQ ID NO: 344533 - RNA, 22 nt, Human
ggcagucuuaucagcauuggac

SEQ ID NO: 344534 - RNA, 22 nt, Human
agcugcccugggcuggagaugg

SEQ ID NO: 344535 - RNA, 19 nt, Human
gccaggagggcucuggcug

SEQ ID NO: 344536 - RNA, 22 nt, Human
ugcugcuguuuccuacaucuca

SEQ ID NO: 344537 - RNA, 22 nt, Human
cuugcugucuugcauuuagagc

SEQ ID NO: 344538 - RNA, 22 nt, Human
ugaguuuugucuugcuagaagu

SEQ ID NO: 344539 - RNA, 20 nt, Human
uucacagaggacucagguca

SEQ ID NO: 344540 - RNA, 20 nt, Human
cugcugugauucccuccucc

SEQ ID NO: 344541 - RNA, 22 nt, Human
uacagcauguccuuagcaaggc

SEQ ID NO: 344542 - RNA, 22 nt, Human
uuauuuaaugugaucugaagag

SEQ ID NO: 344543 - RNA, 22 nt, Human
ucuucuucccaucccucaaaug

SEQ ID NO: 344544 - RNA, 22 nt, Human
ucuucucuccugcuuggcagaa

SEQ ID NO: 344545 - RNA, 20 nt, Human
uucaggauucuagaccacac

SEQ ID NO: 344546 - RNA, 22 nt, Human
cuugggaaugcuaacagaugac

SEQ ID NO: 344547 - RNA, 22 nt, Human
ggcagcuucucccaggcuguuu

SEQ ID NO: 344548 - RNA, 22 nt, Human
augaguucaauuguuucaguca

SEQ ID NO: 344549 - RNA, 22 nt, Human
aucugucaagauagacucugca

SEQ ID NO: 344550 - RNA, 22 nt, Human
uucaggaugaaagugugcaaca

SEQ ID NO: 344551 - RNA, 22 nt, Human
aguuugaaauguuggcaauauu

SEQ ID NO: 344552 - RNA, 22 nt, Human
uuccaugacaccgagggaaguc

SEQ ID NO: 344553 - RNA, 22 nt, Human
ccacagagcauuagauuucaga

SEQ ID NO: 344554 - RNA, 22 nt, Human
uugugcucuguguuauuuaagg

SEQ ID NO: 344555 - RNA, 22 nt, Human
uagaauucaagauucaacaggc

SEQ ID NO: 344556 - RNA, 22 nt, Human
ggcaggcaaugaggaugggaag

SEQ ID NO: 344557 - RNA, 18 nt, Human
uuugcaaaggaaguaugg

SEQ ID NO: 344558 - RNA, 22 nt, Human
gaugagcauuguuucauguguu

SEQ ID NO: 344559 - RNA, 22 nt, Human
uccaggagauucauuaggucau

SEQ ID NO: 344560 - RNA, 22 nt, Human
ccagugcuaagguagccucugc

SEQ ID NO: 344561 - RNA, 22 nt, Human
ggugaagggccuuaggagacag

SEQ ID NO: 344562 - RNA, 22 nt, Human
gcccaggagccuggagaugugu

SEQ ID NO: 344563 - RNA, 21 nt, Human
ucacagacuggucagugaggc

SEQ ID NO: 344564 - RNA, 21 nt, Human
uaauaauuccacuacagagua

SEQ ID NO: 344565 - RNA, 15 nt, Human
caggagaggaagguu

SEQ ID NO: 344566 - RNA, 22 nt, Human
ugugaaagcaagucuaguucuc

SEQ ID NO: 344567 - RNA, 22 nt, Human
cccaggaguuggaggcuacggu

SEQ ID NO: 344568 - RNA, 22 nt, Human
ugcacauucacuuagguauugu

SEQ ID NO: 344569 - RNA, 22 nt, Human
aagaagagaaaugugcugcugg

SEQ ID NO: 344570 - RNA, 22 nt, Human
uguaugaaccuuuaauauagug

SEQ ID NO: 344571 - RNA, 22 nt, Human
gucaggaugagggaugaggagu

SEQ ID NO: 344572 - RNA, 19 nt, Human
ucugccucuggucaggcuc

SEQ ID NO: 344573 - RNA, 22 nt, Human
uucuuuucuuuaggcauugugu

SEQ ID NO: 344574 - RNA, 22 nt, Human
ugcugcugaucauuuauagucu

SEQ ID NO: 344575 - RNA, 22 nt, Human
ggaagagggaaccacgacugua

SEQ ID NO: 344576 - RNA, 22 nt, Human
uaucuguuaugggcugaauugc

SEQ ID NO: 344577 - RNA, 23 nt, Human
ggagaggggugugggcaucuuua

SEQ ID NO: 344578 - RNA, 22 nt, Human
aagcagcuuuugaagagugagg

SEQ ID NO: 344579 - RNA, 22 nt, Human
guuuucaauuauaagauggcuu

SEQ ID NO: 344580 - RNA, 22 nt, Human
acaucucaugaaugauaaauca

SEQ ID NO: 344581 - RNA, 22 nt, Human
caguuucuacgaaggucaaccc

SEQ ID NO: 344582 - RNA, 19 nt, Human
guugaaaguaggugagggu

SEQ ID NO: 344583 - RNA, 22 nt, Human
guccaugauucuguguaguaga

SEQ ID NO: 344584 - RNA, 22 nt, Human
cucaggaugcaauuccaucaag

SEQ ID NO: 344585 - RNA, 22 nt, Human
aggguggcuggaggaaucagaa

SEQ ID NO: 344586 - RNA, 22 nt, Human
uagugcuugagucucuccguac

SEQ ID NO: 344587 - RNA, 22 nt, Human
gccacaggcacuuaagggcugg

SEQ ID NO: 344588 - RNA, 21 nt, Human
uucuucaguuuaauauaaaau

SEQ ID NO: 344589 - RNA, 22 nt, Human
ccugccugcaccuucucugggg

SEQ ID NO: 344590 - RNA, 22 nt, Human
acauaugugcuuauauccauga

SEQ ID NO: 344591 - RNA, 22 nt, Human
aggcacaguuucauccccgggc

SEQ ID NO: 344592 - RNA, 21 nt, Human
cagcagaguaaugcauucgua

SEQ ID NO: 344593 - RNA, 22 nt, Human
uuccucagaaaauacuguccaa

SEQ ID NO: 344594 - RNA, 23 nt, Human
cagggaggagauacuguguaucu

SEQ ID NO: 344595 - RNA, 22 nt, Human
aggcagcuggaggcagagacua

SEQ ID NO: 344596 - RNA, 22 nt, Human
gugcauuugacgaauacucacu

SEQ ID NO: 344597 - RNA, 22 nt, Human
auugaaaggcaaaguaggaagc

SEQ ID NO: 344598 - RNA, 20 nt, Human
gcccaggaucucugaggcau

SEQ ID NO: 344599 - RNA, 22 nt, Human
uggcaggcagugugggagcugg

SEQ ID NO: 344600 - RNA, 22 nt, Human
augcugugccuggaaagcggcu

SEQ ID NO: 344601 - RNA, 22 nt, Human
ggccagaaguuggaaaagagcc

SEQ ID NO: 344602 - RNA, 22 nt, Human
aggcugcucaguagauggagcu

SEQ ID NO: 344603 - RNA, 22 nt, Human
ucacacagguuugcaaugauuu

SEQ ID NO: 344604 - RNA, 22 nt, Human
auucuucaucacuaccuuguga

SEQ ID NO: 344605 - RNA, 22 nt, Human
ucugaaaugcaaauuugacuga

SEQ ID NO: 344606 - RNA, 22 nt, Human
ggaggggauuuaguagaugcua

SEQ ID NO: 344607 - RNA, 22 nt, Human
aguuugaauugaaaugcagaug

SEQ ID NO: 344608 - RNA, 22 nt, Human
uaauacagaaguguauuaaaau

SEQ ID NO: 344609 - RNA, 23 nt, Human
aggauguaggauguauggcagag

SEQ ID NO: 344610 - RNA, 22 nt, Human
auguuuuugagauacaaacaga

SEQ ID NO: 344611 - RNA, 22 nt, Human
ucagucuuugcuuaugacaaua

SEQ ID NO: 344612 - RNA, 22 nt, Human
aagcagcuggaagaguaagaug

SEQ ID NO: 344613 - RNA, 22 nt, Human
agcauccaacaggagggaaggg

SEQ ID NO: 344614 - RNA, 22 nt, Human
ucaguagcagaaagcaaugagu

SEQ ID NO: 344615 - RNA, 22 nt, Human
uaacacauaagcugagaccaug

SEQ ID NO: 344616 - RNA, 22 nt, Human
cugggaaauggcuucgagcuca

SEQ ID NO: 344617 - RNA, 22 nt, Human
ucagucucaucaacucuauucc

SEQ ID NO: 344618 - RNA, 22 nt, Human
uguauuuuuagaccuuuagacc

SEQ ID NO: 344619 - RNA, 22 nt, Human
agugcuuugugcucucacugca

SEQ ID NO: 344620 - RNA, 22 nt, Human
gagaggcagaggccugaaaccg

SEQ ID NO: 344621 - RNA, 22 nt, Human
uaggcagcugcaaacuucgguc

SEQ ID NO: 344622 - RNA, 20 nt, Human
auacacauauucuugcaacu

SEQ ID NO: 344623 - RNA, 22 nt, Human
uaaggccaauuacauauguuca

SEQ ID NO: 344624 - RNA, 22 nt, Human
uuuagacauggcuugcucacuu

SEQ ID NO: 344625 - RNA, 22 nt, Human
cugccuccugccgugcagcuuc

SEQ ID NO: 344626 - RNA, 22 nt, Human
uaauuauuaugacaacaauugc

SEQ ID NO: 344627 - RNA, 22 nt, Human
uugacaauguccuuugaauuuc

SEQ ID NO: 344628 - RNA, 23 nt, Human
uccuuccuuugagaggcuccauc

SEQ ID NO: 344629 - RNA, 23 nt, Human
uuuuccuguggagacaugacugg

SEQ ID NO: 344630 - RNA, 22 nt, Human
ccuccucugggaagauucagag

SEQ ID NO: 344631 - RNA, 22 nt, Human
ucuucccuaaucaccaucuuca

SEQ ID NO: 344632 - RNA, 22 nt, Human
cauaauuucacugucguauggc

SEQ ID NO: 344633 - RNA, 22 nt, Human
gcaccugauugauuucacugcu

SEQ ID NO: 344634 - RNA, 17 nt, Human
aagagaggcugagcugg

SEQ ID NO: 344635 - RNA, 22 nt, Human
aggacaggauugagcugaacug

SEQ ID NO: 344636 - RNA, 22 nt, Human
uuuuaucugcuucauuaguuga

SEQ ID NO: 344637 - RNA, 22 nt, Human
augcuguggggagugaggguag

SEQ ID NO: 344638 - RNA, 22 nt, Human
acuguagcugccacuggaugca

SEQ ID NO: 344639 - RNA, 22 nt, Human
acaaaguuugugguauuccaag

SEQ ID NO: 344640 - RNA, 20 nt, Human
uggaaguucuguugcauugg

SEQ ID NO: 344641 - RNA, 22 nt, Human
uucaacuagauuuauacaauuc

SEQ ID NO: 344642 - RNA, 23 nt, Human
acacauuuuucccguucugaggu

SEQ ID NO: 344643 - RNA, 22 nt, Human
ucccaggacccaggcauucaca

SEQ ID NO: 344644 - RNA, 22 nt, Human
uccaggaguuugaccugugggc

SEQ ID NO: 344645 - RNA, 22 nt, Human
aggcagccaaucagaggcugac

SEQ ID NO: 344646 - RNA, 22 nt, Human
agaggcaggagguugacuugag

SEQ ID NO: 344647 - RNA, 22 nt, Human
caaauguauucucacuucaggg

SEQ ID NO: 344648 - RNA, 22 nt, Human
auuggcaguuagugacgaggcu

SEQ ID NO: 344649 - RNA, 22 nt, Human
auuuccaguccuaaugaucugg

SEQ ID NO: 344650 - RNA, 22 nt, Human
acagugcuggcuacaacccugg

SEQ ID NO: 344651 - RNA, 22 nt, Human
uaugaaacauucauacaaauaa

SEQ ID NO: 344652 - RNA, 22 nt, Human
ccuggagauuucuucaagcuuu

SEQ ID NO: 344653 - RNA, 22 nt, Human
accaggaguuuugaccaggggc

SEQ ID NO: 344654 - RNA, 22 nt, Human
aaguugagaugucauaggagac

SEQ ID NO: 344655 - RNA, 22 nt, Human
uacaaagucacauugaaaugaa

SEQ ID NO: 344656 - RNA, 21 nt, Human
ucacaucuauguuaagcaaac

SEQ ID NO: 344657 - RNA, 22 nt, Human
cggcagcuccgcgccguaggac

SEQ ID NO: 344658 - RNA, 22 nt, Human
cugcuucuccaaaguaggacuu

SEQ ID NO: 344659 - RNA, 22 nt, Human
aucugucaucagcaccacaggu

SEQ ID NO: 344660 - RNA, 22 nt, Human
augcuacauuuugguuuauaaa

SEQ ID NO: 344661 - RNA, 22 nt, Human
gggcagcugccaagugcaucgc

SEQ ID NO: 344662 - RNA, 22 nt, Human
acauuuagaguucuuuacucca

SEQ ID NO: 344663 - RNA, 22 nt, Human
ugagaaaugggucugcugaaga

SEQ ID NO: 344664 - RNA, 22 nt, Human
aaagccauugaacuguacuuua

SEQ ID NO: 344665 - RNA, 22 nt, Human
aggaugaauaacugaaauggug

SEQ ID NO: 344666 - RNA, 22 nt, Human
uuucugaaaucucuuuugagga

SEQ ID NO: 344667 - RNA, 22 nt, Human
cagcuggcaaguggagcagggu

SEQ ID NO: 344668 - RNA, 22 nt, Human
aauaacuuaagaaauuucccca

SEQ ID NO: 344669 - RNA, 22 nt, Human
uagcauuuauuccagauuugga

SEQ ID NO: 344670 - RNA, 22 nt, Human
gcccaggauggcuggaggugcu

SEQ ID NO: 344671 - RNA, 22 nt, Human
ucacugcugcugccaugaugga

SEQ ID NO: 344672 - RNA, 22 nt, Human
gccaggagaaaaggcgaaugau

SEQ ID NO: 344673 - RNA, 22 nt, Human
auuucauugaaguuaauucuuc

SEQ ID NO: 344674 - RNA, 22 nt, Human
ggggcagcuaccggaaguaggg

SEQ ID NO: 344675 - RNA, 22 nt, Human
gaggcugccccuuccucagcug

SEQ ID NO: 344676 - RNA, 22 nt, Human
cauuuacuuaaaucuuuacaag

SEQ ID NO: 344677 - RNA, 22 nt, Human
gcccaggauggagaauaguggu

SEQ ID NO: 344678 - RNA, 22 nt, Human
gaggggcagagguagagaacaa

SEQ ID NO: 344679 - RNA, 22 nt, Human
ugcuguguucuccugacucacc

SEQ ID NO: 344680 - RNA, 22 nt, Human
uucaauucugcucugaucuuag

SEQ ID NO: 344681 - RNA, 19 nt, Human
agaggcagucuccaacagg

SEQ ID NO: 344682 - RNA, 22 nt, Human
uuugcaaagugacuauuauaug

SEQ ID NO: 344683 - RNA, 22 nt, Human
cagagccacuuggagaugagaa

SEQ ID NO: 344684 - RNA, 22 nt, Human
ugccugugguuccaguuuuuuc

SEQ ID NO: 344685 - RNA, 22 nt, Human
uuguaugaucaaaagaaaugua

SEQ ID NO: 344686 - RNA, 20 nt, Human
cucaggauacugcaaaguug

SEQ ID NO: 344687 - RNA, 22 nt, Human
uugaacuguaagcaugucugcc

SEQ ID NO: 344688 - RNA, 22 nt, Human
aaaguuuguuauaugauaagga

SEQ ID NO: 344689 - RNA, 22 nt, Human
uaugaaaugguaguaggaaggg

SEQ ID NO: 344690 - RNA, 22 nt, Human
acaaaugugucuaauugugccu

SEQ ID NO: 344691 - RNA, 20 nt, Human
ucacuaguaaccaucugcuu

SEQ ID NO: 344692 - RNA, 22 nt, Human
ugugauauuugaguauugucaa

SEQ ID NO: 344693 - RNA, 22 nt, Human
ucuuugcagaauuuaacuuugc

SEQ ID NO: 344694 - RNA, 22 nt, Human
augcuguggccagaguucaacu

SEQ ID NO: 344695 - RNA, 22 nt, Human
cugucauuuaagacauucugga

SEQ ID NO: 344696 - RNA, 22 nt, Human
gauuuuauauggcauacugugg

SEQ ID NO: 344697 - RNA, 22 nt, Human
caacauuucaaggucuuuagga

SEQ ID NO: 344698 - RNA, 22 nt, Human
gaaucucaguggaagcaggaag

SEQ ID NO: 344699 - RNA, 18 nt, Human
uuccaugauuccuuucac

SEQ ID NO: 344700 - RNA, 23 nt, Human
ucaggauauugugugccaaggug

SEQ ID NO: 344701 - RNA, 22 nt, Human
caggauggugugagugugagga

SEQ ID NO: 344702 - RNA, 22 nt, Human
agagcagcuggggcagagacca

SEQ ID NO: 344703 - RNA, 22 nt, Human
accgaaggaaacuggaaccguu

SEQ ID NO: 344704 - RNA, 22 nt, Human
ucucagucuuugcaaggaugcu

SEQ ID NO: 344705 - RNA, 22 nt, Human
ugaaagguuauuuaggucugcu

SEQ ID NO: 344706 - RNA, 22 nt, Human
aucuguuccccuaugcucucua

SEQ ID NO: 344707 - RNA, 22 nt, Human
uguaugaauauguuggggaggu

SEQ ID NO: 344708 - RNA, 22 nt, Human
auccaugauuaguaggauaaag

SEQ ID NO: 344709 - RNA, 22 nt, Human
cagcugcuguuacugcuuauua

SEQ ID NO: 344710 - RNA, 22 nt, Human
uuucaguuuccagcuuugucau

SEQ ID NO: 344711 - RNA, 22 nt, Human
aaggcagcuucaccacagcauu

SEQ ID NO: 344712 - RNA, 22 nt, Human
guggcaggagagacacagccau

SEQ ID NO: 344713 - RNA, 22 nt, Human
aagaacuuccuaauauauuuuc

SEQ ID NO: 344714 - RNA, 22 nt, Human
ugaggcagaguaagauacauga

SEQ ID NO: 344715 - RNA, 22 nt, Human
auuggcagaaacagcagggcca

SEQ ID NO: 344716 - RNA, 22 nt, Human
cuuugaauugccguuucaucug

SEQ ID NO: 344717 - RNA, 22 nt, Human
agcugcccagcuaggaagaagg

SEQ ID NO: 344718 - RNA, 22 nt, Human
aagcagaggaccgacggaggga

SEQ ID NO: 344719 - RNA, 22 nt, Human
acacauauucauauguacuuac

SEQ ID NO: 344720 - RNA, 22 nt, Human
uggcagcuguuaauguuuuguu

SEQ ID NO: 344721 - RNA, 22 nt, Human
auggcagccugagcagaggaau

SEQ ID NO: 344722 - RNA, 22 nt, Human
acuuuacaagcuuauagccuag

SEQ ID NO: 344723 - RNA, 22 nt, Human
ucauuugugugagugauuugac

SEQ ID NO: 344724 - RNA, 22 nt, Human
gaggccaaucaauagggcaaua

SEQ ID NO: 344725 - RNA, 22 nt, Human
auugcuguacacuucuagaucu

SEQ ID NO: 344726 - RNA, 21 nt, Human
aggcaucuaaagagaguagac

SEQ ID NO: 344727 - RNA, 22 nt, Human
aacauuucagcaaauaagaaca

SEQ ID NO: 344728 - RNA, 22 nt, Human
uccauuuuguagguaugcuaca

SEQ ID NO: 344729 - RNA, 22 nt, Human
uucagcaaacacgaugcuuguu

SEQ ID NO: 344730 - RNA, 22 nt, Human
agacucaagcagauaggaauua

SEQ ID NO: 344731 - RNA, 22 nt, Human
gccaggaggggagaguguguca

SEQ ID NO: 344732 - RNA, 22 nt, Human
uucuucaaauagcagggaguca

SEQ ID NO: 344733 - RNA, 20 nt, Human
cuguggaauuuuaccaugcg

SEQ ID NO: 344734 - RNA, 20 nt, Human
aggacagcagcugccacuug

SEQ ID NO: 344735 - RNA, 22 nt, Human
uauugaaauucuucauguccuc

SEQ ID NO: 344736 - RNA, 22 nt, Human
agcugcccagauaggaggaggc

SEQ ID NO: 344737 - RNA, 22 nt, Human
uuucuucagagagagcuuuccc

SEQ ID NO: 344738 - RNA, 22 nt, Human
ugaaacuucuaauaugaauagu

SEQ ID NO: 344739 - RNA, 22 nt, Human
ccaggaagcugucugauaugaa

SEQ ID NO: 344740 - RNA, 22 nt, Human
gaggcagccagagguucucauu

SEQ ID NO: 344741 - RNA, 22 nt, Human
ggcagcuuguccuucaggagag

SEQ ID NO: 344742 - RNA, 22 nt, Human
uaauaucuacuucauagaguuu

SEQ ID NO: 344743 - RNA, 22 nt, Human
ggcagcucacgggcauggggug

SEQ ID NO: 344744 - RNA, 22 nt, Human
aggacagcaguuggugagguuc

SEQ ID NO: 344745 - RNA, 23 nt, Human
auucuucauuaucuucuagaaaa

SEQ ID NO: 344746 - RNA, 22 nt, Human
ugaaaugauguacaagaaggca

SEQ ID NO: 344747 - RNA, 22 nt, Human
uuuaaaauuuagaccucuccac

SEQ ID NO: 344748 - RNA, 22 nt, Human
gcugucccgcugacuuccagcu

SEQ ID NO: 344749 - RNA, 22 nt, Human
acccaggacaaaauaaccaggu

SEQ ID NO: 344750 - RNA, 21 nt, Human
gauugaaaccauggcagugag

SEQ ID NO: 344751 - RNA, 23 nt, Human
uggaaagcggaccuggggcagag

SEQ ID NO: 344752 - RNA, 21 nt, Human
uucugggaaaugagcuggggc

SEQ ID NO: 344753 - RNA, 22 nt, Human
agcagagguuuguuggaaaccu

SEQ ID NO: 344754 - RNA, 22 nt, Human
auucuucaguauguguggauug

SEQ ID NO: 344755 - RNA, 18 nt, Human
uggcagcaggaagccauu

SEQ ID NO: 344756 - RNA, 22 nt, Human
ucucuucucuagugagcaacug

SEQ ID NO: 344757 - RNA, 22 nt, Human
aaggccagacaggaccacaucu

SEQ ID NO: 344758 - RNA, 22 nt, Human
uuucauggcuaggacuagagug

SEQ ID NO: 344759 - RNA, 22 nt, Human
ccaggcagcaaauuuucugaau

SEQ ID NO: 344760 - RNA, 22 nt, Human
uaaggccaccguuauagaacca

SEQ ID NO: 344761 - RNA, 22 nt, Human
cccaggaggcagagcuugcagu

SEQ ID NO: 344762 - RNA, 22 nt, Human
acugugugacuguuauuacugu

SEQ ID NO: 344763 - RNA, 22 nt, Human
ucucaggaagugauauugagac

SEQ ID NO: 344764 - RNA, 22 nt, Human
uuugacaaauccuucagcaaug

SEQ ID NO: 344765 - RNA, 23 nt, Human
aggcccaacucugugagggcugc

SEQ ID NO: 344766 - RNA, 22 nt, Human
gaggacagagccgccuggcaag

SEQ ID NO: 344767 - RNA, 22 nt, Human
aaaguauucuugacuguuuuuc

SEQ ID NO: 344768 - RNA, 22 nt, Human
uuagcaucugcuguaagcuuau

SEQ ID NO: 344769 - RNA, 22 nt, Human
gaggcagcgggucaggaccgug

SEQ ID NO: 344770 - RNA, 20 nt, Human
aucuucuuggccagcuugcu

SEQ ID NO: 344771 - RNA, 22 nt, Human
aggggcucaaagugugcaggga

SEQ ID NO: 344772 - RNA, 22 nt, Human
uucuucaauuuuccauauacug

SEQ ID NO: 344773 - RNA, 22 nt, Human
acauugcugcauucuccuuccc

SEQ ID NO: 344774 - RNA, 22 nt, Human
gauggcagcagcagccagggau

SEQ ID NO: 344775 - RNA, 22 nt, Human
ugcuagaaaucugaaacuagca

SEQ ID NO: 344776 - RNA, 22 nt, Human
agagggauggccccguaacuca

SEQ ID NO: 344777 - RNA, 22 nt, Human
aaauaguuacuucugcugucuu

SEQ ID NO: 344778 - RNA, 21 nt, Human
cgcagagcgaacuugcggcgc

SEQ ID NO: 344779 - RNA, 22 nt, Human
guguugaugacauuuuagaaac

SEQ ID NO: 344780 - RNA, 22 nt, Human
cacauauuguaguucaccagga

SEQ ID NO: 344781 - RNA, 22 nt, Human
augacaugaccugguagagaca

SEQ ID NO: 344782 - RNA, 22 nt, Human
cuucuucagcacaauauugaug

SEQ ID NO: 344783 - RNA, 22 nt, Human
aucacauuguuagcauagacug

SEQ ID NO: 344784 - RNA, 22 nt, Human
uagcucuucauuucaucugauu

SEQ ID NO: 344785 - RNA, 22 nt, Human
aucaggauggguuuggcuuagg

SEQ ID NO: 344786 - RNA, 22 nt, Human
caaggccaguuucuccuaguca

SEQ ID NO: 344787 - RNA, 22 nt, Human
uuugacaucuaagaauucuuac

SEQ ID NO: 344788 - RNA, 22 nt, Human
uuaaaugaggcugauguagauu

SEQ ID NO: 344789 - RNA, 21 nt, Human
aaauacagaaacuuguuuuca

SEQ ID NO: 344790 - RNA, 17 nt, Human
agauggcaggaggcaga

SEQ ID NO: 344791 - RNA, 22 nt, Human
cccaggaaagagacugcugggu

SEQ ID NO: 344792 - RNA, 23 nt, Human
agaugagccaacaccuccaugcc

SEQ ID NO: 344793 - RNA, 22 nt, Human
gaggcugcuguuagcccugggc

SEQ ID NO: 344794 - RNA, 22 nt, Human
uacaaguaaauuguagauacca

SEQ ID NO: 344795 - RNA, 22 nt, Human
aaauacauacacuguacguggc

SEQ ID NO: 344796 - RNA, 22 nt, Human
cccuguacagucucuguggcac

SEQ ID NO: 344797 - RNA, 22 nt, Human
uuuccucauuuaucugcuggga

SEQ ID NO: 344798 - RNA, 22 nt, Human
aggcacaggaaugucauccagu

SEQ ID NO: 344799 - RNA, 22 nt, Human
agucuacaaucuuaaaugaacu

SEQ ID NO: 344800 - RNA, 22 nt, Human
ggaggggagucucccaaagccg

SEQ ID NO: 344801 - RNA, 22 nt, Human
uaauacuguauacugcaaauuu

SEQ ID NO: 344802 - RNA, 22 nt, Human
uaggaggguuagagggaaauau

SEQ ID NO: 344803 - RNA, 22 nt, Human
gauggcagcauauugacagcau

SEQ ID NO: 344804 - RNA, 19 nt, Human
caggaaggggcgaaucugg

SEQ ID NO: 344805 - RNA, 22 nt, Human
cccuggaggucagaggccuggg

SEQ ID NO: 344806 - RNA, 22 nt, Human
gcucaggaccgaggggugggaa

SEQ ID NO: 344807 - RNA, 22 nt, Human
uuuauucaucaucuguucauau

SEQ ID NO: 344808 - RNA, 22 nt, Human
gagggaugguaguugacacuga

SEQ ID NO: 344809 - RNA, 22 nt, Human
uuccaugaagggcagccucuca

SEQ ID NO: 344810 - RNA, 22 nt, Human
gcuggcaggagccuuucccuuu

SEQ ID NO: 344811 - RNA, 21 nt, Human
acagcaagccuucacaugagu

SEQ ID NO: 344812 - RNA, 22 nt, Human
uccauuuucaucucauguauaa

SEQ ID NO: 344813 - RNA, 23 nt, Human
uccaggagcaugcuggcuggcga

SEQ ID NO: 344814 - RNA, 22 nt, Human
cauaugaaauaugaguugaaca

SEQ ID NO: 344815 - RNA, 22 nt, Human
gcaggggcuaaggacacagaga

SEQ ID NO: 344816 - RNA, 22 nt, Human
uugaaauggaagugaaaauucu

SEQ ID NO: 344817 - RNA, 22 nt, Human
augcagcuucaggauuaugaug

SEQ ID NO: 344818 - RNA, 22 nt, Human
gucauucuuaacaacucaguag

SEQ ID NO: 344819 - RNA, 22 nt, Human
ggaagaggaggagccaggcuuu

SEQ ID NO: 344820 - RNA, 22 nt, Human
gguuugaacagcuuuggagaag

SEQ ID NO: 344821 - RNA, 22 nt, Human
ugaggggaaggcaugauaaaua

SEQ ID NO: 344822 - RNA, 22 nt, Human
uugaaagacuucuccugugaaa

SEQ ID NO: 344823 - RNA, 22 nt, Human
agauggcagggguaccuggaag

SEQ ID NO: 344824 - RNA, 22 nt, Human
ggagcacuauaauagagauuuu

SEQ ID NO: 344825 - RNA, 22 nt, Human
acuuugcagggcuugauaucca

SEQ ID NO: 344826 - RNA, 22 nt, Human
ccagcagaggggcggagugcag

SEQ ID NO: 344827 - RNA, 22 nt, Human
accaggaguaacagugaguggu

SEQ ID NO: 344828 - RNA, 22 nt, Human
uuuuuaguagagguggguuuca

SEQ ID NO: 344829 - RNA, 22 nt, Human
uuauucuucuucucuugccagg

SEQ ID NO: 344830 - RNA, 22 nt, Human
aaaguucuaaaacucuuuguga

SEQ ID NO: 344831 - RNA, 22 nt, Human
uagggcagagcuuguacacgau

SEQ ID NO: 344832 - RNA, 22 nt, Human
cgaggcagaggcugaaacggcu

SEQ ID NO: 344833 - RNA, 22 nt, Human
uccaggaggcagggcugugccc

SEQ ID NO: 344834 - RNA, 22 nt, Human
acuucaugcagaagagagcugu

SEQ ID NO: 344835 - RNA, 22 nt, Human
caaaguuuuaguaaacauauau

SEQ ID NO: 344836 - RNA, 22 nt, Human
ugaaagguagcuggccucauag

SEQ ID NO: 344837 - RNA, 22 nt, Human
ccagagagauugcuucuaaaga

SEQ ID NO: 344838 - RNA, 22 nt, Human
aggaaaggccuuugcauuuggu

SEQ ID NO: 344839 - RNA, 22 nt, Human
auuuugcuggucugaauuacuu

SEQ ID NO: 344840 - RNA, 22 nt, Human
ggagaggguguggaaaguuauc

SEQ ID NO: 344841 - RNA, 22 nt, Human
uuugaaugcaggacauacagaa

SEQ ID NO: 344842 - RNA, 22 nt, Human
uacuuacacagcuguagaaggu

SEQ ID NO: 344843 - RNA, 22 nt, Human
caggcaggucagugaagaagga

SEQ ID NO: 344844 - RNA, 22 nt, Human
ucucugaguauccugaacugcc

SEQ ID NO: 344845 - RNA, 22 nt, Human
uuugaaagggacaaagucacug

SEQ ID NO: 344846 - RNA, 22 nt, Human
auauuucaugggguuccauacu

SEQ ID NO: 344847 - RNA, 22 nt, Human
ugagagggcccagagcacacca

SEQ ID NO: 344848 - RNA, 22 nt, Human
gaaggccauuagagccugugcc

SEQ ID NO: 344849 - RNA, 21 nt, Human
cccaggaggcugagaagagca

SEQ ID NO: 344850 - RNA, 22 nt, Human
caucaucaaaagugacagagaa

SEQ ID NO: 344851 - RNA, 22 nt, Human
aauuuuaaucaguggugcugag

SEQ ID NO: 344852 - RNA, 22 nt, Human
augcugugucaggaauuugaua

SEQ ID NO: 344853 - RNA, 22 nt, Human
uggaaggaagccaaggaagguu

SEQ ID NO: 344854 - RNA, 22 nt, Human
ugaggcaguucuuacuuguauu

SEQ ID NO: 344855 - RNA, 22 nt, Human
agaccaagacuauaaugagagg

SEQ ID NO: 344856 - RNA, 23 nt, Human
ugugaaauuugaggucagugcuu

SEQ ID NO: 344857 - RNA, 22 nt, Human
aaaaacuguaauuacuuuugca

SEQ ID NO: 344858 - RNA, 22 nt, Human
uuugaauaucacaaacuuucaa

SEQ ID NO: 344859 - RNA, 22 nt, Human
auguuuccgugagcauccuuga

SEQ ID NO: 344860 - RNA, 22 nt, Human
aggaagcuccaugaaggcagag

SEQ ID NO: 344861 - RNA, 22 nt, Human
acauuuuuuagagucccacauu

SEQ ID NO: 344862 - RNA, 22 nt, Human
uucauucuugggaucagagagu

SEQ ID NO: 344863 - RNA, 22 nt, Human
agggcagcccuucugggagggc

SEQ ID NO: 344864 - RNA, 22 nt, Human
auacuguuuugugacuuaucuu

SEQ ID NO: 344865 - RNA, 22 nt, Human
caggagaaauguggcugcuacc

SEQ ID NO: 344866 - RNA, 22 nt, Human
caggggaguuuuaugcaacaga

SEQ ID NO: 344867 - RNA, 22 nt, Human
auguaugaagcuuuguuuggga

SEQ ID NO: 344868 - RNA, 22 nt, Human
gaauaguucuauggcugcaggg

SEQ ID NO: 344869 - RNA, 22 nt, Human
uuucucuugcgauaugcuacac

SEQ ID NO: 344870 - RNA, 22 nt, Human
cuagccaugggcauuaaaggua

SEQ ID NO: 344871 - RNA, 22 nt, Human
auccagucaaaauuaguaaggu

SEQ ID NO: 344872 - RNA, 22 nt, Human
cuucucagcauuuugucagucu

SEQ ID NO: 344873 - RNA, 22 nt, Human
cuguuuaucucuaaccuguuua

SEQ ID NO: 344874 - RNA, 22 nt, Human
aaaguguggucguucauuuugu

SEQ ID NO: 344875 - RNA, 23 nt, Human
uguaugaauaugccacaguuuaa

SEQ ID NO: 344876 - RNA, 22 nt, Human
gugguaaucggauucuuaccgg

SEQ ID NO: 344877 - RNA, 22 nt, Human
aggcagcccugugcuggaugcu

SEQ ID NO: 344878 - RNA, 18 nt, Human
cugcuugggagacgucag

SEQ ID NO: 344879 - RNA, 22 nt, Human
cggagggguuugaacagaggag

SEQ ID NO: 344880 - RNA, 22 nt, Human
acauuuaaccaaacuguuuaau

SEQ ID NO: 344881 - RNA, 22 nt, Human
aggagggagaugcccauccugg

SEQ ID NO: 344882 - RNA, 22 nt, Human
guaggcagucucucaggugauc

SEQ ID NO: 344883 - RNA, 17 nt, Human
gagacagcaggagcccc

SEQ ID NO: 344884 - RNA, 22 nt, Human
uauaucauggagauuaacauuc

SEQ ID NO: 344885 - RNA, 22 nt, Human
aaucacaugugcucaauuuuaa

SEQ ID NO: 344886 - RNA, 22 nt, Human
aaugauuuccccuacacagaag

SEQ ID NO: 344887 - RNA, 22 nt, Human
gcugggaagugcaagaucaagg

SEQ ID NO: 344888 - RNA, 22 nt, Human
aaagccaugaauguuauagagg

SEQ ID NO: 344889 - RNA, 22 nt, Human
gagguagcaugcuggaagggac

SEQ ID NO: 344890 - RNA, 22 nt, Human
uggagagguuuaaacaaaaguu

SEQ ID NO: 344891 - RNA, 22 nt, Human
augcugucgaaaccaaacaucu

SEQ ID NO: 344892 - RNA, 22 nt, Human
agaggacagacggaaagugcca

SEQ ID NO: 344893 - RNA, 22 nt, Human
gauuucuugauaauucaaaucc

SEQ ID NO: 344894 - RNA, 22 nt, Human
guuauauauaguauuucucuga

SEQ ID NO: 344895 - RNA, 22 nt, Human
ucacacagauugguagagcuga

SEQ ID NO: 344896 - RNA, 22 nt, Human
uucugucagcgucagaaauucu

SEQ ID NO: 344897 - RNA, 22 nt, Human
agcccaggaaucugcaucuuga

SEQ ID NO: 344898 - RNA, 22 nt, Human
gucaggauuauuuuauuaaaag

SEQ ID NO: 344899 - RNA, 22 nt, Human
uuugacaugcaaagcacuuuag

SEQ ID NO: 344900 - RNA, 22 nt, Human
uccaugaggcagggaggcuggc

SEQ ID NO: 344901 - RNA, 22 nt, Human
aaauugcauuuuaaagguagau

SEQ ID NO: 344902 - RNA, 22 nt, Human
auaacuuucuucacccuugcug

SEQ ID NO: 344903 - RNA, 22 nt, Human
uucucagagcucacuguaguaa

SEQ ID NO: 344904 - RNA, 22 nt, Human
uccaggagaccagauguaggcc

SEQ ID NO: 344905 - RNA, 22 nt, Human
cagguaaaaauaaauuugugag

SEQ ID NO: 344906 - RNA, 22 nt, Human
agugcuguuagguuaauauagu

SEQ ID NO: 344907 - RNA, 22 nt, Human
cccaggaggcggagguuguggu

SEQ ID NO: 344908 - RNA, 22 nt, Human
uuugaaaggguuaugagacuga

SEQ ID NO: 344909 - RNA, 22 nt, Human
uuucuucagccacuccaaacug

SEQ ID NO: 344910 - RNA, 22 nt, Human
uucugucucuguguuuacauua

SEQ ID NO: 344911 - RNA, 22 nt, Human
uuugcauaagucauguccagug

SEQ ID NO: 344912 - RNA, 22 nt, Human
agaaaugaauauguagugguua

SEQ ID NO: 344913 - RNA, 22 nt, Human
uacuuuuagccuauuugauucu

SEQ ID NO: 344914 - RNA, 22 nt, Human
gcagggaagacccggagcagcg

SEQ ID NO: 344915 - RNA, 22 nt, Human
caaguaaagaaucacauuucuu

SEQ ID NO: 344916 - RNA, 23 nt, Human
gcagaggagcaagcuggacacca

SEQ ID NO: 344917 - RNA, 22 nt, Human
ucuucacaugaccuucaugucu

SEQ ID NO: 344918 - RNA, 22 nt, Human
uggcagcucccagagcuuccaa

SEQ ID NO: 344919 - RNA, 22 nt, Human
uguaggaauguuuuuaaguugg

SEQ ID NO: 344920 - RNA, 22 nt, Human
cauuuuaagaugaccugguuuc

SEQ ID NO: 344921 - RNA, 19 nt, Human
gaggagcuaucggagacag

SEQ ID NO: 344922 - RNA, 22 nt, Human
gucuuuaugguaugaaaacuga

SEQ ID NO: 344923 - RNA, 22 nt, Human
gaauauuuguaauuacuguuga

SEQ ID NO: 344924 - RNA, 22 nt, Human
uaaaugaagaaauggagauugu

SEQ ID NO: 344925 - RNA, 22 nt, Human
caacagcugaucuuugaugaag

SEQ ID NO: 344926 - RNA, 22 nt, Human
aggcaggcuggucugaagagug

SEQ ID NO: 344927 - RNA, 23 nt, Human
accaggagccaagaucucccugg

SEQ ID NO: 344928 - RNA, 22 nt, Human
cucacugucuguacuagcugau

SEQ ID NO: 344929 - RNA, 22 nt, Human
ucuucaauuagauuuaccaauu

SEQ ID NO: 344930 - RNA, 22 nt, Human
uuucacacugcagcaucagaga

SEQ ID NO: 344931 - RNA, 22 nt, Human
aaguguagauuauggagugucu

SEQ ID NO: 344932 - RNA, 22 nt, Human
ugcacagugaccccuggugacu

SEQ ID NO: 344933 - RNA, 22 nt, Human
ugaacacauaaggcuuuccugu

SEQ ID NO: 344934 - RNA, 22 nt, Human
acucaggaaaaauguagugaua

SEQ ID NO: 344935 - RNA, 22 nt, Human
gagcagcuccagccgcaugacu

SEQ ID NO: 344936 - RNA, 22 nt, Human
guaggcagugguuggaagagaa

SEQ ID NO: 344937 - RNA, 22 nt, Human
aaggccaacuaggaugagcuag

SEQ ID NO: 344938 - RNA, 22 nt, Human
aaaauacuguggaguguugaaa

SEQ ID NO: 344939 - RNA, 18 nt, Human
aagaggaggaaacccagg

SEQ ID NO: 344940 - RNA, 23 nt, Human
gugcugugagccccuuggccucc

SEQ ID NO: 344941 - RNA, 22 nt, Human
gaggauggaggugugagcuaug

SEQ ID NO: 344942 - RNA, 22 nt, Human
acuggcaggcugcuggccggcg

SEQ ID NO: 344943 - RNA, 22 nt, Human
gaacacauuucucugacuguag

SEQ ID NO: 344944 - RNA, 22 nt, Human
uuuauuguuuagaagggggcug

SEQ ID NO: 344945 - RNA, 21 nt, Human
uucaaaaugguguguuugucu

SEQ ID NO: 344946 - RNA, 22 nt, Human
gcagcugccccgacugugaguc

SEQ ID NO: 344947 - RNA, 22 nt, Human
gaaggccacaagagaaguuaag

SEQ ID NO: 344948 - RNA, 22 nt, Human
ccucaggaaaugaauaaauggc

SEQ ID NO: 344949 - RNA, 23 nt, Human
cuuuuaacuagaguaucagcugc

SEQ ID NO: 344950 - RNA, 22 nt, Human
ucagagaggcaauacuguuuaa

SEQ ID NO: 344951 - RNA, 22 nt, Human
gugaaacagaagcuccuggaau

SEQ ID NO: 344952 - RNA, 22 nt, Human
cacccugggcugggccuguuaa

SEQ ID NO: 344953 - RNA, 22 nt, Human
gaaaggugccccauaggcagga

SEQ ID NO: 344954 - RNA, 22 nt, Human
uccaggagaaggccauccagcg

SEQ ID NO: 344955 - RNA, 22 nt, Human
auuugcuuuaagguauaaaagg

SEQ ID NO: 344956 - RNA, 22 nt, Human
gaggcaacacauuuggaaagca

SEQ ID NO: 344957 - RNA, 22 nt, Human
gcuccucuauuccccacauuuu

SEQ ID NO: 344958 - RNA, 18 nt, Human
agaggggagguaagucug

SEQ ID NO: 344959 - RNA, 22 nt, Human
uacacacaugcauuugccuuau

SEQ ID NO: 344960 - RNA, 22 nt, Human
gccugcagaacugugaggcaau

SEQ ID NO: 344961 - RNA, 20 nt, Human
uuugucuguuaaguguuucu

SEQ ID NO: 344962 - RNA, 22 nt, Human
aaggagagagcuuugcuggaac

SEQ ID NO: 344963 - RNA, 22 nt, Human
ggugguggagccagcugggagu

SEQ ID NO: 344964 - RNA, 22 nt, Human
ugucagaugcgauaaacuagug

SEQ ID NO: 344965 - RNA, 22 nt, Human
cugcugugacagcugccguguu

SEQ ID NO: 344966 - RNA, 22 nt, Human
cauaauuuuccaugguuugcua

SEQ ID NO: 344967 - RNA, 22 nt, Human
gggcagcugccccucucugggc

SEQ ID NO: 344968 - RNA, 22 nt, Human
caaggccagagccagcgauaag

SEQ ID NO: 344969 - RNA, 22 nt, Human
gcccaggaguugaagggcugac

SEQ ID NO: 344970 - RNA, 22 nt, Human
aucaggaucacagaaacuuuua

SEQ ID NO: 344971 - RNA, 22 nt, Human
gagguagccacagauagagacu

SEQ ID NO: 344972 - RNA, 22 nt, Human
gaggcaguuccugagugacaag

SEQ ID NO: 344973 - RNA, 22 nt, Human
aguaugaaucucuuuauucugc

SEQ ID NO: 344974 - RNA, 22 nt, Human
ugucugugaccucuuaggcaag

SEQ ID NO: 344975 - RNA, 22 nt, Human
agucucugggcaugguugugac

SEQ ID NO: 344976 - RNA, 22 nt, Human
cucaagacugaucgcaguggaa

SEQ ID NO: 344977 - RNA, 22 nt, Human
gcccaggaguugguggcugcag

SEQ ID NO: 344978 - RNA, 22 nt, Human
uuugaaaguucuucugacacua

SEQ ID NO: 344979 - RNA, 22 nt, Human
uucuccagaccuugugacuaug

SEQ ID NO: 344980 - RNA, 16 nt, Human
uucugucacguacggc

SEQ ID NO: 344981 - RNA, 21 nt, Human
auaaaguuuuacaggaaugca

SEQ ID NO: 344982 - RNA, 22 nt, Human
aauguaugggugagaaaguuga

SEQ ID NO: 344983 - RNA, 22 nt, Human
agaaucucuacucaaguacuug

SEQ ID NO: 344984 - RNA, 22 nt, Human
cauuuguacagaacagcuuuau

SEQ ID NO: 344985 - RNA, 22 nt, Human
aggcacagcacaccuggccccc

SEQ ID NO: 344986 - RNA, 22 nt, Human
agaggccaugcuagaggccugg

SEQ ID NO: 344987 - RNA, 18 nt, Human
cucaccauucugcccaau

SEQ ID NO: 344988 - RNA, 22 nt, Human
uccaggagagguagaggguucc

SEQ ID NO: 344989 - RNA, 23 nt, Human
ucucaggacacacaugucuauca

SEQ ID NO: 344990 - RNA, 22 nt, Human
ucagugugaguaccaugcucag

SEQ ID NO: 344991 - RNA, 22 nt, Human
agaauaugaucggaauacagau

SEQ ID NO: 344992 - RNA, 23 nt, Human
uuuuccagaaucgacucuguaga

SEQ ID NO: 344993 - RNA, 23 nt, Human
aaauuauugcucuucaauugccu

SEQ ID NO: 344994 - RNA, 22 nt, Human
acaugcauacacguacauaccu

SEQ ID NO: 344995 - RNA, 22 nt, Human
agucagugaaaacuagaauguu

SEQ ID NO: 344996 - RNA, 22 nt, Human
ccaggagaugggaaaguagcag

SEQ ID NO: 344997 - RNA, 22 nt, Human
uaggcagccagcaucaguuggg

SEQ ID NO: 344998 - RNA, 22 nt, Human
uuaugacaggaaaaucacagaa

SEQ ID NO: 344999 - RNA, 22 nt, Human
ccagagagaaauggauuugagu

SEQ ID NO: 345000 - RNA, 22 nt, Human
gagguggucgaggagggguacc

SEQ ID NO: 345001 - RNA, 22 nt, Human
gucagagagggcacgugcacac

SEQ ID NO: 345002 - RNA, 22 nt, Human
cugcuuuggacaacuauucuug

SEQ ID NO: 345003 - RNA, 22 nt, Human
acacuaaugagaaaggaauuaa

SEQ ID NO: 345004 - RNA, 22 nt, Human
ugaaagggguugaguuacagcu

SEQ ID NO: 345005 - RNA, 19 nt, Human
uucauucuuucuacuuacc

SEQ ID NO: 345006 - RNA, 22 nt, Human
ggccagagaauaugccuuacgu

SEQ ID NO: 345007 - RNA, 22 nt, Human
ccccaggaagccucagauuugc

SEQ ID NO: 345008 - RNA, 22 nt, Human
aaggcagccauagcaccaucca

SEQ ID NO: 345009 - RNA, 22 nt, Human
ccaggagagcagaagcccaggc

SEQ ID NO: 345010 - RNA, 22 nt, Human
cuggcugugcagucuuccagaa

SEQ ID NO: 345011 - RNA, 20 nt, Human
uugauaggcagcuugucagg

SEQ ID NO: 345012 - RNA, 22 nt, Human
ggaaaugacuuggugcuucguu

SEQ ID NO: 345013 - RNA, 21 nt, Human
uaacacauuuugguacuuugg

SEQ ID NO: 345014 - RNA, 22 nt, Human
ugaaggccagcucuuuaucagc

SEQ ID NO: 345015 - RNA, 22 nt, Human
uccaggaggaggaaggcugcca

SEQ ID NO: 345016 - RNA, 22 nt, Human
guggcaggagacuggaagaugg

SEQ ID NO: 345017 - RNA, 22 nt, Human
uggcagucuggguuggcaguua

SEQ ID NO: 345018 - RNA, 20 nt, Human
cccaggaguuugcucuuacu

SEQ ID NO: 345019 - RNA, 22 nt, Human
uucugucauuuagcauugucau

SEQ ID NO: 345020 - RNA, 22 nt, Human
uagcugcugcagcacagggagg

SEQ ID NO: 345021 - RNA, 22 nt, Human
agaccaagugcaggugccacua

SEQ ID NO: 345022 - RNA, 22 nt, Human
agacaaaugguaauuaugucua

SEQ ID NO: 345023 - RNA, 22 nt, Human
uaacacaugguucugucaggaa

SEQ ID NO: 345024 - RNA, 22 nt, Human
augcuuuuaugucacaugguca

SEQ ID NO: 345025 - RNA, 22 nt, Human
caaggccaaagggccacuguca

SEQ ID NO: 345026 - RNA, 22 nt, Human
aaaguuugaaugauauauuagu

SEQ ID NO: 345027 - RNA, 22 nt, Human
gaaggaggcguuagcccuagga

SEQ ID NO: 345028 - RNA, 22 nt, Human
uuucauaaccucaagcuacagu

SEQ ID NO: 345029 - RNA, 22 nt, Human
uuugaagugggcauuagaaccu

SEQ ID NO: 345030 - RNA, 22 nt, Human
uuuguaugugauaagacuauuc

SEQ ID NO: 345031 - RNA, 22 nt, Human
gagagaggccuccauguacuga

SEQ ID NO: 345032 - RNA, 22 nt, Human
aucacauugccagugauuaccc

SEQ ID NO: 345033 - RNA, 19 nt, Human
acuggcaguuucugcaugg

SEQ ID NO: 345034 - RNA, 22 nt, Human
acauguaaaaggaacaugcaug

SEQ ID NO: 345035 - RNA, 20 nt, Human
aaacauucauguacaaguga

SEQ ID NO: 345036 - RNA, 22 nt, Human
uagggaggaggguuuucaaauc

SEQ ID NO: 345037 - RNA, 22 nt, Human
acccaggacaugggcacccgug

SEQ ID NO: 345038 - RNA, 22 nt, Human
ugaggggagguuggggcacauc

SEQ ID NO: 345039 - RNA, 22 nt, Human
acucagaagauauaaugacuca

SEQ ID NO: 345040 - RNA, 19 nt, Human
cccaggaggcggagguugc

SEQ ID NO: 345041 - RNA, 22 nt, Human
agcaccugucacaagcagaagg

SEQ ID NO: 345042 - RNA, 22 nt, Human
gacagaggcuggagcaccuccu

SEQ ID NO: 345043 - RNA, 22 nt, Human
gaggaaccaaucugugauauuc

SEQ ID NO: 345044 - RNA, 22 nt, Human
caggcagcuagauuuauaacaa

SEQ ID NO: 345045 - RNA, 22 nt, Human
uuagccaugugggaaaaacagc

SEQ ID NO: 345046 - RNA, 22 nt, Human
aaggcagcagaggaaaggugcu

SEQ ID NO: 345047 - RNA, 22 nt, Human
aaucauucuuauuucacagcaa

SEQ ID NO: 345048 - RNA, 22 nt, Human
gugcugugucuaucaggaauaa

SEQ ID NO: 345049 - RNA, 22 nt, Human
auucaaauuaaguuaauucagc

SEQ ID NO: 345050 - RNA, 22 nt, Human
gucacuguuuccuauuauauuu

SEQ ID NO: 345051 - RNA, 22 nt, Human
ugaaggccuaacuuccagugcu

SEQ ID NO: 345052 - RNA, 22 nt, Human
cagcuagcuaagaaggccagag

SEQ ID NO: 345053 - RNA, 19 nt, Human
accaggagacagugagcuu

SEQ ID NO: 345054 - RNA, 22 nt, Human
uacuuucuguccuucuguuaaa

SEQ ID NO: 345055 - RNA, 23 nt, Human
agaggcaggaguggcuugcccgg

SEQ ID NO: 345056 - RNA, 22 nt, Human
uugagaagaggcuuuguaggaa

SEQ ID NO: 345057 - RNA, 22 nt, Human
ucacaguaucacacaaggauua

SEQ ID NO: 345058 - RNA, 22 nt, Human
aguuauaaucugcuacugauau

SEQ ID NO: 345059 - RNA, 22 nt, Human
auucucaauggcuacuuucaua

SEQ ID NO: 345060 - RNA, 22 nt, Human
cuguguuugaugagaagccacc

SEQ ID NO: 345061 - RNA, 22 nt, Human
ucccaggacuuccaguuggagg

SEQ ID NO: 345062 - RNA, 22 nt, Human
uucaucaauguguuuaauaaug

SEQ ID NO: 345063 - RNA, 22 nt, Human
aauacuauguugugacacauga

SEQ ID NO: 345064 - RNA, 21 nt, Human
uacagaaugcgcuucagucug

SEQ ID NO: 345065 - RNA, 22 nt, Human
uagucaaaccucagaauacccc

SEQ ID NO: 345066 - RNA, 23 nt, Human
cuugcagggcuggaggcuuagaa

SEQ ID NO: 345067 - RNA, 20 nt, Human
ugaaggccagcagcauaggg

SEQ ID NO: 345068 - RNA, 22 nt, Human
ucauuucccuccuacaaagagg

SEQ ID NO: 345069 - RNA, 22 nt, Human
ccccaggacacauggaccaagu

SEQ ID NO: 345070 - RNA, 20 nt, Human
agaaauauugaguucagagg

SEQ ID NO: 345071 - RNA, 22 nt, Human
uacccaggagaaacagcagggc

SEQ ID NO: 345072 - RNA, 22 nt, Human
aaggcagccagauccuuugggu

SEQ ID NO: 345073 - RNA, 22 nt, Human
caguucuuauuuggccaguguc

SEQ ID NO: 345074 - RNA, 22 nt, Human
uccaggagguagugcuuaauuu

SEQ ID NO: 345075 - RNA, 22 nt, Human
cccaggagguggagguugcagu

SEQ ID NO: 345076 - RNA, 22 nt, Human
uuuuucaagacaaccugcaugu

SEQ ID NO: 345077 - RNA, 22 nt, Human
uagaaacauguucuguucuguu

SEQ ID NO: 345078 - RNA, 22 nt, Human
gaccaaggaagaggggagccag

SEQ ID NO: 345079 - RNA, 22 nt, Human
uauguacaugauuucauuugcu

SEQ ID NO: 345080 - RNA, 22 nt, Human
gugggagcuuuggcaucaggcu

SEQ ID NO: 345081 - RNA, 22 nt, Human
ccacuguuuuucaguuaacuuu

SEQ ID NO: 345082 - RNA, 22 nt, Human
ggcagcuauuccaagcagcacu

SEQ ID NO: 345083 - RNA, 22 nt, Human
uugcucaggcuggugugcagug

SEQ ID NO: 345084 - RNA, 22 nt, Human
agagggagugaaauggaauaga

SEQ ID NO: 345085 - RNA, 22 nt, Human
acugcccucccaucuauugcaa

SEQ ID NO: 345086 - RNA, 22 nt, Human
uuucaaaguugggaauuguaau

SEQ ID NO: 345087 - RNA, 22 nt, Human
uucucuuuugugaugugagaug

SEQ ID NO: 345088 - RNA, 19 nt, Human
cccaggagucuggcugguu

SEQ ID NO: 345089 - RNA, 22 nt, Human
auuuuccucaagccucuggaag

SEQ ID NO: 345090 - RNA, 22 nt, Human
ggaagaggcugagccagguccc

SEQ ID NO: 345091 - RNA, 22 nt, Human
agaggccaggcugcagagggau

SEQ ID NO: 345092 - RNA, 22 nt, Human
uuagccauuaauguccugugca

SEQ ID NO: 345093 - RNA, 22 nt, Human
aauauaauuuuauuccuagagu

SEQ ID NO: 345094 - RNA, 22 nt, Human
uauggaaagcucuuuuugauug

SEQ ID NO: 345095 - RNA, 22 nt, Human
aggcagcuuaagcccuggccca

SEQ ID NO: 345096 - RNA, 22 nt, Human
aaaauuauggaguaucccaaag

SEQ ID NO: 345097 - RNA, 22 nt, Human
uaagauaaguggguugagaugg

SEQ ID NO: 345098 - RNA, 22 nt, Human
uccaggaguccuggguggcccc

SEQ ID NO: 345099 - RNA, 22 nt, Human
cuucuucaucuguaaaacuugg

SEQ ID NO: 345100 - RNA, 22 nt, Human
gccaugcuugguaugcugugag

SEQ ID NO: 345101 - RNA, 22 nt, Human
cccaggaaugaggggcggaggc

SEQ ID NO: 345102 - RNA, 22 nt, Human
aauaacuucauguaacauuuaa

SEQ ID NO: 345103 - RNA, 22 nt, Human
gauuucuucauuuguggugaau

SEQ ID NO: 345104 - RNA, 22 nt, Human
cuuuggcagccucugcuauuga

SEQ ID NO: 345105 - RNA, 22 nt, Human
aggaaaacacaguauugaugga

SEQ ID NO: 345106 - RNA, 22 nt, Human
gaucuucuagcagaaguaauuu

SEQ ID NO: 345107 - RNA, 22 nt, Human
caggaaagggaugggcugccac

SEQ ID NO: 345108 - RNA, 20 nt, Human
ugaggcaggagaauggcaug

SEQ ID NO: 345109 - RNA, 22 nt, Human
ugaaacauuugaugaucuuugg

SEQ ID NO: 345110 - RNA, 22 nt, Human
uuucacuagaacguucuuguuu

SEQ ID NO: 345111 - RNA, 22 nt, Human
acauauuuugaaagcuuucuaa

SEQ ID NO: 345112 - RNA, 22 nt, Human
ugugcaggugcaggaagggggc

SEQ ID NO: 345113 - RNA, 22 nt, Human
aaugcauauguaggcaagcagu

SEQ ID NO: 345114 - RNA, 22 nt, Human
ucccaggaaggauucggcauuu

SEQ ID NO: 345115 - RNA, 22 nt, Human
uaaugucagcauaguuuauuuu

SEQ ID NO: 345116 - RNA, 22 nt, Human
guuugcauuuauuagucuucug

SEQ ID NO: 345117 - RNA, 22 nt, Human
aguugcagacgcagagauguug

SEQ ID NO: 345118 - RNA, 22 nt, Human
gaaggccauugcguccugggau

SEQ ID NO: 345119 - RNA, 22 nt, Human
acaguacauaauccugagucug

SEQ ID NO: 345120 - RNA, 22 nt, Human
caggauggagggagggcuguua

SEQ ID NO: 345121 - RNA, 22 nt, Human
aggcaggccccugagaauagac

SEQ ID NO: 345122 - RNA, 22 nt, Human
uuuuccuguccaggcaauuauu

SEQ ID NO: 345123 - RNA, 22 nt, Human
gagaacucagacgcaggucaug

SEQ ID NO: 345124 - RNA, 22 nt, Human
acucagaaccauuuacucugag

SEQ ID NO: 345125 - RNA, 22 nt, Human
ucagugugaggucuuccacccg

SEQ ID NO: 345126 - RNA, 22 nt, Human
ucugcaggaggcuggcugcagg

SEQ ID NO: 345127 - RNA, 22 nt, Human
acccaggaggcaagguugcagu

SEQ ID NO: 345128 - RNA, 22 nt, Human
cuugaaagauuuggccucugug

SEQ ID NO: 345129 - RNA, 22 nt, Human
ucuucagaggaagucagucuuu

SEQ ID NO: 345130 - RNA, 17 nt, Human
aggccagaugaggcaag

SEQ ID NO: 345131 - RNA, 19 nt, Human
cuucuggcccugagccacc

SEQ ID NO: 345132 - RNA, 22 nt, Human
agugcagcaugcuggggaggcu

SEQ ID NO: 345133 - RNA, 19 nt, Human
ugcccaggccagguugggc

SEQ ID NO: 345134 - RNA, 22 nt, Human
uuuguaaauagcaguacucaug

SEQ ID NO: 345135 - RNA, 22 nt, Human
uguuagaaauuauuaguaauau

SEQ ID NO: 345136 - RNA, 22 nt, Human
aggcagugccuggaccccagcu

SEQ ID NO: 345137 - RNA, 22 nt, Human
ucucaggacuuugggaagcuca

SEQ ID NO: 345138 - RNA, 22 nt, Human
aaaguauuugugauuuuuacca

SEQ ID NO: 345139 - RNA, 22 nt, Human
gacccaggagugcagagagugg

SEQ ID NO: 345140 - RNA, 22 nt, Human
aaaauaacuucuacuauuugca

SEQ ID NO: 345141 - RNA, 18 nt, Human
gcaggagauggguggggu

SEQ ID NO: 345142 - RNA, 22 nt, Human
acauaugauauugaggaucuca

SEQ ID NO: 345143 - RNA, 22 nt, Human
cccaggagguuggggcuacagu

SEQ ID NO: 345144 - RNA, 22 nt, Human
ugcugcuguauccuuaguguca

SEQ ID NO: 345145 - RNA, 22 nt, Human
agcccaggugagggguucgaaa

SEQ ID NO: 345146 - RNA, 22 nt, Human
agacagcugggaaauggagugu

SEQ ID NO: 345147 - RNA, 23 nt, Human
caguggagacucaugcuuccuua

SEQ ID NO: 345148 - RNA, 22 nt, Human
cuucuucauaggcaguccuguu

SEQ ID NO: 345149 - RNA, 22 nt, Human
uccaugagcuagcuuuccaaag

SEQ ID NO: 345150 - RNA, 22 nt, Human
gaggcagcugaagcuucaaaga

SEQ ID NO: 345151 - RNA, 22 nt, Human
ugaaacuuauaagaauaugaau

SEQ ID NO: 345152 - RNA, 22 nt, Human
gcuacugauugaccuuggagag

SEQ ID NO: 345153 - RNA, 22 nt, Human
uggcagcuccggguaggggcug

SEQ ID NO: 345154 - RNA, 22 nt, Human
ucucugguuauuaacuaacucc

SEQ ID NO: 345155 - RNA, 22 nt, Human
uugaauaggacucagcagugau

SEQ ID NO: 345156 - RNA, 22 nt, Human
uuuuuggguccaggcuguaucu

SEQ ID NO: 345157 - RNA, 22 nt, Human
ucuucacaggagccugccugcc

SEQ ID NO: 345158 - RNA, 22 nt, Human
cggcagcucgagggccacccgu

SEQ ID NO: 345159 - RNA, 18 nt, Human
cugcccagagcacuugug

SEQ ID NO: 345160 - RNA, 22 nt, Human
uucaggauuguguuuuuccuga

SEQ ID NO: 345161 - RNA, 22 nt, Human
uuugacauuauccuguuacugg

SEQ ID NO: 345162 - RNA, 20 nt, Human
gcccaggaauuugcauuucu

SEQ ID NO: 345163 - RNA, 22 nt, Human
cacagacccagaagggaugaag

SEQ ID NO: 345164 - RNA, 22 nt, Human
aucugcuuccugggcuccauga

SEQ ID NO: 345165 - RNA, 22 nt, Human
aagcaccugcaguugacaaaaa

SEQ ID NO: 345166 - RNA, 20 nt, Human
ugcguguguauuuauuuucu

SEQ ID NO: 345167 - RNA, 22 nt, Human
cagugcugggcagaggagagcg

SEQ ID NO: 345168 - RNA, 22 nt, Human
aaauuauuaugccccucuauaa

SEQ ID NO: 345169 - RNA, 22 nt, Human
aaaguuguucaguaagaaacuc

SEQ ID NO: 345170 - RNA, 22 nt, Human
uaaggccauuauggugggcccg

SEQ ID NO: 345171 - RNA, 22 nt, Human
cagcugccuucugcgggaaguc

SEQ ID NO: 345172 - RNA, 22 nt, Human
gagagggagccagccaggaacc

SEQ ID NO: 345173 - RNA, 22 nt, Human
uaaugcuuaacagcuggcuuuu

SEQ ID NO: 345174 - RNA, 22 nt, Human
ccaagaugaucuuuacaguguu

SEQ ID NO: 345175 - RNA, 22 nt, Human
uucauacaaugggauauuauga

SEQ ID NO: 345176 - RNA, 22 nt, Human
cauaauuucuguaucagcacca

SEQ ID NO: 345177 - RNA, 22 nt, Human
acauacuuaugcuaaaaauaua

SEQ ID NO: 345178 - RNA, 22 nt, Human
ggcagcuuucaauaggguuaug

SEQ ID NO: 345179 - RNA, 22 nt, Human
uauauguaagcuauguaagagu

SEQ ID NO: 345180 - RNA, 22 nt, Human
cccaggaaaugaacuucugauu

SEQ ID NO: 345181 - RNA, 22 nt, Human
aucaggaugacuauaaggcugc

SEQ ID NO: 345182 - RNA, 22 nt, Human
gagagucuagugcaccuaguuu

SEQ ID NO: 345183 - RNA, 22 nt, Human
accaggaguagaauaucuguga

SEQ ID NO: 345184 - RNA, 18 nt, Human
cauaauuuucuuucuuua

SEQ ID NO: 345185 - RNA, 22 nt, Human
uuucaaacauagaucugaauau

SEQ ID NO: 345186 - RNA, 22 nt, Human
uuauuuucuccucagaaagugg

SEQ ID NO: 345187 - RNA, 22 nt, Human
ccuugcauauauuauaucuuug

SEQ ID NO: 345188 - RNA, 22 nt, Human
ggcagcuggggcagugcccugu

SEQ ID NO: 345189 - RNA, 22 nt, Human
ucuggcuuucauuuguuuaaag

SEQ ID NO: 345190 - RNA, 22 nt, Human
agugagaguauuaaugugaacu

SEQ ID NO: 345191 - RNA, 22 nt, Human
ccuggacucaggcugugggcac

SEQ ID NO: 345192 - RNA, 22 nt, Human
gcuguguuggugaagcuguagc

SEQ ID NO: 345193 - RNA, 22 nt, Human
cauuuucagcacccaucugaaa

SEQ ID NO: 345194 - RNA, 18 nt, Human
aggcagacacuagagguc

SEQ ID NO: 345195 - RNA, 23 nt, Human
ugaaggccuggaggacgcguugu

SEQ ID NO: 345196 - RNA, 22 nt, Human
aguaugaagcugaaugauuuua

SEQ ID NO: 345197 - RNA, 22 nt, Human
uggagcugggguuugaaucugg

SEQ ID NO: 345198 - RNA, 22 nt, Human
ugucuuuggaauauuuagcuga

SEQ ID NO: 345199 - RNA, 21 nt, Human
aggaggggucuuucccacuga

SEQ ID NO: 345200 - RNA, 20 nt, Human
uuucuugucggcuguugcug

SEQ ID NO: 345201 - RNA, 22 nt, Human
cucaggauucucgacacucaca

SEQ ID NO: 345202 - RNA, 22 nt, Human
gacccaggcucgugggacggcu

SEQ ID NO: 345203 - RNA, 22 nt, Human
aaaguguugauaugugacaucc

SEQ ID NO: 345204 - RNA, 22 nt, Human
ggcagcuuccuaggagagggca

SEQ ID NO: 345205 - RNA, 22 nt, Human
uuugacauuggcuuauucuguu

SEQ ID NO: 345206 - RNA, 22 nt, Human
ucagucucuggggcuucuguuu

SEQ ID NO: 345207 - RNA, 19 nt, Human
uuucccagcccuugcugug

SEQ ID NO: 345208 - RNA, 22 nt, Human
ugagggagagggcgaaaaugaa

SEQ ID NO: 345209 - RNA, 22 nt, Human
gggauggggagcuggaaagggg

SEQ ID NO: 345210 - RNA, 22 nt, Human
aaggcagcuuuaaaaaagaugc

SEQ ID NO: 345211 - RNA, 22 nt, Human
cccaggagacauauagaaggac

SEQ ID NO: 345212 - RNA, 22 nt, Human
auaugugaaguggguuauuuug

SEQ ID NO: 345213 - RNA, 22 nt, Human
gacccaggagagaggguugcau

SEQ ID NO: 345214 - RNA, 23 nt, Human
uucauuugucuacuucacuuguu

SEQ ID NO: 345215 - RNA, 22 nt, Human
gucuuucuaugaugaacuguug

SEQ ID NO: 345216 - RNA, 22 nt, Human
auggaguucuuuaaauucacag

SEQ ID NO: 345217 - RNA, 22 nt, Human
uuugaaagccuggcuuuucucu

SEQ ID NO: 345218 - RNA, 22 nt, Human
uacauucagaagaauggacacg

SEQ ID NO: 345219 - RNA, 22 nt, Human
gggagucugggcuagacuccuu

SEQ ID NO: 345220 - RNA, 22 nt, Human
auacauauaugguacuuccugg

SEQ ID NO: 345221 - RNA, 20 nt, Human
accaggagauggaggcaggg

SEQ ID NO: 345222 - RNA, 22 nt, Human
aaggcagcucagcucauggcag

SEQ ID NO: 345223 - RNA, 22 nt, Human
cacauauuugaugaagcuuugu

SEQ ID NO: 345224 - RNA, 22 nt, Human
uguuagaauauuguaauauucg

SEQ ID NO: 345225 - RNA, 22 nt, Human
uugaaggacauccuauuucuag

SEQ ID NO: 345226 - RNA, 22 nt, Human
ugucugugaccucuuuggagcc

SEQ ID NO: 345227 - RNA, 22 nt, Human
ucauuguuucugcuuuucauga

SEQ ID NO: 345228 - RNA, 22 nt, Human
cuugaaagcacuuaguaaauua

SEQ ID NO: 345229 - RNA, 22 nt, Human
uucacagacuuuccauagauug

SEQ ID NO: 345230 - RNA, 22 nt, Human
cugcucuagagagcauuaguca

SEQ ID NO: 345231 - RNA, 22 nt, Human
auuucauagauuguaaaucccu

SEQ ID NO: 345232 - RNA, 22 nt, Human
caggcagcagccacucugguau

SEQ ID NO: 345233 - RNA, 22 nt, Human
cacaauuuguuuuaucaguauu

SEQ ID NO: 345234 - RNA, 22 nt, Human
uauucacaggcacgaaauauug

SEQ ID NO: 345235 - RNA, 22 nt, Human
ugaggcagugugagauaauaaa

SEQ ID NO: 345236 - RNA, 20 nt, Human
gaguuccccauuucuccugg

SEQ ID NO: 345237 - RNA, 22 nt, Human
uuuuaucuaccuaugcucauuu

SEQ ID NO: 345238 - RNA, 22 nt, Human
gcagggaagaucuuggagcugc

SEQ ID NO: 345239 - RNA, 22 nt, Human
ugugaacuggcagguggacggg

SEQ ID NO: 345240 - RNA, 22 nt, Human
ggaggggagauguuugggcuca

SEQ ID NO: 345241 - RNA, 22 nt, Human
uauauauucuuaaguaguguag

SEQ ID NO: 345242 - RNA, 22 nt, Human
ucaauaaaauuguuuuccuauc

SEQ ID NO: 345243 - RNA, 22 nt, Human
ggagccuggucagguuggcucc

SEQ ID NO: 345244 - RNA, 22 nt, Human
agcugccgaugcccagcugcau

SEQ ID NO: 345245 - RNA, 22 nt, Human
gaaggccacaaaaaaugucaua

SEQ ID NO: 345246 - RNA, 22 nt, Human
uuccaugagcucugaguucaca

SEQ ID NO: 345247 - RNA, 22 nt, Human
gagaggucaucucccaucagca

SEQ ID NO: 345248 - RNA, 22 nt, Human
ucaggagaaucagggcuguccu

SEQ ID NO: 345249 - RNA, 22 nt, Human
auaucaguaucuauguauuugu

SEQ ID NO: 345250 - RNA, 22 nt, Human
ccuucuucuguguggcccaaga

SEQ ID NO: 345251 - RNA, 22 nt, Human
uccaggagaaaacugacggugg

SEQ ID NO: 345252 - RNA, 21 nt, Human
uggaggaauaaagcacagaag

SEQ ID NO: 345253 - RNA, 22 nt, Human
uccaggagguuuggaggaagca

SEQ ID NO: 345254 - RNA, 22 nt, Human
gcccaggaguuugcauuuuaac

SEQ ID NO: 345255 - RNA, 22 nt, Human
agaggucagauuucuccuggug

SEQ ID NO: 345256 - RNA, 22 nt, Human
uggcagcugagugcacccccuc

SEQ ID NO: 345257 - RNA, 22 nt, Human
uguagaaccuguuuauuauaga

SEQ ID NO: 345258 - RNA, 19 nt, Human
agcaacaccguuuauuucc

SEQ ID NO: 345259 - RNA, 22 nt, Human
aggaguggugcaggaccugcca

SEQ ID NO: 345260 - RNA, 22 nt, Human
uucaugaaacuuaacuguuggg

SEQ ID NO: 345261 - RNA, 23 nt, Human
aggucagcaggcaaggaaauggc

SEQ ID NO: 345262 - RNA, 22 nt, Human
uuugaagucaggcuuucuaccc

SEQ ID NO: 345263 - RNA, 22 nt, Human
ugcuagaauuugcagaagcaua

SEQ ID NO: 345264 - RNA, 22 nt, Human
caagauggaguccgggaaugug

SEQ ID NO: 345265 - RNA, 22 nt, Human
cugcccaggaaccagaggggca

SEQ ID NO: 345266 - RNA, 22 nt, Human
ucuuugaacuuggcugaucucu

SEQ ID NO: 345267 - RNA, 22 nt, Human
aauaucaacaguguccuucuaa

SEQ ID NO: 345268 - RNA, 22 nt, Human
accaggaggccuggagcacaaa

SEQ ID NO: 345269 - RNA, 22 nt, Human
aaaguuguaauggaagaaaugc

SEQ ID NO: 345270 - RNA, 22 nt, Human
cauaauuucccaagagauugaa

SEQ ID NO: 345271 - RNA, 22 nt, Human
ugaggcaggaguuaaugugcuc

SEQ ID NO: 345272 - RNA, 22 nt, Human
aggcagcaugggccccagcucc

SEQ ID NO: 345273 - RNA, 22 nt, Human
caggcagggagcuggaaaggau

SEQ ID NO: 345274 - RNA, 22 nt, Human
gaggcaugcagagcuggagcag

SEQ ID NO: 345275 - RNA, 22 nt, Human
aaggaaccauuugugugcaugg

SEQ ID NO: 345276 - RNA, 22 nt, Human
aaaggccauuacuugcuuuuag

SEQ ID NO: 345277 - RNA, 22 nt, Human
gaaaggccauuucugaggguuu

SEQ ID NO: 345278 - RNA, 22 nt, Human
uuguaauuugcaaauguauugu

SEQ ID NO: 345279 - RNA, 22 nt, Human
cucugcaugccuugcucagaca

SEQ ID NO: 345280 - RNA, 22 nt, Human
ggcaagcucaggccucaggugu

SEQ ID NO: 345281 - RNA, 22 nt, Human
uaugacauuggccaaguucugu

SEQ ID NO: 345282 - RNA, 22 nt, Human
uauuucagcacaugggauaggu

SEQ ID NO: 345283 - RNA, 17 nt, Human
gucauucucagaaaaug

SEQ ID NO: 345284 - RNA, 23 nt, Human
cugcuguuuucuguaccugaagc

SEQ ID NO: 345285 - RNA, 22 nt, Human
cagcugacagugaggugggggc

SEQ ID NO: 345286 - RNA, 22 nt, Human
uugaauaguuuuggauagcaua

SEQ ID NO: 345287 - RNA, 22 nt, Human
ugcuuucaaaggcuuucuagau

SEQ ID NO: 345288 - RNA, 22 nt, Human
cuucugugauuugguuaggaua

SEQ ID NO: 345289 - RNA, 22 nt, Human
gaucuguuucauucacagucug

SEQ ID NO: 345290 - RNA, 23 nt, Human
auugaugacuugauuacacuuuu

SEQ ID NO: 345291 - RNA, 17 nt, Human
uugaacugcugagucag

SEQ ID NO: 345292 - RNA, 22 nt, Human
acuguugucaggcugcuuugga

SEQ ID NO: 345293 - RNA, 22 nt, Human
uaauaguugugacuuuguaaag

SEQ ID NO: 345294 - RNA, 22 nt, Human
aggcaguuguagagagggcucu

SEQ ID NO: 345295 - RNA, 20 nt, Human
aggaggcauagucuggaaag

SEQ ID NO: 345296 - RNA, 22 nt, Human
augaaaauguacauguguauaa

SEQ ID NO: 345297 - RNA, 22 nt, Human
cuggcuuucucugugguguuca

SEQ ID NO: 345298 - RNA, 22 nt, Human
uuaacacauauuuaucaauugc

SEQ ID NO: 345299 - RNA, 22 nt, Human
ucugcucuguggcuucagcuaa

SEQ ID NO: 345300 - RNA, 22 nt, Human
caaauacuggguaaguuaauuu

SEQ ID NO: 345301 - RNA, 22 nt, Human
aaaggccacacagagcagggag

SEQ ID NO: 345302 - RNA, 22 nt, Human
gcagcugcagagaccggguggg

SEQ ID NO: 345303 - RNA, 22 nt, Human
gugcuuucugcugcauuccucu

SEQ ID NO: 345304 - RNA, 22 nt, Human
aucauuacuccuguaaaauugu

SEQ ID NO: 345305 - RNA, 18 nt, Human
cccucuugcacaaagcaa

SEQ ID NO: 345306 - RNA, 22 nt, Human
gggcagcuggcuuauagguuug

SEQ ID NO: 345307 - RNA, 20 nt, Human
ucuggcaggugaacgagcug

SEQ ID NO: 345308 - RNA, 22 nt, Human
uagcucuucaaucacugucucc

SEQ ID NO: 345309 - RNA, 22 nt, Human
ucaugcuuaaaagacacuugag

SEQ ID NO: 345310 - RNA, 22 nt, Human
uguugauuaguguuuagacuua

SEQ ID NO: 345311 - RNA, 18 nt, Human
gucacuguguuucugagc

SEQ ID NO: 345312 - RNA, 22 nt, Human
cuguaugaacccauauacuuau

SEQ ID NO: 345313 - RNA, 22 nt, Human
gcccaggaguuggaggcugcag

SEQ ID NO: 345314 - RNA, 22 nt, Human
cagcuggccaaucagggcgccc

SEQ ID NO: 345315 - RNA, 22 nt, Human
acaauguguuuuuauacauuug

SEQ ID NO: 345316 - RNA, 22 nt, Human
uauguaaaaauucaucaggcug

SEQ ID NO: 345317 - RNA, 22 nt, Human
aauggccagcaacaggagugaa

SEQ ID NO: 345318 - RNA, 22 nt, Human
cagagaaaaaauccugcucuca

SEQ ID NO: 345319 - RNA, 22 nt, Human
cagaggcauacucccagucuug

SEQ ID NO: 345320 - RNA, 22 nt, Human
ucugaaauagaagugucuuucu

SEQ ID NO: 345321 - RNA, 22 nt, Human
uaaggccaaacuauuauaguuc

SEQ ID NO: 345322 - RNA, 22 nt, Human
uaaaacuuaacuauccagauua

SEQ ID NO: 345323 - RNA, 22 nt, Human
caggauggucagaugcauuguc

SEQ ID NO: 345324 - RNA, 22 nt, Human
caggaggggguggaguuucgcc

SEQ ID NO: 345325 - RNA, 22 nt, Human
uuucaguuuaugucuugaauua

SEQ ID NO: 345326 - RNA, 22 nt, Human
cucaggauccaucuccugcccu

SEQ ID NO: 345327 - RNA, 20 nt, Human
cugcugugguccuuuauuuu

SEQ ID NO: 345328 - RNA, 22 nt, Human
ucucacuggguauaaaugagua

SEQ ID NO: 345329 - RNA, 22 nt, Human
uucuaugccauguucagcuacu

SEQ ID NO: 345330 - RNA, 22 nt, Human
cuuuggcaaggguuuuaauugu

SEQ ID NO: 345331 - RNA, 22 nt, Human
gacggcagaaacucaugagguc

SEQ ID NO: 345332 - RNA, 22 nt, Human
aaguaugugauacauguuaauu

SEQ ID NO: 345333 - RNA, 22 nt, Human
gauggacagccuggaaggaaag

SEQ ID NO: 345334 - RNA, 22 nt, Human
auucugucuuuuuaaaauaaua

SEQ ID NO: 345335 - RNA, 22 nt, Human
cucaggaugaaagucaugguga

SEQ ID NO: 345336 - RNA, 22 nt, Human
aggcagcuuuaacugguaguag

SEQ ID NO: 345337 - RNA, 22 nt, Human
uuugcacuagcauuuguccaug

SEQ ID NO: 345338 - RNA, 22 nt, Human
guucuucaaagugacaacuaaa

SEQ ID NO: 345339 - RNA, 22 nt, Human
uuaggaguccagaugucuuggg

SEQ ID NO: 345340 - RNA, 22 nt, Human
agugcuuugaacgaaaggcuga

SEQ ID NO: 345341 - RNA, 22 nt, Human
acccaggagcaggcugggcagu

SEQ ID NO: 345342 - RNA, 22 nt, Human
gaggcagugucgguggcaggau

SEQ ID NO: 345343 - RNA, 22 nt, Human
cucuucuuauggccguggcuga

SEQ ID NO: 345344 - RNA, 22 nt, Human
aaacacaucauucaugucguca

SEQ ID NO: 345345 - RNA, 22 nt, Human
uugugaguagugccgcaauaaa

SEQ ID NO: 345346 - RNA, 22 nt, Human
uuucaaagaccauuaacuauca

SEQ ID NO: 345347 - RNA, 22 nt, Human
ugauugaagaggugaggaaguu

SEQ ID NO: 345348 - RNA, 22 nt, Human
cccaggaggcagaaguugcagu

SEQ ID NO: 345349 - RNA, 22 nt, Human
cagagggcacaugguuuccuca

SEQ ID NO: 345350 - RNA, 22 nt, Human
gaggggaaaguucugcacaagg

SEQ ID NO: 345351 - RNA, 22 nt, Human
ugcauguguuugccacagugag

SEQ ID NO: 345352 - RNA, 22 nt, Human
uucugucaaauuugccauaugg

SEQ ID NO: 345353 - RNA, 22 nt, Human
uuuaaauuauaguuaaugucug

SEQ ID NO: 345354 - RNA, 22 nt, Human
caaggccaagguuuugugaacu

SEQ ID NO: 345355 - RNA, 22 nt, Human
uucaauucaauucuaaauauau

SEQ ID NO: 345356 - RNA, 22 nt, Human
gccaggagcaugucauuguuga

SEQ ID NO: 345357 - RNA, 22 nt, Human
cacaauuuccuugcuucacuuu

SEQ ID NO: 345358 - RNA, 22 nt, Human
aggaagcuaaccagggagugag

SEQ ID NO: 345359 - RNA, 22 nt, Human
cagaauggcuuuuauggcucag

SEQ ID NO: 345360 - RNA, 22 nt, Human
uccaggagggauugggcugugg

SEQ ID NO: 345361 - RNA, 22 nt, Human
uauucacaugaaaacaaauuuu

SEQ ID NO: 345362 - RNA, 22 nt, Human
ucugucaaaaguuuucaauaaa

SEQ ID NO: 345363 - RNA, 22 nt, Human
cucuucuugaaagaggaauuca

SEQ ID NO: 345364 - RNA, 22 nt, Human
ugugugaaggaauauauacuca

SEQ ID NO: 345365 - RNA, 22 nt, Human
uuggcaguaaaagaaaaugcuu

SEQ ID NO: 345366 - RNA, 22 nt, Human
aagcaacucccuccucauuuuu

SEQ ID NO: 345367 - RNA, 22 nt, Human
augcagcugucagggagaacau

SEQ ID NO: 345368 - RNA, 22 nt, Human
ccuugcugaccaucaccuuuga

SEQ ID NO: 345369 - RNA, 22 nt, Human
ggcagaggaggggugaauuugc

SEQ ID NO: 345370 - RNA, 20 nt, Human
aagagaggaaguuauacuag

SEQ ID NO: 345371 - RNA, 22 nt, Human
cauuuguaucauauguaucuua

SEQ ID NO: 345372 - RNA, 22 nt, Human
ugaguucuaguggcugcagauu

SEQ ID NO: 345373 - RNA, 22 nt, Human
ggguggagaggcuaaguccagu

SEQ ID NO: 345374 - RNA, 23 nt, Human
uccaggagaaccccugucugucc

SEQ ID NO: 345375 - RNA, 22 nt, Human
caggguggcacucagcgcaucu

SEQ ID NO: 345376 - RNA, 22 nt, Human
ugcauuuccagauuucuggagu

SEQ ID NO: 345377 - RNA, 20 nt, Human
cucaggauugucuagccccu

SEQ ID NO: 345378 - RNA, 22 nt, Human
uggcagcucuguucaacaugag

SEQ ID NO: 345379 - RNA, 22 nt, Human
gaggaaccacucugagaagcca

SEQ ID NO: 345380 - RNA, 22 nt, Human
ccugcucagagcgucuugugug

SEQ ID NO: 345381 - RNA, 17 nt, Human
ugauaguucauuuuaag

SEQ ID NO: 345382 - RNA, 22 nt, Human
cauuuauucauuugcuagggcu

SEQ ID NO: 345383 - RNA, 23 nt, Human
cuucucagaagucugugccagga

SEQ ID NO: 345384 - RNA, 22 nt, Human
cugcuguguugccagugucacc

SEQ ID NO: 345385 - RNA, 22 nt, Human
auuaaauuggaucugcauaguu

SEQ ID NO: 345386 - RNA, 22 nt, Human
acauacauauguuuaaaugcau

SEQ ID NO: 345387 - RNA, 22 nt, Human
ucuggucaguaauaagaagugg

SEQ ID NO: 345388 - RNA, 22 nt, Human
aucugcuugaaugagcaacagg

SEQ ID NO: 345389 - RNA, 22 nt, Human
guucuugccagcauccucaggu

SEQ ID NO: 345390 - RNA, 22 nt, Human
gagcagcucugugccuggagac

SEQ ID NO: 345391 - RNA, 22 nt, Human
cauuuguuuagaagucuuuaua

SEQ ID NO: 345392 - RNA, 22 nt, Human
uaugacauuauaaaggauuauu

SEQ ID NO: 345393 - RNA, 22 nt, Human
caggauggagaguuguugguug

SEQ ID NO: 345394 - RNA, 22 nt, Human
uuuguuaauucuuauguuagag

SEQ ID NO: 345395 - RNA, 22 nt, Human
uucaaacaguguagaauauaug

SEQ ID NO: 345396 - RNA, 22 nt, Human
aauaauuagugggacagagaac

SEQ ID NO: 345397 - RNA, 22 nt, Human
ugugaaaagcguguguucuagg

SEQ ID NO: 345398 - RNA, 22 nt, Human
agaggagugggaagcagugcaa

SEQ ID NO: 345399 - RNA, 22 nt, Human
uucaggauuauacucucuuccc

SEQ ID NO: 345400 - RNA, 22 nt, Human
uucugaaagccaauucauugaa

SEQ ID NO: 345401 - RNA, 22 nt, Human
acacagccgugaaucugcuucu

SEQ ID NO: 345402 - RNA, 22 nt, Human
ggaggaugagcuacgaggagcu

SEQ ID NO: 345403 - RNA, 23 nt, Human
uugaaagguagcuggcagcuaga

SEQ ID NO: 345404 - RNA, 22 nt, Human
uaacuuucuucauaugugaacc

SEQ ID NO: 345405 - RNA, 22 nt, Human
ucauuuugggguuugucaucuu

SEQ ID NO: 345406 - RNA, 22 nt, Human
caggagagcccggguccgggcu

SEQ ID NO: 345407 - RNA, 22 nt, Human
ccaggagaaugggauuacccua

SEQ ID NO: 345408 - RNA, 22 nt, Human
agaggcggagcuugcagugagc

SEQ ID NO: 345409 - RNA, 20 nt, Human
uguuaaaggacacuugcuuu

SEQ ID NO: 345410 - RNA, 22 nt, Human
cccuggaggcuggaggcaguag

SEQ ID NO: 345411 - RNA, 22 nt, Human
cccaggagagaggggauaaagc

SEQ ID NO: 345412 - RNA, 16 nt, Human
gcccaggacgggaggc

SEQ ID NO: 345413 - RNA, 22 nt, Human
uuucugugguggguaguucaga

SEQ ID NO: 345414 - RNA, 18 nt, Human
uugagggaggggcagagu

SEQ ID NO: 345415 - RNA, 22 nt, Human
cucccagagaccaagcugagaa

SEQ ID NO: 345416 - RNA, 22 nt, Human
ucuucagauggccaguuguccc

SEQ ID NO: 345417 - RNA, 22 nt, Human
auugaaagauauacuguucuca

SEQ ID NO: 345418 - RNA, 22 nt, Human
aggcaguuguugcugagcagcu

SEQ ID NO: 345419 - RNA, 22 nt, Human
cccuugcaucccauguguggcc

SEQ ID NO: 345420 - RNA, 20 nt, Human
aggcaguuagaaggagauga

SEQ ID NO: 345421 - RNA, 22 nt, Human
aaggcaguaggaucuuccacag

SEQ ID NO: 345422 - RNA, 22 nt, Human
guguguuucagaagccaggugu

SEQ ID NO: 345423 - RNA, 22 nt, Human
uggcagcugccauguccacgug

SEQ ID NO: 345424 - RNA, 22 nt, Human
acuucacagauauuuauuuggu

SEQ ID NO: 345425 - RNA, 22 nt, Human
uauuuuaaagacugccagccua

SEQ ID NO: 345426 - RNA, 22 nt, Human
gaccauuuuuacagagcauuca

SEQ ID NO: 345427 - RNA, 22 nt, Human
cuguaaauaugaagaauauaug

SEQ ID NO: 345428 - RNA, 22 nt, Human
ugaacuuagugggaauaucucu

SEQ ID NO: 345429 - RNA, 22 nt, Human
uucaugugauaaaugugugacu

SEQ ID NO: 345430 - RNA, 22 nt, Human
acauuuaaauaccuauguuucu

SEQ ID NO: 345431 - RNA, 22 nt, Human
cuucuucaagagaaugggagac

SEQ ID NO: 345432 - RNA, 22 nt, Human
uugcuuuguuacugcaguuucc

SEQ ID NO: 345433 - RNA, 22 nt, Human
uuaaauuccagccucauaauag

SEQ ID NO: 345434 - RNA, 22 nt, Human
gcuggcagggacagcugcgugu

SEQ ID NO: 345435 - RNA, 22 nt, Human
gagaggaguagacacuuugguu

SEQ ID NO: 345436 - RNA, 22 nt, Human
uugcacuaggaaaaggcagcca

SEQ ID NO: 345437 - RNA, 21 nt, Human
uuugaaagcuacaucuauagc

SEQ ID NO: 345438 - RNA, 22 nt, Human
uuugcaaauaccaugaaacuug

SEQ ID NO: 345439 - RNA, 22 nt, Human
cuggcuugcagcucaucauaaa

SEQ ID NO: 345440 - RNA, 22 nt, Human
aaguuucauuguucauguaaca

SEQ ID NO: 345441 - RNA, 22 nt, Human
acaguggagaaggcaugaggcu

SEQ ID NO: 345442 - RNA, 22 nt, Human
agugugucugaucacuugugag

SEQ ID NO: 345443 - RNA, 22 nt, Human
ugaaucaguauaaauucucaaa

SEQ ID NO: 345444 - RNA, 22 nt, Human
caugaaaucugaguauguuucc

SEQ ID NO: 345445 - RNA, 22 nt, Human
gaggucaggggagaggcugaug

SEQ ID NO: 345446 - RNA, 22 nt, Human
caggagaggaggcuacuucuua

SEQ ID NO: 345447 - RNA, 21 nt, Human
gugcuuuuccuuaauguucuu

SEQ ID NO: 345448 - RNA, 22 nt, Human
uuuccauguuggugaaaugagg

SEQ ID NO: 345449 - RNA, 22 nt, Human
ucuucuccagugcuucugcaca

SEQ ID NO: 345450 - RNA, 22 nt, Human
uauuaaauuauggauuuaggag

SEQ ID NO: 345451 - RNA, 22 nt, Human
agugagggaugaagaacugcgg

SEQ ID NO: 345452 - RNA, 22 nt, Human
ggcagcuaguuuaagaaagagg

SEQ ID NO: 345453 - RNA, 22 nt, Human
aauuauguagccauaugaaaca

SEQ ID NO: 345454 - RNA, 22 nt, Human
uccaggaggcucugguugacgu

SEQ ID NO: 345455 - RNA, 22 nt, Human
uuucauaauacuguacaugaaa

SEQ ID NO: 345456 - RNA, 23 nt, Human
ucagucuucccugucaguaauag

SEQ ID NO: 345457 - RNA, 22 nt, Human
gcccaggaguucaaggcugcag

SEQ ID NO: 345458 - RNA, 22 nt, Human
uugaaagaggcaaaguuugauc

SEQ ID NO: 345459 - RNA, 18 nt, Human
ucuuccaacacugacacc

SEQ ID NO: 345460 - RNA, 22 nt, Human
ggaggagggguuuacauuggaa

SEQ ID NO: 345461 - RNA, 22 nt, Human
uguaugaagccagaaucuguuu

SEQ ID NO: 345462 - RNA, 22 nt, Human
auucuucacauaagugcuguac

SEQ ID NO: 345463 - RNA, 22 nt, Human
cucccagagagcaggugggccg

SEQ ID NO: 345464 - RNA, 22 nt, Human
auccaugaucaauuuauuacua

SEQ ID NO: 345465 - RNA, 22 nt, Human
augcugugucuagcaggaacac

SEQ ID NO: 345466 - RNA, 22 nt, Human
aggcaguggagcuggaauaggc

SEQ ID NO: 345467 - RNA, 22 nt, Human
aaauaguucagccacggugacu

SEQ ID NO: 345468 - RNA, 22 nt, Human
cccaggagccaucugucuuggc

SEQ ID NO: 345469 - RNA, 22 nt, Human
gagggagggaaaguuuaacacu

SEQ ID NO: 345470 - RNA, 22 nt, Human
agugcuuuccuucuugugacau

SEQ ID NO: 345471 - RNA, 22 nt, Human
aucugucagccugggauuaggg

SEQ ID NO: 345472 - RNA, 22 nt, Human
cccaggagagagacuugaaucu

SEQ ID NO: 345473 - RNA, 22 nt, Human
uaauuauucuagucacauagca

SEQ ID NO: 345474 - RNA, 22 nt, Human
uugaaauaucaaguuauuagug

SEQ ID NO: 345475 - RNA, 22 nt, Human
cugucauugagccugucagggc

SEQ ID NO: 345476 - RNA, 17 nt, Human
ucauuuguugugacuag

SEQ ID NO: 345477 - RNA, 22 nt, Human
ucugauuagcaguuuagggaaa

SEQ ID NO: 345478 - RNA, 22 nt, Human
uucuucaaacaaaaguggcaug

SEQ ID NO: 345479 - RNA, 22 nt, Human
ugcuugugagaguuuuuucaga

SEQ ID NO: 345480 - RNA, 22 nt, Human
acccaggacacagagaugaccc

SEQ ID NO: 345481 - RNA, 22 nt, Human
uuuucagaggccuaagagguuu

SEQ ID NO: 345482 - RNA, 22 nt, Human
gagggagucugugcaaagaauu

SEQ ID NO: 345483 - RNA, 22 nt, Human
uucucagagcacugcugacaaa

SEQ ID NO: 345484 - RNA, 22 nt, Human
agggagcuuccgaacuacagcu

SEQ ID NO: 345485 - RNA, 22 nt, Human
aguuuucacacucaccaaaagg

SEQ ID NO: 345486 - RNA, 22 nt, Human
uucugucacuuaggaggucaua

SEQ ID NO: 345487 - RNA, 22 nt, Human
agaggaggcagcuuaacucagu

SEQ ID NO: 345488 - RNA, 22 nt, Human
ccauuguaaauucuguggaagu

SEQ ID NO: 345489 - RNA, 22 nt, Human
uguugaagauaaaguucucauu

SEQ ID NO: 345490 - RNA, 22 nt, Human
uuucacaacugcuuauuugaga

SEQ ID NO: 345491 - RNA, 23 nt, Human
uuugaaaguaucaacucgccuga

SEQ ID NO: 345492 - RNA, 21 nt, Human
gacaaagugaagcaggcagga

SEQ ID NO: 345493 - RNA, 22 nt, Human
aaucuguucuacucuauucaga

SEQ ID NO: 345494 - RNA, 22 nt, Human
guucuucagauuccauuucagu

SEQ ID NO: 345495 - RNA, 22 nt, Human
uucucagagugaccaagucuuu

SEQ ID NO: 345496 - RNA, 22 nt, Human
gcagcugcaauaggcaucaagc

SEQ ID NO: 345497 - RNA, 22 nt, Human
uugcugugucugauggcugaga

SEQ ID NO: 345498 - RNA, 22 nt, Human
guuuucugauuagcaaaucuga

SEQ ID NO: 345499 - RNA, 22 nt, Human
acccaggagguggaggcugcag

SEQ ID NO: 345500 - RNA, 22 nt, Human
gaggccaaguuggagaccaggu

SEQ ID NO: 345501 - RNA, 17 nt, Human
acucaggaucugggagu

SEQ ID NO: 345502 - RNA, 22 nt, Human
acugcuuuaucugagaaguccu

SEQ ID NO: 345503 - RNA, 22 nt, Human
ucacaaauauuuuaacaguagg

SEQ ID NO: 345504 - RNA, 22 nt, Human
aagauauucaaagauuuauuag

SEQ ID NO: 345505 - RNA, 22 nt, Human
aucaaauauaauaauuuucgcu

SEQ ID NO: 345506 - RNA, 22 nt, Human
ucuuuuggguucuuaugauuua

SEQ ID NO: 345507 - RNA, 22 nt, Human
gcagaggccuagguggaaggcc

SEQ ID NO: 345508 - RNA, 22 nt, Human
cuggcuguauuaguuugauccu

SEQ ID NO: 345509 - RNA, 22 nt, Human
augcaucuauucccaagggcag

SEQ ID NO: 345510 - RNA, 22 nt, Human
gggcagcuccuguggaauccac

SEQ ID NO: 345511 - RNA, 22 nt, Human
uuggaaauugcaagugauuugc

SEQ ID NO: 345512 - RNA, 22 nt, Human
acucaggaagaaagcagcuggu

SEQ ID NO: 345513 - RNA, 22 nt, Human
aauaauuuuagcucagaguugu

SEQ ID NO: 345514 - RNA, 22 nt, Human
gucaggaucaaauugaaguuau

SEQ ID NO: 345515 - RNA, 22 nt, Human
aagggcaggaaaagauggaugu

SEQ ID NO: 345516 - RNA, 22 nt, Human
ccucacugcuauguguuugcuc

SEQ ID NO: 345517 - RNA, 22 nt, Human
auugcuuaucuaucuuuaaguc

SEQ ID NO: 345518 - RNA, 22 nt, Human
cccaggagagaggccaguuggc

SEQ ID NO: 345519 - RNA, 23 nt, Human
auguauuuaaauuucagugauga

SEQ ID NO: 345520 - RNA, 22 nt, Human
cacugagcugauagaauuccag

SEQ ID NO: 345521 - RNA, 22 nt, Human
uaauuucaccguugcuagaaau

SEQ ID NO: 345522 - RNA, 22 nt, Human
uauguguuugacacccugcaag

SEQ ID NO: 345523 - RNA, 22 nt, Human
caggaggaagaacucugcaaca

SEQ ID NO: 345524 - RNA, 22 nt, Human
cucccaggguagggagagacua

SEQ ID NO: 345525 - RNA, 22 nt, Human
agcugcccuuaauaggcauuca

SEQ ID NO: 345526 - RNA, 22 nt, Human
aauuacuuaagagaaacuuuga

SEQ ID NO: 345527 - RNA, 22 nt, Human
uauacacaaggugugcauuugu

SEQ ID NO: 345528 - RNA, 22 nt, Human
uccaggagguugagugaguucc

SEQ ID NO: 345529 - RNA, 22 nt, Human
gcuguguuuuauguuagguuaa

SEQ ID NO: 345530 - RNA, 22 nt, Human
uaugauuuguagacauuugauu

SEQ ID NO: 345531 - RNA, 22 nt, Human
ugucauaacuuagugacaaauc

SEQ ID NO: 345532 - RNA, 22 nt, Human
ccagugcuucuuugcuagcugg

SEQ ID NO: 345533 - RNA, 22 nt, Human
cuucagaagccugcagccuuug

SEQ ID NO: 345534 - RNA, 22 nt, Human
uuaaauauuauguugucugcaa

SEQ ID NO: 345535 - RNA, 22 nt, Human
uggcagcugugcuucauucuuu

SEQ ID NO: 345536 - RNA, 22 nt, Human
ccaggagagcgcccucccggcc

SEQ ID NO: 345537 - RNA, 22 nt, Human
caaaugauaccuauuacuaggc

SEQ ID NO: 345538 - RNA, 22 nt, Human
guagccauuggcaaugaagccu

SEQ ID NO: 345539 - RNA, 22 nt, Human
cauugcuguuaauugucucuag

SEQ ID NO: 345540 - RNA, 22 nt, Human
augaacugcaguauaaacuugg

SEQ ID NO: 345541 - RNA, 22 nt, Human
ccaggaaauagugcugugaucu

SEQ ID NO: 345542 - RNA, 22 nt, Human
cugcccagaagccagaugggca

SEQ ID NO: 345543 - RNA, 22 nt, Human
augauauuugcaaugugcuugc

SEQ ID NO: 345544 - RNA, 22 nt, Human
cugaggaagacagcagcugugu

SEQ ID NO: 345545 - RNA, 22 nt, Human
aauaucagcacuuuugugguau

SEQ ID NO: 345546 - RNA, 22 nt, Human
ugccuggaaggcccaugggaag

SEQ ID NO: 345547 - RNA, 22 nt, Human
uccauuuuagaagaaaauccac

SEQ ID NO: 345548 - RNA, 22 nt, Human
uuagccaugcccuagaagagga

SEQ ID NO: 345549 - RNA, 22 nt, Human
uccuucuuugacaaguggcaga

SEQ ID NO: 345550 - RNA, 22 nt, Human
acagucauuagauacaaugucu

SEQ ID NO: 345551 - RNA, 22 nt, Human
aaaggaagauugagcuuuucca

SEQ ID NO: 345552 - RNA, 22 nt, Human
caggcagcauuuacucugauga

SEQ ID NO: 345553 - RNA, 22 nt, Human
gggagcugaauggcaauggaga

SEQ ID NO: 345554 - RNA, 22 nt, Human
uaauaucuggcauucaaacaug

SEQ ID NO: 345555 - RNA, 22 nt, Human
uguucuucuagauugccuuuua

SEQ ID NO: 345556 - RNA, 22 nt, Human
ugguaaauauguccauucucuu

SEQ ID NO: 345557 - RNA, 22 nt, Human
cauuuguuaaccaguguggauu

SEQ ID NO: 345558 - RNA, 22 nt, Human
ugaaaugagagcacagaauaaa

SEQ ID NO: 345559 - RNA, 22 nt, Human
uuaagauagaacccaguagucu

SEQ ID NO: 345560 - RNA, 22 nt, Human
uggagacugugcuaagggaguu

SEQ ID NO: 345561 - RNA, 22 nt, Human
uuugaaagacagaauauuuuug

SEQ ID NO: 345562 - RNA, 22 nt, Human
uacuaaauaguuuaauuccuca

SEQ ID NO: 345563 - RNA, 22 nt, Human
aaauuauuacaagcuaguuggc

SEQ ID NO: 345564 - RNA, 22 nt, Human
uauuucagggagaauaaauuug

SEQ ID NO: 345565 - RNA, 22 nt, Human
ggcagcuuccugagccagcagc

SEQ ID NO: 345566 - RNA, 22 nt, Human
ucauuucaaugauacuacuaag

SEQ ID NO: 345567 - RNA, 22 nt, Human
gaggagcuggcugucgggaggc

SEQ ID NO: 345568 - RNA, 22 nt, Human
aaggaaccuggaguagagggag

SEQ ID NO: 345569 - RNA, 22 nt, Human
uaacuacauuucacugcaauua

SEQ ID NO: 345570 - RNA, 22 nt, Human
gggcagcugccacuccgcuugc

SEQ ID NO: 345571 - RNA, 22 nt, Human
agugcuuucuugcuccaucagu

SEQ ID NO: 345572 - RNA, 22 nt, Human
cugcuguguuucacaccucugg

SEQ ID NO: 345573 - RNA, 22 nt, Human
auauucuuccaaaacaucauuu

SEQ ID NO: 345574 - RNA, 22 nt, Human
uucacagaauggcaaguuaugg

SEQ ID NO: 345575 - RNA, 22 nt, Human
gugcauuuaggucacaugaugu

SEQ ID NO: 345576 - RNA, 22 nt, Human
uuucuucucgacaccuuauccc

SEQ ID NO: 345577 - RNA, 20 nt, Human
ggcaggcuuuauauggaggg

SEQ ID NO: 345578 - RNA, 22 nt, Human
acacauuuacauguuuacguau

SEQ ID NO: 345579 - RNA, 22 nt, Human
augauguugauaaauuacuuua

SEQ ID NO: 345580 - RNA, 19 nt, Human
ucccaggaagcaaauguca

SEQ ID NO: 345581 - RNA, 22 nt, Human
cuacuucuaaguacauggugau

SEQ ID NO: 345582 - RNA, 22 nt, Human
uggaguucucaggugagggcuu

SEQ ID NO: 345583 - RNA, 21 nt, Human
aggucagcccagcucuggaag

SEQ ID NO: 345584 - RNA, 22 nt, Human
aggcagacaaggacacaguggg

SEQ ID NO: 345585 - RNA, 22 nt, Human
ggccagcagucacagggucaga

SEQ ID NO: 345586 - RNA, 22 nt, Human
ugaggcagugcugggaagccug

SEQ ID NO: 345587 - RNA, 22 nt, Human
ucagugaucuaaggguauggcc

SEQ ID NO: 345588 - RNA, 20 nt, Human
uuuuccuucugaguauguug

SEQ ID NO: 345589 - RNA, 22 nt, Human
aguuggagugaacaugagauug

SEQ ID NO: 345590 - RNA, 22 nt, Human
cagucucuugcuucauuaguug

SEQ ID NO: 345591 - RNA, 22 nt, Human
uuccaugaaauguguuaugcuu

SEQ ID NO: 345592 - RNA, 22 nt, Human
auucucuuuguauaacaucuug

SEQ ID NO: 345593 - RNA, 22 nt, Human
ugaaggaaugaguauacuguuu

SEQ ID NO: 345594 - RNA, 22 nt, Human
cagcugcuuuaguuuuccaucc

SEQ ID NO: 345595 - RNA, 20 nt, Human
agaggaggauuauuuuauuc

SEQ ID NO: 345596 - RNA, 22 nt, Human
cauagagugauguaagguaugu

SEQ ID NO: 345597 - RNA, 22 nt, Human
auaacuuagaguaggcaaaagu

SEQ ID NO: 345598 - RNA, 22 nt, Human
acccaggagcucugggguccuc

SEQ ID NO: 345599 - RNA, 22 nt, Human
uuagcauuucaguacacauguu

SEQ ID NO: 345600 - RNA, 22 nt, Human
cuugcugggguaagucugugcu

SEQ ID NO: 345601 - RNA, 22 nt, Human
ggagcuguuggcagcuaucuug

SEQ ID NO: 345602 - RNA, 22 nt, Human
uugaaaggaauacagaggccua

SEQ ID NO: 345603 - RNA, 22 nt, Human
augcugugcuggcuaaccaugg

SEQ ID NO: 345604 - RNA, 22 nt, Human
ugucaaauuuuuauugcaguau

SEQ ID NO: 345605 - RNA, 22 nt, Human
uagcccagaagagggaagcaac

SEQ ID NO: 345606 - RNA, 22 nt, Human
cuuuuccacugagccucacaaa

SEQ ID NO: 345607 - RNA, 22 nt, Human
cugaacucuuuaugacagcuug

SEQ ID NO: 345608 - RNA, 22 nt, Human
aggcagauauuggggugaugug

SEQ ID NO: 345609 - RNA, 22 nt, Human
aucuccaggcauuucaagagac

SEQ ID NO: 345610 - RNA, 22 nt, Human
gaggcagccucaguggaccucg

SEQ ID NO: 345611 - RNA, 22 nt, Human
uccauuuuagagaugaagaaac

SEQ ID NO: 345612 - RNA, 22 nt, Human
agggaggucuuugaggggcuua

SEQ ID NO: 345613 - RNA, 22 nt, Human
aacauauaaacucuuaaguuca

SEQ ID NO: 345614 - RNA, 20 nt, Human
aggcagcugggaaaugaggg

SEQ ID NO: 345615 - RNA, 22 nt, Human
gcccaggaggucaaguagcuau

SEQ ID NO: 345616 - RNA, 22 nt, Human
cauucuuacacaauauuuuaau

SEQ ID NO: 345617 - RNA, 22 nt, Human
gggaggugauggcaagcagcgg

SEQ ID NO: 345618 - RNA, 22 nt, Human
uuccugagggacuuuugagauu

SEQ ID NO: 345619 - RNA, 22 nt, Human
uagaagcaguaauagaaauagg

SEQ ID NO: 345620 - RNA, 22 nt, Human
uucaggaugcucagaguagucu

SEQ ID NO: 345621 - RNA, 22 nt, Human
agucucugucguagaucagcgu

SEQ ID NO: 345622 - RNA, 22 nt, Human
uccaggaggcaccuuuggacca

SEQ ID NO: 345623 - RNA, 22 nt, Human
aaacauuugcaacucgguuugg

SEQ ID NO: 345624 - RNA, 22 nt, Human
uuucaucuaacacuacauaggg

SEQ ID NO: 345625 - RNA, 22 nt, Human
aggagggacaccaauauauguu

SEQ ID NO: 345626 - RNA, 22 nt, Human
gcuccuucaggugguagcuguu

SEQ ID NO: 345627 - RNA, 22 nt, Human
acacauauauacauauuugugc

SEQ ID NO: 345628 - RNA, 22 nt, Human
uauacaauggcugaaucaucca

SEQ ID NO: 345629 - RNA, 22 nt, Human
aaugucugccagaacugaucau

SEQ ID NO: 345630 - RNA, 22 nt, Human
uuggcagugucugcaaaaugga

SEQ ID NO: 345631 - RNA, 20 nt, Human
agggcagcuugaggagccgg

SEQ ID NO: 345632 - RNA, 22 nt, Human
uaucuguuguccaugcagaaag

SEQ ID NO: 345633 - RNA, 22 nt, Human
uucuccagagggcucugcagga

SEQ ID NO: 345634 - RNA, 22 nt, Human
gaggagcuugugagaagauguc

SEQ ID NO: 345635 - RNA, 22 nt, Human
uuagccauugucagcacauggc

SEQ ID NO: 345636 - RNA, 22 nt, Human
uuaacacagggggagacaaagu

SEQ ID NO: 345637 - RNA, 22 nt, Human
gcccaggaaguugaggcugccg

SEQ ID NO: 345638 - RNA, 22 nt, Human
uacauugcuuucuaauacaucu

SEQ ID NO: 345639 - RNA, 22 nt, Human
uuuggaauuggaaagugcugug

SEQ ID NO: 345640 - RNA, 22 nt, Human
auuuuacuacuccaauuaauga

SEQ ID NO: 345641 - RNA, 22 nt, Human
cagcuucugucugauuagcaag

SEQ ID NO: 345642 - RNA, 22 nt, Human
agaggacagguuuuccaugggc

SEQ ID NO: 345643 - RNA, 22 nt, Human
uuucauuuugguuaugccauaa

SEQ ID NO: 345644 - RNA, 22 nt, Human
gcagcugcuggagggaggcagg

SEQ ID NO: 345645 - RNA, 22 nt, Human
gucuucuuguuuugaaggaaau

SEQ ID NO: 345646 - RNA, 22 nt, Human
uucauuaguucugaagaugucu

SEQ ID NO: 345647 - RNA, 22 nt, Human
uggcagcucauuuggaaaugga

SEQ ID NO: 345648 - RNA, 22 nt, Human
cagucucucagcuuucagcugu

SEQ ID NO: 345649 - RNA, 22 nt, Human
uaggaaaugcuccauugcauaa

SEQ ID NO: 345650 - RNA, 22 nt, Human
uagaaauguugguauuaacauu

SEQ ID NO: 345651 - RNA, 22 nt, Human
ucaguuaacaacuauuuauuga

SEQ ID NO: 345652 - RNA, 22 nt, Human
gaugccuccaaaugagggcaga

SEQ ID NO: 345653 - RNA, 22 nt, Human
aggcagucuaucucuggagccu

SEQ ID NO: 345654 - RNA, 22 nt, Human
gagggagugccagagggccagc

SEQ ID NO: 345655 - RNA, 22 nt, Human
uguggaaaagaauaagggagau

SEQ ID NO: 345656 - RNA, 22 nt, Human
aagcagagcaagcguauuuauu

SEQ ID NO: 345657 - RNA, 22 nt, Human
cagcaggauaugguggagagag

SEQ ID NO: 345658 - RNA, 22 nt, Human
uuacaguuuaguccaagccaga

SEQ ID NO: 345659 - RNA, 22 nt, Human
uucuucaguuugguaaauguaa

SEQ ID NO: 345660 - RNA, 22 nt, Human
uuguaaauaguaguaagaugcc

SEQ ID NO: 345661 - RNA, 22 nt, Human
uuugauaagagcugcugaaacu

SEQ ID NO: 345662 - RNA, 22 nt, Human
uauguacuacacuagaacauuu

SEQ ID NO: 345663 - RNA, 19 nt, Human
uauggcaggccgaggcacu

SEQ ID NO: 345664 - RNA, 22 nt, Human
uuaaagggccgauuuccaggcc

SEQ ID NO: 345665 - RNA, 19 nt, Human
uuugaaagaguuuuauugg

SEQ ID NO: 345666 - RNA, 22 nt, Human
agucucuuauucccuauugcug

SEQ ID NO: 345667 - RNA, 22 nt, Human
cauuuguaguaucuguuuauau

SEQ ID NO: 345668 - RNA, 22 nt, Human
gcaucuaauccaguccagcauc

SEQ ID NO: 345669 - RNA, 22 nt, Human
ucugucaucucuaaaauagaaa

SEQ ID NO: 345670 - RNA, 22 nt, Human
ucccaggaagaucccagggacc

SEQ ID NO: 345671 - RNA, 22 nt, Human
cauuuacacuucuaaccacaag

SEQ ID NO: 345672 - RNA, 22 nt, Human
auguuauuaaaguacagauucu

SEQ ID NO: 345673 - RNA, 21 nt, Human
uucucagagucuauuacaguu

SEQ ID NO: 345674 - RNA, 22 nt, Human
gaggccuggagccgccuaggcg

SEQ ID NO: 345675 - RNA, 20 nt, Human
uugauucaagggcugaugga

SEQ ID NO: 345676 - RNA, 22 nt, Human
uucuucaacaaggacacuguua

SEQ ID NO: 345677 - RNA, 22 nt, Human
uuucuugaccacuauguugaua

SEQ ID NO: 345678 - RNA, 22 nt, Human
uagaaacaaugacaugcuugua

SEQ ID NO: 345679 - RNA, 22 nt, Human
cgcagggauuucaaggggccuu

SEQ ID NO: 345680 - RNA, 22 nt, Human
uggaaauguauuugggcaugcc

SEQ ID NO: 345681 - RNA, 23 nt, Human
cccuggaguaaauucuuggaagg

SEQ ID NO: 345682 - RNA, 22 nt, Human
uggagacucugcaucugugaca

SEQ ID NO: 345683 - RNA, 19 nt, Human
gaggucagcaagaaguauu

SEQ ID NO: 345684 - RNA, 22 nt, Human
aagagggcagcacagguggguc

SEQ ID NO: 345685 - RNA, 22 nt, Human
ucucuucuaacacuagaaauuc

SEQ ID NO: 345686 - RNA, 20 nt, Human
gggcaguucaaugccacucu

SEQ ID NO: 345687 - RNA, 17 nt, Human
gccaggagguuugagcu

SEQ ID NO: 345688 - RNA, 22 nt, Human
ugugugaaggagccacuguuca

SEQ ID NO: 345689 - RNA, 22 nt, Human
guaguuuucugaaaauuacuuu

SEQ ID NO: 345690 - RNA, 22 nt, Human
uaugaacuagcugauuuaguuu

SEQ ID NO: 345691 - RNA, 22 nt, Human
ucucaggagccacagcgggagu

SEQ ID NO: 345692 - RNA, 23 nt, Human
ucccaggaaucugcauuuuuaac

SEQ ID NO: 345693 - RNA, 22 nt, Human
uuauagaaggagcauucacuua

SEQ ID NO: 345694 - RNA, 22 nt, Human
acagucuacuugagcuuguaua

SEQ ID NO: 345695 - RNA, 22 nt, Human
gaaggccacggaauggagcugg

SEQ ID NO: 345696 - RNA, 22 nt, Human
uucacaauggcaaaccauuaaa

SEQ ID NO: 345697 - RNA, 21 nt, Human
agccagcuaucacacagcauu

SEQ ID NO: 345698 - RNA, 22 nt, Human
agaauccuguuuuacuucauca

SEQ ID NO: 345699 - RNA, 22 nt, Human
guuuuucuaggaccaugugauu

SEQ ID NO: 345700 - RNA, 22 nt, Human
cccaggugcugcgugaagccuc

SEQ ID NO: 345701 - RNA, 22 nt, Human
aggcaguggaaggagaaagcaa

SEQ ID NO: 345702 - RNA, 22 nt, Human
cagucucuaaaucaaucugaau

SEQ ID NO: 345703 - RNA, 22 nt, Human
uucaggauucugugucugacaa

SEQ ID NO: 345704 - RNA, 19 nt, Human
uuacuuggcaaagucaguc

SEQ ID NO: 345705 - RNA, 22 nt, Human
caaauguaaauucuuuugaagc

SEQ ID NO: 345706 - RNA, 22 nt, Human
cgucuuccucuuacgaugcgcu

SEQ ID NO: 345707 - RNA, 22 nt, Human
uuauuuaaaagugguaagauuc

SEQ ID NO: 345708 - RNA, 22 nt, Human
cagcgucucguugugggccucg

SEQ ID NO: 345709 - RNA, 20 nt, Human
cuguuaaaagguaugaauuc

SEQ ID NO: 345710 - RNA, 22 nt, Human
acuguguggaccacucugaggc

SEQ ID NO: 345711 - RNA, 22 nt, Human
uguacuaaggcuguguagaugu

SEQ ID NO: 345712 - RNA, 22 nt, Human
gaggcagagaccuucaggaccu

SEQ ID NO: 345713 - RNA, 22 nt, Human
auucuucauaccuacugagguu

SEQ ID NO: 345714 - RNA, 22 nt, Human
auguagagcaguguuguccaau

SEQ ID NO: 345715 - RNA, 22 nt, Human
ugacuagaccuauaucuuuuug

SEQ ID NO: 345716 - RNA, 22 nt, Human
ugaaacaaugugaaguugcuga

SEQ ID NO: 345717 - RNA, 22 nt, Human
uauuucagucacuucuucucug

SEQ ID NO: 345718 - RNA, 19 nt, Human
cauaauacaguggaucuga

SEQ ID NO: 345719 - RNA, 18 nt, Human
gaacagcaauuucauguu

SEQ ID NO: 345720 - RNA, 22 nt, Human
ucuugggcaauuucucuagagg

SEQ ID NO: 345721 - RNA, 22 nt, Human
agggcacucugcagggaccacc

SEQ ID NO: 345722 - RNA, 22 nt, Human
cauaaauuguacccauuccaac

SEQ ID NO: 345723 - RNA, 22 nt, Human
uacuacauacagaauuuagaga

SEQ ID NO: 345724 - RNA, 23 nt, Human
uugcauuaauguggaggcacagg

SEQ ID NO: 345725 - RNA, 21 nt, Human
accgucaguacuaguauugac

SEQ ID NO: 345726 - RNA, 22 nt, Human
ccucuugauugguuggaagcgg

SEQ ID NO: 345727 - RNA, 22 nt, Human
cuguaaccuccucuuuccauuc

SEQ ID NO: 345728 - RNA, 22 nt, Human
ucuauuaaugauucaauagugu

SEQ ID NO: 345729 - RNA, 22 nt, Human
gacuguggacucucaugauaga

SEQ ID NO: 345730 - RNA, 22 nt, Human
cugagcaugcuacaugcagcac

SEQ ID NO: 345731 - RNA, 22 nt, Human
cuugccaguguugcagaagcuc

SEQ ID NO: 345732 - RNA, 21 nt, Human
agccugcaauguagguaccgg

SEQ ID NO: 345733 - RNA, 22 nt, Human
cuguggguggcugugccccagg

SEQ ID NO: 345734 - RNA, 22 nt, Human
guaaagcaaaauguagagauug

SEQ ID NO: 345735 - RNA, 22 nt, Human
cuugggcaggggaaacagcugc

SEQ ID NO: 345736 - RNA, 17 nt, Human
ucuccuggcucuaucag

SEQ ID NO: 345737 - RNA, 22 nt, Human
aaauucuguccugaaugccauu

SEQ ID NO: 345738 - RNA, 20 nt, Human
gccaagaauaugcccgacuc

SEQ ID NO: 345739 - RNA, 22 nt, Human
uuugggcaggcuuuucccuaga

SEQ ID NO: 345740 - RNA, 22 nt, Human
cuucuggcguuggaggucugag

SEQ ID NO: 345741 - RNA, 22 nt, Human
aaggaucauguauauguuuaag

SEQ ID NO: 345742 - RNA, 22 nt, Human
acuagugcacauuguuucucaa

SEQ ID NO: 345743 - RNA, 22 nt, Human
ucugugggcauuuauaaucugg

SEQ ID NO: 345744 - RNA, 22 nt, Human
caacauuucaaggucuuuagga

SEQ ID NO: 345745 - RNA, 22 nt, Human
ggcucugcugguaagaugccuc

SEQ ID NO: 345746 - RNA, 22 nt, Human
uauucacagcugccgcacucag

SEQ ID NO: 345747 - RNA, 22 nt, Human
auuccaaagccugaauaaugga

SEQ ID NO: 345748 - RNA, 22 nt, Human
guauuucuuuacauaugcucau

SEQ ID NO: 345749 - RNA, 22 nt, Human
cuucuaauucuuauguaagcuu

SEQ ID NO: 345750 - RNA, 21 nt, Human
agcugugguuuuacaucuuuu

SEQ ID NO: 345751 - RNA, 18 nt, Human
uauaaacacacuuagguu

SEQ ID NO: 345752 - RNA, 22 nt, Human
ugccagcaguagcaguaggcca

SEQ ID NO: 345753 - RNA, 22 nt, Human
gauccacaggaaccaaaacgca

SEQ ID NO: 345754 - RNA, 22 nt, Human
uauagcagcaugauuuauaguc

SEQ ID NO: 345755 - RNA, 22 nt, Human
uuccugagucgccgagucuaug

SEQ ID NO: 345756 - RNA, 22 nt, Human
ucugcuugugucuguccagccu

SEQ ID NO: 345757 - RNA, 22 nt, Human
cucuauucuaauggauucuggg

SEQ ID NO: 345758 - RNA, 22 nt, Human
auggcucugcugggcaaagcaa

SEQ ID NO: 345759 - RNA, 22 nt, Human
uaucaguagaacaauggacauu

SEQ ID NO: 345760 - RNA, 22 nt, Human
uggggcuccuccuggcaggagg

SEQ ID NO: 345761 - RNA, 22 nt, Human
uaaaacuagugguugggacuaa

SEQ ID NO: 345762 - RNA, 22 nt, Human
uuccccuugauaaugcaguaag

SEQ ID NO: 345763 - RNA, 22 nt, Human
gugcugagugcagagugcagag

SEQ ID NO: 345764 - RNA, 22 nt, Human
aaaacuuucagggauacagaaa

SEQ ID NO: 345765 - RNA, 22 nt, Human
aaauuaacuaucacuuuuguga

SEQ ID NO: 345766 - RNA, 22 nt, Human
ccagguaggagagucaacaugu

SEQ ID NO: 345767 - RNA, 21 nt, Human
agcauucaaaagaugccauaa

SEQ ID NO: 345768 - RNA, 22 nt, Human
uagauuaucccugauuugucca

SEQ ID NO: 345769 - RNA, 22 nt, Human
ucugaggucauuccaaggacau

SEQ ID NO: 345770 - RNA, 22 nt, Human
gaaaauaguucaucacaaugau

SEQ ID NO: 345771 - RNA, 22 nt, Human
ucaugcagauaagaauaaguaa

SEQ ID NO: 345772 - RNA, 22 nt, Human
agggcacuuccucugggucccu

SEQ ID NO: 345773 - RNA, 22 nt, Human
cuguccauggcaaugaugcaga

SEQ ID NO: 345774 - RNA, 22 nt, Human
caggaugccuuugaacucugga

SEQ ID NO: 345775 - RNA, 22 nt, Human
accagucauagaaagcaguggu

SEQ ID NO: 345776 - RNA, 22 nt, Human
uuuaggaagaguugaguaaauu

SEQ ID NO: 345777 - RNA, 22 nt, Human
cauugcaacuucaaacuccugg

SEQ ID NO: 345778 - RNA, 22 nt, Human
uaaccaagcaaacuuucauugu

SEQ ID NO: 345779 - RNA, 22 nt, Human
ucucuacagcacccgcaugcua

SEQ ID NO: 345780 - RNA, 22 nt, Human
ucaguaaaugagcaaaaauuuc

SEQ ID NO: 345781 - RNA, 22 nt, Human
uaacauuucggugacaguggga

SEQ ID NO: 345782 - RNA, 22 nt, Human
auacaacagaaaaugauuauuc

SEQ ID NO: 345783 - RNA, 22 nt, Human
uuccagagaguuauuccccugg

SEQ ID NO: 345784 - RNA, 22 nt, Human
ugcauaaacuucucugguguga

SEQ ID NO: 345785 - RNA, 22 nt, Human
ccaaaauauuagugcuuaagua

SEQ ID NO: 345786 - RNA, 22 nt, Human
ggcuguggucauuaggagguug

SEQ ID NO: 345787 - RNA, 22 nt, Human
cauuuacauuuaagguuaauau

SEQ ID NO: 345788 - RNA, 22 nt, Human
ggacaucuguugugguagagga

SEQ ID NO: 345789 - RNA, 22 nt, Human
auucugcugccuaguuuaugaa

SEQ ID NO: 345790 - RNA, 22 nt, Human
ccugugggagggagcggcugga

SEQ ID NO: 345791 - RNA, 22 nt, Human
gcuucuggaagcauaugcaaga

SEQ ID NO: 345792 - RNA, 22 nt, Human
auacacauguuauuguggaagc

SEQ ID NO: 345793 - RNA, 21 nt, Human
caagacauaugaguacucugg

SEQ ID NO: 345794 - RNA, 22 nt, Human
uuuccagaaauaccauuuggug

SEQ ID NO: 345795 - RNA, 22 nt, Human
acucaucuuugaauuuucagua

SEQ ID NO: 345796 - RNA, 22 nt, Human
acaggaaaugaaaugguaucua

SEQ ID NO: 345797 - RNA, 22 nt, Human
ccugugggcgcagcuggaguca

SEQ ID NO: 345798 - RNA, 22 nt, Human
aauuagaagcuguuagcaaaau

SEQ ID NO: 345799 - RNA, 22 nt, Human
agauguuuuuccaggucuaauu

SEQ ID NO: 345800 - RNA, 22 nt, Human
acaguaaucugggaacuuguua

SEQ ID NO: 345801 - RNA, 22 nt, Human
aguaaaaucaccaucucuuugu

SEQ ID NO: 345802 - RNA, 22 nt, Human
guggcuaggcccaacggcagga

SEQ ID NO: 345803 - RNA, 22 nt, Human
guuaaaugcagauucugacuca

SEQ ID NO: 345804 - RNA, 22 nt, Human
aacacuaaaggucaguuagaag

SEQ ID NO: 345805 - RNA, 22 nt, Human
agcagcaggugaccucgaugcc

SEQ ID NO: 345806 - RNA, 22 nt, Human
cagaaacacuguauuuagggaa

SEQ ID NO: 345807 - RNA, 22 nt, Human
guuuugaauacuacuagaacuu

SEQ ID NO: 345808 - RNA, 22 nt, Human
uuguccagcgaccaggcucugu

SEQ ID NO: 345809 - RNA, 22 nt, Human
cuuugggcacugaaguaugggu

SEQ ID NO: 345810 - RNA, 22 nt, Human
acauucaugcaccuuccuaucc

SEQ ID NO: 345811 - RNA, 22 nt, Human
uuccuuucucuggacugcagcc

SEQ ID NO: 345812 - RNA, 22 nt, Human
cauccauagauugagagauggu

SEQ ID NO: 345813 - RNA, 22 nt, Human
cuucucaaaguugugaaucagg

SEQ ID NO: 345814 - RNA, 22 nt, Human
uaaaaucaugacagauugacau

SEQ ID NO: 345815 - RNA, 22 nt, Human
aaagccauaucuauucuauucu

SEQ ID NO: 345816 - RNA, 22 nt, Human
aacaguaugugagauuuacaca

SEQ ID NO: 345817 - RNA, 22 nt, Human
augccaucaaugacagaguuag

SEQ ID NO: 345818 - RNA, 22 nt, Human
gcaggaguguggugggacaucc

SEQ ID NO: 345819 - RNA, 22 nt, Human
aaaucaugguggaagaaacaga

SEQ ID NO: 345820 - RNA, 22 nt, Human
cauuccgcuccccuuccuugcg

SEQ ID NO: 345821 - RNA, 20 nt, Human
caauaauuuacuucccuauu

SEQ ID NO: 345822 - RNA, 22 nt, Human
augaauaaaacauuuuaaucag

SEQ ID NO: 345823 - RNA, 22 nt, Human
uguuaccauaggucagaacguu

SEQ ID NO: 345824 - RNA, 20 nt, Human
caucaacaccuugucagccu

SEQ ID NO: 345825 - RNA, 20 nt, Human
uugaggagauauugaauacu

SEQ ID NO: 345826 - RNA, 22 nt, Human
ugcuuguauucauaucacagcu

SEQ ID NO: 345827 - RNA, 22 nt, Human
ggcuuuuguuucagcucugcua

SEQ ID NO: 345828 - RNA, 21 nt, Human
auacaagaagauggcagucug

SEQ ID NO: 345829 - RNA, 19 nt, Human
uccagaacugcccuggccu

SEQ ID NO: 345830 - RNA, 22 nt, Human
uagcagaacaauagucaaugau

SEQ ID NO: 345831 - RNA, 22 nt, Human
caauaauugcuuuccagaguua

SEQ ID NO: 345832 - RNA, 22 nt, Human
aggcagaugggagcuggaaguu

SEQ ID NO: 345833 - RNA, 18 nt, Human
uagcucuuguugguccau

SEQ ID NO: 345834 - RNA, 22 nt, Human
uaaaugcaguacaaauuguucu

SEQ ID NO: 345835 - RNA, 22 nt, Human
auuacugaggcaaaguaguuuu

SEQ ID NO: 345836 - RNA, 22 nt, Human
uggcucaucuuuuuagacuuau

SEQ ID NO: 345837 - RNA, 20 nt, Human
ucauaugugguuguauacaa

SEQ ID NO: 345838 - RNA, 22 nt, Human
caguaaauguccucgcagggaa

SEQ ID NO: 345839 - RNA, 22 nt, Human
uuaccacagugccugucuaaug

SEQ ID NO: 345840 - RNA, 22 nt, Human
agugacauuauuuuguguacua

SEQ ID NO: 345841 - RNA, 22 nt, Human
cauaacuugguguuggaaacug

SEQ ID NO: 345842 - RNA, 22 nt, Human
cuucucuuggguguggugucuu

SEQ ID NO: 345843 - RNA, 22 nt, Human
gaaacacucaauuuaguaauuc

SEQ ID NO: 345844 - RNA, 22 nt, Human
acuucagugugguauaaaacgu

SEQ ID NO: 345845 - RNA, 22 nt, Human
gcugauggcuugcuggcugaca

SEQ ID NO: 345846 - RNA, 22 nt, Human
ugcauuaagaauuucugaggau

SEQ ID NO: 345847 - RNA, 22 nt, Human
aucaugcagcaacaagcaaggc

SEQ ID NO: 345848 - RNA, 22 nt, Human
aacagaaaucauuuagggcucu

SEQ ID NO: 345849 - RNA, 22 nt, Human
ucucauaauuguuucccagcua

SEQ ID NO: 345850 - RNA, 22 nt, Human
agucaguaugacuuauaguucu

SEQ ID NO: 345851 - RNA, 22 nt, Human
augaaaacagccuccugugaua

SEQ ID NO: 345852 - RNA, 23 nt, Human
auaauaacgucugucuugucucu

SEQ ID NO: 345853 - RNA, 18 nt, Human
ucugugggaucagugagg

SEQ ID NO: 345854 - RNA, 22 nt, Human
aaauugaauuugggaaacauug

SEQ ID NO: 345855 - RNA, 22 nt, Human
aagcaaaagguuacacuucugg

SEQ ID NO: 345856 - RNA, 22 nt, Human
caguauuuaggauuaggagaga

SEQ ID NO: 345857 - RNA, 22 nt, Human
uuguaacaguagcugucagcuc

SEQ ID NO: 345858 - RNA, 22 nt, Human
aagggccacaugccauuuaaaa

SEQ ID NO: 345859 - RNA, 22 nt, Human
uccaaauagcuggaugauggug

SEQ ID NO: 345860 - RNA, 22 nt, Human
auacaccaccuuggaucuuuca

SEQ ID NO: 345861 - RNA, 22 nt, Human
aauaaguacuuggggauaacuu

SEQ ID NO: 345862 - RNA, 22 nt, Human
uaccuugugagcuuucuaacau

SEQ ID NO: 345863 - RNA, 22 nt, Human
cugaggaucuaauuauuggguc

SEQ ID NO: 345864 - RNA, 22 nt, Human
aaacaucuucucuugauucuuu

SEQ ID NO: 345865 - RNA, 22 nt, Human
gcauaaaggacuauaaggauca

SEQ ID NO: 345866 - RNA, 22 nt, Human
agcaggcauuugauauauauuu

SEQ ID NO: 345867 - RNA, 22 nt, Human
cacaccuuaggccugagcgcuu

SEQ ID NO: 345868 - RNA, 22 nt, Human
augcugagugagugaaacccag

SEQ ID NO: 345869 - RNA, 22 nt, Human
auauaguuggguuucauucuac

SEQ ID NO: 345870 - RNA, 22 nt, Human
guuaacaacacugugagugcug

SEQ ID NO: 345871 - RNA, 22 nt, Human
ccuuuuaagggagacuagagau

SEQ ID NO: 345872 - RNA, 22 nt, Human
ugcugcacuuauggcucugagg

SEQ ID NO: 345873 - RNA, 22 nt, Human
aaugccuuggagagccuagagg

SEQ ID NO: 345874 - RNA, 22 nt, Human
uucaacaacuugguucaaaugg

SEQ ID NO: 345875 - RNA, 21 nt, Human
uugauuuagcagaucuagcug

SEQ ID NO: 345876 - RNA, 22 nt, Human
uacaguaaccagucuacuuaga

SEQ ID NO: 345877 - RNA, 22 nt, Human
aagcagcauaugacagcaucca

SEQ ID NO: 345878 - RNA, 22 nt, Human
gaugauuacacuuuuaaaacag

SEQ ID NO: 345879 - RNA, 22 nt, Human
auagcaaaggacaauagucagu

SEQ ID NO: 345880 - RNA, 22 nt, Human
uaccaaaaccaagccauuaucu

SEQ ID NO: 345881 - RNA, 22 nt, Human
cauugcuuugugcauauuuaaa

SEQ ID NO: 345882 - RNA, 22 nt, Human
cauugcuguuaauugucucuag

SEQ ID NO: 345883 - RNA, 22 nt, Human
gcaguugcaggauuuguguugu

SEQ ID NO: 345884 - RNA, 22 nt, Human
aacuuucuuugcaucuaaguuu

SEQ ID NO: 345885 - RNA, 22 nt, Human
aaggcugaauucaaggguaggc

SEQ ID NO: 345886 - RNA, 22 nt, Human
uucauucuugucuuuguauagu

SEQ ID NO: 345887 - RNA, 22 nt, Human
ucagcaguuuuauaugcagcuu

SEQ ID NO: 345888 - RNA, 22 nt, Human
caguaugucuacuggacaaagu

SEQ ID NO: 345889 - RNA, 22 nt, Human
gaugaaaaaagacgagcauaua

SEQ ID NO: 345890 - RNA, 22 nt, Human
cuggccugaggucggcuguagg

SEQ ID NO: 345891 - RNA, 22 nt, Human
aagccagguguugugguaagag

SEQ ID NO: 345892 - RNA, 22 nt, Human
aagaaugauuacaaagcaacga

SEQ ID NO: 345893 - RNA, 22 nt, Human
caggguggaaaagcuaguugga

SEQ ID NO: 345894 - RNA, 22 nt, Human
gcugagagcaguguggccuuaa

SEQ ID NO: 345895 - RNA, 22 nt, Human
uccauuuucaucucauguauaa

SEQ ID NO: 345896 - RNA, 21 nt, Human
agggagcuggccacacagccu

SEQ ID NO: 345897 - RNA, 22 nt, Human
ccagagccucgcccggagccuc

SEQ ID NO: 345898 - RNA, 22 nt, Human
uuugaaagacagaauauuuuug

SEQ ID NO: 345899 - RNA, 21 nt, Human
ugcugccaucaugcagagaug

SEQ ID NO: 345900 - RNA, 22 nt, Human
ccaggaggcagaaguugcagug

SEQ ID NO: 345901 - RNA, 22 nt, Human
aaaagggacuacucucagcucc

SEQ ID NO: 345902 - RNA, 23 nt, Human
aggcugagcucucccagcuucag

SEQ ID NO: 345903 - RNA, 23 nt, Human
ucagcugcuuccuccugccugcc

SEQ ID NO: 345904 - RNA, 22 nt, Human
uggcagcauguuauguaaggaa

SEQ ID NO: 345905 - RNA, 22 nt, Human
acaaagugcacaagaugagaac

SEQ ID NO: 345906 - RNA, 22 nt, Human
ucaaaggcugcuugucuucugg

SEQ ID NO: 345907 - RNA, 22 nt, Human
gaugcagaaaguagacaccauc

SEQ ID NO: 345908 - RNA, 22 nt, Human
acauuugagaugccuuuuaggu

SEQ ID NO: 345909 - RNA, 22 nt, Human
uuuccagguauuaauacuguau

SEQ ID NO: 345910 - RNA, 22 nt, Human
uccuggcccgaucccugugaag

SEQ ID NO: 345911 - RNA, 22 nt, Human
ugucccaggcugaaguacagug

SEQ ID NO: 345912 - RNA, 22 nt, Human
agaaugcaguuugaaauaaggu

SEQ ID NO: 345913 - RNA, 22 nt, Human
uuucuuauacuauauugucauc

SEQ ID NO: 345914 - RNA, 22 nt, Human
ugggaggagcccucugggaagg

SEQ ID NO: 345915 - RNA, 22 nt, Human
acaacuuuagucuggagggaaa

SEQ ID NO: 345916 - RNA, 17 nt, Human
gccaaaggguuccaauc

SEQ ID NO: 345917 - RNA, 20 nt, Human
cuuggccuacuuagcuuugu

SEQ ID NO: 345918 - RNA, 23 nt, Human
acagagguccaaacaguauaagc

SEQ ID NO: 345919 - RNA, 22 nt, Human
ccagagccugcugagccccauu

SEQ ID NO: 345920 - RNA, 22 nt, Human
agggcagcuggaagguggcuuc

SEQ ID NO: 345921 - RNA, 22 nt, Human
agcuuuaucccuugcccaucga

SEQ ID NO: 345922 - RNA, 22 nt, Human
uucaggaucacuaaacccucca

SEQ ID NO: 345923 - RNA, 17 nt, Human
gggcugacaguggccuc

SEQ ID NO: 345924 - RNA, 22 nt, Human
ucuguucagacacuuuacaugu

SEQ ID NO: 345925 - RNA, 22 nt, Human
uggcugagaccuucccaaauuc

SEQ ID NO: 345926 - RNA, 22 nt, Human
aggcacaguuucauccccgggc

SEQ ID NO: 345927 - RNA, 22 nt, Human
gaggcagcaggcugaggaggau

SEQ ID NO: 345928 - RNA, 22 nt, Human
cugccuuccaaccccagacucc

SEQ ID NO: 345929 - RNA, 22 nt, Human
cuugcuggugguguuuucuaug

SEQ ID NO: 345930 - RNA, 22 nt, Human
agaaauguauagugaauuuuuc

SEQ ID NO: 345931 - RNA, 22 nt, Human
gaaguuuauuucaaucuauuca

SEQ ID NO: 345932 - RNA, 22 nt, Human
acucugccuuucagcagaugaa

SEQ ID NO: 345933 - RNA, 22 nt, Human
ucacacguccuugcuacuccuc

SEQ ID NO: 345934 - RNA, 19 nt, Human
acauggcaucccaggaggu

SEQ ID NO: 345935 - RNA, 22 nt, Human
ugcaggaauuuuuugcagaaag

SEQ ID NO: 345936 - RNA, 22 nt, Human
uggcucagcaagacauugaccu

SEQ ID NO: 345937 - RNA, 22 nt, Human
aaggcagccaugugcuuugggu

SEQ ID NO: 345938 - RNA, 22 nt, Human
ugagccuguccugugcauguga

SEQ ID NO: 345939 - RNA, 21 nt, Human
gacaaagugaagcaggcagga

SEQ ID NO: 345940 - RNA, 22 nt, Human
uucaaucauuuuuacauagucc

SEQ ID NO: 345941 - RNA, 22 nt, Human
ggccucaguuucuccauggguu

SEQ ID NO: 345942 - RNA, 22 nt, Human
augagcuucccagacaggaugg

SEQ ID NO: 345943 - RNA, 22 nt, Human
uggcuuuaggagcuauauaccu

SEQ ID NO: 345944 - RNA, 21 nt, Human
uggagcugccacuuguccucc

SEQ ID NO: 345945 - RNA, 22 nt, Human
uugcagagugguugugaggauu

SEQ ID NO: 345946 - RNA, 22 nt, Human
augugugccccuuuuacucuuu

SEQ ID NO: 345947 - RNA, 22 nt, Human
cuggggcuucaaugcuucggug

SEQ ID NO: 345948 - RNA, 22 nt, Human
uagaggcagaagaaauugacaa

SEQ ID NO: 345949 - RNA, 22 nt, Human
caaauucucaagguuuauccca

SEQ ID NO: 345950 - RNA, 22 nt, Human
auuuguacaaauuuauguuagu

SEQ ID NO: 345951 - RNA, 22 nt, Human
cacauuucuaggaaauuaaaug

SEQ ID NO: 345952 - RNA, 22 nt, Human
cuggagugaagcuuauuuuuca

SEQ ID NO: 345953 - RNA, 22 nt, Human
accaucagucauugucaguggg

SEQ ID NO: 345954 - RNA, 23 nt, Human
cugcagccgcguggggacgugga

SEQ ID NO: 345955 - RNA, 22 nt, Human
aucuucucauguguaaugaggu

SEQ ID NO: 345956 - RNA, 22 nt, Human
aaagauuauggcauugaaauac

SEQ ID NO: 345957 - RNA, 22 nt, Human
ugcucccaggcucuguggucug

SEQ ID NO: 345958 - RNA, 22 nt, Human
caauuucaaugaggccacaggg

SEQ ID NO: 345959 - RNA, 22 nt, Human
uucagagaugacaccugguguu

SEQ ID NO: 345960 - RNA, 22 nt, Human
uguuugcucugacuaucuugcg

SEQ ID NO: 345961 - RNA, 22 nt, Human
uggaagaaggcagagaggcauu

SEQ ID NO: 345962 - RNA, 22 nt, Human
guaggaaagggagugaagggaa

SEQ ID NO: 345963 - RNA, 20 nt, Human
aguguuccggaagacuggca

SEQ ID NO: 345964 - RNA, 22 nt, Human
cuggugucugcucccucacagc

SEQ ID NO: 345965 - RNA, 22 nt, Human
gcuggaaggcuaggcucaguug

SEQ ID NO: 345966 - RNA, 22 nt, Human
agcccaugcaacaggccuagcg

SEQ ID NO: 345967 - RNA, 22 nt, Human
aggagccuccuucucaugugca

SEQ ID NO: 345968 - RNA, 22 nt, Human
ggcagggcaggaaagucaggaa

SEQ ID NO: 345969 - RNA, 22 nt, Human
acccaggagcaggcugggcagu

SEQ ID NO: 345970 - RNA, 22 nt, Human
caguguguggauccucccagga

SEQ ID NO: 345971 - RNA, 16 nt, Human
uggaaggggucuccgg

SEQ ID NO: 345972 - RNA, 22 nt, Human
uucaggaugcucagaguagucu

SEQ ID NO: 345973 - RNA, 22 nt, Human
gcuggcaccugcaccaagcagg

SEQ ID NO: 345974 - RNA, 22 nt, Human
cuuugaauugccguuucaucug

SEQ ID NO: 345975 - RNA, 22 nt, Human
acagccagguaaaggcauggca

SEQ ID NO: 345976 - RNA, 22 nt, Human
auucuucauuuacuguuacuug

SEQ ID NO: 345977 - RNA, 22 nt, Human
ccagggugugggcgucggcacg

SEQ ID NO: 345978 - RNA, 22 nt, Human
auugaaagagaauguagcucuu

SEQ ID NO: 345979 - RNA, 22 nt, Human
cugccagccaggccagguaggc

SEQ ID NO: 345980 - RNA, 22 nt, Human
acacaaacugcuagaaaauugg

SEQ ID NO: 345981 - RNA, 22 nt, Human
gugucaugggagucagaaguga

SEQ ID NO: 345982 - RNA, 22 nt, Human
uggcucugcugaaccuagugca

SEQ ID NO: 345983 - RNA, 20 nt, Human
gccugccucagcuagcugag

SEQ ID NO: 345984 - RNA, 22 nt, Human
agggugucagccacggaauggg

SEQ ID NO: 345985 - RNA, 22 nt, Human
ugccuggaugugcuggccucac

SEQ ID NO: 345986 - RNA, 22 nt, Human
ucacugucugaaagaaauggcc

SEQ ID NO: 345987 - RNA, 22 nt, Human
agggcugcaccggggcuucgcg

SEQ ID NO: 345988 - RNA, 22 nt, Human
agcacagaguugcagagagcgu

SEQ ID NO: 345989 - RNA, 22 nt, Human
acagagauguggaugagggauu

SEQ ID NO: 345990 - RNA, 22 nt, Human
agcagcaucaacccucccgugu

SEQ ID NO: 345991 - RNA, 22 nt, Human
aaauuugauaagccauuguuac

SEQ ID NO: 345992 - RNA, 22 nt, Human
uuacagaacugucuugaaauuu

SEQ ID NO: 345993 - RNA, 21 nt, Human
acagcaagccuucacaugagu

SEQ ID NO: 345994 - RNA, 22 nt, Human
caucauaaaauugagauaacug

SEQ ID NO: 345995 - RNA, 22 nt, Human
aaaugcuguaacugauauucug

SEQ ID NO: 345996 - RNA, 22 nt, Human
uucugugcccauuuuaaaaugg

SEQ ID NO: 345997 - RNA, 22 nt, Human
gcugucuuccuugcuccaaggg

SEQ ID NO: 345998 - RNA, 22 nt, Human
caagaaaugggauuugacugcc

SEQ ID NO: 345999 - RNA, 23 nt, Human
ucuuuacauacugaugaguucuc

SEQ ID NO: 346000 - RNA, 22 nt, Human
cuuugcaaacgauuaccacaug

SEQ ID NO: 346001 - RNA, 22 nt, Human
agauguggccggcuagggagag

SEQ ID NO: 346002 - RNA, 22 nt, Human
caggcugccgugaagcaggccu

SEQ ID NO: 346003 - RNA, 22 nt, Human
gcagaggacacaggagggcaag

SEQ ID NO: 346004 - RNA, 22 nt, Human
gccugagcuacuagggagucug

SEQ ID NO: 346005 - RNA, 20 nt, Human
ugaggcaggagaauggcaug

SEQ ID NO: 346006 - RNA, 19 nt, Human
ucaaaggcuuuuaggagac

SEQ ID NO: 346007 - RNA, 22 nt, Human
cauucauuuaugaaauaucuau

SEQ ID NO: 346008 - RNA, 22 nt, Human
gccucugcgccucagccgaccu

SEQ ID NO: 346009 - RNA, 22 nt, Human
gugcucaggaagcuguuccugc

SEQ ID NO: 346010 - RNA, 22 nt, Human
agaagccagaggcaguggguac

SEQ ID NO: 346011 - RNA, 22 nt, Human
cuguggaauugaugcuuagugu

SEQ ID NO: 346012 - RNA, 22 nt, Human
cagcuccagcccaggcagcucc

SEQ ID NO: 346013 - RNA, 22 nt, Human
cuugcacacauguacaugugua

SEQ ID NO: 346014 - RNA, 22 nt, Human
cugcugugagugguucuugccu

SEQ ID NO: 346015 - RNA, 18 nt, Human
aaggcuucaaagaguaga

SEQ ID NO: 346016 - RNA, 22 nt, Human
ugucucugguauuaggugaaaa

SEQ ID NO: 346017 - RNA, 22 nt, Human
ucccaggccauaaaacucagag

SEQ ID NO: 346018 - RNA, 18 nt, Human
aguggucuguuauaucau

SEQ ID NO: 346019 - RNA, 21 nt, Human
gcugcugccccuagugaggcc

SEQ ID NO: 346020 - RNA, 22 nt, Human
gaucuucuagcagaaguaauuu

SEQ ID NO: 346021 - RNA, 22 nt, Human
uggcccugcagaacuagccugg

SEQ ID NO: 346022 - RNA, 22 nt, Human
cagccagccucucaaccaugca

SEQ ID NO: 346023 - RNA, 22 nt, Human
aggacaggauugagcugaacug

SEQ ID NO: 346024 - RNA, 22 nt, Human
agaaauaugcugauuagaugaa

SEQ ID NO: 346025 - RNA, 22 nt, Human
aagucacaagcauauaugcauu

SEQ ID NO: 346026 - RNA, 20 nt, Human
uucaggauucuagaccacac

SEQ ID NO: 346027 - RNA, 22 nt, Human
agaaagcacucugucuuuuacc

SEQ ID NO: 346028 - RNA, 21 nt, Human
guagggacagagaguugguga

SEQ ID NO: 346029 - RNA, 22 nt, Human
ucuacugugguccuuguaacca

SEQ ID NO: 346030 - RNA, 22 nt, Human
ucagccagaggcuucuugguuu

SEQ ID NO: 346031 - RNA, 22 nt, Human
cucaggaugaaagucaugguga

SEQ ID NO: 346032 - RNA, 17 nt, Human
aggagucucagaugagc

SEQ ID NO: 346033 - RNA, 22 nt, Human
aagcaucucuauguggagagug

SEQ ID NO: 346034 - RNA, 17 nt, Human
ggugagaccucccacuc

SEQ ID NO: 346035 - RNA, 22 nt, Human
agccaggcuaaaugagccauga

SEQ ID NO: 346036 - RNA, 22 nt, Human
agccucucuccagcuuggcaga

SEQ ID NO: 346037 - RNA, 21 nt, Human
ugcaggagucugugagucagg

SEQ ID NO: 346038 - RNA, 20 nt, Human
caucaucacaugagccaauu

SEQ ID NO: 346039 - RNA, 22 nt, Human
caccagggcagcagccuagucu

SEQ ID NO: 346040 - RNA, 22 nt, Human
ucuauacacacaaagaaugcuu

SEQ ID NO: 346041 - RNA, 22 nt, Human
ugauuuccuaggucuggagaag

SEQ ID NO: 346042 - RNA, 22 nt, Human
cucuggagaugguucucaauug

SEQ ID NO: 346043 - RNA, 21 nt, Human
agaugaggauacugaggccua

SEQ ID NO: 346044 - RNA, 22 nt, Human
cagaagaggacuggguagcuca

SEQ ID NO: 346045 - RNA, 22 nt, Human
aggccagcaagaaagagagucu

SEQ ID NO: 346046 - RNA, 22 nt, Human
cucuucuuuaguccagaccauc

SEQ ID NO: 346047 - RNA, 22 nt, Human
auuauuagacuuauaugguagu

SEQ ID NO: 346048 - RNA, 23 nt, Human
acagccaguucaccucuccuugg

SEQ ID NO: 346049 - RNA, 22 nt, Human
cugggccuuggauugacacugu

SEQ ID NO: 346050 - RNA, 22 nt, Human
gggcugacaccacccaggcgca

SEQ ID NO: 346051 - RNA, 22 nt, Human
auccugugcaaugacugcaucu

SEQ ID NO: 346052 - RNA, 22 nt, Human
cagaaaaccugacucuagaacu

SEQ ID NO: 346053 - RNA, 22 nt, Human
ggauggcaggacaaggacccag

SEQ ID NO: 346054 - RNA, 22 nt, Human
cccagggcccuggacagcuaca

SEQ ID NO: 346055 - RNA, 22 nt, Human
cauuuucucaaugaacccucuu

SEQ ID NO: 346056 - RNA, 22 nt, Human
acuuugaaacuaaaauucauua

SEQ ID NO: 346057 - RNA, 22 nt, Human
gacagccucaugaggagcaaaa

SEQ ID NO: 346058 - RNA, 22 nt, Human
agguaaagacagugaaagaggg

SEQ ID NO: 346059 - RNA, 22 nt, Human
aagcaaaagguuacacuucugg

SEQ ID NO: 346060 - RNA, 22 nt, Human
gcugggcagccuggccgcugcc

SEQ ID NO: 346061 - RNA, 22 nt, Human
ugugcagggaagggcaugcuau

SEQ ID NO: 346062 - RNA, 22 nt, Human
uggauaaacucacuguaaguug

SEQ ID NO: 346063 - RNA, 22 nt, Human
uccaugagcuagggauucauca

SEQ ID NO: 346064 - RNA, 21 nt, Human
aaugugugcuauuuaucuuuu

SEQ ID NO: 346065 - RNA, 22 nt, Human
agggcccuccccgcucagggca

SEQ ID NO: 346066 - RNA, 22 nt, Human
augcaaaauaaggcagaaacau

SEQ ID NO: 346067 - RNA, 22 nt, Human
ugaaaaggagccuuagguaggu

SEQ ID NO: 346068 - RNA, 22 nt, Human
aaggacagaaacagauugcugg

SEQ ID NO: 346069 - RNA, 22 nt, Human
aaaagguagauucuccuucuau

SEQ ID NO: 346070 - RNA, 22 nt, Human
cuggcagccaagugggauacuc

SEQ ID NO: 346071 - RNA, 22 nt, Human
aauuuagaauucgcuagcuaau

SEQ ID NO: 346072 - RNA, 22 nt, Human
ucaggaugagcucauaacuaug

SEQ ID NO: 346073 - RNA, 22 nt, Human
uccuggccgccgcguggggccg

SEQ ID NO: 346074 - RNA, 22 nt, Human
agaggcggagguugcagugagc

SEQ ID NO: 346075 - RNA, 22 nt, Human
gaagccaggggccugacaggca

SEQ ID NO: 346076 - RNA, 20 nt, Human
cagagcuguuauggaugaug

SEQ ID NO: 346077 - RNA, 22 nt, Human
gcugagagaaaagugagguucu

SEQ ID NO: 346078 - RNA, 22 nt, Human
auuaguaaaacauuguauaugu

SEQ ID NO: 346079 - RNA, 22 nt, Human
cuauugaauagcccaaaucauu

SEQ ID NO: 346080 - RNA, 22 nt, Human
cauggcagugauucagccuuug

SEQ ID NO: 346081 - RNA, 22 nt, Human
ggcacugauuccauucaugaag

SEQ ID NO: 346082 - RNA, 22 nt, Human
acuuucucccacccacccgucu

SEQ ID NO: 346083 - RNA, 22 nt, Human
aggagucaggaccaaauggaaa

SEQ ID NO: 346084 - RNA, 17 nt, Human
aggcagcucagaacauc

SEQ ID NO: 346085 - RNA, 22 nt, Human
agguggagugaaggaaaggcag

SEQ ID NO: 346086 - RNA, 18 nt, Human
acauuucuaggugaaagc

SEQ ID NO: 346087 - RNA, 22 nt, Human
aaggccaggagacuuggaguca

SEQ ID NO: 346088 - RNA, 22 nt, Human
acuucauuguaauauuauagca

SEQ ID NO: 346089 - RNA, 22 nt, Human
aaguuucauguggagguagacu

SEQ ID NO: 346090 - RNA, 22 nt, Human
gccuguccacuaaacagccaag

SEQ ID NO: 346091 - RNA, 22 nt, Human
agugugggugagggaggcccuc

SEQ ID NO: 346092 - RNA, 22 nt, Human
uucaaugauuuuuagggaucau

SEQ ID NO: 346093 - RNA, 22 nt, Human
auguaucaugcaggguccauga

SEQ ID NO: 346094 - RNA, 20 nt, Human
acaauagauuugagcaaagu

SEQ ID NO: 346095 - RNA, 18 nt, Human
aggcacuggaauuaaggg

SEQ ID NO: 346096 - RNA, 22 nt, Human
ugugggcucccccucacucugu

SEQ ID NO: 346097 - RNA, 22 nt, Human
ugcaggugugguuccucagcca

SEQ ID NO: 346098 - RNA, 22 nt, Human
uuguuucauggggauguuuauu

SEQ ID NO: 346099 - RNA, 22 nt, Human
cucuggccugcuuccucaggua

SEQ ID NO: 346100 - RNA, 22 nt, Human
uauacagucuuuugcuauauuc

SEQ ID NO: 346101 - RNA, 22 nt, Human
acugagcucuugacugggaguu

SEQ ID NO: 346102 - RNA, 22 nt, Human
ugcuuuauucccuucugaugug

SEQ ID NO: 346103 - RNA, 21 nt, Human
acacugugucauaaugcuuaa

SEQ ID NO: 346104 - RNA, 22 nt, Human
acugccuuauaugcugugugug

SEQ ID NO: 346105 - RNA, 22 nt, Human
aaucaguguguaaaguggcugc

SEQ ID NO: 346106 - RNA, 22 nt, Human
uaugaaaauuuagcugaagcau

SEQ ID NO: 346107 - RNA, 22 nt, Human
uguaucaaggguuuauguaagc

SEQ ID NO: 346108 - RNA, 22 nt, Human
ccagcugucacucagaaaggcc

SEQ ID NO: 346109 - RNA, 22 nt, Human
aaguguuuauuuauaacgaucu

SEQ ID NO: 346110 - RNA, 22 nt, Human
uauugaugcuuggauugggcca

SEQ ID NO: 346111 - RNA, 22 nt, Human
ucacagaagaugcuggauguug

SEQ ID NO: 346112 - RNA, 22 nt, Human
uacccagcuccucagaagacca

SEQ ID NO: 346113 - RNA, 22 nt, Human
aaggagagguuguccguguugu

SEQ ID NO: 346114 - RNA, 21 nt, Human
uaagccaccaugugaaaccag

SEQ ID NO: 346115 - RNA, 22 nt, Human
aggucccaggcauagcuggucu

SEQ ID NO: 346116 - RNA, 22 nt, Human
gcacccagcccagggcgugaug

SEQ ID NO: 346117 - RNA, 21 nt, Human
uccauuguuuucccaggguuu

SEQ ID NO: 346118 - RNA, 22 nt, Human
ugagacaaccuaauuaaacacc

SEQ ID NO: 346119 - RNA, 22 nt, Human
cucccaggguagggagagacua

SEQ ID NO: 346120 - RNA, 22 nt, Human
ugacauuuaucaaagaaauggu

SEQ ID NO: 346121 - RNA, 22 nt, Human
ucccagauucuucugugugggc

SEQ ID NO: 346122 - RNA, 22 nt, Human
acagggcagagugaaaugcuau

SEQ ID NO: 346123 - RNA, 22 nt, Human
cauagcaacagcaucaagucaa

SEQ ID NO: 346124 - RNA, 22 nt, Human
cauuuacuguugaaucccuagc

SEQ ID NO: 346125 - RNA, 22 nt, Human
uucauacucacuccaauaacug

SEQ ID NO: 346126 - RNA, 20 nt, Human
aggcagcuggccaggcaggu

SEQ ID NO: 346127 - RNA, 22 nt, Human
agccauccuacuaccucagcau

SEQ ID NO: 346128 - RNA, 22 nt, Human
cauaauuacugauaugcugauu

SEQ ID NO: 346129 - RNA, 22 nt, Human
ggcucuggugcccuggcuccca

SEQ ID NO: 346130 - RNA, 22 nt, Human
uuucagaaagcugaacauauga

SEQ ID NO: 346131 - RNA, 22 nt, Human
aaaucaguucucccuuucuuca

SEQ ID NO: 346132 - RNA, 20 nt, Human
gcaggcagggaaugggggug

SEQ ID NO: 346133 - RNA, 22 nt, Human
aggcugagacugugcauuagug

SEQ ID NO: 346134 - RNA, 22 nt, Human
guuaggcagugugguauagcag

SEQ ID NO: 346135 - RNA, 19 nt, Human
ggcugccuuuccuuaccag

SEQ ID NO: 346136 - RNA, 22 nt, Human
agaacagaugugggcagaccug

SEQ ID NO: 346137 - RNA, 22 nt, Human
aaaagacauaugugggcauucu

SEQ ID NO: 346138 - RNA, 22 nt, Human
ucucccaguccucugugcuuac

SEQ ID NO: 346139 - RNA, 22 nt, Human
gagccaggcccguacuugcugu

SEQ ID NO: 346140 - RNA, 22 nt, Human
augcuauacucaaagaaauuca

SEQ ID NO: 346141 - RNA, 22 nt, Human
cagagcugucauuugccaguga

SEQ ID NO: 346142 - RNA, 22 nt, Human
ugaauaaucuuggguauuaaua

SEQ ID NO: 346143 - RNA, 22 nt, Human
gugcucacugugagacguccug

SEQ ID NO: 346144 - RNA, 22 nt, Human
ugggcagagaucuggaucaaac

SEQ ID NO: 346145 - RNA, 22 nt, Human
uccuuucccuuuccauccuggc

SEQ ID NO: 346146 - RNA, 22 nt, Human
gugcauugcgaugcagacgacc

SEQ ID NO: 346147 - RNA, 22 nt, Human
ucugagcuacgaugccugucac

SEQ ID NO: 346148 - RNA, 22 nt, Human
cucugcugcccaggccugcuag

SEQ ID NO: 346149 - RNA, 22 nt, Human
agagccugcuguguaagucaca

SEQ ID NO: 346150 - RNA, 22 nt, Human
cuucucagucaccugugagucu

SEQ ID NO: 346151 - RNA, 22 nt, Human
cccaggagaauauuuuuggguc

SEQ ID NO: 346152 - RNA, 22 nt, Human
ucccagagcaguacuccaggag

SEQ ID NO: 346153 - RNA, 22 nt, Human
cagagccagcaguggggacagg

SEQ ID NO: 346154 - RNA, 19 nt, Human
ucugcuggcagaauucccu

SEQ ID NO: 346155 - RNA, 22 nt, Human
cuuauuagaguuguguucuguu

SEQ ID NO: 346156 - RNA, 22 nt, Human
uucaagaucuggguuuucagcu

SEQ ID NO: 346157 - RNA, 22 nt, Human
gaggcucaacccacagggguug

SEQ ID NO: 346158 - RNA, 22 nt, Human
gggaccaggugggugcauuccg

SEQ ID NO: 346159 - RNA, 22 nt, Human
aagcuccccgaaacccaccucu

SEQ ID NO: 346160 - RNA, 22 nt, Human
accucaggauguggacacagaa

SEQ ID NO: 346161 - RNA, 22 nt, Human
agacagcaggggagucugguuu

SEQ ID NO: 346162 - RNA, 22 nt, Human
uggcagcuuccugcucauagga

SEQ ID NO: 346163 - RNA, 22 nt, Human
cccaggcauuuucaacuuuagu

SEQ ID NO: 346164 - RNA, 22 nt, Human
caguguuucugaguuccagcuc

SEQ ID NO: 346165 - RNA, 22 nt, Human
ccuggugcuuaccagagcuuuu

SEQ ID NO: 346166 - RNA, 22 nt, Human
agcugcucaggagagccagguc

SEQ ID NO: 346167 - RNA, 18 nt, Human
ucacagugcucuugccua

SEQ ID NO: 346168 - RNA, 22 nt, Human
acucaguacaucuggaguuggc

SEQ ID NO: 346169 - RNA, 22 nt, Human
ccugucugcaugaucccugcca

SEQ ID NO: 346170 - RNA, 22 nt, Human
ugccucugggugaccaaggagc

SEQ ID NO: 346171 - RNA, 22 nt, Human
guauacagauacuuagacgugc

SEQ ID NO: 346172 - RNA, 22 nt, Human
ggcuuuauuauguggccaugug

SEQ ID NO: 346173 - RNA, 22 nt, Human
ucacagaagagauauugacaga

SEQ ID NO: 346174 - RNA, 22 nt, Human
gguuggggcgagcuggaggccc

SEQ ID NO: 346175 - RNA, 22 nt, Human
caugcuuuaccaaagcagugau

SEQ ID NO: 346176 - RNA, 22 nt, Human
aaggagucugggccauucagag

SEQ ID NO: 346177 - RNA, 19 nt, Human
caguggagauuggaggagg

SEQ ID NO: 346178 - RNA, 19 nt, Human
agccuggcuuugcucugcu

SEQ ID NO: 346179 - RNA, 22 nt, Human
ugagccuggcggaagcagcgug

SEQ ID NO: 346180 - RNA, 22 nt, Human
gcaacuuuagggccagcaagua

SEQ ID NO: 346181 - RNA, 22 nt, Human
uccucuggggucagggcacuac

SEQ ID NO: 346182 - RNA, 22 nt, Human
augaauaaaacauuuuaaucag

SEQ ID NO: 346183 - RNA, 22 nt, Human
gcaggccuccccugcuggagcu

SEQ ID NO: 346184 - RNA, 22 nt, Human
ugcagggacaggcucuggggau

SEQ ID NO: 346185 - RNA, 22 nt, Human
cugucccucaucaccucugggu

SEQ ID NO: 346186 - RNA, 22 nt, Human
cccaggaaaguggaggcggcug

SEQ ID NO: 346187 - RNA, 22 nt, Human
augcuauacauaugacaucaca

SEQ ID NO: 346188 - RNA, 22 nt, Human
ucacaguaaaagcauggaagag

SEQ ID NO: 346189 - RNA, 22 nt, Human
agagccuggaccugagcuacaa

SEQ ID NO: 346190 - RNA, 22 nt, Human
aggucaaguuuagauagaguua

SEQ ID NO: 346191 - RNA, 20 nt, Human
cugccaugauugauagagug

SEQ ID NO: 346192 - RNA, 22 nt, Human
cagcagugcuucagugugagau

SEQ ID NO: 346193 - RNA, 22 nt, Human
aacagaauaguugauguacagu

SEQ ID NO: 346194 - RNA, 22 nt, Human
uacacacaugcauuugccuuau

SEQ ID NO: 346195 - RNA, 22 nt, Human
cuugggaaugcuaacagaugac

SEQ ID NO: 346196 - RNA, 22 nt, Human
agggcugccugacuccagagcc

SEQ ID NO: 346197 - RNA, 22 nt, Human
gggaagcagcauugugcuggcu

SEQ ID NO: 346198 - RNA, 22 nt, Human
ucuggauccuaugcacuggacu

SEQ ID NO: 346199 - RNA, 22 nt, Human
auacaucuuccuuuuaaaaugc

SEQ ID NO: 346200 - RNA, 22 nt, Human
cugagccaguagucagggacaa

SEQ ID NO: 346201 - RNA, 22 nt, Human
ugaggcuguucuaccagggcca

SEQ ID NO: 346202 - RNA, 22 nt, Human
uuacagaaaagggguuguccuu

SEQ ID NO: 346203 - RNA, 22 nt, Human
ugaacaaacugcauucuucacu

SEQ ID NO: 346204 - RNA, 22 nt, Human
agagcugggacuuggacucaau

SEQ ID NO: 346205 - RNA, 22 nt, Human
aaugccaguguguugauuccag

SEQ ID NO: 346206 - RNA, 22 nt, Human
gggcuggaucuccugcaggcag

SEQ ID NO: 346207 - RNA, 22 nt, Human
ucccagggcacucacccucccu

SEQ ID NO: 346208 - RNA, 22 nt, Human
gccccucccagucaggagcacu

SEQ ID NO: 346209 - RNA, 22 nt, Human
gcucccugacucaguuccugag

SEQ ID NO: 346210 - RNA, 20 nt, Human
uugauucaagggcugaugga

SEQ ID NO: 346211 - RNA, 22 nt, Human
gcaguguuguuaaaagauuaga

SEQ ID NO: 346212 - RNA, 22 nt, Human
cagucacuggaauagcugagga

SEQ ID NO: 346213 - RNA, 22 nt, Human
uacacaugaucauuuaguagca

SEQ ID NO: 346214 - RNA, 22 nt, Human
agaaauguauucuguauguuuu

SEQ ID NO: 346215 - RNA, 22 nt, Human
auacauacauguaugcacauac

SEQ ID NO: 346216 - RNA, 21 nt, Human
accaggcuugugggagggagc

SEQ ID NO: 346217 - RNA, 22 nt, Human
ugaaggagcugauguaaggggu

SEQ ID NO: 346218 - RNA, 22 nt, Human
gcccagcacauugcugaggacc

SEQ ID NO: 346219 - RNA, 22 nt, Human
gggcugaguuccugccucacuc

SEQ ID NO: 346220 - RNA, 22 nt, Human
ggcagugacuguucagacgucc

SEQ ID NO: 346221 - RNA, 22 nt, Human
ucucaccaaagccuugaccaua

SEQ ID NO: 346222 - RNA, 22 nt, Human
aagggaggaggauuuauuguac

SEQ ID NO: 346223 - RNA, 22 nt, Human
caaguccuccaugugacuaggu

SEQ ID NO: 346224 - RNA, 22 nt, Human
gagggaaagguuaauacaugau

SEQ ID NO: 346225 - RNA, 22 nt, Human
caucacccggaacugugucugc

SEQ ID NO: 346226 - RNA, 22 nt, Human
aaccauuugccauuaucuuaag

SEQ ID NO: 346227 - RNA, 22 nt, Human
ggcucugcaugugagugggugg

SEQ ID NO: 346228 - RNA, 22 nt, Human
ugagcugggcugggcugagcug

SEQ ID NO: 346229 - RNA, 23 nt, Human
ucaguuuuggcuguucaguguug

SEQ ID NO: 346230 - RNA, 22 nt, Human
cagggcaguuugugccuaugag

SEQ ID NO: 346231 - RNA, 22 nt, Human
ccagagacgucggucagggcgc

SEQ ID NO: 346232 - RNA, 19 nt, Human
ugccuggacaaaugugggg

SEQ ID NO: 346233 - RNA, 22 nt, Human
agggaggcaggaaaguugucug

SEQ ID NO: 346234 - RNA, 22 nt, Human
uuuauccauucaccaguugaac

SEQ ID NO: 346235 - RNA, 22 nt, Human
uuaaauuccagccucauaauag

SEQ ID NO: 346236 - RNA, 22 nt, Human
ccuugcugcgugcuagcacaga

SEQ ID NO: 346237 - RNA, 22 nt, Human
cuguuuauacgacagguggagg

SEQ ID NO: 346238 - RNA, 22 nt, Human
augcacagacccaaaggccauc

SEQ ID NO: 346239 - RNA, 22 nt, Human
ucaggagauguaaccuuagcug

SEQ ID NO: 346240 - RNA, 22 nt, Human
caguucuuaauaccaugugguu

SEQ ID NO: 346241 - RNA, 22 nt, Human
cugagaggcacaaggcauuucg

SEQ ID NO: 346242 - RNA, 22 nt, Human
auuauauaggacuugcccuucc

SEQ ID NO: 346243 - RNA, 22 nt, Human
gaagccacagagauuguggggg

SEQ ID NO: 346244 - RNA, 22 nt, Human
uggcagcacuagguacugagcu

SEQ ID NO: 346245 - RNA, 22 nt, Human
ccuggagaccagaggauacuuc

SEQ ID NO: 346246 - RNA, 23 nt, Human
uugugggcagauuccauggggag

SEQ ID NO: 346247 - RNA, 22 nt, Human
auccaaaccuggacaugagugg

SEQ ID NO: 346248 - RNA, 22 nt, Human
cagaaauguuuauauguggugu

SEQ ID NO: 346249 - RNA, 22 nt, Human
cugggccagucucggccgcucu

SEQ ID NO: 346250 - RNA, 22 nt, Human
ucccugggccuccugcuaugca

SEQ ID NO: 346251 - RNA, 22 nt, Human
acccaggagagagcuauaaaau

SEQ ID NO: 346252 - RNA, 22 nt, Human
agggagcuuccgaacuacagcu

SEQ ID NO: 346253 - RNA, 22 nt, Human
agaggcuccuucacucuggcac

SEQ ID NO: 346254 - RNA, 22 nt, Human
cugccuguuuucugauagauuu

SEQ ID NO: 346255 - RNA, 22 nt, Human
agcuccuccugugccaggccag

SEQ ID NO: 346256 - RNA, 22 nt, Human
gggcagcucugcccaucagagg

SEQ ID NO: 346257 - RNA, 22 nt, Human
agcuucucaggagucugaggca

SEQ ID NO: 346258 - RNA, 22 nt, Human
gggucccaggaaggagcagugu

SEQ ID NO: 346259 - RNA, 22 nt, Human
uaaagcaggccacauaugugau

SEQ ID NO: 346260 - RNA, 22 nt, Human
aggcugugcaauuaggguaaga

SEQ ID NO: 346261 - RNA, 22 nt, Human
accagagcuggcucugagcacc

SEQ ID NO: 346262 - RNA, 22 nt, Human
aagauuucagaguuugggggaa

SEQ ID NO: 346263 - RNA, 22 nt, Human
aaggcccuggccccagcuucuu

SEQ ID NO: 346264 - RNA, 22 nt, Human
caccagacagguguaugcauau

SEQ ID NO: 346265 - RNA, 22 nt, Human
guuauguaaucuaacacucagu

SEQ ID NO: 346266 - RNA, 22 nt, Human
cccaagagguggagguugcagu

SEQ ID NO: 346267 - RNA, 22 nt, Human
agucucagaaaagaagcaugga

SEQ ID NO: 346268 - RNA, 22 nt, Human
acuguucauuuguccuguaucu

SEQ ID NO: 346269 - RNA, 22 nt, Human
cugagcugggaguagagacucu

SEQ ID NO: 346270 - RNA, 22 nt, Human
ucucaggaagugauauugagac

SEQ ID NO: 346271 - RNA, 22 nt, Human
uguauacaggcauaagagauac

SEQ ID NO: 346272 - RNA, 21 nt, Human
auacagaaggcagacucucuc

SEQ ID NO: 346273 - RNA, 22 nt, Human
gucaggaucucccaguacauau

SEQ ID NO: 346274 - RNA, 22 nt, Human
gcugucccgcugacuuccagcu

SEQ ID NO: 346275 - RNA, 22 nt, Human
agaggcuguuacacucccagau

SEQ ID NO: 346276 - RNA, 22 nt, Human
uugcaucuagggcaacccagag

SEQ ID NO: 346277 - RNA, 22 nt, Human
agaggccuaaccaagauguccu

SEQ ID NO: 346278 - RNA, 22 nt, Human
uuuguaaaaggaggaagcaugg

SEQ ID NO: 346279 - RNA, 22 nt, Human
ccaggacuuauuacaguauaac

SEQ ID NO: 346280 - RNA, 22 nt, Human
uggccugcccagagcagcucug

SEQ ID NO: 346281 - RNA, 22 nt, Human
uaugucaaaguuaagaaauagg

SEQ ID NO: 346282 - RNA, 22 nt, Human
uguccucagauaugucuacucu

SEQ ID NO: 346283 - RNA, 22 nt, Human
gagcacagccaaaguaagaagg

SEQ ID NO: 346284 - RNA, 22 nt, Human
cagagcauuaaaaccagcucug

SEQ ID NO: 346285 - RNA, 22 nt, Human
gaagccccaaacccucgccauc

SEQ ID NO: 346286 - RNA, 22 nt, Human
uugcauuuaaguagauguuaca

SEQ ID NO: 346287 - RNA, 22 nt, Human
aaauugcagaugcuaaaugacu

SEQ ID NO: 346288 - RNA, 21 nt, Human
cauuagggcagaagcaggaag

SEQ ID NO: 346289 - RNA, 22 nt, Human
agucaccaacaugguucccagg

SEQ ID NO: 346290 - RNA, 22 nt, Human
uuugcauuugcaaauaaugaaa

SEQ ID NO: 346291 - RNA, 22 nt, Human
cacaaugugguuugucaucuuu

SEQ ID NO: 346292 - RNA, 19 nt, Human
ccagguggaacugagguag

SEQ ID NO: 346293 - RNA, 22 nt, Human
auuuguuccacacauauuuacu

SEQ ID NO: 346294 - RNA, 22 nt, Human
ccagcuuuauagcuucaaagga

SEQ ID NO: 346295 - RNA, 22 nt, Human
gaugccugcauuucaggagagu

SEQ ID NO: 346296 - RNA, 22 nt, Human
cagaauguagaucaucaucaag

SEQ ID NO: 346297 - RNA, 17 nt, Human
gccuuccuuccuccaca

SEQ ID NO: 346298 - RNA, 21 nt, Human
ugcuggccucaagggugacuu

SEQ ID NO: 346299 - RNA, 22 nt, Human
ugcauuaugcuugugcuguaua

SEQ ID NO: 346300 - RNA, 18 nt, Human
cccagcccaccauuucuc

SEQ ID NO: 346301 - RNA, 22 nt, Human
ggcugccauaacagaguaccac

SEQ ID NO: 346302 - RNA, 18 nt, Human
gcaaggcucaggccaggc

SEQ ID NO: 346303 - RNA, 22 nt, Human
ccugccugacagagaagguuca

SEQ ID NO: 346304 - RNA, 22 nt, Human
cauucauuagaauagauaugua

SEQ ID NO: 346305 - RNA, 22 nt, Human
gcuccucugucaaaugagagug

SEQ ID NO: 346306 - RNA, 22 nt, Human
augacagaaggccucccugaca

SEQ ID NO: 346307 - RNA, 22 nt, Human
cuggagaggcugggaacagguu

SEQ ID NO: 346308 - RNA, 22 nt, Human
caaagucccagcugcuuagaga

SEQ ID NO: 346309 - RNA, 22 nt, Human
aaggcuuucagcuaacuugauu

SEQ ID NO: 346310 - RNA, 22 nt, Human
uucucuuaucuggcauuauugg

SEQ ID NO: 346311 - RNA, 22 nt, Human
aucaaaguucguaacugauaac

SEQ ID NO: 346312 - RNA, 22 nt, Human
ucugaaggucugagaaccagga

SEQ ID NO: 346313 - RNA, 22 nt, Human
caggaaagggaugggcugccac

SEQ ID NO: 346314 - RNA, 22 nt, Human
agacagggucuugaucagagcu

SEQ ID NO: 346315 - RNA, 22 nt, Human
acacugaauguuuaagaacuug

SEQ ID NO: 346316 - RNA, 22 nt, Human
aguccuuacucgggggcccaga

SEQ ID NO: 346317 - RNA, 22 nt, Human
ucauguuauugacucauaauau

SEQ ID NO: 346318 - RNA, 22 nt, Human
aaucgguugaacccaggaagug

SEQ ID NO: 346319 - RNA, 22 nt, Human
gggcuucucuuuagugagcuga

SEQ ID NO: 346320 - RNA, 22 nt, Human
agagcaggcauaaagcuuugaa

SEQ ID NO: 346321 - RNA, 22 nt, Human
uuggaucauggaaugucugcuu

SEQ ID NO: 346322 - RNA, 22 nt, Human
uguuguuuucucauggagaaua

SEQ ID NO: 346323 - RNA, 22 nt, Human
aagaauguggguggauaugaug

SEQ ID NO: 346324 - RNA, 22 nt, Human
uaguccauuuucacacugcuga

SEQ ID NO: 346325 - RNA, 22 nt, Human
ucaagagaagugcuccacagua

SEQ ID NO: 346326 - RNA, 22 nt, Human
aacauacauauuucagugucca

SEQ ID NO: 346327 - RNA, 22 nt, Human
aaacuuugguauguagcaaaac

SEQ ID NO: 346328 - RNA, 22 nt, Human
agggagcucuaaguagagggac

SEQ ID NO: 346329 - RNA, 22 nt, Human
cuuacauugucuuaguuuucaa

SEQ ID NO: 346330 - RNA, 22 nt, Human
gaggugaguggaucacgagguc

SEQ ID NO: 346331 - RNA, 21 nt, Human
agauuguauggaggugagagg

SEQ ID NO: 346332 - RNA, 22 nt, Human
aguauguauuuuauacuuacag

SEQ ID NO: 346333 - RNA, 22 nt, Human
agcugcccugguaagauugaug

SEQ ID NO: 346334 - RNA, 22 nt, Human
uguucuuuggcuucacagcucu

SEQ ID NO: 346335 - RNA, 19 nt, Human
agugucaucagcuacucag

SEQ ID NO: 346336 - RNA, 22 nt, Human
agaagccagaauauucauggau

SEQ ID NO: 346337 - RNA, 22 nt, Human
aggagcugcaaauauuaguaau

SEQ ID NO: 346338 - RNA, 22 nt, Human
uuuuuggguccaggcuguaucu

SEQ ID NO: 346339 - RNA, 22 nt, Human
aggaccugaaauucuugcuuuu

SEQ ID NO: 346340 - RNA, 22 nt, Human
ucuggcucuaacuaggcaucag

SEQ ID NO: 346341 - RNA, 22 nt, Human
aaaggccacacugcucuuucuc

SEQ ID NO: 346342 - RNA, 22 nt, Human
uguguccuuuggaggaucagcg

SEQ ID NO: 346343 - RNA, 22 nt, Human
uuugcauugcauuaaguauucu

SEQ ID NO: 346344 - RNA, 22 nt, Human
cauucauuuacuuucaacagcu

SEQ ID NO: 346345 - RNA, 22 nt, Human
agcugagcucaggcugauguaa

SEQ ID NO: 346346 - RNA, 22 nt, Human
ugaguacucggagugcuuugga

SEQ ID NO: 346347 - RNA, 22 nt, Human
uuacauaacgguaugaaaaaug

SEQ ID NO: 346348 - RNA, 22 nt, Human
uguucucacuggaugcuucaca

SEQ ID NO: 346349 - RNA, 22 nt, Human
ucucaggguuuguacaagugua

SEQ ID NO: 346350 - RNA, 22 nt, Human
aggcagcuuuguaguaaagcua

SEQ ID NO: 346351 - RNA, 22 nt, Human
uuuaggcagcuacauacuaacu

SEQ ID NO: 346352 - RNA, 22 nt, Human
uaaugugugucaucaguagagu

SEQ ID NO: 346353 - RNA, 17 nt, Human
uggcacagaggugcuau

SEQ ID NO: 346354 - RNA, 22 nt, Human
uaugcacagaaguuugcugaau

SEQ ID NO: 346355 - RNA, 22 nt, Human
cguccuuacagagggucacagc

SEQ ID NO: 346356 - RNA, 22 nt, Human
acaauacaggcuucuggacuua

SEQ ID NO: 346357 - RNA, 22 nt, Human
ucagggacagggugcugcugcg

SEQ ID NO: 346358 - RNA, 22 nt, Human
agaaaugaaaccaaagccuaga

SEQ ID NO: 346359 - RNA, 22 nt, Human
uggcagagaacacacaugauuc

SEQ ID NO: 346360 - RNA, 22 nt, Human
aggcugagcugaccugguuugg

SEQ ID NO: 346361 - RNA, 22 nt, Human
accaggcacucuuguggcagug

SEQ ID NO: 346362 - RNA, 22 nt, Human
ucaaucacguguuccauguucu

SEQ ID NO: 346363 - RNA, 22 nt, Human
uucagagccacuucaagucuaa

SEQ ID NO: 346364 - RNA, 22 nt, Human
caggagcaguuagaagcccacu

SEQ ID NO: 346365 - RNA, 23 nt, Human
gggagaauaugaggaugauggug

SEQ ID NO: 346366 - RNA, 22 nt, Human
cucugggcacauuuuccaggac

SEQ ID NO: 346367 - RNA, 22 nt, Human
auguaauaggguaacauaacau

SEQ ID NO: 346368 - RNA, 22 nt, Human
cagggguggcugcagcagaggu

SEQ ID NO: 346369 - RNA, 22 nt, Human
cuggguggcuguccagccagcc

SEQ ID NO: 346370 - RNA, 22 nt, Human
ucaguuuucaauuucaucagag

SEQ ID NO: 346371 - RNA, 19 nt, Human
ucuggcuccugccaggcug

SEQ ID NO: 346372 - RNA, 22 nt, Human
ugcaaaauaaugaacgauuuuu

SEQ ID NO: 346373 - RNA, 22 nt, Human
ucucaggaauagaguggcagca

SEQ ID NO: 346374 - RNA, 22 nt, Human
ccaggacccugcaaacccuguu

SEQ ID NO: 346375 - RNA, 22 nt, Human
cucucccagucaggcucaggau

SEQ ID NO: 346376 - RNA, 22 nt, Human
accagggcacaggagucugaag

SEQ ID NO: 346377 - RNA, 22 nt, Human
cuauacagagcauccuuaacuu

SEQ ID NO: 346378 - RNA, 22 nt, Human
uuguacaaguauuaugugaaca

SEQ ID NO: 346379 - RNA, 22 nt, Human
acagcagcuugcgugucugguc

SEQ ID NO: 346380 - RNA, 18 nt, Human
uggagcaggaagccuggc

SEQ ID NO: 346381 - RNA, 23 nt, Human
uggugccucagaagcagugggcu

SEQ ID NO: 346382 - RNA, 23 nt, Human
gcccaugcuguugggcccgagca

SEQ ID NO: 346383 - RNA, 22 nt, Human
uaaagccacuucauucuagucu

SEQ ID NO: 346384 - RNA, 22 nt, Human
ugauuuccuagcugacaugaaa

SEQ ID NO: 346385 - RNA, 22 nt, Human
ugguuuugcuaaaauagaaaga

SEQ ID NO: 346386 - RNA, 22 nt, Human
aaacaaacauagguuugaaagu

SEQ ID NO: 346387 - RNA, 22 nt, Human
aguguuguaugggaugacugcu

SEQ ID NO: 346388 - RNA, 22 nt, Human
uuuauuauagugguggggacug

SEQ ID NO: 346389 - RNA, 22 nt, Human
ugccgcagugcggggagggccc

SEQ ID NO: 346390 - RNA, 23 nt, Human
ggccuccuggucuaggcuagacu

SEQ ID NO: 346391 - RNA, 22 nt, Human
cagcugccccuccagggcuggg

SEQ ID NO: 346392 - RNA, 22 nt, Human
uugucuguaaagacggccacca

SEQ ID NO: 346393 - RNA, 22 nt, Human
aguguggguuuuauggagcccu

SEQ ID NO: 346394 - RNA, 22 nt, Human
ccagggcauguaacuaauggug

SEQ ID NO: 346395 - RNA, 22 nt, Human
ucagggcaaugucccucagaag

SEQ ID NO: 346396 - RNA, 22 nt, Human
aucuaaaaggagcucuuuaucu

SEQ ID NO: 346397 - RNA, 22 nt, Human
gauuucuucauucauuagaugg

SEQ ID NO: 346398 - RNA, 22 nt, Human
gcuugggauaugcugauguaaa

SEQ ID NO: 346399 - RNA, 22 nt, Human
gcaccugggguacacagcuaca

SEQ ID NO: 346400 - RNA, 22 nt, Human
ccagcaggacuuuggaaauaug

SEQ ID NO: 346401 - RNA, 22 nt, Human
gaagccagccuugucugccucu

SEQ ID NO: 346402 - RNA, 22 nt, Human
cuagaaauauuuuacagucaag

SEQ ID NO: 346403 - RNA, 22 nt, Human
ucagaggagaugguuaccaggg

SEQ ID NO: 346404 - RNA, 22 nt, Human
aauucuuguuguuaguauauuu

SEQ ID NO: 346405 - RNA, 15 nt, Human
caggagaggaagguu

SEQ ID NO: 346406 - RNA, 19 nt, Human
uggcugggcgugccuccgu

SEQ ID NO: 346407 - RNA, 22 nt, Human
caaaggcuucaucucagagcag

SEQ ID NO: 346408 - RNA, 22 nt, Human
gaggggcugggguugacuccaa

SEQ ID NO: 346409 - RNA, 22 nt, Human
gauggguggucucagacuugcc

SEQ ID NO: 346410 - RNA, 22 nt, Human
cagccucucuguaucucaggau

SEQ ID NO: 346411 - RNA, 20 nt, Human
uaacagaaguagaagugggu

SEQ ID NO: 346412 - RNA, 22 nt, Human
aggaaaggccuuugcauuuggu

SEQ ID NO: 346413 - RNA, 21 nt, Human
gcugcucgagauccagugcuu

SEQ ID NO: 346414 - RNA, 22 nt, Human
auccagggauaaaaguaagguu

SEQ ID NO: 346415 - RNA, 22 nt, Human
auuugcuuaucuccacaguugu

SEQ ID NO: 346416 - RNA, 22 nt, Human
cccagccuggugcacugugggg

SEQ ID NO: 346417 - RNA, 22 nt, Human
agaggagcugggaggcccucgu

SEQ ID NO: 346418 - RNA, 22 nt, Human
uccuucagugucccgcucaggu

SEQ ID NO: 346419 - RNA, 22 nt, Human
gagcccagguucugcuuccagc

SEQ ID NO: 346420 - RNA, 22 nt, Human
ggccaggagcugcacagggcuc

SEQ ID NO: 346421 - RNA, 22 nt, Human
gaggcaguuccugagugacaag

SEQ ID NO: 346422 - RNA, 22 nt, Human
aucaguuuaacugucaagagcc

SEQ ID NO: 346423 - RNA, 22 nt, Human
aucuucaaagggauguccaugg

SEQ ID NO: 346424 - RNA, 22 nt, Human
ucugauaacucuggccccaggc

SEQ ID NO: 346425 - RNA, 22 nt, Human
cuuacauuaaguaagagauuga

SEQ ID NO: 346426 - RNA, 22 nt, Human
cuguuuucccuggaguucagca

SEQ ID NO: 346427 - RNA, 22 nt, Human
uuucacacaacgugaauauacu

SEQ ID NO: 346428 - RNA, 22 nt, Human
auacauguaacugcauuguaau

SEQ ID NO: 346429 - RNA, 22 nt, Human
cuggauuuaggacuaguccaag

SEQ ID NO: 346430 - RNA, 22 nt, Human
ugcauuauaacugaauguuguu

SEQ ID NO: 346431 - RNA, 22 nt, Human
acagaauuugcuugggcaaugg

SEQ ID NO: 346432 - RNA, 22 nt, Human
auguguaggugaaucgaggcug

SEQ ID NO: 346433 - RNA, 22 nt, Human
ugagaauuacaaaugagucaca

SEQ ID NO: 346434 - RNA, 22 nt, Human
aagagccagcuagugaagaggc

SEQ ID NO: 346435 - RNA, 22 nt, Human
aggcagcuggaggcagagacua

SEQ ID NO: 346436 - RNA, 22 nt, Human
cugagcagccccaccagccauu

SEQ ID NO: 346437 - RNA, 22 nt, Human
ugccacacagucugguagaaua

SEQ ID NO: 346438 - RNA, 22 nt, Human
cagucccaggguugguucagcu

SEQ ID NO: 346439 - RNA, 22 nt, Human
auugacaaggaaacuauaccag

SEQ ID NO: 346440 - RNA, 22 nt, Human
cuguccugcaguugggggcagg

SEQ ID NO: 346441 - RNA, 22 nt, Human
gaggacagugugaucugccagc

SEQ ID NO: 346442 - RNA, 22 nt, Human
accagcagaguugaggaggaca

SEQ ID NO: 346443 - RNA, 22 nt, Human
agauaauuugaguaaauuaauu

SEQ ID NO: 346444 - RNA, 22 nt, Human
ugcagccaauucauucauucuu

SEQ ID NO: 346445 - RNA, 22 nt, Human
agcaggggcaggguuuugugcu

SEQ ID NO: 346446 - RNA, 22 nt, Human
aggacaguccgggguccuccac

SEQ ID NO: 346447 - RNA, 22 nt, Human
gaauauauuggugaaaauaguu

SEQ ID NO: 346448 - RNA, 22 nt, Human
ucucugagcugcuucuugcaua

SEQ ID NO: 346449 - RNA, 22 nt, Human
ccuuucucuggcagcaggacag

SEQ ID NO: 346450 - RNA, 22 nt, Human
gcagcugaaagggaucucuaca

SEQ ID NO: 346451 - RNA, 23 nt, Human
agacagaggcugaggcuggccgc

SEQ ID NO: 346452 - RNA, 18 nt, Human
ucauuuguuuugcaugaa

SEQ ID NO: 346453 - RNA, 22 nt, Human
acccagagccagggucaggagc

SEQ ID NO: 346454 - RNA, 22 nt, Human
agaggcugucccuugcuauucc

SEQ ID NO: 346455 - RNA, 18 nt, Human
cuggcuuucuuauccauc

SEQ ID NO: 346456 - RNA, 23 nt, Human
agguucaggagauggaggaacaa

SEQ ID NO: 346457 - RNA, 22 nt, Human
acagcuggaggccccauugucc

SEQ ID NO: 346458 - RNA, 22 nt, Human
ucuucauuuuacaggcagaccu

SEQ ID NO: 346459 - RNA, 22 nt, Human
uaguccuugguaaaauucuaug

SEQ ID NO: 346460 - RNA, 22 nt, Human
cuggagcuccagggucuccucu

SEQ ID NO: 346461 - RNA, 22 nt, Human
gggaccugggccagaggacagu

SEQ ID NO: 346462 - RNA, 22 nt, Human
cucuggagggaggcugagcugg

SEQ ID NO: 346463 - RNA, 22 nt, Human
aacaaauggaacacaaaucuuu

SEQ ID NO: 346464 - RNA, 22 nt, Human
cugcucugugguccaugagaca

SEQ ID NO: 346465 - RNA, 22 nt, Human
cugcaagauuggaagaugcaau

SEQ ID NO: 346466 - RNA, 22 nt, Human
agccugagagccaagcugugca

SEQ ID NO: 346467 - RNA, 22 nt, Human
guuccacaaaauguacccaguu

SEQ ID NO: 346468 - RNA, 22 nt, Human
uagcacauaacuuagaauaguu

SEQ ID NO: 346469 - RNA, 22 nt, Human
acagcugggugcugcucagagc

SEQ ID NO: 346470 - RNA, 22 nt, Human
aggcugucaucuuugcaggcag

SEQ ID NO: 346471 - RNA, 22 nt, Human
gccagagcugagugagguucuu

SEQ ID NO: 346472 - RNA, 22 nt, Human
acacuuuguuguggcauauacg

SEQ ID NO: 346473 - RNA, 22 nt, Human
cugucucagcaggaagucauca

SEQ ID NO: 346474 - RNA, 22 nt, Human
cuuccaaagcacuuuauggacc

SEQ ID NO: 346475 - RNA, 22 nt, Human
uauuuugacgauuuuaugcaaa

SEQ ID NO: 346476 - RNA, 22 nt, Human
ugaguccaagagccagugggaa

SEQ ID NO: 346477 - RNA, 22 nt, Human
gagcagugggaaggaacagggu

SEQ ID NO: 346478 - RNA, 19 nt, Human
augucuggguaacagcugc

SEQ ID NO: 346479 - RNA, 22 nt, Human
agcaggaguguccccuggcugu

SEQ ID NO: 346480 - RNA, 22 nt, Human
ggcaggucagguccaugaccaa

SEQ ID NO: 346481 - RNA, 22 nt, Human
ucaggcugguggucagauggcu

SEQ ID NO: 346482 - RNA, 22 nt, Human
uaaaggcuuuuacaggagugca

SEQ ID NO: 346483 - RNA, 22 nt, Human
aggcucuguuauucuagagggc

SEQ ID NO: 346484 - RNA, 22 nt, Human
gagagugauucccucccauaga

SEQ ID NO: 346485 - RNA, 22 nt, Human
acagcuuuaucucagggaucag

SEQ ID NO: 346486 - RNA, 22 nt, Human
cauuuagacauuugauuugggg

SEQ ID NO: 346487 - RNA, 22 nt, Human
uuguacaaauaggaaccucuga

SEQ ID NO: 346488 - RNA, 22 nt, Human
guaacugaggcagcuuuuaaga

SEQ ID NO: 346489 - RNA, 22 nt, Human
agaaaaaucuuggcgcuugucu

SEQ ID NO: 346490 - RNA, 22 nt, Human
uccaggcucucaggugucagca

SEQ ID NO: 346491 - RNA, 22 nt, Human
gagugguaggcaguguuaggaa

SEQ ID NO: 346492 - RNA, 22 nt, Human
gcaggaagaugagcucagguaa

SEQ ID NO: 346493 - RNA, 22 nt, Human
ggucucugacuuagagauggau

SEQ ID NO: 346494 - RNA, 22 nt, Human
uuguaacagguacuaaauaacu

SEQ ID NO: 346495 - RNA, 22 nt, Human
ccugucagcugauggcuaugua

SEQ ID NO: 346496 - RNA, 22 nt, Human
ugcugccaagcccgugcuccug

SEQ ID NO: 346497 - RNA, 20 nt, Human
uggcuccucuuggcuguggc

SEQ ID NO: 346498 - RNA, 22 nt, Human
acugucaccaucagagcgggaa

SEQ ID NO: 346499 - RNA, 22 nt, Human
ccucuuugugccugcaggcugc

SEQ ID NO: 346500 - RNA, 22 nt, Human
cugcuggggucagagcacuggg

SEQ ID NO: 346501 - RNA, 22 nt, Human
uauaauuuuagaagagauggaa

SEQ ID NO: 346502 - RNA, 22 nt, Human
cugaggcugggcauggggucca

SEQ ID NO: 346503 - RNA, 22 nt, Human
cugccagcucucuggaggcucu

SEQ ID NO: 346504 - RNA, 22 nt, Human
ucagaacauugacauucuuauu

SEQ ID NO: 346505 - RNA, 22 nt, Human
uccaugucuucaugugucuaac

SEQ ID NO: 346506 - RNA, 22 nt, Human
uuucaagcauaacugggaagag

SEQ ID NO: 346507 - RNA, 22 nt, Human
auuucugugcaguaaaugguga

SEQ ID NO: 346508 - RNA, 23 nt, Human
uugaaagguagcuggcagcuaga

SEQ ID NO: 346509 - RNA, 20 nt, Human
cccuggccuguuucaugccc

SEQ ID NO: 346510 - RNA, 22 nt, Human
auguuauaguuauaaaaugagg

SEQ ID NO: 346511 - RNA, 22 nt, Human
agaggcaggaagagcugauuuu

SEQ ID NO: 346512 - RNA, 22 nt, Human
aagagcugauuaagucaugagg

SEQ ID NO: 346513 - RNA, 22 nt, Human
cuauaauuaugcucaaaaugua

SEQ ID NO: 346514 - RNA, 22 nt, Human
aaggagagagcuuugcuggaac

SEQ ID NO: 346515 - RNA, 23 nt, Human
cuugcagggcuggaggcuuagaa

SEQ ID NO: 346516 - RNA, 22 nt, Human
ugcugcuccugccuggcuccca

SEQ ID NO: 346517 - RNA, 22 nt, Human
ugugugcauucacaugcaugcc

SEQ ID NO: 346518 - RNA, 22 nt, Human
cagggacccgcacagguagcau

SEQ ID NO: 346519 - RNA, 22 nt, Human
uauguacaccggggaagguggg

SEQ ID NO: 346520 - RNA, 22 nt, Human
uuauguacaauguuaauguaaa

SEQ ID NO: 346521 - RNA, 22 nt, Human
uggcagcuggagggcaauggcc

SEQ ID NO: 346522 - RNA, 22 nt, Human
ucaggcuggaaugcaguggggc

SEQ ID NO: 346523 - RNA, 22 nt, Human
ggacuggacucucaggcucaca

SEQ ID NO: 346524 - RNA, 22 nt, Human
uucacaggcuuggagguggggg

SEQ ID NO: 346525 - RNA, 22 nt, Human
ggcagcaggagccaucugguag

SEQ ID NO: 346526 - RNA, 22 nt, Human
ugcuuagacgucaaguacagcc

SEQ ID NO: 346527 - RNA, 22 nt, Human
cacuggcaugugaggcgguggc

SEQ ID NO: 346528 - RNA, 22 nt, Human
uagaaacugauagucuugugcu

SEQ ID NO: 346529 - RNA, 22 nt, Human
cagccagguaugggcgugcggg

SEQ ID NO: 346530 - RNA, 22 nt, Human
agaugguguuuccccaggugga

SEQ ID NO: 346531 - RNA, 22 nt, Human
gguguccucaugauuuucuaga

SEQ ID NO: 346532 - RNA, 22 nt, Human
cccaagagcuucuaggacgcug

SEQ ID NO: 346533 - RNA, 22 nt, Human
ucugggagagcugcugucagag

SEQ ID NO: 346534 - RNA, 22 nt, Human
gcucagggaacuuuuugcaggc

SEQ ID NO: 346535 - RNA, 22 nt, Human
aggugcaggagcugugcaggga

SEQ ID NO: 346536 - RNA, 22 nt, Human
augguuuaguuagggcuuuuca

SEQ ID NO: 346537 - RNA, 22 nt, Human
aaguaugacauuuaagacaauu

SEQ ID NO: 346538 - RNA, 22 nt, Human
ucucacuuuguugcccagacuu

SEQ ID NO: 346539 - RNA, 22 nt, Human
ccuggcugucguuuugugaaau

SEQ ID NO: 346540 - RNA, 23 nt, Human
aaagacugcugagaauuuuagga

SEQ ID NO: 346541 - RNA, 21 nt, Human
ucacaugcccauuacuggagc

SEQ ID NO: 346542 - RNA, 22 nt, Human
uucacagagagaacucaaacca

SEQ ID NO: 346543 - RNA, 22 nt, Human
ccuggcaggccccuccuggauu

SEQ ID NO: 346544 - RNA, 22 nt, Human
aaaggcaggcuuucacaucuca

SEQ ID NO: 346545 - RNA, 22 nt, Human
uggaggugagugugguacagca

SEQ ID NO: 346546 - RNA, 22 nt, Human
ccaggaagcggugagggcugcc

SEQ ID NO: 346547 - RNA, 22 nt, Human
uugaucagguugcuguggugua

SEQ ID NO: 346548 - RNA, 22 nt, Human
ggcagugaacagaaaugcagaa

SEQ ID NO: 346549 - RNA, 22 nt, Human
uccuuggcagcagggagcauga

SEQ ID NO: 346550 - RNA, 22 nt, Human
uuacagaaaagggcuuuaagag

SEQ ID NO: 346551 - RNA, 22 nt, Human
uggcaaggcugugggggcagag

SEQ ID NO: 346552 - RNA, 22 nt, Human
aggagugaguguccucagcaga

SEQ ID NO: 346553 - RNA, 18 nt, Human
gcagugaagaaagagcuu

SEQ ID NO: 346554 - RNA, 22 nt, Human
auggcucauuuaucuugcagcc

SEQ ID NO: 346555 - RNA, 22 nt, Human
cacagcuggugcacuagcucug

SEQ ID NO: 346556 - RNA, 22 nt, Human
guucuucaucauuuuagauagg

SEQ ID NO: 346557 - RNA, 22 nt, Human
ucagaggauuggacuuuuaugu

SEQ ID NO: 346558 - RNA, 22 nt, Human
uccuugaagcaacgugcagaca

SEQ ID NO: 346559 - RNA, 22 nt, Human
gcuggccauauauuuugcuguu

SEQ ID NO: 346560 - RNA, 22 nt, Human
aguaaaaauugaggugcaaaau

SEQ ID NO: 346561 - RNA, 22 nt, Human
cuguuuauaaauagaggggagu

SEQ ID NO: 346562 - RNA, 22 nt, Human
caggggcucugggugaugugag

SEQ ID NO: 346563 - RNA, 22 nt, Human
ucauuuucacacauaaauagca

SEQ ID NO: 346564 - RNA, 22 nt, Human
agcugagagguggcaagcugua

SEQ ID NO: 346565 - RNA, 22 nt, Human
uggcugaggagggucuucuggu

SEQ ID NO: 346566 - RNA, 19 nt, Human
agaggccucagcagcuggc

SEQ ID NO: 346567 - RNA, 22 nt, Human
aguuauauaacuaucuagaugc

SEQ ID NO: 346568 - RNA, 22 nt, Human
caaacuggcuaugggaaucuug

SEQ ID NO: 346569 - RNA, 22 nt, Human
gggaugucacugugccuggcac

SEQ ID NO: 346570 - RNA, 22 nt, Human
guggcuucacauggcauuuggc

SEQ ID NO: 346571 - RNA, 22 nt, Human
guccucuuagccacuuaauuau

SEQ ID NO: 346572 - RNA, 22 nt, Human
uguauguugggucaaaguacau

SEQ ID NO: 346573 - RNA, 22 nt, Human
cuacauuuugugauuaugaaau

SEQ ID NO: 346574 - RNA, 22 nt, Human
cucuccagaauaugccgccgug

SEQ ID NO: 346575 - RNA, 18 nt, Human
uauauuucacacauauuc

SEQ ID NO: 346576 - RNA, 22 nt, Human
gcugaagagagaugcguccagc

SEQ ID NO: 346577 - RNA, 22 nt, Human
ggaugcugacuuuggagcaugg

SEQ ID NO: 346578 - RNA, 22 nt, Human
gugcauuggugcgccacuucac

SEQ ID NO: 346579 - RNA, 21 nt, Human
uucaaagagugggcauuguca

SEQ ID NO: 346580 - RNA, 22 nt, Human
augcugugucuagcaggaacac

SEQ ID NO: 346581 - RNA, 22 nt, Human
gaaggagacccugaagaugcug

SEQ ID NO: 346582 - RNA, 22 nt, Human
cucuccucagaacaggcccucu

SEQ ID NO: 346583 - RNA, 22 nt, Human
uccagagggcgauggcuggggg

SEQ ID NO: 346584 - RNA, 22 nt, Human
aaauuaguacauugcaaagucc

SEQ ID NO: 346585 - RNA, 22 nt, Human
aaguauuucguucugaaaaagu

SEQ ID NO: 346586 - RNA, 22 nt, Human
aauacaguaauuuugaugaguu

SEQ ID NO: 346587 - RNA, 22 nt, Human
gagaggcagaggccugaaaccg

SEQ ID NO: 346588 - RNA, 16 nt, Human
gccuggaguggcaggg

SEQ ID NO: 346589 - RNA, 22 nt, Human
guugaaaguagaugcuauuugg

SEQ ID NO: 346590 - RNA, 22 nt, Human
ccuggaaggcaggcauggauug

SEQ ID NO: 346591 - RNA, 22 nt, Human
gcucaggagcucuugguggcgc

SEQ ID NO: 346592 - RNA, 22 nt, Human
gcugcuucucugauggagucca

SEQ ID NO: 346593 - RNA, 22 nt, Human
ccuguggcacaugcagggauuc

SEQ ID NO: 346594 - RNA, 22 nt, Human
aggagccaguuccaccccagga

SEQ ID NO: 346595 - RNA, 22 nt, Human
ggugcagaaggaagggagcugg

SEQ ID NO: 346596 - RNA, 22 nt, Human
gggaagcaggugcagcucgccu

SEQ ID NO: 346597 - RNA, 22 nt, Human
gaugaaaaucuugagaugucga

SEQ ID NO: 346598 - RNA, 22 nt, Human
ccagaggcauguucaaagcaau

SEQ ID NO: 346599 - RNA, 22 nt, Human
gagcuguccgccccugggccga

SEQ ID NO: 346600 - RNA, 22 nt, Human
aaugauuggcacuagauacaca

SEQ ID NO: 346601 - RNA, 22 nt, Human
uuccuaaaagaauacacuggau

SEQ ID NO: 346602 - RNA, 22 nt, Human
agcucccagaguccucugccca

SEQ ID NO: 346603 - RNA, 22 nt, Human
agcagcucugagaggccagcac

SEQ ID NO: 346604 - RNA, 22 nt, Human
cagcuuugauucuuucugccau

SEQ ID NO: 346605 - RNA, 22 nt, Human
cagcuggaugggagaccauguu

SEQ ID NO: 346606 - RNA, 22 nt, Human
agcaggugacagggcuguggug

SEQ ID NO: 346607 - RNA, 22 nt, Human
caggagcucucaucgucagggc

SEQ ID NO: 346608 - RNA, 22 nt, Human
caucagaaagaguccuggacuu

SEQ ID NO: 346609 - RNA, 22 nt, Human
cccagccucuggauucugcccu

SEQ ID NO: 346610 - RNA, 22 nt, Human
gggcagagaaauggacaguugg

SEQ ID NO: 346611 - RNA, 22 nt, Human
cccuccagcucaaagcaaccgg

SEQ ID NO: 346612 - RNA, 22 nt, Human
cugcagccuaggugcagcuggg

SEQ ID NO: 346613 - RNA, 22 nt, Human
agcagggccucuggcacugguc

SEQ ID NO: 346614 - RNA, 22 nt, Human
cagagcuguccaaacccugaca

SEQ ID NO: 346615 - RNA, 22 nt, Human
ucacagaaauaagauaguuauu

SEQ ID NO: 346616 - RNA, 22 nt, Human
gcaguaaaaaaggauaugugca

SEQ ID NO: 346617 - RNA, 22 nt, Human
uucauuccuucccuaagcaacu

SEQ ID NO: 346618 - RNA, 22 nt, Human
aggguaggaacugaguggaagg

SEQ ID NO: 346619 - RNA, 22 nt, Human
cugggccucauccucagaguuu

SEQ ID NO: 346620 - RNA, 22 nt, Human
acagugucaugucguguucccc

SEQ ID NO: 346621 - RNA, 22 nt, Human
acaggugggcuuaagagucggc

SEQ ID NO: 346622 - RNA, 22 nt, Human
ccuggaguuuuuugguugacuc

SEQ ID NO: 346623 - RNA, 22 nt, Human
uuauuauuuuguguacagcaaa

SEQ ID NO: 346624 - RNA, 22 nt, Human
aaaugcaauuguauguacucca

SEQ ID NO: 346625 - RNA, 22 nt, Human
gucuuuauuugagauugucauu

SEQ ID NO: 346626 - RNA, 22 nt, Human
gccuggcaggccugggccagca

SEQ ID NO: 346627 - RNA, 22 nt, Human
ugcuuaaacccugaucaugugu

SEQ ID NO: 346628 - RNA, 17 nt, Human
guccugggaggagagag

SEQ ID NO: 346629 - RNA, 22 nt, Human
uucuuucagaacacaagugauu

SEQ ID NO: 346630 - RNA, 22 nt, Human
gaagggugugugugagggacac

SEQ ID NO: 346631 - RNA, 22 nt, Human
cggcagagcggcgagccccucc

SEQ ID NO: 346632 - RNA, 22 nt, Human
cagagacauuaagugccaugau

SEQ ID NO: 346633 - RNA, 22 nt, Human
uuuuuugucuugaagaaauggu

SEQ ID NO: 346634 - RNA, 22 nt, Human
caguagcacuagauaugugugg

SEQ ID NO: 346635 - RNA, 22 nt, Human
ggugaaggcacaagagggcaag

SEQ ID NO: 346636 - RNA, 23 nt, Human
acagcugcaccuggccgccuggc

SEQ ID NO: 346637 - RNA, 22 nt, Human
gggugggaucuguggagccuca

SEQ ID NO: 346638 - RNA, 22 nt, Human
ugucucagaauggcucauaaua

SEQ ID NO: 346639 - RNA, 21 nt, Human
gcagagccggggcgagaaggc

SEQ ID NO: 346640 - RNA, 22 nt, Human
gugugcaggccacaggccaggg

SEQ ID NO: 346641 - RNA, 22 nt, Human
ugugugccagccuacgaggagc

SEQ ID NO: 346642 - RNA, 21 nt, Human
ucacuuauaauguauuugcug

SEQ ID NO: 346643 - RNA, 22 nt, Human
uuuuuguagucauuagaagagg

SEQ ID NO: 346644 - RNA, 22 nt, Human
ucuuucagccacuuaccugucu

SEQ ID NO: 346645 - RNA, 22 nt, Human
cacugccugugagcugugugcc

SEQ ID NO: 346646 - RNA, 22 nt, Human
gcccagcagcugguggagaagg

SEQ ID NO: 346647 - RNA, 22 nt, Human
gagaagcaaucaguggccaccc

SEQ ID NO: 346648 - RNA, 19 nt, Human
aggcagaggcuuggcuagc

SEQ ID NO: 346649 - RNA, 22 nt, Human
aucuuucaaucaggaaaaaucu

SEQ ID NO: 346650 - RNA, 22 nt, Human
auuaaauuggaucugcauaguu

SEQ ID NO: 346651 - RNA, 22 nt, Human
gcaaagucugcaucuggaucag

SEQ ID NO: 346652 - RNA, 22 nt, Human
uuacaucuaaacugugaacaau

SEQ ID NO: 346653 - RNA, 22 nt, Human
augucuuuauaaauguauaaug

SEQ ID NO: 346654 - RNA, 22 nt, Human
ccucagggaggccucuguggcu

SEQ ID NO: 346655 - RNA, 22 nt, Human
ugucauuuaguccucugugugu

SEQ ID NO: 346656 - RNA, 22 nt, Human
caaggccaguucaccaagggca

SEQ ID NO: 346657 - RNA, 22 nt, Human
ugggccacggggguggagagcu

SEQ ID NO: 346658 - RNA, 22 nt, Human
acagugugaugggccugccuga

SEQ ID NO: 346659 - RNA, 22 nt, Human
cugcagagcauaaaucugaaua

SEQ ID NO: 346660 - RNA, 22 nt, Human
agccagcugccuuucacaucug

SEQ ID NO: 346661 - RNA, 22 nt, Human
aaagaaggggucuacauccaau

SEQ ID NO: 346662 - RNA, 22 nt, Human
uggagccagagcgcagccuggg

SEQ ID NO: 346663 - RNA, 22 nt, Human
uuuacagagaauguacauaaag

SEQ ID NO: 346664 - RNA, 22 nt, Human
uaaauguguguagccaucugug

SEQ ID NO: 346665 - RNA, 22 nt, Human
cugcugcucgaccagucccagg

SEQ ID NO: 346666 - RNA, 22 nt, Human
agcagagaagacacaggcuuca

SEQ ID NO: 346667 - RNA, 22 nt, Human
caguggcgugaucucugcucac

SEQ ID NO: 346668 - RNA, 22 nt, Human
aaguccagguccucauuccauc

SEQ ID NO: 346669 - RNA, 22 nt, Human
gcagcugccccgacugugaguc

SEQ ID NO: 346670 - RNA, 21 nt, Human
auaagcaugcugauuacauuu

SEQ ID NO: 346671 - RNA, 22 nt, Human
aguggagacaggacagucgaua

SEQ ID NO: 346672 - RNA, 22 nt, Human
gcaggcagagucaauuugaucc

SEQ ID NO: 346673 - RNA, 22 nt, Human
uggcccugacuuggaggccuga

SEQ ID NO: 346674 - RNA, 22 nt, Human
acacaaugcauauuuuuccaga

SEQ ID NO: 346675 - RNA, 22 nt, Human
acuguggcucaucaggcuggug

SEQ ID NO: 346676 - RNA, 22 nt, Human
ugccaggcccugcgggguccca

SEQ ID NO: 346677 - RNA, 22 nt, Human
aaaaaucuaugacugcuucucc

SEQ ID NO: 346678 - RNA, 22 nt, Human
gcagcugagagaagaacagggc

SEQ ID NO: 346679 - RNA, 22 nt, Human
ggcaaaaaccgcaauaacuucu

SEQ ID NO: 346680 - RNA, 22 nt, Human
uaaaugaagaaauggagauugu

SEQ ID NO: 346681 - RNA, 22 nt, Human
gggcugagccacagcuuuuguu

SEQ ID NO: 346682 - RNA, 22 nt, Human
uauuuuaaagacugccagccua

SEQ ID NO: 346683 - RNA, 22 nt, Human
ucugcucagugcuuaucucuaa

SEQ ID NO: 346684 - RNA, 22 nt, Human
cuggagccacugggucuuguau

SEQ ID NO: 346685 - RNA, 22 nt, Human
ccucagagccuccagaaggaau

SEQ ID NO: 346686 - RNA, 22 nt, Human
uuugaaagagcugauacaugaa

SEQ ID NO: 346687 - RNA, 23 nt, Human
ucccaggaaucugcauuuuuaac

SEQ ID NO: 346688 - RNA, 22 nt, Human
caguacuuugcaucauuccacu

SEQ ID NO: 346689 - RNA, 22 nt, Human
cacagggccuggggcagcugcu

SEQ ID NO: 346690 - RNA, 18 nt, Human
ccagcaugccagaggcug

SEQ ID NO: 346691 - RNA, 22 nt, Human
ccuggauccaugaaaaggcuac

SEQ ID NO: 346692 - RNA, 22 nt, Human
caggaccuggaaugcuugugaa

SEQ ID NO: 346693 - RNA, 22 nt, Human
uauuuccaggccccacucuaga

SEQ ID NO: 346694 - RNA, 20 nt, Human
uggcaucucucaauuguagg

SEQ ID NO: 346695 - RNA, 22 nt, Human
agauaaugaaugccaugacauu

SEQ ID NO: 346696 - RNA, 22 nt, Human
cuggagccggcgagccccagcc

SEQ ID NO: 346697 - RNA, 22 nt, Human
ucuaguucuagaucccugagga

SEQ ID NO: 346698 - RNA, 22 nt, Human
cccagcuccaagggacagcgaa

SEQ ID NO: 346699 - RNA, 22 nt, Human
uucacaauaggagcaugcaaau

SEQ ID NO: 346700 - RNA, 22 nt, Human
auagacuugguuaguaaauuug

SEQ ID NO: 346701 - RNA, 22 nt, Human
ugaggcagauauuuauuggguu

SEQ ID NO: 346702 - RNA, 22 nt, Human
uggggacacagagccaaacuau

SEQ ID NO: 346703 - RNA, 20 nt, Human
acugugaaugcugaauuagc

SEQ ID NO: 346704 - RNA, 22 nt, Human
agugagggaugaagaacugcgg

SEQ ID NO: 346705 - RNA, 22 nt, Human
guaauuaggaauaaaaugggaa

SEQ ID NO: 346706 - RNA, 20 nt, Human
agcuggccuguccuaggccu

SEQ ID NO: 346707 - RNA, 22 nt, Human
ugaugaaauguugaggcaguga

SEQ ID NO: 346708 - RNA, 22 nt, Human
ugcccagcacugugccagucac

SEQ ID NO: 346709 - RNA, 22 nt, Human
aaauguauugcauaggauauuu

SEQ ID NO: 346710 - RNA, 20 nt, Human
acuggaucuggcuggagcug

SEQ ID NO: 346711 - RNA, 22 nt, Human
ucuuuacaaucuaagcauaguu

SEQ ID NO: 346712 - RNA, 22 nt, Human
cagggugacugcccuggccacu

SEQ ID NO: 346713 - RNA, 22 nt, Human
ggcccuguccuggcugucuccg

SEQ ID NO: 346714 - RNA, 22 nt, Human
uccaggaggcaccuuuggacca

SEQ ID NO: 346715 - RNA, 22 nt, Human
gcaaauucuuaacuggacugug

SEQ ID NO: 346716 - RNA, 22 nt, Human
aaagccagggacagugugcaug

SEQ ID NO: 346717 - RNA, 22 nt, Human
augguuuuucaaguauucagaa

SEQ ID NO: 346718 - RNA, 22 nt, Human
auuccauuguguaaggauaucg

SEQ ID NO: 346719 - RNA, 22 nt, Human
uuaaaaucuaaagcaguugucu

SEQ ID NO: 346720 - RNA, 22 nt, Human
agguacaguagacagacaguua

SEQ ID NO: 346721 - RNA, 22 nt, Human
uaagcuauuccugaagaagguu

SEQ ID NO: 346722 - RNA, 22 nt, Human
uaaaucacuccuaauaaucagu

SEQ ID NO: 346723 - RNA, 22 nt, Human
augggaggcagcagagcccagc

SEQ ID NO: 346724 - RNA, 22 nt, Human
ugggggagauugugcaucucua

SEQ ID NO: 346725 - RNA, 22 nt, Human
ugggccuccaauuccagcggga

SEQ ID NO: 346726 - RNA, 22 nt, Human
accaggagggacccugguggcc

SEQ ID NO: 346727 - RNA, 22 nt, Human
cauguacacucauguaacuaua

SEQ ID NO: 346728 - RNA, 23 nt, Human
aggaggaaaaguuaucugcugag

SEQ ID NO: 346729 - RNA, 22 nt, Human
ugucccagcagcuggguucucu

SEQ ID NO: 346730 - RNA, 22 nt, Human
ucaaaauucuagggagaauggu

SEQ ID NO: 346731 - RNA, 22 nt, Human
uguccuuuucuuuagugcagcu

SEQ ID NO: 346732 - RNA, 22 nt, Human
uuugaaaggguuaugagacuga

SEQ ID NO: 346733 - RNA, 22 nt, Human
uccucaugccgggucucacgcu

SEQ ID NO: 346734 - RNA, 20 nt, Human
uguuccaagcuaaugaauga

SEQ ID NO: 346735 - RNA, 22 nt, Human
uccaguggguugcugagggagg

SEQ ID NO: 346736 - RNA, 22 nt, Human
gaaaaaugcuccaaaucugugg

SEQ ID NO: 346737 - RNA, 22 nt, Human
uuucacauuagauaugucauuu

SEQ ID NO: 346738 - RNA, 22 nt, Human
cagggugggcacccagccucca

SEQ ID NO: 346739 - RNA, 22 nt, Human
acaaaaguguaggaauuccuua

SEQ ID NO: 346740 - RNA, 17 nt, Human
ccuuucucuuucaucuc

SEQ ID NO: 346741 - RNA, 20 nt, Human
cccagguaggugccaugagu

SEQ ID NO: 346742 - RNA, 22 nt, Human
ucucugguuauuaacuaacucc

SEQ ID NO: 346743 - RNA, 22 nt, Human
gcacugaacuuuaaucauuucu

SEQ ID NO: 346744 - RNA, 22 nt, Human
cugucucugucuuaacucccag

SEQ ID NO: 346745 - RNA, 22 nt, Human
uaaggcaccauaauauauuuaa

SEQ ID NO: 346746 - RNA, 23 nt, Human
aaaguguagccagguuaagaacc

SEQ ID NO: 346747 - RNA, 22 nt, Human
cagaguguuucuuugggugggu

SEQ ID NO: 346748 - RNA, 22 nt, Human
uaugugaauacagcaguggaug

SEQ ID NO: 346749 - RNA, 22 nt, Human
acuccuggggauccauuccuuu

SEQ ID NO: 346750 - RNA, 22 nt, Human
ggaggccuagccagcuccaguu

SEQ ID NO: 346751 - RNA, 22 nt, Human
cuuaggcagggcuggaagaucu

SEQ ID NO: 346752 - RNA, 22 nt, Human
ccagagccagagaggugccugc

SEQ ID NO: 346753 - RNA, 22 nt, Human
aucuuugaagaggacuugaagu

SEQ ID NO: 346754 - RNA, 22 nt, Human
auucuucaccugagucagucua

SEQ ID NO: 346755 - RNA, 22 nt, Human
cugaauaauacagacuagcuuc

SEQ ID NO: 346756 - RNA, 22 nt, Human
ucaggcugaaucauccuagcuu

SEQ ID NO: 346757 - RNA, 22 nt, Human
cugucauugagccugucagggc

SEQ ID NO: 346758 - RNA, 17 nt, Human
acaggcagaucaccuga

SEQ ID NO: 346759 - RNA, 22 nt, Human
uccugcagagacagaggccuca

SEQ ID NO: 346760 - RNA, 19 nt, Human
uucuccagccugaccugag

SEQ ID NO: 346761 - RNA, 22 nt, Human
cucacugugccuuuucccaaac

SEQ ID NO: 346762 - RNA, 22 nt, Human
aacagugagaagguggacagga

SEQ ID NO: 346763 - RNA, 22 nt, Human
gcagggcacaaggacgcacagg

SEQ ID NO: 346764 - RNA, 22 nt, Human
cugaggaagacagcagcugugu

SEQ ID NO: 346765 - RNA, 22 nt, Human
gaaaauguuuguccggagcuga

SEQ ID NO: 346766 - RNA, 22 nt, Human
aauguugagcuugaaaguaggu

SEQ ID NO: 346767 - RNA, 22 nt, Human
uggccagcccuucagccaugcc

SEQ ID NO: 346768 - RNA, 22 nt, Human
uaaguuuaaauguacaugaagc

SEQ ID NO: 346769 - RNA, 22 nt, Human
caggcacuguguuaggcacugu

SEQ ID NO: 346770 - RNA, 22 nt, Human
ucuuuuggguucuuaugauuua

SEQ ID NO: 346771 - RNA, 22 nt, Human
aggagucauaaaugugaacaaa

SEQ ID NO: 346772 - RNA, 22 nt, Human
aggagcugagggagcgcccuug

SEQ ID NO: 346773 - RNA, 22 nt, Human
uagggaggcuacuucuuguagg

SEQ ID NO: 346774 - RNA, 22 nt, Human
cugucagcacucuacuacagau

SEQ ID NO: 346775 - RNA, 19 nt, Human
cagcucaguuugauucucu

SEQ ID NO: 346776 - RNA, 22 nt, Human
uccauuuuguagguaugcuaca

SEQ ID NO: 346777 - RNA, 19 nt, Human
uuggaaggagccagagugg

SEQ ID NO: 346778 - RNA, 22 nt, Human
ucuaggagaaccaucagggagg

SEQ ID NO: 346779 - RNA, 21 nt, Human
uccugccuuaguccagagcag

SEQ ID NO: 346780 - RNA, 23 nt, Human
gagugcagaauagacaugcagug

SEQ ID NO: 346781 - RNA, 22 nt, Human
caguccuuauuccuauauuccu

SEQ ID NO: 346782 - RNA, 22 nt, Human
auguuucagauacagaucaaau

SEQ ID NO: 346783 - RNA, 22 nt, Human
ugccaggccacguagcuucaag

SEQ ID NO: 346784 - RNA, 22 nt, Human
uuuggaauuggaaagugcugug

SEQ ID NO: 346785 - RNA, 21 nt, Human
cccaggaguccuauuuaaaug

SEQ ID NO: 346786 - RNA, 22 nt, Human
ugagcaucuuuuuacagguuua

SEQ ID NO: 346787 - RNA, 22 nt, Human
augacaaaagaagacaugaggu

SEQ ID NO: 346788 - RNA, 22 nt, Human
ugucccagacacaguaugcgcu

SEQ ID NO: 346789 - RNA, 22 nt, Human
uuuugaaagggugauuuggcuu

SEQ ID NO: 346790 - RNA, 22 nt, Human
gagcuuuaccuuagguucuguu

SEQ ID NO: 346791 - RNA, 22 nt, Human
ccucucucuccugcacacacac

SEQ ID NO: 346792 - RNA, 22 nt, Human
uggaggcaucagagugcuuggc

SEQ ID NO: 346793 - RNA, 22 nt, Human
acagggcauuuccucuaugugu

SEQ ID NO: 346794 - RNA, 22 nt, Human
guuucacagucugcagaauuuu

SEQ ID NO: 346795 - RNA, 22 nt, Human
uguaacaguaagccugugagcu

SEQ ID NO: 346796 - RNA, 22 nt, Human
aggaggggcaaugauagucugg

SEQ ID NO: 346797 - RNA, 22 nt, Human
agaucugaaucucauccgagga

SEQ ID NO: 346798 - RNA, 22 nt, Human
ccugggcaacauagggagaccc

SEQ ID NO: 346799 - RNA, 22 nt, Human
auaucacaaacaagucuguacu

SEQ ID NO: 346800 - RNA, 22 nt, Human
agauuucaauggauauugcaag

SEQ ID NO: 346801 - RNA, 22 nt, Human
augugaaacugaagcauccaua

SEQ ID NO: 346802 - RNA, 17 nt, Human
gccaggagguuugagcu

SEQ ID NO: 346803 - RNA, 22 nt, Human
ugaggcucugcuucuguggcuc

SEQ ID NO: 346804 - RNA, 22 nt, Human
agcaccauugcaaauauggcag

SEQ ID NO: 346805 - RNA, 23 nt, Human
agcuucauugaccuccgcagggg

SEQ ID NO: 346806 - RNA, 22 nt, Human
cagaggcaggauaagaacugcg

SEQ ID NO: 346807 - RNA, 22 nt, Human
auuuuuccaauuaggauaaaga

SEQ ID NO: 346808 - RNA, 22 nt, Human
acaaagcuagagaagagaauug

SEQ ID NO: 346809 - RNA, 20 nt, Human
gggcaguucaaugccacucu

SEQ ID NO: 346810 - RNA, 22 nt, Human
aaguuacuggcaagggcugcag

SEQ ID NO: 346811 - RNA, 22 nt, Human
ugguuuauuucucugaaagguu

SEQ ID NO: 346812 - RNA, 19 nt, Human
cuucuggcccugagccacc

SEQ ID NO: 346813 - RNA, 22 nt, Human
caggguagacaguaggugucug

SEQ ID NO: 346814 - RNA, 22 nt, Human
auaguacacauccuacaauguu

SEQ ID NO: 346815 - RNA, 22 nt, Human
gcccaggaguugaagggcugac

SEQ ID NO: 346816 - RNA, 22 nt, Human
ugugugcagccucugucuuugg

SEQ ID NO: 346817 - RNA, 22 nt, Human
uugagaagaauguguugaguuu

SEQ ID NO: 346818 - RNA, 22 nt, Human
aggcugaggcggguagaucacc

SEQ ID NO: 346819 - RNA, 22 nt, Human
ugaaaugaucaguuugguuacu

SEQ ID NO: 346820 - RNA, 22 nt, Human
ccaggguggggcaggcccacug

SEQ ID NO: 346821 - RNA, 22 nt, Human
gaggugggagggcagucccuaa

SEQ ID NO: 346822 - RNA, 22 nt, Human
aaggggaaaaaguguuaggagu

SEQ ID NO: 346823 - RNA, 22 nt, Human
agggucugacaaugugacuuag

SEQ ID NO: 346824 - RNA, 22 nt, Human
agcagggcuuugcagacuuggg

SEQ ID NO: 346825 - RNA, 22 nt, Human
aauaagauccugaagauauguu

SEQ ID NO: 346826 - RNA, 22 nt, Human
gguacaaugucuuacagaccca

SEQ ID NO: 346827 - RNA, 22 nt, Human
caagggaccugagauggucucu

SEQ ID NO: 346828 - RNA, 22 nt, Human
cccucaggagaugucagcugga

SEQ ID NO: 346829 - RNA, 22 nt, Human
gguggaaggccuggaaggaggc

SEQ ID NO: 346830 - RNA, 22 nt, Human
ugcagaagaccuuccagggcug

SEQ ID NO: 346831 - RNA, 22 nt, Human
gucuucaauagagccucaauuu

SEQ ID NO: 346832 - RNA, 22 nt, Human
uaauuuauuucaacugccaagg

SEQ ID NO: 346833 - RNA, 22 nt, Human
ccaggaaugaaauguagauaaa

SEQ ID NO: 346834 - RNA, 22 nt, Human
agggaggaccaaugugugguua

SEQ ID NO: 346835 - RNA, 22 nt, Human
auggcagccugagcagaggaau

SEQ ID NO: 346836 - RNA, 22 nt, Human
uauuuagaugcauuuggauugc

SEQ ID NO: 346837 - RNA, 22 nt, Human
gagaggggcccaagccacauag

SEQ ID NO: 346838 - RNA, 22 nt, Human
cagggcuagugacaccccaguc

SEQ ID NO: 346839 - RNA, 22 nt, Human
ugugccaggcacuugcccaggc

SEQ ID NO: 346840 - RNA, 21 nt, Human
gaacauuuggguuguuucuac

SEQ ID NO: 346841 - RNA, 22 nt, Human
auugucuuuggugcuuccagga

SEQ ID NO: 346842 - RNA, 22 nt, Human
gggcucugggauucagagcaag

SEQ ID NO: 346843 - RNA, 22 nt, Human
uuccauuuauucuuguccagau

SEQ ID NO: 346844 - RNA, 23 nt, Human
accaggagaaaagcuuugcggga

SEQ ID NO: 346845 - RNA, 22 nt, Human
ccaggugucuguggccagcccu

SEQ ID NO: 346846 - RNA, 22 nt, Human
uggcucaggguccccaaauggu

SEQ ID NO: 346847 - RNA, 22 nt, Human
ugugcagcucuagagccaagcc

SEQ ID NO: 346848 - RNA, 17 nt, Human
ucaggcugggugcagug

SEQ ID NO: 346849 - RNA, 22 nt, Human
cuuauguaaacuacagauaaua

SEQ ID NO: 346850 - RNA, 22 nt, Human
gaagcccaggcuuccuuggcuu

SEQ ID NO: 346851 - RNA, 22 nt, Human
gaggaggcacuugagcagaugu

SEQ ID NO: 346852 - RNA, 22 nt, Human
aggugucugggcuuuggaguca

SEQ ID NO: 346853 - RNA, 22 nt, Human
ccagcagggcagugcccuggac

SEQ ID NO: 346854 - RNA, 22 nt, Human
ugcucauuggcgaucugaggga

SEQ ID NO: 346855 - RNA, 22 nt, Human
ggcuuccuuucacuacccucag

SEQ ID NO: 346856 - RNA, 22 nt, Human
gcauuuauuucuuuacugcauc

SEQ ID NO: 346857 - RNA, 22 nt, Human
gagcagcugcagugcagacccu

SEQ ID NO: 346858 - RNA, 22 nt, Human
ggcagaagaaaggcuaagucuc

SEQ ID NO: 346859 - RNA, 22 nt, Human
aaaguggucaccuucucauuuc

SEQ ID NO: 346860 - RNA, 22 nt, Human
gccagguguccucacagugagg

SEQ ID NO: 346861 - RNA, 22 nt, Human
aucaggauggguuuggcuuagg

SEQ ID NO: 346862 - RNA, 22 nt, Human
ugcuggaggggccugaccagga

SEQ ID NO: 346863 - RNA, 22 nt, Human
gaccauuugcuaguaaauugca

SEQ ID NO: 346864 - RNA, 22 nt, Human
gaggccugcagcguggucccug

SEQ ID NO: 346865 - RNA, 22 nt, Human
augaauaaguaaacuccuuugg

SEQ ID NO: 346866 - RNA, 22 nt, Human
ccuggggcucaagauggcgccg

SEQ ID NO: 346867 - RNA, 22 nt, Human
gcagggcagugugucugugggg

SEQ ID NO: 346868 - RNA, 22 nt, Human
ggugaggggagagugaaagaaa

SEQ ID NO: 346869 - RNA, 22 nt, Human
ucagaagcaaacaucacucuag

SEQ ID NO: 346870 - RNA, 22 nt, Human
cacacuagucuauccauuagcu

SEQ ID NO: 346871 - RNA, 22 nt, Human
ucauuucccuccuacaaagagg

SEQ ID NO: 346872 - RNA, 22 nt, Human
gugugcaguagagaaagagcag

SEQ ID NO: 346873 - RNA, 22 nt, Human
uuguaacacuuuucuauuaaua

SEQ ID NO: 346874 - RNA, 22 nt, Human
uggcugggggugcuauagcugc

SEQ ID NO: 346875 - RNA, 22 nt, Human
aggagugagcuuuggggucaga

SEQ ID NO: 346876 - RNA, 22 nt, Human
agaaaauauucauugagaggcu

SEQ ID NO: 346877 - RNA, 22 nt, Human
cagaguacugggagaacagaag

SEQ ID NO: 346878 - RNA, 22 nt, Human
uucugucacuuaggaggucaua

SEQ ID NO: 346879 - RNA, 22 nt, Human
uggcugaauaauauucuguugu

SEQ ID NO: 346880 - RNA, 22 nt, Human
agaauuagucacaauuauagga

SEQ ID NO: 346881 - RNA, 22 nt, Human
cugacucccaaagaggacgcgu

SEQ ID NO: 346882 - RNA, 22 nt, Human
uauguuaaauguuugauguuua

SEQ ID NO: 346883 - RNA, 22 nt, Human
gccagcaguauguccuggcagu

SEQ ID NO: 346884 - RNA, 22 nt, Human
aagccagguguuuaggccagcg

SEQ ID NO: 346885 - RNA, 22 nt, Human
acuaaacugaagcaugaaaagg

SEQ ID NO: 346886 - RNA, 19 nt, Human
agagaggcugugugaggga

SEQ ID NO: 346887 - RNA, 22 nt, Human
guuaggcauuugccuuaauuuu

SEQ ID NO: 346888 - RNA, 22 nt, Human
agaguguuuuucugucaaggac

SEQ ID NO: 346889 - RNA, 22 nt, Human
caugaauauuuaguauuuacuu

SEQ ID NO: 346890 - RNA, 22 nt, Human
cggcagcaaaggaagccagguc

SEQ ID NO: 346891 - RNA, 22 nt, Human
gagggcugcugccagauaugcc

SEQ ID NO: 346892 - RNA, 19 nt, Human
ccugucugucuucagcuag

SEQ ID NO: 346893 - RNA, 22 nt, Human
cuucagaacuauaaaaaguacu

SEQ ID NO: 346894 - RNA, 23 nt, Human
gagagcugacugucaagacuguu

SEQ ID NO: 346895 - RNA, 22 nt, Human
acagauauaugauuguguaaau

SEQ ID NO: 346896 - RNA, 22 nt, Human
gccccuggcuggccagcuccuc

SEQ ID NO: 346897 - RNA, 23 nt, Human
augaaugaauaaggcaggaaagc

SEQ ID NO: 346898 - RNA, 22 nt, Human
ccagcuuuuggggugacaauuu

SEQ ID NO: 346899 - RNA, 22 nt, Human
aaaaagauguccugaaguuuag

SEQ ID NO: 346900 - RNA, 22 nt, Human
aaauguagaccuauagggaccu

SEQ ID NO: 346901 - RNA, 22 nt, Human
agugugucugaucacuugugag

SEQ ID NO: 346902 - RNA, 20 nt, Human
gaguuccccauuucuccugg

SEQ ID NO: 346903 - RNA, 22 nt, Human
auuuggcaacauuaauugaauc

SEQ ID NO: 346904 - RNA, 22 nt, Human
gaauucugucgcuuacuagaug

SEQ ID NO: 346905 - RNA, 22 nt, Human
aagccgaggccacacagcagga

SEQ ID NO: 346906 - RNA, 22 nt, Human
uguaaucauuacaguacaugga

SEQ ID NO: 346907 - RNA, 22 nt, Human
acucugaaugugcauguaaauc

SEQ ID NO: 346908 - RNA, 22 nt, Human
cagccucuaagcacagccucuc

SEQ ID NO: 346909 - RNA, 20 nt, Human
aggcagcugggaaaugaggg

SEQ ID NO: 346910 - RNA, 22 nt, Human
cucugguguccuuuagaauuua

SEQ ID NO: 346911 - RNA, 21 nt, Human
cccacggaaugaugaggcacu

SEQ ID NO: 346912 - RNA, 22 nt, Human
ucugggaaguccucugucaugc

SEQ ID NO: 346913 - RNA, 22 nt, Human
gaggcagcaucuauggugggaa

SEQ ID NO: 346914 - RNA, 22 nt, Human
gccugcagaacugugaggcaau

SEQ ID NO: 346915 - RNA, 22 nt, Human
cucuggcuuugcucaugcaucc

SEQ ID NO: 346916 - RNA, 22 nt, Human
aagcuggcaauuaucaaaacug

SEQ ID NO: 346917 - RNA, 22 nt, Human
auugacaagacaauggcucuua

SEQ ID NO: 346918 - RNA, 22 nt, Human
uugucugugaaauggaaauagu

SEQ ID NO: 346919 - RNA, 22 nt, Human
uccugccugagcguggaggagg

SEQ ID NO: 346920 - RNA, 23 nt, Human
aaguaacagggauaauagcaguu

SEQ ID NO: 346921 - RNA, 22 nt, Human
ccacaggggucucuguagcuga

SEQ ID NO: 346922 - RNA, 22 nt, Human
ggcagggcccugauuccugggg

SEQ ID NO: 346923 - RNA, 19 nt, Human
ugcuuaauuccuaguaggu

SEQ ID NO: 346924 - RNA, 22 nt, Human
gcaguguuaggaauaaaaauga

SEQ ID NO: 346925 - RNA, 22 nt, Human
aaucuggcauguaagcuuagag

SEQ ID NO: 346926 - RNA, 22 nt, Human
cccagacauaacagcagagagg

SEQ ID NO: 346927 - RNA, 20 nt, Human
uccaagcccuccuuccauuc

SEQ ID NO: 346928 - RNA, 22 nt, Human
uugcucugaacccagggcacca

SEQ ID NO: 346929 - RNA, 22 nt, Human
caggaugagguagaggcagaua

SEQ ID NO: 346930 - RNA, 22 nt, Human
ugguccagaugccuuggcuuua

SEQ ID NO: 346931 - RNA, 22 nt, Human
gauuuccucacuaacauccauc

SEQ ID NO: 346932 - RNA, 22 nt, Human
ucuggccuacuggaguccauga

SEQ ID NO: 346933 - RNA, 22 nt, Human
ugcucugugguccaagauggcu

SEQ ID NO: 346934 - RNA, 22 nt, Human
gccugcuggcuguccauugcag

SEQ ID NO: 346935 - RNA, 22 nt, Human
gcuggcuugauaguuucugcuu

SEQ ID NO: 346936 - RNA, 22 nt, Human
guagaaauuccauuuacuuuga

SEQ ID NO: 346937 - RNA, 22 nt, Human
cugugauuguuaguuccuauac

SEQ ID NO: 346938 - RNA, 22 nt, Human
acugaaggguaaugugggagcc

SEQ ID NO: 346939 - RNA, 22 nt, Human
guaaaugugcuucuuuuaacuu

SEQ ID NO: 346940 - RNA, 22 nt, Human
ugaucugaaggacaugggaccc

SEQ ID NO: 346941 - RNA, 22 nt, Human
uuucacauuuuauacuuaagcc

SEQ ID NO: 346942 - RNA, 22 nt, Human
cauuuugugcuagacacuaugg

SEQ ID NO: 346943 - RNA, 22 nt, Human
cugcacagagcagggcagacac

SEQ ID NO: 346944 - RNA, 22 nt, Human
cuccagggggcauccacacagc

SEQ ID NO: 346945 - RNA, 22 nt, Human
gcuccucuccucggagucgggg

SEQ ID NO: 346946 - RNA, 22 nt, Human
guuuaagaaaauucauguuguu

SEQ ID NO: 346947 - RNA, 22 nt, Human
ugggccugaaggagcugcgccc

SEQ ID NO: 346948 - RNA, 22 nt, Human
aaguccaugaucaagauguggc

SEQ ID NO: 346949 - RNA, 22 nt, Human
ggcagcagggcugucucccuac

SEQ ID NO: 346950 - RNA, 22 nt, Human
gaaagccauagcccagcuuuac

SEQ ID NO: 346951 - RNA, 22 nt, Human
gugcaggguagcgacggcagga

SEQ ID NO: 346952 - RNA, 22 nt, Human
ugcuguuauacuuagcugguua

SEQ ID NO: 346953 - RNA, 22 nt, Human
guuguuuuuguucucuauagcu

SEQ ID NO: 346954 - RNA, 22 nt, Human
guggccuggaaaggcuggucug

SEQ ID NO: 346955 - RNA, 22 nt, Human
aaaugcacagaggccagagagg

SEQ ID NO: 346956 - RNA, 22 nt, Human
agggauggaagacuugaagacc

SEQ ID NO: 346957 - RNA, 22 nt, Human
gggcagcucagccaccaugcag

SEQ ID NO: 346958 - RNA, 22 nt, Human
auccuugaacuuagacacuagg

SEQ ID NO: 346959 - RNA, 21 nt, Human
ccugagggugguugugaagau

SEQ ID NO: 346960 - RNA, 22 nt, Human
gccaggagcccugggcaaguuc

SEQ ID NO: 346961 - RNA, 22 nt, Human
cccagggaagccauuucugacu

SEQ ID NO: 346962 - RNA, 22 nt, Human
gggcuccaacggugagcaugga

SEQ ID NO: 346963 - RNA, 22 nt, Human
caaagggcucuagacucagcag

SEQ ID NO: 346964 - RNA, 22 nt, Human
aucaaaguaggcauauguuuuu

SEQ ID NO: 346965 - RNA, 22 nt, Human
ugcugugggcaguacauaagcu

SEQ ID NO: 346966 - RNA, 22 nt, Human
uccaggcauuccagccauucca

SEQ ID NO: 346967 - RNA, 22 nt, Human
cauugcuguuaauugucucuag

SEQ ID NO: 346968 - RNA, 22 nt, Human
ugucaccaccggaagaaacugc

SEQ ID NO: 346969 - RNA, 22 nt, Human
gaggccuggucuaugagauguu

SEQ ID NO: 346970 - RNA, 22 nt, Human
gcuguucaaaagccacaguuac

SEQ ID NO: 346971 - RNA, 22 nt, Human
uucacauuaucaggauuguuuc

SEQ ID NO: 346972 - RNA, 22 nt, Human
uuugaauaucacaaacuuucaa

SEQ ID NO: 346973 - RNA, 22 nt, Human
guuagguagaaguuuacuuuga

SEQ ID NO: 346974 - RNA, 22 nt, Human
caggggaguuuuaugcaacaga

SEQ ID NO: 346975 - RNA, 22 nt, Human
uaggcagggauuaggguugauu

SEQ ID NO: 346976 - RNA, 23 nt, Human
uggcucagcuaguuuuccauuuc

SEQ ID NO: 346977 - RNA, 22 nt, Human
cagcagcccacgcgugcugucc

SEQ ID NO: 346978 - RNA, 22 nt, Human
ccacuucaucagugcuccauuu

SEQ ID NO: 346979 - RNA, 22 nt, Human
uucagcagucguccaggaaaag

SEQ ID NO: 346980 - RNA, 22 nt, Human
aucuuguuauaagagauaaugg

SEQ ID NO: 346981 - RNA, 22 nt, Human
gaggccaaucaauagggcaaua

SEQ ID NO: 346982 - RNA, 17 nt, Human
uggacccuugggccucc

SEQ ID NO: 346983 - RNA, 22 nt, Human
gccugccuucggugcgcagcgg

SEQ ID NO: 346984 - RNA, 23 nt, Human
cuccucguaacucuguggugggu

SEQ ID NO: 346985 - RNA, 22 nt, Human
gcagcugcagacccucagugcu

SEQ ID NO: 346986 - RNA, 22 nt, Human
uacauuguucaugcaugagaaa

SEQ ID NO: 346987 - RNA, 22 nt, Human
uggcagcaauuagcuagagcug

SEQ ID NO: 346988 - RNA, 22 nt, Human
uagggcagauucgguggaguuu

SEQ ID NO: 346989 - RNA, 22 nt, Human
gagaggaguaggcugauggugc

SEQ ID NO: 346990 - RNA, 22 nt, Human
aagguacaccaaaguucaaguu

SEQ ID NO: 346991 - RNA, 22 nt, Human
gaggagagaagcuaacggugcu

SEQ ID NO: 346992 - RNA, 22 nt, Human
guugaaagaugucuugguuccc

SEQ ID NO: 346993 - RNA, 20 nt, Human
uguugauuggugucaucuca

SEQ ID NO: 346994 - RNA, 21 nt, Human
ggcccugguuacgccuccucu

SEQ ID NO: 346995 - RNA, 22 nt, Human
uuucuacagcuggugcaacuuu

SEQ ID NO: 346996 - RNA, 22 nt, Human
ggcugcagguugguuggcagcu

SEQ ID NO: 346997 - RNA, 22 nt, Human
agggcugcuuugcuaaauaugg

SEQ ID NO: 346998 - RNA, 22 nt, Human
ugugccaugaggcucugauaug

SEQ ID NO: 346999 - RNA, 22 nt, Human
ccagugcuuccaggaauacggu

SEQ ID NO: 347000 - RNA, 22 nt, Human
uggaccugcguaggugcugggc

SEQ ID NO: 347001 - RNA, 22 nt, Human
ucaaugauuagaguuuagugug

SEQ ID NO: 347002 - RNA, 22 nt, Human
cuucacauguuggaguccuuug

SEQ ID NO: 347003 - RNA, 22 nt, Human
ccaggaggcggaagguacagug

SEQ ID NO: 347004 - RNA, 22 nt, Human
ucucugagcgcauuccuccggc

SEQ ID NO: 347005 - RNA, 22 nt, Human
cagggccagagagggcuggcug

SEQ ID NO: 347006 - RNA, 22 nt, Human
acagggcagaaauguugcaucu

SEQ ID NO: 347007 - RNA, 22 nt, Human
uggcuucugcuuucaguggagg

SEQ ID NO: 347008 - RNA, 19 nt, Human
cuggccaggccaggggccc

SEQ ID NO: 347009 - RNA, 22 nt, Human
ccucagggaaugggaggcuggg

SEQ ID NO: 347010 - RNA, 22 nt, Human
uccaggagguugagugaguucc

SEQ ID NO: 347011 - RNA, 22 nt, Human
gcccagccuccaagcuccaagg

SEQ ID NO: 347012 - RNA, 22 nt, Human
cacaaaaguaggaggcaggcgg

SEQ ID NO: 347013 - RNA, 22 nt, Human
agcaggaacgaguucaugggga

SEQ ID NO: 347014 - RNA, 22 nt, Human
ugaaggcagcaugcacacuagu

SEQ ID NO: 347015 - RNA, 22 nt, Human
ucaggagcugcacugggcccac

SEQ ID NO: 347016 - RNA, 22 nt, Human
uugauuucuuacucuuccaagg

SEQ ID NO: 347017 - RNA, 22 nt, Human
agaggccaggcugcagagggau

SEQ ID NO: 347018 - RNA, 22 nt, Human
caauguguuugcauauuaaaau

SEQ ID NO: 347019 - RNA, 22 nt, Human
gugaccaucagagaauaacaaa

SEQ ID NO: 347020 - RNA, 22 nt, Human
gcugccagccaacuugcugugc

SEQ ID NO: 347021 - RNA, 22 nt, Human
accagagcgcucaagccuuccc

SEQ ID NO: 347022 - RNA, 22 nt, Human
cagagcauuuggaagccacgug

SEQ ID NO: 347023 - RNA, 22 nt, Human
augcuucagugcuaccuucaaa

SEQ ID NO: 347024 - RNA, 22 nt, Human
uuuaggcaauagauggcagugu

SEQ ID NO: 347025 - RNA, 22 nt, Human
gaagaaagauuggcaugcuuca

SEQ ID NO: 347026 - RNA, 22 nt, Human
caauaauauccugugcuguuug

SEQ ID NO: 347027 - RNA, 22 nt, Human
cagaagcauuccagcaaauagu

SEQ ID NO: 347028 - RNA, 22 nt, Human
ggcccugugguuuugcaaaguc

SEQ ID NO: 347029 - RNA, 22 nt, Human
agcccccaaaagugcuuaugau

SEQ ID NO: 347030 - RNA, 22 nt, Human
uuccaggggcagcagugauggu

SEQ ID NO: 347031 - RNA, 22 nt, Human
gagccagccuucuucugagguc

SEQ ID NO: 347032 - RNA, 22 nt, Human
uauuaucauugguaauaugguc

SEQ ID NO: 347033 - RNA, 17 nt, Human
agaacuguaguagcucc

SEQ ID NO: 347034 - RNA, 22 nt, Human
cccuuagcuccaagggguuugg

SEQ ID NO: 347035 - RNA, 21 nt, Human
ggccugaguauaggacaggcc

SEQ ID NO: 347036 - RNA, 22 nt, Human
gagggaccuuuacacagacauu

SEQ ID NO: 347037 - RNA, 22 nt, Human
acuuaaaaagaaucuuuucacg

SEQ ID NO: 347038 - RNA, 22 nt, Human
uguagaaauuaguaagaucaac

SEQ ID NO: 347039 - RNA, 22 nt, Human
augguacaaaauguauaaaguc

SEQ ID NO: 347040 - RNA, 22 nt, Human
uuagaaagaacuuuagauauca

SEQ ID NO: 347041 - RNA, 20 nt, Human
gcaaauggaucccacaagcc

SEQ ID NO: 347042 - RNA, 22 nt, Human
ucagcagggaggcucugugccc

SEQ ID NO: 347043 - RNA, 22 nt, Human
agggcuggcuaggugcguuccc

SEQ ID NO: 347044 - RNA, 22 nt, Human
agccuggacagcuacggagaac

SEQ ID NO: 347045 - RNA, 22 nt, Human
cuagggacugggaccuuaguua

SEQ ID NO: 347046 - RNA, 22 nt, Human
cuggccuggagccucugggugg

SEQ ID NO: 347047 - RNA, 22 nt, Human
cugaaggagguagagugacaua

SEQ ID NO: 347048 - RNA, 22 nt, Human
cugugcaguggcagcguguggg

SEQ ID NO: 347049 - RNA, 22 nt, Human
aguggcagagaccccagccagc

SEQ ID NO: 347050 - RNA, 22 nt, Human
cagaagaguagcugaacaaguu

SEQ ID NO: 347051 - RNA, 22 nt, Human
ucuuccucucuaauugaucaga

SEQ ID NO: 347052 - RNA, 22 nt, Human
ugaagaauguugcagugagcau

SEQ ID NO: 347053 - RNA, 17 nt, Human
guccuacccauggucua

SEQ ID NO: 347054 - RNA, 22 nt, Human
uagauuucaggcuggcuugcgg

SEQ ID NO: 347055 - RNA, 22 nt, Human
uuucaguuacugcuauaucauu

SEQ ID NO: 347056 - RNA, 23 nt, Human
ucucugaguuguacuuucccuug

SEQ ID NO: 347057 - RNA, 17 nt, Human
uuccccugaccaagccu

SEQ ID NO: 347058 - RNA, 22 nt, Human
aucuggcuggauucuuagcguu

SEQ ID NO: 347059 - RNA, 23 nt, Human
uagaauucaaucuguuccacauc

SEQ ID NO: 347060 - RNA, 22 nt, Human
cagacagcugcuuucuugcugu

SEQ ID NO: 347061 - RNA, 22 nt, Human
ggcugggcaaacaagacucuuc

SEQ ID NO: 347062 - RNA, 22 nt, Human
ugcuugggaauguggagucaga

SEQ ID NO: 347063 - RNA, 22 nt, Human
gagcagaacuacucacauaucg

SEQ ID NO: 347064 - RNA, 22 nt, Human
ugcaccauacccauuccccucu

SEQ ID NO: 347065 - RNA, 22 nt, Human
cuggagagaaaugacaaagcua

SEQ ID NO: 347066 - RNA, 22 nt, Human
gggcucucaugaguguguggua

SEQ ID NO: 347067 - RNA, 22 nt, Human
ggggggugcugaucaguggagc

SEQ ID NO: 347068 - RNA, 22 nt, Human
ugcuccuuccucauccugugca

SEQ ID NO: 347069 - RNA, 22 nt, Human
gaaaauguuagcuucauaguca

SEQ ID NO: 347070 - RNA, 22 nt, Human
uccuuugguuguagacaggaau

SEQ ID NO: 347071 - RNA, 22 nt, Human
uauuucuguaacucagggucug

SEQ ID NO: 347072 - RNA, 22 nt, Human
aauguguauaugaacauacagg

SEQ ID NO: 347073 - RNA, 22 nt, Human
gcagccagccccucugaccucu

SEQ ID NO: 347074 - RNA, 22 nt, Human
agcauggggcaaugcaugugcu

SEQ ID NO: 347075 - RNA, 22 nt, Human
gaggagaaauuuggggaccuga

SEQ ID NO: 347076 - RNA, 22 nt, Human
aggcugaguuucucauucucgc

SEQ ID NO: 347077 - RNA, 22 nt, Human
ucagaggaccuuacugagaacc

SEQ ID NO: 347078 - RNA, 22 nt, Human
uugcagcugcaguaaauguuca

SEQ ID NO: 347079 - RNA, 22 nt, Human
ugcaugcauaaauguacacaca

SEQ ID NO: 347080 - RNA, 22 nt, Human
uggucuuuaagguagcugucau

SEQ ID NO: 347081 - RNA, 20 nt, Human
gaaaugugaccucuucugug

SEQ ID NO: 347082 - RNA, 22 nt, Human
aaggcacugaacuuaaauucug

SEQ ID NO: 347083 - RNA, 22 nt, Human
cacagaauaaauugguaucaga

SEQ ID NO: 347084 - RNA, 22 nt, Human
aggggcuggaguucgagguuac

SEQ ID NO: 347085 - RNA, 22 nt, Human
caggagaaauguggcugcuacc

SEQ ID NO: 347086 - RNA, 21 nt, Human
acagauuuuauaucucugcug

SEQ ID NO: 347087 - RNA, 22 nt, Human
caguacuuauuucuauuuaggg

SEQ ID NO: 347088 - RNA, 22 nt, Human
aaaauccugcugacucgagaug

SEQ ID NO: 347089 - RNA, 18 nt, Human
ugacagaaccuggagccu

SEQ ID NO: 347090 - RNA, 21 nt, Human
uaaaucucuguauucuucagu

SEQ ID NO: 347091 - RNA, 22 nt, Human
gcugcucuccauggccgugagu

SEQ ID NO: 347092 - RNA, 22 nt, Human
gccagggaacccaagggccuca

SEQ ID NO: 347093 - RNA, 22 nt, Human
gaggcugcuguuagcccugggc

SEQ ID NO: 347094 - RNA, 21 nt, Human
agcagaggggacauguuugau

SEQ ID NO: 347095 - RNA, 22 nt, Human
ugauucuauggaaggcauaagg

SEQ ID NO: 347096 - RNA, 22 nt, Human
cccaggaaugggaaggaggaau

SEQ ID NO: 347097 - RNA, 22 nt, Human
augcuuuauuauuuugcaggga

SEQ ID NO: 347098 - RNA, 22 nt, Human
aaauugaaugauuaagugguga

SEQ ID NO: 347099 - RNA, 22 nt, Human
ugcuccagugagcuggccaucc

SEQ ID NO: 347100 - RNA, 22 nt, Human
ugccacacucacuucuguggac

SEQ ID NO: 347101 - RNA, 22 nt, Human
gugccugcugcagagucgcugu

SEQ ID NO: 347102 - RNA, 22 nt, Human
uaggcagcagugcuaugauucu

SEQ ID NO: 347103 - RNA, 22 nt, Human
gaggcacaucacuuggugcauu

SEQ ID NO: 347104 - RNA, 22 nt, Human
cugcuguggguuaagacacugu

SEQ ID NO: 347105 - RNA, 22 nt, Human
auugaaucugcacuaguauuuu

SEQ ID NO: 347106 - RNA, 22 nt, Human
aaauauguauggaguucaugaa

SEQ ID NO: 347107 - RNA, 22 nt, Human
uggcagggaguugcaggauuuc

SEQ ID NO: 347108 - RNA, 22 nt, Human
uggagcuggcuuguggaaguug

SEQ ID NO: 347109 - RNA, 22 nt, Human
agagcagcacguuguccccaca

SEQ ID NO: 347110 - RNA, 22 nt, Human
auuuucauuuugcagggugaga

SEQ ID NO: 347111 - RNA, 22 nt, Human
cuggagugaggucugggagccu

SEQ ID NO: 347112 - RNA, 22 nt, Human
auauuagguuggugcaaaagua

SEQ ID NO: 347113 - RNA, 22 nt, Human
ugaaaguuacaggaaaacagau

SEQ ID NO: 347114 - RNA, 22 nt, Human
uccugcagccacugcaggcaga

SEQ ID NO: 347115 - RNA, 22 nt, Human
caggaugggugucggccagcac

SEQ ID NO: 347116 - RNA, 22 nt, Human
gaaaauguuuccuguuauuugc

SEQ ID NO: 347117 - RNA, 22 nt, Human
uugaaaggccuguuuauccagc

SEQ ID NO: 347118 - RNA, 22 nt, Human
cccagcccccgagugucuggaa

SEQ ID NO: 347119 - RNA, 22 nt, Human
caucucaugggcaugccaagcu

SEQ ID NO: 347120 - RNA, 22 nt, Human
ggcagcuccaaaaggaaacacu

SEQ ID NO: 347121 - RNA, 22 nt, Human
gaucuucucuuuaguagaaaca

SEQ ID NO: 347122 - RNA, 22 nt, Human
ugggcagacuaaggucaaagcu

SEQ ID NO: 347123 - RNA, 22 nt, Human
uguuucauuaguacugacaaua

SEQ ID NO: 347124 - RNA, 22 nt, Human
agauacauugaguuuccuccug

SEQ ID NO: 347125 - RNA, 22 nt, Human
uggcagcuacagacagagguga

SEQ ID NO: 347126 - RNA, 22 nt, Human
gccucugcccauccaccaucag

SEQ ID NO: 347127 - RNA, 22 nt, Human
ugggaguguucuuggcuugcuu

SEQ ID NO: 347128 - RNA, 22 nt, Human
ugaaucugauuucccuggaggc

SEQ ID NO: 347129 - RNA, 23 nt, Human
agugcugaauugaaagcuccagg

SEQ ID NO: 347130 - RNA, 22 nt, Human
gccagagccacuuuugggugau

SEQ ID NO: 347131 - RNA, 22 nt, Human
gggcugugggacccggcacuuu

SEQ ID NO: 347132 - RNA, 22 nt, Human
acugucugcaaaacucauacuc

SEQ ID NO: 347133 - RNA, 22 nt, Human
uaaguucauuagacuacagaua

SEQ ID NO: 347134 - RNA, 20 nt, Human
caggaggcaaggucaagguc

SEQ ID NO: 347135 - RNA, 22 nt, Human
acaacuuucuggguuaucugau

SEQ ID NO: 347136 - RNA, 22 nt, Human
gccuggaguacuccuugaagug

SEQ ID NO: 347137 - RNA, 22 nt, Human
cagugcaguugguggcaggggu

SEQ ID NO: 347138 - RNA, 18 nt, Human
uggagcugagugcugugc

SEQ ID NO: 347139 - RNA, 22 nt, Human
uuaaugcuugucuagaucuucu

SEQ ID NO: 347140 - RNA, 22 nt, Human
acacugugacaaaggcuguucu

SEQ ID NO: 347141 - RNA, 22 nt, Human
agcagagcugcaguggccugcu

SEQ ID NO: 347142 - RNA, 22 nt, Human
gccaggcagacaggucaucagg

SEQ ID NO: 347143 - RNA, 22 nt, Human
ccagagccccugagcuucccug

SEQ ID NO: 347144 - RNA, 22 nt, Human
uuccaggacuggguguuugaag

SEQ ID NO: 347145 - RNA, 22 nt, Human
aggcugagccugggcguggugg

SEQ ID NO: 347146 - RNA, 22 nt, Human
ggcagggagagcaugcugauaa

SEQ ID NO: 347147 - RNA, 17 nt, Human
auuuccucagggcugag

SEQ ID NO: 347148 - RNA, 22 nt, Human
uuagaaaacauaagugguaaag

SEQ ID NO: 347149 - RNA, 22 nt, Human
gugugcagucugcuaggcaggg

SEQ ID NO: 347150 - RNA, 23 nt, Human
gccucagagaaacagcugcacac

SEQ ID NO: 347151 - RNA, 22 nt, Human
uggccugccucccggcuucuuu

SEQ ID NO: 347152 - RNA, 22 nt, Human
uucauguaauuccauaagguaa

SEQ ID NO: 347153 - RNA, 22 nt, Human
gacagcuggcaguggaaaggug

SEQ ID NO: 347154 - RNA, 22 nt, Human
aaggcagccgugugacugcaug

SEQ ID NO: 347155 - RNA, 22 nt, Human
gugcaugugcauccauguguac

SEQ ID NO: 347156 - RNA, 22 nt, Human
ugacaguuaagguauacauuca

SEQ ID NO: 347157 - RNA, 22 nt, Human
cucaggaugcaggucacaggac

SEQ ID NO: 347158 - RNA, 22 nt, Human
ccugguguugugaaguagccgu

SEQ ID NO: 347159 - RNA, 22 nt, Human
gcucugucaacagcuagcugug

SEQ ID NO: 347160 - RNA, 22 nt, Human
agaggaggaagagcuuuaaaau

SEQ ID NO: 347161 - RNA, 22 nt, Human
guuccaaaguuagaguguauug

SEQ ID NO: 347162 - RNA, 22 nt, Human
uuacaaagaguguucuuuucca

SEQ ID NO: 347163 - RNA, 22 nt, Human
aggcaggcacacuuccuccagg

SEQ ID NO: 347164 - RNA, 22 nt, Human
agagccugaggccaggaaaaug

SEQ ID NO: 347165 - RNA, 22 nt, Human
aucaggaucugggagccugaaa

SEQ ID NO: 347166 - RNA, 22 nt, Human
cuguuucaagugaagucagaca

SEQ ID NO: 347167 - RNA, 21 nt, Human
uguccuuaaugcaauguccuu

SEQ ID NO: 347168 - RNA, 22 nt, Human
gaugugagugguagcugggauu

SEQ ID NO: 347169 - RNA, 19 nt, Human
agaggcagucuccaacagg

SEQ ID NO: 347170 - RNA, 22 nt, Human
agggcuccaggggcugggugac

SEQ ID NO: 347171 - RNA, 22 nt, Human
aagugaaacauguaucucuuua

SEQ ID NO: 347172 - RNA, 22 nt, Human
cagcuggcaaguggagcagggu

SEQ ID NO: 347173 - RNA, 22 nt, Human
aggugagguuugggagguguca

SEQ ID NO: 347174 - RNA, 22 nt, Human
ggccuugggaggagggucagaa

SEQ ID NO: 347175 - RNA, 22 nt, Human
ucaaagucauggcuaguaauga

SEQ ID NO: 347176 - RNA, 22 nt, Human
uacuaaauaguuuaauuccuca

SEQ ID NO: 347177 - RNA, 22 nt, Human
gaggcagagucacaaagagucu

SEQ ID NO: 347178 - RNA, 22 nt, Human
aaaucaguuggaacacaagcag

SEQ ID NO: 347179 - RNA, 22 nt, Human
gagcaggcuugcagagaagggg

SEQ ID NO: 347180 - RNA, 22 nt, Human
ugaggccaaugacccugggcag

SEQ ID NO: 347181 - RNA, 22 nt, Human
ugcuguguggaugugaagaauc

SEQ ID NO: 347182 - RNA, 22 nt, Human
cccagagcugagucugauauau

SEQ ID NO: 347183 - RNA, 22 nt, Human
acaugcaugucuaugggcaggu

SEQ ID NO: 347184 - RNA, 22 nt, Human
aggcucagucuguucaugcacu

SEQ ID NO: 347185 - RNA, 22 nt, Human
uggccugggugcugcugacauc

SEQ ID NO: 347186 - RNA, 22 nt, Human
cccugcugucaggugcugggag

SEQ ID NO: 347187 - RNA, 22 nt, Human
agcaguggugugaggagggcuc

SEQ ID NO: 347188 - RNA, 21 nt, Human
ucccagggccaggugccauca

SEQ ID NO: 347189 - RNA, 22 nt, Human
cagaggcucaccagccuuucac

SEQ ID NO: 347190 - RNA, 18 nt, Human
ggcagggaaaagauaggg

SEQ ID NO: 347191 - RNA, 22 nt, Human
acauuuaaauaugccuuauauu

SEQ ID NO: 347192 - RNA, 19 nt, Human
gaaguccucuaguaaauuu

SEQ ID NO: 347193 - RNA, 21 nt, Human
ggauggauagggaagagauuu

SEQ ID NO: 347194 - RNA, 22 nt, Human
cagaggaagcagacacaucuug

SEQ ID NO: 347195 - RNA, 22 nt, Human
gaguggggcccacugcugggug

SEQ ID NO: 347196 - RNA, 22 nt, Human
uguggcuguguccaccugcugc

SEQ ID NO: 347197 - RNA, 22 nt, Human
ggcuuuauuuugcaugaaugcu

SEQ ID NO: 347198 - RNA, 22 nt, Human
ggagugaaguggcgcgaucucg

SEQ ID NO: 347199 - RNA, 22 nt, Human
auuucucagugaaaugacaggc

SEQ ID NO: 347200 - RNA, 22 nt, Human
ccagccagucccgcaugaccgc

SEQ ID NO: 347201 - RNA, 22 nt, Human
uucauucugggcucuaaggaac

SEQ ID NO: 347202 - RNA, 22 nt, Human
ugagccugcugucgcuggaccc

SEQ ID NO: 347203 - RNA, 22 nt, Human
cacaugaugguggaagccauag

SEQ ID NO: 347204 - RNA, 22 nt, Human
cuuuccaagaaugcagauaccu

SEQ ID NO: 347205 - RNA, 22 nt, Human
ccaccagcagugugcaaggauu

SEQ ID NO: 347206 - RNA, 22 nt, Human
uuagauaacaguagaauaucaa

SEQ ID NO: 347207 - RNA, 22 nt, Human
aggagggcaggcuggcugccua

SEQ ID NO: 347208 - RNA, 22 nt, Human
ccagcaugagacgaugaugaag

SEQ ID NO: 347209 - RNA, 21 nt, Human
acaggcucuggggaugcuggg

SEQ ID NO: 347210 - RNA, 22 nt, Human
uguuccaauaaggaguugaaau

SEQ ID NO: 347211 - RNA, 22 nt, Human
cccacucccugcacgccugccg

SEQ ID NO: 347212 - RNA, 22 nt, Human
cucugaauggacacuccagugu

SEQ ID NO: 347213 - RNA, 22 nt, Human
gucaccagucccagcuccugaa

SEQ ID NO: 347214 - RNA, 22 nt, Human
guguaauuauauaaagaucuac

SEQ ID NO: 347215 - RNA, 22 nt, Human
augcuguggaugccuugcccca

SEQ ID NO: 347216 - RNA, 22 nt, Human
uuggccuuaaccucucugugcc

SEQ ID NO: 347217 - RNA, 22 nt, Human
auaugcacauacauacauaggu

SEQ ID NO: 347218 - RNA, 22 nt, Human
gggcugaccaaugccuugcuuu

SEQ ID NO: 347219 - RNA, 22 nt, Human
aguggcagagguugacugcagu

SEQ ID NO: 347220 - RNA, 22 nt, Human
aaacagcugucauuguuuuaaa

SEQ ID NO: 347221 - RNA, 22 nt, Human
acauuucuuugcuagacagcag

SEQ ID NO: 347222 - RNA, 22 nt, Human
agggggugcccagaugaaggau

SEQ ID NO: 347223 - RNA, 22 nt, Human
uagcccagagucccaauuccag

SEQ ID NO: 347224 - RNA, 22 nt, Human
cauggcuucuaagugauaacgu

SEQ ID NO: 347225 - RNA, 22 nt, Human
uauuucuguaugcauaaaagga

SEQ ID NO: 347226 - RNA, 22 nt, Human
cugggaggugaacagaaaaacu

SEQ ID NO: 347227 - RNA, 22 nt, Human
agggauguaaauucuucuucuu

SEQ ID NO: 347228 - RNA, 20 nt, Human
ccuccaggcacacccaugug

SEQ ID NO: 347229 - RNA, 22 nt, Human
gcaggagacuggcugugguagu

SEQ ID NO: 347230 - RNA, 22 nt, Human
gagcagcuagauaaagcccuuc

SEQ ID NO: 347231 - RNA, 22 nt, Human
uacaaaguaauguauaauaucg

SEQ ID NO: 347232 - RNA, 22 nt, Human
ggcagggucuggacugaaagcu

SEQ ID NO: 347233 - RNA, 22 nt, Human
ugaagcagagugaaggugaauu

SEQ ID NO: 347234 - RNA, 22 nt, Human
uccugcagagccgcccucaggu

SEQ ID NO: 347235 - RNA, 22 nt, Human
gaauccaggguuguuugagcua

SEQ ID NO: 347236 - RNA, 20 nt, Human
ugucaugcauuagaugaaga

SEQ ID NO: 347237 - RNA, 22 nt, Human
ccucuucuaggacguccuugug

SEQ ID NO: 347238 - RNA, 22 nt, Human
ugggcugcccaagguggccaug

SEQ ID NO: 347239 - RNA, 22 nt, Human
aaagcccauguggaaguacagg

SEQ ID NO: 347240 - RNA, 22 nt, Human
gaggcuccccaugaggccccag

SEQ ID NO: 347241 - RNA, 22 nt, Human
caaauucucacccuguuugauu

SEQ ID NO: 347242 - RNA, 22 nt, Human
uuugcauuacuugacuuuaguu

SEQ ID NO: 347243 - RNA, 22 nt, Human
agccaggcgggucuuugcuccu

SEQ ID NO: 347244 - RNA, 22 nt, Human
agggcaugaagcaguggacagc

SEQ ID NO: 347245 - RNA, 22 nt, Human
gagaagucauuugaccaccuag

SEQ ID NO: 347246 - RNA, 22 nt, Human
gcucugggauuaccagccuuag

SEQ ID NO: 347247 - RNA, 22 nt, Human
cacagcuugggcucugacaaua

SEQ ID NO: 347248 - RNA, 22 nt, Human
gcagcuguguaaugagcccaca

SEQ ID NO: 347249 - RNA, 22 nt, Human
aaauuauuaugccccucuauaa

SEQ ID NO: 347250 - RNA, 22 nt, Human
gauaaaauaacuauggaauacu

SEQ ID NO: 347251 - RNA, 22 nt, Human
cuggcaggaagaggaaagguca

SEQ ID NO: 347252 - RNA, 22 nt, Human
agguacagcaauauaagagguc

SEQ ID NO: 347253 - RNA, 23 nt, Human
ucguugaauagcaauagcacaac

SEQ ID NO: 347254 - RNA, 19 nt, Human
agcagccauagacaauaug

SEQ ID NO: 347255 - RNA, 22 nt, Human
uucaggaugaaagugugcaaca

SEQ ID NO: 347256 - RNA, 22 nt, Human
guugaaagaucauguggcugcc

SEQ ID NO: 347257 - RNA, 22 nt, Human
caggguggaagcuguagagugg

SEQ ID NO: 347258 - RNA, 22 nt, Human
cucacaggagaaagucaugguc

SEQ ID NO: 347259 - RNA, 22 nt, Human
aggcugcugaggccaccacgcu

SEQ ID NO: 347260 - RNA, 23 nt, Human
ggagugcaauggcgccaucucgg

SEQ ID NO: 347261 - RNA, 22 nt, Human
cagagcugcacauucuaugaug

SEQ ID NO: 347262 - RNA, 22 nt, Human
uauuccaaaauaguuaagcacu

SEQ ID NO: 347263 - RNA, 22 nt, Human
cacugaaggacaguaggaaggg

SEQ ID NO: 347264 - RNA, 22 nt, Human
aaaguauuugugauuuuuacca

SEQ ID NO: 347265 - RNA, 22 nt, Human
uggagagcgugcuuagcacucu

SEQ ID NO: 347266 - RNA, 19 nt, Human
agaaaucucgagauuuguu

SEQ ID NO: 347267 - RNA, 22 nt, Human
uaucuuugcaaauaucucuaag

SEQ ID NO: 347268 - RNA, 22 nt, Human
ugccagccagguucugaggcua

SEQ ID NO: 347269 - RNA, 22 nt, Human
gcuguggucugugagcuccaaa

SEQ ID NO: 347270 - RNA, 22 nt, Human
guguuuccaguucagaaagcaa

SEQ ID NO: 347271 - RNA, 22 nt, Human
ugcagggcccucauuccugucc

SEQ ID NO: 347272 - RNA, 22 nt, Human
ccacaggaccagaggagaucac

SEQ ID NO: 347273 - RNA, 22 nt, Human
ggugaggcccagugaucugugu

SEQ ID NO: 347274 - RNA, 22 nt, Human
accaggcagucaccguccagga

SEQ ID NO: 347275 - RNA, 22 nt, Human
ugggccuggguuccuccugggc

SEQ ID NO: 347276 - RNA, 22 nt, Human
aggagcugagucagcccgacag

SEQ ID NO: 347277 - RNA, 22 nt, Human
gugauugcccagcaccauuguu

SEQ ID NO: 347278 - RNA, 22 nt, Human
ccagcccuucccaacuggccag

SEQ ID NO: 347279 - RNA, 22 nt, Human
uucauguauuuaucauguaaau

SEQ ID NO: 347280 - RNA, 22 nt, Human
aguaaaauuaauggaucagaag

SEQ ID NO: 347281 - RNA, 22 nt, Human
uuauuacacugaaagaauugcg

SEQ ID NO: 347282 - RNA, 22 nt, Human
gcuuggaaguaggauugggaga

SEQ ID NO: 347283 - RNA, 22 nt, Human
ggcuggcuggcugguagacaag

SEQ ID NO: 347284 - RNA, 22 nt, Human
cucuguccuugcacaguuccua

SEQ ID NO: 347285 - RNA, 20 nt, Human
gagauggcuaagugcugaac

SEQ ID NO: 347286 - RNA, 22 nt, Human
acaugauuggacuccuuccccu

SEQ ID NO: 347287 - RNA, 22 nt, Human
guuauguaucuugauugggugg

SEQ ID NO: 347288 - RNA, 22 nt, Human
ugaagcagagaauuugacaguc

SEQ ID NO: 347289 - RNA, 22 nt, Human
uuaauuaugcaaaaggccccau

SEQ ID NO: 347290 - RNA, 22 nt, Human
uugcauuuuuagaugcuucugu

SEQ ID NO: 347291 - RNA, 22 nt, Human
gccagagcagaauagaguggcc

SEQ ID NO: 347292 - RNA, 22 nt, Human
uaaagguagugugacauauugu

SEQ ID NO: 347293 - RNA, 22 nt, Human
uauacagaaccgccugaagucu

SEQ ID NO: 347294 - RNA, 22 nt, Human
ucagcagggcugugguguggcu

SEQ ID NO: 347295 - RNA, 22 nt, Human
ucugggagggagccucagaauc

SEQ ID NO: 347296 - RNA, 22 nt, Human
ccagguggaggugugagguccu

SEQ ID NO: 347297 - RNA, 22 nt, Human
gcugcagcagaaguucucagag

SEQ ID NO: 347298 - RNA, 23 nt, Human
acucacaaagcaggaucauguug

SEQ ID NO: 347299 - RNA, 22 nt, Human
aggcagcccugugcuggaugcu

SEQ ID NO: 347300 - RNA, 22 nt, Human
gaggaccacagaugagccugca

SEQ ID NO: 347301 - RNA, 21 nt, Human
agcagagugcuuugacuuugu

SEQ ID NO: 347302 - RNA, 22 nt, Human
gcaaggcugcugccacccaucu

SEQ ID NO: 347303 - RNA, 16 nt, Human
gggcugggggauucug

SEQ ID NO: 347304 - RNA, 22 nt, Human
cagcaggcccagaguuucaugg

SEQ ID NO: 347305 - RNA, 22 nt, Human
gggcugcuuuuuucuuagcaga

SEQ ID NO: 347306 - RNA, 22 nt, Human
gauuucuuugcaagcuguguuc

SEQ ID NO: 347307 - RNA, 22 nt, Human
agcaggcagccauuuggaaggc

SEQ ID NO: 347308 - RNA, 22 nt, Human
auggcuuucagauuucuauguu

SEQ ID NO: 347309 - RNA, 21 nt, Human
agaaauguaucauucuuuucc

SEQ ID NO: 347310 - RNA, 22 nt, Human
ucacuuuugaucccuaugcagu

SEQ ID NO: 347311 - RNA, 22 nt, Human
ccagguggaaggucugugcucu

SEQ ID NO: 347312 - RNA, 22 nt, Human
gagagcugugguuugaccaggc

SEQ ID NO: 347313 - RNA, 22 nt, Human
gccagagcugagacacgagucc

SEQ ID NO: 347314 - RNA, 22 nt, Human
uaaggcacccuucugaguagag

SEQ ID NO: 347315 - RNA, 22 nt, Human
uggccugccuucgcugagcuga

SEQ ID NO: 347316 - RNA, 22 nt, Human
uagcucuucaaucacugucucc

SEQ ID NO: 347317 - RNA, 22 nt, Human
ggagaggggcaaguuuaucuag

SEQ ID NO: 347318 - RNA, 22 nt, Human
ugcuuugggucucucuaguuuc

SEQ ID NO: 347319 - RNA, 19 nt, Human
accucugcagagauguuua

SEQ ID NO: 347320 - RNA, 22 nt, Human
agaggccuaauugcuacccuuu

SEQ ID NO: 347321 - RNA, 22 nt, Human
cacugaagccugggaguaagac

SEQ ID NO: 347322 - RNA, 19 nt, Human
gcagccaccgcggcggccg

SEQ ID NO: 347323 - RNA, 22 nt, Human
caaauucacaugauugcuucug

SEQ ID NO: 347324 - RNA, 22 nt, Human
augugcauuaaaugucaauguu

SEQ ID NO: 347325 - RNA, 22 nt, Human
cugccuccugccgugcagcuuc

SEQ ID NO: 347326 - RNA, 22 nt, Human
gcguaaggccucuggucucgga

SEQ ID NO: 347327 - RNA, 22 nt, Human
gcuggagcuugagaggacaggg

SEQ ID NO: 347328 - RNA, 22 nt, Human
augcugaagagugcacaggcua

SEQ ID NO: 347329 - RNA, 22 nt, Human
gagcugccuguugcauagcaac

SEQ ID NO: 347330 - RNA, 22 nt, Human
uuuaagacuuagauuuauuggg

SEQ ID NO: 347331 - RNA, 22 nt, Human
cuuaagauuugcgauaccuaau

SEQ ID NO: 347332 - RNA, 22 nt, Human
uagcagggccaggcugggaacc

SEQ ID NO: 347333 - RNA, 22 nt, Human
gcucccuccaugaggcagaccg

SEQ ID NO: 347334 - RNA, 22 nt, Human
cggagggguuugaacagaggag

SEQ ID NO: 347335 - RNA, 22 nt, Human
uaccaggcagcugcacagaggc

SEQ ID NO: 347336 - RNA, 22 nt, Human
ugcauuguuuagaacucuuugg

SEQ ID NO: 347337 - RNA, 22 nt, Human
gccuggcugagguggggaggca

SEQ ID NO: 347338 - RNA, 22 nt, Human
aaucagucucauuuagcaggga

SEQ ID NO: 347339 - RNA, 22 nt, Human
cccaggucugugccagcucuga

SEQ ID NO: 347340 - RNA, 22 nt, Human
caaagccucugauuucacuugu

SEQ ID NO: 347341 - RNA, 17 nt, Human
ucuguucaugcauaccu

SEQ ID NO: 347342 - RNA, 20 nt, Human
agcuucuucugucuaauuuu

SEQ ID NO: 347343 - RNA, 22 nt, Human
ucauugcaguugaguuguguua

SEQ ID NO: 347344 - RNA, 22 nt, Human
uuauuauaaugagggauaaaaa

SEQ ID NO: 347345 - RNA, 22 nt, Human
ggguuggggcccagcagucugc

SEQ ID NO: 347346 - RNA, 22 nt, Human
cugccaggcagggagauggcug

SEQ ID NO: 347347 - RNA, 22 nt, Human
gcuguauuccugcacuguauag

SEQ ID NO: 347348 - RNA, 22 nt, Human
augguuuaagggagaauauuga

SEQ ID NO: 347349 - RNA, 22 nt, Human
ugagcuuacgugggaacagacu

SEQ ID NO: 347350 - RNA, 22 nt, Human
gccuggcaggccucaugagggg

SEQ ID NO: 347351 - RNA, 22 nt, Human
ggcugcugcccaccccugcaug

SEQ ID NO: 347352 - RNA, 22 nt, Human
aguggugcugcgcgcggagcuc

SEQ ID NO: 347353 - RNA, 20 nt, Human
gucaggauuaguaaacucug

SEQ ID NO: 347354 - RNA, 22 nt, Human
uacaacauuguguugcuucaua

SEQ ID NO: 347355 - RNA, 22 nt, Human
uauuucuucgggauucaagcua

SEQ ID NO: 347356 - RNA, 22 nt, Human
gcugcaggagcuggagcugugg

SEQ ID NO: 347357 - RNA, 20 nt, Human
ccuggcuuugcaucugugau

SEQ ID NO: 347358 - RNA, 22 nt, Human
caaggccacugcucagguuucc

SEQ ID NO: 347359 - RNA, 22 nt, Human
uccugccuagcaggugaccuau

SEQ ID NO: 347360 - RNA, 22 nt, Human
gucagaggggacaagacacaga

SEQ ID NO: 347361 - RNA, 22 nt, Human
uccagucaagcuugagaauuuc

SEQ ID NO: 347362 - RNA, 20 nt, Human
cuguagggugcagcaggcuc

SEQ ID NO: 347363 - RNA, 22 nt, Human
ugaaaguugcacauaagagaau

SEQ ID NO: 347364 - RNA, 22 nt, Human
ggcagcaacucggagagaagag

SEQ ID NO: 347365 - RNA, 22 nt, Human
cugggagggguagccaauccua

SEQ ID NO: 347366 - RNA, 22 nt, Human
ugaguccauugauggauaguga

SEQ ID NO: 347367 - RNA, 22 nt, Human
accaggcagcacuuuccuugca

SEQ ID NO: 347368 - RNA, 22 nt, Human
uggguaggccaggaagcagugu

SEQ ID NO: 347369 - RNA, 22 nt, Human
uggcagggugccaguugcgagu

SEQ ID NO: 347370 - RNA, 17 nt, Human
gagacagcaggagcccc

SEQ ID NO: 347371 - RNA, 22 nt, Human
acaacuuugacccuuguucuua

SEQ ID NO: 347372 - RNA, 22 nt, Human
acacaccaugauuuauuuaccc

SEQ ID NO: 347373 - RNA, 22 nt, Human
ccacagaaaguugucuagagua

SEQ ID NO: 347374 - RNA, 22 nt, Human
gagucacauuaauuuaauuuua

SEQ ID NO: 347375 - RNA, 22 nt, Human
uucuucaauuauuggaaagaaa

SEQ ID NO: 347376 - RNA, 22 nt, Human
acacaggggcucggcugggugc

SEQ ID NO: 347377 - RNA, 22 nt, Human
agccuccaucccaugcacaaag

SEQ ID NO: 347378 - RNA, 22 nt, Human
uggcugagcucccuguguguug

SEQ ID NO: 347379 - RNA, 22 nt, Human
caaaugcuaacuucuuuccaaa

SEQ ID NO: 347380 - RNA, 22 nt, Human
ucucaguguguuuucucucaga

SEQ ID NO: 347381 - RNA, 22 nt, Human
uuucacaauuuuaaggagcaaa

SEQ ID NO: 347382 - RNA, 17 nt, Human
gcucccugaggacagcu

SEQ ID NO: 347383 - RNA, 22 nt, Human
gaugcagggcuggcaggagcuu

SEQ ID NO: 347384 - RNA, 22 nt, Human
ugaagugaccuggggcagugua

SEQ ID NO: 347385 - RNA, 22 nt, Human
guuuucaugucuauugggcaua

SEQ ID NO: 347386 - RNA, 22 nt, Human
auguagcagauauuugugcaca

SEQ ID NO: 347387 - RNA, 22 nt, Human
aauuagggagccaucauaaggu

SEQ ID NO: 347388 - RNA, 22 nt, Human
aggauccuuuggccacuucuua

SEQ ID NO: 347389 - RNA, 22 nt, Human
uaaauucccaacucugcucuuc

SEQ ID NO: 347390 - RNA, 22 nt, Human
ucccagagugugggcaucaagg

SEQ ID NO: 347391 - RNA, 22 nt, Human
uacagucuuuggaaagagauag

SEQ ID NO: 347392 - RNA, 22 nt, Human
gccccagguugccugucccagg

SEQ ID NO: 347393 - RNA, 22 nt, Human
gcugggcugagcuagacuuggc

SEQ ID NO: 347394 - RNA, 22 nt, Human
aaaggccacacagagcagggag

SEQ ID NO: 347395 - RNA, 22 nt, Human
ccagcagggaaaaacccaccaa

SEQ ID NO: 347396 - RNA, 23 nt, Human
uuucuucagaagccuugcgaggc

SEQ ID NO: 347397 - RNA, 22 nt, Human
gagaaagcuucuuucccacagg

SEQ ID NO: 347398 - RNA, 22 nt, Human
ggccucaguuucuucaacugua

SEQ ID NO: 347399 - RNA, 22 nt, Human
cauuuauugaguggccacagug

SEQ ID NO: 347400 - RNA, 22 nt, Human
uugcccagaguccacagcguac

SEQ ID NO: 347401 - RNA, 22 nt, Human
agagacaaugccaaugcacacg

SEQ ID NO: 347402 - RNA, 22 nt, Human
guggcugcagagccagcaagcu

SEQ ID NO: 347403 - RNA, 22 nt, Human
ugcuagaauaccuaccuggagg

SEQ ID NO: 347404 - RNA, 22 nt, Human
uggcucagaagaaaagguaaac

SEQ ID NO: 347405 - RNA, 22 nt, Human
ugguacuuggaggcagaaaaau

SEQ ID NO: 347406 - RNA, 22 nt, Human
gagccagcuauguagcaagagg

SEQ ID NO: 347407 - RNA, 22 nt, Human
cucuggagcgcugcuucccgcg

SEQ ID NO: 347408 - RNA, 22 nt, Human
cugugcaguaggucagggcugg

SEQ ID NO: 347409 - RNA, 21 nt, Human
ugccagcauuaaacagucauu

SEQ ID NO: 347410 - RNA, 22 nt, Human
gaaugcacuuccaacaucuauu

SEQ ID NO: 347411 - RNA, 22 nt, Human
aggcagcuagagagugaaacug

SEQ ID NO: 347412 - RNA, 22 nt, Human
ugaaccagagucuccagugguu

SEQ ID NO: 347413 - RNA, 22 nt, Human
cagcccuggccccagguggucu

SEQ ID NO: 347414 - RNA, 22 nt, Human
uguauuuuuagaccuuuagacc

SEQ ID NO: 347415 - RNA, 22 nt, Human
ugagccagccuugcagcugugc

SEQ ID NO: 347416 - RNA, 22 nt, Human
gcugucuggguugagggcccug

SEQ ID NO: 347417 - RNA, 19 nt, Human
ccagucccauacaggagau

SEQ ID NO: 347418 - RNA, 22 nt, Human
cuguguccugcgucaagccaau

SEQ ID NO: 347419 - RNA, 22 nt, Human
auccugggaagcugacauugaa

SEQ ID NO: 347420 - RNA, 22 nt, Human
gaguccuuuucauagcaguggg

SEQ ID NO: 347421 - RNA, 22 nt, Human
gaagcucucaaacucuccccuu

SEQ ID NO: 347422 - RNA, 22 nt, Human
uaagacaugguugaucuagugu

SEQ ID NO: 347423 - RNA, 22 nt, Human
aaguccuugaagaaacaguucu

SEQ ID NO: 347424 - RNA, 22 nt, Human
ccagacuguggaguuccuggug

SEQ ID NO: 347425 - RNA, 22 nt, Human
ggcacugagaggcucuuccuaa

SEQ ID NO: 347426 - RNA, 22 nt, Human
aggagcccugcgggaggcagag

SEQ ID NO: 347427 - RNA, 22 nt, Human
ucaguaaaugaaugaauauaug

SEQ ID NO: 347428 - RNA, 22 nt, Human
aacuuugaggucacugaauucc

SEQ ID NO: 347429 - RNA, 22 nt, Human
ggaggggaugguuugacccugg

SEQ ID NO: 347430 - RNA, 22 nt, Human
ugcuggggcucugaccacucca

SEQ ID NO: 347431 - RNA, 22 nt, Human
cugcucuguucccccaucaucu

SEQ ID NO: 347432 - RNA, 22 nt, Human
uccaggcagggcagccaucaag

SEQ ID NO: 347433 - RNA, 22 nt, Human
cagcagcaugaauucgagccac

SEQ ID NO: 347434 - RNA, 22 nt, Human
gggcaguugauggaggucugga

SEQ ID NO: 347435 - RNA, 22 nt, Human
cggggacacacuggcagcuccu

SEQ ID NO: 347436 - RNA, 22 nt, Human
cauuaaaauaucucaugguguu

SEQ ID NO: 347437 - RNA, 22 nt, Human
gcagcagagcuuuguccuggcu

SEQ ID NO: 347438 - RNA, 22 nt, Human
gccacaugucaugugcucagua

SEQ ID NO: 347439 - RNA, 22 nt, Human
gagcuuuagcugagaccugcuu

SEQ ID NO: 347440 - RNA, 22 nt, Human
agucccuguacuuuccacugcc

SEQ ID NO: 347441 - RNA, 22 nt, Human
gcccucuggcagccuuggcugg

SEQ ID NO: 347442 - RNA, 22 nt, Human
cuuccucccccacacacucacu

SEQ ID NO: 347443 - RNA, 22 nt, Human
uuauuccaauuucuccuacaaa

SEQ ID NO: 347444 - RNA, 22 nt, Human
acagagccacuuuggugccuac

SEQ ID NO: 347445 - RNA, 22 nt, Human
gcagaaggauccgcaggugcaa

SEQ ID NO: 347446 - RNA, 22 nt, Human
ucugcaggacugaggccuguuu

SEQ ID NO: 347447 - RNA, 22 nt, Human
uccagcagaaaagagguaggga

SEQ ID NO: 347448 - RNA, 22 nt, Human
ucagcuuuggucacauugaguu

SEQ ID NO: 347449 - RNA, 22 nt, Human
uggcccugacagguccugggca

SEQ ID NO: 347450 - RNA, 22 nt, Human
gcugcccaggguggagccggcu

SEQ ID NO: 347451 - RNA, 22 nt, Human
agaagcaguuauuuuuugcaca

SEQ ID NO: 347452 - RNA, 20 nt, Human
ucagaggcugccagcugggg

SEQ ID NO: 347453 - RNA, 22 nt, Human
aaaaccaggcguuuccuauuau

SEQ ID NO: 347454 - RNA, 22 nt, Human
cuguaguugaugauuucugaua

SEQ ID NO: 347455 - RNA, 21 nt, Human
aucucacagcccagagaagcc

SEQ ID NO: 347456 - RNA, 22 nt, Human
ggguguccugugccaagcuggg

SEQ ID NO: 347457 - RNA, 22 nt, Human
uagggcaggggaggaaucugaa

SEQ ID NO: 347458 - RNA, 22 nt, Human
uggccaggcagguagaacggcc

SEQ ID NO: 347459 - RNA, 22 nt, Human
ucacaauuuggauacagcuaug

SEQ ID NO: 347460 - RNA, 20 nt, Human
cagcuuggaugagaggcuga

SEQ ID NO: 347461 - RNA, 22 nt, Human
caguggaggccuugggaccuuu

SEQ ID NO: 347462 - RNA, 22 nt, Human
gcaggagccaggccgagcuggu

SEQ ID NO: 347463 - RNA, 21 nt, Human
cugccuugaaugguacuggga

SEQ ID NO: 347464 - RNA, 22 nt, Human
gccaggagugucccacucauuu

SEQ ID NO: 347465 - RNA, 22 nt, Human
uuuauuuauccuucuggauugc

SEQ ID NO: 347466 - RNA, 22 nt, Human
ucaucuugcugccauugcuuua

SEQ ID NO: 347467 - RNA, 22 nt, Human
cagaggcugccagccaugugca

SEQ ID NO: 347468 - RNA, 22 nt, Human
gacccagcuaaccaggugggga

SEQ ID NO: 347469 - RNA, 22 nt, Human
agaagccacaggccucgucugg

SEQ ID NO: 347470 - RNA, 22 nt, Human
accaucagucacauguagagaa

SEQ ID NO: 347471 - RNA, 22 nt, Human
gcuccucuauuccccacauuuu

SEQ ID NO: 347472 - RNA, 19 nt, Human
ucucugcuucucuuggcau

SEQ ID NO: 347473 - RNA, 22 nt, Human
uuguugucauuguagaggauuu

SEQ ID NO: 347474 - RNA, 22 nt, Human
uauuucccagggagcaacaagc

SEQ ID NO: 347475 - RNA, 22 nt, Human
augcucuggaguacgugaaauu

SEQ ID NO: 347476 - RNA, 22 nt, Human
caagagcucagaaacccuugcu

SEQ ID NO: 347477 - RNA, 22 nt, Human
gauuuccuagacauggggcaga

SEQ ID NO: 347478 - RNA, 22 nt, Human
caguugcuacaguucaagugug

SEQ ID NO: 347479 - RNA, 22 nt, Human
guuuuccauggaggucugaccu

SEQ ID NO: 347480 - RNA, 22 nt, Human
ucagaggaaagggaacauaguc

SEQ ID NO: 347481 - RNA, 22 nt, Human
guuaauuugcagcuuucgagcu

SEQ ID NO: 347482 - RNA, 22 nt, Human
guggcucucgccagccugcggg

SEQ ID NO: 347483 - RNA, 23 nt, Human
ugaugggaaggaacgacuaccac

SEQ ID NO: 347484 - RNA, 22 nt, Human
acagacagauuuugucugaugu

SEQ ID NO: 347485 - RNA, 22 nt, Human
agccagcucccuccccugcagg

SEQ ID NO: 347486 - RNA, 18 nt, Human
gcagcugacacuggaguu

SEQ ID NO: 347487 - RNA, 22 nt, Human
auuuagaaauuccaaaaguauu

SEQ ID NO: 347488 - RNA, 22 nt, Human
cccuggaguccuggcaguugau

SEQ ID NO: 347489 - RNA, 22 nt, Human
uuaaacagagucugaaauguaa

SEQ ID NO: 347490 - RNA, 22 nt, Human
gcaggcaggcuuccuugaacug

SEQ ID NO: 347491 - RNA, 22 nt, Human
cauuacaugguccaggauauau

SEQ ID NO: 347492 - RNA, 22 nt, Human
caggauggucuucauuuggcuc

SEQ ID NO: 347493 - RNA, 22 nt, Human
uggaggcaacugaagauguagu

SEQ ID NO: 347494 - RNA, 22 nt, Human
agcagagccugggcuaggggug

SEQ ID NO: 347495 - RNA, 22 nt, Human
aagauuuacuagcauaauagcu

SEQ ID NO: 347496 - RNA, 17 nt, Human
gcuuccucaugcaguuc

SEQ ID NO: 347497 - RNA, 20 nt, Human
uugauucccucuaaacucgc

SEQ ID NO: 347498 - RNA, 22 nt, Human
ugauugaagaggugaggaaguu

SEQ ID NO: 347499 - RNA, 22 nt, Human
gcucccugcagcugagaguucc

SEQ ID NO: 347500 - RNA, 22 nt, Human
ccuccagguguuacauaugacu

SEQ ID NO: 347501 - RNA, 22 nt, Human
uuguccuuaccucaaucuggaa

SEQ ID NO: 347502 - RNA, 22 nt, Human
uuuccucugagugagcugggag

SEQ ID NO: 347503 - RNA, 22 nt, Human
uuccaaacugccaauucagaag

SEQ ID NO: 347504 - RNA, 22 nt, Human
ccugggaagagcugacaggagg

SEQ ID NO: 347505 - RNA, 22 nt, Human
aggucauuaaaguuaaaugagg

SEQ ID NO: 347506 - RNA, 22 nt, Human
aggaugaggcuggcaggucuug

SEQ ID NO: 347507 - RNA, 22 nt, Human
ugcauuaucuuuaauguucuca

SEQ ID NO: 347508 - RNA, 22 nt, Human
aaaggucaaaaucgugacauug

SEQ ID NO: 347509 - RNA, 22 nt, Human
cagaggcagaggucaucucugg

SEQ ID NO: 347510 - RNA, 22 nt, Human
cagagcagaagcgguccucaca

SEQ ID NO: 347511 - RNA, 22 nt, Human
cugaggcugaagagggccuacg

SEQ ID NO: 347512 - RNA, 22 nt, Human
aacaugauggggaagaacaaga

SEQ ID NO: 347513 - RNA, 22 nt, Human
aaggagucucagcugggccuga

SEQ ID NO: 347514 - RNA, 22 nt, Human
agaauuguaagcaauuugauua

SEQ ID NO: 347515 - RNA, 22 nt, Human
uucacaggaauguaggggucuu

SEQ ID NO: 347516 - RNA, 23 nt, Human
gggugggccaaauuagguagccu

SEQ ID NO: 347517 - RNA, 22 nt, Human
auauauaaccuggauaaggcuu

SEQ ID NO: 347518 - RNA, 22 nt, Human
uuucacuagaacguucuuguuu

SEQ ID NO: 347519 - RNA, 20 nt, Human
ucucagcauaagaacccuuc

SEQ ID NO: 347520 - RNA, 22 nt, Human
uucaaguuuugccuccccaucc

SEQ ID NO: 347521 - RNA, 22 nt, Human
ccagaaggcggagauugcagug

SEQ ID NO: 347522 - RNA, 20 nt, Human
gagauggacagaugaagggg

SEQ ID NO: 347523 - RNA, 22 nt, Human
uucccaguuagucauuuuuaca

SEQ ID NO: 347524 - RNA, 22 nt, Human
auuuucaugacuaccuuaaaua

SEQ ID NO: 347525 - RNA, 22 nt, Human
guucuucaggccauccucccag

SEQ ID NO: 347526 - RNA, 22 nt, Human
ugugugccugagccgugccugg

SEQ ID NO: 347527 - RNA, 22 nt, Human
gaugauggacaaagcauuggug

SEQ ID NO: 347528 - RNA, 20 nt, Human
ucuguucaaaucuuaguucc

SEQ ID NO: 347529 - RNA, 22 nt, Human
acaggccuuggcaggcauguga

SEQ ID NO: 347530 - RNA, 22 nt, Human
caggccugauacacugaacucu

SEQ ID NO: 347531 - RNA, 22 nt, Human
uccugcaggggcugaggaacca

SEQ ID NO: 347532 - RNA, 19 nt, Human
uuuacucuccaaggugagu

SEQ ID NO: 347533 - RNA, 23 nt, Human
ccagggccccuacaccacugucc

SEQ ID NO: 347534 - RNA, 18 nt, Human
ugaauagggguuugcaga

SEQ ID NO: 347535 - RNA, 22 nt, Human
uguacuuccccaaugacagcac

SEQ ID NO: 347536 - RNA, 22 nt, Human
ugucucuggcccaugagcagag

SEQ ID NO: 347537 - RNA, 22 nt, Human
accuggagucauuugaggagua

SEQ ID NO: 347538 - RNA, 22 nt, Human
gagggacagcuaaagagaaauu

SEQ ID NO: 347539 - RNA, 22 nt, Human
ugcaggcuggaggagggacuaa

SEQ ID NO: 347540 - RNA, 22 nt, Human
uauaacaguuuaggugguguca

SEQ ID NO: 347541 - RNA, 22 nt, Human
acuguacacgugucauuuacag

SEQ ID NO: 347542 - RNA, 22 nt, Human
ucuuaaagagcgcaauuugagg

SEQ ID NO: 347543 - RNA, 22 nt, Human
auaauaacaccugaauaggaaa

SEQ ID NO: 347544 - RNA, 22 nt, Human
ucugcugucacucauuugcuuc

SEQ ID NO: 347545 - RNA, 22 nt, Human
gggcagcagagcccugccgagu

SEQ ID NO: 347546 - RNA, 22 nt, Human
ucacugggagaugugggaaggg

SEQ ID NO: 347547 - RNA, 22 nt, Human
ucaguuuucucaucugugaaau

SEQ ID NO: 347548 - RNA, 22 nt, Human
agugaaaugauucugagcaaga

SEQ ID NO: 347549 - RNA, 22 nt, Human
gguggggccugcuccagcggcc

SEQ ID NO: 347550 - RNA, 22 nt, Human
ggguuucaugguucucacaaug

SEQ ID NO: 347551 - RNA, 22 nt, Human
aacuuucuuggaugucucaaca

SEQ ID NO: 347552 - RNA, 22 nt, Human
aggccuguuggcgugggcucua

SEQ ID NO: 347553 - RNA, 22 nt, Human
cauggauugaauauaaauuaga

SEQ ID NO: 347554 - RNA, 22 nt, Human
aaggcagcaccgccuccugaaa

SEQ ID NO: 347555 - RNA, 22 nt, Human
ccaggcugcuguugguguccgc

SEQ ID NO: 347556 - RNA, 22 nt, Human
gccccugggagcagagccacca

SEQ ID NO: 347557 - RNA, 22 nt, Human
gcaccaggcuuagagccccagg

SEQ ID NO: 347558 - RNA, 18 nt, Human
aaguaacagaagagcaca

SEQ ID NO: 347559 - RNA, 22 nt, Human
ugggcugcugagaaugagagag

SEQ ID NO: 347560 - RNA, 19 nt, Human
uggcuuccaucucucucau

SEQ ID NO: 347561 - RNA, 22 nt, Human
uccuugaaaaucuugguuuaga

SEQ ID NO: 347562 - RNA, 22 nt, Human
gaggcagcauucgcauagacag

SEQ ID NO: 347563 - RNA, 22 nt, Human
acauuucucagggaguuuugcu

SEQ ID NO: 347564 - RNA, 22 nt, Human
gcccugagggguggugucugua

SEQ ID NO: 347565 - RNA, 22 nt, Human
ugagggaguuggguguauagga

SEQ ID NO: 347566 - RNA, 22 nt, Human
aaaguguaaggaauuuaaguaa

SEQ ID NO: 347567 - RNA, 22 nt, Human
cagggccuuauccugccauuga

SEQ ID NO: 347568 - RNA, 22 nt, Human
gagcuuccacucuagaaggagu

SEQ ID NO: 347569 - RNA, 22 nt, Human
gucaaacaaauuaacauaucca

SEQ ID NO: 347570 - RNA, 23 nt, Human
acagaaaucauuuguaagguacc

SEQ ID NO: 347571 - RNA, 22 nt, Human
gaggggcucuugggcaugaagg

SEQ ID NO: 347572 - RNA, 22 nt, Human
gguggcagcgucuaucugacau

SEQ ID NO: 347573 - RNA, 22 nt, Human
gcucugucuucagcacacagua

SEQ ID NO: 347574 - RNA, 22 nt, Human
agucuuuccugcuugacuguuc

SEQ ID NO: 347575 - RNA, 22 nt, Human
aaaguccagagggcacacugaa

SEQ ID NO: 347576 - RNA, 22 nt, Human
cuggaaguauaggggagaugau

SEQ ID NO: 347577 - RNA, 22 nt, Human
gucccagggaagaaggcagcac

SEQ ID NO: 347578 - RNA, 22 nt, Human
cauggccucaaaggacugcaga

SEQ ID NO: 347579 - RNA, 22 nt, Human
agagccacugggagacagagca

SEQ ID NO: 347580 - RNA, 22 nt, Human
aucugcuugaaugagcaacagg

SEQ ID NO: 347581 - RNA, 22 nt, Human
cccaggcugaguuagagguguc

SEQ ID NO: 347582 - RNA, 22 nt, Human
ugacagaaagaauaugucaauc

SEQ ID NO: 347583 - RNA, 17 nt, Human
gaggacagggaaguagg

SEQ ID NO: 347584 - RNA, 22 nt, Human
ggagggcaucaaucaggccugg

SEQ ID NO: 347585 - RNA, 22 nt, Human
ucuggccugggccugccggugc

SEQ ID NO: 347586 - RNA, 22 nt, Human
ugaggcaggacauggacaacug

SEQ ID NO: 347587 - RNA, 22 nt, Human
uucccucucacuuaaagcuugg

SEQ ID NO: 347588 - RNA, 22 nt, Human
ugcuuuauuuauaaaauagcaa

SEQ ID NO: 347589 - RNA, 22 nt, Human
ugggcagguuguuauuugacau

SEQ ID NO: 347590 - RNA, 22 nt, Human
ugguaucagagccaucuguauu

SEQ ID NO: 347591 - RNA, 22 nt, Human
gggcugagagugacuguucugu

SEQ ID NO: 347592 - RNA, 22 nt, Human
agcugccauccgaggugucaga

SEQ ID NO: 347593 - RNA, 22 nt, Human
ccaguugguuucaaugggacag

SEQ ID NO: 347594 - RNA, 22 nt, Human
ucauuguuauguuuugcugucu

SEQ ID NO: 347595 - RNA, 22 nt, Human
caggggcugugggcggagccuc

SEQ ID NO: 347596 - RNA, 22 nt, Human
auggcagggaccaagcugucau

SEQ ID NO: 347597 - RNA, 22 nt, Human
aagaaacaaccacugcucuccu

SEQ ID NO: 347598 - RNA, 22 nt, Human
ugggccuguugccugaguccau

SEQ ID NO: 347599 - RNA, 22 nt, Human
gcuguuccugcuuagaggucgg

SEQ ID NO: 347600 - RNA, 19 nt, Human
uugaggggccaggggagau

SEQ ID NO: 347601 - RNA, 22 nt, Human
cuggagccuagguugaccuggg

SEQ ID NO: 347602 - RNA, 22 nt, Human
ugcugggggcuuucuggauacc

SEQ ID NO: 347603 - RNA, 22 nt, Human
ucaggcagaccaccgugggcag

SEQ ID NO: 347604 - RNA, 22 nt, Human
uuacaggggacauuggggacau

SEQ ID NO: 347605 - RNA, 22 nt, Human
auauguguauuugguuagccua

SEQ ID NO: 347606 - RNA, 22 nt, Human
uggguuuaaacucaacucuaaa

SEQ ID NO: 347607 - RNA, 22 nt, Human
gaggucaggcuugcagcagggu

SEQ ID NO: 347608 - RNA, 22 nt, Human
gaaaaugugccuuuggguauug

SEQ ID NO: 347609 - RNA, 22 nt, Human
aucugacuucacgcccaugcca

SEQ ID NO: 347610 - RNA, 23 nt, Human
cagcuuucagggcuuuagggaag

SEQ ID NO: 347611 - RNA, 19 nt, Human
cucucacucgccacauccu

SEQ ID NO: 347612 - RNA, 18 nt, Human
cagagcagagguggagcg

SEQ ID NO: 347613 - RNA, 22 nt, Human
uaaguggaagguuauaugcuaa

SEQ ID NO: 347614 - RNA, 18 nt, Human
cucugcuaaugggcagcu

SEQ ID NO: 347615 - RNA, 22 nt, Human
agaaugcuccagagcugaaaga

SEQ ID NO: 347616 - RNA, 23 nt, Human
agggaaaguaguaauggccuuug

SEQ ID NO: 347617 - RNA, 22 nt, Human
uuauuauuccccaagucauuau

SEQ ID NO: 347618 - RNA, 22 nt, Human
uagcuuuaauaagcugcugaau

SEQ ID NO: 347619 - RNA, 22 nt, Human
ucagucuuugcuuaugacaaua

SEQ ID NO: 347620 - RNA, 22 nt, Human
uccaagaagucaucuaaacugu

SEQ ID NO: 347621 - RNA, 19 nt, Human
agcaaauauaauaguguuc

SEQ ID NO: 347622 - RNA, 22 nt, Human
cagacagaccugcaagggcaca

SEQ ID NO: 347623 - RNA, 17 nt, Human
gccugcaggcccgcaga

SEQ ID NO: 347624 - RNA, 22 nt, Human
aaaaauguuaucuacuguccga

SEQ ID NO: 347625 - RNA, 22 nt, Human
gcccucagaguuccccacagug

SEQ ID NO: 347626 - RNA, 22 nt, Human
caucuucagguucauggucaua

SEQ ID NO: 347627 - RNA, 21 nt, Human
aucagcaaaugccugucuccc

SEQ ID NO: 347628 - RNA, 22 nt, Human
gcccagcaccucucucaggguu

SEQ ID NO: 347629 - RNA, 22 nt, Human
agcagcaggcuguguggacuga

SEQ ID NO: 347630 - RNA, 22 nt, Human
cugagcaggauauucacagcag

SEQ ID NO: 347631 - RNA, 22 nt, Human
ggccaggagauggacaccacau

SEQ ID NO: 347632 - RNA, 21 nt, Human
ggcagugaugugaagugcauc

SEQ ID NO: 347633 - RNA, 22 nt, Human
uucuucagucccacuagccaca

SEQ ID NO: 347634 - RNA, 19 nt, Human
ccaggccucuggggccugu

SEQ ID NO: 347635 - RNA, 20 nt, Human
aguagcagugugacauugac

SEQ ID NO: 347636 - RNA, 22 nt, Human
cccucagcuucucccugcagcu

SEQ ID NO: 347637 - RNA, 22 nt, Human
ugauuuccaugaagcugaaggc

SEQ ID NO: 347638 - RNA, 22 nt, Human
gccgugcgugcgcaggugcugu

SEQ ID NO: 347639 - RNA, 22 nt, Human
aggcugcagugcagguaggauu

SEQ ID NO: 347640 - RNA, 22 nt, Human
cugccagguuggcgcucgcucu

SEQ ID NO: 347641 - RNA, 21 nt, Human
agcuuccugcagugggagguc

SEQ ID NO: 347642 - RNA, 22 nt, Human
aguggggagguccaggccaccc

SEQ ID NO: 347643 - RNA, 22 nt, Human
aaucagaauuuguccccugagu

SEQ ID NO: 347644 - RNA, 22 nt, Human
uggcagcugcaggccuccugag

SEQ ID NO: 347645 - RNA, 22 nt, Human
uuguuaaaaauagauuuccagg

SEQ ID NO: 347646 - RNA, 22 nt, Human
aggcucccaagcacugacccca

SEQ ID NO: 347647 - RNA, 22 nt, Human
ugguuuaaccugucucuuauua

SEQ ID NO: 347648 - RNA, 22 nt, Human
ggaccagagaagugagcaccug

SEQ ID NO: 347649 - RNA, 23 nt, Human
aggcccaacucugugagggcugc

SEQ ID NO: 347650 - RNA, 20 nt, Human
cccaggagugagcagcuuua

SEQ ID NO: 347651 - RNA, 22 nt, Human
augggaugaacuugaucugcuu

SEQ ID NO: 347652 - RNA, 22 nt, Human
aaucccagcuacucaggaaguu

SEQ ID NO: 347653 - RNA, 22 nt, Human
auaauauaauccuacuucccau

SEQ ID NO: 347654 - RNA, 20 nt, Human
uaagaacaagacuaggaagc

SEQ ID NO: 347655 - RNA, 22 nt, Human
cuauugaauuaacuauuaaagu

SEQ ID NO: 347656 - RNA, 18 nt, Human
uggguggcuagggaguuu

SEQ ID NO: 347657 - RNA, 22 nt, Human
auguaucagaaauagcauuggc

SEQ ID NO: 347658 - RNA, 22 nt, Human
aaguuucaugauguaauuauug

SEQ ID NO: 347659 - RNA, 22 nt, Human
caaagucagccagcuaguaggu

SEQ ID NO: 347660 - RNA, 22 nt, Human
cccgggaggaggaaguugcagu

SEQ ID NO: 347661 - RNA, 20 nt, Human
agaagccaagugacauguuu

SEQ ID NO: 347662 - RNA, 22 nt, Human
guuuccauggcucuguuaaugg

SEQ ID NO: 347663 - RNA, 22 nt, Human
ucagcuuugggggucucaggag

SEQ ID NO: 347664 - RNA, 22 nt, Human
agugucauaugccacugcaucc

SEQ ID NO: 347665 - RNA, 19 nt, Human
ggcauccagaacuaccagu

SEQ ID NO: 347666 - RNA, 22 nt, Human
uuuuccagagcugucucuugca

SEQ ID NO: 347667 - RNA, 22 nt, Human
cagggcucccuugcaaggaggg

SEQ ID NO: 347668 - RNA, 22 nt, Human
auuucacucucccugccacuua

SEQ ID NO: 347669 - RNA, 22 nt, Human
cucuucagauaaaagggauauu

SEQ ID NO: 347670 - RNA, 22 nt, Human
uuucugaauaacucuaugauau

SEQ ID NO: 347671 - RNA, 22 nt, Human
ggcacucagagauucaggcugu

SEQ ID NO: 347672 - RNA, 18 nt, Human
gcugagguggugucagag

SEQ ID NO: 347673 - RNA, 22 nt, Human
auuuagcaaaaaaugaugaagc

SEQ ID NO: 347674 - RNA, 22 nt, Human
aacccagccguguagcugccgc

SEQ ID NO: 347675 - RNA, 22 nt, Human
gagcagcuguccccaaagcuuc

SEQ ID NO: 347676 - RNA, 22 nt, Human
cgugagcaaaauggacacuccc

SEQ ID NO: 347677 - RNA, 22 nt, Human
uuagggacagcucuguagguga

SEQ ID NO: 347678 - RNA, 22 nt, Human
ucuguccuguuuccuccugaca

SEQ ID NO: 347679 - RNA, 22 nt, Human
ggcauccaguucugaucaacaa

SEQ ID NO: 347680 - RNA, 22 nt, Human
gcucugggugaacuuggagcaa

SEQ ID NO: 347681 - RNA, 23 nt, Human
aaacaugcagcacaugaaugcua

SEQ ID NO: 347682 - RNA, 22 nt, Human
agauauuuguaucuugcuauug

SEQ ID NO: 347683 - RNA, 18 nt, Human
agcagaauucuaggguuc

SEQ ID NO: 347684 - RNA, 22 nt, Human
ucagggcaagucucagaagguu

SEQ ID NO: 347685 - RNA, 22 nt, Human
uuucauguuuauggaaaaugag

SEQ ID NO: 347686 - RNA, 22 nt, Human
uuugaaagggacaaagucacug

SEQ ID NO: 347687 - RNA, 22 nt, Human
uuauuuauuguguaccuacugu

SEQ ID NO: 347688 - RNA, 22 nt, Human
cugaaggauuuaguucuuugcu

SEQ ID NO: 347689 - RNA, 22 nt, Human
uuuggaauuggcauucuauucu

SEQ ID NO: 347690 - RNA, 17 nt, Human
ugguggcuggagucagg

SEQ ID NO: 347691 - RNA, 22 nt, Human
gccuuaauuuaugucuaacaua

SEQ ID NO: 347692 - RNA, 22 nt, Human
aaucagaacgcucgaucuucgg

SEQ ID NO: 347693 - RNA, 18 nt, Human
cugcccagagcauuucau

SEQ ID NO: 347694 - RNA, 22 nt, Human
cacacacaguuuuguauucugu

SEQ ID NO: 347695 - RNA, 22 nt, Human
gagccaaggguugccauggaga

SEQ ID NO: 347696 - RNA, 22 nt, Human
ugucacauaauuuaucuguagg

SEQ ID NO: 347697 - RNA, 22 nt, Human
uacauucaacaugucacuaugu

SEQ ID NO: 347698 - RNA, 22 nt, Human
ugccuuggugcuucuucaugug

SEQ ID NO: 347699 - RNA, 23 nt, Human
ccacagagcugccaauuccugug

SEQ ID NO: 347700 - RNA, 22 nt, Human
ggccccaggaccuccacggucc

SEQ ID NO: 347701 - RNA, 22 nt, Human
ucugccuguugcuagaauguca

SEQ ID NO: 347702 - RNA, 22 nt, Human
aaaugcagcagcuaauugaaaa

SEQ ID NO: 347703 - RNA, 22 nt, Human
uggcucuggauuaaucuaggaa

SEQ ID NO: 347704 - RNA, 20 nt, Human
cuccagggaacagacuggag

SEQ ID NO: 347705 - RNA, 22 nt, Human
aaaguuagaaugauaucaacga

SEQ ID NO: 347706 - RNA, 18 nt, Human
gugugcaguugcaggggu

SEQ ID NO: 347707 - RNA, 22 nt, Human
agagaaaacucauugagguguc

SEQ ID NO: 347708 - RNA, 22 nt, Human
cagcuuccauaagagauggaga

SEQ ID NO: 347709 - RNA, 22 nt, Human
agucucugcugguugugccuau

SEQ ID NO: 347710 - RNA, 22 nt, Human
gucagcugucuccccagagugg

SEQ ID NO: 347711 - RNA, 22 nt, Human
uguaugcaaauuuauuagcaca

SEQ ID NO: 347712 - RNA, 17 nt, Human
ugcauguccuuuguucc

SEQ ID NO: 347713 - RNA, 22 nt, Human
cacugggcguguccugggugag

SEQ ID NO: 347714 - RNA, 20 nt, Human
ccucaguguccuggacuggg

SEQ ID NO: 347715 - RNA, 22 nt, Human
ucagggcaaaagggaaaccauu

SEQ ID NO: 347716 - RNA, 22 nt, Human
guacauuggcaacucucuuaga

SEQ ID NO: 347717 - RNA, 22 nt, Human
ugggaccugcuccuggaaugag

SEQ ID NO: 347718 - RNA, 22 nt, Human
agcucagggcgaucugucucgg

SEQ ID NO: 347719 - RNA, 22 nt, Human
ccuguguguaggccaggggagu

SEQ ID NO: 347720 - RNA, 22 nt, Human
ccacugcccccugaagaccagg

SEQ ID NO: 347721 - RNA, 22 nt, Human
caggagacaaguuagcagcuga

SEQ ID NO: 347722 - RNA, 22 nt, Human
gcacccagggacuuggcuggcc

SEQ ID NO: 347723 - RNA, 22 nt, Human
uccaggcaaagccuuguagacg

SEQ ID NO: 347724 - RNA, 19 nt, Human
acaaaugauguugcacuga

SEQ ID NO: 347725 - RNA, 22 nt, Human
guccucugcccaggucaagguu

SEQ ID NO: 347726 - RNA, 22 nt, Human
cagggcagggccacacccccug

SEQ ID NO: 347727 - RNA, 22 nt, Human
aagggugggcccuggcagccau

SEQ ID NO: 347728 - RNA, 22 nt, Human
gcccagcaggggauggcagcuc

SEQ ID NO: 347729 - RNA, 22 nt, Human
caggcagcaggagcccugcucg

SEQ ID NO: 347730 - RNA, 22 nt, Human
uuugucauaucacacaauuuug

SEQ ID NO: 347731 - RNA, 22 nt, Human
ccagugcccagucucccugguc

SEQ ID NO: 347732 - RNA, 22 nt, Human
uggcagcuuuuuguuucaggcu

SEQ ID NO: 347733 - RNA, 22 nt, Human
uggagcaggcaucuuucucucu

SEQ ID NO: 347734 - RNA, 22 nt, Human
aguuuuuccguggcuacgauaa

SEQ ID NO: 347735 - RNA, 22 nt, Human
uuuaggcagaagcccugcugau

SEQ ID NO: 347736 - RNA, 22 nt, Human
gggaccuggacaugugugugcu

SEQ ID NO: 347737 - RNA, 22 nt, Human
ucugucccugagagcucaggag

SEQ ID NO: 347738 - RNA, 22 nt, Human
aaauguguuccuuugcuacaga

SEQ ID NO: 347739 - RNA, 22 nt, Human
gcugaaggucucuggagagguc

SEQ ID NO: 347740 - RNA, 22 nt, Human
gauagaaagguguugaaaucca

SEQ ID NO: 347741 - RNA, 22 nt, Human
ggcaucuccaaaacaugaacuc

SEQ ID NO: 347742 - RNA, 22 nt, Human
agaauaguggcaaugacugcac

SEQ ID NO: 347743 - RNA, 22 nt, Human
aaaccgcaauuacuuuugcguc

SEQ ID NO: 347744 - RNA, 22 nt, Human
agauguguuucuaguuccugca

SEQ ID NO: 347745 - RNA, 22 nt, Human
gcuuccugauauucauacuguu

SEQ ID NO: 347746 - RNA, 22 nt, Human
guaaaucccauccuuucucugg

SEQ ID NO: 347747 - RNA, 22 nt, Human
cucagaaguucagccuagagua

SEQ ID NO: 347748 - RNA, 22 nt, Human
uuagaaaugcacccaagaccua

SEQ ID NO: 347749 - RNA, 22 nt, Human
uuuuaguguagucaccgugggu

SEQ ID NO: 347750 - RNA, 22 nt, Human
ugcaggaacugggagggauagu

SEQ ID NO: 347751 - RNA, 22 nt, Human
caauuucauuaauagauauaga

SEQ ID NO: 347752 - RNA, 22 nt, Human
uaauauauuucugcuaagcuca

SEQ ID NO: 347753 - RNA, 22 nt, Human
gccaggcuggugucacaacucu

SEQ ID NO: 347754 - RNA, 22 nt, Human
gaggggcagaaugugaucaggg

SEQ ID NO: 347755 - RNA, 22 nt, Human
uaaguccuagcuuugguaggaa

SEQ ID NO: 347756 - RNA, 20 nt, Human
cucaggauugucuagccccu

SEQ ID NO: 347757 - RNA, 22 nt, Human
uuuacagaauguugaauuuggg

SEQ ID NO: 347758 - RNA, 22 nt, Human
agccacagagagggagcugcaa

SEQ ID NO: 347759 - RNA, 22 nt, Human
aggucacacaacugucagaggc

SEQ ID NO: 347760 - RNA, 22 nt, Human
ggcucaggagaggggcuaaaag

SEQ ID NO: 347761 - RNA, 22 nt, Human
cccuggagcaucucugcugucu

SEQ ID NO: 347762 - RNA, 21 nt, Human
agcuggugucagagcucuggg

SEQ ID NO: 347763 - RNA, 19 nt, Human
gcacugaagaguuggucac

SEQ ID NO: 347764 - RNA, 22 nt, Human
agggccugagcuggcugaccuc

SEQ ID NO: 347765 - RNA, 22 nt, Human
gagccucguggcggccacugcg

SEQ ID NO: 347766 - RNA, 22 nt, Human
gagauuggccuggcuugccaac

SEQ ID NO: 347767 - RNA, 22 nt, Human
cagggcucccucuggcucccag

SEQ ID NO: 347768 - RNA, 22 nt, Human
ugucucugaacagcuuacuaaa

SEQ ID NO: 347769 - RNA, 22 nt, Human
ccucaggaaccacauugcugcu

SEQ ID NO: 347770 - RNA, 22 nt, Human
ugugugacccccagugaagccu

SEQ ID NO: 347771 - RNA, 22 nt, Human
gagggcugaagauuguggcccc

SEQ ID NO: 347772 - RNA, 22 nt, Human
cugaauaauuuuauaguugcug

SEQ ID NO: 347773 - RNA, 22 nt, Human
gugucccaggagaggagacaau

SEQ ID NO: 347774 - RNA, 22 nt, Human
accgggaaguccugcacugggc

SEQ ID NO: 347775 - RNA, 22 nt, Human
agcaccuguugcacuucauaau

SEQ ID NO: 347776 - RNA, 22 nt, Human
agacaaguucugugggucaccu

SEQ ID NO: 347777 - RNA, 22 nt, Human
acauuucucauucuccccuaac

SEQ ID NO: 347778 - RNA, 22 nt, Human
gcagccuguuguaccagccugu

SEQ ID NO: 347779 - RNA, 22 nt, Human
agcuguggcagcacuuuggagu

SEQ ID NO: 347780 - RNA, 20 nt, Human
gggaguggugguagccugug

SEQ ID NO: 347781 - RNA, 22 nt, Human
agcaguggagcgagauguuuaa

SEQ ID NO: 347782 - RNA, 22 nt, Human
cccaggagagagacuugaaucu

SEQ ID NO: 347783 - RNA, 22 nt, Human
agcccaggcagagggaugcuug

SEQ ID NO: 347784 - RNA, 22 nt, Human
gugcccugaguggguaggagag

SEQ ID NO: 347785 - RNA, 22 nt, Human
uguauagaguuggaagaugacu

SEQ ID NO: 347786 - RNA, 22 nt, Human
cuuauaaaguccaucugaacaa

SEQ ID NO: 347787 - RNA, 22 nt, Human
agcugaguuaauucaucacuua

SEQ ID NO: 347788 - RNA, 22 nt, Human
auuuucagagacaucuggacuu

SEQ ID NO: 347789 - RNA, 22 nt, Human
gguggguauugaauacaggugu

SEQ ID NO: 347790 - RNA, 22 nt, Human
auuucuguugcuuauaaauuac

SEQ ID NO: 347791 - RNA, 22 nt, Human
gccuggagacagcagaggcggc

SEQ ID NO: 347792 - RNA, 18 nt, Human
gucauugcaacauacugu

SEQ ID NO: 347793 - RNA, 22 nt, Human
uaggccaguggcagguugugug

SEQ ID NO: 347794 - RNA, 23 nt, Human
aggauccugguacaggagcagag

SEQ ID NO: 347795 - RNA, 22 nt, Human
auucuucagcaggggacacuau

SEQ ID NO: 347796 - RNA, 22 nt, Human
aggagugcaaauaguccagaga

SEQ ID NO: 347797 - RNA, 22 nt, Human
gaggaggcuuccgggaggcacg

SEQ ID NO: 347798 - RNA, 22 nt, Human
ccaggagauaagcugaguuuau

SEQ ID NO: 347799 - RNA, 22 nt, Human
cucuuccuacagucugcuaugc

SEQ ID NO: 347800 - RNA, 22 nt, Human
cucagaguccauaguuuacagu

SEQ ID NO: 347801 - RNA, 22 nt, Human
uuauacuaaaacgcauugaauu

SEQ ID NO: 347802 - RNA, 21 nt, Human
cacucaggguaugugccaggc

SEQ ID NO: 347803 - RNA, 22 nt, Human
aggaaagggguagguguggacg

SEQ ID NO: 347804 - RNA, 22 nt, Human
aguaaacauuuucauauuuucu

SEQ ID NO: 347805 - RNA, 18 nt, Human
ccagguggugacagagau

SEQ ID NO: 347806 - RNA, 22 nt, Human
cugucugcuagaacaucuauac

SEQ ID NO: 347807 - RNA, 22 nt, Human
cauauuucagucuaagaugugu

SEQ ID NO: 347808 - RNA, 22 nt, Human
ucagccaggccaggcauucaca

SEQ ID NO: 347809 - RNA, 22 nt, Human
cauguuaauaugcauugaguac

SEQ ID NO: 347810 - RNA, 22 nt, Human
uucacagaguuauuuuuaugcu

SEQ ID NO: 347811 - RNA, 22 nt, Human
gccucugcaauuacauugugcc

SEQ ID NO: 347812 - RNA, 22 nt, Human
ucugagaguccaucuccaagcc

SEQ ID NO: 347813 - RNA, 22 nt, Human
gcaguggauccaaugguaucuu

SEQ ID NO: 347814 - RNA, 22 nt, Human
aggcccaguagugcugccuuua

SEQ ID NO: 347815 - RNA, 22 nt, Human
gagcuguccuaccaggaguccu

SEQ ID NO: 347816 - RNA, 20 nt, Human
uucuuucaucuacacguugu

SEQ ID NO: 347817 - RNA, 22 nt, Human
auuugucuucaguagguucuuc

SEQ ID NO: 347818 - RNA, 22 nt, Human
uccugguggcuuucccugccuu

SEQ ID NO: 347819 - RNA, 22 nt, Human
ucauacacaagagcauguaaca

SEQ ID NO: 347820 - RNA, 22 nt, Human
uucuccagaccuugugacuaug

SEQ ID NO: 347821 - RNA, 22 nt, Human
uggagccaugccuggccuuucc

SEQ ID NO: 347822 - RNA, 22 nt, Human
cagagcagacguugagauuaag

SEQ ID NO: 347823 - RNA, 22 nt, Human
gcugccuguccugaggaguccg

SEQ ID NO: 347824 - RNA, 22 nt, Human
gccuggaggaauguagcugagg

SEQ ID NO: 347825 - RNA, 22 nt, Human
acuggcucagaguuccuagaga

SEQ ID NO: 347826 - RNA, 22 nt, Human
ccaugagcuucaacugacacag

SEQ ID NO: 347827 - RNA, 22 nt, Human
agcagggcuucugugccugugc

SEQ ID NO: 347828 - RNA, 22 nt, Human
cugcucugaguauuaacggagg

SEQ ID NO: 347829 - RNA, 22 nt, Human
aagauuauuuaagacaggaacc

SEQ ID NO: 347830 - RNA, 22 nt, Human
gccagggggucagcaggcacuu

SEQ ID NO: 347831 - RNA, 22 nt, Human
aaacauugcuaaauaaugcugc

SEQ ID NO: 347832 - RNA, 22 nt, Human
uuagcuaaacuguaacuagaau

SEQ ID NO: 347833 - RNA, 22 nt, Human
uucaacacaggaacaugauaua

SEQ ID NO: 347834 - RNA, 22 nt, Human
caguccuuagauuuuacugcca

SEQ ID NO: 347835 - RNA, 22 nt, Human
uuucaacauauaccauaaugcc

SEQ ID NO: 347836 - RNA, 22 nt, Human
acccaggauagagugcugcagu

SEQ ID NO: 347837 - RNA, 22 nt, Human
ucucagagaacaguuggugcuu

SEQ ID NO: 347838 - RNA, 22 nt, Human
cugccaggcacgugcagcauca

SEQ ID NO: 347839 - RNA, 22 nt, Human
uccaggagaaaacugacggugg

SEQ ID NO: 347840 - RNA, 23 nt, Human
uggcagugaucaaaagcuuacau

SEQ ID NO: 347841 - RNA, 22 nt, Human
gaagcagcaaguauaggacagg

SEQ ID NO: 347842 - RNA, 22 nt, Human
ucuccuucgaggcccagcuccc

SEQ ID NO: 347843 - RNA, 22 nt, Human
gugaaggacuagcauggagggc

SEQ ID NO: 347844 - RNA, 22 nt, Human
gagagugaggccugggaaucua

SEQ ID NO: 347845 - RNA, 22 nt, Human
uagccucuggaauccuuucucu

SEQ ID NO: 347846 - RNA, 22 nt, Human
ucaaguuuaauugagauguuua

SEQ ID NO: 347847 - RNA, 22 nt, Human
ugcccaggauugugaggucagg

SEQ ID NO: 347848 - RNA, 22 nt, Human
agcagccaagguaaccugugcu

SEQ ID NO: 347849 - RNA, 22 nt, Human
agaggucagauuucuccuggug

SEQ ID NO: 347850 - RNA, 23 nt, Human
uggcugagauccuacuguuugcu

SEQ ID NO: 347851 - RNA, 22 nt, Human
augcuuaaugaggguauauaug

SEQ ID NO: 347852 - RNA, 22 nt, Human
cauccaggcaccacaaccagcu

SEQ ID NO: 347853 - RNA, 22 nt, Human
gauuuuaauuauaggagguccu

SEQ ID NO: 347854 - RNA, 22 nt, Human
acuaaggaauaugacaaacuca

SEQ ID NO: 347855 - RNA, 22 nt, Human
cccugcaguccuuucuuggcuc

SEQ ID NO: 347856 - RNA, 22 nt, Human
gcucagagcuugaaguuccacu

SEQ ID NO: 347857 - RNA, 22 nt, Human
ggagaagggacagacucagcuu

SEQ ID NO: 347858 - RNA, 22 nt, Human
gccaggcauguccucugcagaa

SEQ ID NO: 347859 - RNA, 22 nt, Human
caguccuugcuaugacccugag

SEQ ID NO: 347860 - RNA, 22 nt, Human
gggcagguggcaaagccagagg

SEQ ID NO: 347861 - RNA, 22 nt, Human
augaggcaggagugcaguggca

SEQ ID NO: 347862 - RNA, 22 nt, Human
aguuuauagcccagauucaugg

SEQ ID NO: 347863 - RNA, 22 nt, Human
cuugucugugucggauaaaacu

SEQ ID NO: 347864 - RNA, 22 nt, Human
ccaucccuucucuggccagcag

SEQ ID NO: 347865 - RNA, 22 nt, Human
caaggccaugagcagcgagugu

SEQ ID NO: 347866 - RNA, 22 nt, Human
uuccuuagcagaccugguaucc

SEQ ID NO: 347867 - RNA, 22 nt, Human
cuaugaaaugucagauucugca

SEQ ID NO: 347868 - RNA, 22 nt, Human
uagcagcuuaaguaauuagaau

SEQ ID NO: 347869 - RNA, 22 nt, Human
gagcuggugugugcccgagcac

SEQ ID NO: 347870 - RNA, 19 nt, Human
agcaaauacaucaaaauug

SEQ ID NO: 347871 - RNA, 21 nt, Human
acaguucaugauaacuccauc

SEQ ID NO: 347872 - RNA, 22 nt, Human
cccagcuugcccaggacugagg

SEQ ID NO: 347873 - RNA, 22 nt, Human
uucauugugauucuuggcuagc

SEQ ID NO: 347874 - RNA, 19 nt, Human
ucugaaguccagggcauac

SEQ ID NO: 347875 - RNA, 22 nt, Human
uuuuggucagguuggucucgaa

SEQ ID NO: 347876 - RNA, 22 nt, Human
cagcaggggaacugugggccag

SEQ ID NO: 347877 - RNA, 22 nt, Human
ucuccuggauggaccuucucuu

SEQ ID NO: 347878 - RNA, 22 nt, Human
ccuugcauauauuauaucuuug

SEQ ID NO: 347879 - RNA, 22 nt, Human
uccccagccgugaaggagagga

SEQ ID NO: 347880 - RNA, 22 nt, Human
agcuguggcaaccuugucagac

SEQ ID NO: 347881 - RNA, 22 nt, Human
gaagaagcaggaguguguagca

SEQ ID NO: 347882 - RNA, 22 nt, Human
aauuuacaggugcacucgccau

SEQ ID NO: 347883 - RNA, 22 nt, Human
agauggcagggguaccuggaag

SEQ ID NO: 347884 - RNA, 22 nt, Human
gcagcuuucuacuuccuacagc

SEQ ID NO: 347885 - RNA, 19 nt, Human
ucaaugcaugaaaucagcc

SEQ ID NO: 347886 - RNA, 22 nt, Human
uccaggcauagaaggcacgcac

SEQ ID NO: 347887 - RNA, 22 nt, Human
cagcucccagagugaccagcag

SEQ ID NO: 347888 - RNA, 22 nt, Human
uuucacaaguuucaggauucug

SEQ ID NO: 347889 - RNA, 22 nt, Human
auccaaaucaugucagaagaac

SEQ ID NO: 347890 - RNA, 22 nt, Human
ucauuuauaaggaugcaauuaa

SEQ ID NO: 347891 - RNA, 22 nt, Human
aggggugaaggcccgauaggag

SEQ ID NO: 347892 - RNA, 22 nt, Human
ugucugguggguugacaggcag

SEQ ID NO: 347893 - RNA, 22 nt, Human
gccucugggcucugccccuggc

SEQ ID NO: 347894 - RNA, 22 nt, Human
aggggugauuugggacaggaca

SEQ ID NO: 347895 - RNA, 22 nt, Human
ggucucagcccucgccagcagc

SEQ ID NO: 347896 - RNA, 22 nt, Human
uaugcacacaggcuuaauucau

SEQ ID NO: 347897 - RNA, 22 nt, Human
cccagccucuggguucugccgg

SEQ ID NO: 347898 - RNA, 22 nt, Human
uggaaagaauuccuaugguuca

SEQ ID NO: 347899 - RNA, 22 nt, Human
uugcugaagugaagguauguuu

SEQ ID NO: 347900 - RNA, 21 nt, Human
ucugggcccaugcugccucac

SEQ ID NO: 347901 - RNA, 17 nt, Human
uaucagaauguguuuac

SEQ ID NO: 347902 - RNA, 22 nt, Human
ugacuucaaaggcucuacuccu

SEQ ID NO: 347903 - RNA, 22 nt, Human
cugaagcacagcauauaaauaa

SEQ ID NO: 347904 - RNA, 22 nt, Human
cugugucggacgugggcagcag

SEQ ID NO: 347905 - RNA, 22 nt, Human
uggggcagaguaggauuuuggc

SEQ ID NO: 347906 - RNA, 22 nt, Human
cccaguggagauaggagugugg

SEQ ID NO: 347907 - RNA, 22 nt, Human
gagccagggcugugagcugagc

SEQ ID NO: 347908 - RNA, 22 nt, Human
cugggcacaaguggcccuggau

SEQ ID NO: 347909 - RNA, 22 nt, Human
agcccggcuuccccgguugcua

SEQ ID NO: 347910 - RNA, 22 nt, Human
gugaggcagcaggagccucugu

SEQ ID NO: 347911 - RNA, 19 nt, Human
gcugcucugggucucaucu

SEQ ID NO: 347912 - RNA, 22 nt, Human
ucucuggggauggaccugggag

SEQ ID NO: 347913 - RNA, 22 nt, Human
ucuuuugugauucuucaguuac

SEQ ID NO: 347914 - RNA, 18 nt, Human
ucagcuuuugaaaaccaa

SEQ ID NO: 347915 - RNA, 22 nt, Human
cagggcuccccgcaccgcagcc

SEQ ID NO: 347916 - RNA, 22 nt, Human
aaauuucaagcaaaguagcuau

SEQ ID NO: 347917 - RNA, 22 nt, Human
agacaacaucacuaaagcugag

SEQ ID NO: 347918 - RNA, 22 nt, Human
uuauucagucugucuagggagu

SEQ ID NO: 347919 - RNA, 18 nt, Human
aagaggaggaaacccagg

SEQ ID NO: 347920 - RNA, 20 nt, Human
uacauucaaaacaaacucug

SEQ ID NO: 347921 - RNA, 22 nt, Human
ggaggugguggcagugacaauu

SEQ ID NO: 347922 - RNA, 22 nt, Human
uucaacucuucaagaucacauc

SEQ ID NO: 347923 - RNA, 22 nt, Human
ugaaauguuugaagaccacuga

SEQ ID NO: 347924 - RNA, 22 nt, Human
auccugggcagugugucacucu

SEQ ID NO: 347925 - RNA, 22 nt, Human
gcagcuuugucacggagugucg

SEQ ID NO: 347926 - RNA, 22 nt, Human
ucagccaguuuguuuauuccgg

SEQ ID NO: 347927 - RNA, 22 nt, Human
ucauccaguucacauggugagu

SEQ ID NO: 347928 - RNA, 22 nt, Human
aggauccugcgcuuugggggag

SEQ ID NO: 347929 - RNA, 22 nt, Human
uaacagaagaugaaacuucuuu

SEQ ID NO: 347930 - RNA, 22 nt, Human
cacauuucucuaccucacacaa

SEQ ID NO: 347931 - RNA, 17 nt, Human
aggcaggcagagcggga

SEQ ID NO: 347932 - RNA, 22 nt, Human
caaggccauauugccuguaugu

SEQ ID NO: 347933 - RNA, 22 nt, Human
uugagucaguaauuccauuucu

SEQ ID NO: 347934 - RNA, 22 nt, Human
cuggcuuuggucaugugaucau

SEQ ID NO: 347935 - RNA, 22 nt, Human
agggcuccugaggcccuucugg

SEQ ID NO: 347936 - RNA, 22 nt, Human
ggaggcccagagaggugaagug

SEQ ID NO: 347937 - RNA, 22 nt, Human
auucuuggagcagucaaagaag

SEQ ID NO: 347938 - RNA, 22 nt, Human
cugcuuuggcucagugacauca

SEQ ID NO: 347939 - RNA, 22 nt, Human
uugggcuggcagagguggucuu

SEQ ID NO: 347940 - RNA, 22 nt, Human
cccucugcaggcuggaccugcc

SEQ ID NO: 347941 - RNA, 22 nt, Human
gcugcuuccuuuccugcugacc

SEQ ID NO: 347942 - RNA, 22 nt, Human
uggggcuggggaucuugagccu

SEQ ID NO: 347943 - RNA, 22 nt, Human
ucugcagcuuuuugguggggug

SEQ ID NO: 347944 - RNA, 22 nt, Human
ccaggcaucacgggcauguggc

SEQ ID NO: 347945 - RNA, 22 nt, Human
gcccaggaaguugaggcugccg

SEQ ID NO: 347946 - RNA, 22 nt, Human
ggauucagugucuguuaauagu

SEQ ID NO: 347947 - RNA, 22 nt, Human
cagaaacauguauaaaguugua

SEQ ID NO: 347948 - RNA, 22 nt, Human
gcaggcugggguagccccacuu

SEQ ID NO: 347949 - RNA, 23 nt, Human
ucucagaggauuccugggccuug

SEQ ID NO: 347950 - RNA, 22 nt, Human
gagcacagcuggagguagcauu

SEQ ID NO: 347951 - RNA, 22 nt, Human
ugcucuccggcuuccguggccu

SEQ ID NO: 347952 - RNA, 22 nt, Human
guacuuccagccaagugagaca

SEQ ID NO: 347953 - RNA, 22 nt, Human
aggcuuguggauuggagcgagu

SEQ ID NO: 347954 - RNA, 23 nt, Human
uggcugagcccacuaucuuggcc

SEQ ID NO: 347955 - RNA, 21 nt, Human
gcucccugcucagcuccuggg

SEQ ID NO: 347956 - RNA, 22 nt, Human
auuuggaaacaauuauauucuu

SEQ ID NO: 347957 - RNA, 22 nt, Human
uggacucagugcugccauuccc

SEQ ID NO: 347958 - RNA, 22 nt, Human
aaaguuacuaucacaaugaaau

SEQ ID NO: 347959 - RNA, 22 nt, Human
uggcauuuuguucaguauaugg

SEQ ID NO: 347960 - RNA, 22 nt, Human
agagcagauggccagggggccu

SEQ ID NO: 347961 - RNA, 22 nt, Human
uacuagaaccucacaacaaucc

SEQ ID NO: 347962 - RNA, 22 nt, Human
augaggcagguggaggcugcca

SEQ ID NO: 347963 - RNA, 22 nt, Human
caagggcucuuuugaggaaugu

SEQ ID NO: 347964 - RNA, 23 nt, Human
cacugcagcguggucuggcagga

SEQ ID NO: 347965 - RNA, 22 nt, Human
cagaggaaaguauuucuggaag

SEQ ID NO: 347966 - RNA, 22 nt, Human
cugaggcucaagggcagguggg

SEQ ID NO: 347967 - RNA, 22 nt, Human
uagggcucugcucaucaguugu

SEQ ID NO: 347968 - RNA, 22 nt, Human
uuggcuucucuuaacccuaaag

SEQ ID NO: 347969 - RNA, 22 nt, Human
aguacaaugucugacacaguag

SEQ ID NO: 347970 - RNA, 22 nt, Human
ggcagcuuguccuggaggaugg

SEQ ID NO: 347971 - RNA, 22 nt, Human
cccaggugcugcgugaagccuc

SEQ ID NO: 347972 - RNA, 22 nt, Human
cugcagggcagggccuccuggc

SEQ ID NO: 347973 - RNA, 22 nt, Human
gaaggccuagggaugcucugcg

SEQ ID NO: 347974 - RNA, 22 nt, Human
agcaccuggucuccuggcgcug

SEQ ID NO: 347975 - RNA, 22 nt, Human
uauuccagguuucuuguuguau

SEQ ID NO: 347976 - RNA, 22 nt, Human
cagcuggcauaccugggcccgg

SEQ ID NO: 347977 - RNA, 22 nt, Human
agccacagagguugaugugguu

SEQ ID NO: 347978 - RNA, 22 nt, Human
ugaggccacuuccccacagccc

SEQ ID NO: 347979 - RNA, 19 nt, Human
ucugccucuggucaggcuc

SEQ ID NO: 347980 - RNA, 22 nt, Human
uucauacuaaaguguaagaugu

SEQ ID NO: 347981 - RNA, 22 nt, Human
cccacagguccccaugaacucg

SEQ ID NO: 347982 - RNA, 22 nt, Human
agaggagguggugaugcuuuaa

SEQ ID NO: 347983 - RNA, 22 nt, Human
ccuggcugcauuuugcuggaug

SEQ ID NO: 347984 - RNA, 22 nt, Human
agcugccccaugagaggcaggu

SEQ ID NO: 347985 - RNA, 22 nt, Human
auuauguauuugguauaguuug

SEQ ID NO: 347986 - RNA, 22 nt, Human
acagaauuaaugaaaauuacaa

SEQ ID NO: 347987 - RNA, 22 nt, Human
gaggccaggguaccaucaacau

SEQ ID NO: 347988 - RNA, 22 nt, Human
uccaggagucuagccucaggcc

SEQ ID NO: 347989 - RNA, 22 nt, Human
ggaggccuugaggccaggagcu

SEQ ID NO: 347990 - RNA, 22 nt, Human
gggcucugggaugcucuuagag

SEQ ID NO: 347991 - RNA, 21 nt, Human
ggcagcacuaccugaagcaua

SEQ ID NO: 347992 - RNA, 22 nt, Human
uugcaggauuuuagagaugaca

SEQ ID NO: 347993 - RNA, 21 nt, Human
cucacaggaugcaguguuacu

SEQ ID NO: 347994 - RNA, 22 nt, Human
auugaaagcacaaagaacaagu

SEQ ID NO: 347995 - RNA, 22 nt, Human
agggcucugagcuggaccaccu

SEQ ID NO: 347996 - RNA, 22 nt, Human
gggagcuggagcuggaagacuc

SEQ ID NO: 347997 - RNA, 22 nt, Human
cuuggcugucuauaggaaagag

SEQ ID NO: 347998 - RNA, 22 nt, Human
caaguccuuuucuuggcucagg

SEQ ID NO: 347999 - RNA, 21 nt, Human
uuccagagauuguuucaccug

SEQ ID NO: 348000 - RNA, 22 nt, Human
ucauaacagcuaagucccuuuc

SEQ ID NO: 348001 - RNA, 21 nt, Human
uagggcucucugugucaggug

SEQ ID NO: 348002 - RNA, 22 nt, Human
gguuucaaauuaaagucuuaag

SEQ ID NO: 348003 - RNA, 22 nt, Human
ugcugcugauggcaccuaggca

SEQ ID NO: 348004 - RNA, 23 nt, Human
agcuggaggcugucuacucccaa

SEQ ID NO: 348005 - RNA, 22 nt, Human
ccagagcuucggggcggcugua

SEQ ID NO: 348006 - RNA, 23 nt, Human
acucagagaccccgggaagugac

SEQ ID NO: 348007 - RNA, 22 nt, Human
uuuuuauaugaaggauagugcg

SEQ ID NO: 348008 - RNA, 22 nt, Human
ggagcugcuccuucagccaagu

SEQ ID NO: 348009 - RNA, 23 nt, Human
aggugccaacugagagcugagag

SEQ ID NO: 348010 - RNA, 22 nt, Human
caaaguuuggcucucaugacau

SEQ ID NO: 348011 - RNA, 22 nt, Human
cugagccacugcuuguucagug

SEQ ID NO: 348012 - RNA, 22 nt, Human
uccugcaguuacaucccagcca

SEQ ID NO: 348013 - RNA, 22 nt, Human
augaguaaaaccacuauuuaca

SEQ ID NO: 348014 - RNA, 22 nt, Human
cugcugugaguuuggaggucua

SEQ ID NO: 348015 - RNA, 21 nt, Human
ugaggcucuguugugccugca

SEQ ID NO: 348016 - RNA, 22 nt, Human
ccagcagaagcucccgcugggu

SEQ ID NO: 348017 - RNA, 22 nt, Human
aggcugggaaaccugaaguugu

SEQ ID NO: 348018 - RNA, 22 nt, Human
gagccaccuucaacucaggaau

SEQ ID NO: 348019 - RNA, 19 nt, Human
ucccaggaagcaaauguca

SEQ ID NO: 348020 - RNA, 22 nt, Human
caucagaaaccuugaggaaacu

SEQ ID NO: 348021 - RNA, 22 nt, Human
gcucaggaccgaggggugggaa

SEQ ID NO: 348022 - RNA, 22 nt, Human
auguaguguagagauuagucuc

SEQ ID NO: 348023 - RNA, 22 nt, Human
accaggagucuagccuagucaa

SEQ ID NO: 348024 - RNA, 22 nt, Human
auuccaaaggcuggccuggagg

SEQ ID NO: 348025 - RNA, 22 nt, Human
auacaucuaugccuuucugaca

SEQ ID NO: 348026 - RNA, 20 nt, Human
uccaguggccugaaucugga

SEQ ID NO: 348027 - RNA, 22 nt, Human
uuauuuucuccucagaaagugg

SEQ ID NO: 348028 - RNA, 22 nt, Human
agagggauaauauguauuguaa

SEQ ID NO: 348029 - RNA, 23 nt, Human
cagggcugguagggaagagcgug

SEQ ID NO: 348030 - RNA, 22 nt, Human
gaggcagcugaaggagugacag

SEQ ID NO: 348031 - RNA, 22 nt, Human
cacaagacuuauuuguguagaa

SEQ ID NO: 348032 - RNA, 22 nt, Human
agagcugcaggguggacccagg

SEQ ID NO: 348033 - RNA, 22 nt, Human
aaaaaugaauucuucaguggca

SEQ ID NO: 348034 - RNA, 22 nt, Human
agccagcagggcuuagaggaca

SEQ ID NO: 348035 - RNA, 22 nt, Human
uacauuccauguguguguauuc

SEQ ID NO: 348036 - RNA, 22 nt, Human
cccuggaggucagaggccuggg

SEQ ID NO: 348037 - RNA, 22 nt, Human
uuacaaagagugccagagugug

SEQ ID NO: 348038 - RNA, 22 nt, Human
agugauuugggugucagaaagu

SEQ ID NO: 348039 - RNA, 22 nt, Human
aggccagcgcugcuagcucccg

SEQ ID NO: 348040 - RNA, 22 nt, Human
ugcugaugcuguucuguuagga

SEQ ID NO: 348041 - RNA, 22 nt, Human
ucccagagaaagucaaggucuu

SEQ ID NO: 348042 - RNA, 22 nt, Human
acugugugacuguuauuacugu

SEQ ID NO: 348043 - RNA, 22 nt, Human
gcuguggccgucagggaaaugg

SEQ ID NO: 348044 - RNA, 22 nt, Human
caggugccgggaaugcagcaau

SEQ ID NO: 348045 - RNA, 16 nt, Human
gcagaggaaaggggag

SEQ ID NO: 348046 - RNA, 23 nt, Human
ucuuuccucagcacacaccaaga

SEQ ID NO: 348047 - RNA, 22 nt, Human
cuucugugauuugguuaggaua

SEQ ID NO: 348048 - RNA, 22 nt, Human
cccaggaggcggagguuguggu

SEQ ID NO: 348049 - RNA, 22 nt, Human
caggucagaggcgcagccccca

SEQ ID NO: 348050 - RNA, 22 nt, Human
agagcagccugugaugaugcac

SEQ ID NO: 348051 - RNA, 22 nt, Human
uuacagaagaguaacuuggcaa

SEQ ID NO: 348052 - RNA, 22 nt, Human
cagugaggaguccagggcagag

SEQ ID NO: 348053 - RNA, 21 nt, Human
uucucagagucuauuacaguu

SEQ ID NO: 348054 - RNA, 22 nt, Human
uugcaagacacuuggaagcaca

SEQ ID NO: 348055 - RNA, 22 nt, Human
aggcucaguuugguuuccauug

SEQ ID NO: 348056 - RNA, 22 nt, Human
gagucugaugucccccaggcca

SEQ ID NO: 348057 - RNA, 22 nt, Human
ccugggaggcggagguugcagu

SEQ ID NO: 348058 - RNA, 22 nt, Human
uugcuuuguggugguucuucca

SEQ ID NO: 348059 - RNA, 22 nt, Human
ccagagcagggcagcagggcuc

SEQ ID NO: 348060 - RNA, 22 nt, Human
cagcucugggugacaggagggc

SEQ ID NO: 348061 - RNA, 22 nt, Human
ugguaaagaaggcuagaucuga

SEQ ID NO: 348062 - RNA, 22 nt, Human
aggcagcaugggccccagcucc

SEQ ID NO: 348063 - RNA, 22 nt, Human
cagugaggaagcugucuggacc

SEQ ID NO: 348064 - RNA, 22 nt, Human
ucacauuuuccuugguaucugu

SEQ ID NO: 348065 - RNA, 22 nt, Human
uucaacuuuaugcauauguauu

SEQ ID NO: 348066 - RNA, 22 nt, Human
cugaaagaauaagauguuuaca

SEQ ID NO: 348067 - RNA, 22 nt, Human
aagaggaaaugauugacuauau

SEQ ID NO: 348068 - RNA, 22 nt, Human
ucacauuuucauauucucugag

SEQ ID NO: 348069 - RNA, 22 nt, Human
aaugaugguuucaucacuugaa

SEQ ID NO: 348070 - RNA, 20 nt, Human
ugcuguaagauuagagagcu

SEQ ID NO: 348071 - RNA, 22 nt, Human
gucaggauuugaacucaggucu

SEQ ID NO: 348072 - RNA, 22 nt, Human
uauuuagaacagacaauagaaa

SEQ ID NO: 348073 - RNA, 22 nt, Human
gaugugggguugagggaccagc

SEQ ID NO: 348074 - RNA, 22 nt, Human
cugcccaggaaggagaggaugg

SEQ ID NO: 348075 - RNA, 22 nt, Human
gcaaaauuaaacuuagcaucau

SEQ ID NO: 348076 - RNA, 22 nt, Human
guuucacagaugguguucauau

SEQ ID NO: 348077 - RNA, 22 nt, Human
gcccagaaguugaggcugcagu

SEQ ID NO: 348078 - RNA, 22 nt, Human
gacagcaggagaucaugauaga

SEQ ID NO: 348079 - RNA, 22 nt, Human
gacuuuggcaucuagacauugu

SEQ ID NO: 348080 - RNA, 20 nt, Human
gaggcugcggacugcuggac

SEQ ID NO: 348081 - RNA, 22 nt, Human
gcauuuaaauuugaacuucaga

SEQ ID NO: 348082 - RNA, 22 nt, Human
ccuggaucuaaggaagcuggga

SEQ ID NO: 348083 - RNA, 22 nt, Human
agcugcaggccucuccugggga

SEQ ID NO: 348084 - RNA, 22 nt, Human
uuccucagccagcacuuagggg

SEQ ID NO: 348085 - RNA, 19 nt, Human
cccaggagcaguauugaug

SEQ ID NO: 348086 - RNA, 22 nt, Human
auccuucagcugcccuguuacc

SEQ ID NO: 348087 - RNA, 22 nt, Human
cagcaggguuaagugacucacc

SEQ ID NO: 348088 - RNA, 22 nt, Human
ucagcccugggacccagggaug

SEQ ID NO: 348089 - RNA, 19 nt, Human
ggccaccucucuucccagg

SEQ ID NO: 348090 - RNA, 22 nt, Human
gaggggcucuuuaauaguaaca

SEQ ID NO: 348091 - RNA, 22 nt, Human
agagccagcauuugggcccugc

SEQ ID NO: 348092 - RNA, 22 nt, Human
uucauuacugcgguagucacac

SEQ ID NO: 348093 - RNA, 22 nt, Human
ugaggcagcaauuguauuguau

SEQ ID NO: 348094 - RNA, 22 nt, Human
uccauuuucuugcucuagguaa

SEQ ID NO: 348095 - RNA, 22 nt, Human
auuaggcagugccauuguacgg

SEQ ID NO: 348096 - RNA, 22 nt, Human
cagaggcugggaccucaggcau

SEQ ID NO: 348097 - RNA, 22 nt, Human
gauggcagcauauugacagcau

SEQ ID NO: 348098 - RNA, 22 nt, Human
agcagcauguaugagggugaac

SEQ ID NO: 348099 - RNA, 22 nt, Human
uucuucaaagaugucuguugga

SEQ ID NO: 348100 - RNA, 22 nt, Human
gcaguggcaccgcuggcucugg

SEQ ID NO: 348101 - RNA, 22 nt, Human
auuugcaugcuucuauugugaa

SEQ ID NO: 348102 - RNA, 22 nt, Human
cagcucuggcgucagggagcga

SEQ ID NO: 348103 - RNA, 22 nt, Human
gcagcauuuguggaaugggccc

SEQ ID NO: 348104 - RNA, 22 nt, Human
ucgagucauguucucccauuaa

SEQ ID NO: 348105 - RNA, 22 nt, Human
ccaggagacaaagaugacugcu

SEQ ID NO: 348106 - RNA, 22 nt, Human
aagaugcagcuuccacuuuugc

SEQ ID NO: 348107 - RNA, 22 nt, Human
gaagagcuguagccugcucuuu

SEQ ID NO: 348108 - RNA, 22 nt, Human
cagaggcaggaagaugggcagu

SEQ ID NO: 348109 - RNA, 22 nt, Human
auucauuugcuauuguguaugg

SEQ ID NO: 348110 - RNA, 22 nt, Human
agucccagugagaugaaccagg

SEQ ID NO: 348111 - RNA, 22 nt, Human
cagguaaaaauaaauuugugag

SEQ ID NO: 348112 - RNA, 20 nt, Human
ucaggaugugcugagugaag

SEQ ID NO: 348113 - RNA, 22 nt, Human
aggcggcugguguccugcaggu

SEQ ID NO: 348114 - RNA, 22 nt, Human
gcugugcagucuuuggugugcc

SEQ ID NO: 348115 - RNA, 20 nt, Human
agaaggcuccuuuugccaag

SEQ ID NO: 348116 - RNA, 22 nt, Human
aagggcagcugacagaugcuua

SEQ ID NO: 348117 - RNA, 22 nt, Human
uguguacagcaggauuucucaa

SEQ ID NO: 348118 - RNA, 23 nt, Human
gugcugugagccccuuggccucc

SEQ ID NO: 348119 - RNA, 22 nt, Human
gggcagugguuacacagcugag

SEQ ID NO: 348120 - RNA, 22 nt, Human
gauuuuauuagcccaaacuuug

SEQ ID NO: 348121 - RNA, 22 nt, Human
cugaguccagggacagaggcgu

SEQ ID NO: 348122 - RNA, 16 nt, Human
cuuccucuucacuggc

SEQ ID NO: 348123 - RNA, 22 nt, Human
gagcugccugaacaagcagcag

SEQ ID NO: 348124 - RNA, 22 nt, Human
cacccagggcugugccugccca

SEQ ID NO: 348125 - RNA, 22 nt, Human
cccaggaaaugaacuucugauu

SEQ ID NO: 348126 - RNA, 22 nt, Human
gcaggcugaugacuggaguugg

SEQ ID NO: 348127 - RNA, 22 nt, Human
acaaaggugagcagaagacaca

SEQ ID NO: 348128 - RNA, 22 nt, Human
uggagggcaugcuguccauggg

SEQ ID NO: 348129 - RNA, 22 nt, Human
ucccaggaaaacacucgaggac

SEQ ID NO: 348130 - RNA, 16 nt, Human
aggcucagaggcugga

SEQ ID NO: 348131 - RNA, 22 nt, Human
agcuuccucaccucagaggucu

SEQ ID NO: 348132 - RNA, 23 nt, Human
ugacacauuuccuuuccacugca

SEQ ID NO: 348133 - RNA, 22 nt, Human
ggcaggguccacaccugggaaa

SEQ ID NO: 348134 - RNA, 22 nt, Human
agggcugcuccuccuucaggcc

SEQ ID NO: 348135 - RNA, 22 nt, Human
cccaggaaaagcagugccagca

SEQ ID NO: 348136 - RNA, 19 nt, Human
uuugaaaggauuguuauuu

SEQ ID NO: 348137 - RNA, 22 nt, Human
ucuggagcuuccucauuuacag

SEQ ID NO: 348138 - RNA, 22 nt, Human
gcagccagguuugaggaccacu

SEQ ID NO: 348139 - RNA, 22 nt, Human
cucagaagccuucagucuuggc

SEQ ID NO: 348140 - RNA, 22 nt, Human
uuuguaaagucuguucugaguu

SEQ ID NO: 348141 - RNA, 22 nt, Human
caggagcugggucuggaagcag

SEQ ID NO: 348142 - RNA, 22 nt, Human
ucucagagggaaaggccaauuu

SEQ ID NO: 348143 - RNA, 22 nt, Human
aggggugaaagagggcccucaa

SEQ ID NO: 348144 - RNA, 22 nt, Human
agcaggaggguuuuguagaguc

SEQ ID NO: 348145 - RNA, 21 nt, Human
cagacccucuagaggccaccu

SEQ ID NO: 348146 - RNA, 22 nt, Human
uacagagaguacagcauccaca

SEQ ID NO: 348147 - RNA, 22 nt, Human
uggcucaguuaggucagaaaca

SEQ ID NO: 348148 - RNA, 22 nt, Human
ugcaguggaaucuggagagcag

SEQ ID NO: 348149 - RNA, 17 nt, Human
agguggguggaucaccu

SEQ ID NO: 348150 - RNA, 22 nt, Human
ugucaaaaugacuuuacuacag

SEQ ID NO: 348151 - RNA, 22 nt, Human
gcagauggcucagacacugggg

SEQ ID NO: 348152 - RNA, 22 nt, Human
aggccagcucacccuggcuccu

SEQ ID NO: 348153 - RNA, 22 nt, Human
cauuugaugacucaacucauaa

SEQ ID NO: 348154 - RNA, 22 nt, Human
guggggggacguuggucacuuu

SEQ ID NO: 348155 - RNA, 22 nt, Human
aagauauagauaaaacuaugca

SEQ ID NO: 348156 - RNA, 22 nt, Human
gccagaagggguggauccaggc

SEQ ID NO: 348157 - RNA, 22 nt, Human
aggucagcugcugauaggcagc

SEQ ID NO: 348158 - RNA, 22 nt, Human
ucugggagagcacguggcugac

SEQ ID NO: 348159 - RNA, 22 nt, Human
ccaggcugcagucaaggggcau

SEQ ID NO: 348160 - RNA, 22 nt, Human
uacauaauuaaucuuuaaguuc

SEQ ID NO: 348161 - RNA, 22 nt, Human
aaaucaguuguuauauuaaaga

SEQ ID NO: 348162 - RNA, 22 nt, Human
auccaaacauguaccacacuaa

SEQ ID NO: 348163 - RNA, 22 nt, Human
aaguauaagcuauucuucauga

SEQ ID NO: 348164 - RNA, 22 nt, Human
acuguggccugcuguaugggcu

SEQ ID NO: 348165 - RNA, 19 nt, Human
augcuuuauguuauuucuu

SEQ ID NO: 348166 - RNA, 22 nt, Human
ccauggagcgggugagugagug

SEQ ID NO: 348167 - RNA, 22 nt, Human
agcagcucuuaacaaagcaugg

SEQ ID NO: 348168 - RNA, 22 nt, Human
cugguccuugacgcgugggagg

SEQ ID NO: 348169 - RNA, 18 nt, Human
gaaaggagagacaguagg

SEQ ID NO: 348170 - RNA, 22 nt, Human
aauccugugugacucuggggag

SEQ ID NO: 348171 - RNA, 22 nt, Human
aagggcuggaauaucucuuaga

SEQ ID NO: 348172 - RNA, 20 nt, Human
cauuugaaucuccauucugc

SEQ ID NO: 348173 - RNA, 22 nt, Human
gagaggccaccugacgagcagu

SEQ ID NO: 348174 - RNA, 22 nt, Human
agugucugccaacugcaugguc

SEQ ID NO: 348175 - RNA, 22 nt, Human
cuggccuggcagggagggcaug

SEQ ID NO: 348176 - RNA, 22 nt, Human
ccugucuguccucucaugagcc

SEQ ID NO: 348177 - RNA, 22 nt, Human
cgggcuggcugcagcugcugga

SEQ ID NO: 348178 - RNA, 22 nt, Human
uccguauuugacuauugcaccg

SEQ ID NO: 348179 - RNA, 22 nt, Human
agagucugaaugcucagaguug

SEQ ID NO: 348180 - RNA, 22 nt, Human
aggccugacuugaauuuagggc

SEQ ID NO: 348181 - RNA, 22 nt, Human
aggagaaguaaggcuagaugau

SEQ ID NO: 348182 - RNA, 23 nt, Human
gagggcucugagugcuugggcca

SEQ ID NO: 348183 - RNA, 22 nt, Human
gcagcugaauguccauugcugc

SEQ ID NO: 348184 - RNA, 21 nt, Human
gcugagagguugggaaguuca

SEQ ID NO: 348185 - RNA, 22 nt, Human
auucucaaacaagugguuugau

SEQ ID NO: 348186 - RNA, 21 nt, Human
gaaaggucuuaacuuacagag

SEQ ID NO: 348187 - RNA, 22 nt, Human
ugggcaggaugcguugauucuu

SEQ ID NO: 348188 - RNA, 22 nt, Human
aucauucuagcuguuguguuga

SEQ ID NO: 348189 - RNA, 22 nt, Human
aguauuucugcucaugaaagag

SEQ ID NO: 348190 - RNA, 22 nt, Human
cuuguagaauugaaauggucuc

SEQ ID NO: 348191 - RNA, 22 nt, Human
auggcagauggcuggagcaggu

SEQ ID NO: 348192 - RNA, 22 nt, Human
ucuccugguuuguuaaauaauu

SEQ ID NO: 348193 - RNA, 22 nt, Human
aggccuagaggaauggccaggg

SEQ ID NO: 348194 - RNA, 21 nt, Human
uguaugcacgcacaugcacac

SEQ ID NO: 348195 - RNA, 22 nt, Human
ggugacugguuuaucuggcagu

SEQ ID NO: 348196 - RNA, 22 nt, Human
uauauuaacacccacuugccuc

SEQ ID NO: 348197 - RNA, 22 nt, Human
uauuuaucgagugucuacuaug

SEQ ID NO: 348198 - RNA, 19 nt, Human
ucuggcuccgccucuuagu

SEQ ID NO: 348199 - RNA, 22 nt, Human
cugagcauggccgguccauggu

SEQ ID NO: 348200 - RNA, 22 nt, Human
auucacagggacaaugggagag

SEQ ID NO: 348201 - RNA, 17 nt, Human
aaaauucuguaaagagg

SEQ ID NO: 348202 - RNA, 22 nt, Human
gccucugcaucuucgccgcacu

SEQ ID NO: 348203 - RNA, 22 nt, Human
aaaugcacugaacacauguugu

SEQ ID NO: 348204 - RNA, 22 nt, Human
cuaaaauuaccuaccaguuuag

SEQ ID NO: 348205 - RNA, 22 nt, Human
cauucugugauucuaaaucccu

SEQ ID NO: 348206 - RNA, 22 nt, Human
aagggcaggugggcauuucugg

SEQ ID NO: 348207 - RNA, 22 nt, Human
auggauaagucaaagaguaucc

SEQ ID NO: 348208 - RNA, 22 nt, Human
auaguuugaaggcuguucuacu

SEQ ID NO: 348209 - RNA, 22 nt, Human
cucccagguuacaucugagccu

SEQ ID NO: 348210 - RNA, 22 nt, Human
gcucugggaacugacugccuuc

SEQ ID NO: 348211 - RNA, 22 nt, Human
aaguucaaguguaaucuuuauu

SEQ ID NO: 348212 - RNA, 22 nt, Human
aaaauugaggcucauguuaaau

SEQ ID NO: 348213 - RNA, 22 nt, Human
gcauggcugguguccugaggga

SEQ ID NO: 348214 - RNA, 22 nt, Human
uaggagaggugaauggcacacu

SEQ ID NO: 348215 - RNA, 22 nt, Human
uauuuuguuaauaauccagucc

SEQ ID NO: 348216 - RNA, 22 nt, Human
acugguuuuccagguuacuucu

SEQ ID NO: 348217 - RNA, 22 nt, Human
auaaguaggaaaauuugaauau

SEQ ID NO: 348218 - RNA, 22 nt, Human
caggccuggcugcagcucgccu

SEQ ID NO: 348219 - RNA, 22 nt, Human
uccuugaauugugccacuuacc

SEQ ID NO: 348220 - RNA, 22 nt, Human
caggccuggcccccggcacacc

SEQ ID NO: 348221 - RNA, 22 nt, Human
aggaaaaucgagucuggaggca

SEQ ID NO: 348222 - RNA, 22 nt, Human
aauguuaauuuacugucuucau

SEQ ID NO: 348223 - RNA, 22 nt, Human
ggggcggggcucugagaagcau

SEQ ID NO: 348224 - RNA, 22 nt, Human
agggcagaaauauugauacugu

SEQ ID NO: 348225 - RNA, 21 nt, Human
uucuuuccccagaggacuaaa

SEQ ID NO: 348226 - RNA, 22 nt, Human
agcagggcuugccgcuuguccu

SEQ ID NO: 348227 - RNA, 22 nt, Human
ugccagcuccgaggagcugcag

SEQ ID NO: 348228 - RNA, 22 nt, Human
augggaggaugcucgggugcuc

SEQ ID NO: 348229 - RNA, 22 nt, Human
uaagcugugggagauuggcaua

SEQ ID NO: 348230 - RNA, 22 nt, Human
uggcucugggaaucuguugcuu

SEQ ID NO: 348231 - RNA, 23 nt, Human
cagggcccugcucaauuucucca

SEQ ID NO: 348232 - RNA, 22 nt, Human
cuguccagcuuggcuccugggg

SEQ ID NO: 348233 - RNA, 20 nt, Human
aggacagcagcugccacuug

SEQ ID NO: 348234 - RNA, 22 nt, Human
uggccuugggcagguggccugc

SEQ ID NO: 348235 - RNA, 22 nt, Human
ucugcagaauucgaggaagaaa

SEQ ID NO: 348236 - RNA, 19 nt, Human
acacagggcuagaguuaca

SEQ ID NO: 348237 - RNA, 22 nt, Human
ggccagagaauaugccuuacgu

SEQ ID NO: 348238 - RNA, 22 nt, Human
acagccagggucucaggaggcg

SEQ ID NO: 348239 - RNA, 22 nt, Human
uccagggagauggcagaggcug

SEQ ID NO: 348240 - RNA, 22 nt, Human
augaaauaucuugaagaaauuc

SEQ ID NO: 348241 - RNA, 22 nt, Human
gaggaagaagcaaaccagcuaa

SEQ ID NO: 348242 - RNA, 22 nt, Human
acagagagguaaaauauauagu

SEQ ID NO: 348243 - RNA, 22 nt, Human
cccugccuugggguccacaccg

SEQ ID NO: 348244 - RNA, 22 nt, Human
caggcugcggucggcucugguc

SEQ ID NO: 348245 - RNA, 22 nt, Human
gaggucaauaauaugugcuuua

SEQ ID NO: 348246 - RNA, 22 nt, Human
ucccaaggcacagggcagggac

SEQ ID NO: 348247 - RNA, 22 nt, Human
uccagggguaccggccaggcag

SEQ ID NO: 348248 - RNA, 20 nt, Human
gcucccagccugcagucccc

SEQ ID NO: 348249 - RNA, 22 nt, Human
acaaauaugguacucggagaaa

SEQ ID NO: 348250 - RNA, 20 nt, Human
gcugcucuccacggucugca

SEQ ID NO: 348251 - RNA, 22 nt, Human
uugagaagaggcuuuguaggaa

SEQ ID NO: 348252 - RNA, 22 nt, Human
aaguauauuuuuugaagcauau

SEQ ID NO: 348253 - RNA, 22 nt, Human
guucauauuacuuugagugcag

SEQ ID NO: 348254 - RNA, 20 nt, Human
ggaccagguggggcgguggc

SEQ ID NO: 348255 - RNA, 22 nt, Human
auaaacagcuccauuuagugcc

SEQ ID NO: 348256 - RNA, 22 nt, Human
gccagguggucuggcuccagag

SEQ ID NO: 348257 - RNA, 22 nt, Human
guuaggcaguuuucuucauucu

SEQ ID NO: 348258 - RNA, 22 nt, Human
uugcagagaucagcagguuuga

SEQ ID NO: 348259 - RNA, 22 nt, Human
acugggccuugccauggcagcc

SEQ ID NO: 348260 - RNA, 22 nt, Human
cuaugaaaggauuuggaguugu

SEQ ID NO: 348261 - RNA, 22 nt, Human
acauuucuccuacuuguuauuu

SEQ ID NO: 348262 - RNA, 22 nt, Human
gcuuuauguaaguccaaaggca

SEQ ID NO: 348263 - RNA, 22 nt, Human
cuguagcaaguuauucaauaaa

SEQ ID NO: 348264 - RNA, 22 nt, Human
agugcugucuccuucccccggg

SEQ ID NO: 348265 - RNA, 22 nt, Human
aagggcagcuauuaucgucauc

SEQ ID NO: 348266 - RNA, 22 nt, Human
ucuccugugcacccucccugug

SEQ ID NO: 348267 - RNA, 22 nt, Human
uauugaaauccauuacguucuu

SEQ ID NO: 348268 - RNA, 22 nt, Human
uccuucaagaugccacagcuuu

SEQ ID NO: 348269 - RNA, 22 nt, Human
uggcccugaggacccagugugg

SEQ ID NO: 348270 - RNA, 22 nt, Human
gugauuuagauguugaaaguga

SEQ ID NO: 348271 - RNA, 22 nt, Human
gaauacauuggaaaucagaaua

SEQ ID NO: 348272 - RNA, 22 nt, Human
auaugaagaauuccaauuugga

SEQ ID NO: 348273 - RNA, 22 nt, Human
aguguuugucccguuagaaaug

SEQ ID NO: 348274 - RNA, 22 nt, Human
agucacuguucugucaugucaa

SEQ ID NO: 348275 - RNA, 22 nt, Human
uccacuuuagcaaugauugaau

SEQ ID NO: 348276 - RNA, 22 nt, Human
agccacagcaacaagugcaauu

SEQ ID NO: 348277 - RNA, 23 nt, Human
ucagagagcuguugagagcugcc

SEQ ID NO: 348278 - RNA, 22 nt, Human
gugggaugguagguagguaaua

SEQ ID NO: 348279 - RNA, 22 nt, Human
uuccuuaguugacugucuuagu

SEQ ID NO: 348280 - RNA, 21 nt, Human
ugacugaggcuucuucacaca

SEQ ID NO: 348281 - RNA, 23 nt, Human
ggccuguguuuugucugaaguac

SEQ ID NO: 348282 - RNA, 22 nt, Human
cuucagaagaaaagcagugugu

SEQ ID NO: 348283 - RNA, 22 nt, Human
ggauggcagucugcaugagaaa

SEQ ID NO: 348284 - RNA, 22 nt, Human
cagggccuuuuagcaucuucuc

SEQ ID NO: 348285 - RNA, 22 nt, Human
acugugugcccugacgccaggg

SEQ ID NO: 348286 - RNA, 22 nt, Human
ggaaggagggcggcaaugauga

SEQ ID NO: 348287 - RNA, 22 nt, Human
aucaggaugaagcuguagcgaa

SEQ ID NO: 348288 - RNA, 22 nt, Human
ccucugcaccauagccuucagc

SEQ ID NO: 348289 - RNA, 22 nt, Human
ggccugccucacagucagcacc

SEQ ID NO: 348290 - RNA, 22 nt, Human
uagaaauguugguauuaacauu

SEQ ID NO: 348291 - RNA, 22 nt, Human
uaauucagggccagaaucccca

SEQ ID NO: 348292 - RNA, 22 nt, Human
uuauucuuuucuccagaauccc

SEQ ID NO: 348293 - RNA, 22 nt, Human
aguccuuaugugguggagagag

SEQ ID NO: 348294 - RNA, 22 nt, Human
aaacaucaccauuuuaccuaau

SEQ ID NO: 348295 - RNA, 22 nt, Human
guacagaaggauuucuaguagu

SEQ ID NO: 348296 - RNA, 22 nt, Human
gcugcugugugggagacaggcg

SEQ ID NO: 348297 - RNA, 22 nt, Human
gaauuucaaagagguuaagagg

SEQ ID NO: 348298 - RNA, 22 nt, Human
gggagcaggagccugccugcca

SEQ ID NO: 348299 - RNA, 22 nt, Human
aggccuggcaugagaccugaga

SEQ ID NO: 348300 - RNA, 22 nt, Human
ccugccugauuccaggauggcu

SEQ ID NO: 348301 - RNA, 22 nt, Human
gcaugggcuuucucagaguucu

SEQ ID NO: 348302 - RNA, 22 nt, Human
uguguacaagaguguuuacugu

SEQ ID NO: 348303 - RNA, 22 nt, Human
uaaaagcucuucuguugaguua

SEQ ID NO: 348304 - RNA, 22 nt, Human
aagcugcccucauucccagugc

SEQ ID NO: 348305 - RNA, 22 nt, Human
uggggcagcagaccuuucuugg

SEQ ID NO: 348306 - RNA, 22 nt, Human
cccugccuacaggguuuucuuu

SEQ ID NO: 348307 - RNA, 22 nt, Human
ucugcaggccucgacaaggcca

SEQ ID NO: 348308 - RNA, 22 nt, Human
auugucuucuggucuuaucuuu

SEQ ID NO: 348309 - RNA, 20 nt, Human
ccugccugccucggcucauu

SEQ ID NO: 348310 - RNA, 18 nt, Human
uguuccaaggaaggaauc

SEQ ID NO: 348311 - RNA, 22 nt, Human
uuuacucuugcuacacaacugu

SEQ ID NO: 348312 - RNA, 22 nt, Human
cagcagggggcagcgcagauca

SEQ ID NO: 348313 - RNA, 22 nt, Human
ucagcuuuuuggauugcccaag

SEQ ID NO: 348314 - RNA, 22 nt, Human
gcugcagcccggcgcgccugag

SEQ ID NO: 348315 - RNA, 22 nt, Human
agacaacaccaaaugcuagugu

SEQ ID NO: 348316 - RNA, 22 nt, Human
ccuggagggcgccgcacagucc

SEQ ID NO: 348317 - RNA, 22 nt, Human
aggaugagccgcgcaagcugac

SEQ ID NO: 348318 - RNA, 22 nt, Human
auguacauuuagaucauuucug

SEQ ID NO: 348319 - RNA, 22 nt, Human
uucacagacauugcagacugaa

SEQ ID NO: 348320 - RNA, 20 nt, Human
agggucagagagcgugagug

SEQ ID NO: 348321 - RNA, 22 nt, Human
aguaaacacugucuuuauauau

SEQ ID NO: 348322 - RNA, 22 nt, Human
ccaggcucugucuggucagaag

SEQ ID NO: 348323 - RNA, 22 nt, Human
uuuauccagaaucaggauuuuu

SEQ ID NO: 348324 - RNA, 22 nt, Human
ccauggcaauggucagucuauu

SEQ ID NO: 348325 - RNA, 22 nt, Human
acucugaggcaggucagggcag

SEQ ID NO: 348326 - RNA, 22 nt, Human
aggauuuauuccagaaaugcaa

SEQ ID NO: 348327 - RNA, 18 nt, Human
caugggugacagguggau

SEQ ID NO: 348328 - RNA, 22 nt, Human
uaaggccagccagcaaaucugu

SEQ ID NO: 348329 - RNA, 22 nt, Human
cuauuagguaugugguugcuau

SEQ ID NO: 348330 - RNA, 22 nt, Human
agaaacauccugcuuuccauuu

SEQ ID NO: 348331 - RNA, 22 nt, Human
gugugcagggggccagcgcagc

SEQ ID NO: 348332 - RNA, 19 nt, Human
agcaccugugagagccugg

SEQ ID NO: 348333 - RNA, 22 nt, Human
cagcagagggagccauugaaau

SEQ ID NO: 348334 - RNA, 22 nt, Human
acacaauacagggcucaaaaua

SEQ ID NO: 348335 - RNA, 22 nt, Human
uuccucaguuagugccugaggc

SEQ ID NO: 348336 - RNA, 22 nt, Human
cucugagagcggucuguggcuu

SEQ ID NO: 348337 - RNA, 22 nt, Human
caggugcuguccugcacauguc

SEQ ID NO: 348338 - RNA, 22 nt, Human
cuguucaugcugauucuguaug

SEQ ID NO: 348339 - RNA, 22 nt, Human
cagggccacuguagaugaggag

SEQ ID NO: 348340 - RNA, 22 nt, Human
gacccaggagugcagagagugg

SEQ ID NO: 348341 - RNA, 20 nt, Human
guaaaauauggucuuugggu

SEQ ID NO: 348342 - RNA, 22 nt, Human
uuacagaauguucuuccaacag

SEQ ID NO: 348343 - RNA, 22 nt, Human
guccucagagugggcagguccu

SEQ ID NO: 348344 - RNA, 22 nt, Human
aaguuuaacuugaauucuuucu

SEQ ID NO: 348345 - RNA, 22 nt, Human
ggaggaugccaagcugugcaca

SEQ ID NO: 348346 - RNA, 22 nt, Human
agacgagggcccccaggacagc

SEQ ID NO: 348347 - RNA, 22 nt, Human
uucacauuauaaucaguucugc

SEQ ID NO: 348348 - RNA, 22 nt, Human
ugaaugauuugggugcauucag

SEQ ID NO: 348349 - RNA, 22 nt, Human
uggcuuaagauuuaugcuuuua

SEQ ID NO: 348350 - RNA, 22 nt, Human
auagucuuagaucagauaaagu

SEQ ID NO: 348351 - RNA, 22 nt, Human
uaaaaugaucucucauguucuu

SEQ ID NO: 348352 - RNA, 22 nt, Human
cuucucagcauuuugucagucu

SEQ ID NO: 348353 - RNA, 22 nt, Human
cugggcacagcguugggcucuu

SEQ ID NO: 348354 - RNA, 22 nt, Human
agccccugggaguagcugcugc

SEQ ID NO: 348355 - RNA, 22 nt, Human
cugccucucagccugaccgcca

SEQ ID NO: 348356 - RNA, 22 nt, Human
ggaggugggagacauaggcggc

SEQ ID NO: 348357 - RNA, 22 nt, Human
acaugcauacaagcacauguag

SEQ ID NO: 348358 - RNA, 21 nt, Human
aggcucagagagaaacucuug

SEQ ID NO: 348359 - RNA, 22 nt, Human
uaaaggcucacuggcuuggggu

SEQ ID NO: 348360 - RNA, 22 nt, Human
uaugaagaaguucugugaaaug

SEQ ID NO: 348361 - RNA, 22 nt, Human
ccacaggcugcugcaggucccg

SEQ ID NO: 348362 - RNA, 22 nt, Human
ugcugccaccccucaccagagc

SEQ ID NO: 348363 - RNA, 22 nt, Human
aggugcagcugacaccaugugg

SEQ ID NO: 348364 - RNA, 22 nt, Human
ucccaggagcaccuuuugagcc

SEQ ID NO: 348365 - RNA, 22 nt, Human
uucaguuucagucuugcaaaaa

SEQ ID NO: 348366 - RNA, 22 nt, Human
ccugggcagguguggcuucccc

SEQ ID NO: 348367 - RNA, 22 nt, Human
accugccuucucaaggacauga

SEQ ID NO: 348368 - RNA, 22 nt, Human
gguggguauaguuagggccucu

SEQ ID NO: 348369 - RNA, 22 nt, Human
aggcugagucgggaggaucacu

SEQ ID NO: 348370 - RNA, 22 nt, Human
ucagggcacugucaccugauau

SEQ ID NO: 348371 - RNA, 21 nt, Human
gccuggcagguggaagggcuc

SEQ ID NO: 348372 - RNA, 22 nt, Human
aagcagaauuucccacuaguug

SEQ ID NO: 348373 - RNA, 22 nt, Human
aguagaauagauggauacuauu

SEQ ID NO: 348374 - RNA, 22 nt, Human
ccaggugggaggaaagcagaga

SEQ ID NO: 348375 - RNA, 22 nt, Human
ggaggggagauguuugggcuca

SEQ ID NO: 348376 - RNA, 22 nt, Human
uucagaaaugaauauugguauu

SEQ ID NO: 348377 - RNA, 22 nt, Human
acgcagaagggccuggcgugcc

SEQ ID NO: 348378 - RNA, 21 nt, Human
cugcucugacagugaggccag

SEQ ID NO: 348379 - RNA, 19 nt, Human
cugcucaggucagucuguc

SEQ ID NO: 348380 - RNA, 22 nt, Human
gacagaggcuggagcaccuccu

SEQ ID NO: 348381 - RNA, 22 nt, Human
uauguuuuucaagugcacacua

SEQ ID NO: 348382 - RNA, 22 nt, Human
ugaggcagcccacuuuccuuag

SEQ ID NO: 348383 - RNA, 22 nt, Human
cugggcaggagggcucuaugga

SEQ ID NO: 348384 - RNA, 22 nt, Human
uuguaaauaguaguaagaugcc

SEQ ID NO: 348385 - RNA, 22 nt, Human
aggaagugaaagggaaggaguu

SEQ ID NO: 348386 - RNA, 18 nt, Human
ccugccagucuggagcag

SEQ ID NO: 348387 - RNA, 22 nt, Human
ugaagaugucagcagggguggu

SEQ ID NO: 348388 - RNA, 22 nt, Human
gccuggaguucagccaaguccc

SEQ ID NO: 348389 - RNA, 23 nt, Human
agagcuuagggaauucacaugag

SEQ ID NO: 348390 - RNA, 19 nt, Human
cccuggcaggcaagccugg

SEQ ID NO: 348391 - RNA, 22 nt, Human
agcuaagacuuagugacuuagu

SEQ ID NO: 348392 - RNA, 20 nt, Human
cuuccacacaagaagcacag

SEQ ID NO: 348393 - RNA, 22 nt, Human
acagcagccugcagcccugugu

SEQ ID NO: 348394 - RNA, 22 nt, Human
ugagccuggggccugggcagcg

SEQ ID NO: 348395 - RNA, 22 nt, Human
auauguguacgugcaguauaua

SEQ ID NO: 348396 - RNA, 22 nt, Human
gcagaagcuguucgaaggccgc

SEQ ID NO: 348397 - RNA, 22 nt, Human
ucuucagauaaagggagaguau

SEQ ID NO: 348398 - RNA, 22 nt, Human
acagugaaugcccaagaaaagu

SEQ ID NO: 348399 - RNA, 22 nt, Human
ugcccacauggugccauggcca

SEQ ID NO: 348400 - RNA, 22 nt, Human
gucagcacuuuuccgaggcaga

SEQ ID NO: 348401 - RNA, 22 nt, Human
uuugaaguccaucuggcccagu

SEQ ID NO: 348402 - RNA, 22 nt, Human
ugcagggcacggugcgcguggg

SEQ ID NO: 348403 - RNA, 22 nt, Human
auaaaauuugcuacuguuaaau

SEQ ID NO: 348404 - RNA, 20 nt, Human
cagggcucugggccuggccu

SEQ ID NO: 348405 - RNA, 22 nt, Human
acagacagggcaccugccuccu

SEQ ID NO: 348406 - RNA, 22 nt, Human
cuguggcuaggaagcuguggga

SEQ ID NO: 348407 - RNA, 22 nt, Human
uauaucauggagauuaacauuc

SEQ ID NO: 348408 - RNA, 22 nt, Human
auauacaaagggcaaccucgcu

SEQ ID NO: 348409 - RNA, 22 nt, Human
aaggcacugacugugcagggga

SEQ ID NO: 348410 - RNA, 22 nt, Human
aggaauucaagaccagcugggc

SEQ ID NO: 348411 - RNA, 22 nt, Human
agaacagcaguuaugguucauu

SEQ ID NO: 348412 - RNA, 18 nt, Human
cugucaccgccaccacac

SEQ ID NO: 348413 - RNA, 22 nt, Human
gguggcagaauaauugaagguc

SEQ ID NO: 348414 - RNA, 22 nt, Human
gaaccucagugaaacuggaggu

SEQ ID NO: 348415 - RNA, 22 nt, Human
acuauacaccaaaauauuaagg

SEQ ID NO: 348416 - RNA, 20 nt, Human
gaaguccuguuauauccuuu

SEQ ID NO: 348417 - RNA, 22 nt, Human
ucuggagcuggcagggcccugg

SEQ ID NO: 348418 - RNA, 22 nt, Human
ggagugucagaaacaguguccu

SEQ ID NO: 348419 - RNA, 22 nt, Human
auuuccacauaagggaaauaag

SEQ ID NO: 348420 - RNA, 22 nt, Human
cagucccaguuugagacucugg

SEQ ID NO: 348421 - RNA, 22 nt, Human
gggguugguuuaaaugcuugag

SEQ ID NO: 348422 - RNA, 22 nt, Human
auuaaauuaaguggcuaauuua

SEQ ID NO: 348423 - RNA, 19 nt, Human
ccagcagacacagcugccc

SEQ ID NO: 348424 - RNA, 21 nt, Human
uccaaaucccauucuguaguc

SEQ ID NO: 348425 - RNA, 22 nt, Human
ugagcccaggaguaugaggcug

SEQ ID NO: 348426 - RNA, 22 nt, Human
caucaucaaaacaaauggaguc

SEQ ID NO: 348427 - RNA, 22 nt, Human
caggcagcgcucguggccuggc

SEQ ID NO: 348428 - RNA, 22 nt, Human
agugcauauaugaagaguauga

SEQ ID NO: 348429 - RNA, 20 nt, Human
gccaggcacuguucucaaua

SEQ ID NO: 348430 - RNA, 22 nt, Human
acaaaguuaacaguuggauagu

SEQ ID NO: 348431 - RNA, 22 nt, Human
aggauuuacaaugauucuaggu

SEQ ID NO: 348432 - RNA, 20 nt, Human
uggagccacagucagguucc

SEQ ID NO: 348433 - RNA, 22 nt, Human
uugaaggaggcuccuuuuuaaa

SEQ ID NO: 348434 - RNA, 23 nt, Human
cagaccuggcagucauccucaac

SEQ ID NO: 348435 - RNA, 22 nt, Human
uugccaggagcucaucugaggg

SEQ ID NO: 348436 - RNA, 20 nt, Human
cugggcugcccagcuauggg

SEQ ID NO: 348437 - RNA, 22 nt, Human
accugccuaguugguucugccc

SEQ ID NO: 348438 - RNA, 22 nt, Human
agggucaggagacacuggcaac

SEQ ID NO: 348439 - RNA, 23 nt, Human
ccugucugugcuggguggacaca

SEQ ID NO: 348440 - RNA, 22 nt, Human
agagccccugguggagugagaa

SEQ ID NO: 348441 - RNA, 22 nt, Human
gaaagguugggugaauggugga

SEQ ID NO: 348442 - RNA, 22 nt, Human
uucucagauauuuacugagcau

SEQ ID NO: 348443 - RNA, 22 nt, Human
gagcugucuggggacucugggu

SEQ ID NO: 348444 - RNA, 22 nt, Human
cuggagcuaauaauccaucuga

SEQ ID NO: 348445 - RNA, 19 nt, Human
aggacccuuauccuggcuu

SEQ ID NO: 348446 - RNA, 22 nt, Human
cacuggaauauggcguugaacc

SEQ ID NO: 348447 - RNA, 22 nt, Human
gagaccaggaaguacagcagcc

SEQ ID NO: 348448 - RNA, 22 nt, Human
ucaucucaaaacccaaggggca

SEQ ID NO: 348449 - RNA, 22 nt, Human
aggcugagcugguagugaguac

SEQ ID NO: 348450 - RNA, 22 nt, Human
uuaauuuucucaucugugaaau

SEQ ID NO: 348451 - RNA, 20 nt, Human
gggagucuggaugaaagaug

SEQ ID NO: 348452 - RNA, 22 nt, Human
aggagagagaacacuugggucc

SEQ ID NO: 348453 - RNA, 22 nt, Human
cuggagccuucaccaggggaaa

SEQ ID NO: 348454 - RNA, 22 nt, Human
ugaaggcccagccacagaaugg

SEQ ID NO: 348455 - RNA, 22 nt, Human
ucccuggaacagagagacaacg

SEQ ID NO: 348456 - RNA, 22 nt, Human
cuggcuuucccuggacaacagc

SEQ ID NO: 348457 - RNA, 22 nt, Human
uguaugugcuugagaagguggg

SEQ ID NO: 348458 - RNA, 22 nt, Human
ggaggaccugcuggcccugcaa

SEQ ID NO: 348459 - RNA, 22 nt, Human
uucaauucuaaacuaauauucu

SEQ ID NO: 348460 - RNA, 22 nt, Human
ccugggagcuguggaaaggcug

SEQ ID NO: 348461 - RNA, 22 nt, Human
uggcagccacaucucguggauu

SEQ ID NO: 348462 - RNA, 22 nt, Human
ugagcccagagcccuuguaggg

SEQ ID NO: 348463 - RNA, 22 nt, Human
uagaacuacaagcauuaaaagu

SEQ ID NO: 348464 - RNA, 22 nt, Human
cugcccuggcagccuaccaugg

SEQ ID NO: 348465 - RNA, 22 nt, Human
ccuuuuucaauauagaauugca

SEQ ID NO: 348466 - RNA, 22 nt, Human
uugaaggacauccuauuucuag

SEQ ID NO: 348467 - RNA, 22 nt, Human
gaggccugggagccuguccucc

SEQ ID NO: 348468 - RNA, 22 nt, Human
gagagcccugcuccuaucccag

SEQ ID NO: 348469 - RNA, 22 nt, Human
acagagaugcaaguguguauuu

SEQ ID NO: 348470 - RNA, 22 nt, Human
ugggugagugggaaaagcccag

SEQ ID NO: 348471 - RNA, 22 nt, Human
aaggugaaacuggaagcuggcc

SEQ ID NO: 348472 - RNA, 22 nt, Human
cagaggcagccgggggagaacg

SEQ ID NO: 348473 - RNA, 22 nt, Human
caaauguguuuuuucuucuaca

SEQ ID NO: 348474 - RNA, 22 nt, Human
uucauugugaacacauucugcc

SEQ ID NO: 348475 - RNA, 22 nt, Human
cagggccauuggcguggcuguc

SEQ ID NO: 348476 - RNA, 21 nt, Human
gcacagcaugaguguuggcau

SEQ ID NO: 348477 - RNA, 22 nt, Human
gcagggcagggcaagaacuggg

SEQ ID NO: 348478 - RNA, 22 nt, Human
cuacagaagaaacuaucacuau

SEQ ID NO: 348479 - RNA, 22 nt, Human
ucaugcuuaaaagacacuugag

SEQ ID NO: 348480 - RNA, 18 nt, Human
cagcugugcccuguuugg

SEQ ID NO: 348481 - RNA, 23 nt, Human
aaccagauaaauggcuccagggc

SEQ ID NO: 348482 - RNA, 22 nt, Human
cugucacacugauaucaggcuu

SEQ ID NO: 348483 - RNA, 19 nt, Human
gguaaaagugagcuucagg

SEQ ID NO: 348484 - RNA, 22 nt, Human
acagggccucagcugauucugg

SEQ ID NO: 348485 - RNA, 22 nt, Human
ccagaauucagaaagggcauaa

SEQ ID NO: 348486 - RNA, 22 nt, Human
gucacacucagaaugacuagag

SEQ ID NO: 348487 - RNA, 22 nt, Human
agcugagcauuugauccaccuc

SEQ ID NO: 348488 - RNA, 22 nt, Human
gcaccugcaggaugagccaggg

SEQ ID NO: 348489 - RNA, 22 nt, Human
uguuucagucccuguguucaau

SEQ ID NO: 348490 - RNA, 22 nt, Human
auguccaguuucuacacacaua

SEQ ID NO: 348491 - RNA, 22 nt, Human
gaggcucagagaagucauggua

SEQ ID NO: 348492 - RNA, 23 nt, Human
gaggcagcuccugcagugcccug

SEQ ID NO: 348493 - RNA, 22 nt, Human
uauuuuaucugccagaguggag

SEQ ID NO: 348494 - RNA, 22 nt, Human
acagagcugggaucugaaccca

SEQ ID NO: 348495 - RNA, 22 nt, Human
uggcccugugugcaggcugcac

SEQ ID NO: 348496 - RNA, 22 nt, Human
gggaccugaggagggguuucag

SEQ ID NO: 348497 - RNA, 22 nt, Human
ggcugggagcuggacaggccgg

SEQ ID NO: 348498 - RNA, 20 nt, Human
uuacagaaaugauguuauuu

SEQ ID NO: 348499 - RNA, 22 nt, Human
ucucuggagggcuccaggcggg

SEQ ID NO: 348500 - RNA, 22 nt, Human
ucagagaaaugaaguagggauu

SEQ ID NO: 348501 - RNA, 22 nt, Human
gcucugugccacaugcaguguu

SEQ ID NO: 348502 - RNA, 16 nt, Human
ugggaccuguggccaa

SEQ ID NO: 348503 - RNA, 22 nt, Human
cuuccugaacaaugccaucaau

SEQ ID NO: 348504 - RNA, 22 nt, Human
ggccugcacagagguggcucua

SEQ ID NO: 348505 - RNA, 22 nt, Human
uaccuuuugcuuauuaugacac

SEQ ID NO: 348506 - RNA, 22 nt, Human
aggaagccugcaggugacugcu

SEQ ID NO: 348507 - RNA, 22 nt, Human
gagggaggggagcuccacccuc

SEQ ID NO: 348508 - RNA, 22 nt, Human
ugaugggaggugcugcaggacc

SEQ ID NO: 348509 - RNA, 22 nt, Human
cccaaggcauggcaugguggca

SEQ ID NO: 348510 - RNA, 22 nt, Human
aaaaacuguaauuacuuuugca

SEQ ID NO: 348511 - RNA, 22 nt, Human
caggcacuagcagaaugaggcu

SEQ ID NO: 348512 - RNA, 22 nt, Human
uagcacaucuggcgcuuauagg

SEQ ID NO: 348513 - RNA, 22 nt, Human
ugagcuggucuugaguguagcu

SEQ ID NO: 348514 - RNA, 22 nt, Human
aagggcaggcagagaucauaua

SEQ ID NO: 348515 - RNA, 22 nt, Human
ucaguuuucauuucaugagcag

SEQ ID NO: 348516 - RNA, 22 nt, Human
cugagagccuccuguuggcuag

SEQ ID NO: 348517 - RNA, 22 nt, Human
uccagucauuuccauuguuccc

SEQ ID NO: 348518 - RNA, 22 nt, Human
ucaucuucuauuaauagggaga

SEQ ID NO: 348519 - RNA, 22 nt, Human
cugaggcagagggcagaccaga

SEQ ID NO: 348520 - RNA, 22 nt, Human
aggcucagcaucugauucauau

SEQ ID NO: 348521 - RNA, 22 nt, Human
gaguccuugacacauaguaggu

SEQ ID NO: 348522 - RNA, 22 nt, Human
cuggggugugcucagagcaggg

SEQ ID NO: 348523 - RNA, 20 nt, Human
uccaggcagcucagaguguc

SEQ ID NO: 348524 - RNA, 22 nt, Human
uuagaaagcuuuccauagucaa

SEQ ID NO: 348525 - RNA, 22 nt, Human
ccugggcauucuuugaguucuc

SEQ ID NO: 348526 - RNA, 22 nt, Human
aggaccugacuggcuccugcuu

SEQ ID NO: 348527 - RNA, 19 nt, Human
aggauuuauuaugugcuca

SEQ ID NO: 348528 - RNA, 22 nt, Human
uggcagagcccagacuccaguc

SEQ ID NO: 348529 - RNA, 22 nt, Human
guacauuuuacuuuguuugaau

SEQ ID NO: 348530 - RNA, 22 nt, Human
ggcgcuggccacgguggcucug

SEQ ID NO: 348531 - RNA, 22 nt, Human
aauagcucacugauuucucuuu

SEQ ID NO: 348532 - RNA, 22 nt, Human
agcugcagucaagcugggccac

SEQ ID NO: 348533 - RNA, 22 nt, Human
agccagaggccagccugccuca

SEQ ID NO: 348534 - RNA, 22 nt, Human
ggaggagcacuucugagcucag

SEQ ID NO: 348535 - RNA, 22 nt, Human
uaaacagaaagcagauguacuu

SEQ ID NO: 348536 - RNA, 22 nt, Human
uugaaaacuuucuagaccaaga

SEQ ID NO: 348537 - RNA, 18 nt, Human
gcagcuagccaggggggc

SEQ ID NO: 348538 - RNA, 21 nt, Human
aggcagaaagagcccaggcug

SEQ ID NO: 348539 - RNA, 22 nt, Human
cccagggaagggcuaccugagg

SEQ ID NO: 348540 - RNA, 22 nt, Human
ucaguuuucucauuuaugagau

SEQ ID NO: 348541 - RNA, 22 nt, Human
accaggcugugaagugagacua

SEQ ID NO: 348542 - RNA, 22 nt, Human
ugcagcugauuaaagggcagac

SEQ ID NO: 348543 - RNA, 22 nt, Human
ucuguucaucucaugggagaau

SEQ ID NO: 348544 - RNA, 22 nt, Human
gcagggucugaggccacagagg

SEQ ID NO: 348545 - RNA, 22 nt, Human
aggcccugcuuuccagagcuca

SEQ ID NO: 348546 - RNA, 22 nt, Human
cacuuagucucaccaguucagu

SEQ ID NO: 348547 - RNA, 22 nt, Human
gcagggcagcugaagcuaggug

SEQ ID NO: 348548 - RNA, 22 nt, Human
gaagcagcagcuggggacaguu

SEQ ID NO: 348549 - RNA, 22 nt, Human
auuucagaugaccaaauggaaa

SEQ ID NO: 348550 - RNA, 22 nt, Human
uuuaggcaugcaguucuauuua

SEQ ID NO: 348551 - RNA, 22 nt, Human
ucaguggagagcuuccaggauu

SEQ ID NO: 348552 - RNA, 22 nt, Human
gccugggugucgaucacuagug

SEQ ID NO: 348553 - RNA, 22 nt, Human
uuauuuaaaauguagguuggga

SEQ ID NO: 348554 - RNA, 22 nt, Human
ccagcugcugugaggaccacag

SEQ ID NO: 348555 - RNA, 22 nt, Human
auacagaauacuaauuccugag

SEQ ID NO: 348556 - RNA, 20 nt, Human
ucagauuuuucuaacuuuga

SEQ ID NO: 348557 - RNA, 22 nt, Human
ccuuccagaguucagucugccc

SEQ ID NO: 348558 - RNA, 22 nt, Human
gagcugucucuauaugaaugcu

SEQ ID NO: 348559 - RNA, 22 nt, Human
ccugcaggggagagacuucuag

SEQ ID NO: 348560 - RNA, 22 nt, Human
gggaggugauggcaagcagcgg

SEQ ID NO: 348561 - RNA, 22 nt, Human
ucccagagcucugacaccagcu

SEQ ID NO: 348562 - RNA, 22 nt, Human
uuauuuaggagaaggaacccug

SEQ ID NO: 348563 - RNA, 22 nt, Human
aggagcagaacuguuguggagg

SEQ ID NO: 348564 - RNA, 22 nt, Human
agcagggcugugcuccuuccga

SEQ ID NO: 348565 - RNA, 22 nt, Human
gauuuacagcuauacccaaugg

SEQ ID NO: 348566 - RNA, 22 nt, Human
uuuaagagcuaguaugucauuu

SEQ ID NO: 348567 - RNA, 22 nt, Human
aggcugagcggggucccagagc

SEQ ID NO: 348568 - RNA, 17 nt, Human
gagugcugguggagcuc

SEQ ID NO: 348569 - RNA, 21 nt, Human
uguucacauggagcagaaugu

SEQ ID NO: 348570 - RNA, 22 nt, Human
gagggaccccaggcuggcccuu

SEQ ID NO: 348571 - RNA, 22 nt, Human
gccagggcaggggagcaucugc

SEQ ID NO: 348572 - RNA, 22 nt, Human
agucauaauuauaaacaucagu

SEQ ID NO: 348573 - RNA, 22 nt, Human
guauuauuggguaguaugguaa

SEQ ID NO: 348574 - RNA, 22 nt, Human
uggcagggccuaccccaauauc

SEQ ID NO: 348575 - RNA, 22 nt, Human
agcccaggaaguugaggcuugc

SEQ ID NO: 348576 - RNA, 22 nt, Human
gaaauuauugcuagagacugca

SEQ ID NO: 348577 - RNA, 22 nt, Human
cggcugugucuucacaggagcc

SEQ ID NO: 348578 - RNA, 22 nt, Human
ggccuuggugccauggccaguu

SEQ ID NO: 348579 - RNA, 22 nt, Human
ucucugaagauauuuauuauua

SEQ ID NO: 348580 - RNA, 22 nt, Human
uugugcaauuuaaaaucuuccu

SEQ ID NO: 348581 - RNA, 22 nt, Human
acagagaaagugggcugaagau

SEQ ID NO: 348582 - RNA, 22 nt, Human
cuggguggaucgcagccccagg

SEQ ID NO: 348583 - RNA, 22 nt, Human
uugcacuaggaaaaggcagcca

SEQ ID NO: 348584 - RNA, 22 nt, Human
ugggcacuguagcuggugcugg

SEQ ID NO: 348585 - RNA, 22 nt, Human
gggcagguguuuccaaggugag

SEQ ID NO: 348586 - RNA, 22 nt, Human
gcuugcuggugccugcaggcuc

SEQ ID NO: 348587 - RNA, 22 nt, Human
caagauggagaagcagcaaggg

SEQ ID NO: 348588 - RNA, 22 nt, Human
gccuggaguuguggugaagcca

SEQ ID NO: 348589 - RNA, 22 nt, Human
ggccagggccuggggacugucc

SEQ ID NO: 348590 - RNA, 20 nt, Human
gcugccuuguccugcuuggu

SEQ ID NO: 348591 - RNA, 22 nt, Human
gagccagcugagcugcacuguc

SEQ ID NO: 348592 - RNA, 22 nt, Human
uauuaggguaaauuugacaugc

SEQ ID NO: 348593 - RNA, 22 nt, Human
ucaggggaaaucucucagcgaa

SEQ ID NO: 348594 - RNA, 22 nt, Human
cagcaggaggcauggcuucccu

SEQ ID NO: 348595 - RNA, 22 nt, Human
ggcuggguuauuuauggccaag

SEQ ID NO: 348596 - RNA, 22 nt, Human
gacuucaaaggucaaacaucgc

SEQ ID NO: 348597 - RNA, 22 nt, Human
gagagucacugucugcauuucc

SEQ ID NO: 348598 - RNA, 22 nt, Human
guuaaagaagaauaguuccuuu

SEQ ID NO: 348599 - RNA, 22 nt, Human
cuggccagaguuggagggugug

SEQ ID NO: 348600 - RNA, 22 nt, Human
uuacaagugucagguacuggca

SEQ ID NO: 348601 - RNA, 22 nt, Human
aucaggaucugcaucauaagaa

SEQ ID NO: 348602 - RNA, 22 nt, Human
aaucagaauuuauugaaucuuu

SEQ ID NO: 348603 - RNA, 22 nt, Human
aggcucaguucacgucaacuuu

SEQ ID NO: 348604 - RNA, 22 nt, Human
aaggcugaggagggccugcagg

SEQ ID NO: 348605 - RNA, 22 nt, Human
acacaugagaaacaucaguugu

SEQ ID NO: 348606 - RNA, 22 nt, Human
auuccaaagccugaauaaugga

SEQ ID NO: 348607 - RNA, 22 nt, Human
gcuguggcuguacagagaccau

SEQ ID NO: 348608 - RNA, 22 nt, Human
cacugcuuucacaguuuguucc

SEQ ID NO: 348609 - RNA, 22 nt, Human
uauauucaaugauuaguaucag

SEQ ID NO: 348610 - RNA, 22 nt, Human
gcagcugcuggagggaggcagg

SEQ ID NO: 348611 - RNA, 22 nt, Human
agcugccacauggugucacugu

SEQ ID NO: 348612 - RNA, 22 nt, Human
aggcacugugcagucccaagca

SEQ ID NO: 348613 - RNA, 22 nt, Human
cagacagaaggcuccuugaggu

SEQ ID NO: 348614 - RNA, 23 nt, Human
uccaggagaaccccugucugucc

SEQ ID NO: 348615 - RNA, 22 nt, Human
ucuguucaagacugaggugaca

SEQ ID NO: 348616 - RNA, 22 nt, Human
uuggcuuccaggaucucagcag

SEQ ID NO: 348617 - RNA, 22 nt, Human
caguuucuucaucaguuaagca

SEQ ID NO: 348618 - RNA, 22 nt, Human
cucuccuugcagauggcugccu

SEQ ID NO: 348619 - RNA, 23 nt, Human
cucugcaggagagugggcagggc

SEQ ID NO: 348620 - RNA, 22 nt, Human
uggcccugcuaugauccugcaa

SEQ ID NO: 348621 - RNA, 22 nt, Human
uacauaguauucacauuguuuu

SEQ ID NO: 348622 - RNA, 22 nt, Human
uuccaugaaagugaaauggagc

SEQ ID NO: 348623 - RNA, 22 nt, Human
gcucccaccuuugcuaucagua

SEQ ID NO: 348624 - RNA, 22 nt, Human
uagcagggaagaugaucagaau

SEQ ID NO: 348625 - RNA, 22 nt, Human
ugcagaaggccugacauugcac

SEQ ID NO: 348626 - RNA, 22 nt, Human
cccaugagguggagguugcagu

SEQ ID NO: 348627 - RNA, 22 nt, Human
cucugcuuggaacuggacagaa

SEQ ID NO: 348628 - RNA, 22 nt, Human
gacagccaugcacuucugcugu

SEQ ID NO: 348629 - RNA, 22 nt, Human
ggcagcucacugauuagcaauu

SEQ ID NO: 348630 - RNA, 22 nt, Human
uacauucuggaaaggcacagac

SEQ ID NO: 348631 - RNA, 22 nt, Human
ugagcuucaaaauaugugaauc

SEQ ID NO: 348632 - RNA, 22 nt, Human
uccugagagcagcugcuuugga

SEQ ID NO: 348633 - RNA, 19 nt, Human
cuugguuaugguaugaugc

SEQ ID NO: 348634 - RNA, 22 nt, Human
aaggcacucagccuugggacag

SEQ ID NO: 348635 - RNA, 21 nt, Human
cccaggaggcugagaagagca

SEQ ID NO: 348636 - RNA, 22 nt, Human
cagccuguagaauacaguaaau

SEQ ID NO: 348637 - RNA, 22 nt, Human
agcaugaagacuucagagcuag

SEQ ID NO: 348638 - RNA, 22 nt, Human
acuuugcagagccagaagagaa

SEQ ID NO: 348639 - RNA, 22 nt, Human
gcagcaggcuuuucauaccuug

SEQ ID NO: 348640 - RNA, 22 nt, Human
agucucagaaaauaugcuuuuu

SEQ ID NO: 348641 - RNA, 22 nt, Human
uugcuuccucgaggccagcgug

SEQ ID NO: 348642 - RNA, 22 nt, Human
acccaggggcagccuugcugug

SEQ ID NO: 348643 - RNA, 22 nt, Human
agccucucugaugugacagcua

SEQ ID NO: 348644 - RNA, 22 nt, Human
aaggcagcaagaauuccagguu

SEQ ID NO: 348645 - RNA, 18 nt, Human
gcagcugcaguuguagcu

SEQ ID NO: 348646 - RNA, 22 nt, Human
accaggcuggagugcaguggcg

SEQ ID NO: 348647 - RNA, 22 nt, Human
caguggcaugguugacugcagu

SEQ ID NO: 348648 - RNA, 22 nt, Human
acagaccaaaaaaggauauugg

SEQ ID NO: 348649 - RNA, 21 nt, Human
uuguucuuccagaagcaaagu

SEQ ID NO: 348650 - RNA, 22 nt, Human
uccagugguuugaaaggggugu

SEQ ID NO: 348651 - RNA, 22 nt, Human
uguguccuucugggagucccag

SEQ ID NO: 348652 - RNA, 22 nt, Human
aggauuuaaauccuuaaccacu

SEQ ID NO: 348653 - RNA, 22 nt, Human
gugugccaccagucaaggugaa

SEQ ID NO: 348654 - RNA, 22 nt, Human
uuguaacaaucugucauaaaug

SEQ ID NO: 348655 - RNA, 22 nt, Human
aggaaacuccccuacaucucaa

SEQ ID NO: 348656 - RNA, 22 nt, Human
ucagcuuggacagcuugguuga

SEQ ID NO: 348657 - RNA, 19 nt, Human
ggagccuggagcacgugcc

SEQ ID NO: 348658 - RNA, 22 nt, Human
gucuauauauugcuugaauaau

SEQ ID NO: 348659 - RNA, 22 nt, Human
ugcagggcuauaacuccauucu

SEQ ID NO: 348660 - RNA, 22 nt, Human
uggagucugugaugcucugggu

SEQ ID NO: 348661 - RNA, 22 nt, Human
agauggggcugaaaguuccaau

SEQ ID NO: 348662 - RNA, 22 nt, Human
auuuagaaguuggagggcaaga

SEQ ID NO: 348663 - RNA, 22 nt, Human
agccaggccuuuucucaagguu

SEQ ID NO: 348664 - RNA, 22 nt, Human
cugcuuugacuguuaagaacca

SEQ ID NO: 348665 - RNA, 22 nt, Human
cacauuugaaggaauuagcauu

SEQ ID NO: 348666 - RNA, 22 nt, Human
acagcuguauccccagagcuca

SEQ ID NO: 348667 - RNA, 22 nt, Human
uuaugcaacaggugagcagaca

SEQ ID NO: 348668 - RNA, 23 nt, Human
uagggcagcugggagggacaugc

SEQ ID NO: 348669 - RNA, 22 nt, Human
ucuuuccauggccacacagucu

SEQ ID NO: 348670 - RNA, 22 nt, Human
agaagccagcuucagcugcccg

SEQ ID NO: 348671 - RNA, 22 nt, Human
gucaaauauacuaagagguaaa

SEQ ID NO: 348672 - RNA, 22 nt, Human
gcugcagcaagcccuccagggg

SEQ ID NO: 348673 - RNA, 22 nt, Human
ggcucugcagugacuugagggg

SEQ ID NO: 348674 - RNA, 22 nt, Human
aagaauguucauuaaacuguug

SEQ ID NO: 348675 - RNA, 22 nt, Human
aaugggauaauuguucauggga

SEQ ID NO: 348676 - RNA, 22 nt, Human
cagcaagauuuuuaaagcaagg

SEQ ID NO: 348677 - RNA, 22 nt, Human
cagcugagucugagguucuuug

SEQ ID NO: 348678 - RNA, 19 nt, Human
ccaggccuggcgucuccgc

SEQ ID NO: 348679 - RNA, 22 nt, Human
aggagagcuggugucuggaauc

SEQ ID NO: 348680 - RNA, 22 nt, Human
ggccugcuauuggugggcagac

SEQ ID NO: 348681 - RNA, 22 nt, Human
uuuaggcagaacauggacuuug

SEQ ID NO: 348682 - RNA, 22 nt, Human
ggaggcuccacugcucuuccug

SEQ ID NO: 348683 - RNA, 22 nt, Human
guacucucuugaaggccuuucu

SEQ ID NO: 348684 - RNA, 22 nt, Human
uggcucagccagcccuaggaac

SEQ ID NO: 348685 - RNA, 22 nt, Human
ggugggcaacauuuggccugag

SEQ ID NO: 348686 - RNA, 21 nt, Human
cuggacugaggagacagucgc

SEQ ID NO: 348687 - RNA, 22 nt, Human
uuccuccacgugacaggagcca

SEQ ID NO: 348688 - RNA, 20 nt, Human
uuccuguauacaaagaguuc

SEQ ID NO: 348689 - RNA, 22 nt, Human
ggcucagguuuccuucccagcu

SEQ ID NO: 348690 - RNA, 22 nt, Human
gcccagcaggacagagugguuu

SEQ ID NO: 348691 - RNA, 22 nt, Human
ugaaugaaugaauuaauagagu

SEQ ID NO: 348692 - RNA, 22 nt, Human
acuagaaacuaauggauuauua

SEQ ID NO: 348693 - RNA, 22 nt, Human
aggaagcucggagagggcaaau

SEQ ID NO: 348694 - RNA, 22 nt, Human
uagcacauacauaauagauaga

SEQ ID NO: 348695 - RNA, 17 nt, Human
gcauccaguaacaugcc

SEQ ID NO: 348696 - RNA, 21 nt, Human
uucaaugaaaacaaagugagg

SEQ ID NO: 348697 - RNA, 22 nt, Human
cagcuagcuaagaaggccagag

SEQ ID NO: 348698 - RNA, 22 nt, Human
agccuggagaggcgccauacac

SEQ ID NO: 348699 - RNA, 17 nt, Human
agcagcuggguugaucu

SEQ ID NO: 348700 - RNA, 22 nt, Human
gcaugugucuccccaguggagg

SEQ ID NO: 348701 - RNA, 22 nt, Human
ugaacaacugcaaaaaucucca

SEQ ID NO: 348702 - RNA, 22 nt, Human
aagccagguuccauggaggagc

SEQ ID NO: 348703 - RNA, 22 nt, Human
ucugagaggcagaccuuccuaa

SEQ ID NO: 348704 - RNA, 22 nt, Human
auccuugagccuuaucuuuugu

SEQ ID NO: 348705 - RNA, 22 nt, Human
uccagacccaugacccugggga

SEQ ID NO: 348706 - RNA, 22 nt, Human
uuuguaaaggccugaauuucag

SEQ ID NO: 348707 - RNA, 22 nt, Human
cagugaaaucacaacuuuaguu

SEQ ID NO: 348708 - RNA, 22 nt, Human
gaauucugguuuugaaaugaau

SEQ ID NO: 348709 - RNA, 22 nt, Human
agugcccuggcccagcuggacc

SEQ ID NO: 348710 - RNA, 22 nt, Human
uggggcugucccgguuuggcga

SEQ ID NO: 348711 - RNA, 19 nt, Human
cuguccuuggcugcacugu

SEQ ID NO: 348712 - RNA, 22 nt, Human
auuuagaacuuuguuugccaau

SEQ ID NO: 348713 - RNA, 19 nt, Human
caagugaagccugggaugg

SEQ ID NO: 348714 - RNA, 22 nt, Human
ucuggaucaccacuucugccuc

SEQ ID NO: 348715 - RNA, 22 nt, Human
gccuggaggggacagucucugg

SEQ ID NO: 348716 - RNA, 22 nt, Human
gccaagagaaugugagagaaau

SEQ ID NO: 348717 - RNA, 22 nt, Human
gcagggacagggcagggccuuu

SEQ ID NO: 348718 - RNA, 22 nt, Human
aauaucagcacuuuugugguau

SEQ ID NO: 348719 - RNA, 22 nt, Human
ggaugcuggggaccaaucucug

SEQ ID NO: 348720 - RNA, 22 nt, Human
ugagcccaggaguuggaggcug

SEQ ID NO: 348721 - RNA, 22 nt, Human
ccaaaugcuccacugacuuugg

SEQ ID NO: 348722 - RNA, 22 nt, Human
caucagaauagcucuguggaua

SEQ ID NO: 348723 - RNA, 22 nt, Human
uucauucccuuauauuagcauu

SEQ ID NO: 348724 - RNA, 22 nt, Human
agcagccauccuuagagaaaga

SEQ ID NO: 348725 - RNA, 22 nt, Human
ggggaugguggcauuuguaaaa

SEQ ID NO: 348726 - RNA, 22 nt, Human
ccaaggagcugcaggcacuugu

SEQ ID NO: 348727 - RNA, 22 nt, Human
cuggcagcucugagucccuucu

SEQ ID NO: 348728 - RNA, 22 nt, Human
uuccaugagcucugaguucaca

SEQ ID NO: 348729 - RNA, 22 nt, Human
ugaggccaggaucccaggcucu

SEQ ID NO: 348730 - RNA, 22 nt, Human
gcugauuauuacaugucugugg

SEQ ID NO: 348731 - RNA, 22 nt, Human
ucccagccacagguguagcccu

SEQ ID NO: 348732 - RNA, 22 nt, Human
cuuaaauuggaugaguuaaguu

SEQ ID NO: 348733 - RNA, 22 nt, Human
ggcagugaugucaaacagugaa

SEQ ID NO: 348734 - RNA, 22 nt, Human
uucuuuaaaauagugagaaaga

SEQ ID NO: 348735 - RNA, 22 nt, Human
caaaugcaggucagcagguguc

SEQ ID NO: 348736 - RNA, 17 nt, Human
cugucugcgcaugaggu

SEQ ID NO: 348737 - RNA, 22 nt, Human
cgcauacauagaaacacacaga

SEQ ID NO: 348738 - RNA, 22 nt, Human
acagcuguggggacucuugccc

SEQ ID NO: 348739 - RNA, 22 nt, Human
cucuggcuucuaccuugcaguu

SEQ ID NO: 348740 - RNA, 22 nt, Human
ugcaaacaggagaguaaguaua

SEQ ID NO: 348741 - RNA, 22 nt, Human
aauuaauggaaaguaaggaagg

SEQ ID NO: 348742 - RNA, 22 nt, Human
gcuggggagcaagaguagugag

SEQ ID NO: 348743 - RNA, 22 nt, Human
uacugccuggagcauuggugcu

SEQ ID NO: 348744 - RNA, 19 nt, Human
ggcugucucggcccagcca

SEQ ID NO: 348745 - RNA, 22 nt, Human
ugcaggcuuuagccccauggcu

SEQ ID NO: 348746 - RNA, 17 nt, Human
ugagaaguaggcaucau

SEQ ID NO: 348747 - RNA, 22 nt, Human
ccagcagagcauggggaggaag

SEQ ID NO: 348748 - RNA, 19 nt, Human
agcuccugggcucugggcc

SEQ ID NO: 348749 - RNA, 22 nt, Human
uauuuaaaaagaggccagcugg

SEQ ID NO: 348750 - RNA, 22 nt, Human
auugacaaucuacuauguucug

SEQ ID NO: 348751 - RNA, 22 nt, Human
gcccaugcacuuucugugaugg

SEQ ID NO: 348752 - RNA, 22 nt, Human
gagacugauggggcucccagaa

SEQ ID NO: 348753 - RNA, 22 nt, Human
agggcuggcaucucuaaugcug

SEQ ID NO: 348754 - RNA, 22 nt, Human
ccaaugauggugcccacgauga

SEQ ID NO: 348755 - RNA, 19 nt, Human
caugagcugcucacuuccc

SEQ ID NO: 348756 - RNA, 22 nt, Human
cuacauuuuucaccgagccucu

SEQ ID NO: 348757 - RNA, 22 nt, Human
cucagcccagcccaggaccagg

SEQ ID NO: 348758 - RNA, 22 nt, Human
ggaugcugggagacagcaggca

SEQ ID NO: 348759 - RNA, 22 nt, Human
gcagccugaggcccuuucuggc

SEQ ID NO: 348760 - RNA, 22 nt, Human
guacauuucucuuguucuuauu

SEQ ID NO: 348761 - RNA, 22 nt, Human
uuucuuaggcucuaaaaugacu

SEQ ID NO: 348762 - RNA, 18 nt, Human
ccuggaccugucuccuuu

SEQ ID NO: 348763 - RNA, 22 nt, Human
gcagaggaucaggcucuggaaa

SEQ ID NO: 348764 - RNA, 22 nt, Human
ggcagcugagcauggcuaccuu

SEQ ID NO: 348765 - RNA, 22 nt, Human
cuggccugagcacagcggcugc

SEQ ID NO: 348766 - RNA, 18 nt, Human
agugugugcccuuucagg

SEQ ID NO: 348767 - RNA, 23 nt, Human
ugauuuccagugagucaguggga

SEQ ID NO: 348768 - RNA, 22 nt, Human
gaguucuaaaggcagaacauaa

SEQ ID NO: 348769 - RNA, 22 nt, Human
uuccuuguuuguagcucuggga

SEQ ID NO: 348770 - RNA, 22 nt, Human
aaagcaaucagauucagauguc

SEQ ID NO: 348771 - RNA, 22 nt, Human
gugcauuugugcaugcacaugu

SEQ ID NO: 348772 - RNA, 22 nt, Human
ucuuuccuuagaauaauucuuu

SEQ ID NO: 348773 - RNA, 21 nt, Human
gacaggggaagaagcaaggag

SEQ ID NO: 348774 - RNA, 19 nt, Human
cagagcagugguuccugaa

SEQ ID NO: 348775 - RNA, 22 nt, Human
gaucauuugcaggaaacauuaa

SEQ ID NO: 348776 - RNA, 22 nt, Human
ucagcaguguaguuuaucauuc

SEQ ID NO: 348777 - RNA, 22 nt, Human
uggcucaggcuugaaaauagau

SEQ ID NO: 348778 - RNA, 22 nt, Human
ggcucugggucuguggggagcg

SEQ ID NO: 348779 - RNA, 22 nt, Human
gcaaaggccacuggggcgaugg

SEQ ID NO: 348780 - RNA, 22 nt, Human
guuaauaaagguauagaaucag

SEQ ID NO: 348781 - RNA, 22 nt, Human
gaggccugucgcuaggccucug

SEQ ID NO: 348782 - RNA, 21 nt, Human
gccagagcaguacaaugaggu

SEQ ID NO: 348783 - RNA, 22 nt, Human
acauuucugcuagaauagguga

SEQ ID NO: 348784 - RNA, 22 nt, Human
cucagaauuacaucccauuuua

SEQ ID NO: 348785 - RNA, 22 nt, Human
ugggagcaagcuggugcuggag

SEQ ID NO: 348786 - RNA, 22 nt, Human
cuuuccaaugucacuaugaauc

SEQ ID NO: 348787 - RNA, 22 nt, Human
cuuucacaguccugacugagcg

SEQ ID NO: 348788 - RNA, 15 nt, Human
ugggcagaucacuug

SEQ ID NO: 348789 - RNA, 22 nt, Human
ccuccaguacuccaguccagcg

SEQ ID NO: 348790 - RNA, 22 nt, Human
ugaggugaccgcagaugggaag

SEQ ID NO: 348791 - RNA, 22 nt, Human
ugaaagcacucacuucugcucu

SEQ ID NO: 348792 - RNA, 22 nt, Human
gagcagcucugggugacccagu

SEQ ID NO: 348793 - RNA, 22 nt, Human
cagcugacagugaggugggggc

SEQ ID NO: 348794 - RNA, 22 nt, Human
agggcagaaguacagacacuua

SEQ ID NO: 348795 - RNA, 20 nt, Human
ugggagcuggugaggucuca

SEQ ID NO: 348796 - RNA, 22 nt, Human
ggaggccaaggcaggcggauca

SEQ ID NO: 348797 - RNA, 19 nt, Human
cugaagucuuuucagcugg

SEQ ID NO: 348798 - RNA, 17 nt, Human
ucuuuccugccaugcuc

SEQ ID NO: 348799 - RNA, 22 nt, Human
uucuuuugggaauuacguaugc

SEQ ID NO: 348800 - RNA, 22 nt, Human
uuaguaauguguuaauaugaau

SEQ ID NO: 348801 - RNA, 22 nt, Human
cuugauguauaaguugauaugu

SEQ ID NO: 348802 - RNA, 22 nt, Human
aaggcagcagaggaaaggugcu

SEQ ID NO: 348803 - RNA, 22 nt, Human
ucucagggagggcgagucagcg

SEQ ID NO: 348804 - RNA, 22 nt, Human
agcagccaguucucugugguag

SEQ ID NO: 348805 - RNA, 22 nt, Human
aucuggcucgcuaggcucuggg

SEQ ID NO: 348806 - RNA, 22 nt, Human
uacuuuagaaggaaauaaguuc

SEQ ID NO: 348807 - RNA, 22 nt, Human
ucacauuuuaucuauuuuaagu

SEQ ID NO: 348808 - RNA, 22 nt, Human
cagcaggcucugaguggcugcc

SEQ ID NO: 348809 - RNA, 22 nt, Human
uuucuguaaguggcaaauaaug

SEQ ID NO: 348810 - RNA, 22 nt, Human
caggcagccuucucgucucaca

SEQ ID NO: 348811 - RNA, 22 nt, Human
gccaccagguuagauccagccu

SEQ ID NO: 348812 - RNA, 22 nt, Human
uuugggaacucuaucauggaaa

SEQ ID NO: 348813 - RNA, 21 nt, Human
ggccucugccuugccccacuc

SEQ ID NO: 348814 - RNA, 22 nt, Human
caucagucuagauucuaguacc

SEQ ID NO: 348815 - RNA, 22 nt, Human
agccucugguccucccucagcu

SEQ ID NO: 348816 - RNA, 22 nt, Human
acacaggagauauguaauggcu

SEQ ID NO: 348817 - RNA, 22 nt, Human
uacaguuuguuacauuguuagu

SEQ ID NO: 348818 - RNA, 16 nt, Human
ccuggauccccugugg

SEQ ID NO: 348819 - RNA, 22 nt, Human
ucacauacacuaggauauuuuu

SEQ ID NO: 348820 - RNA, 22 nt, Human
caaggccaguuucuccuaguca

SEQ ID NO: 348821 - RNA, 22 nt, Human
auuccaaagcacaucagaacua

SEQ ID NO: 348822 - RNA, 21 nt, Human
ggcuccugcuuugugaggggc

SEQ ID NO: 348823 - RNA, 22 nt, Human
caugguuuugagccuauuaugc

SEQ ID NO: 348824 - RNA, 22 nt, Human
acaaaggugcgucccuucagcu

SEQ ID NO: 348825 - RNA, 22 nt, Human
cucugaccauucccuugauuuu

SEQ ID NO: 348826 - RNA, 22 nt, Human
uuggagguuugaaaauaugugu

SEQ ID NO: 348827 - RNA, 22 nt, Human
gauuucaauccagcuuucuucu

SEQ ID NO: 348828 - RNA, 22 nt, Human
ugucccuggaacuauggcucca

SEQ ID NO: 348829 - RNA, 22 nt, Human
ugucucugccagcuagcagaau

SEQ ID NO: 348830 - RNA, 22 nt, Human
ggaggggagguccagcugaucu

SEQ ID NO: 348831 - RNA, 22 nt, Human
gguuugcacgauauuuccaugg

SEQ ID NO: 348832 - RNA, 23 nt, Human
acacaauagaguacuauucagcc

SEQ ID NO: 348833 - RNA, 22 nt, Human
cccaggaggcagagguugcagu

SEQ ID NO: 348834 - RNA, 22 nt, Human
gggcugcugcugccagcgacac

SEQ ID NO: 348835 - RNA, 22 nt, Human
ucagcuuugcaaguuagaaaau

SEQ ID NO: 348836 - RNA, 19 nt, Human
accaggaguaucagagcug

SEQ ID NO: 348837 - RNA, 22 nt, Human
ggccagagagcagccaggauuc

SEQ ID NO: 348838 - RNA, 22 nt, Human
aacauuggauauuuauuaaaag

SEQ ID NO: 348839 - RNA, 22 nt, Human
uagggauguaaacauaguaauu

SEQ ID NO: 348840 - RNA, 22 nt, Human
uccaggacuagcauuucugaua

SEQ ID NO: 348841 - RNA, 22 nt, Human
aaguuacacauuuucauuguaa

SEQ ID NO: 348842 - RNA, 22 nt, Human
ccugucuguaucgguucagagu

SEQ ID NO: 348843 - RNA, 22 nt, Human
uacuuacagagcuuauaaguua

SEQ ID NO: 348844 - RNA, 22 nt, Human
aaaugaccagaauacaggcuuc

SEQ ID NO: 348845 - RNA, 23 nt, Human
uggauaaagcugugcugcauagg

SEQ ID NO: 348846 - RNA, 22 nt, Human
agggcugacacaccuuauccuc

SEQ ID NO: 348847 - RNA, 22 nt, Human
cagggacaugacuggucucugu

SEQ ID NO: 348848 - RNA, 22 nt, Human
cugcccaggcugaaggaacauc

SEQ ID NO: 348849 - RNA, 22 nt, Human
agcugccacugagggugcacag

SEQ ID NO: 348850 - RNA, 22 nt, Human
augugcaugcacuuacaugugu

SEQ ID NO: 348851 - RNA, 22 nt, Human
agggacagaugaaugacugagu

SEQ ID NO: 348852 - RNA, 22 nt, Human
aaagccauuacaaaauuucaua

SEQ ID NO: 348853 - RNA, 22 nt, Human
uaggaggguuagagggaaauau

SEQ ID NO: 348854 - RNA, 22 nt, Human
aaccccgcucaggcugggugag

SEQ ID NO: 348855 - RNA, 22 nt, Human
ggaagggcaaaagagaugaacu

SEQ ID NO: 348856 - RNA, 22 nt, Human
uuugaagauaaauauggagaaa

SEQ ID NO: 348857 - RNA, 22 nt, Human
ggcucaggccagaccacgacuc

SEQ ID NO: 348858 - RNA, 18 nt, Human
gagguccugcucuagccc

SEQ ID NO: 348859 - RNA, 22 nt, Human
ugaggcaggaaguuauauaaug

SEQ ID NO: 348860 - RNA, 22 nt, Human
gaguccuuccagcaggcauuua

SEQ ID NO: 348861 - RNA, 22 nt, Human
ucauaaaaauagacucuaaagu

SEQ ID NO: 348862 - RNA, 22 nt, Human
aucagagaaguuucacuggcau

SEQ ID NO: 348863 - RNA, 19 nt, Human
uuucagacucaucuccagc

SEQ ID NO: 348864 - RNA, 23 nt, Human
accaggaguugucucaggaaaca

SEQ ID NO: 348865 - RNA, 22 nt, Human
gagcagcuuaugucaagccaga

SEQ ID NO: 348866 - RNA, 22 nt, Human
cagcugucuaaguugagcagga

SEQ ID NO: 348867 - RNA, 22 nt, Human
aagaaauuaaugugccauuacu

SEQ ID NO: 348868 - RNA, 22 nt, Human
ggcuuccuggagaaggucugag

SEQ ID NO: 348869 - RNA, 22 nt, Human
cagggcugagaauuuagagaca

SEQ ID NO: 348870 - RNA, 22 nt, Human
cagcuggcagaaccugcaucca

SEQ ID NO: 348871 - RNA, 22 nt, Human
uuuaauuuuccucuuccuggag

SEQ ID NO: 348872 - RNA, 22 nt, Human
acuuccaaauaccaucacauug

SEQ ID NO: 348873 - RNA, 22 nt, Human
cgaggcagaggcugaaacggcu

SEQ ID NO: 348874 - RNA, 22 nt, Human
gccuggcuccuaaggacuggcu

SEQ ID NO: 348875 - RNA, 22 nt, Human
gagguggguguaucacagguca

SEQ ID NO: 348876 - RNA, 22 nt, Human
ugaggcagcaauugauuauuca

SEQ ID NO: 348877 - RNA, 22 nt, Human
uuuuauuggagugauaccaagc

SEQ ID NO: 348878 - RNA, 22 nt, Human
auccucaguguuucugacaucu

SEQ ID NO: 348879 - RNA, 22 nt, Human
agccagugcaacagcagugaag

SEQ ID NO: 348880 - RNA, 22 nt, Human
agagcuggccagggaucacucu

SEQ ID NO: 348881 - RNA, 22 nt, Human
uaacaagucauuuuaaauuaug

SEQ ID NO: 348882 - RNA, 22 nt, Human
uugaagauggaucgccacucuc

SEQ ID NO: 348883 - RNA, 22 nt, Human
aauuucaauuacuuuugcacca

SEQ ID NO: 348884 - RNA, 20 nt, Human
aucaggauucuugcuuuguu

SEQ ID NO: 348885 - RNA, 22 nt, Human
acauacauauguuuaaaugcau

SEQ ID NO: 348886 - RNA, 21 nt, Human
ccuggccaaucugauaggguu

SEQ ID NO: 348887 - RNA, 22 nt, Human
uaaguuuucuggaauaacuugg

SEQ ID NO: 348888 - RNA, 22 nt, Human
uucagugucaauuuuuaaauau

SEQ ID NO: 348889 - RNA, 22 nt, Human
gugccugcagcaauccauggca

SEQ ID NO: 348890 - RNA, 22 nt, Human
caggaggcagagguugcagcga

SEQ ID NO: 348891 - RNA, 22 nt, Human
gcaaggaccuuugagcgugcca

SEQ ID NO: 348892 - RNA, 22 nt, Human
ugcccaggcuccucgcagccuu

SEQ ID NO: 348893 - RNA, 22 nt, Human
aggaggccgauuucagaggucg

SEQ ID NO: 348894 - RNA, 22 nt, Human
uucuaguguccuuggacuugcu

SEQ ID NO: 348895 - RNA, 22 nt, Human
cccagcaggcauguugggagga

SEQ ID NO: 348896 - RNA, 22 nt, Human
uagggcucagaguccaguuucu

SEQ ID NO: 348897 - RNA, 22 nt, Human
uaaguccuaauggcagaagucu

SEQ ID NO: 348898 - RNA, 22 nt, Human
agaggucagaacaggaaagugu

SEQ ID NO: 348899 - RNA, 22 nt, Human
ugcacccucaucagucaaaugg

SEQ ID NO: 348900 - RNA, 22 nt, Human
caccaggugcuggaggacauca

SEQ ID NO: 348901 - RNA, 22 nt, Human
ggugggcacauucagucucugu

SEQ ID NO: 348902 - RNA, 19 nt, Human
ccaggagagcuuggagaag

SEQ ID NO: 348903 - RNA, 22 nt, Human
agagcugggugaagugccauca

SEQ ID NO: 348904 - RNA, 22 nt, Human
uaaaugagggcugacaugauug

SEQ ID NO: 348905 - RNA, 22 nt, Human
aggaugaauaacugaaauggug

SEQ ID NO: 348906 - RNA, 22 nt, Human
cuggaagugggguuggcuugaa

SEQ ID NO: 348907 - RNA, 22 nt, Human
cauagaaacugagacaaggauu

SEQ ID NO: 348908 - RNA, 22 nt, Human
gccaccagccccaugcgcugug

SEQ ID NO: 348909 - RNA, 22 nt, Human
aggggcugggacagagccaagc

SEQ ID NO: 348910 - RNA, 19 nt, Human
gcgaggaagucacuguggu

SEQ ID NO: 348911 - RNA, 22 nt, Human
ggcagcucaccucugguccagg

SEQ ID NO: 348912 - RNA, 22 nt, Human
ugcagcuucuuguccugugauu

SEQ ID NO: 348913 - RNA, 22 nt, Human
gcugccugaagugucuacacug

SEQ ID NO: 348914 - RNA, 22 nt, Human
aguauaauuagauaucaaaagu

SEQ ID NO: 348915 - RNA, 22 nt, Human
aauguguacaugacagauagaa

SEQ ID NO: 348916 - RNA, 22 nt, Human
uugaagcaugguacuuguucaa

SEQ ID NO: 348917 - RNA, 17 nt, Human
cucacggaggaugaauc

SEQ ID NO: 348918 - RNA, 22 nt, Human
ggugggcaggucacucugccuc

SEQ ID NO: 348919 - RNA, 22 nt, Human
cagcuggggcagccacgugcgg

SEQ ID NO: 348920 - RNA, 22 nt, Human
guuugcauuucuugaacuauau

SEQ ID NO: 348921 - RNA, 19 nt, Human
gcugcuggcucuggcugga

SEQ ID NO: 348922 - RNA, 22 nt, Human
agggaucaaaaaauguacaugc

SEQ ID NO: 348923 - RNA, 22 nt, Human
aagcuuuaugacuuggagacag

SEQ ID NO: 348924 - RNA, 22 nt, Human
uaccuugggguuuuguugcucu

SEQ ID NO: 348925 - RNA, 22 nt, Human
guagaaauauuuaucucugaga

SEQ ID NO: 348926 - RNA, 20 nt, Human
ccaggcacugucccaugcag

SEQ ID NO: 348927 - RNA, 22 nt, Human
gaaccaaguaggauacaaggag

SEQ ID NO: 348928 - RNA, 22 nt, Human
gaaggagagagacaucgucccu

SEQ ID NO: 348929 - RNA, 21 nt, Human
ggcuuuaugcucacccagccu

SEQ ID NO: 348930 - RNA, 22 nt, Human
cccaggaaagagacugcugggu

SEQ ID NO: 348931 - RNA, 22 nt, Human
cagaggaagagauacaagcccu

SEQ ID NO: 348932 - RNA, 22 nt, Human
ccuuuggguucaaucucggucu

SEQ ID NO: 348933 - RNA, 22 nt, Human
uggagcugaacuuugaggccag

SEQ ID NO: 348934 - RNA, 22 nt, Human
uggcugcuagccagagcuucag

SEQ ID NO: 348935 - RNA, 22 nt, Human
uagcaucuggagaaacaagucc

SEQ ID NO: 348936 - RNA, 22 nt, Human
cucaggaucgcuugcccuaggg

SEQ ID NO: 348937 - RNA, 22 nt, Human
ggagcagccacgucucagggca

SEQ ID NO: 348938 - RNA, 22 nt, Human
aaaguccuuuuugccaugcaag

SEQ ID NO: 348939 - RNA, 20 nt, Human
cugcucugcuuugcaggugg

SEQ ID NO: 348940 - RNA, 20 nt, Human
agcagcuguguuuucauccu

SEQ ID NO: 348941 - RNA, 22 nt, Human
ccuuccuggagcccaugcagau

SEQ ID NO: 348942 - RNA, 23 nt, Human
uugaaggagaaagcuuucuuggu

SEQ ID NO: 348943 - RNA, 22 nt, Human
aacucaguuacauauuagaaua

SEQ ID NO: 348944 - RNA, 22 nt, Human
cccagcuccgagcuccgagccg

SEQ ID NO: 348945 - RNA, 18 nt, Human
cuccagggaacucaguca

SEQ ID NO: 348946 - RNA, 22 nt, Human
guauuugauacaugaaauggug

SEQ ID NO: 348947 - RNA, 22 nt, Human
cugcagagguugguucuaagau

SEQ ID NO: 348948 - RNA, 22 nt, Human
cauuuacagcagacugaugaaa

SEQ ID NO: 348949 - RNA, 22 nt, Human
aguggcagaucucuggucugga

SEQ ID NO: 348950 - RNA, 22 nt, Human
gucugucucucuccagagugca

SEQ ID NO: 348951 - RNA, 19 nt, Human
ccuuggaguuccaggugga

SEQ ID NO: 348952 - RNA, 22 nt, Human
aaagguuaagguguucaagaaa

SEQ ID NO: 348953 - RNA, 22 nt, Human
ggaccagagcucgggcuucuca

SEQ ID NO: 348954 - RNA, 22 nt, Human
ggcccugagcugaaguacugug

SEQ ID NO: 348955 - RNA, 22 nt, Human
gcugcagcuguaggacacaauu

SEQ ID NO: 348956 - RNA, 22 nt, Human
acagccagggcauugucgccga

SEQ ID NO: 348957 - RNA, 22 nt, Human
uggcuucugggacuugugagca

SEQ ID NO: 348958 - RNA, 22 nt, Human
aaugaaaauuggacccuagaac

SEQ ID NO: 348959 - RNA, 22 nt, Human
gaaaggucaguuccacuuccau

SEQ ID NO: 348960 - RNA, 22 nt, Human
uguggcugacuccuggucccca

SEQ ID NO: 348961 - RNA, 22 nt, Human
uuccuggugguggugacagcac

SEQ ID NO: 348962 - RNA, 22 nt, Human
uucucuucaucucaguaaaugu

SEQ ID NO: 348963 - RNA, 22 nt, Human
agcagggcuguguagguaauga

SEQ ID NO: 348964 - RNA, 22 nt, Human
ucucagaguaauucuuuaaggu

SEQ ID NO: 348965 - RNA, 22 nt, Human
ugcugccacugguagucucauu

SEQ ID NO: 348966 - RNA, 22 nt, Human
cauuuauugguuaggccagcag

SEQ ID NO: 348967 - RNA, 22 nt, Human
gaggccaggacaugaaagcuga

SEQ ID NO: 348968 - RNA, 20 nt, Human
aagcaauauagugcaaaugu

SEQ ID NO: 348969 - RNA, 22 nt, Human
aaaaguguccagauuaugaaga

SEQ ID NO: 348970 - RNA, 20 nt, Human
ccaagagcaugcaugaggaa

SEQ ID NO: 348971 - RNA, 22 nt, Human
aguacaauuuaaugaagauagc

SEQ ID NO: 348972 - RNA, 22 nt, Human
ugccaaggguaugggcaagaua

SEQ ID NO: 348973 - RNA, 22 nt, Human
ugaaauagacacagugcuauac

SEQ ID NO: 348974 - RNA, 22 nt, Human
guucuucaaagugacaacuaaa

SEQ ID NO: 348975 - RNA, 22 nt, Human
uggcacagacagaucaggaguc

SEQ ID NO: 348976 - RNA, 22 nt, Human
gaggccaggaagcccaagauca

SEQ ID NO: 348977 - RNA, 22 nt, Human
acauuucucagguaagucauuu

SEQ ID NO: 348978 - RNA, 22 nt, Human
ccugcagguaaggcuaacugcc

SEQ ID NO: 348979 - RNA, 18 nt, Human
ucucuuuuccccucauug

SEQ ID NO: 348980 - RNA, 22 nt, Human
cauguuuucuaggcuuucacaa

SEQ ID NO: 348981 - RNA, 21 nt, Human
ucagggcagugggagguuccu

SEQ ID NO: 348982 - RNA, 22 nt, Human
gcagcuuuguaaaguaugaagc

SEQ ID NO: 348983 - RNA, 22 nt, Human
ugcagcuguuacggacccuguc

SEQ ID NO: 348984 - RNA, 22 nt, Human
aggaagcccuugucauuucugu

SEQ ID NO: 348985 - RNA, 22 nt, Human
gauuucuguaacacuucagaua

SEQ ID NO: 348986 - RNA, 22 nt, Human
agugcugucaguuuuauagaua

SEQ ID NO: 348987 - RNA, 22 nt, Human
uagcugccaaaagggugggcua

SEQ ID NO: 348988 - RNA, 22 nt, Human
ccaaagucagugcucagucguc

SEQ ID NO: 348989 - RNA, 22 nt, Human
cuguagcagugugcucuuuuuc

SEQ ID NO: 348990 - RNA, 22 nt, Human
augcuuuaaaugucuuuugcuu

SEQ ID NO: 348991 - RNA, 20 nt, Human
cucucccagcacagcuuccu

SEQ ID NO: 348992 - RNA, 22 nt, Human
aaacuuuguagagaaugcuggc

SEQ ID NO: 348993 - RNA, 22 nt, Human
ggagcagccgcgucucagggca

SEQ ID NO: 348994 - RNA, 22 nt, Human
auuguggcuagacagucacaau

SEQ ID NO: 348995 - RNA, 20 nt, Human
aagcagaagcugcucucagc

SEQ ID NO: 348996 - RNA, 22 nt, Human
gaggccugaggcugccuggagc

SEQ ID NO: 348997 - RNA, 22 nt, Human
cauauuuauagaucuggcauuu

SEQ ID NO: 348998 - RNA, 22 nt, Human
aggcagcaauugaaaucauugu

SEQ ID NO: 348999 - RNA, 22 nt, Human
ugcagaagcagagccgguggcc

SEQ ID NO: 349000 - RNA, 22 nt, Human
aggccagcuuccagaggggcag

SEQ ID NO: 349001 - RNA, 22 nt, Human
agaauaauacugaaaugcugaa

SEQ ID NO: 349002 - RNA, 22 nt, Human
acuuuguauaagacaauaaaga

SEQ ID NO: 349003 - RNA, 23 nt, Human
uuccagaguccacaucugccacc

SEQ ID NO: 349004 - RNA, 22 nt, Human
ugggcagaauugugguaguuaa

SEQ ID NO: 349005 - RNA, 22 nt, Human
uucauaaugagguccuagaggc

SEQ ID NO: 349006 - RNA, 22 nt, Human
aggugccagaugcacagcugaa

SEQ ID NO: 349007 - RNA, 22 nt, Human
ggagggagcauccccuugcuga

SEQ ID NO: 349008 - RNA, 22 nt, Human
aaucuucuuucuuaacaguaca

SEQ ID NO: 349009 - RNA, 22 nt, Human
cucugagagagcuggugagcac

SEQ ID NO: 349010 - RNA, 22 nt, Human
cuugaaguugcaaaacauuaau

SEQ ID NO: 349011 - RNA, 22 nt, Human
ccuggccagaggcgugccugug

SEQ ID NO: 349012 - RNA, 22 nt, Human
cuggcucccucgcugaggugcu

SEQ ID NO: 349013 - RNA, 22 nt, Human
cgcaccacugaauuccagccug

SEQ ID NO: 349014 - RNA, 18 nt, Human
ugcuggguaacuguaugg

SEQ ID NO: 349015 - RNA, 18 nt, Human
gagcccugagucugcaca

SEQ ID NO: 349016 - RNA, 22 nt, Human
cagaaccaggaacugauggaga

SEQ ID NO: 349017 - RNA, 17 nt, Human
ccuguguuugcuccuuc

SEQ ID NO: 349018 - RNA, 22 nt, Human
aggcucagauucacauuugguu

SEQ ID NO: 349019 - RNA, 22 nt, Human
aaguggugguaugaaccgaggg

SEQ ID NO: 349020 - RNA, 20 nt, Human
uguauauuuucugguguaaa

SEQ ID NO: 349021 - RNA, 22 nt, Human
gucuccugagacugcagucacc

SEQ ID NO: 349022 - RNA, 22 nt, Human
agccaugcaccuuacucuugcu

SEQ ID NO: 349023 - RNA, 22 nt, Human
uuauuaaugaguacaaguuauu

SEQ ID NO: 349024 - RNA, 22 nt, Human
gaaagagaaccugggccuagau

SEQ ID NO: 349025 - RNA, 22 nt, Human
cugaaggacacgugaggagcca

SEQ ID NO: 349026 - RNA, 22 nt, Human
gcucuggacccuggaguggcug

SEQ ID NO: 349027 - RNA, 22 nt, Human
cuggcugugcagucuuccagaa

SEQ ID NO: 349028 - RNA, 17 nt, Human
agggucaggugaaguuc

SEQ ID NO: 349029 - RNA, 22 nt, Human
uccucagacacccugcuggcuu

SEQ ID NO: 349030 - RNA, 22 nt, Human
caagggugguauugggagcaua

SEQ ID NO: 349031 - RNA, 22 nt, Human
ucagcagggccuccuugugcag

SEQ ID NO: 349032 - RNA, 22 nt, Human
aggaagcugcuggaguagugug

SEQ ID NO: 349033 - RNA, 22 nt, Human
gcaugagggggguuaggaaguu

SEQ ID NO: 349034 - RNA, 22 nt, Human
aagaggcagcccgcugaggcug

SEQ ID NO: 349035 - RNA, 19 nt, Human
ugacaggcuguugccuuga

SEQ ID NO: 349036 - RNA, 20 nt, Human
guucucacugaucugcaggg

SEQ ID NO: 349037 - RNA, 22 nt, Human
guaucuuuuacaccaggaaauu

SEQ ID NO: 349038 - RNA, 22 nt, Human
cagccccucacagagcuguccu

SEQ ID NO: 349039 - RNA, 22 nt, Human
ggcacugaaguggguguugggu

SEQ ID NO: 349040 - RNA, 23 nt, Human
ucuccagugucucuucauugagu

SEQ ID NO: 349041 - RNA, 22 nt, Human
caacauuugaguaaagaaaugg

SEQ ID NO: 349042 - RNA, 22 nt, Human
uaggauuuaggcuuuaacaucu

SEQ ID NO: 349043 - RNA, 22 nt, Human
ggcucagacucccaggcccucu

SEQ ID NO: 349044 - RNA, 22 nt, Human
uucuccucuguuggccuucccu

SEQ ID NO: 349045 - RNA, 22 nt, Human
aagagcugugggugguaguccu

SEQ ID NO: 349046 - RNA, 22 nt, Human
auggauuuggaugagauuacuu

SEQ ID NO: 349047 - RNA, 22 nt, Human
auacacauguguaugugcaugc

SEQ ID NO: 349048 - RNA, 22 nt, Human
ggccaggcacugugugagauau

SEQ ID NO: 349049 - RNA, 22 nt, Human
gguucacacuuucaugauuuca

SEQ ID NO: 349050 - RNA, 22 nt, Human
aaauuucuggaagugucagagu

SEQ ID NO: 349051 - RNA, 22 nt, Human
cagggacccuacuagcucacac

SEQ ID NO: 349052 - RNA, 22 nt, Human
ggcagcuuucaauaggguuaug

SEQ ID NO: 349053 - RNA, 22 nt, Human
uggcaggaggaugaggcggcua

SEQ ID NO: 349054 - RNA, 22 nt, Human
uccagccaugcaugacaaucac

SEQ ID NO: 349055 - RNA, 22 nt, Human
cagcuggcgggcagagccgcca

SEQ ID NO: 349056 - RNA, 22 nt, Human
gccagguggcugagugacugag

SEQ ID NO: 349057 - RNA, 19 nt, Human
ggacacagaaagcugcauu

SEQ ID NO: 349058 - RNA, 20 nt, Human
uauuucugggcaaccauuua

SEQ ID NO: 349059 - RNA, 22 nt, Human
ugcagugguugagagcccagac

SEQ ID NO: 349060 - RNA, 22 nt, Human
uaagcauucaaugcuuagcacu

SEQ ID NO: 349061 - RNA, 18 nt, Human
augggaggggccaagaga

SEQ ID NO: 349062 - RNA, 22 nt, Human
agccacagucaaccuguccaua

SEQ ID NO: 349063 - RNA, 22 nt, Human
ccucugcagcagagagccagag

SEQ ID NO: 349064 - RNA, 22 nt, Human
uacauuguuuuuucuugccauc

SEQ ID NO: 349065 - RNA, 22 nt, Human
aggguggcaguuacuggagcaa

SEQ ID NO: 349066 - RNA, 22 nt, Human
ucuggcucuuugggugauugua

SEQ ID NO: 349067 - RNA, 22 nt, Human
aaguucuaauuuugcauucagg

SEQ ID NO: 349068 - RNA, 23 nt, Human
gugauuucagggaacagaaucag

SEQ ID NO: 349069 - RNA, 22 nt, Human
uggcagaggcucugugauguug

SEQ ID NO: 349070 - RNA, 22 nt, Human
uccaggcacuauauauacuuuu

SEQ ID NO: 349071 - RNA, 22 nt, Human
aagaaugucguugguauuuuaa

SEQ ID NO: 349072 - RNA, 22 nt, Human
ucuuuuggaaaugaugugcagg

SEQ ID NO: 349073 - RNA, 22 nt, Human
ccagggugggaggcugaaggcg

SEQ ID NO: 349074 - RNA, 22 nt, Human
auguccagggcacacagcagug

SEQ ID NO: 349075 - RNA, 21 nt, Human
aggcuguccuuugccagcccu

SEQ ID NO: 349076 - RNA, 22 nt, Human
aagaggaagucuccauggagag

SEQ ID NO: 349077 - RNA, 22 nt, Human
ggcugccugaggcugaggcccg

SEQ ID NO: 349078 - RNA, 22 nt, Human
aguggcagagcaggugcuggaa

SEQ ID NO: 349079 - RNA, 22 nt, Human
cagggcucgcugccagcuucag

SEQ ID NO: 349080 - RNA, 22 nt, Human
agggaccucuucuugcagcuga

SEQ ID NO: 349081 - RNA, 22 nt, Human
agaccauagggaccucagguug

SEQ ID NO: 349082 - RNA, 22 nt, Human
ccugggagguggagguugcagu

SEQ ID NO: 349083 - RNA, 22 nt, Human
gcugucccgaaccccugguaau

SEQ ID NO: 349084 - RNA, 22 nt, Human
ggaaagagcuaaaagggugaga

SEQ ID NO: 349085 - RNA, 20 nt, Human
cccucugcacauggcugugg

SEQ ID NO: 349086 - RNA, 22 nt, Human
gcaggaguuaggcgucguggau

SEQ ID NO: 349087 - RNA, 22 nt, Human
uggcccugaggggcugugcccc

SEQ ID NO: 349088 - RNA, 22 nt, Human
ugagccagucugucugggugaa

SEQ ID NO: 349089 - RNA, 22 nt, Human
ucucagagggaaacaugaguga

SEQ ID NO: 349090 - RNA, 22 nt, Human
aaacaaguguaaacuagucugu

SEQ ID NO: 349091 - RNA, 22 nt, Human
caggaacacaaguucagggaug

SEQ ID NO: 349092 - RNA, 22 nt, Human
agaggcuggauugagcauagac

SEQ ID NO: 349093 - RNA, 22 nt, Human
acucuucuugcugcucauuaau

SEQ ID NO: 349094 - RNA, 22 nt, Human
aggaaaaagaguugcugccuuc

SEQ ID NO: 349095 - RNA, 22 nt, Human
uccaggaggcagggcugugccc

SEQ ID NO: 349096 - RNA, 22 nt, Human
cccaggagguggagguugcagu

SEQ ID NO: 349097 - RNA, 22 nt, Human
gcuagaucucucauaaauucca

SEQ ID NO: 349098 - RNA, 22 nt, Human
aaugucugagucucuguauccc

SEQ ID NO: 349099 - RNA, 22 nt, Human
ucaccgccuugcccggccgggc

SEQ ID NO: 349100 - RNA, 22 nt, Human
auguauguuaguguauuaucua

SEQ ID NO: 349101 - RNA, 22 nt, Human
auucagugugagguuuucaagu

SEQ ID NO: 349102 - RNA, 22 nt, Human
aucaguuuggugcuuucaguga

SEQ ID NO: 349103 - RNA, 22 nt, Human
aacaugucuggguauucacaag

SEQ ID NO: 349104 - RNA, 22 nt, Human
guggcagggugcucaucaugca

SEQ ID NO: 349105 - RNA, 22 nt, Human
caguuuauagcucuagcagcuu

SEQ ID NO: 349106 - RNA, 22 nt, Human
gaggguggguuucuugcacguc

SEQ ID NO: 349107 - RNA, 22 nt, Human
uugaggagcaggaugggaggcu

SEQ ID NO: 349108 - RNA, 22 nt, Human
gcuggcagucccaucagcuggg

SEQ ID NO: 349109 - RNA, 22 nt, Human
acagaggucauggagaguucuc

SEQ ID NO: 349110 - RNA, 22 nt, Human
aauuucaaacucuugcccucag

SEQ ID NO: 349111 - RNA, 19 nt, Human
ugcaggaggacugagcaga

SEQ ID NO: 349112 - RNA, 22 nt, Human
agccaacuaauuaaacaacuuu

SEQ ID NO: 349113 - RNA, 22 nt, Human
gaggagggagcuggaagcucuu

SEQ ID NO: 349114 - RNA, 22 nt, Human
ggcuccuguccuccuggagcuc

SEQ ID NO: 349115 - RNA, 22 nt, Human
accaggcacuccugaggucuga

SEQ ID NO: 349116 - RNA, 22 nt, Human
gcuauacagcaggagaauggaa

SEQ ID NO: 349117 - RNA, 22 nt, Human
ggcuccugaaagacuaugggaa

SEQ ID NO: 349118 - RNA, 22 nt, Human
gaggcagcugaagcuucaaaga

SEQ ID NO: 349119 - RNA, 19 nt, Human
ucuggagcugaugcaggug

SEQ ID NO: 349120 - RNA, 22 nt, Human
ucagcagauggguuguguuggc

SEQ ID NO: 349121 - RNA, 22 nt, Human
caggcugggcagccuccccggc

SEQ ID NO: 349122 - RNA, 22 nt, Human
guggcugguuuccugcaugcaa

SEQ ID NO: 349123 - RNA, 22 nt, Human
uuucaaauggagucgugaaaug

SEQ ID NO: 349124 - RNA, 22 nt, Human
uauuugagcgaagcaguguuuu

SEQ ID NO: 349125 - RNA, 15 nt, Human
cuccaugauuuugca

SEQ ID NO: 349126 - RNA, 22 nt, Human
uccugcagguggaugauucucu

SEQ ID NO: 349127 - RNA, 22 nt, Human
cccagcagcuugcacagugcug

SEQ ID NO: 349128 - RNA, 22 nt, Human
cacccagcagcacuuaagacua

SEQ ID NO: 349129 - RNA, 22 nt, Human
acagcauugcuccaucucaaga

SEQ ID NO: 349130 - RNA, 22 nt, Human
ccaucccuucaccacagcagua

SEQ ID NO: 349131 - RNA, 22 nt, Human
caguggcaaugggacagagcac

SEQ ID NO: 349132 - RNA, 22 nt, Human
aggcagaggagaaugaucuucc

SEQ ID NO: 349133 - RNA, 22 nt, Human
gcagaggccaggccaccagcaa

SEQ ID NO: 349134 - RNA, 20 nt, Human
caagcccucuuuagccugcc

SEQ ID NO: 349135 - RNA, 22 nt, Human
accucugcucaagaccccuccg

SEQ ID NO: 349136 - RNA, 22 nt, Human
uagggaccuuagaauuguaugu

SEQ ID NO: 349137 - RNA, 22 nt, Human
uucugaggcacuggcucuccca

SEQ ID NO: 349138 - RNA, 22 nt, Human
ugaggcagaguaagauacauga

SEQ ID NO: 349139 - RNA, 21 nt, Human
uccauaagagaccaucuccua

SEQ ID NO: 349140 - RNA, 22 nt, Human
aggagggugauccgggcugguc

SEQ ID NO: 349141 - RNA, 22 nt, Human
uucuuucccaguagaugugaaa

SEQ ID NO: 349142 - RNA, 22 nt, Human
acugagcugcaagucagggagg

SEQ ID NO: 349143 - RNA, 23 nt, Human
ucuccuccuagauacagucaugg

SEQ ID NO: 349144 - RNA, 22 nt, Human
ucugggagcacacgcagugauc

SEQ ID NO: 349145 - RNA, 22 nt, Human
ugugucccuuggaaccucagcu

SEQ ID NO: 349146 - RNA, 22 nt, Human
ggcagcagggucuagauugaug

SEQ ID NO: 349147 - RNA, 22 nt, Human
agacagcuaauaaaugagugug

SEQ ID NO: 349148 - RNA, 22 nt, Human
uggccugguuauauugcuauca

SEQ ID NO: 349149 - RNA, 22 nt, Human
ccagcagacacacaggcguggg

SEQ ID NO: 349150 - RNA, 22 nt, Human
ucccuggcagcuaagggugguc

SEQ ID NO: 349151 - RNA, 22 nt, Human
acaggcugcugggcuccgugcu

SEQ ID NO: 349152 - RNA, 22 nt, Human
uaugcauagguaucuauacuca

SEQ ID NO: 349153 - RNA, 22 nt, Human
guggcucuaggugagcauggag

SEQ ID NO: 349154 - RNA, 23 nt, Human
ugcagccacucaggagcucagug

SEQ ID NO: 349155 - RNA, 22 nt, Human
auuuugaaaagcauuugaguaa

SEQ ID NO: 349156 - RNA, 22 nt, Human
gccuggguuccaugaucuccag

SEQ ID NO: 349157 - RNA, 22 nt, Human
uuuuuuaguuaggucagaaugu

SEQ ID NO: 349158 - RNA, 22 nt, Human
ggagaugguggaagcuggugca

SEQ ID NO: 349159 - RNA, 22 nt, Human
uugagaagaaauaguuugcaau

SEQ ID NO: 349160 - RNA, 22 nt, Human
ugcugucuguuuacuggcuaua

SEQ ID NO: 349161 - RNA, 22 nt, Human
uuuaaauuuguguuuagagggu

SEQ ID NO: 349162 - RNA, 22 nt, Human
aaaucuggccccuugccuauuu

SEQ ID NO: 349163 - RNA, 22 nt, Human
ucucagagaccugaacucccug

SEQ ID NO: 349164 - RNA, 22 nt, Human
aggugcuggaguagaagaaaaa

SEQ ID NO: 349165 - RNA, 22 nt, Human
ccuauugacaauucucuucucc

SEQ ID NO: 349166 - RNA, 22 nt, Human
cuggccacaacuagcccaggac

SEQ ID NO: 349167 - RNA, 22 nt, Human
ugcuguggcaguuuauguauag

SEQ ID NO: 349168 - RNA, 23 nt, Human
uuaagacuggcugaacuuaguag

SEQ ID NO: 349169 - RNA, 18 nt, Human
cucagggcaucagucugg

SEQ ID NO: 349170 - RNA, 22 nt, Human
uuuuucaagacaaccugcaugu

SEQ ID NO: 349171 - RNA, 22 nt, Human
aggcccuggguuagggcccacu

SEQ ID NO: 349172 - RNA, 22 nt, Human
uccuggcccacuaugccagcau

SEQ ID NO: 349173 - RNA, 22 nt, Human
cugagccaugagccugcgccca

SEQ ID NO: 349174 - RNA, 22 nt, Human
ccuccagcugccucagucucuu

SEQ ID NO: 349175 - RNA, 22 nt, Human
guauacauagaugaugaacaag

SEQ ID NO: 349176 - RNA, 22 nt, Human
ucagagaguuacacaaauuguu

SEQ ID NO: 349177 - RNA, 22 nt, Human
aauauucaaguuauucuuucuu

SEQ ID NO: 349178 - RNA, 22 nt, Human
aguguugucaaacggcucagca

SEQ ID NO: 349179 - RNA, 22 nt, Human
uaggagagcugaacuauugucu

SEQ ID NO: 349180 - RNA, 22 nt, Human
augucuuuggcuuugacauggc

SEQ ID NO: 349181 - RNA, 22 nt, Human
uggcacugccaaccugcuaggu

SEQ ID NO: 349182 - RNA, 22 nt, Human
gggcacugcuuugcucugucac

SEQ ID NO: 349183 - RNA, 20 nt, Human
uccuucaggcagggccuagu

SEQ ID NO: 349184 - RNA, 18 nt, Human
uccugccugcgggcuccc

SEQ ID NO: 349185 - RNA, 22 nt, Human
ucuucaaaaaauauccaucagu

SEQ ID NO: 349186 - RNA, 22 nt, Human
gaaggaagugcucauacuaguu

SEQ ID NO: 349187 - RNA, 22 nt, Human
uuugaaaguguuuacuugggaa

SEQ ID NO: 349188 - RNA, 22 nt, Human
cuccugagcucugaggaagcuu

SEQ ID NO: 349189 - RNA, 22 nt, Human
gugccugccccacuccucagca

SEQ ID NO: 349190 - RNA, 22 nt, Human
auacauacauguacacauaaau

SEQ ID NO: 349191 - RNA, 22 nt, Human
aauuagggaaaauuuacuugua

SEQ ID NO: 349192 - RNA, 22 nt, Human
uggagccaaugaacauuugcug

SEQ ID NO: 349193 - RNA, 22 nt, Human
auuuaagacugacuucaccagu

SEQ ID NO: 349194 - RNA, 22 nt, Human
ugccugaugcaggaguaucaga

SEQ ID NO: 349195 - RNA, 22 nt, Human
acaguguucacuuaacaaugga

SEQ ID NO: 349196 - RNA, 21 nt, Human
gccagccuguuuaccuguggu

SEQ ID NO: 349197 - RNA, 22 nt, Human
cagaacauuccaugugcccugc

SEQ ID NO: 349198 - RNA, 22 nt, Human
uccucugccccagaugaaauuu

SEQ ID NO: 349199 - RNA, 22 nt, Human
ugcagcauucuuggccacuacu

SEQ ID NO: 349200 - RNA, 22 nt, Human
cucuucaaaagucuaauccuua

SEQ ID NO: 349201 - RNA, 22 nt, Human
aacaaauggggccuuguaugaa

SEQ ID NO: 349202 - RNA, 22 nt, Human
gaagcccauuuguacagcacau

SEQ ID NO: 349203 - RNA, 22 nt, Human
aaugauggucauggcaacuuuu

SEQ ID NO: 349204 - RNA, 22 nt, Human
agggccucugacgcccccagcc

SEQ ID NO: 349205 - RNA, 21 nt, Human
uaucuacuggugucuuucaga

SEQ ID NO: 349206 - RNA, 22 nt, Human
aaguucaaggcucuagaguucc

SEQ ID NO: 349207 - RNA, 22 nt, Human
ugccagaagauucucuaucaga

SEQ ID NO: 349208 - RNA, 22 nt, Human
auuuaucaccaguuagcugacu

SEQ ID NO: 349209 - RNA, 22 nt, Human
gagcuuccugaugccgaccagu

SEQ ID NO: 349210 - RNA, 22 nt, Human
agauuuagugguggaauuuugg

SEQ ID NO: 349211 - RNA, 22 nt, Human
cuugggagacacaagaagacau

SEQ ID NO: 349212 - RNA, 22 nt, Human
gcagcagagaacacaaugaugg

SEQ ID NO: 349213 - RNA, 22 nt, Human
aaaauugaagugaucaggaacu

SEQ ID NO: 349214 - RNA, 22 nt, Human
uucucuuugacauuauucaggu

SEQ ID NO: 349215 - RNA, 22 nt, Human
uguaucaaaccaaauuaauucu

SEQ ID NO: 349216 - RNA, 22 nt, Human
gcaaagguagccaaggagcuca

SEQ ID NO: 349217 - RNA, 22 nt, Human
cugaagccaugugcucacuggu

SEQ ID NO: 349218 - RNA, 22 nt, Human
gagagggccgggggccagcucc

SEQ ID NO: 349219 - RNA, 22 nt, Human
ggcugcaggcaggguauccacu

SEQ ID NO: 349220 - RNA, 22 nt, Human
aggcuucugcugauauuucauu

SEQ ID NO: 349221 - RNA, 18 nt, Human
uggcucagauggcuuuaa

SEQ ID NO: 349222 - RNA, 22 nt, Human
ucagagucucccccaguuuggg

SEQ ID NO: 349223 - RNA, 22 nt, Human
cagucccagacccagaaggugg

SEQ ID NO: 349224 - RNA, 22 nt, Human
caggccugagacaucugagaua

SEQ ID NO: 349225 - RNA, 22 nt, Human
aucauucuaguccuuauggucu

SEQ ID NO: 349226 - RNA, 22 nt, Human
gccugcagggccugggccuacc

SEQ ID NO: 349227 - RNA, 22 nt, Human
aaguugaaugcguacgugacau

SEQ ID NO: 349228 - RNA, 22 nt, Human
aacaguaacgagauguccuaac

SEQ ID NO: 349229 - RNA, 22 nt, Human
acugaaagauaaaucaguuagc

SEQ ID NO: 349230 - RNA, 20 nt, Human
cugggcagguguuugaucuc

SEQ ID NO: 349231 - RNA, 22 nt, Human
augaugguaaauucaguauccg

SEQ ID NO: 349232 - RNA, 22 nt, Human
uuuccaauaaagugucauuguu

SEQ ID NO: 349233 - RNA, 22 nt, Human
caggcaggucagugaagaagga

SEQ ID NO: 349234 - RNA, 22 nt, Human
ugccaggcugucaauucaccca

SEQ ID NO: 349235 - RNA, 22 nt, Human
agaggaugauuuuaaggacacu

SEQ ID NO: 349236 - RNA, 21 nt, Human
gcagccacagccaccaagcua

SEQ ID NO: 349237 - RNA, 22 nt, Human
uagcuaucuguguccagaucca

SEQ ID NO: 349238 - RNA, 22 nt, Human
aauuagagaucaguucuuugac

SEQ ID NO: 349239 - RNA, 22 nt, Human
acugucuuguguuaaagaacca

SEQ ID NO: 349240 - RNA, 22 nt, Human
gaugguuugguaaaaguauguu

SEQ ID NO: 349241 - RNA, 22 nt, Human
cuugcugugugguguucucaga

SEQ ID NO: 349242 - RNA, 22 nt, Human
auauuaggcaaggagauuauuu

SEQ ID NO: 349243 - RNA, 22 nt, Human
agaggccggccgagcccauggg

SEQ ID NO: 349244 - RNA, 22 nt, Human
uacacauguauuuauguguaca

SEQ ID NO: 349245 - RNA, 22 nt, Human
ccacugucagaggggcugugcc

SEQ ID NO: 349246 - RNA, 22 nt, Human
augucuuucgcaucaguagcua

SEQ ID NO: 349247 - RNA, 22 nt, Human
ccugaagagcacucuagaguug

SEQ ID NO: 349248 - RNA, 22 nt, Human
guuuuauaauugcuucauaaga

SEQ ID NO: 349249 - RNA, 22 nt, Human
gcguggugcugcccugcacaca

SEQ ID NO: 349250 - RNA, 22 nt, Human
cugaggcugggcugaggguaua

SEQ ID NO: 349251 - RNA, 22 nt, Human
cuugccuucuuuuccuauagaa

SEQ ID NO: 349252 - RNA, 23 nt, Human
ccucagcauggcaggagcccagc

SEQ ID NO: 349253 - RNA, 22 nt, Human
uaaugcuuaacagcuggcuuuu

SEQ ID NO: 349254 - RNA, 22 nt, Human
uggcucaggugugagcugaaga

SEQ ID NO: 349255 - RNA, 19 nt, Human
gaaggagagcugaguuagg

SEQ ID NO: 349256 - RNA, 22 nt, Human
guccaggucuggacccugagcc

SEQ ID NO: 349257 - RNA, 22 nt, Human
ggccaggcugguuccuugaccu

SEQ ID NO: 349258 - RNA, 22 nt, Human
uguuaaauguuccuuuacugga

SEQ ID NO: 349259 - RNA, 22 nt, Human
cuacagaauggagggucagaga

SEQ ID NO: 349260 - RNA, 22 nt, Human
acauguaaaaggaacaugcaug

SEQ ID NO: 349261 - RNA, 22 nt, Human
guaacaaaguuucuaggugcug

SEQ ID NO: 349262 - RNA, 22 nt, Human
auucauuccaggucagucagac

SEQ ID NO: 349263 - RNA, 21 nt, Human
ggcagccugacccccagagag

SEQ ID NO: 349264 - RNA, 22 nt, Human
ugaagcaggguggccagauugu

SEQ ID NO: 349265 - RNA, 22 nt, Human
cagucccagcugcucagaaggc

SEQ ID NO: 349266 - RNA, 22 nt, Human
uuuccuucaucaucugagagcu

SEQ ID NO: 349267 - RNA, 22 nt, Human
aaggcagcaacuaauggaucuc

SEQ ID NO: 349268 - RNA, 22 nt, Human
agcugcccagcuaggaagaagg

SEQ ID NO: 349269 - RNA, 22 nt, Human
uggcucuguuuuaugaguacca

SEQ ID NO: 349270 - RNA, 22 nt, Human
gcucucuggaggccauggacag

SEQ ID NO: 349271 - RNA, 22 nt, Human
aggcugaggagggauguugcuu

SEQ ID NO: 349272 - RNA, 22 nt, Human
cauugacaguucuuuaaguugc

SEQ ID NO: 349273 - RNA, 22 nt, Human
agggacaguuacaucaucagac

SEQ ID NO: 349274 - RNA, 22 nt, Human
gcagggcagcuuagucccuguc

SEQ ID NO: 349275 - RNA, 20 nt, Human
ccagagaguagguuagugau

SEQ ID NO: 349276 - RNA, 22 nt, Human
uauucacaggcuggagugaugu

SEQ ID NO: 349277 - RNA, 22 nt, Human
cucucugguacauagaguuugg

SEQ ID NO: 349278 - RNA, 19 nt, Human
acagaaauuaguuauuuuc

SEQ ID NO: 349279 - RNA, 22 nt, Human
ggccucugccccagccacaccu

SEQ ID NO: 349280 - RNA, 22 nt, Human
gugcuuccugccuggugccuuu

SEQ ID NO: 349281 - RNA, 23 nt, Human
aggaacugaggccuagggaggua

SEQ ID NO: 349282 - RNA, 22 nt, Human
agcagcucacaggauuccugaa

SEQ ID NO: 349283 - RNA, 22 nt, Human
agggcuccuccccggccuccac

SEQ ID NO: 349284 - RNA, 22 nt, Human
uguuuuauuucuccaagaggga

SEQ ID NO: 349285 - RNA, 22 nt, Human
aagcuggagaguuaggugaaua

SEQ ID NO: 349286 - RNA, 22 nt, Human
aguucacagccauguucaugug

SEQ ID NO: 349287 - RNA, 21 nt, Human
uuuauguacuucauagaguag

SEQ ID NO: 349288 - RNA, 22 nt, Human
uccaggagaccagauguaggcc

SEQ ID NO: 349289 - RNA, 22 nt, Human
cauuuguuaauuacuauuaucu

SEQ ID NO: 349290 - RNA, 22 nt, Human
ccaggccuggccaggggaugcc

SEQ ID NO: 349291 - RNA, 22 nt, Human
ucaaagcuuagauaauuucuuu

SEQ ID NO: 349292 - RNA, 22 nt, Human
uccuugaagaaugauucuugga

SEQ ID NO: 349293 - RNA, 22 nt, Human
uggcagugccccuugaccagug

SEQ ID NO: 349294 - RNA, 21 nt, Human
ucagcuuugcaacugcacauc

SEQ ID NO: 349295 - RNA, 22 nt, Human
ccaggagccacucaggcccaca

SEQ ID NO: 349296 - RNA, 22 nt, Human
agccugguuuaagcauuuuaua

SEQ ID NO: 349297 - RNA, 22 nt, Human
ggagcagagcauuucacagccu

SEQ ID NO: 349298 - RNA, 20 nt, Human
uuggucagugguucaguuug

SEQ ID NO: 349299 - RNA, 22 nt, Human
cauggcaggaggcugcuggcag

SEQ ID NO: 349300 - RNA, 23 nt, Human
uaguuauuuucucuguaauuugc

SEQ ID NO: 349301 - RNA, 22 nt, Human
uucauucauuacgugccaggca

SEQ ID NO: 349302 - RNA, 22 nt, Human
guucuucaucauuaacacucug

SEQ ID NO: 349303 - RNA, 22 nt, Human
aucuggcuugacuuugcgacuu

SEQ ID NO: 349304 - RNA, 22 nt, Human
gaaaucugucuuuguuugaaua

SEQ ID NO: 349305 - RNA, 22 nt, Human
gcagugaagccagaucugaaau

SEQ ID NO: 349306 - RNA, 20 nt, Human
uggagcugugguaaggagca

SEQ ID NO: 349307 - RNA, 22 nt, Human
cugcagccucaaccuccugagc

SEQ ID NO: 349308 - RNA, 22 nt, Human
uucuuaaaacuuauggacaggu

SEQ ID NO: 349309 - RNA, 22 nt, Human
uacaaagucaccagcuucuugc

SEQ ID NO: 349310 - RNA, 22 nt, Human
gcugccugguuucucagcugca

SEQ ID NO: 349311 - RNA, 22 nt, Human
uuucuguagggauuucacaguu

SEQ ID NO: 349312 - RNA, 22 nt, Human
aucagaagaaauggaugugacu

SEQ ID NO: 349313 - RNA, 22 nt, Human
gccuggagaccugcuccucuac

SEQ ID NO: 349314 - RNA, 22 nt, Human
augggcuguccuaguccagccc

SEQ ID NO: 349315 - RNA, 22 nt, Human
gugccucagcaccgccugcagc

SEQ ID NO: 349316 - RNA, 21 nt, Human
ugaaugaggaggauggcauuu

SEQ ID NO: 349317 - RNA, 22 nt, Human
gcaggggcuaaggacacagaga

SEQ ID NO: 349318 - RNA, 22 nt, Human
ucaggagacuuaugucacagug

SEQ ID NO: 349319 - RNA, 22 nt, Human
ccagucacuggaaaaugggaau

SEQ ID NO: 349320 - RNA, 22 nt, Human
cuggccuggcaggggaccucua

SEQ ID NO: 349321 - RNA, 22 nt, Human
aaaugcauggcuguuuuaaagc

SEQ ID NO: 349322 - RNA, 22 nt, Human
uccaggcacgaggcccugugca

SEQ ID NO: 349323 - RNA, 22 nt, Human
gaaggaagucauuagugcagac

SEQ ID NO: 349324 - RNA, 22 nt, Human
ucuaggagcaugaagggaaggc

SEQ ID NO: 349325 - RNA, 22 nt, Human
ggggacugccuuccacagacac

SEQ ID NO: 349326 - RNA, 22 nt, Human
uucuacaauaugaauaaugaag

SEQ ID NO: 349327 - RNA, 22 nt, Human
ggcaggcugggugucauggagu

SEQ ID NO: 349328 - RNA, 22 nt, Human
cugucauuuaagacauucugga

SEQ ID NO: 349329 - RNA, 22 nt, Human
guuuagaauucuaacuuuaagg

SEQ ID NO: 349330 - RNA, 18 nt, Human
agggaucaucacugcagc

SEQ ID NO: 349331 - RNA, 22 nt, Human
agaggccaguggcugugcuguc

SEQ ID NO: 349332 - RNA, 22 nt, Human
ugcuuuaaccaucuuguuugga

SEQ ID NO: 349333 - RNA, 22 nt, Human
aaauacugucucugagagagcc

SEQ ID NO: 349334 - RNA, 22 nt, Human
caugcuguguguuuuagcucca

SEQ ID NO: 349335 - RNA, 22 nt, Human
gacagggccgcagauggagacu

SEQ ID NO: 349336 - RNA, 21 nt, Human
ccaggcagagcugugaguucu

SEQ ID NO: 349337 - RNA, 22 nt, Human
gcgagggcacgcgguugaaggc

SEQ ID NO: 349338 - RNA, 22 nt, Human
acagaaauuagcagugaguuua

SEQ ID NO: 349339 - RNA, 22 nt, Human
cauuagggccaccauaacaaaa

SEQ ID NO: 349340 - RNA, 22 nt, Human
uauuugauagagauaaaugaua

SEQ ID NO: 349341 - RNA, 22 nt, Human
ucccagaguauuagcaauugcu

SEQ ID NO: 349342 - RNA, 22 nt, Human
ugggcaggggcccugcuuccgu

SEQ ID NO: 349343 - RNA, 18 nt, Human
gccugccuagagcuugcc

SEQ ID NO: 349344 - RNA, 22 nt, Human
gaaguccucaaugcauugucuu

SEQ ID NO: 349345 - RNA, 21 nt, Human
cagaaguaaggguaacuucuc

SEQ ID NO: 349346 - RNA, 22 nt, Human
ccagggcaggggcuggaguuca

SEQ ID NO: 349347 - RNA, 22 nt, Human
uugaaaguuaucuagauucuga

SEQ ID NO: 349348 - RNA, 22 nt, Human
ggggcuguuuuuggaauggcug

SEQ ID NO: 349349 - RNA, 22 nt, Human
ggaugcaggaguugaagaagga

SEQ ID NO: 349350 - RNA, 22 nt, Human
ggugguggagccagcugggagu

SEQ ID NO: 349351 - RNA, 22 nt, Human
gagguggaaggcaggaacaaau

SEQ ID NO: 349352 - RNA, 21 nt, Human
aucaccagcagaagcugcaga

SEQ ID NO: 349353 - RNA, 22 nt, Human
uaauuuaauuccauggauucua

SEQ ID NO: 349354 - RNA, 20 nt, Human
aaacauucauguacaaguga

SEQ ID NO: 349355 - RNA, 22 nt, Human
cacagaggaaaggcaguuggua

SEQ ID NO: 349356 - RNA, 22 nt, Human
cagcagccuacaaugcacagaa

SEQ ID NO: 349357 - RNA, 22 nt, Human
gagacacaggugguuccuguca

SEQ ID NO: 349358 - RNA, 22 nt, Human
gugucacaugguuuacugcagc

SEQ ID NO: 349359 - RNA, 22 nt, Human
gccagagcaugcacugccugca

SEQ ID NO: 349360 - RNA, 22 nt, Human
ucacuuauaaaaugcaagaucu

SEQ ID NO: 349361 - RNA, 22 nt, Human
ugcaggcucacccuggagcuga

SEQ ID NO: 349362 - RNA, 22 nt, Human
uggauuuaauggaugaggggca

SEQ ID NO: 349363 - RNA, 22 nt, Human
uugcaaaggggaauaaagcaau

SEQ ID NO: 349364 - RNA, 22 nt, Human
gcagccugaugaucuggguugu

SEQ ID NO: 349365 - RNA, 22 nt, Human
acaaaggcaggauugacuuagu

SEQ ID NO: 349366 - RNA, 22 nt, Human
uacuuuggauccuuacaauagc

SEQ ID NO: 349367 - RNA, 21 nt, Human
agcagaggcagaauguaugca

SEQ ID NO: 349368 - RNA, 22 nt, Human
ugugcugguacaugugaggaug

SEQ ID NO: 349369 - RNA, 23 nt, Human
cauuucaacgaauuuuccuucug

SEQ ID NO: 349370 - RNA, 22 nt, Human
cagaggcugcucuggguggcau

SEQ ID NO: 349371 - RNA, 22 nt, Human
gcuuuuauugucuuuacgacga

SEQ ID NO: 349372 - RNA, 22 nt, Human
uuuuaugugcuggacuggcagu

SEQ ID NO: 349373 - RNA, 22 nt, Human
ucaugaauauugaaugcuucau

SEQ ID NO: 349374 - RNA, 21 nt, Human
ucauuuuuauugcuaccuugc

SEQ ID NO: 349375 - RNA, 22 nt, Human
gcaggcagucaucuuucauauu

SEQ ID NO: 349376 - RNA, 21 nt, Human
aacauuucaggauccaaauug

SEQ ID NO: 349377 - RNA, 22 nt, Human
aagggcucugugcuugucccau

SEQ ID NO: 349378 - RNA, 22 nt, Human
ccugggucuugguucaugcucu

SEQ ID NO: 349379 - RNA, 22 nt, Human
agaaggccuaacuugggggcaa

SEQ ID NO: 349380 - RNA, 22 nt, Human
cauuaucugccauugacaccau

SEQ ID NO: 349381 - RNA, 22 nt, Human
gaggcagcucuucugaaugggg

SEQ ID NO: 349382 - RNA, 22 nt, Human
cagaggguugucaggcgccuug

SEQ ID NO: 349383 - RNA, 18 nt, Human
cugugcagcaaacugagc

SEQ ID NO: 349384 - RNA, 22 nt, Human
aaucuguuuaguucugcguaug

SEQ ID NO: 349385 - RNA, 22 nt, Human
caaaguauauuggauugaaugg

SEQ ID NO: 349386 - RNA, 22 nt, Human
aggccuuccucggagacaggga

SEQ ID NO: 349387 - RNA, 22 nt, Human
gcuuuaaugcuucguggggcca

SEQ ID NO: 349388 - RNA, 22 nt, Human
uccagcuuauagguagauuuaa

SEQ ID NO: 349389 - RNA, 21 nt, Human
gcccucaggggaggauggccu

SEQ ID NO: 349390 - RNA, 22 nt, Human
ugcugccagccaggccauggag

SEQ ID NO: 349391 - RNA, 22 nt, Human
cuggccacaugugugcugagca

SEQ ID NO: 349392 - RNA, 22 nt, Human
uggagggcucuuucaccuggua

SEQ ID NO: 349393 - RNA, 22 nt, Human
uggaggagggcuggugucugua

SEQ ID NO: 349394 - RNA, 22 nt, Human
aaguccuuggagaauagaaagg

SEQ ID NO: 349395 - RNA, 22 nt, Human
acccaggagguggaggcugcag

SEQ ID NO: 349396 - RNA, 22 nt, Human
cagagauuauuauaacuaauua

SEQ ID NO: 349397 - RNA, 22 nt, Human
guguccagagaaacucacagcu

SEQ ID NO: 349398 - RNA, 22 nt, Human
aggaggcuguggagcacuccau

SEQ ID NO: 349399 - RNA, 22 nt, Human
cacugaaauauuaauaucuuau

SEQ ID NO: 349400 - RNA, 22 nt, Human
gggcaugagagggcagcuggca

SEQ ID NO: 349401 - RNA, 22 nt, Human
ucauccuuuugcaugggaaggc

SEQ ID NO: 349402 - RNA, 22 nt, Human
caucagaagaaagacaaaugau

SEQ ID NO: 349403 - RNA, 22 nt, Human
ucuaauccuugcuaccugggug

SEQ ID NO: 349404 - RNA, 22 nt, Human
aguugaagguuggcugauccau

SEQ ID NO: 349405 - RNA, 22 nt, Human
gagcucccaggccccagcaagg

SEQ ID NO: 349406 - RNA, 22 nt, Human
aacagcaauagcacuauucauu

SEQ ID NO: 349407 - RNA, 22 nt, Human
uggagcuggaauuugagcugga

SEQ ID NO: 349408 - RNA, 22 nt, Human
ucuggcucugaauucacuucug

SEQ ID NO: 349409 - RNA, 22 nt, Human
uacuaaacccucgauggaucuu

SEQ ID NO: 349410 - RNA, 22 nt, Human
ucugaagggcugaguggaggag

SEQ ID NO: 349411 - RNA, 19 nt, Human
ucucacaucagcuccuagc

SEQ ID NO: 349412 - RNA, 22 nt, Human
ggcugaaggaugaaagcugcag

SEQ ID NO: 349413 - RNA, 22 nt, Human
cugagauggccacugggucuca

SEQ ID NO: 349414 - RNA, 22 nt, Human
ggcaagaaggcuucagguagcu

SEQ ID NO: 349415 - RNA, 22 nt, Human
ugcagaagaaaacagcugugug

SEQ ID NO: 349416 - RNA, 22 nt, Human
gagucuuugguaaagucugcug

SEQ ID NO: 349417 - RNA, 22 nt, Human
cacuuaagcaguuaauuuaucu

SEQ ID NO: 349418 - RNA, 22 nt, Human
gggagccagcagggcauggagc

SEQ ID NO: 349419 - RNA, 22 nt, Human
agccugagugcuuaggacuguu

SEQ ID NO: 349420 - RNA, 22 nt, Human
ucagagcuaaggggagagcaaa

SEQ ID NO: 349421 - RNA, 21 nt, Human
aggagggcacaaggccaggaa

SEQ ID NO: 349422 - RNA, 22 nt, Human
ucagcagggagaggagaaugca

SEQ ID NO: 349423 - RNA, 22 nt, Human
gcagcuggggccacacuuaggc

SEQ ID NO: 349424 - RNA, 22 nt, Human
aagcaauaagccagauuuggau

SEQ ID NO: 349425 - RNA, 22 nt, Human
gggggcuggacuuucccacaca

SEQ ID NO: 349426 - RNA, 22 nt, Human
gagcugccuacauugccaagag

SEQ ID NO: 349427 - RNA, 22 nt, Human
cagcugccugcaacacaagcuu

SEQ ID NO: 349428 - RNA, 23 nt, Human
ugcugguguuuuugggaccaggg

SEQ ID NO: 349429 - RNA, 19 nt, Human
ggcuggaguggccaucugu

SEQ ID NO: 349430 - RNA, 22 nt, Human
aauauuuguuaguguuuuaaug

SEQ ID NO: 349431 - RNA, 23 nt, Human
ugcugggguaguuuguggcacag

SEQ ID NO: 349432 - RNA, 22 nt, Human
aaaggaagaugccaggacucug

SEQ ID NO: 349433 - RNA, 23 nt, Human
gccucuggagccccagugcucag

SEQ ID NO: 349434 - RNA, 21 nt, Human
uuuuauugaugaauggccacu

SEQ ID NO: 349435 - RNA, 22 nt, Human
uaaucuacuguuuauaugaaau

SEQ ID NO: 349436 - RNA, 22 nt, Human
uacauggguagguuaagucaua

SEQ ID NO: 349437 - RNA, 22 nt, Human
ucuguucagcugccucagggua

SEQ ID NO: 349438 - RNA, 22 nt, Human
gcagcuccuccugggcuggaga

SEQ ID NO: 349439 - RNA, 22 nt, Human
auaaagauuuuuaggcauuucu

SEQ ID NO: 349440 - RNA, 22 nt, Human
ucaaugauagacaagaucuaag

SEQ ID NO: 349441 - RNA, 22 nt, Human
uucaagauccagcacaacagug

SEQ ID NO: 349442 - RNA, 22 nt, Human
ucaggagaacuuccuucuaccc

SEQ ID NO: 349443 - RNA, 22 nt, Human
caggaagauuagaccaagagcu

SEQ ID NO: 349444 - RNA, 22 nt, Human
agugucugaaccaccggggcau

SEQ ID NO: 349445 - RNA, 22 nt, Human
gcagggcaguaagagcuagagu

SEQ ID NO: 349446 - RNA, 22 nt, Human
cuggcuccuccaaggccuggag

SEQ ID NO: 349447 - RNA, 22 nt, Human
cucauacauaugccauuccugc

SEQ ID NO: 349448 - RNA, 22 nt, Human
cagucaccugaagacuugacca

SEQ ID NO: 349449 - RNA, 22 nt, Human
uuugaaugcaggacauacagaa

SEQ ID NO: 349450 - RNA, 22 nt, Human
ugcaccccauuuuacauuuaca

SEQ ID NO: 349451 - RNA, 22 nt, Human
aggaagcuaaccagggagugag

SEQ ID NO: 349452 - RNA, 22 nt, Human
aaauguaguauguugcauguau

SEQ ID NO: 349453 - RNA, 22 nt, Human
ugucagaggcucagggucucag

SEQ ID NO: 349454 - RNA, 22 nt, Human
uagaaagcuugggguguuuaaa

SEQ ID NO: 349455 - RNA, 22 nt, Human
uuucuaaaugguggcugcauug

SEQ ID NO: 349456 - RNA, 21 nt, Human
cagaggccucaugcucugugc

SEQ ID NO: 349457 - RNA, 22 nt, Human
cagagaaagaagcccauucauu

SEQ ID NO: 349458 - RNA, 22 nt, Human
gcccaguaguucaagguugcag

SEQ ID NO: 349459 - RNA, 21 nt, Human
gagugcagcaagguagagucu

SEQ ID NO: 349460 - RNA, 22 nt, Human
caaggccacuccagagacuggu

SEQ ID NO: 349461 - RNA, 22 nt, Human
gcugggaggaucucucccuguc

SEQ ID NO: 349462 - RNA, 22 nt, Human
agccaggauuggcugagccuua

SEQ ID NO: 349463 - RNA, 23 nt, Human
aaauucaguccuucaacucugag

SEQ ID NO: 349464 - RNA, 22 nt, Human
agggcagcucucaccucuggcc

SEQ ID NO: 349465 - RNA, 22 nt, Human
cuuuggcacagucucauuugau

SEQ ID NO: 349466 - RNA, 20 nt, Human
gcugccuguuucuguaagua

SEQ ID NO: 349467 - RNA, 22 nt, Human
uguaguaagugcgcaauaaaua

SEQ ID NO: 349468 - RNA, 22 nt, Human
uccucagggcggccuccgucuu

SEQ ID NO: 349469 - RNA, 19 nt, Human
uauuucaaagugccgucua

SEQ ID NO: 349470 - RNA, 22 nt, Human
cccugcagaccaaugccauaga

SEQ ID NO: 349471 - RNA, 22 nt, Human
ugugaauaaugccgcaauaaac

SEQ ID NO: 349472 - RNA, 22 nt, Human
gggcugacucugcacugagcca

SEQ ID NO: 349473 - RNA, 21 nt, Human
cucaggaucuuauauauuagu

SEQ ID NO: 349474 - RNA, 22 nt, Human
caggggaagaugccaagggaga

SEQ ID NO: 349475 - RNA, 22 nt, Human
cagggugccucccgcucgccgg

SEQ ID NO: 349476 - RNA, 22 nt, Human
aguguccccuacagaggcauuc

SEQ ID NO: 349477 - RNA, 19 nt, Human
cacacccaugcuugccaag

SEQ ID NO: 349478 - RNA, 20 nt, Human
gggugagauguaggagaggg

SEQ ID NO: 349479 - RNA, 22 nt, Human
accuugaugccuuuccaagaug

SEQ ID NO: 349480 - RNA, 22 nt, Human
ugaaggccucugguacaugcca

SEQ ID NO: 349481 - RNA, 22 nt, Human
uuugcauuucuaaugagcuccg

SEQ ID NO: 349482 - RNA, 22 nt, Human
uauaaaauggcaucagcuccaa

SEQ ID NO: 349483 - RNA, 22 nt, Human
ugaggcucaagaaagauuuguu

SEQ ID NO: 349484 - RNA, 22 nt, Human
uccuuugacuucuugcagucca

SEQ ID NO: 349485 - RNA, 22 nt, Human
gccuggagugguccugcugccc

SEQ ID NO: 349486 - RNA, 22 nt, Human
gaggagcaugggaaggcucugg

SEQ ID NO: 349487 - RNA, 22 nt, Human
cacagguguaugaauaugucca

SEQ ID NO: 349488 - RNA, 22 nt, Human
gcugcuccgucugagcucuggu

SEQ ID NO: 349489 - RNA, 22 nt, Human
gagagaaaugugcaguuugggc

SEQ ID NO: 349490 - RNA, 22 nt, Human
aguggagaauaugcagaaagcc

SEQ ID NO: 349491 - RNA, 22 nt, Human
ucugcaggcuuggaguggcagc

SEQ ID NO: 349492 - RNA, 22 nt, Human
uauucacagcugccgcacucag

SEQ ID NO: 349493 - RNA, 22 nt, Human
ucuuggagaauggcagagaagc

SEQ ID NO: 349494 - RNA, 22 nt, Human
auuuuucucuuuccacugagau

SEQ ID NO: 349495 - RNA, 22 nt, Human
augaaaauucuaugcaggccag

SEQ ID NO: 349496 - RNA, 22 nt, Human
cacccuagcugucauuucaguu

SEQ ID NO: 349497 - RNA, 22 nt, Human
agugcagagagcaauacucuac

SEQ ID NO: 349498 - RNA, 22 nt, Human
gauggcaggugauagccgaguc

SEQ ID NO: 349499 - RNA, 22 nt, Human
gcagccagggagagaaccaggg

SEQ ID NO: 349500 - RNA, 20 nt, Human
ucauccaggacaggaguggc

SEQ ID NO: 349501 - RNA, 22 nt, Human
aggcccaguccucugccgucug

SEQ ID NO: 349502 - RNA, 22 nt, Human
aauauaugagggagcuauuuga

SEQ ID NO: 349503 - RNA, 22 nt, Human
ugccaggcuuuggucaaaggcu

SEQ ID NO: 349504 - RNA, 22 nt, Human
acaacuuuucuaucauguggaa

SEQ ID NO: 349505 - RNA, 22 nt, Human
agaaaugaagagagucaagguu

SEQ ID NO: 349506 - RNA, 22 nt, Human
cauuugaaccuggauguucuua

SEQ ID NO: 349507 - RNA, 22 nt, Human
uguccuuuuggcugucuauggu

SEQ ID NO: 349508 - RNA, 22 nt, Human
cugcccugucugcagccuggcu

SEQ ID NO: 349509 - RNA, 21 nt, Human
ggacagcugcgcgcagggcuc

SEQ ID NO: 349510 - RNA, 22 nt, Human
accugcagcugagaaaaugacu

SEQ ID NO: 349511 - RNA, 22 nt, Human
gcagagugaggaagagcuucca

SEQ ID NO: 349512 - RNA, 23 nt, Human
gccuucagcucgggaaggcuccc

SEQ ID NO: 349513 - RNA, 22 nt, Human
uggcugagugaacauguccauu

SEQ ID NO: 349514 - RNA, 22 nt, Human
gagagggauacugaguuuuggu

SEQ ID NO: 349515 - RNA, 22 nt, Human
gguuugcauucugaaaggcuca

SEQ ID NO: 349516 - RNA, 22 nt, Human
agggaguuagaaauccaggaua

SEQ ID NO: 349517 - RNA, 22 nt, Human
agggcccuaaggaaggcacaca

SEQ ID NO: 349518 - RNA, 22 nt, Human
ggggugggcgugcagggacacc

SEQ ID NO: 349519 - RNA, 18 nt, Human
uugagggaggggcagagu

SEQ ID NO: 349520 - RNA, 22 nt, Human
uacagauauagagauuuauaga

SEQ ID NO: 349521 - RNA, 22 nt, Human
cuguuauuucugccaggugagu

SEQ ID NO: 349522 - RNA, 21 nt, Human
uauuugcugccaucuuugagg

SEQ ID NO: 349523 - RNA, 22 nt, Human
accaggaguaacagugaguggu

SEQ ID NO: 349524 - RNA, 22 nt, Human
gcugccacauuuucaggacuaa

SEQ ID NO: 349525 - RNA, 23 nt, Human
gguggcaggaguggaugcugagc

SEQ ID NO: 349526 - RNA, 22 nt, Human
uuaauuaaauucaugagcauug

SEQ ID NO: 349527 - RNA, 22 nt, Human
ggagaaagcuguaguggaaugu

SEQ ID NO: 349528 - RNA, 22 nt, Human
cugggcugcgggcgccccucca

SEQ ID NO: 349529 - RNA, 22 nt, Human
uccagggaucuuuagagucuuu

SEQ ID NO: 349530 - RNA, 22 nt, Human
uuauugccugauugaggucauu

SEQ ID NO: 349531 - RNA, 22 nt, Human
gcugggcagccccuacagagag

SEQ ID NO: 349532 - RNA, 19 nt, Human
ccagagacauuggcaucuu

SEQ ID NO: 349533 - RNA, 22 nt, Human
aagcuggacucugccauuuacu

SEQ ID NO: 349534 - RNA, 22 nt, Human
gcacccaggccggcgacugcag

SEQ ID NO: 349535 - RNA, 22 nt, Human
cauugcacaucugagaagagau

SEQ ID NO: 349536 - RNA, 22 nt, Human
agcugcugaaugacacugcaag

SEQ ID NO: 349537 - RNA, 22 nt, Human
aaggcacuuuuccugagaugau

SEQ ID NO: 349538 - RNA, 22 nt, Human
agcugcagcguucauuuuucca

SEQ ID NO: 349539 - RNA, 22 nt, Human
uuuguuuagaugguaaaucagu

SEQ ID NO: 349540 - RNA, 19 nt, Human
aggagaagacucucucccc

SEQ ID NO: 349541 - RNA, 22 nt, Human
uucaagauaauaggaaugaaaa

SEQ ID NO: 349542 - RNA, 22 nt, Human
uggcuccuaucaaggagugggu

SEQ ID NO: 349543 - RNA, 22 nt, Human
gaggcaggcccugaaugaguca

SEQ ID NO: 349544 - RNA, 22 nt, Human
aagucauugguagcuugauagg

SEQ ID NO: 349545 - RNA, 22 nt, Human
ggcugcugguggaaugguaggc

SEQ ID NO: 349546 - RNA, 22 nt, Human
uucaggaugacaccauguccag

SEQ ID NO: 349547 - RNA, 22 nt, Human
gggcugcugcccaggaggcacc

SEQ ID NO: 349548 - RNA, 18 nt, Human
ucuuuggacaacuacugg

SEQ ID NO: 349549 - RNA, 22 nt, Human
ugaggcucaaggucugguggag

SEQ ID NO: 349550 - RNA, 22 nt, Human
cuggagcucuguguguuccuga

SEQ ID NO: 349551 - RNA, 21 nt, Human
uccuccuucaaguccuggccu

SEQ ID NO: 349552 - RNA, 22 nt, Human
aucaaaguuucccagaaguugu

SEQ ID NO: 349553 - RNA, 22 nt, Human
uaaaucucacuggguauauugg

SEQ ID NO: 349554 - RNA, 22 nt, Human
uuucaaagguggaagagugaau

SEQ ID NO: 349555 - RNA, 20 nt, Human
uuucaguuaucuugaccuuc

SEQ ID NO: 349556 - RNA, 22 nt, Human
uauguacauguuaaagggcaaa

SEQ ID NO: 349557 - RNA, 22 nt, Human
cagaauuuaaguggauuauucu

SEQ ID NO: 349558 - RNA, 22 nt, Human
uggggacacagagguucguugg

SEQ ID NO: 349559 - RNA, 22 nt, Human
augcugugccuucucugugcca

SEQ ID NO: 349560 - RNA, 22 nt, Human
ccugccuggcugucagcagagc

SEQ ID NO: 349561 - RNA, 22 nt, Human
uuuccucugacugcuccccugc

SEQ ID NO: 349562 - RNA, 23 nt, Human
ugggcagcuucugcaugcccacc

SEQ ID NO: 349563 - RNA, 22 nt, Human
gauuucaaccuaacaguaugac

SEQ ID NO: 349564 - RNA, 20 nt, Human
augugagggguugaaguggg

SEQ ID NO: 349565 - RNA, 22 nt, Human
ucugguuagccaauaaugccaa

SEQ ID NO: 349566 - RNA, 22 nt, Human
caaacauucaaguacaagucuu

SEQ ID NO: 349567 - RNA, 22 nt, Human
cagcucucacacccuccuccca

SEQ ID NO: 349568 - RNA, 22 nt, Human
ggcuuccuggggccuccugcaa

SEQ ID NO: 349569 - RNA, 22 nt, Human
ggagcagggcagugaauucugg

SEQ ID NO: 349570 - RNA, 22 nt, Human
uagaauucauguuacuguuagc

SEQ ID NO: 349571 - RNA, 20 nt, Human
uuucacagucccuguuuccu

SEQ ID NO: 349572 - RNA, 22 nt, Human
aagcagggugucuugacccaug

SEQ ID NO: 349573 - RNA, 22 nt, Human
aaggccugaacaugaggagaug

SEQ ID NO: 349574 - RNA, 22 nt, Human
uuucagacagauucuucucagu

SEQ ID NO: 349575 - RNA, 22 nt, Human
caggagaagguuuggagugcag

SEQ ID NO: 349576 - RNA, 22 nt, Human
aggcacugacagauucuguguc

SEQ ID NO: 349577 - RNA, 22 nt, Human
aucagugcuaaagcaaaugccc

SEQ ID NO: 349578 - RNA, 22 nt, Human
acucaggaaaugagaggcucuc

SEQ ID NO: 349579 - RNA, 22 nt, Human
cugccaggccucaucccagcca

SEQ ID NO: 349580 - RNA, 22 nt, Human
ucucacuggguauaaaugagua

SEQ ID NO: 349581 - RNA, 22 nt, Human
gcagggcaucccugagcgggug

SEQ ID NO: 349582 - RNA, 22 nt, Human
cacugcuuauaaauucuaggca

SEQ ID NO: 349583 - RNA, 18 nt, Human
caauuucauccuuaagcc

SEQ ID NO: 349584 - RNA, 22 nt, Human
aaacuuuguucgucugaugugg

SEQ ID NO: 349585 - RNA, 22 nt, Human
cugagggcaugaacauuccaua

SEQ ID NO: 349586 - RNA, 22 nt, Human
uucacagaauggcaaguuaugg

SEQ ID NO: 349587 - RNA, 22 nt, Human
ucagcuuugccaccagcuguaa

SEQ ID NO: 349588 - RNA, 22 nt, Human
uuauuagcugggcuucagggug

SEQ ID NO: 349589 - RNA, 22 nt, Human
aggcuuccucgugccuuagaua

SEQ ID NO: 349590 - RNA, 22 nt, Human
acacauauucauauguacuuac

SEQ ID NO: 349591 - RNA, 22 nt, Human
aggagcugaagucucugcacuc

SEQ ID NO: 349592 - RNA, 22 nt, Human
auuccaaacucuuucccugucg

SEQ ID NO: 349593 - RNA, 21 nt, Human
agcagccauggaugguaugua

SEQ ID NO: 349594 - RNA, 22 nt, Human
agaggugacauaggagaggcuc

SEQ ID NO: 349595 - RNA, 22 nt, Human
gguguagcucugugucccacug

SEQ ID NO: 349596 - RNA, 22 nt, Human
gccacguugccacccgggugac

SEQ ID NO: 349597 - RNA, 22 nt, Human
uuugaaagggaaauaaacuccu

SEQ ID NO: 349598 - RNA, 22 nt, Human
ccagcucccugaagccuggucu

SEQ ID NO: 349599 - RNA, 22 nt, Human
cagaggugcauacaggucauua

SEQ ID NO: 349600 - RNA, 20 nt, Human
cacaggcuauaugagagcca

SEQ ID NO: 349601 - RNA, 19 nt, Human
ucaguggagaaaggggaag

SEQ ID NO: 349602 - RNA, 22 nt, Human
agcuguguggugucugacagcu

SEQ ID NO: 349603 - RNA, 22 nt, Human
cagcuggcuccaccucugggcu

SEQ ID NO: 349604 - RNA, 22 nt, Human
ggcugaaacagauuucaagaca

SEQ ID NO: 349605 - RNA, 22 nt, Human
cccuggagugugacgaggcauu

SEQ ID NO: 349606 - RNA, 22 nt, Human
uaugaacucuggagucugagug

SEQ ID NO: 349607 - RNA, 22 nt, Human
gggauggcucaaaggagucagg

SEQ ID NO: 349608 - RNA, 22 nt, Human
aaagaguucuaugaucuuucca

SEQ ID NO: 349609 - RNA, 22 nt, Human
ccagcagagucuaggaaggagg

SEQ ID NO: 349610 - RNA, 22 nt, Human
auuucaacauucucaguuguag

SEQ ID NO: 349611 - RNA, 22 nt, Human
cuggaagguucuuugugugccu

SEQ ID NO: 349612 - RNA, 21 nt, Human
uggcugaguggaugcaugaau

SEQ ID NO: 349613 - RNA, 22 nt, Human
ccugccugcaaaaugggacaag

SEQ ID NO: 349614 - RNA, 22 nt, Human
cacagguggcuccaaguuagag

SEQ ID NO: 349615 - RNA, 23 nt, Human
cagguggcuccacgagggguggg

SEQ ID NO: 349616 - RNA, 22 nt, Human
ccagcgcuucccaucagggagg

SEQ ID NO: 349617 - RNA, 23 nt, Human
ccaggccucucagagggugugcc

SEQ ID NO: 349618 - RNA, 22 nt, Human
ggagcugggaauuggaucaucu

SEQ ID NO: 349619 - RNA, 23 nt, Human
agagcaucaugaugcuaagucug

SEQ ID NO: 349620 - RNA, 22 nt, Human
guuccauaucacagcagacgaa

SEQ ID NO: 349621 - RNA, 23 nt, Human
aggcagugggggccacuuugcuu

SEQ ID NO: 349622 - RNA, 22 nt, Human
uguucccaagauaagauuauga

SEQ ID NO: 349623 - RNA, 22 nt, Human
agugcuuuagcauccaacuguc

SEQ ID NO: 349624 - RNA, 22 nt, Human
guauuugauagauuucaaagga

SEQ ID NO: 349625 - RNA, 22 nt, Human
gcagagccugacgggauuuuuc

SEQ ID NO: 349626 - RNA, 22 nt, Human
ugaaucaguauaaauucucaaa

SEQ ID NO: 349627 - RNA, 22 nt, Human
aggagcagcuucugaaccaugu

SEQ ID NO: 349628 - RNA, 22 nt, Human
uacaaagugagcaaccucuuuu

SEQ ID NO: 349629 - RNA, 22 nt, Human
cacaugggugugccuggaggaa

SEQ ID NO: 349630 - RNA, 20 nt, Human
ugaaaggugggaauuguggg

SEQ ID NO: 349631 - RNA, 22 nt, Human
aaugcacagcuaaagugguucc

SEQ ID NO: 349632 - RNA, 22 nt, Human
gaaauguguuguucauuucuaa

SEQ ID NO: 349633 - RNA, 22 nt, Human
cauaauuuuuuuaagucagaac

SEQ ID NO: 349634 - RNA, 22 nt, Human
gaccauuucuaggaaucagacu

SEQ ID NO: 349635 - RNA, 22 nt, Human
uggcugagggcacuaugaagcc

SEQ ID NO: 349636 - RNA, 22 nt, Human
uacaguaacauguuguacaagc

SEQ ID NO: 349637 - RNA, 22 nt, Human
ugcuuuauucgacaucugguag

SEQ ID NO: 349638 - RNA, 22 nt, Human
ugaggaagggugugacggcacc

SEQ ID NO: 349639 - RNA, 22 nt, Human
ucauugcaguagggagagaccc

SEQ ID NO: 349640 - RNA, 22 nt, Human
auauauuuacucuccuguugca

SEQ ID NO: 349641 - RNA, 22 nt, Human
cagcugaagagaggugcugagu

SEQ ID NO: 349642 - RNA, 22 nt, Human
acaaagucacaauaauuaaccu

SEQ ID NO: 349643 - RNA, 22 nt, Human
uuugcuauaaaagggucacacg

SEQ ID NO: 349644 - RNA, 22 nt, Human
ggcaaaaaccacaauuacuuuu

SEQ ID NO: 349645 - RNA, 22 nt, Human
ggaccugccagaacucaggcua

SEQ ID NO: 349646 - RNA, 22 nt, Human
uccuggguccauggcagccgaa

SEQ ID NO: 349647 - RNA, 20 nt, Human
aucagcaacugccacucagu

SEQ ID NO: 349648 - RNA, 22 nt, Human
ucauugcagacuaacaaucuca

SEQ ID NO: 349649 - RNA, 22 nt, Human
gauggcaggcaggugaguagag

SEQ ID NO: 349650 - RNA, 22 nt, Human
gggaagggacuuguuuaagguc

SEQ ID NO: 349651 - RNA, 22 nt, Human
ucacagacacagggagaagcau

SEQ ID NO: 349652 - RNA, 22 nt, Human
cacucugagaaguacaagcucc

SEQ ID NO: 349653 - RNA, 22 nt, Human
cagcugcuguuacugcuuauua

SEQ ID NO: 349654 - RNA, 22 nt, Human
ucugggaauuuauuggcacuuu

SEQ ID NO: 349655 - RNA, 22 nt, Human
ugaaggaagaauaggcaguguu

SEQ ID NO: 349656 - RNA, 22 nt, Human
gauggcuuugugcaccaugauu

SEQ ID NO: 349657 - RNA, 21 nt, Human
ugggagagggcucagcuaccc

SEQ ID NO: 349658 - RNA, 22 nt, Human
uucugaaccauugagcacugcc

SEQ ID NO: 349659 - RNA, 22 nt, Human
aggcacugauucuguuuuccau

SEQ ID NO: 349660 - RNA, 23 nt, Human
ggucccaguggagaggccucacc

SEQ ID NO: 349661 - RNA, 22 nt, Human
uguuacacagcagaauagcaag

SEQ ID NO: 349662 - RNA, 23 nt, Human
aagcugccagucugaagccuggg

SEQ ID NO: 349663 - RNA, 22 nt, Human
agcagcaugaugacagagucuc

SEQ ID NO: 349664 - RNA, 22 nt, Human
gccuggagcccaguguggggcu

SEQ ID NO: 349665 - RNA, 22 nt, Human
ggagugggaacaaugacauggu

SEQ ID NO: 349666 - RNA, 22 nt, Human
ggcugcuggaagacugaacaag

SEQ ID NO: 349667 - RNA, 22 nt, Human
ccuggcaguuuugcccaggauu

SEQ ID NO: 349668 - RNA, 20 nt, Human
gggugggagagucugagggu

SEQ ID NO: 349669 - RNA, 22 nt, Human
ugucucaguucccuucucugga

SEQ ID NO: 349670 - RNA, 22 nt, Human
cccaggagguuggggcuacagu

SEQ ID NO: 349671 - RNA, 22 nt, Human
cagggcuggauccuccagacuc

SEQ ID NO: 349672 - RNA, 22 nt, Human
agauggagaaugacaauuaagg

SEQ ID NO: 349673 - RNA, 22 nt, Human
ggauguugauugaauggccauu

SEQ ID NO: 349674 - RNA, 22 nt, Human
gaauuucaagcagugcaauguu

SEQ ID NO: 349675 - RNA, 22 nt, Human
aauauuucuccuucguuauagc

SEQ ID NO: 349676 - RNA, 22 nt, Human
ugcuuuauggauuuguguccug

SEQ ID NO: 349677 - RNA, 22 nt, Human
cuggcugguuacuauuucuggu

SEQ ID NO: 349678 - RNA, 22 nt, Human
ggcagugaaugaaacagaggcu

SEQ ID NO: 349679 - RNA, 22 nt, Human
uuagaaaggaaucuucauuuca

SEQ ID NO: 349680 - RNA, 22 nt, Human
agagcccucuucacugccccuu

SEQ ID NO: 349681 - RNA, 22 nt, Human
ugaauaaacuaugaggaggaau

SEQ ID NO: 349682 - RNA, 22 nt, Human
aggcuucagguuugcuuugcag

SEQ ID NO: 349683 - RNA, 21 nt, Human
ggggcagagcuaggcccugca

SEQ ID NO: 349684 - RNA, 22 nt, Human
uuugcacuagcauuuguccaug

SEQ ID NO: 349685 - RNA, 22 nt, Human
auaaaaguaggaccaacuuaca

SEQ ID NO: 349686 - RNA, 21 nt, Human
agaaaauggcguuuuagauuu

SEQ ID NO: 349687 - RNA, 22 nt, Human
aaugauguauuaguacaacaca

SEQ ID NO: 349688 - RNA, 22 nt, Human
acugugugggccgcucacuggg

SEQ ID NO: 349689 - RNA, 23 nt, Human
agucuucauuguauuuccagacc

SEQ ID NO: 349690 - RNA, 22 nt, Human
cacauaauaaauguuccugaug

SEQ ID NO: 349691 - RNA, 22 nt, Human
gaaugugucacccugucccaug

SEQ ID NO: 349692 - RNA, 22 nt, Human
cugcucuguuucuuagcugggu

SEQ ID NO: 349693 - RNA, 22 nt, Human
cagcugccugucuggaggcaau

SEQ ID NO: 349694 - RNA, 22 nt, Human
ccagggcuggugggagaugcug

SEQ ID NO: 349695 - RNA, 22 nt, Human
auuuaguguauucuaauaugug

SEQ ID NO: 349696 - RNA, 22 nt, Human
auaaagauuucuuuuucucuac

SEQ ID NO: 349697 - RNA, 22 nt, Human
agucuucucauuucacaugcuu

SEQ ID NO: 349698 - RNA, 17 nt, Human
aggaagggcaaguuucu

SEQ ID NO: 349699 - RNA, 22 nt, Human
auucaaguucuucugucuuugc

SEQ ID NO: 349700 - RNA, 22 nt, Human
aggucagcaggccaggggcgaa

SEQ ID NO: 349701 - RNA, 22 nt, Human
aagauuuccuggauguaauucc

SEQ ID NO: 349702 - RNA, 20 nt, Human
cuucuucaguaguuuguucu

SEQ ID NO: 349703 - RNA, 22 nt, Human
gccaggaggggagaguguguca

SEQ ID NO: 349704 - RNA, 22 nt, Human
gagccugaaauacaggucacug

SEQ ID NO: 349705 - RNA, 23 nt, Human
uaagaacagacaagcauuuacau

SEQ ID NO: 349706 - RNA, 22 nt, Human
ugugaaagauacuaggcagagg

SEQ ID NO: 349707 - RNA, 22 nt, Human
guacauuucauuuaaaugaugu

SEQ ID NO: 349708 - RNA, 22 nt, Human
ggcugcagcagagggacucacg

SEQ ID NO: 349709 - RNA, 22 nt, Human
ucacuguugaccuggaaguggg

SEQ ID NO: 349710 - RNA, 22 nt, Human
acauuugacauuuaguaucagc

SEQ ID NO: 349711 - RNA, 22 nt, Human
ugaggcaguugagcuuccugag

SEQ ID NO: 349712 - RNA, 22 nt, Human
ggagcugucuguagggcacagg

SEQ ID NO: 349713 - RNA, 22 nt, Human
uagggcucuggugggcucuguu

SEQ ID NO: 349714 - RNA, 19 nt, Human
ucucuacacuacauuucua

SEQ ID NO: 349715 - RNA, 22 nt, Human
caguaaauuaucucaucucugu

SEQ ID NO: 349716 - RNA, 22 nt, Human
gcaggagccacuucagggaugc

SEQ ID NO: 349717 - RNA, 22 nt, Human
auaugcauguacgugugcacaa

SEQ ID NO: 349718 - RNA, 22 nt, Human
cagcccagcagucuuagccugc

SEQ ID NO: 349719 - RNA, 22 nt, Human
uaucagaaugcagccaugugca

SEQ ID NO: 349720 - RNA, 22 nt, Human
ugacaccacaacuagccauuga

SEQ ID NO: 349721 - RNA, 22 nt, Human
augguuuuccucugcugcuuaa

SEQ ID NO: 349722 - RNA, 22 nt, Human
uagggcucagagaaguggggcc

SEQ ID NO: 349723 - RNA, 22 nt, Human
cuugaaagauuuggccucugug

SEQ ID NO: 349724 - RNA, 22 nt, Human
aucacugucgucaucugagauu

SEQ ID NO: 349725 - RNA, 21 nt, Human
agucccauccgguaagcaagc

SEQ ID NO: 349726 - RNA, 22 nt, Human
aggguggcugaguagauggaag

SEQ ID NO: 349727 - RNA, 22 nt, Human
gacacagcacuguacaaggaau

SEQ ID NO: 349728 - RNA, 22 nt, Human
ggggaccuucccagagcaguug

SEQ ID NO: 349729 - RNA, 22 nt, Human
uggccuuggcagugagaagagu

SEQ ID NO: 349730 - RNA, 22 nt, Human
uggcugaauaaaauaugguguu

SEQ ID NO: 349731 - RNA, 19 nt, Human
gacagugcaguuguaguac

SEQ ID NO: 349732 - RNA, 22 nt, Human
ugcagaagaaugagcuuggagu

SEQ ID NO: 349733 - RNA, 23 nt, Human
gcagagcugcccuauugccuugg

SEQ ID NO: 349734 - RNA, 22 nt, Human
aggcucagcccaagguggagag

SEQ ID NO: 349735 - RNA, 22 nt, Human
gaggcucaguuaugucaucagg

SEQ ID NO: 349736 - RNA, 22 nt, Human
aagauacauaaagguagagucu

SEQ ID NO: 349737 - RNA, 22 nt, Human
ggcagcaugagccuggugaauu

SEQ ID NO: 349738 - RNA, 22 nt, Human
cuguggcuuucucugccuccuu

SEQ ID NO: 349739 - RNA, 21 nt, Human
uggcagagugcagucuauaca

SEQ ID NO: 349740 - RNA, 22 nt, Human
cuggcuguauuaguuugauccu

SEQ ID NO: 349741 - RNA, 22 nt, Human
ucuuagaaauuccccaguggcu

SEQ ID NO: 349742 - RNA, 22 nt, Human
ccagcagcuguggcuuugccuc

SEQ ID NO: 349743 - RNA, 22 nt, Human
aguaaaaucaccaucucuuugu

SEQ ID NO: 349744 - RNA, 22 nt, Human
ggcagauguuauaugaucugag

SEQ ID NO: 349745 - RNA, 22 nt, Human
ccugaggcuuaaucugucccaa

SEQ ID NO: 349746 - RNA, 22 nt, Human
ccagggaguuuccaaucugaga

SEQ ID NO: 349747 - RNA, 20 nt, Human
auguccagugacuggaccau

SEQ ID NO: 349748 - RNA, 22 nt, Human
ugaaaugagauagauaaucagg

SEQ ID NO: 349749 - RNA, 22 nt, Human
uagagcauuuagaggggcagga

SEQ ID NO: 349750 - RNA, 22 nt, Human
aguggcaggaaaguggaagaga

SEQ ID NO: 349751 - RNA, 22 nt, Human
uggaagcacuuggguuuuguug

SEQ ID NO: 349752 - RNA, 22 nt, Human
caggccuccacuccacgcagac

SEQ ID NO: 349753 - RNA, 22 nt, Human
agaggauguucuaggcacucau

SEQ ID NO: 349754 - RNA, 22 nt, Human
agaagaaaugugaaggccacug

SEQ ID NO: 349755 - RNA, 22 nt, Human
ugcaauaaguuguguuaucacu

SEQ ID NO: 349756 - RNA, 22 nt, Human
cagcucaaguuucccaggucag

SEQ ID NO: 349757 - RNA, 22 nt, Human
ccacugucuuuuccaggcugaa

SEQ ID NO: 349758 - RNA, 22 nt, Human
gcugauccuuuuaugucuagcu

SEQ ID NO: 349759 - RNA, 22 nt, Human
ucccagaggcuccagucucuau

SEQ ID NO: 349760 - RNA, 22 nt, Human
ucauccaguaugacuggugucu

SEQ ID NO: 349761 - RNA, 22 nt, Human
cuacauuuuaauaagcugcuua

SEQ ID NO: 349762 - RNA, 22 nt, Human
aauacugucuuucacagauauu

SEQ ID NO: 349763 - RNA, 22 nt, Human
gagucugagaacugggcucagu

SEQ ID NO: 349764 - RNA, 22 nt, Human
cccaugccuucugacucacagg

SEQ ID NO: 349765 - RNA, 22 nt, Human
agggccaccucucuggguuccc

SEQ ID NO: 349766 - RNA, 22 nt, Human
cugagccaaccacagcaggagc

SEQ ID NO: 349767 - RNA, 18 nt, Human
uuugcaaaggaaguaugg

SEQ ID NO: 349768 - RNA, 22 nt, Human
cuccucugucuaccacgagggu

SEQ ID NO: 349769 - RNA, 22 nt, Human
ggagcugaaggggugggcucag

SEQ ID NO: 349770 - RNA, 22 nt, Human
cagcaggaaagacaucugagca

SEQ ID NO: 349771 - RNA, 22 nt, Human
cuccagggagcuguggagguuu

SEQ ID NO: 349772 - RNA, 22 nt, Human
auuggcaguuagugacgaggcu

SEQ ID NO: 349773 - RNA, 22 nt, Human
uucucauucugacucaguguag

SEQ ID NO: 349774 - RNA, 22 nt, Human
ucuguucauaguaguguauaug

SEQ ID NO: 349775 - RNA, 22 nt, Human
auccaaagauggaaagaacuuu

SEQ ID NO: 349776 - RNA, 22 nt, Human
auguuuauguugggcuauauuu

SEQ ID NO: 349777 - RNA, 22 nt, Human
agggccagcccauaaugccaaa

SEQ ID NO: 349778 - RNA, 22 nt, Human
uuucuucauucaccuucacccc

SEQ ID NO: 349779 - RNA, 22 nt, Human
auacagauguugaauguuauau

SEQ ID NO: 349780 - RNA, 22 nt, Human
augaggcauuccacucaaacuc

SEQ ID NO: 349781 - RNA, 22 nt, Human
ugucagagcaaggccaggccag

SEQ ID NO: 349782 - RNA, 22 nt, Human
guauuagggccaaaggcaggaa

SEQ ID NO: 349783 - RNA, 22 nt, Human
cagcuucccuuggcugagcaga

SEQ ID NO: 349784 - RNA, 22 nt, Human
cagagugaacagugggaugugc

SEQ ID NO: 349785 - RNA, 18 nt, Human
aggaaagaaaggcaggug

SEQ ID NO: 349786 - RNA, 22 nt, Human
agagugaaguuuuugaaaguga

SEQ ID NO: 349787 - RNA, 22 nt, Human
agcugccaaguuucucaguuua

SEQ ID NO: 349788 - RNA, 22 nt, Human
ccagcccugucaccaacuggag

SEQ ID NO: 349789 - RNA, 22 nt, Human
gagaaggcugauccuuggaguu

SEQ ID NO: 349790 - RNA, 22 nt, Human
ugacauuuuaucaauaucacag

SEQ ID NO: 349791 - RNA, 22 nt, Human
caaguaaacaauaugugauuca

SEQ ID NO: 349792 - RNA, 22 nt, Human
aggcagaugguaacugugauau

SEQ ID NO: 349793 - RNA, 22 nt, Human
agcugccaggccccugagaacc

SEQ ID NO: 349794 - RNA, 22 nt, Human
gcacagagggcagugagccucu

SEQ ID NO: 349795 - RNA, 22 nt, Human
aaaucagucccucuuggaauuu

SEQ ID NO: 349796 - RNA, 22 nt, Human
cugcugugcuuguggccacccg

SEQ ID NO: 349797 - RNA, 18 nt, Human
ggagccagucugucucug

SEQ ID NO: 349798 - RNA, 22 nt, Human
ucaucacuguaucauugauaga

SEQ ID NO: 349799 - RNA, 22 nt, Human
acagcuuuguuuucccugcuga

SEQ ID NO: 349800 - RNA, 22 nt, Human
gauuucaaggaguuuucacagu

SEQ ID NO: 349801 - RNA, 22 nt, Human
augaggcaaucaugguccaguu

SEQ ID NO: 349802 - RNA, 18 nt, Human
uguagagccagguuugcc

SEQ ID NO: 349803 - RNA, 22 nt, Human
ugcugccauggucgcugguguc

SEQ ID NO: 349804 - RNA, 22 nt, Human
guagcccaccuggggagggcga

SEQ ID NO: 349805 - RNA, 22 nt, Human
cuggaucaugggaaagggauca

SEQ ID NO: 349806 - RNA, 22 nt, Human
agcuggugcugaagcucuugag

SEQ ID NO: 349807 - RNA, 22 nt, Human
ucuccccaaaggacucacucuc

SEQ ID NO: 349808 - RNA, 22 nt, Human
ugcagggaacuuggacagcuag

SEQ ID NO: 349809 - RNA, 22 nt, Human
ggaggaugagcuacgaggagcu

SEQ ID NO: 349810 - RNA, 21 nt, Human
auggagccuaagaguggaggu

SEQ ID NO: 349811 - RNA, 22 nt, Human
uagcagcugugaguaaaagcca

SEQ ID NO: 349812 - RNA, 22 nt, Human
gagccuggccuccugccucagc

SEQ ID NO: 349813 - RNA, 22 nt, Human
ggccuucacgugaccuggcgug

SEQ ID NO: 349814 - RNA, 22 nt, Human
ccuuuauucaauuaguccuaau

SEQ ID NO: 349815 - RNA, 22 nt, Human
aaguucaaggugauaguggcag

SEQ ID NO: 349816 - RNA, 22 nt, Human
acaagcaugggcuuugacauca

SEQ ID NO: 349817 - RNA, 22 nt, Human
gcucuggacuggggccugagaa

SEQ ID NO: 349818 - RNA, 22 nt, Human
aaucaguuguucacucugaaaa

SEQ ID NO: 349819 - RNA, 17 nt, Human
cugagcauccgugcucu

SEQ ID NO: 349820 - RNA, 22 nt, Human
auucuaacacaugcucuaagaa

SEQ ID NO: 349821 - RNA, 22 nt, Human
ucauuucucccggccaaaaacu

SEQ ID NO: 349822 - RNA, 22 nt, Human
ccagcugcugugcagggaggcu

SEQ ID NO: 349823 - RNA, 22 nt, Human
uccagggacagcgcuggagcua

SEQ ID NO: 349824 - RNA, 22 nt, Human
auuaaagacagcagauggaugg

SEQ ID NO: 349825 - RNA, 22 nt, Human
gggccacauugaagggugggua

SEQ ID NO: 349826 - RNA, 20 nt, Human
cugagcccccagccugcagg

SEQ ID NO: 349827 - RNA, 22 nt, Human
auauucacugagcauaaagcca

SEQ ID NO: 349828 - RNA, 19 nt, Human
ucccagagucuagagguug

SEQ ID NO: 349829 - RNA, 22 nt, Human
acacagggcagagagcuggcuc

SEQ ID NO: 349830 - RNA, 22 nt, Human
acaugcauucucuaaaagcaaa

SEQ ID NO: 349831 - RNA, 22 nt, Human
aguccaggaguugggugacauu

SEQ ID NO: 349832 - RNA, 22 nt, Human
gcagcuuucugggacagaaagg

SEQ ID NO: 349833 - RNA, 22 nt, Human
ugccugucuuaauaucuggaaa

SEQ ID NO: 349834 - RNA, 22 nt, Human
agcaggagcccuuaucaccagg

SEQ ID NO: 349835 - RNA, 22 nt, Human
cagggccaugaggcacaggguc

SEQ ID NO: 349836 - RNA, 22 nt, Human
accaggagguguuugcucaagu

SEQ ID NO: 349837 - RNA, 22 nt, Human
ucagagugugacuuggucauga

SEQ ID NO: 349838 - RNA, 22 nt, Human
cuagaaauguagauucuuagug

SEQ ID NO: 349839 - RNA, 22 nt, Human
gcagcugcaauaggcaucaagc

SEQ ID NO: 349840 - RNA, 22 nt, Human
uccuccaggucuaggguggcuu

SEQ ID NO: 349841 - RNA, 22 nt, Human
aggccucacauugggcuucaag

SEQ ID NO: 349842 - RNA, 22 nt, Human
agaagugccgaaaggaagacag

SEQ ID NO: 349843 - RNA, 22 nt, Human
caagagcuacccugugccauau

SEQ ID NO: 349844 - RNA, 22 nt, Human
guggggaaaggaguggggcuca

SEQ ID NO: 349845 - RNA, 22 nt, Human
ugcaguggugguaaagaugcuc

SEQ ID NO: 349846 - RNA, 17 nt, Human
gguguauggggagggaa

SEQ ID NO: 349847 - RNA, 17 nt, Human
agcuccugcccauggcu

SEQ ID NO: 349848 - RNA, 22 nt, Human
ccagagagauugcuucuaaaga

SEQ ID NO: 349849 - RNA, 22 nt, Human
uggcuucuuagaccaguggccu

SEQ ID NO: 349850 - RNA, 22 nt, Human
agauacauuaguaguuacuugu

SEQ ID NO: 349851 - RNA, 17 nt, Human
ugccagccugucccagg

SEQ ID NO: 349852 - RNA, 20 nt, Human
gcccacucuaauccacuguc

SEQ ID NO: 349853 - RNA, 22 nt, Human
aguacuucagaggcugcccagg

SEQ ID NO: 349854 - RNA, 22 nt, Human
uaaagaucuuaggaagauuuuc

SEQ ID NO: 349855 - RNA, 22 nt, Human
cagccagggucaggcagcuucu

SEQ ID NO: 349856 - RNA, 21 nt, Human
cccuugccugcacuccucggc

SEQ ID NO: 349857 - RNA, 22 nt, Human
gaugagggccugguggcugugc

SEQ ID NO: 349858 - RNA, 22 nt, Human
gcagcugagcgugaggaagagu

SEQ ID NO: 349859 - RNA, 22 nt, Human
ggcccacacugacagcugagcu

SEQ ID NO: 349860 - RNA, 17 nt, Human
gcagugaaaagagauca

SEQ ID NO: 349861 - RNA, 22 nt, Human
ggagcagggaauuacagcgcag

SEQ ID NO: 349862 - RNA, 22 nt, Human
uauaguacauggaaucuucaua

SEQ ID NO: 349863 - RNA, 21 nt, Human
cuacagaaucgagcauucugg

SEQ ID NO: 349864 - RNA, 22 nt, Human
gaggcaggcacuguuaucagca

SEQ ID NO: 349865 - RNA, 22 nt, Human
agggaguuccgaucugugcacc

SEQ ID NO: 349866 - RNA, 19 nt, Human
uagcagcugccaaaggaga

SEQ ID NO: 349867 - RNA, 22 nt, Human
cauuuguauagugcuuagacca

SEQ ID NO: 349868 - RNA, 22 nt, Human
uacaaaaaauugauacugacga

SEQ ID NO: 349869 - RNA, 22 nt, Human
ucuucagacuccaaauguuuua

SEQ ID NO: 349870 - RNA, 22 nt, Human
uuugggcaauucagugggaccu

SEQ ID NO: 349871 - RNA, 22 nt, Human
ucaauaauggcaggauaaauuu

SEQ ID NO: 349872 - RNA, 18 nt, Human
aggcaggugcuggaaguc

SEQ ID NO: 349873 - RNA, 22 nt, Human
cacaggagaacccacagauucu

SEQ ID NO: 349874 - RNA, 22 nt, Human
uuauucagauuggcuacaggau

SEQ ID NO: 349875 - RNA, 22 nt, Human
augaacacauguacacauuucu

SEQ ID NO: 349876 - RNA, 22 nt, Human
ggagggaaugucuagcauucuu

SEQ ID NO: 349877 - RNA, 22 nt, Human
ccucaggauacaggagccacag

SEQ ID NO: 349878 - RNA, 22 nt, Human
aucagagacaaaaccagcacuu

SEQ ID NO: 349879 - RNA, 22 nt, Human
ucaggugguccuaagugccauc

SEQ ID NO: 349880 - RNA, 22 nt, Human
ccucccaccauuuagagagagc

SEQ ID NO: 349881 - RNA, 22 nt, Human
ugcagggaggccccgcagcccu

SEQ ID NO: 349882 - RNA, 22 nt, Human
ggcagucuuaucagcauuggac

SEQ ID NO: 349883 - RNA, 19 nt, Human
cugggagguguucagagaa

SEQ ID NO: 349884 - RNA, 17 nt, Human
gcugagaggcagcacag

SEQ ID NO: 349885 - RNA, 22 nt, Human
uuccuucucagcccucgaggau

SEQ ID NO: 349886 - RNA, 22 nt, Human
uacauaauugucuuuguccuca

SEQ ID NO: 349887 - RNA, 22 nt, Human
ggcuuucuaugaacucaaaggc

SEQ ID NO: 349888 - RNA, 22 nt, Human
ugcagggcauaggguccaguuu

SEQ ID NO: 349889 - RNA, 22 nt, Human
cugccucuauaggaguccacca

SEQ ID NO: 349890 - RNA, 22 nt, Human
uccuggaggcaaaugagcacau

SEQ ID NO: 349891 - RNA, 22 nt, Human
accuuucaaaguggcuaucacu

SEQ ID NO: 349892 - RNA, 22 nt, Human
cagcccugagaaggaggaucuc

SEQ ID NO: 349893 - RNA, 22 nt, Human
gaacccaggcuuuugaggcugu

SEQ ID NO: 349894 - RNA, 22 nt, Human
auuaggcauucugaaugagguc

SEQ ID NO: 349895 - RNA, 22 nt, Human
auauaugcauguguacuuaugu

SEQ ID NO: 349896 - RNA, 22 nt, Human
ccuagagcucugcuuuaucuaa

SEQ ID NO: 349897 - RNA, 22 nt, Human
gaggcagcaugguaccuuggag

SEQ ID NO: 349898 - RNA, 22 nt, Human
aagcuuuaaggaauuuuaugga

SEQ ID NO: 349899 - RNA, 22 nt, Human
uuuguaaauagcaguacucaug

SEQ ID NO: 349900 - RNA, 22 nt, Human
acacccagagcgccagugccga

SEQ ID NO: 349901 - RNA, 22 nt, Human
acugugcaugaaccgaaacaaa

SEQ ID NO: 349902 - RNA, 22 nt, Human
uuaucacuuaugagcuuuuugc

SEQ ID NO: 349903 - RNA, 22 nt, Human
acuguucaucucuuagaaagua

SEQ ID NO: 349904 - RNA, 22 nt, Human
gcucccagcauugcugcugaau

SEQ ID NO: 349905 - RNA, 22 nt, Human
cuggcuggccggaggcaucccu

SEQ ID NO: 349906 - RNA, 22 nt, Human
acauuucuuucuauucaguagc

SEQ ID NO: 349907 - RNA, 22 nt, Human
gcugcccagacauugaaucagg

SEQ ID NO: 349908 - RNA, 23 nt, Human
ugcuguccaacagacuggccaug

SEQ ID NO: 349909 - RNA, 22 nt, Human
uguggcaggcaagauguacaga

SEQ ID NO: 349910 - RNA, 21 nt, Human
uuaagagcuuagcaguaggcc

SEQ ID NO: 349911 - RNA, 22 nt, Human
gguccagggaacuuugaaggau

SEQ ID NO: 349912 - RNA, 22 nt, Human
ggcagugaaucugagagccugg

SEQ ID NO: 349913 - RNA, 22 nt, Human
ucccaggaaugucugaaaguga

SEQ ID NO: 349914 - RNA, 22 nt, Human
ccuggagguggagguugcagug

SEQ ID NO: 349915 - RNA, 23 nt, Human
ucagaggaucaucaaacguuuuc

SEQ ID NO: 349916 - RNA, 22 nt, Human
caauuucucuuuauaucucaca

SEQ ID NO: 349917 - RNA, 22 nt, Human
ccagaggucuccugcacgggau

SEQ ID NO: 349918 - RNA, 22 nt, Human
cagugcuccugauguacccuug

SEQ ID NO: 349919 - RNA, 22 nt, Human
ucgggcucgcucuccuagcgga

SEQ ID NO: 349920 - RNA, 22 nt, Human
ccuguucauuuuuugacucugc

SEQ ID NO: 349921 - RNA, 22 nt, Human
caggauggccccggggcugugc

SEQ ID NO: 349922 - RNA, 22 nt, Human
aacucuauuuacccuacuaaac

SEQ ID NO: 349923 - RNA, 22 nt, Human
accagcucagaagccagaaaga

SEQ ID NO: 349924 - RNA, 22 nt, Human
aucuuccuucacuuucucccac

SEQ ID NO: 349925 - RNA, 20 nt, Human
gccuggaggcagagauaaag

SEQ ID NO: 349926 - RNA, 22 nt, Human
cuucccagaccuuagagugcag

SEQ ID NO: 349927 - RNA, 23 nt, Human
ccagccucugggucuucauccag

SEQ ID NO: 349928 - RNA, 22 nt, Human
ugaugcugcugggaguggugcu

SEQ ID NO: 349929 - RNA, 22 nt, Human
aaauggauggaaagcaauuuuu

SEQ ID NO: 349930 - RNA, 22 nt, Human
aagaagagaacuggcauccuaa

SEQ ID NO: 349931 - RNA, 22 nt, Human
uuugaacaggaguaucuauagu

SEQ ID NO: 349932 - RNA, 22 nt, Human
uagggcucugagaguucagccu

SEQ ID NO: 349933 - RNA, 22 nt, Human
caggggccggcuguccgugccc

SEQ ID NO: 349934 - RNA, 22 nt, Human
gcacacccucucaccagcacug

SEQ ID NO: 349935 - RNA, 22 nt, Human
cccugggacccgcugcagaggc

SEQ ID NO: 349936 - RNA, 22 nt, Human
ugcaagagguaaaaugaaagga

SEQ ID NO: 349937 - RNA, 22 nt, Human
ugggaaauguguuucuggacca

SEQ ID NO: 349938 - RNA, 22 nt, Human
uggagcaagcuggagagaacau

SEQ ID NO: 349939 - RNA, 21 nt, Human
gcacagggacagaucaucaca

SEQ ID NO: 349940 - RNA, 22 nt, Human
caggggccaggcugucugcugu

SEQ ID NO: 349941 - RNA, 22 nt, Human
acauuugucuucuuucagauua

SEQ ID NO: 349942 - RNA, 22 nt, Human
caagcagagacuagauagcugu

SEQ ID NO: 349943 - RNA, 22 nt, Human
cccaguuucaacuuuccagugg

SEQ ID NO: 349944 - RNA, 22 nt, Human
uuucacauaaauauuaugccua

SEQ ID NO: 349945 - RNA, 22 nt, Human
guguccaucagcagccacugug

SEQ ID NO: 349946 - RNA, 21 nt, Human
uggaggaauaaagcacagaag

SEQ ID NO: 349947 - RNA, 22 nt, Human
cuuuauuccuacaagauuuucu

SEQ ID NO: 349948 - RNA, 22 nt, Human
guuuacaaauauuuuaaauggu

SEQ ID NO: 349949 - RNA, 22 nt, Human
aucagagauuguaguaugugca

SEQ ID NO: 349950 - RNA, 22 nt, Human
agaaauguuacaguuguuauuu

SEQ ID NO: 349951 - RNA, 22 nt, Human
ggcucagggaaugaggaagaau

SEQ ID NO: 349952 - RNA, 22 nt, Human
acagccuggacuggcucucugc

SEQ ID NO: 349953 - RNA, 22 nt, Human
uccuucaggccucauucucaua

SEQ ID NO: 349954 - RNA, 22 nt, Human
uuuuaucuucauuccuaucuac

SEQ ID NO: 349955 - RNA, 22 nt, Human
agccacagcgaaccucucuucc

SEQ ID NO: 349956 - RNA, 22 nt, Human
ugcuuuaucugugagaaccuga

SEQ ID NO: 349957 - RNA, 22 nt, Human
cagaggaggccaccgcauaggc

SEQ ID NO: 349958 - RNA, 22 nt, Human
gcuggcagaauuucuucuugcu

SEQ ID NO: 349959 - RNA, 22 nt, Human
ugcugccaugcagagcaacaga

SEQ ID NO: 349960 - RNA, 19 nt, Human
uggaggagaggaaaaguca

SEQ ID NO: 349961 - RNA, 22 nt, Human
ggagagaauuccauggacaugu

SEQ ID NO: 349962 - RNA, 22 nt, Human
uugguuuagagagugugguuac

SEQ ID NO: 349963 - RNA, 22 nt, Human
uaggcugggaagaaagauucuc

SEQ ID NO: 349964 - RNA, 22 nt, Human
gaugggcguggcgcguuuggug

SEQ ID NO: 349965 - RNA, 22 nt, Human
ggggcagaguagcuggggugug

SEQ ID NO: 349966 - RNA, 22 nt, Human
gaggcacuggaggaaaggagaa

SEQ ID NO: 349967 - RNA, 22 nt, Human
agcuuuaugaggagaccuuagu

SEQ ID NO: 349968 - RNA, 22 nt, Human
acaggcugacuuccugccaugu

SEQ ID NO: 349969 - RNA, 22 nt, Human
aggggacacggcuucuccaggg

SEQ ID NO: 349970 - RNA, 22 nt, Human
uagucucugcuuugcccuuggc

SEQ ID NO: 349971 - RNA, 22 nt, Human
ggcugccugugcccaggcacac

SEQ ID NO: 349972 - RNA, 22 nt, Human
cugucuguuuuaccuucuccag

SEQ ID NO: 349973 - RNA, 22 nt, Human
guggagcaaucagagggucagu

SEQ ID NO: 349974 - RNA, 22 nt, Human
aaggacagggaugguugauugu

SEQ ID NO: 349975 - RNA, 22 nt, Human
gcucacugcaaccucugcuucc

SEQ ID NO: 349976 - RNA, 19 nt, Human
uggcagggagaguuugaag

SEQ ID NO: 349977 - RNA, 22 nt, Human
acacauuuacauguuuacguau

SEQ ID NO: 349978 - RNA, 22 nt, Human
uagaacagaggguugcccagau

SEQ ID NO: 349979 - RNA, 22 nt, Human
uggcucaguuugggggauugaa

SEQ ID NO: 349980 - RNA, 22 nt, Human
cugggaggcccacguugggaag

SEQ ID NO: 349981 - RNA, 17 nt, Human
cuggagccuccaacucc

SEQ ID NO: 349982 - RNA, 22 nt, Human
ugugggcaggcccgggucugag

SEQ ID NO: 349983 - RNA, 22 nt, Human
ugcccagggauaagccuagaga

SEQ ID NO: 349984 - RNA, 22 nt, Human
gccucugcaugcucagcaccca

SEQ ID NO: 349985 - RNA, 22 nt, Human
cagagacaguuucacagggucu

SEQ ID NO: 349986 - RNA, 22 nt, Human
aggcacugugcugaugucuuau

SEQ ID NO: 349987 - RNA, 22 nt, Human
ugaagcagcaccauuuuagagc

SEQ ID NO: 349988 - RNA, 22 nt, Human
agcuggccuucggugucacugg

SEQ ID NO: 349989 - RNA, 22 nt, Human
aauguuuuaaaagagauugaga

SEQ ID NO: 349990 - RNA, 22 nt, Human
gucuggaggaggaagaaggcac

SEQ ID NO: 349991 - RNA, 22 nt, Human
ucucugagcccaauguagcaau

SEQ ID NO: 349992 - RNA, 22 nt, Human
ugucuuuggaauauuuagcuga

SEQ ID NO: 349993 - RNA, 21 nt, Human
agggagcuuuagguagaaguu

SEQ ID NO: 349994 - RNA, 22 nt, Human
aagcucugcucagcagacuagg

SEQ ID NO: 349995 - RNA, 22 nt, Human
ccagaauagaaggcagcuguca

SEQ ID NO: 349996 - RNA, 22 nt, Human
acaaagaucuugcuuuccuacu

SEQ ID NO: 349997 - RNA, 22 nt, Human
cccaggauggggcugcaguuau

SEQ ID NO: 349998 - RNA, 22 nt, Human
aggcugaaaacgagauggcaau

SEQ ID NO: 349999 - RNA, 22 nt, Human
aggacccugaggucuccuguga

SEQ ID NO: 350000 - RNA, 22 nt, Human
aggcaggcucaggcccaugcuu

SEQ ID NO: 350001 - RNA, 22 nt, Human
uuugaagucaggcuuucuaccc

SEQ ID NO: 350002 - RNA, 22 nt, Human
acagaguucccacuccagaagc

SEQ ID NO: 350003 - RNA, 22 nt, Human
gacauucacaguuuccgauggu

SEQ ID NO: 350004 - RNA, 22 nt, Human
aauagaaaggaggggcucuugu

SEQ ID NO: 350005 - RNA, 22 nt, Human
cugaggcauguuacaggacaua

SEQ ID NO: 350006 - RNA, 22 nt, Human
accauuuaauaaguauuuccau

SEQ ID NO: 350007 - RNA, 22 nt, Human
acccagaggcggagguugcagu

SEQ ID NO: 350008 - RNA, 22 nt, Human
gcauccagucuuggcuccugga

SEQ ID NO: 350009 - RNA, 22 nt, Human
aaaaguuaccucuguaauauaa

SEQ ID NO: 350010 - RNA, 22 nt, Human
gcaaguacaaacgcaucggcug

SEQ ID NO: 350011 - RNA, 22 nt, Human
ugucaccucuuuggcugcagcu

SEQ ID NO: 350012 - RNA, 22 nt, Human
uggcacuggcgcaggauggcgg

SEQ ID NO: 350013 - RNA, 22 nt, Human
ggguccagcgacagcaggcuca

SEQ ID NO: 350014 - RNA, 22 nt, Human
agcacuuuccuggcaaaugugg

SEQ ID NO: 350015 - RNA, 22 nt, Human
ugcagggcuccuggcuccaauc

SEQ ID NO: 350016 - RNA, 22 nt, Human
ccgggcgggggcucucgucacc

SEQ ID NO: 350017 - RNA, 22 nt, Human
agucaguguucuccggagaggc

SEQ ID NO: 350018 - RNA, 22 nt, Human
uggcagcuauuacaaggaaguc

SEQ ID NO: 350019 - RNA, 23 nt, Human
cacuccuguuucuaagccagcau

SEQ ID NO: 350020 - RNA, 22 nt, Human
gcugcccugugguccagcaggu

SEQ ID NO: 350021 - RNA, 22 nt, Human
uuacagaaguauugagagaucc

SEQ ID NO: 350022 - RNA, 22 nt, Human
ggugcugguucaggguggcugu

SEQ ID NO: 350023 - RNA, 22 nt, Human
ugucuuuagccagcagucuucu

SEQ ID NO: 350024 - RNA, 22 nt, Human
uucaagauggccccagugagcc

SEQ ID NO: 350025 - RNA, 22 nt, Human
gagcucuggcagggcaggucug

SEQ ID NO: 350026 - RNA, 22 nt, Human
uuacaguauuguuaaacucuuu

SEQ ID NO: 350027 - RNA, 22 nt, Human
agucucagccacacagaccuau

SEQ ID NO: 350028 - RNA, 22 nt, Human
caauauucaguggaaaagccau

SEQ ID NO: 350029 - RNA, 22 nt, Human
gcugccaugccacagcacucac

SEQ ID NO: 350030 - RNA, 22 nt, Human
uccaugugccaaggggcagagg

SEQ ID NO: 350031 - RNA, 22 nt, Human
cacugaagguaggaccaaggcu

SEQ ID NO: 350032 - RNA, 22 nt, Human
uuuauuugucuugccauuuagu

SEQ ID NO: 350033 - RNA, 22 nt, Human
uguauuagaucugagaacuucu

SEQ ID NO: 350034 - RNA, 22 nt, Human
uccugccuugccugggacauca

SEQ ID NO: 350035 - RNA, 22 nt, Human
uacauauagacaguuacucuag

SEQ ID NO: 350036 - RNA, 20 nt, Human
ggcaccaggcuaggauugga

SEQ ID NO: 350037 - RNA, 22 nt, Human
gaggccaaguuggagaccaggu

SEQ ID NO: 350038 - RNA, 22 nt, Human
gcagggaggaagagaugcuucc

SEQ ID NO: 350039 - RNA, 22 nt, Human
caagcuggaguuccucagagug

SEQ ID NO: 350040 - RNA, 22 nt, Human
gcuguccugggaacaggcacua

SEQ ID NO: 350041 - RNA, 22 nt, Human
auauacuuggagacuaucauug

SEQ ID NO: 350042 - RNA, 22 nt, Human
ucucagaguuugaaucuggagu

SEQ ID NO: 350043 - RNA, 22 nt, Human
ggaugcaggggcagcagagccu

SEQ ID NO: 350044 - RNA, 22 nt, Human
uggcugagaaaaugguuuuagg

SEQ ID NO: 350045 - RNA, 22 nt, Human
cccucugccugggaccaagucc

SEQ ID NO: 350046 - RNA, 22 nt, Human
ucuaaagaagaggguucugcgg

SEQ ID NO: 350047 - RNA, 22 nt, Human
ugucuuuaaaauuaaacacauc

SEQ ID NO: 350048 - RNA, 22 nt, Human
agaaauuccuaagguacacaag

SEQ ID NO: 350049 - RNA, 22 nt, Human
uuguaacagcugcuuaauagag

SEQ ID NO: 350050 - RNA, 22 nt, Human
gccaggaggcugcuguguaggc

SEQ ID NO: 350051 - RNA, 22 nt, Human
uacccaggagaaacagcagggc

SEQ ID NO: 350052 - RNA, 22 nt, Human
gaggccagcuaguccaggaagu

SEQ ID NO: 350053 - RNA, 22 nt, Human
agaauaucguagcauauuaucu

SEQ ID NO: 350054 - RNA, 22 nt, Human
aauauugagaaccagcauguuu

SEQ ID NO: 350055 - RNA, 22 nt, Human
aaacagaaauuuccucaugcuc

SEQ ID NO: 350056 - RNA, 22 nt, Human
uuuucauuagaaugacugagaa

SEQ ID NO: 350057 - RNA, 22 nt, Human
auguucaaacaaguuaaugcca

SEQ ID NO: 350058 - RNA, 20 nt, Human
accaggagauggaggcaggg

SEQ ID NO: 350059 - RNA, 22 nt, Human
agguaggguuaauggagauaua

SEQ ID NO: 350060 - RNA, 22 nt, Human
aauauaaauuccugggcccagc

SEQ ID NO: 350061 - RNA, 22 nt, Human
uggccugcuuucauuugaugcu

SEQ ID NO: 350062 - RNA, 22 nt, Human
aggcagugccuggaccccagcu

SEQ ID NO: 350063 - RNA, 18 nt, Human
ucuggcucaggacugaac

SEQ ID NO: 350064 - RNA, 22 nt, Human
uguucccauuuucugcauaauc

SEQ ID NO: 350065 - RNA, 22 nt, Human
cugaaaauguuacacaggaaga

SEQ ID NO: 350066 - RNA, 22 nt, Human
agcaauauuucagcuagcaggu

SEQ ID NO: 350067 - RNA, 22 nt, Human
agggccagagucuguguagaua

SEQ ID NO: 350068 - RNA, 22 nt, Human
gugcagugagcagugcagcacc

SEQ ID NO: 350069 - RNA, 22 nt, Human
aagaacaguguccugggacucg

SEQ ID NO: 350070 - RNA, 22 nt, Human
cugcuuugaggggcucuguaua

SEQ ID NO: 350071 - RNA, 22 nt, Human
ccauggcucuagagauugaaaa

SEQ ID NO: 350072 - RNA, 22 nt, Human
accagggcaaauguuuguacuc

SEQ ID NO: 350073 - RNA, 22 nt, Human
ggccuggcauggggacuaaggg

SEQ ID NO: 350074 - RNA, 22 nt, Human
aucuaaacagguguucuuuaga

SEQ ID NO: 350075 - RNA, 22 nt, Human
caggggaaggagccuugaaacu

SEQ ID NO: 350076 - RNA, 22 nt, Human
gaguuauuaauggcugaguuug

SEQ ID NO: 350077 - RNA, 19 nt, Human
cugugcuuuaaacuccuau

SEQ ID NO: 350078 - RNA, 22 nt, Human
uuacagaaugugccauuugguc

SEQ ID NO: 350079 - RNA, 19 nt, Human
augauggucccauucaccu

SEQ ID NO: 350080 - RNA, 22 nt, Human
ugguccugagcaccagccugac

SEQ ID NO: 350081 - RNA, 18 nt, Human
cagauccaggcagcuauu

SEQ ID NO: 350082 - RNA, 22 nt, Human
ugcccacauucaaaaggugaug

SEQ ID NO: 350083 - RNA, 22 nt, Human
cugccucuccccagaguggccc

SEQ ID NO: 350084 - RNA, 22 nt, Human
ugcagcugguuuagaacuagau

SEQ ID NO: 350085 - RNA, 22 nt, Human
gcagggcucauucuaguacaau

SEQ ID NO: 350086 - RNA, 22 nt, Human
agaguccaugaagacagcugag

SEQ ID NO: 350087 - RNA, 22 nt, Human
uggcugagguuaugcugguugu

SEQ ID NO: 350088 - RNA, 22 nt, Human
cccugcagcuuuugcauaguca

SEQ ID NO: 350089 - RNA, 22 nt, Human
uagugaaacaguuaucaaucug

SEQ ID NO: 350090 - RNA, 22 nt, Human
ccauggcuuucuuucauuguaa

SEQ ID NO: 350091 - RNA, 22 nt, Human
ucuucagaggaagucagucuuu

SEQ ID NO: 350092 - RNA, 22 nt, Human
gagcagggagacaacucuggug

SEQ ID NO: 350093 - RNA, 22 nt, Human
agagggcaugcuugguggccug

SEQ ID NO: 350094 - RNA, 20 nt, Human
ggcaggcuuuauauggaggg

SEQ ID NO: 350095 - RNA, 22 nt, Human
cagcuuggcuuccgcuuuacug

SEQ ID NO: 350096 - RNA, 22 nt, Human
ucagugaucuaaggguauggcc

SEQ ID NO: 350097 - RNA, 22 nt, Human
cagagguaccagcagccucugg

SEQ ID NO: 350098 - RNA, 23 nt, Human
uggcucucucagugcugcagagg

SEQ ID NO: 350099 - RNA, 22 nt, Human
auggaucagaaucccgggaggg

SEQ ID NO: 350100 - RNA, 22 nt, Human
gcaggagacaacuguaaggaga

SEQ ID NO: 350101 - RNA, 22 nt, Human
ggcaggagauaaaauauuaguu

SEQ ID NO: 350102 - RNA, 22 nt, Human
agaugcagaaaaacuaagugau

SEQ ID NO: 350103 - RNA, 22 nt, Human
ccugugucagccccugccucca

SEQ ID NO: 350104 - RNA, 22 nt, Human
auuugucuuuggaccugugaga

SEQ ID NO: 350105 - RNA, 22 nt, Human
ugaaagcuguccacuaggcugu

SEQ ID NO: 350106 - RNA, 22 nt, Human
aagcuuuaugaucucucagcua

SEQ ID NO: 350107 - RNA, 19 nt, Human
uggcuucuguuuucauguu

SEQ ID NO: 350108 - RNA, 22 nt, Human
gauuuacaaagcucucuagugu

SEQ ID NO: 350109 - RNA, 21 nt, Human
gcaaguacuaucaucauuauc

SEQ ID NO: 350110 - RNA, 22 nt, Human
uggcccugcuuaugucucucuu

SEQ ID NO: 350111 - RNA, 22 nt, Human
ucuuuaauguacuuucuuucac

SEQ ID NO: 350112 - RNA, 22 nt, Human
gguuuaauggagauauuucaga

SEQ ID NO: 350113 - RNA, 22 nt, Human
acauuucuuccuaauuaucccu

SEQ ID NO: 350114 - RNA, 22 nt, Human
agagccagcauuugacacuggc

SEQ ID NO: 350115 - RNA, 22 nt, Human
auaucagacagaaagcauugac

SEQ ID NO: 350116 - RNA, 22 nt, Human
uggaggcaguuuaagucugaga

SEQ ID NO: 350117 - RNA, 17 nt, Human
guuugcaugguguuaac

SEQ ID NO: 350118 - RNA, 22 nt, Human
guuguauagagggcaugaaucu

SEQ ID NO: 350119 - RNA, 20 nt, Human
ggccuuggccucuuugcagc

SEQ ID NO: 350120 - RNA, 22 nt, Human
agccugguguggggcugcagag

SEQ ID NO: 350121 - RNA, 22 nt, Human
acagauuugacugguaccuggc

SEQ ID NO: 350122 - RNA, 22 nt, Human
cugcaggcaucuaacugugggc

SEQ ID NO: 350123 - RNA, 22 nt, Human
gcugccaguguggcaugaugca

SEQ ID NO: 350124 - RNA, 22 nt, Human
cuuguauuccccuaucucuaaa

SEQ ID NO: 350125 - RNA, 22 nt, Human
agggcugcaucugccuggugaa

SEQ ID NO: 350126 - RNA, 22 nt, Human
cugcgcagcaaucagagaggag

SEQ ID NO: 350127 - RNA, 21 nt, Human
ggagucagggucuggcugggg

SEQ ID NO: 350128 - RNA, 22 nt, Human
uuuaaauggcauuuucccagau

SEQ ID NO: 350129 - RNA, 22 nt, Human
agauguaaacucucaugucauu

SEQ ID NO: 350130 - RNA, 22 nt, Human
ccuggagcccaaggcagugaga

SEQ ID NO: 350131 - RNA, 22 nt, Human
ucagguggcuuggagggggacg

SEQ ID NO: 350132 - RNA, 22 nt, Human
ccuggauucaagucuuucuuuc

SEQ ID NO: 350133 - RNA, 22 nt, Human
ucaggcugcagcugucagcagc

SEQ ID NO: 350134 - RNA, 22 nt, Human
aaaggagacuucagaucuccuu

SEQ ID NO: 350135 - RNA, 22 nt, Human
ccugccugcaccuucucugggg

SEQ ID NO: 350136 - RNA, 21 nt, Human
gccagggaagagaguuggcug

SEQ ID NO: 350137 - RNA, 22 nt, Human
ugagccugcaauaagcacagcc

SEQ ID NO: 350138 - RNA, 22 nt, Human
aaugugguuaacccauuuaaga

SEQ ID NO: 350139 - RNA, 22 nt, Human
caggaucccuggccuccgccca

SEQ ID NO: 350140 - RNA, 22 nt, Human
guggcugcuaagucuccuuccu

SEQ ID NO: 350141 - RNA, 22 nt, Human
gauuuauuggucuuucauuggu

SEQ ID NO: 350142 - RNA, 22 nt, Human
aauccagguggcggagguugug

SEQ ID NO: 350143 - RNA, 23 nt, Human
agaaaagcuuggacacauggccu

SEQ ID NO: 350144 - RNA, 22 nt, Human
gcagguggcagaggugggaucu

SEQ ID NO: 350145 - RNA, 22 nt, Human
aaugauuuggcaaaggaaucca

SEQ ID NO: 350146 - RNA, 22 nt, Human
aucccugcccucauggagcuua

SEQ ID NO: 350147 - RNA, 22 nt, Human
gcagggcuguucaggagggugg

SEQ ID NO: 350148 - RNA, 22 nt, Human
ugggcuacucugggagccuaac

SEQ ID NO: 350149 - RNA, 19 nt, Human
agggcuaggcacauagggc

SEQ ID NO: 350150 - RNA, 22 nt, Human
agggcagagagaugaaugggau

SEQ ID NO: 350151 - RNA, 22 nt, Human
uggacagguuugggugccuguu

SEQ ID NO: 350152 - RNA, 22 nt, Human
agcagccacacgccuccuucuc

SEQ ID NO: 350153 - RNA, 22 nt, Human
gagccuggauugaagugggugg

SEQ ID NO: 350154 - RNA, 22 nt, Human
gggugggaacaggaugccagga

SEQ ID NO: 350155 - RNA, 22 nt, Human
aggagggagcuuaagccaggca

SEQ ID NO: 350156 - RNA, 22 nt, Human
caacagucugguuuauauaaua

SEQ ID NO: 350157 - RNA, 22 nt, Human
aaauauguaagauuagcacuag

SEQ ID NO: 350158 - RNA, 22 nt, Human
ccaggacuucgaggcuacagug

SEQ ID NO: 350159 - RNA, 22 nt, Human
cagagcugcagauugaaggcau

SEQ ID NO: 350160 - RNA, 17 nt, Human
aaugaaugaauucuuug

SEQ ID NO: 350161 - RNA, 22 nt, Human
cagauauuaggagcucaauaau

SEQ ID NO: 350162 - RNA, 22 nt, Human
cauccugguuaccccauaguca

SEQ ID NO: 350163 - RNA, 22 nt, Human
aaagaaucagaagucucaaaca

SEQ ID NO: 350164 - RNA, 22 nt, Human
aggaccuguagggccugcaucc

SEQ ID NO: 350165 - RNA, 22 nt, Human
gagagggcucuguguggguacu

SEQ ID NO: 350166 - RNA, 22 nt, Human
aaauucaauuaacuuucaugcu

SEQ ID NO: 350167 - RNA, 22 nt, Human
gcagggcaaacccagguguuca

SEQ ID NO: 350168 - RNA, 22 nt, Human
ugggacacccucacgccugcac

SEQ ID NO: 350169 - RNA, 22 nt, Human
gcaaagucucaagacccaagug

SEQ ID NO: 350170 - RNA, 22 nt, Human
cugagaauuacucugaugagua

SEQ ID NO: 350171 - RNA, 22 nt, Human
uaggccagaggagcagcuuugg

SEQ ID NO: 350172 - RNA, 22 nt, Human
ggcuggccucaggguccucgcu

SEQ ID NO: 350173 - RNA, 22 nt, Human
guguggcugugggagauguuca

SEQ ID NO: 350174 - RNA, 22 nt, Human
gggugcaggcagcccaggcagg

SEQ ID NO: 350175 - RNA, 22 nt, Human
acagccagaggagccaggcugg

SEQ ID NO: 350176 - RNA, 22 nt, Human
cucaggccauucuuccagcugc

SEQ ID NO: 350177 - RNA, 22 nt, Human
cuggcucaccuccgcuccagca

SEQ ID NO: 350178 - RNA, 22 nt, Human
auguaguauuuggaaauguaaa

SEQ ID NO: 350179 - RNA, 22 nt, Human
cucaacagcucugccauacucc

SEQ ID NO: 350180 - RNA, 22 nt, Human
uccugcagcugauaaauacagu

SEQ ID NO: 350181 - RNA, 22 nt, Human
gcugagagcggccagcugggaa

SEQ ID NO: 350182 - RNA, 22 nt, Human
aggggcugacuggaaagugcca

SEQ ID NO: 350183 - RNA, 22 nt, Human
uaaucauggccucaaauuuuau

SEQ ID NO: 350184 - RNA, 22 nt, Human
ccugucauacuaacguaguggg

SEQ ID NO: 350185 - RNA, 23 nt, Human
acuuaaaugguucuuuaucucag

SEQ ID NO: 350186 - RNA, 22 nt, Human
gauuuccuaauguggaucucug

SEQ ID NO: 350187 - RNA, 22 nt, Human
uggguacuccuauuaguucagu

SEQ ID NO: 350188 - RNA, 22 nt, Human
agggcagaaaccaccuugaugg

SEQ ID NO: 350189 - RNA, 22 nt, Human
gagugcaucguggccauuuuaa

SEQ ID NO: 350190 - RNA, 18 nt, Human
agcuucccucugagaggg

SEQ ID NO: 350191 - RNA, 22 nt, Human
uauuuccaagcugaauccaaug

SEQ ID NO: 350192 - RNA, 22 nt, Human
ucucccagugucuggcagucag

SEQ ID NO: 350193 - RNA, 22 nt, Human
uagcagcucacagccucccauu

SEQ ID NO: 350194 - RNA, 22 nt, Human
gcagaggccaucaacuuugcca

SEQ ID NO: 350195 - RNA, 22 nt, Human
uuuccaaaguugccauaagcuu

SEQ ID NO: 350196 - RNA, 22 nt, Human
uuugggcaguagauguaucacu

SEQ ID NO: 350197 - RNA, 22 nt, Human
cagcaucaccgccauuucugau

SEQ ID NO: 350198 - RNA, 22 nt, Human
gggcuagaaauucugcagugga

SEQ ID NO: 350199 - RNA, 22 nt, Human
gggucucucucggcuccacgcg

SEQ ID NO: 350200 - RNA, 22 nt, Human
agagaugaacauaaaacaagga

SEQ ID NO: 350201 - RNA, 22 nt, Human
cauucacagagggggaagcauc

SEQ ID NO: 350202 - RNA, 22 nt, Human
ucccagaggaaauggcagcuga

SEQ ID NO: 350203 - RNA, 22 nt, Human
cagaggccccagaacuagcucu

SEQ ID NO: 350204 - RNA, 22 nt, Human
acacaaauuguaggauaauugc

SEQ ID NO: 350205 - RNA, 22 nt, Human
uauuucugggaguucagaaauu

SEQ ID NO: 350206 - RNA, 22 nt, Human
cugcagugaaaucaggaagcaa

SEQ ID NO: 350207 - RNA, 22 nt, Human
acaaagugaauugcaucgaguu

SEQ ID NO: 350208 - RNA, 22 nt, Human
gaggcugguucugaaguacugu

SEQ ID NO: 350209 - RNA, 22 nt, Human
uauguacaguccuuaacuuaaa

SEQ ID NO: 350210 - RNA, 22 nt, Human
ucccagaagugaaauuucuaga

SEQ ID NO: 350211 - RNA, 22 nt, Human
uuugcauuaucucacuuauaua

SEQ ID NO: 350212 - RNA, 22 nt, Human
cuguccuuacugcuucuggcuu

SEQ ID NO: 350213 - RNA, 22 nt, Human
auaaaaacugacccauccuuug

SEQ ID NO: 350214 - RNA, 19 nt, Human
cugguccugacugaggggu

SEQ ID NO: 350215 - RNA, 22 nt, Human
gccugcagugagugcagaaggu

SEQ ID NO: 350216 - RNA, 22 nt, Human
gagagguccauuccccugucag

SEQ ID NO: 350217 - RNA, 22 nt, Human
gggggcaguaaccucaaagugu

SEQ ID NO: 350218 - RNA, 17 nt, Human
ggcagcugugugcaugc

SEQ ID NO: 350219 - RNA, 22 nt, Human
uggguggcacuucuggggucca

SEQ ID NO: 350220 - RNA, 22 nt, Human
uaguggaggggaugcaaagcuu

SEQ ID NO: 350221 - RNA, 22 nt, Human
aaggaggaauuucagggugaau

SEQ ID NO: 350222 - RNA, 22 nt, Human
caucaguguggcaguucacugu

SEQ ID NO: 350223 - RNA, 22 nt, Human
gugccugggcaugagcuuguug

SEQ ID NO: 350224 - RNA, 21 nt, Human
gcagagccugagguucuugag

SEQ ID NO: 350225 - RNA, 22 nt, Human
uauuucagacacugaucuugca

SEQ ID NO: 350226 - RNA, 22 nt, Human
agggcccucuggcaggccaggc

SEQ ID NO: 350227 - RNA, 22 nt, Human
auggggcugggauucuccucgg

SEQ ID NO: 350228 - RNA, 22 nt, Human
ggcugccagugagugcagaccg

SEQ ID NO: 350229 - RNA, 22 nt, Human
gcgaaaaauguguaaauauguu

SEQ ID NO: 350230 - RNA, 22 nt, Human
ucagaauuuugguuugguuggu

SEQ ID NO: 350231 - RNA, 22 nt, Human
ccagcucugccaagcgucagcu

SEQ ID NO: 350232 - RNA, 22 nt, Human
uuucauaauagugcaguuuguu

SEQ ID NO: 350233 - RNA, 22 nt, Human
uagcagaaccagcagucaauuu

SEQ ID NO: 350234 - RNA, 22 nt, Human
ggcagccuugacuagugacuua

SEQ ID NO: 350235 - RNA, 22 nt, Human
uuugaaagccuggcuuuucucu

SEQ ID NO: 350236 - RNA, 22 nt, Human
aagccucuggggccucaucugu

SEQ ID NO: 350237 - RNA, 22 nt, Human
acugagcugugacaaugcuuaa

SEQ ID NO: 350238 - RNA, 22 nt, Human
ugcauauugugaaaauguagau

SEQ ID NO: 350239 - RNA, 22 nt, Human
aauacugagaucccacaaagca

SEQ ID NO: 350240 - RNA, 22 nt, Human
aaacacaccuuuggaacuguga

SEQ ID NO: 350241 - RNA, 22 nt, Human
cagggccaagcugcagcaucug

SEQ ID NO: 350242 - RNA, 17 nt, Human
ugagcaguagaagaugc

SEQ ID NO: 350243 - RNA, 22 nt, Human
acuuauuagcugugugaccuug

SEQ ID NO: 350244 - RNA, 22 nt, Human
ccucucuguaagggucccuccc

SEQ ID NO: 350245 - RNA, 20 nt, Human
gaagccagaggggaaaggag

SEQ ID NO: 350246 - RNA, 22 nt, Human
gagucacaaaagaugcccaggg

SEQ ID NO: 350247 - RNA, 17 nt, Human
uagcuguguuucagcua

SEQ ID NO: 350248 - RNA, 22 nt, Human
augauggugggagaugacccag

SEQ ID NO: 350249 - RNA, 22 nt, Human
uccuucagaggacggcagccag

SEQ ID NO: 350250 - RNA, 22 nt, Human
ggcuucccuuuccgagaggaga

SEQ ID NO: 350251 - RNA, 19 nt, Human
uuacuuggcaaagucaguc

SEQ ID NO: 350252 - RNA, 19 nt, Human
acagcagggauuuuuggag

SEQ ID NO: 350253 - RNA, 22 nt, Human
cuguguuggcuuuucucuugua

SEQ ID NO: 350254 - RNA, 22 nt, Human
ucauuacagagauauaaucuac

SEQ ID NO: 350255 - RNA, 22 nt, Human
gagggccaacuagcaccacuuu

SEQ ID NO: 350256 - RNA, 22 nt, Human
cuugcaggcagggccuccugga

SEQ ID NO: 350257 - RNA, 22 nt, Human
gcuggccugaccagccacaggc

SEQ ID NO: 350258 - RNA, 22 nt, Human
ucauuguuucugcuuuucauga

SEQ ID NO: 350259 - RNA, 22 nt, Human
aggagcugaaacuucucauaug

SEQ ID NO: 350260 - RNA, 22 nt, Human
cagggcacaguuauggaggugg

SEQ ID NO: 350261 - RNA, 22 nt, Human
augcaguaaaauaggagguaau

SEQ ID NO: 350262 - RNA, 22 nt, Human
cauggcagagaaggggaacugg

SEQ ID NO: 350263 - RNA, 22 nt, Human
ggaggcaggaaagacagguuca

SEQ ID NO: 350264 - RNA, 20 nt, Human
gagggcaggcacccauuuca

SEQ ID NO: 350265 - RNA, 22 nt, Human
auuuucaaaacaucugcugugu

SEQ ID NO: 350266 - RNA, 22 nt, Human
cgaugguucuggcugcuuguau

SEQ ID NO: 350267 - RNA, 22 nt, Human
accuggccauccagcuggcauc

SEQ ID NO: 350268 - RNA, 22 nt, Human
agccagcuggugggucagcugg

SEQ ID NO: 350269 - RNA, 22 nt, Human
cuggggcucucuggaaugcuug

SEQ ID NO: 350270 - RNA, 22 nt, Human
cagaagcaaaugccuugcugag

SEQ ID NO: 350271 - RNA, 22 nt, Human
ucacacagguuugcaaugauuu

SEQ ID NO: 350272 - RNA, 22 nt, Human
gucuuucuaugaugaacuguug

SEQ ID NO: 350273 - RNA, 22 nt, Human
gucaaguuaagauaaggucaug

SEQ ID NO: 350274 - RNA, 21 nt, Human
uuuucccacugaaagcuccca

SEQ ID NO: 350275 - RNA, 21 nt, Human
acccuggguucuccauacccu

SEQ ID NO: 350276 - RNA, 22 nt, Human
gaggcagagugcaccccaggag

SEQ ID NO: 350277 - RNA, 22 nt, Human
gggagccacagugaggugcaug

SEQ ID NO: 350278 - RNA, 21 nt, Human
guccagagagccggcuccuga

SEQ ID NO: 350279 - RNA, 22 nt, Human
agugcacuggcaccaucucagc

SEQ ID NO: 350280 - RNA, 22 nt, Human
aggaaucccgcaccagcugcug

SEQ ID NO: 350281 - RNA, 22 nt, Human
ugaggggauacgguacacauug

SEQ ID NO: 350282 - RNA, 22 nt, Human
ccaggaguuggagguugcagug

SEQ ID NO: 350283 - RNA, 19 nt, Human
agcuguggaugugggauuu

SEQ ID NO: 350284 - RNA, 22 nt, Human
agcaggugggcaugaaagcuga

SEQ ID NO: 350285 - RNA, 22 nt, Human
gagaaaugcaugcaugucauca

SEQ ID NO: 350286 - RNA, 22 nt, Human
agugaccauuuucagcuagagg

SEQ ID NO: 350287 - RNA, 22 nt, Human
gggccccaaaaugccaggcucu

SEQ ID NO: 350288 - RNA, 22 nt, Human
uuccuuaguguuagauucugug

SEQ ID NO: 350289 - RNA, 22 nt, Human
ucuggccaacaaaaacuaaguc

SEQ ID NO: 350290 - RNA, 22 nt, Human
uccugagggcgauucagcaggu

SEQ ID NO: 350291 - RNA, 22 nt, Human
uuggagcccugaggaucuggau

SEQ ID NO: 350292 - RNA, 22 nt, Human
acucagaguuugcguuccauac

SEQ ID NO: 350293 - RNA, 22 nt, Human
cucuuuccucagccacagucua

SEQ ID NO: 350294 - RNA, 22 nt, Human
uaugcacacauuagcacagggu

SEQ ID NO: 350295 - RNA, 22 nt, Human
aggcaucugaguuugcaagcuu

SEQ ID NO: 350296 - RNA, 19 nt, Human
auuugaaagcugugcuugc

SEQ ID NO: 350297 - RNA, 22 nt, Human
uguguuccuucgucuucccuuc

SEQ ID NO: 350298 - RNA, 22 nt, Human
aaucaguuguccaaaguucaca

SEQ ID NO: 350299 - RNA, 22 nt, Human
cuguggcuaugguguacauacu

SEQ ID NO: 350300 - RNA, 22 nt, Human
ugggcuggugagggaucauuua

SEQ ID NO: 350301 - RNA, 22 nt, Human
ccagggcagaaaaagagggaau

SEQ ID NO: 350302 - RNA, 22 nt, Human
agcaccuguggcucaugcucgu

SEQ ID NO: 350303 - RNA, 22 nt, Human
gcugccuguggcccuucugggu

SEQ ID NO: 350304 - RNA, 22 nt, Human
cagaauaugacaagauuuuccu

SEQ ID NO: 350305 - RNA, 22 nt, Human
ugagcuggucacuccuucugaa

SEQ ID NO: 350306 - RNA, 22 nt, Human
aaggagugcaugacucagagua

SEQ ID NO: 350307 - RNA, 22 nt, Human
uccuggagccacggagcuuuca

SEQ ID NO: 350308 - RNA, 22 nt, Human
ccacagcaugcaggccugacac

SEQ ID NO: 350309 - RNA, 22 nt, Human
gggcagguggagggcccagcca

SEQ ID NO: 350310 - RNA, 22 nt, Human
gaaaugcauaaucuuaguagau

SEQ ID NO: 350311 - RNA, 21 nt, Human
gagugcaggucugaugccauc

SEQ ID NO: 350312 - RNA, 22 nt, Human
uuucacacuagucagaauacca

SEQ ID NO: 350313 - RNA, 22 nt, Human
cagggccucuccuccaggaacu

SEQ ID NO: 350314 - RNA, 22 nt, Human
cacaugcauaaggauaauuacu

SEQ ID NO: 350315 - RNA, 22 nt, Human
ucccuucacagaugcgauguuu

SEQ ID NO: 350316 - RNA, 22 nt, Human
acacagggggcauucuaggagu

SEQ ID NO: 350317 - RNA, 19 nt, Human
ugcagaggguaggaaggcc

SEQ ID NO: 350318 - RNA, 22 nt, Human
cucagaguucuccugggaggug

SEQ ID NO: 350319 - RNA, 22 nt, Human
gcagggcaggauuugaacccag

SEQ ID NO: 350320 - RNA, 22 nt, Human
aggucauuguuaagucaccaua

SEQ ID NO: 350321 - RNA, 22 nt, Human
ugaggcagugugagauaauaaa

SEQ ID NO: 350322 - RNA, 22 nt, Human
ugccaggauggccagggggcca

SEQ ID NO: 350323 - RNA, 22 nt, Human
ucuccgaucacagguuuucaau

SEQ ID NO: 350324 - RNA, 22 nt, Human
cagaaaucauugugaugacagg

SEQ ID NO: 350325 - RNA, 22 nt, Human
aaucauaauuguauacauucau

SEQ ID NO: 350326 - RNA, 22 nt, Human
ucauuuguggaagugauugugg

SEQ ID NO: 350327 - RNA, 22 nt, Human
uuaguuagucccugguaccuuu

SEQ ID NO: 350328 - RNA, 22 nt, Human
uucaccgugaaccgauuccuca

SEQ ID NO: 350329 - RNA, 22 nt, Human
cagugcaugaaacaauaugcag

SEQ ID NO: 350330 - RNA, 22 nt, Human
cagugggugaugaguccugggg

SEQ ID NO: 350331 - RNA, 22 nt, Human
aaggcacuuaacgugggaggau

SEQ ID NO: 350332 - RNA, 22 nt, Human
ugcugaugaguccuucuaucgc

SEQ ID NO: 350333 - RNA, 22 nt, Human
ucaggcugugggcacuggccau

SEQ ID NO: 350334 - RNA, 22 nt, Human
acauuucuuuucaucucuauau

SEQ ID NO: 350335 - RNA, 22 nt, Human
agggcagagacaugcuuccuga

SEQ ID NO: 350336 - RNA, 23 nt, Human
ugagcaucacaggagaaccaggc

SEQ ID NO: 350337 - RNA, 18 nt, Human
agucucagcggaggagua

SEQ ID NO: 350338 - RNA, 22 nt, Human
auggguuucccucugaaauuau

SEQ ID NO: 350339 - RNA, 22 nt, Human
uggagggaacccaggcugcucu

SEQ ID NO: 350340 - RNA, 22 nt, Human
uggcucucaggccugcugcguu

SEQ ID NO: 350341 - RNA, 22 nt, Human
gaggaggaaacccuguuccucu

SEQ ID NO: 350342 - RNA, 22 nt, Human
aacccuggggcagcugcuaggg

SEQ ID NO: 350343 - RNA, 22 nt, Human
cacagggccacuuucccaguaa

SEQ ID NO: 350344 - RNA, 22 nt, Human
uguggaaaauuggaacguuccu

SEQ ID NO: 350345 - RNA, 23 nt, Human
aggauguaggauguauggcagag

SEQ ID NO: 350346 - RNA, 22 nt, Human
uacauguuuacuccaagucagg

SEQ ID NO: 350347 - RNA, 22 nt, Human
cacagcugaaguagccaugugg

SEQ ID NO: 350348 - RNA, 19 nt, Human
ucuguucacauuguuucgc

SEQ ID NO: 350349 - RNA, 22 nt, Human
gcccagagagaugcuguagacc

SEQ ID NO: 350350 - RNA, 22 nt, Human
acaaauguggacauggauaaug

SEQ ID NO: 350351 - RNA, 22 nt, Human
gacuuucucuccucccaggugu

SEQ ID NO: 350352 - RNA, 22 nt, Human
cugggccagauccagccucaca

SEQ ID NO: 350353 - RNA, 22 nt, Human
aggcagcauccagaggagaaug

SEQ ID NO: 350354 - RNA, 22 nt, Human
ucaaaggcuugugguucuggga

SEQ ID NO: 350355 - RNA, 22 nt, Human
gcuggcucccauugguccuucc

SEQ ID NO: 350356 - RNA, 22 nt, Human
uagaaaucauuuagaaguauug

SEQ ID NO: 350357 - RNA, 22 nt, Human
cagcugccagcuucucuccauc

SEQ ID NO: 350358 - RNA, 22 nt, Human
uugguacagaugagguauucuc

SEQ ID NO: 350359 - RNA, 22 nt, Human
ccugccucaucaacuugucgug

SEQ ID NO: 350360 - RNA, 22 nt, Human
auacaucucauguaagagauaa

SEQ ID NO: 350361 - RNA, 22 nt, Human
cccaggcacauccacucuguga

SEQ ID NO: 350362 - RNA, 23 nt, Human
uggcucugagcuuccugguggcc

SEQ ID NO: 350363 - RNA, 22 nt, Human
gagggcagagacagugauucac

SEQ ID NO: 350364 - RNA, 21 nt, Human
agcagcaucagccucaccuga

SEQ ID NO: 350365 - RNA, 22 nt, Human
gucucagggacugcuucugggg

SEQ ID NO: 350366 - RNA, 23 nt, Human
uggccugcagaguuucugcuggg

SEQ ID NO: 350367 - RNA, 22 nt, Human
aaaauuauucauggcuuuugga

SEQ ID NO: 350368 - RNA, 22 nt, Human
ucucagaggucuucagccucug

SEQ ID NO: 350369 - RNA, 22 nt, Human
cuggacagaaagggcugcugug

SEQ ID NO: 350370 - RNA, 20 nt, Human
ccugggcuccaggagccccg

SEQ ID NO: 350371 - RNA, 22 nt, Human
uccacauccauugcuugacuuu

SEQ ID NO: 350372 - RNA, 22 nt, Human
uuugcaaauaccaugaaacuug

SEQ ID NO: 350373 - RNA, 22 nt, Human
ugucaguguauacauacaguau

SEQ ID NO: 350374 - RNA, 22 nt, Human
aggcagugcugugcccugaacc

SEQ ID NO: 350375 - RNA, 22 nt, Human
uuuucaguaaugucuacauaau

SEQ ID NO: 350376 - RNA, 22 nt, Human
uauuggugggggcagagagaga

SEQ ID NO: 350377 - RNA, 22 nt, Human
guaaaauucuagcaucugaaag

SEQ ID NO: 350378 - RNA, 22 nt, Human
ccagugcuucuuugcuagcugg

SEQ ID NO: 350379 - RNA, 21 nt, Human
uuucccagcugaaaauaaaug

SEQ ID NO: 350380 - RNA, 22 nt, Human
uaguuucagcuccuucauccug

SEQ ID NO: 350381 - RNA, 20 nt, Human
ucagccagcuaacaugggga

SEQ ID NO: 350382 - RNA, 22 nt, Human
gcagaggcuccauuuuacagau

SEQ ID NO: 350383 - RNA, 22 nt, Human
aagggccuccuggggagccugg

SEQ ID NO: 350384 - RNA, 22 nt, Human
uuagauaauguagagauaugag

SEQ ID NO: 350385 - RNA, 22 nt, Human
ccagaagacaagaauguucuua

SEQ ID NO: 350386 - RNA, 22 nt, Human
agcagaagaaagccacaugacu

SEQ ID NO: 350387 - RNA, 22 nt, Human
agaucacaguggcaacucccuu

SEQ ID NO: 350388 - RNA, 22 nt, Human
auucuuggcaaggagauuuaaa

SEQ ID NO: 350389 - RNA, 22 nt, Human
gagcuuuacuucugacuggugc

SEQ ID NO: 350390 - RNA, 22 nt, Human
cagcugugaauugucuuaucua

SEQ ID NO: 350391 - RNA, 22 nt, Human
ucacaugaguauuauuuuccaa

SEQ ID NO: 350392 - RNA, 22 nt, Human
ggcuucaccgcgggguugcagg

SEQ ID NO: 350393 - RNA, 22 nt, Human
cucuggccgcagcucagcucug

SEQ ID NO: 350394 - RNA, 22 nt, Human
gucagcagugucagcucugggg

SEQ ID NO: 350395 - RNA, 22 nt, Human
ggccuugguaaagggaugcaug

SEQ ID NO: 350396 - RNA, 22 nt, Human
cagggagggaggaaaauuugcu

SEQ ID NO: 350397 - RNA, 22 nt, Human
gacagagugcagggcuagaaga

SEQ ID NO: 350398 - RNA, 22 nt, Human
aggccagaugucgggcuagaag

SEQ ID NO: 350399 - RNA, 22 nt, Human
uguacaauagcuauuaucucca

SEQ ID NO: 350400 - RNA, 22 nt, Human
agcagcuguacuuucaucuguu

SEQ ID NO: 350401 - RNA, 22 nt, Human
augaguugaagcuacaagaggc

SEQ ID NO: 350402 - RNA, 22 nt, Human
gggcaggugcccagggccagag

SEQ ID NO: 350403 - RNA, 21 nt, Human
gaggccacuaauaggggcaga

SEQ ID NO: 350404 - RNA, 22 nt, Human
caguggucugugcuucuguaca

SEQ ID NO: 350405 - RNA, 22 nt, Human
gugccaggcccagggagcgggg

SEQ ID NO: 350406 - RNA, 22 nt, Human
aggcugugagcaagaacaccua

SEQ ID NO: 350407 - RNA, 22 nt, Human
caucacugacgcugagauucca

SEQ ID NO: 350408 - RNA, 22 nt, Human
gugcucuguguauuaggauguc

SEQ ID NO: 350409 - RNA, 18 nt, Human
uacagauuauagauacau

SEQ ID NO: 350410 - RNA, 22 nt, Human
ucaaugauaguacaaucagccu

SEQ ID NO: 350411 - RNA, 22 nt, Human
auuauccucagaaaacauguga

SEQ ID NO: 350412 - RNA, 22 nt, Human
aaaugugcuugugaucagcugu

SEQ ID NO: 350413 - RNA, 22 nt, Human
aguucuuuugugaacauaugcu

SEQ ID NO: 350414 - RNA, 22 nt, Human
gcagcucccagcuugaaagguc

SEQ ID NO: 350415 - RNA, 22 nt, Human
gggcagcagaggaucccuuaau

SEQ ID NO: 350416 - RNA, 22 nt, Human
uaaauucagugaguaauuucug

SEQ ID NO: 350417 - RNA, 22 nt, Human
aggcuggguaccugucauaugc

SEQ ID NO: 350418 - RNA, 22 nt, Human
gcugguuaggugagggugcgcc

SEQ ID NO: 350419 - RNA, 22 nt, Human
cugcuguguuagcagguuuagu

SEQ ID NO: 350420 - RNA, 22 nt, Human
ggucucaggagacuggagagca

SEQ ID NO: 350421 - RNA, 22 nt, Human
agcugcccugggucuugcugcu

SEQ ID NO: 350422 - RNA, 22 nt, Human
cucagaguccccacaucugggu

SEQ ID NO: 350423 - RNA, 22 nt, Human
cagagguagccgagugcaaucg

SEQ ID NO: 350424 - RNA, 22 nt, Human
ugaggcaggaugcuugcacagg

SEQ ID NO: 350425 - RNA, 22 nt, Human
uauagaaguaagcauugugaug

SEQ ID NO: 350426 - RNA, 22 nt, Human
uggcugaguguuccaaggagca

SEQ ID NO: 350427 - RNA, 22 nt, Human
gcuccuucaggugguagcuguu

SEQ ID NO: 350428 - RNA, 18 nt, Human
aggggcagcuugugugga

SEQ ID NO: 350429 - RNA, 18 nt, Human
ucucagaggccauccuag

SEQ ID NO: 350430 - RNA, 22 nt, Human
acauugcugcauucuccuuccc

SEQ ID NO: 350431 - RNA, 22 nt, Human
caccuggcuggaagugcuccgg

SEQ ID NO: 350432 - RNA, 22 nt, Human
uccagccaugacucggacagug

SEQ ID NO: 350433 - RNA, 22 nt, Human
gccaggagacuccauucauuug

SEQ ID NO: 350434 - RNA, 22 nt, Human
cugcccugggaguaccuguccu

SEQ ID NO: 350435 - RNA, 22 nt, Human
aguggacucuucccagugcuug

SEQ ID NO: 350436 - RNA, 22 nt, Human
cagggcagcuuccuuuguuagg

SEQ ID NO: 350437 - RNA, 22 nt, Human
gcucuguacgcaggaugagggg

SEQ ID NO: 350438 - RNA, 22 nt, Human
uagugauuaaaggcagaauguu

SEQ ID NO: 350439 - RNA, 22 nt, Human
uggcauuucaguauuuucauaa

SEQ ID NO: 350440 - RNA, 22 nt, Human
cuggcuuucucugugguguuca

SEQ ID NO: 350441 - RNA, 22 nt, Human
ggcauuuacauaaucuuauuua

SEQ ID NO: 350442 - RNA, 22 nt, Human
acacugcucacuucuucccuug

SEQ ID NO: 350443 - RNA, 22 nt, Human
aagcccagcaucccugcaccag

SEQ ID NO: 350444 - RNA, 21 nt, Human
ucucuggaguuagcagagaga

SEQ ID NO: 350445 - RNA, 22 nt, Human
gaggaaacauuguagaagcagu

SEQ ID NO: 350446 - RNA, 22 nt, Human
agagcagcugugacauggacag

SEQ ID NO: 350447 - RNA, 22 nt, Human
ggaagccaugagggacaguucu

SEQ ID NO: 350448 - RNA, 22 nt, Human
ucucuguaguugggcagcugcu

SEQ ID NO: 350449 - RNA, 22 nt, Human
auguuuuauauuuugcagcagu

SEQ ID NO: 350450 - RNA, 22 nt, Human
gcacagaacuucucuuaguagg

SEQ ID NO: 350451 - RNA, 22 nt, Human
ccugcagggaaucgaggcagaa

SEQ ID NO: 350452 - RNA, 22 nt, Human
uacaagaaauuucugcauauau

SEQ ID NO: 350453 - RNA, 22 nt, Human
cacaauguauauguauaucaaa

SEQ ID NO: 350454 - RNA, 22 nt, Human
uuucucuguucucuaacuguaa

SEQ ID NO: 350455 - RNA, 22 nt, Human
acauucacgcucucaaagcuga

SEQ ID NO: 350456 - RNA, 22 nt, Human
aguccaguguguucuggcagca

SEQ ID NO: 350457 - RNA, 22 nt, Human
cuagaaaucucuguuuacauca

SEQ ID NO: 350458 - RNA, 22 nt, Human
ccucucccacguggcagaggcu

SEQ ID NO: 350459 - RNA, 22 nt, Human
acagccugcugccugcuucuug

SEQ ID NO: 350460 - RNA, 22 nt, Human
cagucccagacauaguaaggga

SEQ ID NO: 350461 - RNA, 22 nt, Human
cacucugcagcugaagggcugg

SEQ ID NO: 350462 - RNA, 22 nt, Human
cuggaagggucuacuuagcaga

SEQ ID NO: 350463 - RNA, 22 nt, Human
uuaggaguccagaugucuuggg

SEQ ID NO: 350464 - RNA, 22 nt, Human
ggcugccaggagggaggccagu

SEQ ID NO: 350465 - RNA, 22 nt, Human
gucacagaguuauuaauugugu

SEQ ID NO: 350466 - RNA, 22 nt, Human
agcugcuaugacaacaccagcc

SEQ ID NO: 350467 - RNA, 22 nt, Human
uuaguuuucccaucuuuauggu

SEQ ID NO: 350468 - RNA, 22 nt, Human
uugauuaaucccaugugaguag

SEQ ID NO: 350469 - RNA, 20 nt, Human
cauauauaccuagaagugga

SEQ ID NO: 350470 - RNA, 22 nt, Human
aggagcagaacugauucugacu

SEQ ID NO: 350471 - RNA, 22 nt, Human
uccaggaggacugagggggcug

SEQ ID NO: 350472 - RNA, 22 nt, Human
gucaggaugagggaugaggagu

SEQ ID NO: 350473 - RNA, 22 nt, Human
caauuucugggccucacacaag

SEQ ID NO: 350474 - RNA, 22 nt, Human
acuggaucuaauugguuauagu

SEQ ID NO: 350475 - RNA, 21 nt, Human
auuauuauaaagaccacaggg

SEQ ID NO: 350476 - RNA, 23 nt, Human
ucuaauacaugaaaccuagaugu

SEQ ID NO: 350477 - RNA, 22 nt, Human
accacugcccauggugaaaacu

SEQ ID NO: 350478 - RNA, 22 nt, Human
gagccugaugaaacaggcagac

SEQ ID NO: 350479 - RNA, 22 nt, Human
ucaaaccaccuuguuacugggg

SEQ ID NO: 350480 - RNA, 22 nt, Human
ucuucaaaugcuaguaauauca

SEQ ID NO: 350481 - RNA, 22 nt, Human
ggagggugcauuuuacccugug

SEQ ID NO: 350482 - RNA, 22 nt, Human
cccagguggcagaagcugcagu

SEQ ID NO: 350483 - RNA, 22 nt, Human
ccugggagguggagguugcagc

SEQ ID NO: 350484 - RNA, 22 nt, Human
auggccuggccagagcucugcu

SEQ ID NO: 350485 - RNA, 22 nt, Human
agccagccgggggaccacagug

SEQ ID NO: 350486 - RNA, 22 nt, Human
auaauuuacuaagcucuaccuu

SEQ ID NO: 350487 - RNA, 22 nt, Human
ucccagagcucuggagguugga

SEQ ID NO: 350488 - RNA, 22 nt, Human
ugucauuuucuaaucuguuguc

SEQ ID NO: 350489 - RNA, 22 nt, Human
ggggccagcuucgcgugcucuu

SEQ ID NO: 350490 - RNA, 20 nt, Human
ugcagcuucaccugugucau

SEQ ID NO: 350491 - RNA, 22 nt, Human
uuccuuagugacuucuagcuac

SEQ ID NO: 350492 - RNA, 22 nt, Human
aucuuguuaaaaugcagaaacu

SEQ ID NO: 350493 - RNA, 20 nt, Human
cagucccaauccagggccag

SEQ ID NO: 350494 - RNA, 22 nt, Human
ugccaggggaccuagggauguc

SEQ ID NO: 350495 - RNA, 17 nt, Human
cauguguaugugggagu

SEQ ID NO: 350496 - RNA, 22 nt, Human
aggcaagcccccagugaggcuc

SEQ ID NO: 350497 - RNA, 22 nt, Human
ccucagagguguggcaucucug

SEQ ID NO: 350498 - RNA, 22 nt, Human
gccuggagccucagcaaggagg

SEQ ID NO: 350499 - RNA, 22 nt, Human
ucuacugcacuggugucucauc

SEQ ID NO: 350500 - RNA, 22 nt, Human
gaggaaccaaaucagcuugcac

SEQ ID NO: 350501 - RNA, 22 nt, Human
auuuccuauagauauggugagu

SEQ ID NO: 350502 - RNA, 22 nt, Human
auuuccuuugcaaagacugugc

SEQ ID NO: 350503 - RNA, 22 nt, Human
ggauggagaugaccauggugac

SEQ ID NO: 350504 - RNA, 22 nt, Human
cagaacauucacucauaugugg

SEQ ID NO: 350505 - RNA, 22 nt, Human
uuccucaucugugcaccucacu

SEQ ID NO: 350506 - RNA, 22 nt, Human
gcaccaggaggcccuucucauc

SEQ ID NO: 350507 - RNA, 22 nt, Human
ucuucuucccaucccucaaaug

SEQ ID NO: 350508 - RNA, 22 nt, Human
ccucaggauccgcaggugcagu

SEQ ID NO: 350509 - RNA, 22 nt, Human
cagcaggauagguuucuuugga

SEQ ID NO: 350510 - RNA, 17 nt, Human
gauuuccugaaguucuu

SEQ ID NO: 350511 - RNA, 22 nt, Human
guuccaggcaagugggauagga

SEQ ID NO: 350512 - RNA, 22 nt, Human
cuggcagcugugugaagaacug

SEQ ID NO: 350513 - RNA, 22 nt, Human
cuggcuuucauuucaagcacgu

SEQ ID NO: 350514 - RNA, 21 nt, Human
caaagccaggcaacucucucc

SEQ ID NO: 350515 - RNA, 22 nt, Human
gcugggagaggcccugaaguga

SEQ ID NO: 350516 - RNA, 21 nt, Human
auacagaagguggcaaaguac

SEQ ID NO: 350517 - RNA, 22 nt, Human
caugcacagugauaucugaaga

SEQ ID NO: 350518 - RNA, 22 nt, Human
aguauuuagcauagugguuagu

SEQ ID NO: 350519 - RNA, 22 nt, Human
ggcucugcccagaugaagagga

SEQ ID NO: 350520 - RNA, 22 nt, Human
gcaacuuuagaaaaaucuauaa

SEQ ID NO: 350521 - RNA, 22 nt, Human
aggcacugugcuucuuauaugu

SEQ ID NO: 350522 - RNA, 21 nt, Human
aggugcagagccagggaccag

SEQ ID NO: 350523 - RNA, 20 nt, Human
acccagcucugugcccuggg

SEQ ID NO: 350524 - RNA, 22 nt, Human
acccaggcugcuucucaguggc

SEQ ID NO: 350525 - RNA, 22 nt, Human
uggaagugcucuucugaccaac

SEQ ID NO: 350526 - RNA, 22 nt, Human
uuagauauguuuuugcuaaugc

SEQ ID NO: 350527 - RNA, 22 nt, Human
cuuccaaauguaaauaaguuuc

SEQ ID NO: 350528 - RNA, 22 nt, Human
gugggcagugguuugcgcgguc

SEQ ID NO: 350529 - RNA, 22 nt, Human
aagagcuggaagugaagauaac

SEQ ID NO: 350530 - RNA, 22 nt, Human
uuugcauuuuagauuuaggccu

SEQ ID NO: 350531 - RNA, 23 nt, Human
cuuuccuuucuuugacacccagc

SEQ ID NO: 350532 - RNA, 22 nt, Human
cagggagaagucuggucagucc

SEQ ID NO: 350533 - RNA, 22 nt, Human
uuccauaauaaccugagagaaa

SEQ ID NO: 350534 - RNA, 22 nt, Human
aucaggauagugguuaccuggg

SEQ ID NO: 350535 - RNA, 22 nt, Human
aggcagacaaggacacaguggg

SEQ ID NO: 350536 - RNA, 23 nt, Human
caugggagugagaaugccagcuc

SEQ ID NO: 350537 - RNA, 20 nt, Human
ugcagcugguuucacaggga

SEQ ID NO: 350538 - RNA, 22 nt, Human
guuuauuauucaacuucauguu

SEQ ID NO: 350539 - RNA, 22 nt, Human
ugccaggcccucccacagauua

SEQ ID NO: 350540 - RNA, 22 nt, Human
ucuguucaguuguaccuucccc

SEQ ID NO: 350541 - RNA, 22 nt, Human
gguacaauggaccauaaaagcu

SEQ ID NO: 350542 - RNA, 22 nt, Human
auaaggaaugauguaucaguuu

SEQ ID NO: 350543 - RNA, 22 nt, Human
aaagaaucguguguaguuugaa

SEQ ID NO: 350544 - RNA, 22 nt, Human
agcuuuauggugccucacuuga

SEQ ID NO: 350545 - RNA, 19 nt, Human
gcugugugaccuugggcaa

SEQ ID NO: 350546 - RNA, 22 nt, Human
gccagguggagguugcagugag

SEQ ID NO: 350547 - RNA, 22 nt, Human
uuucuuuguuguuaucacauca

SEQ ID NO: 350548 - RNA, 20 nt, Human
uccagggcuagggagcucau

SEQ ID NO: 350549 - RNA, 22 nt, Human
aaaucucaguguucuaagcauu

SEQ ID NO: 350550 - RNA, 22 nt, Human
agggcagcuaaggugcugacug

SEQ ID NO: 350551 - RNA, 22 nt, Human
cagugcagguuuagggcugggg

SEQ ID NO: 350552 - RNA, 22 nt, Human
auaaaugauucagcaggaaaua

SEQ ID NO: 350553 - RNA, 22 nt, Human
aaauaauguuaggccuuugcuc

SEQ ID NO: 350554 - RNA, 22 nt, Human
gccuuugcaccaucagugcaau

SEQ ID NO: 350555 - RNA, 22 nt, Human
agugaaaugauaguguaaauac

SEQ ID NO: 350556 - RNA, 22 nt, Human
ucagcugaguucuagagcacuc

SEQ ID NO: 350557 - RNA, 22 nt, Human
aacaucuuuuuguuugcugaaa

SEQ ID NO: 350558 - RNA, 21 nt, Human
cuguccaguaauuccuggcac

SEQ ID NO: 350559 - RNA, 21 nt, Human
ggucagggggugccuccaggu

SEQ ID NO: 350560 - RNA, 22 nt, Human
ugggccugggucuuugcugcca

SEQ ID NO: 350561 - RNA, 22 nt, Human
caccagggcucugagcucugaa

SEQ ID NO: 350562 - RNA, 22 nt, Human
caaaagaagcucuuggggcuag

SEQ ID NO: 350563 - RNA, 22 nt, Human
aaagauuuaagaauaauuugug

SEQ ID NO: 350564 - RNA, 22 nt, Human
cagacagacagccguggccacc

SEQ ID NO: 350565 - RNA, 22 nt, Human
auauaauuguucugaaguguuu

SEQ ID NO: 350566 - RNA, 22 nt, Human
cugggaaauggcuucgagcuca

SEQ ID NO: 350567 - RNA, 22 nt, Human
cuguggagcuuguggcaguggg

SEQ ID NO: 350568 - RNA, 22 nt, Human
gggaguggguuuggccuaggcc

SEQ ID NO: 350569 - RNA, 22 nt, Human
gugauuccuauuaguacaugca

SEQ ID NO: 350570 - RNA, 22 nt, Human
agguggguaucaugagagauua

SEQ ID NO: 350571 - RNA, 22 nt, Human
ccaggccuccugugaguggacc

SEQ ID NO: 350572 - RNA, 22 nt, Human
ugagccaggaguuugaggcugu

SEQ ID NO: 350573 - RNA, 22 nt, Human
guaaacaucagccacucuauuu

SEQ ID NO: 350574 - RNA, 22 nt, Human
ggggcaggagcccuucuucagc

SEQ ID NO: 350575 - RNA, 22 nt, Human
cagcaggaaacuuaaagguaau

SEQ ID NO: 350576 - RNA, 22 nt, Human
cgggcagauugggaagguucau

SEQ ID NO: 350577 - RNA, 22 nt, Human
uuaguacugauagggucaauca

SEQ ID NO: 350578 - RNA, 22 nt, Human
uggccucuuaggacauccucua

SEQ ID NO: 350579 - RNA, 22 nt, Human
uucuggagagaaaccuuacaaa

SEQ ID NO: 350580 - RNA, 22 nt, Human
uggcagaguuggagguggaaga

SEQ ID NO: 350581 - RNA, 22 nt, Human
uagggaugagccaguggguagu

SEQ ID NO: 350582 - RNA, 23 nt, Human
uggcucuguggaucccucaggag

SEQ ID NO: 350583 - RNA, 22 nt, Human
aucauuccacauguaccacuag

SEQ ID NO: 350584 - RNA, 22 nt, Human
ugucuuccucuuggcuugagcu

SEQ ID NO: 350585 - RNA, 22 nt, Human
ggcagcaguggcugcuauuguc

SEQ ID NO: 350586 - RNA, 22 nt, Human
uuccacaauguaugaauaagau

SEQ ID NO: 350587 - RNA, 21 nt, Human
aacauuucugggagaacucac

SEQ ID NO: 350588 - RNA, 22 nt, Human
aagagcuggcccaaucugagca

SEQ ID NO: 350589 - RNA, 23 nt, Human
uccagggauuaaugaagucaguc

SEQ ID NO: 350590 - RNA, 22 nt, Human
gcuccagguauuugcccuuuua

SEQ ID NO: 350591 - RNA, 22 nt, Human
cucuggaggccuaaggaagugg

SEQ ID NO: 350592 - RNA, 22 nt, Human
agggcuguuuuuggcaccuggg

SEQ ID NO: 350593 - RNA, 22 nt, Human
cauggcuuuuuagcauauucaa

SEQ ID NO: 350594 - RNA, 19 nt, Human
cauguuaugcuguaguauc

SEQ ID NO: 350595 - RNA, 22 nt, Human
uaauuguagcuuuguaaucagc

SEQ ID NO: 350596 - RNA, 22 nt, Human
cugggaggcacuauucaggagg

SEQ ID NO: 350597 - RNA, 22 nt, Human
gucauuucuguuucuucagugc

SEQ ID NO: 350598 - RNA, 22 nt, Human
agccucucuuuauucccagcua

SEQ ID NO: 350599 - RNA, 22 nt, Human
uuguguccugauuugacacaau

SEQ ID NO: 350600 - RNA, 22 nt, Human
aaggcugauuagacugauagcu

SEQ ID NO: 350601 - RNA, 17 nt, Human
agcagcugaagcagcca

SEQ ID NO: 350602 - RNA, 22 nt, Human
agcugcccuuaauaggcauuca

SEQ ID NO: 350603 - RNA, 18 nt, Human
cugaggcuggcaggagcc

SEQ ID NO: 350604 - RNA, 22 nt, Human
cagagcaggcccacugcccucc

SEQ ID NO: 350605 - RNA, 19 nt, Human
uaguggagugacaaguucu

SEQ ID NO: 350606 - RNA, 22 nt, Human
cuucccugauaagagccucaga

SEQ ID NO: 350607 - RNA, 22 nt, Human
ggcaggcuggcuuuguuccagg

SEQ ID NO: 350608 - RNA, 22 nt, Human
ugaggaagcaaaggcuugugug

SEQ ID NO: 350609 - RNA, 22 nt, Human
agaucucaccucuguguauuau

SEQ ID NO: 350610 - RNA, 23 nt, Human
acuuuauccuauaucuuuguucu

SEQ ID NO: 350611 - RNA, 22 nt, Human
cugugcuggcagaccuggaguu

SEQ ID NO: 350612 - RNA, 22 nt, Human
gggcagcugccacuccgcuugc

SEQ ID NO: 350613 - RNA, 22 nt, Human
ccagccagcugcccuuggggcc

SEQ ID NO: 350614 - RNA, 22 nt, Human
ccaaaguccauaguuuacauua

SEQ ID NO: 350615 - RNA, 22 nt, Human
cugggcagguauacaaaaaaug

SEQ ID NO: 350616 - RNA, 22 nt, Human
agggagguccaucccugcagag

SEQ ID NO: 350617 - RNA, 22 nt, Human
ugcagugguguccagguguacu

SEQ ID NO: 350618 - RNA, 22 nt, Human
aagccaggcaugcuuggacagu

SEQ ID NO: 350619 - RNA, 22 nt, Human
aucuggcuuacgaagcacuggu

SEQ ID NO: 350620 - RNA, 22 nt, Human
aagaacauuuuguagaaugaca

SEQ ID NO: 350621 - RNA, 22 nt, Human
agccagugggauuagagccucu

SEQ ID NO: 350622 - RNA, 22 nt, Human
uuugacagacauuuacuacauu

SEQ ID NO: 350623 - RNA, 22 nt, Human
ugacagggugauuaugagagcu

SEQ ID NO: 350624 - RNA, 22 nt, Human
agcucugcaggcacagcugagg

SEQ ID NO: 350625 - RNA, 22 nt, Human
uuccaggagacuuccagaaaua

SEQ ID NO: 350626 - RNA, 22 nt, Human
aggugucuucagggugagacag

SEQ ID NO: 350627 - RNA, 22 nt, Human
ugucccagguccuagaugacca

SEQ ID NO: 350628 - RNA, 22 nt, Human
acagcuugcaauggcuuucaac

SEQ ID NO: 350629 - RNA, 22 nt, Human
cagucucucagcuuucagcugu

SEQ ID NO: 350630 - RNA, 22 nt, Human
ugggcagauguggcucuccuug

SEQ ID NO: 350631 - RNA, 22 nt, Human
gugggcugcccuugaggucagc

SEQ ID NO: 350632 - RNA, 22 nt, Human
aggcagugcagaguccucuucu

SEQ ID NO: 350633 - RNA, 18 nt, Human
ugacucacccugucagug

SEQ ID NO: 350634 - RNA, 22 nt, Human
ggucccugguucccucugagcu

SEQ ID NO: 350635 - RNA, 21 nt, Human
cugugcuuuuuaagugugaug

SEQ ID NO: 350636 - RNA, 22 nt, Human
uacauagcaaggaaaugacaga

SEQ ID NO: 350637 - RNA, 22 nt, Human
cuugucagccaauuguggauuu

SEQ ID NO: 350638 - RNA, 22 nt, Human
agcaugaaagcauaggacaguc

SEQ ID NO: 350639 - RNA, 22 nt, Human
aaauaucauuuauaacuuuuaa

SEQ ID NO: 350640 - RNA, 22 nt, Human
uuauucuuuaaacauauauguu

SEQ ID NO: 350641 - RNA, 22 nt, Human
augaugugugcugaucaagcuu

SEQ ID NO: 350642 - RNA, 22 nt, Human
uggcucugucacugugagcuau

SEQ ID NO: 350643 - RNA, 22 nt, Human
uuucucugcugccugugucgau

SEQ ID NO: 350644 - RNA, 22 nt, Human
cacagaaaaaggcuugaaaauc

SEQ ID NO: 350645 - RNA, 22 nt, Human
aucuggcucaccuggguaaaua

SEQ ID NO: 350646 - RNA, 22 nt, Human
gaggggaaagugugaggcugcg

SEQ ID NO: 350647 - RNA, 22 nt, Human
aagggcucugugugccucccca

SEQ ID NO: 350648 - RNA, 22 nt, Human
aaaggccacuugaaggauuuuu

SEQ ID NO: 350649 - RNA, 22 nt, Human
agccaguguuaagugacugguu

SEQ ID NO: 350650 - RNA, 22 nt, Human
ugacagggcuagaggcaaugca

SEQ ID NO: 350651 - RNA, 22 nt, Human
gcccaggaagugacucagaugu

SEQ ID NO: 350652 - RNA, 22 nt, Human
cagucuuuguucccauuacuga

SEQ ID NO: 350653 - RNA, 22 nt, Human
guggugcauccuugaguaagcu

SEQ ID NO: 350654 - RNA, 22 nt, Human
uucuucuugucugcccucacau

SEQ ID NO: 350655 - RNA, 22 nt, Human
agagcagauggagcuggaagag

SEQ ID NO: 350656 - RNA, 22 nt, Human
gcuuugcauuguuuaaucagga

SEQ ID NO: 350657 - RNA, 22 nt, Human
agcugccugggcuuguacaccu

SEQ ID NO: 350658 - RNA, 22 nt, Human
ccugccagugaagcugacgggc

SEQ ID NO: 350659 - RNA, 22 nt, Human
ucaagauaccaccauuauaugu

SEQ ID NO: 350660 - RNA, 22 nt, Human
agggggugcuacuuccagaguu

SEQ ID NO: 350661 - RNA, 22 nt, Human
uccugccuaccuugcggaggug

SEQ ID NO: 350662 - RNA, 22 nt, Human
uaauguguccugaaagcuucug

SEQ ID NO: 350663 - RNA, 20 nt, Human
ccugucugcaauggagguca

SEQ ID NO: 350664 - RNA, 22 nt, Human
aaugcuguauaucuuagcuaau

SEQ ID NO: 350665 - RNA, 21 nt, Human
gugguuauuuucauuagcauc

SEQ ID NO: 350666 - RNA, 22 nt, Human
uuguccaaaguaacacaucuag

SEQ ID NO: 350667 - RNA, 22 nt, Human
aggguagguguaagauagcccu

SEQ ID NO: 350668 - RNA, 22 nt, Human
agcugccaucugaagaacugca

SEQ ID NO: 350669 - RNA, 22 nt, Human
uaaagcaguguugggucggacg

SEQ ID NO: 350670 - RNA, 22 nt, Human
uugacacaguuuucucauuaag

SEQ ID NO: 350671 - RNA, 22 nt, Human
aggccucacucucagagcuucu

SEQ ID NO: 350672 - RNA, 22 nt, Human
ugggcagagucauacaggagac

SEQ ID NO: 350673 - RNA, 22 nt, Human
uguugauuaguguuuagacuua

SEQ ID NO: 350674 - RNA, 22 nt, Human
uuaaauuuuagaaacagacucu

SEQ ID NO: 350675 - RNA, 22 nt, Human
ccagucccgcaugguccagaau

SEQ ID NO: 350676 - RNA, 21 nt, Human
gguugguguguccaguggcca

SEQ ID NO: 350677 - RNA, 22 nt, Human
ucugaaaguaucuggaucuuuu

SEQ ID NO: 350678 - RNA, 22 nt, Human
acugucugcuggccccugguua

SEQ ID NO: 350679 - RNA, 22 nt, Human
caagggcucacggucugcuggg

SEQ ID NO: 350680 - RNA, 22 nt, Human
ggggcagcucccgagggcagga

SEQ ID NO: 350681 - RNA, 22 nt, Human
agcugcugagccaggcugaugu

SEQ ID NO: 350682 - RNA, 22 nt, Human
ugggugaggaugaugaggcagc

SEQ ID NO: 350683 - RNA, 22 nt, Human
gcccaggaaaugccccguggug

SEQ ID NO: 350684 - RNA, 22 nt, Human
gucagaggggcagcugccaggc

SEQ ID NO: 350685 - RNA, 22 nt, Human
ggcucugcuucagaaggcucau

SEQ ID NO: 350686 - RNA, 22 nt, Human
ucucuucuaacacuagaaauuc

SEQ ID NO: 350687 - RNA, 22 nt, Human
gugcauguuaaugguguacaaa

SEQ ID NO: 350688 - RNA, 22 nt, Human
ugggcugcuguuacaggggcug

SEQ ID NO: 350689 - RNA, 22 nt, Human
acaaacuaccuacagauguuca

SEQ ID NO: 350690 - RNA, 22 nt, Human
ccuguucaagggaugauugacc

SEQ ID NO: 350691 - RNA, 22 nt, Human
uggcagaaagaaccaugugcaa

SEQ ID NO: 350692 - RNA, 22 nt, Human
uugauuucuauucagauguaga

SEQ ID NO: 350693 - RNA, 22 nt, Human
gagggcucugucuggaagggaa

SEQ ID NO: 350694 - RNA, 21 nt, Human
gcucagaguauugcacuguuu

SEQ ID NO: 350695 - RNA, 22 nt, Human
ucacaacucuuuccauuuaaua

SEQ ID NO: 350696 - RNA, 22 nt, Human
gcucugagcacugugcggcugg

SEQ ID NO: 350697 - RNA, 22 nt, Human
uuccaguucccaugaggauuaa

SEQ ID NO: 350698 - RNA, 22 nt, Human
aaucauucuuauuucacagcaa

SEQ ID NO: 350699 - RNA, 21 nt, Human
auggagucaggggaaugggcc

SEQ ID NO: 350700 - RNA, 21 nt, Human
ggcagcugaccgcgcggugca

SEQ ID NO: 350701 - RNA, 22 nt, Human
auuguacaaugccuggaacauu

SEQ ID NO: 350702 - RNA, 22 nt, Human
ggcagcuccucaaaaaauuaaa

SEQ ID NO: 350703 - RNA, 22 nt, Human
acugagcugcuugaagugaacu

SEQ ID NO: 350704 - RNA, 22 nt, Human
cacauuucugugagucaauauu

SEQ ID NO: 350705 - RNA, 22 nt, Human
cagaucuagagcuuuuccaucu

SEQ ID NO: 350706 - RNA, 22 nt, Human
guuguacagcauccagugcaga

SEQ ID NO: 350707 - RNA, 22 nt, Human
uaagacuucauuaguaauaugg

SEQ ID NO: 350708 - RNA, 23 nt, Human
uuagagaugauuaaaaaaucuug

SEQ ID NO: 350709 - RNA, 22 nt, Human
ucuagacacuacuaguaaccgg

SEQ ID NO: 350710 - RNA, 22 nt, Human
ccuguucaagguauuaauuauc

SEQ ID NO: 350711 - RNA, 22 nt, Human
uuuccaaaaugaaucuaaugca

SEQ ID NO: 350712 - RNA, 22 nt, Human
uaacagaagaaaacauauugga

SEQ ID NO: 350713 - RNA, 22 nt, Human
aggccucagugaucaucaucag

SEQ ID NO: 350714 - RNA, 22 nt, Human
acauuucugcaucucagagcua

SEQ ID NO: 350715 - RNA, 22 nt, Human
cuuccuggccauugccauggca

SEQ ID NO: 350716 - RNA, 22 nt, Human
ucuggagcuggagggcaaggca

SEQ ID NO: 350717 - RNA, 22 nt, Human
gggaccugccauugcucacagg

SEQ ID NO: 350718 - RNA, 22 nt, Human
cagcagcucccauccgcugagc

SEQ ID NO: 350719 - RNA, 19 nt, Human
uuacaucugcaacacuggu

SEQ ID NO: 350720 - RNA, 22 nt, Human
acuguucacccagcacuagcag

SEQ ID NO: 350721 - RNA, 22 nt, Human
gagcucauccccaugguccguc

SEQ ID NO: 350722 - RNA, 22 nt, Human
gaaucauuuauuuuugacagca

SEQ ID NO: 350723 - RNA, 22 nt, Human
acaugcuuuaacuuauuuugau

SEQ ID NO: 350724 - RNA, 22 nt, Human
uuuauacuccacucugcaagcg

SEQ ID NO: 350725 - RNA, 22 nt, Human
uggcaucucaaacaggcagauu

SEQ ID NO: 350726 - RNA, 22 nt, Human
cacacaugagucuccccauugg

SEQ ID NO: 350727 - RNA, 23 nt, Human
ccagcucccaggucugaggacug

SEQ ID NO: 350728 - RNA, 22 nt, Human
gagcucagcacuaaaaucaugu

SEQ ID NO: 350729 - RNA, 22 nt, Human
aaggcugagggcuguaccuggc

SEQ ID NO: 350730 - RNA, 22 nt, Human
cacagggcagguacucucagag

SEQ ID NO: 350731 - RNA, 22 nt, Human
gucucagagagcuacucucuua

SEQ ID NO: 350732 - RNA, 18 nt, Human
uggacaggguggagaaaa

SEQ ID NO: 350733 - RNA, 22 nt, Human
uccagcagaccaucaaggcuca

SEQ ID NO: 350734 - RNA, 22 nt, Human
gccugaggaaugcuccugacuu

SEQ ID NO: 350735 - RNA, 22 nt, Human
uguaggaguccaaucaggagac

SEQ ID NO: 350736 - RNA, 22 nt, Human
gaguccaguguuuaccaggggu

SEQ ID NO: 350737 - RNA, 22 nt, Human
cccaggcuggauuucgguggca

SEQ ID NO: 350738 - RNA, 19 nt, Human
ugucccagacuccgugucu

SEQ ID NO: 350739 - RNA, 22 nt, Human
acagaacugggaaaugcacaua

SEQ ID NO: 350740 - RNA, 22 nt, Human
aagagggcagcacagguggguc

SEQ ID NO: 350741 - RNA, 20 nt, Human
cugugccuaaaccuccgggu

SEQ ID NO: 350742 - RNA, 22 nt, Human
gguuucaacucagcuaguaagg

SEQ ID NO: 350743 - RNA, 22 nt, Human
aggcagacugugcgggaagagu

SEQ ID NO: 350744 - RNA, 22 nt, Human
ccagaucuaaguccaaaguacu

SEQ ID NO: 350745 - RNA, 22 nt, Human
aggcccugcccagagcuccucg

SEQ ID NO: 350746 - RNA, 22 nt, Human
acaugaaacuguugcauuagaa

SEQ ID NO: 350747 - RNA, 22 nt, Human
uugucuuaaauggauggacaau

SEQ ID NO: 350748 - RNA, 22 nt, Human
aaaacuuucagggauacagaaa

SEQ ID NO: 350749 - RNA, 22 nt, Human
gacccagcuuaagucacauguu

SEQ ID NO: 350750 - RNA, 22 nt, Human
acagaaauauucguggugcuug

SEQ ID NO: 350751 - RNA, 22 nt, Human
cauugcacuccacccuaggcaa

SEQ ID NO: 350752 - RNA, 22 nt, Human
aaccugcaguuuuuauucugag

SEQ ID NO: 350753 - RNA, 22 nt, Human
aucuggcuccuacacuugaaga

SEQ ID NO: 350754 - RNA, 22 nt, Human
aaaauggucucagcuggcacca

SEQ ID NO: 350755 - RNA, 22 nt, Human
cccugcagaucuaggguccuuc

SEQ ID NO: 350756 - RNA, 22 nt, Human
cagucucucugaaguauuaaga

SEQ ID NO: 350757 - RNA, 22 nt, Human
aaguccagugcuuuagauucca

SEQ ID NO: 350758 - RNA, 22 nt, Human
ucagccugcuccaagugcugcc

SEQ ID NO: 350759 - RNA, 22 nt, Human
agccuccuguagcccucaccca

SEQ ID NO: 350760 - RNA, 22 nt, Human
caggagugaaaugaggcccagg

SEQ ID NO: 350761 - RNA, 22 nt, Human
aauuucagaacccaaauuagcg

SEQ ID NO: 350762 - RNA, 22 nt, Human
guuucgucaggcuuauucuauc

SEQ ID NO: 350763 - RNA, 22 nt, Human
augcucugggcaggagcccugg

SEQ ID NO: 350764 - RNA, 22 nt, Human
ucaagagagugcugcuuggggu

SEQ ID NO: 350765 - RNA, 20 nt, Human
aguaccuuuuguauguuacc

SEQ ID NO: 350766 - RNA, 20 nt, Human
augugucuguaaacaacucu

SEQ ID NO: 350767 - RNA, 22 nt, Human
acuuuaucaggaaucacacagc

SEQ ID NO: 350768 - RNA, 21 nt, Human
ugcuuuaugggaaaaauguca

SEQ ID NO: 350769 - RNA, 22 nt, Human
aggcagcugaggucuggcgccc

SEQ ID NO: 350770 - RNA, 22 nt, Human
ucucagagauguuagggaagag

SEQ ID NO: 350771 - RNA, 22 nt, Human
aagaagaugguuaacuuucagu

SEQ ID NO: 350772 - RNA, 22 nt, Human
uaagaacaguguuucaucucua

SEQ ID NO: 350773 - RNA, 22 nt, Human
uaaggccaauuacauauguuca

SEQ ID NO: 350774 - RNA, 22 nt, Human
accaggcagcaccaaagccggu

SEQ ID NO: 350775 - RNA, 22 nt, Human
auaacagagagcuacugaacug

SEQ ID NO: 350776 - RNA, 22 nt, Human
cugugucccccucagccaggug

SEQ ID NO: 350777 - RNA, 22 nt, Human
ggcagagguagcuggaaccagg

SEQ ID NO: 350778 - RNA, 22 nt, Human
cauuuuaaaugauuuaagccaa

SEQ ID NO: 350779 - RNA, 22 nt, Human
aggucagcaugaguagaaggua

SEQ ID NO: 350780 - RNA, 22 nt, Human
ggcagcaaauauugucagcugu

SEQ ID NO: 350781 - RNA, 22 nt, Human
agcagccacagcagaucugagu

SEQ ID NO: 350782 - RNA, 22 nt, Human
uucagagagaccaaguggcgug

SEQ ID NO: 350783 - RNA, 22 nt, Human
uugugugguagcuucauugaac

SEQ ID NO: 350784 - RNA, 22 nt, Human
auuugcauaauagugauuugua

SEQ ID NO: 350785 - RNA, 22 nt, Human
uccauuuuagagaugaagaaac

SEQ ID NO: 350786 - RNA, 22 nt, Human
ugcugcucuguaaagugaugag

SEQ ID NO: 350787 - RNA, 22 nt, Human
ggccucuggcaggcaggcccuc

SEQ ID NO: 350788 - RNA, 22 nt, Human
gaauagcuuccuuuuuuccaaa

SEQ ID NO: 350789 - RNA, 22 nt, Human
aucuuucuccauauacaucuuu

SEQ ID NO: 350790 - RNA, 22 nt, Human
agcuucuuggcucagcacuugg

SEQ ID NO: 350791 - RNA, 22 nt, Human
uggcagaguggaccauacucaa

SEQ ID NO: 350792 - RNA, 22 nt, Human
agcagcauuccuggcuucuauc

SEQ ID NO: 350793 - RNA, 22 nt, Human
guuagaaacacauucuuauuga

SEQ ID NO: 350794 - RNA, 22 nt, Human
ugaaggccagggauuugcagcc

SEQ ID NO: 350795 - RNA, 22 nt, Human
ucuggcuuucauuuguuuaaag

SEQ ID NO: 350796 - RNA, 22 nt, Human
augggaggaaggaggcccuuga

SEQ ID NO: 350797 - RNA, 22 nt, Human
aagaugcaugcugaagcuggcu

SEQ ID NO: 350798 - RNA, 22 nt, Human
ucauucagguugggcaaguguc

SEQ ID NO: 350799 - RNA, 22 nt, Human
ggcugccuucagacuccagcuu

SEQ ID NO: 350800 - RNA, 22 nt, Human
uuugcaaauauguguuucuauu

SEQ ID NO: 350801 - RNA, 22 nt, Human
ucccaggugaugcugaggccac

SEQ ID NO: 350802 - RNA, 22 nt, Human
gcuguucacaucuggaccauuu

SEQ ID NO: 350803 - RNA, 22 nt, Human
gggggacuggaccguccugggu

SEQ ID NO: 350804 - RNA, 22 nt, Human
aaggcagagggcuggaucagag

SEQ ID NO: 350805 - RNA, 22 nt, Human
uccaggagugauaaggccacug

SEQ ID NO: 350806 - RNA, 22 nt, Human
gucuuucuuaauucaagugcuu

SEQ ID NO: 350807 - RNA, 22 nt, Human
agcagggcaaagucaggcuaac

SEQ ID NO: 350808 - RNA, 22 nt, Human
uccagccuuucuacucacugag

SEQ ID NO: 350809 - RNA, 22 nt, Human
cgacccuacagacagugcugag

SEQ ID NO: 350810 - RNA, 22 nt, Human
ugcagggccuuguugaugugcu

SEQ ID NO: 350811 - RNA, 22 nt, Human
aucaaaaugcuccagugauggu

SEQ ID NO: 350812 - RNA, 22 nt, Human
gccaguggcuugccaggcagga

SEQ ID NO: 350813 - RNA, 22 nt, Human
cacagggcuucucauggggugc

SEQ ID NO: 350814 - RNA, 22 nt, Human
gccucugcucggacuuugccuc

SEQ ID NO: 350815 - RNA, 20 nt, Human
ccuggagccuggaaggaguc

SEQ ID NO: 350816 - RNA, 22 nt, Human
uuggcugagagaggaaaagggc

SEQ ID NO: 350817 - RNA, 22 nt, Human
ugauuuccacgugcacccaggu

SEQ ID NO: 350818 - RNA, 22 nt, Human
cuguacauauacauuuuuuucc

SEQ ID NO: 350819 - RNA, 22 nt, Human
cacucugacuggcccugcagga

SEQ ID NO: 350820 - RNA, 22 nt, Human
aggcagcccacaggacacagga

SEQ ID NO: 350821 - RNA, 22 nt, Human
ggugggcagcucuuggcaggca

SEQ ID NO: 350822 - RNA, 22 nt, Human
uuggcagggccaggcucucucu

SEQ ID NO: 350823 - RNA, 20 nt, Human
uggcuccugcgguggaacca

SEQ ID NO: 350824 - RNA, 22 nt, Human
agcugcccagauaggaggaggc

SEQ ID NO: 350825 - RNA, 22 nt, Human
guccaugauucuguguaguaga

SEQ ID NO: 350826 - RNA, 22 nt, Human
ucauugaauuucacagcuuuau

SEQ ID NO: 350827 - RNA, 22 nt, Human
uaaguaaauuuauaaugugauu

SEQ ID NO: 350828 - RNA, 22 nt, Human
uucugugaaucuuuuuucccac

SEQ ID NO: 350829 - RNA, 22 nt, Human
uccugcagccaagggucaucga

SEQ ID NO: 350830 - RNA, 22 nt, Human
caggcacuucugcugcuugucu

SEQ ID NO: 350831 - RNA, 22 nt, Human
acacacaacucauuguguaaua

SEQ ID NO: 350832 - RNA, 23 nt, Human
acagacaacacugaugagagaaa

SEQ ID NO: 350833 - RNA, 22 nt, Human
ccaggagucuggaugagguguc

SEQ ID NO: 350834 - RNA, 22 nt, Human
uucucagaauugacugggagca

SEQ ID NO: 350835 - RNA, 22 nt, Human
aaggcagccuuuguuugauuga

SEQ ID NO: 350836 - RNA, 22 nt, Human
auagcuuucuuaaauauauaaa

SEQ ID NO: 350837 - RNA, 21 nt, Human
aaagugguaaggauuauuuug

SEQ ID NO: 350838 - RNA, 22 nt, Human
ccagagcuccagggcuacagaa

SEQ ID NO: 350839 - RNA, 22 nt, Human
gaaaacacuuugaucugaaagu

SEQ ID NO: 350840 - RNA, 22 nt, Human
ccagggcaauaggaacacuuuu

SEQ ID NO: 350841 - RNA, 22 nt, Human
aggcucagugauguaaaauaua

SEQ ID NO: 350842 - RNA, 22 nt, Human
ucuggcucucaacaaauauuua

SEQ ID NO: 350843 - RNA, 22 nt, Human
acauuucugagcagggagcugu

SEQ ID NO: 350844 - RNA, 22 nt, Human
uuccagaaaucuuucagcucaa

SEQ ID NO: 350845 - RNA, 22 nt, Human
cagggcucccaaauaucucuuc

SEQ ID NO: 350846 - RNA, 22 nt, Human
cuguccccgcgaguccagagcu

SEQ ID NO: 350847 - RNA, 22 nt, Human
cuggcuuucuauuuggugcuau

SEQ ID NO: 350848 - RNA, 22 nt, Human
uggcccugcugggucagagcug

SEQ ID NO: 350849 - RNA, 22 nt, Human
cagcaggauaugguggagagag

SEQ ID NO: 350850 - RNA, 22 nt, Human
uagaaaucuacuuagacuuucu

SEQ ID NO: 350851 - RNA, 22 nt, Human
cuggcaggcggcagagcccagg

SEQ ID NO: 350852 - RNA, 22 nt, Human
uuuggaaaguugucacuuuaga

SEQ ID NO: 350853 - RNA, 19 nt, Human
ucacaggcaucuccccaga

SEQ ID NO: 350854 - RNA, 22 nt, Human
ucacuuagauggggaucaucac

SEQ ID NO: 350855 - RNA, 22 nt, Human
cacaaaugguuguagacauuaa

SEQ ID NO: 350856 - RNA, 22 nt, Human
cagugccaugucugagccccua

SEQ ID NO: 350857 - RNA, 22 nt, Human
cagcagcugauggggaagugau

SEQ ID NO: 350858 - RNA, 21 nt, Human
auagaacaccaggcauauaua

SEQ ID NO: 350859 - RNA, 22 nt, Human
auacauacguacauacguaugu

SEQ ID NO: 350860 - RNA, 22 nt, Human
agccugccuugggcugcuugag

SEQ ID NO: 350861 - RNA, 22 nt, Human
acagagcauauaaagugcuuug

SEQ ID NO: 350862 - RNA, 22 nt, Human
ugccugaggagucagggcaggu

SEQ ID NO: 350863 - RNA, 22 nt, Human
ccaggcugugguuuagauagag

SEQ ID NO: 350864 - RNA, 22 nt, Human
uagggaggaggguuuucaaauc

SEQ ID NO: 350865 - RNA, 20 nt, Human
gucucagaauggauuugcau

SEQ ID NO: 350866 - RNA, 22 nt, Human
cucuucucugcagccuuugaag

SEQ ID NO: 350867 - RNA, 22 nt, Human
agccagagcagggaauuggaca

SEQ ID NO: 350868 - RNA, 22 nt, Human
ccagcccugaacccugcugcau

SEQ ID NO: 350869 - RNA, 22 nt, Human
acagguggccccgagggagugg

SEQ ID NO: 350870 - RNA, 22 nt, Human
gacagacauuuccugauccaau

SEQ ID NO: 350871 - RNA, 22 nt, Human
ugcauuucagaagaaaauucgg

SEQ ID NO: 350872 - RNA, 22 nt, Human
ucuggcucucauacucgccagu

SEQ ID NO: 350873 - RNA, 22 nt, Human
acuggaagccaguugacaauca

SEQ ID NO: 350874 - RNA, 22 nt, Human
ucuguuuaggcaaaauagcuac

SEQ ID NO: 350875 - RNA, 22 nt, Human
cacugggcaauucugagccuaa

SEQ ID NO: 350876 - RNA, 22 nt, Human
caugguuuauuagagcuuauuu

SEQ ID NO: 350877 - RNA, 22 nt, Human
cagcugccuucugcgggaaguc

SEQ ID NO: 350878 - RNA, 22 nt, Human
cagggucuuauaaggccaauuu

SEQ ID NO: 350879 - RNA, 22 nt, Human
gggagacacgcugcaggcauaa

SEQ ID NO: 350880 - RNA, 19 nt, Human
uucccaggaaaggggugca

SEQ ID NO: 350881 - RNA, 22 nt, Human
gggccagugaacaaugagggaa

SEQ ID NO: 350882 - RNA, 22 nt, Human
ccacucugauuuuggcuccacu

SEQ ID NO: 350883 - RNA, 22 nt, Human
cauuugaaugagauugcuguaa

SEQ ID NO: 350884 - RNA, 22 nt, Human
aaaguuuccugcuaagugcuau

SEQ ID NO: 350885 - RNA, 21 nt, Human
aggcagcuggaaggccuggcu

SEQ ID NO: 350886 - RNA, 22 nt, Human
uggaggaugccauccaggauac

SEQ ID NO: 350887 - RNA, 23 nt, Human
agggcugaugccauugcagcucu

SEQ ID NO: 350888 - RNA, 22 nt, Human
gcagggugauagugaggcucag

SEQ ID NO: 350889 - RNA, 19 nt, Human
aaaaacuuaguccagaaag

SEQ ID NO: 350890 - RNA, 22 nt, Human
ggagccaguuuagaccucaguu

SEQ ID NO: 350891 - RNA, 22 nt, Human
ugcacauucacuuagguauugu

SEQ ID NO: 350892 - RNA, 22 nt, Human
cugcugcucagugucaucaugu

SEQ ID NO: 350893 - RNA, 22 nt, Human
guugggaaggcaagaaguagaa

SEQ ID NO: 350894 - RNA, 22 nt, Human
aauucuugguccuaguguauaa

SEQ ID NO: 350895 - RNA, 19 nt, Human
uccauaagcuuguguucau

SEQ ID NO: 350896 - RNA, 22 nt, Human
ugcaggugcguuuucaagccuc

SEQ ID NO: 350897 - RNA, 22 nt, Human
cuggcccagagagcagagcuua

SEQ ID NO: 350898 - RNA, 22 nt, Human
uuucacauaugguuguugauug

SEQ ID NO: 350899 - RNA, 22 nt, Human
aagaaaugcagaaaugugcugg

SEQ ID NO: 350900 - RNA, 22 nt, Human
ucccaggcaaaggcagcucauu

SEQ ID NO: 350901 - RNA, 22 nt, Human
ucuuuucuggacucugcaugga

SEQ ID NO: 350902 - RNA, 22 nt, Human
ucuuccagcaaugugaaaucac

SEQ ID NO: 350903 - RNA, 22 nt, Human
cuacagaaguuucccuugcuua

SEQ ID NO: 350904 - RNA, 22 nt, Human
ggcuggagauaugucuggaaca

SEQ ID NO: 350905 - RNA, 22 nt, Human
aaaugcacacaccaggaaacua

SEQ ID NO: 350906 - RNA, 22 nt, Human
uggcugagugauauuugcaaag

SEQ ID NO: 350907 - RNA, 22 nt, Human
acaugauuuuaguaucauaaua

SEQ ID NO: 350908 - RNA, 20 nt, Human
cccuccagcaaccaggacuu

SEQ ID NO: 350909 - RNA, 22 nt, Human
ugauuuuuagcuauucugaaga

SEQ ID NO: 350910 - RNA, 22 nt, Human
ucugccuugagguccucagcuc

SEQ ID NO: 350911 - RNA, 22 nt, Human
cugcagggaugugaggcccguu

SEQ ID NO: 350912 - RNA, 22 nt, Human
ccuucugcuggucaucccagug

SEQ ID NO: 350913 - RNA, 22 nt, Human
aggacuucaucaccuguauaaa

SEQ ID NO: 350914 - RNA, 22 nt, Human
gggcugagccauuugaaccuug

SEQ ID NO: 350915 - RNA, 22 nt, Human
agggcagccauugagggauucu

SEQ ID NO: 350916 - RNA, 23 nt, Human
ugaaggccuggaggacgcguugu

SEQ ID NO: 350917 - RNA, 22 nt, Human
ggcaggugcucugugggccugg

SEQ ID NO: 350918 - RNA, 22 nt, Human
cguggccuuugagugagcuccc

SEQ ID NO: 350919 - RNA, 20 nt, Human
uauggcuuggcaaagcuuca

SEQ ID NO: 350920 - RNA, 22 nt, Human
aaugccaacuuggauauacauu

SEQ ID NO: 350921 - RNA, 22 nt, Human
ggucacaggggagaagagugau

SEQ ID NO: 350922 - RNA, 22 nt, Human
ucuggaucuccagcacuuauca

SEQ ID NO: 350923 - RNA, 22 nt, Human
gacaguccuugcccaguaucua

SEQ ID NO: 350924 - RNA, 22 nt, Human
ugcuuuauugcaucaguguggg

SEQ ID NO: 350925 - RNA, 22 nt, Human
gccugcagcaugcuaggucuug

SEQ ID NO: 350926 - RNA, 22 nt, Human
gggcugugagaguggggcugcu

SEQ ID NO: 350927 - RNA, 22 nt, Human
ucucagagugguggucccucug

SEQ ID NO: 350928 - RNA, 22 nt, Human
uggcagagcccagaacugagca

SEQ ID NO: 350929 - RNA, 22 nt, Human
ucauaaaaugcuccugauauug

SEQ ID NO: 350930 - RNA, 22 nt, Human
aagauauacuauuaaguaccau

SEQ ID NO: 350931 - RNA, 22 nt, Human
gggcuucuagaccagcagugag

SEQ ID NO: 350932 - RNA, 22 nt, Human
aaguguuuggggaucauuuuaa

SEQ ID NO: 350933 - RNA, 22 nt, Human
aggcccagagcaggaaaggguu

SEQ ID NO: 350934 - RNA, 22 nt, Human
uggcucugccacuaacuuggua

SEQ ID NO: 350935 - RNA, 22 nt, Human
aacauauaaacucuuaaguuca

SEQ ID NO: 350936 - RNA, 21 nt, Human
aaguggagaagaaaagcugga

SEQ ID NO: 350937 - RNA, 22 nt, Human
ccagggcaauuauuuggagggu

SEQ ID NO: 350938 - RNA, 22 nt, Human
cugugccuggggggcagagcug

SEQ ID NO: 350939 - RNA, 22 nt, Human
gucucagauucagacaucuaca

SEQ ID NO: 350940 - RNA, 23 nt, Human
aguuccagaaaaaugcucaagca

SEQ ID NO: 350941 - RNA, 22 nt, Human
acagagagcugugauugaguua

SEQ ID NO: 350942 - RNA, 22 nt, Human
gaguucaguaguuauagucuag

SEQ ID NO: 350943 - RNA, 22 nt, Human
gggucagcugcugggggcugac

SEQ ID NO: 350944 - RNA, 19 nt, Human
acccagagcccuuugcagg

SEQ ID NO: 350945 - RNA, 22 nt, Human
cucuggaguuagugaucugggc

SEQ ID NO: 350946 - RNA, 22 nt, Human
uggccugucuuguugugcuaga

SEQ ID NO: 350947 - RNA, 22 nt, Human
ccugcagcuguaggagaaggcg

SEQ ID NO: 350948 - RNA, 22 nt, Human
ucuuuccuguaacugcuguuca

SEQ ID NO: 350949 - RNA, 22 nt, Human
aaacagaaggguagguaaacau

SEQ ID NO: 350950 - RNA, 22 nt, Human
uucucagagugaccaagucuuu

SEQ ID NO: 350951 - RNA, 20 nt, Human
agguauaagaaaugugauuu

SEQ ID NO: 350952 - RNA, 22 nt, Human
accugcaguggccacuccuaau

SEQ ID NO: 350953 - RNA, 22 nt, Human
ugccaggagagugcaugcaggg

SEQ ID NO: 350954 - RNA, 22 nt, Human
ggcuucccaaggagccaggaug

SEQ ID NO: 350955 - RNA, 20 nt, Human
uuaagaaaagcacauccugc

SEQ ID NO: 350956 - RNA, 22 nt, Human
gaggggcuggcacgauggcugc

SEQ ID NO: 350957 - RNA, 22 nt, Human
uuuacagagagagaacuggacu

SEQ ID NO: 350958 - RNA, 22 nt, Human
auucuuauuauaguaaaacagu

SEQ ID NO: 350959 - RNA, 22 nt, Human
aggcccuggcacugccugggag

SEQ ID NO: 350960 - RNA, 22 nt, Human
gaaacaacuacuauugauuucu

SEQ ID NO: 350961 - RNA, 21 nt, Human
aaaggccauaaucacggagca

SEQ ID NO: 350962 - RNA, 22 nt, Human
gggcauggaggucugucugcag

SEQ ID NO: 350963 - RNA, 22 nt, Human
uaguaucuauuaguaacaagag

SEQ ID NO: 350964 - RNA, 22 nt, Human
uuugagaagcaucugguccacu

SEQ ID NO: 350965 - RNA, 22 nt, Human
uuuaauuugaaaugaguaaccc

SEQ ID NO: 350966 - RNA, 22 nt, Human
uugcaauagccuuauuuccaaa

SEQ ID NO: 350967 - RNA, 22 nt, Human
uaaugcacagaauugacauggg

SEQ ID NO: 350968 - RNA, 22 nt, Human
gcugucugacuccaaguuggag

SEQ ID NO: 350969 - RNA, 22 nt, Human
caagauggaguccgggaaugug

SEQ ID NO: 350970 - RNA, 22 nt, Human
agcucacaguguccuuccucaa

SEQ ID NO: 350971 - RNA, 22 nt, Human
ucccagggacaccaagcuguuu

SEQ ID NO: 350972 - RNA, 22 nt, Human
auaaaacuuauuagaauugugu

SEQ ID NO: 350973 - RNA, 22 nt, Human
ugaggaugacgauggcaauggc

SEQ ID NO: 350974 - RNA, 22 nt, Human
uugaagaggacuuugcagcugu

SEQ ID NO: 350975 - RNA, 22 nt, Human
gcacaauaauucuuguuuugcu

SEQ ID NO: 350976 - RNA, 22 nt, Human
guguccagggccguguugucuu

SEQ ID NO: 350977 - RNA, 22 nt, Human
ggacaagccugugaguggguuu

SEQ ID NO: 350978 - RNA, 22 nt, Human
gguggagcuguggacaggaagg

SEQ ID NO: 350979 - RNA, 22 nt, Human
uauuucugauugcucaugaggc

SEQ ID NO: 350980 - RNA, 22 nt, Human
gccugagaaggauaggaagcga

SEQ ID NO: 350981 - RNA, 22 nt, Human
cccagcucucgcacuuacuagc

SEQ ID NO: 350982 - RNA, 22 nt, Human
gcuggccucaucacugacuucu

SEQ ID NO: 350983 - RNA, 22 nt, Human
cuggaucaugcauugcuugucc

SEQ ID NO: 350984 - RNA, 22 nt, Human
agggagcugcucugcuuccgug

SEQ ID NO: 350985 - RNA, 22 nt, Human
gcagcagaggcccuacucuuug

SEQ ID NO: 350986 - RNA, 20 nt, Human
agucccuuuggucagguauu

SEQ ID NO: 350987 - RNA, 22 nt, Human
ggugccaggcucccagcucagg

SEQ ID NO: 350988 - RNA, 23 nt, Human
ucacaggggccagcgcucugugg

SEQ ID NO: 350989 - RNA, 22 nt, Human
aggacagagggaccagagccca

SEQ ID NO: 350990 - RNA, 22 nt, Human
uuuuccuauaugcaaagaaugc

SEQ ID NO: 350991 - RNA, 22 nt, Human
uugggacagaaaaggagaagau

SEQ ID NO: 350992 - RNA, 22 nt, Human
caggugggagccacagcguaca

SEQ ID NO: 350993 - RNA, 17 nt, Human
caggcagacauguaagc

SEQ ID NO: 350994 - RNA, 22 nt, Human
uagcacaucuucuuggccugca

SEQ ID NO: 350995 - RNA, 22 nt, Human
aauguuguuuuucugcaugucu

SEQ ID NO: 350996 - RNA, 18 nt, Human
cguuuuuccgggauugca

SEQ ID NO: 350997 - RNA, 22 nt, Human
guggcccaggcuuggcgcuggc

SEQ ID NO: 350998 - RNA, 22 nt, Human
ggccuggcucuugcccagccug

SEQ ID NO: 350999 - RNA, 22 nt, Human
gcaguaggagaagaggaugcuu

SEQ ID NO: 351000 - RNA, 18 nt, Human
gggaucaggcugccuagg

SEQ ID NO: 351001 - RNA, 22 nt, Human
ugcucuguaaggucagaaaagg

SEQ ID NO: 351002 - RNA, 22 nt, Human
gucaacuugcaagaugcugggc

SEQ ID NO: 351003 - RNA, 23 nt, Human
uggagaugccccacucccugucu

SEQ ID NO: 351004 - RNA, 22 nt, Human
aagacugugucuauggcuacuc

SEQ ID NO: 351005 - RNA, 22 nt, Human
caagaugggcaccccagcaccu

SEQ ID NO: 351006 - RNA, 22 nt, Human
gcagcugaagcugcaguuccag

SEQ ID NO: 351007 - RNA, 22 nt, Human
aggugaguuacaggaggagguc

SEQ ID NO: 351008 - RNA, 22 nt, Human
ucagaggaauuugcuuuucaug

SEQ ID NO: 351009 - RNA, 22 nt, Human
cuaucuuucgauucuagcuuaa

SEQ ID NO: 351010 - RNA, 22 nt, Human
gccuguuggguaacagaguuca

SEQ ID NO: 351011 - RNA, 22 nt, Human
acaugcuuucuagguccuucug

SEQ ID NO: 351012 - RNA, 22 nt, Human
uccaggcauaagccuugagugu

SEQ ID NO: 351013 - RNA, 22 nt, Human
ccucagaguaggucucagcugu

SEQ ID NO: 351014 - RNA, 22 nt, Human
guguccuuuuaugugacugguu

SEQ ID NO: 351015 - RNA, 22 nt, Human
auguagcaucuauccugauaaa

SEQ ID NO: 351016 - RNA, 22 nt, Human
gggacaggccccucgcuagcuu

SEQ ID NO: 351017 - RNA, 22 nt, Human
uuuuauguuccucuuuaugcga

SEQ ID NO: 351018 - RNA, 22 nt, Human
augcacccagugucuggacuau

SEQ ID NO: 351019 - RNA, 22 nt, Human
ccugagcugaacuaagcaguuu

SEQ ID NO: 351020 - RNA, 20 nt, Human
ucccaaggaugccugggugu

SEQ ID NO: 351021 - RNA, 22 nt, Human
cagaugaggcaaccucauugcu

SEQ ID NO: 351022 - RNA, 23 nt, Human
ggcagagagcauggcuggggccc

SEQ ID NO: 351023 - RNA, 22 nt, Human
caguaaaugcagauauagauac

SEQ ID NO: 351024 - RNA, 22 nt, Human
ccaggccauucccagaguugcu

SEQ ID NO: 351025 - RNA, 22 nt, Human
uggcugagaaaaaagagcuaua

SEQ ID NO: 351026 - RNA, 22 nt, Human
ccauggcucuuaccuuguuaua

SEQ ID NO: 351027 - RNA, 22 nt, Human
cagccugcuagggcaaugccuu

SEQ ID NO: 351028 - RNA, 22 nt, Human
aacuuuguguguuuaauauggc

SEQ ID NO: 351029 - RNA, 22 nt, Human
gcucagaaaagugaggcucagu

SEQ ID NO: 351030 - RNA, 22 nt, Human
gaggccacagcuaucagggaca

SEQ ID NO: 351031 - RNA, 23 nt, Human
ggcucugugcugggccugcagga

SEQ ID NO: 351032 - RNA, 22 nt, Human
uucucugagauagacuaagugg

SEQ ID NO: 351033 - RNA, 18 nt, Human
uccucucuuuccccaggg

SEQ ID NO: 351034 - RNA, 22 nt, Human
aaguuugagaagcuuauagaua

SEQ ID NO: 351035 - RNA, 22 nt, Human
cagagcuggagaaguggauuua

SEQ ID NO: 351036 - RNA, 20 nt, Human
ucucuucuggggagauaaaa

SEQ ID NO: 351037 - RNA, 22 nt, Human
uaagaacuucggacauguuauc

SEQ ID NO: 351038 - RNA, 22 nt, Human
cuggccagacuacacaugugug

SEQ ID NO: 351039 - RNA, 22 nt, Human
uacauuccacuagugacuggcg

SEQ ID NO: 351040 - RNA, 18 nt, Human
ugaacagaugaguugaag

SEQ ID NO: 351041 - RNA, 22 nt, Human
aagccagauuucacucuuaauu

SEQ ID NO: 351042 - RNA, 22 nt, Human
uggaggaugagugugggcucug

SEQ ID NO: 351043 - RNA, 22 nt, Human
ggcgugggaaguggggcuucug

SEQ ID NO: 351044 - RNA, 22 nt, Human
gggcugcugccaaucacagccu

SEQ ID NO: 351045 - RNA, 22 nt, Human
guaacauaguuugugcuucauc

SEQ ID NO: 351046 - RNA, 22 nt, Human
cugccucuugacagaucguggc

SEQ ID NO: 351047 - RNA, 22 nt, Human
gggaauuauagcugucacaggc

SEQ ID NO: 351048 - RNA, 22 nt, Human
gccccagcguggcuguguuagg

SEQ ID NO: 351049 - RNA, 22 nt, Human
ggauccuuaacuaucacaguga

SEQ ID NO: 351050 - RNA, 22 nt, Human
aucuacccacugaacacaauau

SEQ ID NO: 351051 - RNA, 22 nt, Human
ucaguuuuuaagaguuaugcga

SEQ ID NO: 351052 - RNA, 22 nt, Human
auuguaaguagaaauguuaugg

SEQ ID NO: 351053 - RNA, 22 nt, Human
gccugccuuuguaugacccuga

SEQ ID NO: 351054 - RNA, 22 nt, Human
cagcccugagagaaccaucuau

SEQ ID NO: 351055 - RNA, 22 nt, Human
cugccucugguuuuggucccug

SEQ ID NO: 351056 - RNA, 22 nt, Human
gcaguggggcgcugggaguugg

SEQ ID NO: 351057 - RNA, 22 nt, Human
aguaaacaguaucuuuaguguc

SEQ ID NO: 351058 - RNA, 22 nt, Human
cucagagucugcauuucuguca

SEQ ID NO: 351059 - RNA, 22 nt, Human
ugccuugcgggcguuucuguug

SEQ ID NO: 351060 - RNA, 22 nt, Human
agugcauuauauguuucaaugg

SEQ ID NO: 351061 - RNA, 22 nt, Human
auaaggcauauagucacuuuuu

SEQ ID NO: 351062 - RNA, 23 nt, Human
cccagcgcugagcccugcaggca

SEQ ID NO: 351063 - RNA, 22 nt, Human
cuuaacagauacaucugugguu

SEQ ID NO: 351064 - RNA, 21 nt, Human
gcugucucuggcuccugggaa

SEQ ID NO: 351065 - RNA, 22 nt, Human
auuaggcaauucugggcaucuc

SEQ ID NO: 351066 - RNA, 20 nt, Human
ugcagggcucugcuucucuc

SEQ ID NO: 351067 - RNA, 22 nt, Human
gaagcagcaaaucugcaguauc

SEQ ID NO: 351068 - RNA, 22 nt, Human
uuuucauuguuccucgagcauu

SEQ ID NO: 351069 - RNA, 22 nt, Human
auccuuagaagggagugaggac

SEQ ID NO: 351070 - RNA, 22 nt, Human
aggaagccuggggcugcccucg

SEQ ID NO: 351071 - RNA, 22 nt, Human
aucagcaaaaaugccuucagaa

SEQ ID NO: 351072 - RNA, 22 nt, Human
gggcuguggagccgcgagggcu

SEQ ID NO: 351073 - RNA, 23 nt, Human
ugaagugaaauuucacaagggac

SEQ ID NO: 351074 - RNA, 22 nt, Human
gcugucugucuucacaucucgc

SEQ ID NO: 351075 - RNA, 16 nt, Human
uagggcugggaaggag

SEQ ID NO: 351076 - RNA, 22 nt, Human
ugcuggcccaguauggacugca

SEQ ID NO: 351077 - RNA, 20 nt, Human
cccugagaccagagagcagc

SEQ ID NO: 351078 - RNA, 22 nt, Human
ggcucccugccuguccucaguc

SEQ ID NO: 351079 - RNA, 22 nt, Human
gagggcugauaacaggaauaca

SEQ ID NO: 351080 - RNA, 22 nt, Human
cccuggagguggagguugcagg

SEQ ID NO: 351081 - RNA, 22 nt, Human
caaugaaauugagauccagaga

SEQ ID NO: 351082 - RNA, 22 nt, Human
cugcagcuguagaggacagugg

SEQ ID NO: 351083 - RNA, 22 nt, Human
cuccagggagcugcgggagcca

SEQ ID NO: 351084 - RNA, 22 nt, Human
gucccuggucuaccguggcuuc

SEQ ID NO: 351085 - RNA, 22 nt, Human
agagucugaggcagcugcagcc

SEQ ID NO: 351086 - RNA, 22 nt, Human
cucugugccucaguuuucuucu

SEQ ID NO: 351087 - RNA, 22 nt, Human
ucacacgugagguucuauccug

SEQ ID NO: 351088 - RNA, 22 nt, Human
uagugcuuuaaguuuacagaga

SEQ ID NO: 351089 - RNA, 22 nt, Human
gauuuagagcaggaaugcaugg

SEQ ID NO: 351090 - RNA, 20 nt, Human
uccuuuggccuuagagcugu

SEQ ID NO: 351091 - RNA, 22 nt, Human
aggcacugcuucuaaguaggaa

SEQ ID NO: 351092 - RNA, 22 nt, Human
cugcagaggguuugagcauccu

SEQ ID NO: 351093 - RNA, 22 nt, Human
ucugccugcuaacuccugcacc

SEQ ID NO: 351094 - RNA, 22 nt, Human
uucucacuauguauguagauug

SEQ ID NO: 351095 - RNA, 20 nt, Human
ucccaggcuccacccuagac

SEQ ID NO: 351096 - RNA, 22 nt, Human
gaaauauacauugcaggaagag

SEQ ID NO: 351097 - RNA, 22 nt, Human
ggugucccaggccagcugugug

SEQ ID NO: 351098 - RNA, 22 nt, Human
cuccccagguucaggagguggg

SEQ ID NO: 351099 - RNA, 20 nt, Human
agacaaaaugacuucaugca

SEQ ID NO: 351100 - RNA, 20 nt, Human
gugccuggagaagaggcugu

SEQ ID NO: 351101 - RNA, 22 nt, Human
cucagcagagaccagggaggaa

SEQ ID NO: 351102 - RNA, 18 nt, Human
ccgggcuuuggugacaca

SEQ ID NO: 351103 - RNA, 22 nt, Human
uucacagucacccuucuccaug

SEQ ID NO: 351104 - RNA, 23 nt, Human
agucagagagugugagacaacug

SEQ ID NO: 351105 - RNA, 22 nt, Human
gaagcccuauccucuccuggga

SEQ ID NO: 351106 - RNA, 22 nt, Human
ccauguggugggaaggagaaug

SEQ ID NO: 351107 - RNA, 19 nt, Human
augucuguugaauuucaua

SEQ ID NO: 351108 - RNA, 22 nt, Human
cagggcucugccuugagggaug

SEQ ID NO: 351109 - RNA, 22 nt, Human
ccacccagaccagggaucuggg

SEQ ID NO: 351110 - RNA, 22 nt, Human
aagcacaaugaacaucuuagau

SEQ ID NO: 351111 - RNA, 22 nt, Human
uacuuucuguccuucuguuaaa

SEQ ID NO: 351112 - RNA, 22 nt, Human
ccucacuggccagccaggggug

SEQ ID NO: 351113 - RNA, 22 nt, Human
gccaggugcauggcugagucuc

SEQ ID NO: 351114 - RNA, 22 nt, Human
uuuucacacaaggugauaaguu

SEQ ID NO: 351115 - RNA, 20 nt, Human
ugugcccaauguccagguuc

SEQ ID NO: 351116 - RNA, 22 nt, Human
uuacagaaagguugugggauag

SEQ ID NO: 351117 - RNA, 21 nt, Human
cuacagaagcucuccuaucca

SEQ ID NO: 351118 - RNA, 22 nt, Human
uggagccaggagccugggaguc

SEQ ID NO: 351119 - RNA, 22 nt, Human
acaauauuguacccagaaguuu

SEQ ID NO: 351120 - RNA, 22 nt, Human
auuucucacucacaguccaugu

SEQ ID NO: 351121 - RNA, 22 nt, Human
agcugccacaugcccaagggca

SEQ ID NO: 351122 - RNA, 22 nt, Human
uccaguucuaggucacucucug

SEQ ID NO: 351123 - RNA, 22 nt, Human
acagaaauugggcaaauggaag

SEQ ID NO: 351124 - RNA, 22 nt, Human
cauguacaaaaggcaaaugccu

SEQ ID NO: 351125 - RNA, 22 nt, Human
gggagcugaauggcaauggaga

SEQ ID NO: 351126 - RNA, 22 nt, Human
ucuggccauggcaagccgagug

SEQ ID NO: 351127 - RNA, 22 nt, Human
ucucccacagccgugcuucaag

SEQ ID NO: 351128 - RNA, 22 nt, Human
aauuuguuaaaagugagugaca

SEQ ID NO: 351129 - RNA, 22 nt, Human
agugugaguaauucagggaggg

SEQ ID NO: 351130 - RNA, 22 nt, Human
gauaauaagcacagcaggaugu

SEQ ID NO: 351131 - RNA, 22 nt, Human
ucuuccugaaacccuguuccag

SEQ ID NO: 351132 - RNA, 22 nt, Human
gcucagagauggggaaugaaaa

SEQ ID NO: 351133 - RNA, 22 nt, Human
uggaaggcaugggaacuguucu

SEQ ID NO: 351134 - RNA, 22 nt, Human
ggagccagagggaugcaguuga

SEQ ID NO: 351135 - RNA, 22 nt, Human
gaagccaguacugugcucugca

SEQ ID NO: 351136 - RNA, 22 nt, Human
ucacacacauaaucuaagauua

SEQ ID NO: 351137 - RNA, 22 nt, Human
aaugagcugcugcuguuccacc

SEQ ID NO: 351138 - RNA, 22 nt, Human
gggacagaaggaagugagcaca

SEQ ID NO: 351139 - RNA, 22 nt, Human
uccucaggaucuaggagugcuu

SEQ ID NO: 351140 - RNA, 22 nt, Human
ccuguggcugccacuuggguga

SEQ ID NO: 351141 - RNA, 22 nt, Human
uccuugaaaagaaugucuccau

SEQ ID NO: 351142 - RNA, 22 nt, Human
uccugcaggccuguucccagua

SEQ ID NO: 351143 - RNA, 22 nt, Human
aggggcaguuccaaguuuugug

SEQ ID NO: 351144 - RNA, 22 nt, Human
augaggcacaucacagccaaug

SEQ ID NO: 351145 - RNA, 22 nt, Human
agaaguuaccacauacuucucu

SEQ ID NO: 351146 - RNA, 22 nt, Human
accagagcuuacaugcuagaaa

SEQ ID NO: 351147 - RNA, 22 nt, Human
gccucugcucucagguagccuc

SEQ ID NO: 351148 - RNA, 22 nt, Human
ugagagucucagaccuccuggu

SEQ ID NO: 351149 - RNA, 22 nt, Human
ucacuuaaaaauucuaguuaug

SEQ ID NO: 351150 - RNA, 22 nt, Human
gauuucuugaccccugucucag

SEQ ID NO: 351151 - RNA, 23 nt, Human
ucugagagaacaaugccuccuau

SEQ ID NO: 351152 - RNA, 22 nt, Human
cagugcaguuucccagaugcug

SEQ ID NO: 351153 - RNA, 22 nt, Human
uaugcacaguuacaagaauauc

SEQ ID NO: 351154 - RNA, 22 nt, Human
gucaggauuaaugggaguaugc

SEQ ID NO: 351155 - RNA, 22 nt, Human
uaacagaagagcaggcagcccu

SEQ ID NO: 351156 - RNA, 22 nt, Human
ccugcucugguuuagucagucu

SEQ ID NO: 351157 - RNA, 22 nt, Human
ccaaaggccaggcacugagguu

SEQ ID NO: 351158 - RNA, 22 nt, Human
auaaggcacacauagauagggu

SEQ ID NO: 351159 - RNA, 22 nt, Human
auguauccuuauacacauuuau

SEQ ID NO: 351160 - RNA, 22 nt, Human
uauagagguggaaacugagguu

SEQ ID NO: 351161 - RNA, 22 nt, Human
guggcagagguuccucagugug

SEQ ID NO: 351162 - RNA, 22 nt, Human
cuggguggcgucuggggccagu

SEQ ID NO: 351163 - RNA, 22 nt, Human
uacaaaguagaaauucaguaaa

SEQ ID NO: 351164 - RNA, 22 nt, Human
gggucaggcucagcagggcagc

SEQ ID NO: 351165 - RNA, 22 nt, Human
ggauggcauguugggcucuguu

SEQ ID NO: 351166 - RNA, 22 nt, Human
cuggagcauccaugcccagggu

SEQ ID NO: 351167 - RNA, 22 nt, Human
ucuagaaaaaaacugcugugga

SEQ ID NO: 351168 - RNA, 22 nt, Human
uuucacaucagagguagauuag

SEQ ID NO: 351169 - RNA, 22 nt, Human
uggcuaggcuccaagagcugga

SEQ ID NO: 351170 - RNA, 22 nt, Human
ccagucacucugugagagcuac

SEQ ID NO: 351171 - RNA, 22 nt, Human
uaaaauguguuucuguaugguu

SEQ ID NO: 351172 - RNA, 22 nt, Human
gcagccagaagacucagaacaa

SEQ ID NO: 351173 - RNA, 22 nt, Human
agccuccacagaugcaaagggc

SEQ ID NO: 351174 - RNA, 22 nt, Human
ggcugccugaacuuuggggaaa

SEQ ID NO: 351175 - RNA, 22 nt, Human
ucugucacucccugaugaugaa

SEQ ID NO: 351176 - RNA, 23 nt, Human
ucccagggaaggugagcgaggcu

SEQ ID NO: 351177 - RNA, 22 nt, Human
cagugagggcauucagugcugg

SEQ ID NO: 351178 - RNA, 22 nt, Human
ugcccaggguuucuaagagcag

SEQ ID NO: 351179 - RNA, 22 nt, Human
ggggcugggauuugaacccagg

SEQ ID NO: 351180 - RNA, 22 nt, Human
cacucaggcugugucaggagga

SEQ ID NO: 351181 - RNA, 22 nt, Human
uauacagaaagaauucaagucu

SEQ ID NO: 351182 - RNA, 22 nt, Human
uuuugcuugagugcacaaaaug

SEQ ID NO: 351183 - RNA, 19 nt, Human
agccacagaacuugcagga

SEQ ID NO: 351184 - RNA, 22 nt, Human
uggcagcugucagaaugcaaau

SEQ ID NO: 351185 - RNA, 22 nt, Human
agccuggagcuugaguuaugag

SEQ ID NO: 351186 - RNA, 22 nt, Human
aggaaaaauaaggcagcagggc

SEQ ID NO: 351187 - RNA, 22 nt, Human
cuggagccgcauggagcaggga

SEQ ID NO: 351188 - RNA, 22 nt, Human
ucagagcugcccaugcaagggg

SEQ ID NO: 351189 - RNA, 22 nt, Human
gccaccagcagaaaaggggcca

SEQ ID NO: 351190 - RNA, 22 nt, Human
auugucuuuccacugagaaguu

SEQ ID NO: 351191 - RNA, 22 nt, Human
uuacaugguuguuggaaaugcu

SEQ ID NO: 351192 - RNA, 22 nt, Human
aaggcagcuucaccacagcauu

SEQ ID NO: 351193 - RNA, 22 nt, Human
cacucugcgcugggcgccagcg

SEQ ID NO: 351194 - RNA, 22 nt, Human
aaaagcucuuucugcuguagau

SEQ ID NO: 351195 - RNA, 18 nt, Human
gacccagcagaugggcuu

SEQ ID NO: 351196 - RNA, 22 nt, Human
augguuuacugaucuuuuuggu

SEQ ID NO: 351197 - RNA, 22 nt, Human
gaggaagaaagcauaggugggg

SEQ ID NO: 351198 - RNA, 22 nt, Human
cugaugcuauaagccacagugg

SEQ ID NO: 351199 - RNA, 22 nt, Human
uuagucuucuuccuuauauguu

SEQ ID NO: 351200 - RNA, 22 nt, Human
cugggcuguucugccccugggu

SEQ ID NO: 351201 - RNA, 22 nt, Human
aggaggaauacaauccagcagc

SEQ ID NO: 351202 - RNA, 22 nt, Human
aaagaggauggaguagucagcu

SEQ ID NO: 351203 - RNA, 22 nt, Human
acagccugcagccccaggucgc

SEQ ID NO: 351204 - RNA, 22 nt, Human
uggcugagcugcagcguggcuu

SEQ ID NO: 351205 - RNA, 22 nt, Human
agauucuacucuagauccaugg

SEQ ID NO: 351206 - RNA, 22 nt, Human
agcuuuauagaaaggaucagug

SEQ ID NO: 351207 - RNA, 22 nt, Human
gagcuuugcuggaagccugggg

SEQ ID NO: 351208 - RNA, 22 nt, Human
uucacauugugcagauuauggu

SEQ ID NO: 351209 - RNA, 22 nt, Human
uaagaaauuuaguuauagaaug

SEQ ID NO: 351210 - RNA, 22 nt, Human
uuauuuuguagcucugaucuuu

SEQ ID NO: 351211 - RNA, 22 nt, Human
ggagcugcucagagccaguccc

SEQ ID NO: 351212 - RNA, 19 nt, Human
aaggcagaaguuggauaug

SEQ ID NO: 351213 - RNA, 22 nt, Human
aagggcugagcacagugagcca

SEQ ID NO: 351214 - RNA, 22 nt, Human
guguuccauguuugagguaguu

SEQ ID NO: 351215 - RNA, 22 nt, Human
aggcagcaugcucugcuucuac

SEQ ID NO: 351216 - RNA, 22 nt, Human
uaaaugugcacuuuacuuuuca

SEQ ID NO: 351217 - RNA, 22 nt, Human
ucauuucuguugugcaucacug

SEQ ID NO: 351218 - RNA, 22 nt, Human
ggagguggcagggaacauaauu

SEQ ID NO: 351219 - RNA, 22 nt, Human
aacuagaacgucuaguugcugg

SEQ ID NO: 351220 - RNA, 22 nt, Human
ugaccaaaggugguuuauuugg

SEQ ID NO: 351221 - RNA, 22 nt, Human
ucugaacuccagcccugcucuc

SEQ ID NO: 351222 - RNA, 22 nt, Human
gacagguggggaaacuaaggua

SEQ ID NO: 351223 - RNA, 16 nt, Human
ccacagggcaaggggc

SEQ ID NO: 351224 - RNA, 22 nt, Human
uauaacacucagaaagaaucau

SEQ ID NO: 351225 - RNA, 22 nt, Human
cagcugccuguauuguccucau

SEQ ID NO: 351226 - RNA, 22 nt, Human
cagcugagaccagaaugcaggu

SEQ ID NO: 351227 - RNA, 22 nt, Human
agcccaaggcuucccugcuggc

SEQ ID NO: 351228 - RNA, 22 nt, Human
cuccucugucuggcccugagcc

SEQ ID NO: 351229 - RNA, 22 nt, Human
uucuggaggccccuuccuucuc

SEQ ID NO: 351230 - RNA, 22 nt, Human
agucaauuaucucuaggucauc

SEQ ID NO: 351231 - RNA, 22 nt, Human
ugauuuccuggcuuuggaguuc

SEQ ID NO: 351232 - RNA, 22 nt, Human
acagaguaucuaucaggaguau

SEQ ID NO: 351233 - RNA, 21 nt, Human
gauuucacuuaccuucauuua

SEQ ID NO: 351234 - RNA, 23 nt, Human
uugcauagacauccucauagauu

SEQ ID NO: 351235 - RNA, 22 nt, Human
uccuuuccagccucaccucagc

SEQ ID NO: 351236 - RNA, 22 nt, Human
aggucaccauggcaugcuccac

SEQ ID NO: 351237 - RNA, 22 nt, Human
uuggaauucaaguuguagcuua

SEQ ID NO: 351238 - RNA, 23 nt, Human
cccaggaguuucacugcaaaggu

SEQ ID NO: 351239 - RNA, 22 nt, Human
uugaagcaggaaaauuucuauu

SEQ ID NO: 351240 - RNA, 22 nt, Human
uuaagacauucagauauuucua

SEQ ID NO: 351241 - RNA, 22 nt, Human
uagagcuagcuucaaaaugcga

SEQ ID NO: 351242 - RNA, 22 nt, Human
agcagcaucucuuauugcagug

SEQ ID NO: 351243 - RNA, 22 nt, Human
aguuuuuccugauuuuacagaa

SEQ ID NO: 351244 - RNA, 22 nt, Human
agucugucugucacuucugcag

SEQ ID NO: 351245 - RNA, 22 nt, Human
ggaguaggaguagaacucauca

SEQ ID NO: 351246 - RNA, 22 nt, Human
aagucagcacuccaggaagcca

SEQ ID NO: 351247 - RNA, 22 nt, Human
agccacaggaaacagagacagc

SEQ ID NO: 351248 - RNA, 22 nt, Human
aggccugaggaccuucuggagg

SEQ ID NO: 351249 - RNA, 23 nt, Human
cagggaggagauacuguguaucu

SEQ ID NO: 351250 - RNA, 22 nt, Human
agcuggccuguuagagcugagu

SEQ ID NO: 351251 - RNA, 22 nt, Human
aacaguaucuuuuaucagaaau

SEQ ID NO: 351252 - RNA, 22 nt, Human
cccaaggccucuccuuggcuug

SEQ ID NO: 351253 - RNA, 22 nt, Human
gaaggcacugaacuccuucugg

SEQ ID NO: 351254 - RNA, 22 nt, Human
uguuuauugagugccuacuaua

SEQ ID NO: 351255 - RNA, 22 nt, Human
cagccaggcccccgagucguug

SEQ ID NO: 351256 - RNA, 22 nt, Human
gaagccagcaguggagaaagga

SEQ ID NO: 351257 - RNA, 22 nt, Human
uaaaauagcaugugcagugaaa

SEQ ID NO: 351258 - RNA, 22 nt, Human
agggagaagguuuagcugugag

SEQ ID NO: 351259 - RNA, 22 nt, Human
uauggcuuuaaacaacuuaggu

SEQ ID NO: 351260 - RNA, 22 nt, Human
uucucuuagcuguaaagucaau

SEQ ID NO: 351261 - RNA, 22 nt, Human
auccuugaaugacucugcccuc

SEQ ID NO: 351262 - RNA, 22 nt, Human
cacagcagaaaguguaggagga

SEQ ID NO: 351263 - RNA, 22 nt, Human
gccuucugcgcucgugucuccg

SEQ ID NO: 351264 - RNA, 22 nt, Human
auagugggaauuacgauauacu

SEQ ID NO: 351265 - RNA, 22 nt, Human
gaagggugcauggagggaaguc

SEQ ID NO: 351266 - RNA, 22 nt, Human
agaguccagaaaacagugugcu

SEQ ID NO: 351267 - RNA, 19 nt, Human
ccucccacggauuccuucc

SEQ ID NO: 351268 - RNA, 22 nt, Human
cacagaggacuguagcggggag

SEQ ID NO: 351269 - RNA, 22 nt, Human
gucacaggccuggaugaggggc

SEQ ID NO: 351270 - RNA, 22 nt, Human
uagggauguggugagaacugag

SEQ ID NO: 351271 - RNA, 22 nt, Human
uccagcagggaauuaguagucu

SEQ ID NO: 351272 - RNA, 22 nt, Human
agagaacacgugcaucugcaau

SEQ ID NO: 351273 - RNA, 18 nt, Human
ucagagagcagcuuuauu

SEQ ID NO: 351274 - RNA, 22 nt, Human
gcccaggaagccaccgggaagu

SEQ ID NO: 351275 - RNA, 22 nt, Human
caucagaauuacuuggggagcu

SEQ ID NO: 351276 - RNA, 22 nt, Human
gcucugcuggaaguucucugga

SEQ ID NO: 351277 - RNA, 22 nt, Human
ugacagcugagccccaggcaag

SEQ ID NO: 351278 - RNA, 22 nt, Human
ugcuuggcuuucugagcuucug

SEQ ID NO: 351279 - RNA, 22 nt, Human
aagcagccaccucaucuccacu

SEQ ID NO: 351280 - RNA, 22 nt, Human
aggcccagacucagcggggcgg

SEQ ID NO: 351281 - RNA, 22 nt, Human
caugucuggguauaugcauaug

SEQ ID NO: 351282 - RNA, 22 nt, Human
uugggcugaaguagagggcaga

SEQ ID NO: 351283 - RNA, 22 nt, Human
gcugccucaggcaccuccuggc

SEQ ID NO: 351284 - RNA, 22 nt, Human
cagucucuaaaucaaucugaau

SEQ ID NO: 351285 - RNA, 22 nt, Human
uccuugaaugaagagaggugac

SEQ ID NO: 351286 - RNA, 22 nt, Human
ggcugccugaggcagugagaga

SEQ ID NO: 351287 - RNA, 22 nt, Human
cuccucuggcuuccuggaggca

SEQ ID NO: 351288 - RNA, 22 nt, Human
ugagaagcugcuugugcuguau

SEQ ID NO: 351289 - RNA, 22 nt, Human
gcagcuucaguaggugaagaca

SEQ ID NO: 351290 - RNA, 22 nt, Human
auugcuguaaauuaucuuauua

SEQ ID NO: 351291 - RNA, 22 nt, Human
uguuuucuauuaccugagauug

SEQ ID NO: 351292 - RNA, 22 nt, Human
ugcugggcuaggguggagcucu

SEQ ID NO: 351293 - RNA, 22 nt, Human
agggacuggcucucugagcagg

SEQ ID NO: 351294 - RNA, 20 nt, Human
uguggcaggaugagggcgga

SEQ ID NO: 351295 - RNA, 22 nt, Human
gugagcaggauaggggcucccu

SEQ ID NO: 351296 - RNA, 20 nt, Human
aaagucuguuuaucucugga

SEQ ID NO: 351297 - RNA, 22 nt, Human
acuuucucaaaucagacuuuaa

SEQ ID NO: 351298 - RNA, 22 nt, Human
ucgugucagaucagagguuccu

SEQ ID NO: 351299 - RNA, 22 nt, Human
guccagggaaauagcgacaggg

SEQ ID NO: 351300 - RNA, 22 nt, Human
ugcagggcaguuuguuucggca

SEQ ID NO: 351301 - RNA, 22 nt, Human
ugagacaguuuuucuauuucca

SEQ ID NO: 351302 - RNA, 22 nt, Human
ucacugcaaucucugccuucca

SEQ ID NO: 351303 - RNA, 22 nt, Human
cugggcuacguguugacagcau

SEQ ID NO: 351304 - RNA, 22 nt, Human
uuucuucacaggguauugggug

SEQ ID NO: 351305 - RNA, 22 nt, Human
gaggagcacaugaggcugaggg

SEQ ID NO: 351306 - RNA, 22 nt, Human
ccaguguucauaauuuuacacu

SEQ ID NO: 351307 - RNA, 22 nt, Human
ggcagcugggucacaccgaucu

SEQ ID NO: 351308 - RNA, 22 nt, Human
uggcugcagaucaagggcaggc

SEQ ID NO: 351309 - RNA, 22 nt, Human
cccaggaguuugaguucagcau

SEQ ID NO: 351310 - RNA, 22 nt, Human
cauuuagaaacuguuuuuaaca

SEQ ID NO: 351311 - RNA, 22 nt, Human
acuuugaaggggaacauuuuaa

SEQ ID NO: 351312 - RNA, 22 nt, Human
gcugccuuuugcuccucccacc

SEQ ID NO: 351313 - RNA, 22 nt, Human
auauuucuccaaauguuuucaa

SEQ ID NO: 351314 - RNA, 22 nt, Human
uggcuagcccuuguggggagag

SEQ ID NO: 351315 - RNA, 22 nt, Human
ugcagaggagucagccugggca

SEQ ID NO: 351316 - RNA, 22 nt, Human
gagcacagggaauagacagaua

SEQ ID NO: 351317 - RNA, 22 nt, Human
aggcugccuguuccaaucuccu

SEQ ID NO: 351318 - RNA, 22 nt, Human
aucaggaugacuauaaggcugc

SEQ ID NO: 351319 - RNA, 18 nt, Human
gcuccuggaccaggucac

SEQ ID NO: 351320 - RNA, 22 nt, Human
gagagcugcaagguagggcggg

SEQ ID NO: 351321 - RNA, 22 nt, Human
auuucucaguuccuacuguuua

SEQ ID NO: 351322 - RNA, 22 nt, Human
ggugaccucaccuggucccacc

SEQ ID NO: 351323 - RNA, 22 nt, Human
cccaggaggcagaaguugcagu

SEQ ID NO: 351324 - RNA, 22 nt, Human
ggcuccucucuggccgcucccg

SEQ ID NO: 351325 - RNA, 22 nt, Human
caguccugugucccuugguggg

SEQ ID NO: 351326 - RNA, 22 nt, Human
ucccuggguccugcuugcucuc

SEQ ID NO: 351327 - RNA, 19 nt, Human
cagaguccuugaccagucc

SEQ ID NO: 351328 - RNA, 22 nt, Human
agugcuuugugcucucacugca

SEQ ID NO: 351329 - RNA, 22 nt, Human
uuuuuaguagagguggguuuca

SEQ ID NO: 351330 - RNA, 22 nt, Human
aaggaagagucuagaacaggca

SEQ ID NO: 351331 - RNA, 18 nt, Human
ggacaucaucaggugcuu

SEQ ID NO: 351332 - RNA, 22 nt, Human
cuguccuugcuggccagguaug

SEQ ID NO: 351333 - RNA, 22 nt, Human
aauggcuucugaagcacacuuu

SEQ ID NO: 351334 - RNA, 22 nt, Human
aaggccaugcacauccuaggca

SEQ ID NO: 351335 - RNA, 22 nt, Human
gcuggcaucacuggcuucggug

SEQ ID NO: 351336 - RNA, 17 nt, Human
acagagcacaucaagau

SEQ ID NO: 351337 - RNA, 22 nt, Human
aggaccuguguuuuccuugaau

SEQ ID NO: 351338 - RNA, 22 nt, Human
gaguccaguuagugaggcuggg

SEQ ID NO: 351339 - RNA, 19 nt, Human
ugcccaggccagguugggc

SEQ ID NO: 351340 - RNA, 22 nt, Human
uuaaggauguugugauuuauua

SEQ ID NO: 351341 - RNA, 22 nt, Human
aggaugggccugggauaugcuu

SEQ ID NO: 351342 - RNA, 22 nt, Human
ggguccagacacuccagaggaa

SEQ ID NO: 351343 - RNA, 22 nt, Human
gugcugaguagaaugaaugccu

SEQ ID NO: 351344 - RNA, 22 nt, Human
uggcagaggaggcucagauuga

SEQ ID NO: 351345 - RNA, 19 nt, Human
cuggugcuugagugaguca

SEQ ID NO: 351346 - RNA, 17 nt, Human
uggcaagaauggaaaug

SEQ ID NO: 351347 - RNA, 22 nt, Human
uuacagaaucuacucgugguga

SEQ ID NO: 351348 - RNA, 22 nt, Human
gggcagcucucacagcagccaa

SEQ ID NO: 351349 - RNA, 22 nt, Human
aagcagccacuggccaguuaua

SEQ ID NO: 351350 - RNA, 22 nt, Human
ugggcaagucacuucugucuuu

SEQ ID NO: 351351 - RNA, 22 nt, Human
ugcauuaugcuacccagaagcu

SEQ ID NO: 351352 - RNA, 22 nt, Human
ucacacacauuugcugucugau

SEQ ID NO: 351353 - RNA, 22 nt, Human
gggcugagugaccucaggccaa

SEQ ID NO: 351354 - RNA, 22 nt, Human
gcccaggaugguguguaguggu

SEQ ID NO: 351355 - RNA, 22 nt, Human
agcagcugccagagagaguucc

SEQ ID NO: 351356 - RNA, 22 nt, Human
uucacaaaacacuauuuucugg

SEQ ID NO: 351357 - RNA, 22 nt, Human
ggguccagaguugaagagguua

SEQ ID NO: 351358 - RNA, 22 nt, Human
auuuccaaucucugcauauggg

SEQ ID NO: 351359 - RNA, 22 nt, Human
ccaggaaauggcuugcuucuuu

SEQ ID NO: 351360 - RNA, 22 nt, Human
gccuucaggaggguuccagaca

SEQ ID NO: 351361 - RNA, 20 nt, Human
cagagaccugucuucacaga

SEQ ID NO: 351362 - RNA, 22 nt, Human
cguagguggcucagcaccuggg

SEQ ID NO: 351363 - RNA, 20 nt, Human
uuuuuccuucucuacaggca

SEQ ID NO: 351364 - RNA, 22 nt, Human
uuauuuaaugugaucugaagag

SEQ ID NO: 351365 - RNA, 22 nt, Human
augucuaaaagauaaaguuuaa

SEQ ID NO: 351366 - RNA, 22 nt, Human
ugggccuggaguuuguccagag

SEQ ID NO: 351367 - RNA, 22 nt, Human
uguauuuucugaagauaaucaa

SEQ ID NO: 351368 - RNA, 20 nt, Human
acauguacuaaugaauacag

SEQ ID NO: 351369 - RNA, 22 nt, Human
acccuggggguggccagugcca

SEQ ID NO: 351370 - RNA, 22 nt, Human
uuuacauugcauuagguauuau

SEQ ID NO: 351371 - RNA, 18 nt, Human
guuaauuuugaaguucau

SEQ ID NO: 351372 - RNA, 19 nt, Human
caucuggaugauucuccug

SEQ ID NO: 351373 - RNA, 22 nt, Human
agccaggccagcugucuugagu

SEQ ID NO: 351374 - RNA, 22 nt, Human
caggcugaggcaguaggguuug

SEQ ID NO: 351375 - RNA, 22 nt, Human
uuagaaaucugcugccaugcaa

SEQ ID NO: 351376 - RNA, 22 nt, Human
ugcuagaaaucugaaacuagca

SEQ ID NO: 351377 - RNA, 22 nt, Human
gaggcagagaccuucaggaccu

SEQ ID NO: 351378 - RNA, 22 nt, Human
agcagcaacuuauuuuucuuau

SEQ ID NO: 351379 - RNA, 22 nt, Human
gcagugugaccgagcuugcuuc

SEQ ID NO: 351380 - RNA, 21 nt, Human
uaagaacauuaucuucuuccu

SEQ ID NO: 351381 - RNA, 22 nt, Human
agaggcaguauacaauccgagc

SEQ ID NO: 351382 - RNA, 22 nt, Human
ugggccugggcuccuguccucu

SEQ ID NO: 351383 - RNA, 22 nt, Human
agacagagauacuauguuguca

SEQ ID NO: 351384 - RNA, 22 nt, Human
uccuuccugcaggccaaguccu

SEQ ID NO: 351385 - RNA, 22 nt, Human
uuucaucuuccuuggcauaggu

SEQ ID NO: 351386 - RNA, 22 nt, Human
gaccauuuguugaaaagauuau

SEQ ID NO: 351387 - RNA, 22 nt, Human
auucaguuucauggcacagcua

SEQ ID NO: 351388 - RNA, 22 nt, Human
acagagcucccagccaucuccu

SEQ ID NO: 351389 - RNA, 22 nt, Human
uuucacauuuaggcgugaauug

SEQ ID NO: 351390 - RNA, 22 nt, Human
ugagugccugaacauagaguag

SEQ ID NO: 351391 - RNA, 22 nt, Human
uagggcugugucuccaggacca

SEQ ID NO: 351392 - RNA, 22 nt, Human
uacccagcaaucccuagagguu

SEQ ID NO: 351393 - RNA, 22 nt, Human
gugcagugaaaaaagaaugucc

SEQ ID NO: 351394 - RNA, 22 nt, Human
uugaagcagagaaauacuugaa

SEQ ID NO: 351395 - RNA, 22 nt, Human
guccucuguuagaaaugugcuu

SEQ ID NO: 351396 - RNA, 22 nt, Human
ucucagagccuaacuaaccuaa

SEQ ID NO: 351397 - RNA, 22 nt, Human
ucccaggaaggauucggcauuu

SEQ ID NO: 351398 - RNA, 22 nt, Human
caggcuggagugcaguugugca

SEQ ID NO: 351399 - RNA, 22 nt, Human
uauuugcaacauaaaacucuga

SEQ ID NO: 351400 - RNA, 16 nt, Human
ggcaccagugaacaca

SEQ ID NO: 351401 - RNA, 22 nt, Human
cauuguuaccaucuuuuaccua

SEQ ID NO: 351402 - RNA, 22 nt, Human
ccaggggaaacagggagcacuc

SEQ ID NO: 351403 - RNA, 21 nt, Human
cugcuuuacuucagaggaucu

SEQ ID NO: 351404 - RNA, 22 nt, Human
uuccaaaggaauggggagcuau

SEQ ID NO: 351405 - RNA, 22 nt, Human
cuguuuaucccuuuggucagca

SEQ ID NO: 351406 - RNA, 22 nt, Human
gcagggcuauuggaaggagaug

SEQ ID NO: 351407 - RNA, 22 nt, Human
cuacagaaucuaccucaagcca

SEQ ID NO: 351408 - RNA, 22 nt, Human
ugcagggagggcccagcaaucu

SEQ ID NO: 351409 - RNA, 22 nt, Human
auacagaauucacuacaguuuc

SEQ ID NO: 351410 - RNA, 22 nt, Human
cauuuauuggcauguaguaggu

SEQ ID NO: 351411 - RNA, 22 nt, Human
ggacacagauaaucacacagau

SEQ ID NO: 351412 - RNA, 22 nt, Human
cccauuuaucccaagguuacuc

SEQ ID NO: 351413 - RNA, 22 nt, Human
aguuuuauuccaaugugcagca

SEQ ID NO: 351414 - RNA, 22 nt, Human
gccucuggucccucaugcugug

SEQ ID NO: 351415 - RNA, 22 nt, Human
auaugagagaggaaagauuuua

SEQ ID NO: 351416 - RNA, 20 nt, Human
agcaagaguaaggacagcga

SEQ ID NO: 351417 - RNA, 22 nt, Human
uugcugaaaucuaugacauccu

SEQ ID NO: 351418 - RNA, 22 nt, Human
cucaaggacuuauucaugccug

SEQ ID NO: 351419 - RNA, 17 nt, Human
aguguuuccuuaucauu

SEQ ID NO: 351420 - RNA, 22 nt, Human
ugaaugaacuaaaucauaguuc

SEQ ID NO: 351421 - RNA, 19 nt, Human
gccacuccugaugcugccc

SEQ ID NO: 351422 - RNA, 22 nt, Human
cagaagaaaguggggagacaag

SEQ ID NO: 351423 - RNA, 22 nt, Human
agccaggaaccagcuacagucu

SEQ ID NO: 351424 - RNA, 22 nt, Human
cauuuucaugaguuucuguuca

SEQ ID NO: 351425 - RNA, 22 nt, Human
aguggcagagugcacucaggca

SEQ ID NO: 351426 - RNA, 18 nt, Human
uggcagcuagguaaagaa

SEQ ID NO: 351427 - RNA, 19 nt, Human
gcacacccugcaccaccau

SEQ ID NO: 351428 - RNA, 22 nt, Human
cuuucucaaugccggaaggcac

SEQ ID NO: 351429 - RNA, 22 nt, Human
agaauuccucuaggaucugccc

SEQ ID NO: 351430 - RNA, 20 nt, Human
ugugaaagcaguagaaugac

SEQ ID NO: 351431 - RNA, 22 nt, Human
guucacaucacuucacugaacc

SEQ ID NO: 351432 - RNA, 20 nt, Human
uguaacaaucuggauguugc

SEQ ID NO: 351433 - RNA, 22 nt, Human
ccucagggucugaggagaccgu

SEQ ID NO: 351434 - RNA, 22 nt, Human
gaugggggccagggccugcuuu

SEQ ID NO: 351435 - RNA, 22 nt, Human
cagggagaaaucuccaggaggu

SEQ ID NO: 351436 - RNA, 22 nt, Human
ugggugggagcacccugucugg

SEQ ID NO: 351437 - RNA, 22 nt, Human
caacauuucaaggucuuuagga

SEQ ID NO: 351438 - RNA, 22 nt, Human
gggcaguuuauucuagaugguu

SEQ ID NO: 351439 - RNA, 23 nt, Human
ucuggcucuaugugacagcucuc

SEQ ID NO: 351440 - RNA, 20 nt, Human
agcugccccugggcacugcc

SEQ ID NO: 351441 - RNA, 22 nt, Human
uccaggcaugucccaagccgga

SEQ ID NO: 351442 - RNA, 22 nt, Human
ggaggggagucucccaaagccg

SEQ ID NO: 351443 - RNA, 22 nt, Human
cuguuuaucuaggaguugcagg

SEQ ID NO: 351444 - RNA, 20 nt, Human
cccaggugucugaagcucug

SEQ ID NO: 351445 - RNA, 22 nt, Human
cccaggagguggagcuugcagu

SEQ ID NO: 351446 - RNA, 22 nt, Human
uucagcaaauggacuguucagg

SEQ ID NO: 351447 - RNA, 22 nt, Human
gagguggugguggaggcauagc

SEQ ID NO: 351448 - RNA, 22 nt, Human
cucucugggggccaugccaaga

SEQ ID NO: 351449 - RNA, 22 nt, Human
uuccaggauagcuuucaggaau

SEQ ID NO: 351450 - RNA, 22 nt, Human
ucugguaaccuuuaucccuccu

SEQ ID NO: 351451 - RNA, 18 nt, Human
ugagagugugugcucuug

SEQ ID NO: 351452 - RNA, 22 nt, Human
gcugagagugagcacuggauau

SEQ ID NO: 351453 - RNA, 22 nt, Human
uggaaauggaucugaugagucu

SEQ ID NO: 351454 - RNA, 22 nt, Human
cuucuggggauggagcccagaa

SEQ ID NO: 351455 - RNA, 22 nt, Human
aagacccacaaggcugaauguu

SEQ ID NO: 351456 - RNA, 22 nt, Human
gccaggaguucagaugcauguu

SEQ ID NO: 351457 - RNA, 22 nt, Human
cauggcccucuucuggagcaau

SEQ ID NO: 351458 - RNA, 20 nt, Human
ugaagcagccuugauucugu

SEQ ID NO: 351459 - RNA, 22 nt, Human
uuugaaguaccugguucugacu

SEQ ID NO: 351460 - RNA, 23 nt, Human
ucucaagaggaagcagggcucau

SEQ ID NO: 351461 - RNA, 22 nt, Human
ugccuucaaucaggauggucuc

SEQ ID NO: 351462 - RNA, 18 nt, Human
cccagugcucacugccuc

SEQ ID NO: 351463 - RNA, 21 nt, Human
agcagaggcugccuggugacu

SEQ ID NO: 351464 - RNA, 22 nt, Human
cagcagugugcaggugugcugg

SEQ ID NO: 351465 - RNA, 22 nt, Human
uggcugaguuccuggcacacgg

SEQ ID NO: 351466 - RNA, 22 nt, Human
ccagagaggcaaaacuccuucc

SEQ ID NO: 351467 - RNA, 22 nt, Human
uccaugaguuugaggaaaagag

SEQ ID NO: 351468 - RNA, 22 nt, Human
augggaguuuucucugaugcuc

SEQ ID NO: 351469 - RNA, 22 nt, Human
uggcucugagacacaggcucuc

SEQ ID NO: 351470 - RNA, 22 nt, Human
auucaagagcccauguuuccug

SEQ ID NO: 351471 - RNA, 22 nt, Human
gggaaccagccgcuuccgccuc

SEQ ID NO: 351472 - RNA, 22 nt, Human
auaucuuuguaugguucagcag

SEQ ID NO: 351473 - RNA, 22 nt, Human
gacccaggcccaaggcugccag

SEQ ID NO: 351474 - RNA, 22 nt, Human
agaagccaacagggcaggagag

SEQ ID NO: 351475 - RNA, 22 nt, Human
ugucaccacauuugucaauauc

SEQ ID NO: 351476 - RNA, 22 nt, Human
ccagcuuuugcacuggacuggg

SEQ ID NO: 351477 - RNA, 22 nt, Human
cucugagcagaggccguggcua

SEQ ID NO: 351478 - RNA, 22 nt, Human
ucaggauguccaaaauccagcc

SEQ ID NO: 351479 - RNA, 20 nt, Human
agacccuguguccuguggcc

SEQ ID NO: 351480 - RNA, 21 nt, Human
ugagagccuccaaccggcuac

SEQ ID NO: 351481 - RNA, 22 nt, Human
gagcucagauucuggugucaga

SEQ ID NO: 351482 - RNA, 22 nt, Human
aagauuucugcuuuuggaggca

SEQ ID NO: 351483 - RNA, 22 nt, Human
ggcagaaggccucccagcuccu

SEQ ID NO: 351484 - RNA, 22 nt, Human
ugaaaugaagggcuuguucugg

SEQ ID NO: 351485 - RNA, 22 nt, Human
uuucaauguaacauuuccaggc

SEQ ID NO: 351486 - RNA, 22 nt, Human
aggccuggguguucaccagaag

SEQ ID NO: 351487 - RNA, 22 nt, Human
gugcuuaauacaugucaauaac

SEQ ID NO: 351488 - RNA, 22 nt, Human
ggcugggcucgcugauuggcug

SEQ ID NO: 351489 - RNA, 22 nt, Human
aauuugcaugaugagaacaaua

SEQ ID NO: 351490 - RNA, 22 nt, Human
uaaaggcuuuuagugaugguaa

SEQ ID NO: 351491 - RNA, 22 nt, Human
caggggcaggugugagaucauc

SEQ ID NO: 351492 - RNA, 22 nt, Human
ugucagaacucuauugaugucc

SEQ ID NO: 351493 - RNA, 22 nt, Human
ccauuguaguaucuguuuuagu

SEQ ID NO: 351494 - RNA, 22 nt, Human
aggcuucuucuuccuauuuagu

SEQ ID NO: 351495 - RNA, 22 nt, Human
agaauuagguaaguucaucuga

SEQ ID NO: 351496 - RNA, 22 nt, Human
gccugccuagaauugcagcuuu

SEQ ID NO: 351497 - RNA, 23 nt, Human
ugagcugguauuguccaucucca

SEQ ID NO: 351498 - RNA, 22 nt, Human
aggccagccucaggcagggacc

SEQ ID NO: 351499 - RNA, 22 nt, Human
ugcagggaauccagucuagggu

SEQ ID NO: 351500 - RNA, 22 nt, Human
guggccaggacauugccaggca

SEQ ID NO: 351501 - RNA, 22 nt, Human
aaauuucuugaggcucucuagc

SEQ ID NO: 351502 - RNA, 22 nt, Human
gacagugcauuuccuggcaugg

SEQ ID NO: 351503 - RNA, 22 nt, Human
aaugauugcaaacauugagaac

SEQ ID NO: 351504 - RNA, 22 nt, Human
cuggccugggagcugcuagcgu

SEQ ID NO: 351505 - RNA, 22 nt, Human
ugggcuggagcuuguugcuucc

SEQ ID NO: 351506 - RNA, 22 nt, Human
cagcuuuaccuuuaggaguaac

SEQ ID NO: 351507 - RNA, 23 nt, Human
agacccagagacuggcucugcuc

SEQ ID NO: 351508 - RNA, 22 nt, Human
uacauuuauaaggcuucucugu

SEQ ID NO: 351509 - RNA, 22 nt, Human
cuguacaggugaggagggggcu

SEQ ID NO: 351510 - RNA, 22 nt, Human
ugugcauguauugauuuguacc

SEQ ID NO: 351511 - RNA, 22 nt, Human
cagcagagguuggaacaguucu

SEQ ID NO: 351512 - RNA, 19 nt, Human
gccugggaugggcagaacu

SEQ ID NO: 351513 - RNA, 22 nt, Human
ugggcugaaaugcuguggacua

SEQ ID NO: 351514 - RNA, 22 nt, Human
accuuucauuaaagucuguagu

SEQ ID NO: 351515 - RNA, 22 nt, Human
cuccuggacauggagcggagga

SEQ ID NO: 351516 - RNA, 22 nt, Human
aggccagcagcaugacggcauc

SEQ ID NO: 351517 - RNA, 22 nt, Human
ccagagagaaaauggagggcca

SEQ ID NO: 351518 - RNA, 22 nt, Human
uuugaaaggugucgagaugugu

SEQ ID NO: 351519 - RNA, 22 nt, Human
ggaaagaggauaguggguaggu

SEQ ID NO: 351520 - RNA, 18 nt, Human
ucaaagucuggcuccacu

SEQ ID NO: 351521 - RNA, 22 nt, Human
agcagccaggaaucugcagagc

SEQ ID NO: 351522 - RNA, 22 nt, Human
uuucuguuaggcaucauuuuaa

SEQ ID NO: 351523 - RNA, 22 nt, Human
ucaguggaacugucugggugag

SEQ ID NO: 351524 - RNA, 22 nt, Human
gcauguguggaggagaugugcu

SEQ ID NO: 351525 - RNA, 22 nt, Human
cucuuaaauaacaucauugcuu

SEQ ID NO: 351526 - RNA, 22 nt, Human
cagccugcucucagauguugag

SEQ ID NO: 351527 - RNA, 22 nt, Human
ugccucagucuaaagucucuca

SEQ ID NO: 351528 - RNA, 22 nt, Human
gccagccuucuguggccugcaa

SEQ ID NO: 351529 - RNA, 22 nt, Human
cuggccaggcuugggacagaca

SEQ ID NO: 351530 - RNA, 22 nt, Human
gaacuguaguuaauacuacaca

SEQ ID NO: 351531 - RNA, 18 nt, Human
gugcugugggcaguggcc

SEQ ID NO: 351532 - RNA, 22 nt, Human
gaggaaaauauucagggagguu

SEQ ID NO: 351533 - RNA, 22 nt, Human
cuguaauucacuagggucagcg

SEQ ID NO: 351534 - RNA, 22 nt, Human
gggaagggagggccuccaguca

SEQ ID NO: 351535 - RNA, 22 nt, Human
uuaaacaguguuucaugugggg

SEQ ID NO: 351536 - RNA, 22 nt, Human
ucaucugucccaggcuuuuuuc

SEQ ID NO: 351537 - RNA, 22 nt, Human
acuuccuggcugggugaccugg

SEQ ID NO: 351538 - RNA, 22 nt, Human
gcuggccugggcagaggcuaug

SEQ ID NO: 351539 - RNA, 22 nt, Human
ucccagaggucucugcugguuc

SEQ ID NO: 351540 - RNA, 19 nt, Human
cagaggcaccagguauaga

SEQ ID NO: 351541 - RNA, 20 nt, Human
gccuggcacccggggcuggc

SEQ ID NO: 351542 - RNA, 23 nt, Human
uccugagaugagacagugcugcc

SEQ ID NO: 351543 - RNA, 21 nt, Human
guguuuccuguuuauggcuug

SEQ ID NO: 351544 - RNA, 17 nt, Human
ugaagaugcauggcagc

SEQ ID NO: 351545 - RNA, 22 nt, Human
gggcucucgauuagacccuggg

SEQ ID NO: 351546 - RNA, 22 nt, Human
cagggcucaucugugugaccag

SEQ ID NO: 351547 - RNA, 22 nt, Human
cacugcaggucugagauggggg

SEQ ID NO: 351548 - RNA, 21 nt, Human
ugccaggccugagcugggguc

SEQ ID NO: 351549 - RNA, 22 nt, Human
aaaaaugaaacggcugguuggc

SEQ ID NO: 351550 - RNA, 20 nt, Human
ccuggaagagcuccccaggc

SEQ ID NO: 351551 - RNA, 20 nt, Human
ucagaugggagugagccauc

SEQ ID NO: 351552 - RNA, 22 nt, Human
aagaaauuaaggaaugcaacga

SEQ ID NO: 351553 - RNA, 22 nt, Human
ucagggcauggcugcacuuggc

SEQ ID NO: 351554 - RNA, 22 nt, Human
aaagaaaccuaucagccacaug

SEQ ID NO: 351555 - RNA, 22 nt, Human
uugcucuguaauaaucuggggu

SEQ ID NO: 351556 - RNA, 22 nt, Human
uguccucuaauuggccucuugc

SEQ ID NO: 351557 - RNA, 22 nt, Human
cucuucaauagauuguugaggg

SEQ ID NO: 351558 - RNA, 22 nt, Human
uucuucaaaacaacacuggccu

SEQ ID NO: 351559 - RNA, 22 nt, Human
gccugcagaggugcugcuagcu

SEQ ID NO: 351560 - RNA, 22 nt, Human
agcaggugagcacagccaggcu

SEQ ID NO: 351561 - RNA, 22 nt, Human
cugaggcacagugaacuucucc

SEQ ID NO: 351562 - RNA, 22 nt, Human
gcacaauaacagccaagguuau

SEQ ID NO: 351563 - RNA, 22 nt, Human
uagaaacacagaucugguguca

SEQ ID NO: 351564 - RNA, 22 nt, Human
guguguccucaguaguggcaug

SEQ ID NO: 351565 - RNA, 19 nt, Human
aagggcugggcaccucacu

SEQ ID NO: 351566 - RNA, 22 nt, Human
ucuggcuccguguccgcuccca

SEQ ID NO: 351567 - RNA, 22 nt, Human
cagagcucagagcagggcacuc

SEQ ID NO: 351568 - RNA, 22 nt, Human
cagcauggagacaaagugggca

SEQ ID NO: 351569 - RNA, 22 nt, Human
ugauuucccuguagccucugaa

SEQ ID NO: 351570 - RNA, 22 nt, Human
gcagggcacagacagugccaag

SEQ ID NO: 351571 - RNA, 22 nt, Human
ucccagagacaucauuucuccg

SEQ ID NO: 351572 - RNA, 22 nt, Human
gcagggugccgacuucagggau

SEQ ID NO: 351573 - RNA, 22 nt, Human
gugucaugcacacucaguguug

SEQ ID NO: 351574 - RNA, 22 nt, Human
gcuggaccaggugugcacaggc

SEQ ID NO: 351575 - RNA, 22 nt, Human
ccugggaggcggagguugcagg

SEQ ID NO: 351576 - RNA, 22 nt, Human
gagccugaauuugaccugcuua

SEQ ID NO: 351577 - RNA, 22 nt, Human
ggcagcuaggggcagggaauuc

SEQ ID NO: 351578 - RNA, 22 nt, Human
auucuguauggaaaagcacuau

SEQ ID NO: 351579 - RNA, 22 nt, Human
gcuuccuucuaccacaucaugc

SEQ ID NO: 351580 - RNA, 22 nt, Human
aagggcugcauuugauguguca

SEQ ID NO: 351581 - RNA, 22 nt, Human
acuuucauuuguaauaaacuuc

SEQ ID NO: 351582 - RNA, 22 nt, Human
cuggcagcuggaggcuagaggc

SEQ ID NO: 351583 - RNA, 22 nt, Human
aggccagaaaugucagggagug

SEQ ID NO: 351584 - RNA, 22 nt, Human
agucacaguuccuacccaguaa

SEQ ID NO: 351585 - RNA, 22 nt, Human
cauuuguaguuaaaaaugucuc

SEQ ID NO: 351586 - RNA, 22 nt, Human
aaguaaaagcuuuaccaugcgc

SEQ ID NO: 351587 - RNA, 22 nt, Human
aaugugaucgcuuuagaagcuu

SEQ ID NO: 351588 - RNA, 22 nt, Human
auccauuugaaagaacagucca

SEQ ID NO: 351589 - RNA, 22 nt, Human
ugagcccagucugucugacaug

SEQ ID NO: 351590 - RNA, 22 nt, Human
ccugagcuggaagagcuugugc

SEQ ID NO: 351591 - RNA, 22 nt, Human
gcucugcugagauaucugggag

SEQ ID NO: 351592 - RNA, 22 nt, Human
agcaggugcauggcgagcgcgg

SEQ ID NO: 351593 - RNA, 22 nt, Human
auuguaauuuuagagaaagugg

SEQ ID NO: 351594 - RNA, 22 nt, Human
cgucuuccucuuacgaugcgcu

SEQ ID NO: 351595 - RNA, 22 nt, Human
uuuauguaguuacggacuauca

SEQ ID NO: 351596 - RNA, 22 nt, Human
uagaaacauauaggauggcagg

SEQ ID NO: 351597 - RNA, 22 nt, Human
uccauucauucauugaugaaca

SEQ ID NO: 351598 - RNA, 19 nt, Human
ucccuuccugucgggcucc

SEQ ID NO: 351599 - RNA, 22 nt, Human
acagagcuguacaugugccaug

SEQ ID NO: 351600 - RNA, 22 nt, Human
ugcagaccucccauggcugccu

SEQ ID NO: 351601 - RNA, 22 nt, Human
acagcagcuaaaggugucuccu

SEQ ID NO: 351602 - RNA, 22 nt, Human
uucuuuccaaccagauauuggu

SEQ ID NO: 351603 - RNA, 22 nt, Human
auuucacucauucauguuacuu

SEQ ID NO: 351604 - RNA, 22 nt, Human
cuucucaaaguugugaaucagg

SEQ ID NO: 351605 - RNA, 22 nt, Human
aaguuucaaauauaaaauuaca

SEQ ID NO: 351606 - RNA, 22 nt, Human
gagugugucggucagcguggcg

SEQ ID NO: 351607 - RNA, 22 nt, Human
gggcagcucggaagugggaaag

SEQ ID NO: 351608 - RNA, 22 nt, Human
gcaggagugacauggaugugga

SEQ ID NO: 351609 - RNA, 19 nt, Human
acucaagucuaaugaaauc

SEQ ID NO: 351610 - RNA, 18 nt, Human
gcugucugaggucugagg

SEQ ID NO: 351611 - RNA, 20 nt, Human
guugaaaguaauaugaugcu

SEQ ID NO: 351612 - RNA, 22 nt, Human
caagaaucuugcagcuuagacu

SEQ ID NO: 351613 - RNA, 22 nt, Human
aaauccuaauaaugcacuagug

SEQ ID NO: 351614 - RNA, 22 nt, Human
uuuacagauguggaaagugagc

SEQ ID NO: 351615 - RNA, 22 nt, Human
cuucuaggcuucucagggggca

SEQ ID NO: 351616 - RNA, 22 nt, Human
gcugucugcaagccaggaaaug

SEQ ID NO: 351617 - RNA, 22 nt, Human
ugggcugaguguggaacuaguu

SEQ ID NO: 351618 - RNA, 22 nt, Human
aggaagccuggcauuaaaaagc

SEQ ID NO: 351619 - RNA, 22 nt, Human
uucuggagaucugccuauggga

SEQ ID NO: 351620 - RNA, 22 nt, Human
uuccucaggcuucccuuugucc

SEQ ID NO: 351621 - RNA, 22 nt, Human
uauuuguauuucaugcaguaaa

SEQ ID NO: 351622 - RNA, 21 nt, Human
aguuugaugcaauuucugaga

SEQ ID NO: 351623 - RNA, 22 nt, Human
ccuggcagcaggugggcccgug

SEQ ID NO: 351624 - RNA, 22 nt, Human
ugggagagugcucaaugugcaa

SEQ ID NO: 351625 - RNA, 22 nt, Human
cauuucugggagacaugcuaga

SEQ ID NO: 351626 - RNA, 22 nt, Human
cucuucuugccugaugaggcag

SEQ ID NO: 351627 - RNA, 22 nt, Human
ugcuuccuugagcucuccaauc

SEQ ID NO: 351628 - RNA, 22 nt, Human
ggugaggaaagauggugacagu

SEQ ID NO: 351629 - RNA, 22 nt, Human
ccuguucauuuguauuugucuu

SEQ ID NO: 351630 - RNA, 22 nt, Human
caggauggucagaugcauuguc

SEQ ID NO: 351631 - RNA, 21 nt, Human
gagacagacuuucguccccug

SEQ ID NO: 351632 - RNA, 22 nt, Human
augcaguauaaaucauuucugg

SEQ ID NO: 351633 - RNA, 22 nt, Human
cagcagcuggugagacacagcc

SEQ ID NO: 351634 - RNA, 22 nt, Human
guggauggauugaggcaguggg

SEQ ID NO: 351635 - RNA, 22 nt, Human
ggagggcugccagguggagcgg

SEQ ID NO: 351636 - RNA, 23 nt, Human
agaugagccaacaccuccaugcc

SEQ ID NO: 351637 - RNA, 22 nt, Human
ccacagggccuuuccugcuggc

SEQ ID NO: 351638 - RNA, 22 nt, Human
agcuuuauauuuaaugaauucu

SEQ ID NO: 351639 - RNA, 22 nt, Human
aaagauuuaugaaguucaauua

SEQ ID NO: 351640 - RNA, 22 nt, Human
ugagccuggagucguggagggg

SEQ ID NO: 351641 - RNA, 22 nt, Human
caagauuugccaguggccaacu

SEQ ID NO: 351642 - RNA, 19 nt, Human
cuccucagucccagagguc

SEQ ID NO: 351643 - RNA, 21 nt, Human
ccugagccuguuuauccagaa

SEQ ID NO: 351644 - RNA, 22 nt, Human
aggaaaugcugaugcuccugga

SEQ ID NO: 351645 - RNA, 23 nt, Human
agggugagcaagcuauggagacc

SEQ ID NO: 351646 - RNA, 22 nt, Human
ugccaggcugcccuccagucug

SEQ ID NO: 351647 - RNA, 22 nt, Human
gucauaaagcuuguugcauuua

SEQ ID NO: 351648 - RNA, 22 nt, Human
agaaaucaauaucuauauguug

SEQ ID NO: 351649 - RNA, 20 nt, Human
aggagccauugacugcagca

SEQ ID NO: 351650 - RNA, 22 nt, Human
cagcaauaaugucuacaaaucu

SEQ ID NO: 351651 - RNA, 22 nt, Human
uugguacaaugugcuagguagg

SEQ ID NO: 351652 - RNA, 22 nt, Human
auggagggugucagagagcgaa

SEQ ID NO: 351653 - RNA, 22 nt, Human
agauacauuguucuaagcauug

SEQ ID NO: 351654 - RNA, 22 nt, Human
ucauuuguucucauucucuacu

SEQ ID NO: 351655 - RNA, 22 nt, Human
cggcugaggaucuccaggccug

SEQ ID NO: 351656 - RNA, 22 nt, Human
cucuggagcauuucaccuacau

SEQ ID NO: 351657 - RNA, 22 nt, Human
gcaggaagccuuaccaagccca

SEQ ID NO: 351658 - RNA, 23 nt, Human
ggaaagagaggaguugugcauag

SEQ ID NO: 351659 - RNA, 22 nt, Human
cugccaggacugacgucuucag

SEQ ID NO: 351660 - RNA, 20 nt, Human
uuucaagucagcaauucuca

SEQ ID NO: 351661 - RNA, 22 nt, Human
gcugcagccaaauucauuguca

SEQ ID NO: 351662 - RNA, 22 nt, Human
cuuaauuacuguccaauaugca

SEQ ID NO: 351663 - RNA, 20 nt, Human
uuugucuguuaaguguuucu

SEQ ID NO: 351664 - RNA, 22 nt, Human
ugaaaucuuauacuuugguagu

SEQ ID NO: 351665 - RNA, 22 nt, Human
uguuaucugagcaacgucgacg

SEQ ID NO: 351666 - RNA, 22 nt, Human
acagagagaggcccgaggcugc

SEQ ID NO: 351667 - RNA, 22 nt, Human
gcacaugguaggcauuugaugu

SEQ ID NO: 351668 - RNA, 22 nt, Human
ugaagccaccgaaccagaagag

SEQ ID NO: 351669 - RNA, 22 nt, Human
ucagcugcucaaauuuauguca

SEQ ID NO: 351670 - RNA, 19 nt, Human
cugcagggaugugcagagu

SEQ ID NO: 351671 - RNA, 22 nt, Human
gaagaacacuucaugauucauu

SEQ ID NO: 351672 - RNA, 22 nt, Human
ucaaaauuagugaccaaaggca

SEQ ID NO: 351673 - RNA, 22 nt, Human
ggggauggugggaaggcaaucu

SEQ ID NO: 351674 - RNA, 21 nt, Human
ucagaguggaagacaguuuga

SEQ ID NO: 351675 - RNA, 22 nt, Human
gugcaugucggggugcauguca

SEQ ID NO: 351676 - RNA, 22 nt, Human
ugggcucauggcccagcacugg

SEQ ID NO: 351677 - RNA, 22 nt, Human
ugguuucccauuaucugcagga

SEQ ID NO: 351678 - RNA, 22 nt, Human
aaugcauauguaggcaagcagu

SEQ ID NO: 351679 - RNA, 22 nt, Human
gcagagcuccccaagacaccaa

SEQ ID NO: 351680 - RNA, 22 nt, Human
uugaaaggcacaggcaccuggg

SEQ ID NO: 351681 - RNA, 22 nt, Human
guguauaacuaucuaucuagua

SEQ ID NO: 351682 - RNA, 22 nt, Human
aaucagaaaauucaguggaauu

SEQ ID NO: 351683 - RNA, 22 nt, Human
gcuggccucgcaggcaggaugu

SEQ ID NO: 351684 - RNA, 23 nt, Human
agagcuuucuaaaauguaaaucu

SEQ ID NO: 351685 - RNA, 22 nt, Human
augcccaaugucacaauuuuug

SEQ ID NO: 351686 - RNA, 17 nt, Human
agcugaccagauggacu

SEQ ID NO: 351687 - RNA, 22 nt, Human
uggagcagagaugggagcccaa

SEQ ID NO: 351688 - RNA, 22 nt, Human
cuggcccauggugagcucuggg

SEQ ID NO: 351689 - RNA, 17 nt, Human
ugcauuguaggcuagcc

SEQ ID NO: 351690 - RNA, 22 nt, Human
agucucaggcagaggaaggcua

SEQ ID NO: 351691 - RNA, 22 nt, Human
ggagcuguuggcagcuaucuug

SEQ ID NO: 351692 - RNA, 18 nt, Human
agggagagaccgcggguc

SEQ ID NO: 351693 - RNA, 22 nt, Human
cacugcucgcugcagcauggcc

SEQ ID NO: 351694 - RNA, 22 nt, Human
ucaguaaaugagcaaaaauuuc

SEQ ID NO: 351695 - RNA, 22 nt, Human
uggcucaguuucugcccagcug

SEQ ID NO: 351696 - RNA, 22 nt, Human
agcagggcucuguggagggugg

SEQ ID NO: 351697 - RNA, 22 nt, Human
cauacuuucuuuuucacgcaua

SEQ ID NO: 351698 - RNA, 22 nt, Human
agaauucucuuccauugaaaca

SEQ ID NO: 351699 - RNA, 22 nt, Human
ccacagaggacaacugccuggc

SEQ ID NO: 351700 - RNA, 22 nt, Human
aggagcugcuuaaaugguuggu

SEQ ID NO: 351701 - RNA, 22 nt, Human
ggccucagaccggagcuggcca

SEQ ID NO: 351702 - RNA, 22 nt, Human
uuugaaagucaaccuuccaguu

SEQ ID NO: 351703 - RNA, 22 nt, Human
aagcaccuggguuauaucuuag

SEQ ID NO: 351704 - RNA, 22 nt, Human
ggcucugcgcgguaaagugacu

SEQ ID NO: 351705 - RNA, 22 nt, Human
aggugcagaaaaaaguccuuua

SEQ ID NO: 351706 - RNA, 22 nt, Human
acagguuuuuguggauauaugu

SEQ ID NO: 351707 - RNA, 22 nt, Human
ugucacauguguggcauuuuuc

SEQ ID NO: 351708 - RNA, 22 nt, Human
cagaggaggcgguauacacugc

SEQ ID NO: 351709 - RNA, 22 nt, Human
uauccaaacauauagucucucu

SEQ ID NO: 351710 - RNA, 22 nt, Human
ccuccugggacaggcuggcaca

SEQ ID NO: 351711 - RNA, 22 nt, Human
agucucugcaugaugcagcaca

SEQ ID NO: 351712 - RNA, 22 nt, Human
guguuuuaucagacaaaguaua

SEQ ID NO: 351713 - RNA, 22 nt, Human
ggcuggcuugccaagcucaggg

SEQ ID NO: 351714 - RNA, 22 nt, Human
gaggcauggccugaggcuagga

SEQ ID NO: 351715 - RNA, 22 nt, Human
ggagcugcacgcucugaagccu

SEQ ID NO: 351716 - RNA, 22 nt, Human
guuccaaagcaaaggaggugag

SEQ ID NO: 351717 - RNA, 22 nt, Human
augcugugauuguagaaauauu

SEQ ID NO: 351718 - RNA, 22 nt, Human
uuacagaacugcccuaguuggc

SEQ ID NO: 351719 - RNA, 22 nt, Human
cccucuggcucuucucaggccg

SEQ ID NO: 351720 - RNA, 21 nt, Human
ugcagaggcacaaacaagccc

SEQ ID NO: 351721 - RNA, 22 nt, Human
cugggccugguagggcuugaaa

SEQ ID NO: 351722 - RNA, 22 nt, Human
ucucccacuggccuuguaugau

SEQ ID NO: 351723 - RNA, 22 nt, Human
agagugauggguugugcugacc

SEQ ID NO: 351724 - RNA, 22 nt, Human
accaggcaaaaccacaggagca

SEQ ID NO: 351725 - RNA, 22 nt, Human
gaguguuccagaaacuggcccu

SEQ ID NO: 351726 - RNA, 22 nt, Human
cagcaauauacacagucuaugg

SEQ ID NO: 351727 - RNA, 22 nt, Human
gcuucuggaggagcugggcuga

SEQ ID NO: 351728 - RNA, 22 nt, Human
gugaauaacuuucuauguuaau

SEQ ID NO: 351729 - RNA, 20 nt, Human
gcucccugguagaaauguuu

SEQ ID NO: 351730 - RNA, 22 nt, Human
cacugaagaugcgacuagugcu

SEQ ID NO: 351731 - RNA, 23 nt, Human
cuccccaguguccucaugcaucu

SEQ ID NO: 351732 - RNA, 22 nt, Human
agguaaagacugcaaggagaau

SEQ ID NO: 351733 - RNA, 22 nt, Human
gccagagccggcuucacaggau

SEQ ID NO: 351734 - RNA, 22 nt, Human
ucccagggugcgccugcccucg

SEQ ID NO: 351735 - RNA, 22 nt, Human
cugaauaauguucucuuguaug

SEQ ID NO: 351736 - RNA, 22 nt, Human
auaaacagaguaguugcuacug

SEQ ID NO: 351737 - RNA, 22 nt, Human
gccaguggcccucuggagaagg

SEQ ID NO: 351738 - RNA, 22 nt, Human
ucuuuucaucauuuaauaggua

SEQ ID NO: 351739 - RNA, 22 nt, Human
cacagggcuuugauggcugagu

SEQ ID NO: 351740 - RNA, 22 nt, Human
uagagaaauaagcuuugccuug

SEQ ID NO: 351741 - RNA, 22 nt, Human
agcuggccuuagugagcaccug

SEQ ID NO: 351742 - RNA, 22 nt, Human
gcccaggcuggagugcaguagc

SEQ ID NO: 351743 - RNA, 22 nt, Human
ucccagagauuuccucuccuuc

SEQ ID NO: 351744 - RNA, 22 nt, Human
ccagcuggugacauccccaacc

SEQ ID NO: 351745 - RNA, 22 nt, Human
gaggagagggcugcgggcccac

SEQ ID NO: 351746 - RNA, 22 nt, Human
cuguggaaggccuguccugaaa

SEQ ID NO: 351747 - RNA, 22 nt, Human
uucuaucauacuugaauacauu

SEQ ID NO: 351748 - RNA, 22 nt, Human
ggcacugagcgggcucugagcg

SEQ ID NO: 351749 - RNA, 22 nt, Human
ccaggagagcaaaggucacucu

SEQ ID NO: 351750 - RNA, 22 nt, Human
agauggagaccuuggaugaacu

SEQ ID NO: 351751 - RNA, 20 nt, Human
aggagaugauccagagucag

SEQ ID NO: 351752 - RNA, 23 nt, Human
agaggggagcaucugcuggcuga

SEQ ID NO: 351753 - RNA, 22 nt, Human
caaagcaaggcucaguuugaac

SEQ ID NO: 351754 - RNA, 22 nt, Human
uugcugaauugaauccuuuggu

SEQ ID NO: 351755 - RNA, 22 nt, Human
uggccuuccuggugacucauga

SEQ ID NO: 351756 - RNA, 22 nt, Human
cugagcuggucuauggacuugg

SEQ ID NO: 351757 - RNA, 22 nt, Human
aguuccagcugugaccagaaaa

SEQ ID NO: 351758 - RNA, 22 nt, Human
agccaagcugaucuccugcuga

SEQ ID NO: 351759 - RNA, 22 nt, Human
uuccucucucuugccagaaugu

SEQ ID NO: 351760 - RNA, 22 nt, Human
auacauaauuacuuccgauguu

SEQ ID NO: 351761 - RNA, 22 nt, Human
gggcugagaauucagcuuuccu

SEQ ID NO: 351762 - RNA, 22 nt, Human
aucuaggauuugaaugcacagu

SEQ ID NO: 351763 - RNA, 22 nt, Human
aauaauuuuagcucagaguugu

SEQ ID NO: 351764 - RNA, 22 nt, Human
uagggauguccugagacuuggc

SEQ ID NO: 351765 - RNA, 22 nt, Human
uauuucagguauggugugaaau

SEQ ID NO: 351766 - RNA, 22 nt, Human
uuugaaaauuagacacaggcua

SEQ ID NO: 351767 - RNA, 19 nt, Human
ucuuucauuucuagcucug

SEQ ID NO: 351768 - RNA, 22 nt, Human
acucucucacagcuuggcugau

SEQ ID NO: 351769 - RNA, 23 nt, Human
aguuuuucugcaugguucuguau

SEQ ID NO: 351770 - RNA, 22 nt, Human
agcauuuaugacuaauguaaaa

SEQ ID NO: 351771 - RNA, 22 nt, Human
ccucuucugagugagacucccu

SEQ ID NO: 351772 - RNA, 22 nt, Human
uauuucugaggcccaggaagug

SEQ ID NO: 351773 - RNA, 22 nt, Human
ggccagcucugcacagcagcug

SEQ ID NO: 351774 - RNA, 22 nt, Human
uucuucaaccaucuacauaaac

SEQ ID NO: 351775 - RNA, 22 nt, Human
guccucagucaguuuggugggg

SEQ ID NO: 351776 - RNA, 22 nt, Human
auggauaagaacaaauaucuga

SEQ ID NO: 351777 - RNA, 22 nt, Human
ucucaggacuuugggaagcuca

SEQ ID NO: 351778 - RNA, 22 nt, Human
gccaggaggucagccccucaac

SEQ ID NO: 351779 - RNA, 19 nt, Human
ucaggaguuaguugugcuc

SEQ ID NO: 351780 - RNA, 23 nt, Human
uuugcaaauuggacacaaccaca

SEQ ID NO: 351781 - RNA, 22 nt, Human
ccuggcagcuccuccccggcgg

SEQ ID NO: 351782 - RNA, 22 nt, Human
ugcaauaacccaguaucuguga

SEQ ID NO: 351783 - RNA, 22 nt, Human
agggacacugaugagaaauucu

SEQ ID NO: 351784 - RNA, 22 nt, Human
uaugcacauugguuuccucauu

SEQ ID NO: 351785 - RNA, 22 nt, Human
auuaggcauauaugcuuuuaau

SEQ ID NO: 351786 - RNA, 22 nt, Human
agagaggcgaguuaccugugcu

SEQ ID NO: 351787 - RNA, 22 nt, Human
augcauaauguauguauugacu

SEQ ID NO: 351788 - RNA, 22 nt, Human
uauuugaaggcauacauuuuga

SEQ ID NO: 351789 - RNA, 22 nt, Human
acagguggggaggcugagguuc

SEQ ID NO: 351790 - RNA, 22 nt, Human
guuuuauaugucucugcugaca

SEQ ID NO: 351791 - RNA, 22 nt, Human
ccagcucuagccccauguggcu

SEQ ID NO: 351792 - RNA, 22 nt, Human
uccugcagccuugggcuggagc

SEQ ID NO: 351793 - RNA, 22 nt, Human
aggcagaccaugaaucaugacc

SEQ ID NO: 351794 - RNA, 22 nt, Human
agaggaggcagcuuaacucagu

SEQ ID NO: 351795 - RNA, 22 nt, Human
cagugcugggcagaggagagcg

SEQ ID NO: 351796 - RNA, 21 nt, Human
augaagucuaugcuucugugu

SEQ ID NO: 351797 - RNA, 19 nt, Human
aucagcaagguaggaugug

SEQ ID NO: 351798 - RNA, 22 nt, Human
ccugggcuugcaucugugcugg

SEQ ID NO: 351799 - RNA, 19 nt, Human
guuaggcaggguggggagu

SEQ ID NO: 351800 - RNA, 22 nt, Human
aaggccagaguacuagaggcug

SEQ ID NO: 351801 - RNA, 22 nt, Human
ccacagggauaggaauggggcu

SEQ ID NO: 351802 - RNA, 22 nt, Human
gccuucugauugcuggacugac

SEQ ID NO: 351803 - RNA, 22 nt, Human
uagaaauguuagauguauugag

SEQ ID NO: 351804 - RNA, 22 nt, Human
aacuagucagugauucucagaa

SEQ ID NO: 351805 - RNA, 22 nt, Human
aggagaggcaucaagaaaaucg

SEQ ID NO: 351806 - RNA, 21 nt, Human
ggacaccagucacacuggauu

SEQ ID NO: 351807 - RNA, 22 nt, Human
gcaaaucaccaccuagcuggau

SEQ ID NO: 351808 - RNA, 22 nt, Human
cuggcucauuuuagcaucaggu

SEQ ID NO: 351809 - RNA, 22 nt, Human
uaucuuuagaggaagagaaucu

SEQ ID NO: 351810 - RNA, 22 nt, Human
aagauacugaugauguaggcua

SEQ ID NO: 351811 - RNA, 22 nt, Human
ugcugucccccgugucugggcu

SEQ ID NO: 351812 - RNA, 22 nt, Human
cagagccucagaauccugugga

SEQ ID NO: 351813 - RNA, 22 nt, Human
cagggccucauccucagagauu

SEQ ID NO: 351814 - RNA, 22 nt, Human
gccugccuguuggcugaggugc

SEQ ID NO: 351815 - RNA, 19 nt, Human
guuuuucccagacgaggca

SEQ ID NO: 351816 - RNA, 22 nt, Human
ggcucugcuggauugaggccag

SEQ ID NO: 351817 - RNA, 22 nt, Human
aauuauauuguggugugaaugu

SEQ ID NO: 351818 - RNA, 22 nt, Human
auuuaucucuggaaacuaagca

SEQ ID NO: 351819 - RNA, 19 nt, Human
gaggagcuaucggagacag

SEQ ID NO: 351820 - RNA, 18 nt, Human
agagaugguguagaguuu

SEQ ID NO: 351821 - RNA, 21 nt, Human
agaaaaaccagcauguuuuca

SEQ ID NO: 351822 - RNA, 22 nt, Human
ucagggcagguuaacuugggug

SEQ ID NO: 351823 - RNA, 19 nt, Human
gagcugccuuuugaagacc

SEQ ID NO: 351824 - RNA, 22 nt, Human
gucuccugagccuugacugcaa

SEQ ID NO: 351825 - RNA, 18 nt, Human
gcuggcugcacuucugcu

SEQ ID NO: 351826 - RNA, 22 nt, Human
gggcagguguugucaaucuaau

SEQ ID NO: 351827 - RNA, 20 nt, Human
agacccucuggacugggccc

SEQ ID NO: 351828 - RNA, 22 nt, Human
auacagaauuugcccuuuucau

SEQ ID NO: 351829 - RNA, 22 nt, Human
auuagggcuggaugcaaggaaa

SEQ ID NO: 351830 - RNA, 22 nt, Human
gccucaggacuggcauacucau

SEQ ID NO: 351831 - RNA, 22 nt, Human
ucuuagcacagcuauauaaguu

SEQ ID NO: 351832 - RNA, 22 nt, Human
ccucagaggugaacaucagugc

SEQ ID NO: 351833 - RNA, 22 nt, Human
ucaggagcuugguagugugauu

SEQ ID NO: 351834 - RNA, 22 nt, Human
guuugcauaucugugaaaugga

SEQ ID NO: 351835 - RNA, 20 nt, Human
ucucaggguucagcaaagua

SEQ ID NO: 351836 - RNA, 22 nt, Human
gcauguguuauuuuauguauga

SEQ ID NO: 351837 - RNA, 22 nt, Human
cuagggaccucagcuccuggag

SEQ ID NO: 351838 - RNA, 22 nt, Human
uggcagagguauauugggagga

SEQ ID NO: 351839 - RNA, 22 nt, Human
cauggagauaaacugaaauauu

SEQ ID NO: 351840 - RNA, 20 nt, Human
caccagucaugagucaauac

SEQ ID NO: 351841 - RNA, 22 nt, Human
aucuguucuucaaaauauuaca

SEQ ID NO: 351842 - RNA, 22 nt, Human
uggaguucauccaugacagcuu

SEQ ID NO: 351843 - RNA, 21 nt, Human
ugcucaugcaaugcaugucca

SEQ ID NO: 351844 - RNA, 22 nt, Human
gaaauaagaguccaugccaggu

SEQ ID NO: 351845 - RNA, 22 nt, Human
aaaaguaauugaugcaaucgua

SEQ ID NO: 351846 - RNA, 22 nt, Human
uggucaguugcaucagagaagu

SEQ ID NO: 351847 - RNA, 22 nt, Human
uucacauugguucuugauagcu

SEQ ID NO: 351848 - RNA, 22 nt, Human
acauuucuaucauccuguaaug

SEQ ID NO: 351849 - RNA, 22 nt, Human
uacuuguagcagguggcauuua

SEQ ID NO: 351850 - RNA, 20 nt, Human
gcacugaaauucaauguuug

SEQ ID NO: 351851 - RNA, 22 nt, Human
acauuucuucccuuuagcagaa

SEQ ID NO: 351852 - RNA, 22 nt, Human
ugaaaucuuuaguuucuguccc

SEQ ID NO: 351853 - RNA, 22 nt, Human
ucaaagucacaacucucuaauu

SEQ ID NO: 351854 - RNA, 22 nt, Human
aaguggagucccuacaaccagc

SEQ ID NO: 351855 - RNA, 20 nt, Human
gcugaagauucccaugcaag

SEQ ID NO: 351856 - RNA, 22 nt, Human
cuuuggcaaugaaacacaagaa

SEQ ID NO: 351857 - RNA, 22 nt, Human
gcuggagccaagcugcucuugg

SEQ ID NO: 351858 - RNA, 22 nt, Human
ccuggcucuucagagguuccua

SEQ ID NO: 351859 - RNA, 22 nt, Human
caagaucagggugccagaaugg

SEQ ID NO: 351860 - RNA, 22 nt, Human
ucuuaaaaguaugccaauugga

SEQ ID NO: 351861 - RNA, 21 nt, Human
agggaaagaaaaugagcuaau

SEQ ID NO: 351862 - RNA, 22 nt, Human
ugcaauaacuacuuuaauguug

SEQ ID NO: 351863 - RNA, 22 nt, Human
acacaucagaaauaugaaugag

SEQ ID NO: 351864 - RNA, 22 nt, Human
ccagggugcucuguggcgucgc

SEQ ID NO: 351865 - RNA, 22 nt, Human
ugaggggagacagaguggacuc

SEQ ID NO: 351866 - RNA, 22 nt, Human
ugaguccaucgcagggaagugg

SEQ ID NO: 351867 - RNA, 22 nt, Human
aagugaagaaauacaugagaau

SEQ ID NO: 351868 - RNA, 22 nt, Human
ucacagggauggaauagaaaua

SEQ ID NO: 351869 - RNA, 22 nt, Human
gcuggcugcgucaucacagggc

SEQ ID NO: 351870 - RNA, 22 nt, Human
aaaugaacaguugcauucucug

SEQ ID NO: 351871 - RNA, 22 nt, Human
gagcaccucaauuugcuauuug

SEQ ID NO: 351872 - RNA, 22 nt, Human
auuucugauaaacguaagcugc

SEQ ID NO: 351873 - RNA, 22 nt, Human
guuucauacagauuauucaugg

SEQ ID NO: 351874 - RNA, 22 nt, Human
auacagaagccuguauuucugg

SEQ ID NO: 351875 - RNA, 22 nt, Human
uuccaaaguuaguuauuagaaa

SEQ ID NO: 351876 - RNA, 22 nt, Human
agcauggggcuccgcaaugaac

SEQ ID NO: 351877 - RNA, 22 nt, Human
ugccaaauugcccuauaaauga

SEQ ID NO: 351878 - RNA, 22 nt, Human
ucuuggagacucuuguauauuu

SEQ ID NO: 351879 - RNA, 22 nt, Human
acacagggauauuucagguggu

SEQ ID NO: 351880 - RNA, 22 nt, Human
uuuccucuucuucccaugucau

SEQ ID NO: 351881 - RNA, 22 nt, Human
ccagucccagcucugccaugcu

SEQ ID NO: 351882 - RNA, 22 nt, Human
cagaaggcuuuguggaguagac

SEQ ID NO: 351883 - RNA, 20 nt, Human
uuuaggcauuacucuuuugu

SEQ ID NO: 351884 - RNA, 22 nt, Human
cccccuggcaggcuggccucuc

SEQ ID NO: 351885 - RNA, 22 nt, Human
caugcuuucuguccaaauguua

SEQ ID NO: 351886 - RNA, 22 nt, Human
ucccagaaaaaggaggcuauga

SEQ ID NO: 351887 - RNA, 22 nt, Human
aaggaagacacagaugaaguga

SEQ ID NO: 351888 - RNA, 22 nt, Human
uaaggcacgcauaagagggggc

SEQ ID NO: 351889 - RNA, 22 nt, Human
cccagagcuccgguccugccca

SEQ ID NO: 351890 - RNA, 22 nt, Human
acccaggacuuggcaaccucau

SEQ ID NO: 351891 - RNA, 22 nt, Human
uagagcugcuggacuguaacag

SEQ ID NO: 351892 - RNA, 22 nt, Human
acauuucugcauguaggguaau

SEQ ID NO: 351893 - RNA, 22 nt, Human
ugauugaacugagcuucaagau

SEQ ID NO: 351894 - RNA, 22 nt, Human
uuuuuaagcuccuuugauguca

SEQ ID NO: 351895 - RNA, 22 nt, Human
caucugccuaaguggcccuguu

SEQ ID NO: 351896 - RNA, 22 nt, Human
gcuucacaggcaaguuaagccu

SEQ ID NO: 351897 - RNA, 22 nt, Human
caggagugcagguggugaggca

SEQ ID NO: 351898 - RNA, 22 nt, Human
acagccuggccugaguuaaggc

SEQ ID NO: 351899 - RNA, 22 nt, Human
ccuggcuguggcggugcucuca

SEQ ID NO: 351900 - RNA, 22 nt, Human
ccuggagccccucuggccagcc

SEQ ID NO: 351901 - RNA, 23 nt, Human
agaugaggcuucuccauguuggu

SEQ ID NO: 351902 - RNA, 22 nt, Human
ucagcuuucucaaagaagcugg

SEQ ID NO: 351903 - RNA, 22 nt, Human
agucccagcuacucaagaggcu

SEQ ID NO: 351904 - RNA, 22 nt, Human
aaaauacacauacuaggggaaa

SEQ ID NO: 351905 - RNA, 22 nt, Human
aaggcuuuuaacuacuguuuua

SEQ ID NO: 351906 - RNA, 22 nt, Human
acugaaggucucagcaaggaug

SEQ ID NO: 351907 - RNA, 22 nt, Human
cuuaaauuuucaucuacaagaa

SEQ ID NO: 351908 - RNA, 22 nt, Human
gugccuggcaugcgccggugcu

SEQ ID NO: 351909 - RNA, 22 nt, Human
caguccuugauccaauaguggg

SEQ ID NO: 351910 - RNA, 22 nt, Human
cccagcuccagagccagaaaca

SEQ ID NO: 351911 - RNA, 22 nt, Human
cuggagcugcuguccuugggug

SEQ ID NO: 351912 - RNA, 22 nt, Human
acccagcuaacccuacccugga

SEQ ID NO: 351913 - RNA, 22 nt, Human
acacagauuuuacauguuaugc

SEQ ID NO: 351914 - RNA, 22 nt, Human
caugcacaaagguaagaugcgu

SEQ ID NO: 351915 - RNA, 22 nt, Human
ggcucuggagcacagacgucug

SEQ ID NO: 351916 - RNA, 22 nt, Human
ccaggcagagugcuccagaaag

SEQ ID NO: 351917 - RNA, 22 nt, Human
ugcaacuuguuuggagagaaag

SEQ ID NO: 351918 - RNA, 22 nt, Human
ugaagcagcuucuuucugucaa

SEQ ID NO: 351919 - RNA, 16 nt, Human
cagccugcagugguca

SEQ ID NO: 351920 - RNA, 22 nt, Human
uggcucagucuggguugacuga

SEQ ID NO: 351921 - RNA, 22 nt, Human
gggaaauugugugagaucuuug

SEQ ID NO: 351922 - RNA, 22 nt, Human
acuugcugguggcauuuacagu

SEQ ID NO: 351923 - RNA, 22 nt, Human
gcugucuguggugucagcugac

SEQ ID NO: 351924 - RNA, 22 nt, Human
auguguaugcaugcacuaagau

SEQ ID NO: 351925 - RNA, 22 nt, Human
ggaggcugcugccucacguggg

SEQ ID NO: 351926 - RNA, 22 nt, Human
ccaguggaaauguggucaggau

SEQ ID NO: 351927 - RNA, 22 nt, Human
ggcugagcccccucugcguagg

SEQ ID NO: 351928 - RNA, 22 nt, Human
agucaguggcuccgagccuggu

SEQ ID NO: 351929 - RNA, 21 nt, Human
accucaagcaacaaccaaggu

SEQ ID NO: 351930 - RNA, 22 nt, Human
agaaaauuagauuuuacugugu

SEQ ID NO: 351931 - RNA, 22 nt, Human
agcuuuauauguuguuucucca

SEQ ID NO: 351932 - RNA, 19 nt, Human
gccugagccagccaugcaa

SEQ ID NO: 351933 - RNA, 21 nt, Human
ccagaggccucucuuggccac

SEQ ID NO: 351934 - RNA, 22 nt, Human
caguacuuaacuuauaggagag

SEQ ID NO: 351935 - RNA, 17 nt, Human
aucuggcugcuucuaga

SEQ ID NO: 351936 - RNA, 22 nt, Human
uuuagggaaauugaggguuaag

SEQ ID NO: 351937 - RNA, 22 nt, Human
aguauuucuaguugguucuacu

SEQ ID NO: 351938 - RNA, 22 nt, Human
ggcuggcucagggcuugagaga

SEQ ID NO: 351939 - RNA, 22 nt, Human
aggcugucugaccccagagccc

SEQ ID NO: 351940 - RNA, 17 nt, Human
agauggcaggaggcaga

SEQ ID NO: 351941 - RNA, 21 nt, Human
uaaggccaagucuauuucugu

SEQ ID NO: 351942 - RNA, 22 nt, Human
agacaucaaugaucagagguag

SEQ ID NO: 351943 - RNA, 22 nt, Human
ugucaccaugccagcuucugcc

SEQ ID NO: 351944 - RNA, 22 nt, Human
ucugaggcuaagagacagaggc

SEQ ID NO: 351945 - RNA, 22 nt, Human
gcaggaaagguugagacuuugc

SEQ ID NO: 351946 - RNA, 19 nt, Human
ucaucucacagggccuggc

SEQ ID NO: 351947 - RNA, 23 nt, Human
gcugagguacauuuacaggaaga

SEQ ID NO: 351948 - RNA, 22 nt, Human
uuaauaaaguaugaauuggaaa

SEQ ID NO: 351949 - RNA, 22 nt, Human
guuuuucuuugugugaagacaa

SEQ ID NO: 351950 - RNA, 22 nt, Human
ucagagugaggcgucaacauga

SEQ ID NO: 351951 - RNA, 16 nt, Human
aggcagagauuuaccc

SEQ ID NO: 351952 - RNA, 22 nt, Human
agagggcagggcgguaaguccu

SEQ ID NO: 351953 - RNA, 22 nt, Human
uuugaagugggcauuagaaccu

SEQ ID NO: 351954 - RNA, 22 nt, Human
augccaggccccacgcugggca

SEQ ID NO: 351955 - RNA, 22 nt, Human
uuuuaucuaccuaugcucauuu

SEQ ID NO: 351956 - RNA, 22 nt, Human
ggcucaguguuuguggaacaua

SEQ ID NO: 351957 - RNA, 20 nt, Human
ggagaugcagcccaggugcc

SEQ ID NO: 351958 - RNA, 19 nt, Human
acaggcagaauugggugug

SEQ ID NO: 351959 - RNA, 22 nt, Human
cccuggaagguucucuggcuca

SEQ ID NO: 351960 - RNA, 22 nt, Human
ccaaaggcggaacugagucucu

SEQ ID NO: 351961 - RNA, 22 nt, Human
acaggcagagaacucagccaga

SEQ ID NO: 351962 - RNA, 22 nt, Human
acaggugguaaaauggacuguc

SEQ ID NO: 351963 - RNA, 21 nt, Human
aggaaguggccagauugggaa

SEQ ID NO: 351964 - RNA, 21 nt, Human
auacuuugaauuacagccuug

SEQ ID NO: 351965 - RNA, 22 nt, Human
ggcucuggugggaagguuagau

SEQ ID NO: 351966 - RNA, 22 nt, Human
acaugggaucaaugaggcaggc

SEQ ID NO: 351967 - RNA, 22 nt, Human
cagagcugacccaaggauugaa

SEQ ID NO: 351968 - RNA, 22 nt, Human
ugcucugguaacucacuuccau

SEQ ID NO: 351969 - RNA, 22 nt, Human
uccugccucuccaugcuaacua

SEQ ID NO: 351970 - RNA, 22 nt, Human
caaggagaguaauugaaugaga

SEQ ID NO: 351971 - RNA, 22 nt, Human
cagaauggcuuuuauggcucag

SEQ ID NO: 351972 - RNA, 22 nt, Human
auaagaaacauuauucuuucca

SEQ ID NO: 351973 - RNA, 22 nt, Human
uaaauucugaucaaguuccuuc

SEQ ID NO: 351974 - RNA, 22 nt, Human
ccagcuuucucagaggcuucua

SEQ ID NO: 351975 - RNA, 22 nt, Human
gcaguccaaaguggcucucacc

SEQ ID NO: 351976 - RNA, 22 nt, Human
gaaaucugaacaacagcuguca

SEQ ID NO: 351977 - RNA, 22 nt, Human
gcagagguggcaucugggcucu

SEQ ID NO: 351978 - RNA, 22 nt, Human
gaggcagcuggguccggucggg

SEQ ID NO: 351979 - RNA, 22 nt, Human
caggggacaguaugguggauga

SEQ ID NO: 351980 - RNA, 18 nt, Human
uggcucuggacuugcucc

SEQ ID NO: 351981 - RNA, 22 nt, Human
gcuuugaagucugugucuuuug

SEQ ID NO: 351982 - RNA, 22 nt, Human
auuuauuauugugguuacuucu

SEQ ID NO: 351983 - RNA, 22 nt, Human
agccucugucaagcuuuucaaa

SEQ ID NO: 351984 - RNA, 22 nt, Human
gaggccagaguuccccgaguca

SEQ ID NO: 351985 - RNA, 20 nt, Human
ggcucuggaaucuggugggc

SEQ ID NO: 351986 - RNA, 22 nt, Human
gcuggccuuugaggaagcugcg

SEQ ID NO: 351987 - RNA, 19 nt, Human
gcucugagaggggcauggg

SEQ ID NO: 351988 - RNA, 22 nt, Human
uaacagaauagcagaaacagaa

SEQ ID NO: 351989 - RNA, 18 nt, Human
acagggagggcgcugggg

SEQ ID NO: 351990 - RNA, 22 nt, Human
cagagcauaauugacaugaggu

SEQ ID NO: 351991 - RNA, 22 nt, Human
acagagccaaaaggacauagua

SEQ ID NO: 351992 - RNA, 22 nt, Human
gcaaaugcucuccuuggucagg

SEQ ID NO: 351993 - RNA, 22 nt, Human
gcccugucggaacugcgaccuc

SEQ ID NO: 351994 - RNA, 22 nt, Human
aguguccaacucagcuugucaa

SEQ ID NO: 351995 - RNA, 22 nt, Human
uguguacacagauaguaauggc

SEQ ID NO: 351996 - RNA, 22 nt, Human
cagccaucaguaaagacagcuu

SEQ ID NO: 351997 - RNA, 22 nt, Human
aagaauuauugcaauacuagau

SEQ ID NO: 351998 - RNA, 22 nt, Human
ggagaggcuuggcccagccugg

SEQ ID NO: 351999 - RNA, 22 nt, Human
acagauugaucuugagaauuau

SEQ ID NO: 352000 - RNA, 22 nt, Human
agcuuguuaaggaugcauauua

SEQ ID NO: 352001 - RNA, 22 nt, Human
cugugaggcccugggugcugga

SEQ ID NO: 352002 - RNA, 22 nt, Human
ggcagaggaggggugaauuugc

SEQ ID NO: 352003 - RNA, 22 nt, Human
gaggaggccaguggaaggaagc

SEQ ID NO: 352004 - RNA, 20 nt, Human
ugagugauggaggcggguca

SEQ ID NO: 352005 - RNA, 20 nt, Human
ucugugugccaucaccuaac

SEQ ID NO: 352006 - RNA, 22 nt, Human
ggcuguggcauuaggugaggcc

SEQ ID NO: 352007 - RNA, 22 nt, Human
aagguacagaaauuaacaagga

SEQ ID NO: 352008 - RNA, 22 nt, Human
aggagugggggcgagaaguuaa

SEQ ID NO: 352009 - RNA, 22 nt, Human
agcacauaccagaaccacaggu

SEQ ID NO: 352010 - RNA, 22 nt, Human
aucaggauuacacggggaugcu

SEQ ID NO: 352011 - RNA, 22 nt, Human
uuauggcauauuccucauugua

SEQ ID NO: 352012 - RNA, 20 nt, Human
agccaggccucaaguuaagu

SEQ ID NO: 352013 - RNA, 22 nt, Human
ugucucugcuuuccuugcaggg

SEQ ID NO: 352014 - RNA, 22 nt, Human
uucauuccuucuguaccuugcc

SEQ ID NO: 352015 - RNA, 22 nt, Human
uggagcugagagccaggcuggc

SEQ ID NO: 352016 - RNA, 22 nt, Human
uccugaggcucacuuugaaugu

SEQ ID NO: 352017 - RNA, 22 nt, Human
ucagaggagggacucagaccca

SEQ ID NO: 352018 - RNA, 22 nt, Human
accuuucacgguaucagacauc

SEQ ID NO: 352019 - RNA, 18 nt, Human
cuucagugacagucuggc

SEQ ID NO: 352020 - RNA, 22 nt, Human
ugccaggcccugugcuggaugc

SEQ ID NO: 352021 - RNA, 22 nt, Human
uucucagugaaguuuagaacau

SEQ ID NO: 352022 - RNA, 22 nt, Human
accaggagagauuuuauugaga

SEQ ID NO: 352023 - RNA, 22 nt, Human
uccuuagagacaagaccaguuu

SEQ ID NO: 352024 - RNA, 22 nt, Human
uuggcuucuggcagucuggacg

SEQ ID NO: 352025 - RNA, 22 nt, Human
uagggcagccuuauagcuccca

SEQ ID NO: 352026 - RNA, 23 nt, Human
gucagggcuggggucagagugac

SEQ ID NO: 352027 - RNA, 22 nt, Human
acccagcuggaugcauggaggc

SEQ ID NO: 352028 - RNA, 22 nt, Human
cagcuccccucuguggggcagu

SEQ ID NO: 352029 - RNA, 22 nt, Human
guuuuauaggugaaauauuacu

SEQ ID NO: 352030 - RNA, 22 nt, Human
uccaggcacagaguuggucagu

SEQ ID NO: 352031 - RNA, 22 nt, Human
aaucaugugggauagucugcuc

SEQ ID NO: 352032 - RNA, 21 nt, Human
cgggcuggccgggcccucacc

SEQ ID NO: 352033 - RNA, 22 nt, Human
caucagcacuaugauuaaagua

SEQ ID NO: 352034 - RNA, 22 nt, Human
aacagacaacuccuguggcuca

SEQ ID NO: 352035 - RNA, 17 nt, Human
ggcagccucaggcguuu

SEQ ID NO: 352036 - RNA, 22 nt, Human
uccuggauucugcccugaaggc

SEQ ID NO: 352037 - RNA, 22 nt, Human
uuuuaaucaugcuucuaugucc

SEQ ID NO: 352038 - RNA, 22 nt, Human
aucauaaagugcuaucugauug

SEQ ID NO: 352039 - RNA, 22 nt, Human
ugguuuuagaugccuuuacugc

SEQ ID NO: 352040 - RNA, 19 nt, Human
cucugccucuggcuguggc

SEQ ID NO: 352041 - RNA, 22 nt, Human
ugcagcaggagccaggccuggu

SEQ ID NO: 352042 - RNA, 22 nt, Human
aauguguguauuucuaggcgag

SEQ ID NO: 352043 - RNA, 22 nt, Human
ggaggccaaggugggcggauca

SEQ ID NO: 352044 - RNA, 22 nt, Human
aacaugaaguuuucuauaguga

SEQ ID NO: 352045 - RNA, 18 nt, Human
ggaaaccacaggguucug

SEQ ID NO: 352046 - RNA, 22 nt, Human
acauugaugaaaagguaucauu

SEQ ID NO: 352047 - RNA, 22 nt, Human
gccugggaagacuaagugggag

SEQ ID NO: 352048 - RNA, 22 nt, Human
aaagccagguugugugcaggaa

SEQ ID NO: 352049 - RNA, 22 nt, Human
uuuucuaacaucuaguaauuug

SEQ ID NO: 352050 - RNA, 22 nt, Human
aaucuucuacuugacaguucuc

SEQ ID NO: 352051 - RNA, 22 nt, Human
cucugcagaggcccaaggcuga

SEQ ID NO: 352052 - RNA, 20 nt, Human
aagagcugacucacaguggu

SEQ ID NO: 352053 - RNA, 22 nt, Human
agguaaaauagauaguauuucu

SEQ ID NO: 352054 - RNA, 22 nt, Human
agggccaggaacaccugaaggg

SEQ ID NO: 352055 - RNA, 22 nt, Human
caagaauccuguucuugaagau

SEQ ID NO: 352056 - RNA, 18 nt, Human
ccauuucaugauuauuac

SEQ ID NO: 352057 - RNA, 22 nt, Human
agagggauggccccguaacuca

SEQ ID NO: 352058 - RNA, 22 nt, Human
ccuggcugggccugauuucuca

SEQ ID NO: 352059 - RNA, 22 nt, Human
ggcugcuggcauugagguaggu

SEQ ID NO: 352060 - RNA, 22 nt, Human
uuuauucugugcuacaugaaga

SEQ ID NO: 352061 - RNA, 22 nt, Human
cccaggcagaauuaguguuuca

SEQ ID NO: 352062 - RNA, 22 nt, Human
gggcaggaugcaguuucagaga

SEQ ID NO: 352063 - RNA, 22 nt, Human
gccaggcuggaaagaacagaca

SEQ ID NO: 352064 - RNA, 22 nt, Human
auguagcaugaggcacugugcc

SEQ ID NO: 352065 - RNA, 18 nt, Human
aggaagcaggaggaaggc

SEQ ID NO: 352066 - RNA, 22 nt, Human
agcacccucagccuuauccaga

SEQ ID NO: 352067 - RNA, 22 nt, Human
gggcgccgugggaaacagccgg

SEQ ID NO: 352068 - RNA, 22 nt, Human
uuuagggaagaagcccauggcc

SEQ ID NO: 352069 - RNA, 22 nt, Human
uggagcaggugccaggugugug

SEQ ID NO: 352070 - RNA, 22 nt, Human
guggguggaucaccugagguca

SEQ ID NO: 352071 - RNA, 16 nt, Human
ugggcagaugagaaga

SEQ ID NO: 352072 - RNA, 19 nt, Human
gggcagaauggcaucucag

SEQ ID NO: 352073 - RNA, 22 nt, Human
uccuauugguagacauuucugu

SEQ ID NO: 352074 - RNA, 22 nt, Human
uagcuuuaggaugguucucuug

SEQ ID NO: 352075 - RNA, 22 nt, Human
ucugccuuccccauaaucugau

SEQ ID NO: 352076 - RNA, 18 nt, Human
agcagcugugccacacug

SEQ ID NO: 352077 - RNA, 20 nt, Human
uacagaaacaggacuuuugg

SEQ ID NO: 352078 - RNA, 19 nt, Human
ccagcccugucacuucuug

SEQ ID NO: 352079 - RNA, 22 nt, Human
aagauuauggcagauaacaauu

SEQ ID NO: 352080 - RNA, 22 nt, Human
cuggucugagggcucuugaggc

SEQ ID NO: 352081 - RNA, 22 nt, Human
aagcaauauacugauaugauua

SEQ ID NO: 352082 - RNA, 22 nt, Human
aggacccugagcgggcaugccg

SEQ ID NO: 352083 - RNA, 22 nt, Human
ucuuugcaaauguuauuaucuu

SEQ ID NO: 352084 - RNA, 22 nt, Human
uggcagcugugcuucauucuuu

SEQ ID NO: 352085 - RNA, 22 nt, Human
gugugcaugcauagacaccaca

SEQ ID NO: 352086 - RNA, 22 nt, Human
ucuuugcuccacacucuagaga

SEQ ID NO: 352087 - RNA, 22 nt, Human
gagaaagacguaggcugggagg

SEQ ID NO: 352088 - RNA, 22 nt, Human
ugggacugcucuugcugggguc

SEQ ID NO: 352089 - RNA, 22 nt, Human
uagaggcauuaaugaauaaaca

SEQ ID NO: 352090 - RNA, 22 nt, Human
aagccuuccugagugcaaggcc

SEQ ID NO: 352091 - RNA, 22 nt, Human
aggcugagaaagugggaagaug

SEQ ID NO: 352092 - RNA, 22 nt, Human
aagcagaaaaacugagcuccaa

SEQ ID NO: 352093 - RNA, 22 nt, Human
agcucccagucuccucuccaug

SEQ ID NO: 352094 - RNA, 22 nt, Human
gaucuguuucauucacagucug

SEQ ID NO: 352095 - RNA, 22 nt, Human
ggcaugcucuuuguccacagua

SEQ ID NO: 352096 - RNA, 22 nt, Human
gcugcucuacccaugcaucugu

SEQ ID NO: 352097 - RNA, 22 nt, Human
cagcugagcaucacuagucugg

SEQ ID NO: 352098 - RNA, 22 nt, Human
agggacuauuuacccaucucac

SEQ ID NO: 352099 - RNA, 22 nt, Human
ggaccuggcaauuugcaucucu

SEQ ID NO: 352100 - RNA, 22 nt, Human
uuggcaggaauauugcagaggu

SEQ ID NO: 352101 - RNA, 21 nt, Human
ccagccucagaucagggagcu

SEQ ID NO: 352102 - RNA, 22 nt, Human
ucucaaacuaacaaugauuaua

SEQ ID NO: 352103 - RNA, 19 nt, Human
guuccaaaggccagaccuu

SEQ ID NO: 352104 - RNA, 22 nt, Human
aauuccaaauguuuucaaucca

SEQ ID NO: 352105 - RNA, 22 nt, Human
gagaaacuaacaucugaaggug

SEQ ID NO: 352106 - RNA, 22 nt, Human
guugacagcuggugagcugcua

SEQ ID NO: 352107 - RNA, 22 nt, Human
aggaccagaggccagagucagc

SEQ ID NO: 352108 - RNA, 19 nt, Human
gucagcaccauggacaggg

SEQ ID NO: 352109 - RNA, 22 nt, Human
cagaagcauugacuccuugcuc

SEQ ID NO: 352110 - RNA, 22 nt, Human
aggggcuguggaaaccaacucu

SEQ ID NO: 352111 - RNA, 22 nt, Human
ugccagcacuucuggcugucug

SEQ ID NO: 352112 - RNA, 22 nt, Human
uggggguguccuggugcacaca

SEQ ID NO: 352113 - RNA, 22 nt, Human
gugucacaagagcccaggaaac

SEQ ID NO: 352114 - RNA, 22 nt, Human
cagggccaccguguuugcugcu

SEQ ID NO: 352115 - RNA, 22 nt, Human
gucaugccagcggagcucggga

SEQ ID NO: 352116 - RNA, 19 nt, Human
caggaugaucccaugacac

SEQ ID NO: 352117 - RNA, 23 nt, Human
cauguacacacagcuguacagug

SEQ ID NO: 352118 - RNA, 22 nt, Human
gugcagcugugguggagccagg

SEQ ID NO: 352119 - RNA, 19 nt, Human
augagcuggcauuucaggu

SEQ ID NO: 352120 - RNA, 22 nt, Human
aaaagcagagacucuggagcua

SEQ ID NO: 352121 - RNA, 22 nt, Human
gggacuggaguagaggccggug

SEQ ID NO: 352122 - RNA, 22 nt, Human
uugcaaaagccgaggcacucca

SEQ ID NO: 352123 - RNA, 20 nt, Human
ccaccuggccaaggcugugc

SEQ ID NO: 352124 - RNA, 22 nt, Human
ucuuuggaucccaacuggcugg

SEQ ID NO: 352125 - RNA, 22 nt, Human
uccucccacauaggacaauggg

SEQ ID NO: 352126 - RNA, 22 nt, Human
gcagggaagaucuuggagcugc

SEQ ID NO: 352127 - RNA, 22 nt, Human
uucagaaaaaacuucaauaagu

SEQ ID NO: 352128 - RNA, 22 nt, Human
uuugacagcuuguuacaaaguu

SEQ ID NO: 352129 - RNA, 22 nt, Human
auaugcauuuaccuggcauaua

SEQ ID NO: 352130 - RNA, 22 nt, Human
ugaggcagguaagcaaguuuug

SEQ ID NO: 352131 - RNA, 22 nt, Human
ugcaaucucggcacuuugggag

SEQ ID NO: 352132 - RNA, 22 nt, Human
cuggcagguggauggggacucc

SEQ ID NO: 352133 - RNA, 22 nt, Human
uuucugugguggguaguucaga

SEQ ID NO: 352134 - RNA, 22 nt, Human
uaguggaggguguagcugcugg

SEQ ID NO: 352135 - RNA, 22 nt, Human
ugcagaagugagucaugaggaa

SEQ ID NO: 352136 - RNA, 19 nt, Human
ugggcuuccccagggcaga

SEQ ID NO: 352137 - RNA, 22 nt, Human
agaucauaugaaaaauuucaag

SEQ ID NO: 352138 - RNA, 22 nt, Human
auggccuuagugaugauuaaua

SEQ ID NO: 352139 - RNA, 22 nt, Human
acuuccugcaaucguccacucc

SEQ ID NO: 352140 - RNA, 22 nt, Human
acugggaggcaaagagcaagga

SEQ ID NO: 352141 - RNA, 22 nt, Human
ggagaaggugcuggucacugug

SEQ ID NO: 352142 - RNA, 22 nt, Human
uccauggggcccaggaugagag

SEQ ID NO: 352143 - RNA, 22 nt, Human
cugagcugggaguggauagugg

SEQ ID NO: 352144 - RNA, 22 nt, Human
uggcugaaucugcagcaggaag

SEQ ID NO: 352145 - RNA, 22 nt, Human
auuucuuuucaagagggugcuu

SEQ ID NO: 352146 - RNA, 22 nt, Human
ugccugcuaggcccugcugggu

SEQ ID NO: 352147 - RNA, 22 nt, Human
aauacaguagguaauaguucau

SEQ ID NO: 352148 - RNA, 22 nt, Human
accugcagccacuucucuccuu

SEQ ID NO: 352149 - RNA, 22 nt, Human
guccuggcccacuggcaggcug

SEQ ID NO: 352150 - RNA, 19 nt, Human
ugucucugaaagaugagcu

SEQ ID NO: 352151 - RNA, 22 nt, Human
aucuucaacuugaucauuugaa

SEQ ID NO: 352152 - RNA, 22 nt, Human
auggcagccuguggacagucaa

SEQ ID NO: 352153 - RNA, 22 nt, Human
ucugggcuugguuagggcuguu

SEQ ID NO: 352154 - RNA, 22 nt, Human
cuuauguaugcuacuuuguggu

SEQ ID NO: 352155 - RNA, 22 nt, Human
cagagugaaauaggggaucaag

SEQ ID NO: 352156 - RNA, 22 nt, Human
gaguccaguaguuaggacagag

SEQ ID NO: 352157 - RNA, 22 nt, Human
aggugcagcugguggagucugg

SEQ ID NO: 352158 - RNA, 22 nt, Human
uuccuuagccugccuuccaggg

SEQ ID NO: 352159 - RNA, 22 nt, Human
gggcugacaguuuccccugaaa

SEQ ID NO: 352160 - RNA, 18 nt, Human
uggcagagugucuguucu

SEQ ID NO: 352161 - RNA, 22 nt, Human
uggcagagagacucuccuugau

SEQ ID NO: 352162 - RNA, 22 nt, Human
aggagcagaccguaguccugca

SEQ ID NO: 352163 - RNA, 22 nt, Human
uugacagcuauuuugcuuugau

SEQ ID NO: 352164 - RNA, 22 nt, Human
gccagcagccacagaagucacu

SEQ ID NO: 352165 - RNA, 22 nt, Human
acuuguucauugaguacauaug

SEQ ID NO: 352166 - RNA, 22 nt, Human
gaaucucaguggaagcaggaag

SEQ ID NO: 352167 - RNA, 22 nt, Human
uguaaauaguuagcuugccucu

SEQ ID NO: 352168 - RNA, 22 nt, Human
uggcuauugagugaucucuaga

SEQ ID NO: 352169 - RNA, 22 nt, Human
ccagcagcuuuauuggcucucc

SEQ ID NO: 352170 - RNA, 22 nt, Human
aagauggaguaguguaaugguu

SEQ ID NO: 352171 - RNA, 22 nt, Human
uuuccuuugcccaauacauguc

SEQ ID NO: 352172 - RNA, 22 nt, Human
uaauuccaccuuuuuccaacuu

SEQ ID NO: 352173 - RNA, 22 nt, Human
ucccagccauuccuuuaggugu

SEQ ID NO: 352174 - RNA, 22 nt, Human
ggcagagcuugcagugagccga

SEQ ID NO: 352175 - RNA, 22 nt, Human
aggauuuauuauaugcccucau

SEQ ID NO: 352176 - RNA, 22 nt, Human
caggacagaaauaaggaauaua

SEQ ID NO: 352177 - RNA, 20 nt, Human
cccagagccauagccagaca

SEQ ID NO: 352178 - RNA, 22 nt, Human
gccgaagcugccgucugguccu

SEQ ID NO: 352179 - RNA, 22 nt, Human
cagcugcccauccugggaaaug

SEQ ID NO: 352180 - RNA, 22 nt, Human
cagggccaagccccuuuggcug

SEQ ID NO: 352181 - RNA, 22 nt, Human
uuuaaagagaaugugaaggagu

SEQ ID NO: 352182 - RNA, 22 nt, Human
ggcaguggcuccucucuacucc

SEQ ID NO: 352183 - RNA, 22 nt, Human
aaauccuaagcagaggaauuua

SEQ ID NO: 352184 - RNA, 22 nt, Human
gaaggucaccuccccucucugg

SEQ ID NO: 352185 - RNA, 22 nt, Human
agaaaugugaauuucauuuccu

SEQ ID NO: 352186 - RNA, 22 nt, Human
uuuccaaauaaggucacacuca

SEQ ID NO: 352187 - RNA, 22 nt, Human
uccauuuacuauucucauaucg

SEQ ID NO: 352188 - RNA, 22 nt, Human
uuuccucuucuggcaggcaggg

SEQ ID NO: 352189 - RNA, 22 nt, Human
uacaaaaguaauuacgguuuuu

SEQ ID NO: 352190 - RNA, 22 nt, Human
aaaaauagcuucucuugucccu

SEQ ID NO: 352191 - RNA, 22 nt, Human
aggcagaugggagcuggaaguu

SEQ ID NO: 352192 - RNA, 22 nt, Human
uggccugggccggcagauauac

SEQ ID NO: 352193 - RNA, 22 nt, Human
ucuucccuaaucaccaucuuca

SEQ ID NO: 352194 - RNA, 22 nt, Human
ggggcuggcucacuaagagacu

SEQ ID NO: 352195 - RNA, 22 nt, Human
ucauuuguugcuguuaccugag

SEQ ID NO: 352196 - RNA, 22 nt, Human
auggggcuguucucugcccugc

SEQ ID NO: 352197 - RNA, 22 nt, Human
auauuguugacuauaagaguaa

SEQ ID NO: 352198 - RNA, 22 nt, Human
cuguggcugcagccuugguccu

SEQ ID NO: 352199 - RNA, 22 nt, Human
uggagccagcccaggccccucu

SEQ ID NO: 352200 - RNA, 22 nt, Human
ccugggagugugccaucucugu

SEQ ID NO: 352201 - RNA, 22 nt, Human
gcugucacucaccaggccugca

SEQ ID NO: 352202 - RNA, 22 nt, Human
ugccaggcugaacagggucuua

SEQ ID NO: 352203 - RNA, 22 nt, Human
aggcagcugcccucuccuuccu

SEQ ID NO: 352204 - RNA, 22 nt, Human
agauaugacuagaagcucauuu

SEQ ID NO: 352205 - RNA, 18 nt, Human
uucaccagugugaugggu

SEQ ID NO: 352206 - RNA, 22 nt, Human
ucugccugccagucugguccuc

SEQ ID NO: 352207 - RNA, 22 nt, Human
cauugacaucaggcuuggccaa

SEQ ID NO: 352208 - RNA, 22 nt, Human
uuacaaguauuuaagaugcugu

SEQ ID NO: 352209 - RNA, 22 nt, Human
ugcacuccaggcugggugacag

SEQ ID NO: 352210 - RNA, 22 nt, Human
agagaagacuuacagccacagu

SEQ ID NO: 352211 - RNA, 22 nt, Human
gcugauguaagacuuuugguuu

SEQ ID NO: 352212 - RNA, 22 nt, Human
acagggucaagggugcuacaag

SEQ ID NO: 352213 - RNA, 23 nt, Human
gcagauggccccagagugcugcc

SEQ ID NO: 352214 - RNA, 22 nt, Human
uaguggagaguuguuuugugca

SEQ ID NO: 352215 - RNA, 22 nt, Human
ugugcagcuaguccuggacuug

SEQ ID NO: 352216 - RNA, 22 nt, Human
guaacagaggguuugcagauau

SEQ ID NO: 352217 - RNA, 22 nt, Human
uuugcauuuguucaaguauuga

SEQ ID NO: 352218 - RNA, 22 nt, Human
uauuucaacguaugaaaagcug

SEQ ID NO: 352219 - RNA, 20 nt, Human
auugucagccuucagaggag

SEQ ID NO: 352220 - RNA, 22 nt, Human
gagauggggucagcugggacau

SEQ ID NO: 352221 - RNA, 22 nt, Human
ccugcaguuuguugugaccccg

SEQ ID NO: 352222 - RNA, 22 nt, Human
aacuucuugguccugagcuguu

SEQ ID NO: 352223 - RNA, 23 nt, Human
acuuuauugaccccaggucaguu

SEQ ID NO: 352224 - RNA, 23 nt, Human
aggagccaggugcagcccuugug

SEQ ID NO: 352225 - RNA, 22 nt, Human
cacuguguaagaagaugggcuu

SEQ ID NO: 352226 - RNA, 22 nt, Human
aggcacugaauauccaguaaaa

SEQ ID NO: 352227 - RNA, 22 nt, Human
uggaagagggagcuggguggcc

SEQ ID NO: 352228 - RNA, 22 nt, Human
gcagccccaggagacgcccagg

SEQ ID NO: 352229 - RNA, 19 nt, Human
uggaagaggaagggaaaua

SEQ ID NO: 352230 - RNA, 22 nt, Human
aggaccugagaguuggaaaucc

SEQ ID NO: 352231 - RNA, 22 nt, Human
gugccagggaguggaggagcuu

SEQ ID NO: 352232 - RNA, 22 nt, Human
aucaguuuugggggacauacug

SEQ ID NO: 352233 - RNA, 22 nt, Human
cuaggaggcgggggcugcagua

SEQ ID NO: 352234 - RNA, 22 nt, Human
uuuccaaagguggcaggaacaa

SEQ ID NO: 352235 - RNA, 22 nt, Human
caaaaugugagucccaccucaa

SEQ ID NO: 352236 - RNA, 18 nt, Human
ccugcagcccaggaggcc

SEQ ID NO: 352237 - RNA, 22 nt, Human
ccucagcugcuucccuggagcc

SEQ ID NO: 352238 - RNA, 22 nt, Human
uggagaagauuggucaccauuc

SEQ ID NO: 352239 - RNA, 21 nt, Human
aaagaaucauggguaauuuca

SEQ ID NO: 352240 - RNA, 22 nt, Human
aagauuuccuucaguagagcua

SEQ ID NO: 352241 - RNA, 22 nt, Human
uucaacuauuaugaauaaaauu

SEQ ID NO: 352242 - RNA, 22 nt, Human
ggccaggcuggucucagacuuc

SEQ ID NO: 352243 - RNA, 22 nt, Human
uuuugcuuuuguaacacagugu

SEQ ID NO: 352244 - RNA, 22 nt, Human
gcugucugucucugugacuuaa

SEQ ID NO: 352245 - RNA, 19 nt, Human
acuuugcaugugugucuaa

SEQ ID NO: 352246 - RNA, 22 nt, Human
gcugcugucacggugcuaaggg

SEQ ID NO: 352247 - RNA, 22 nt, Human
agggcuagaguugagaugggga

SEQ ID NO: 352248 - RNA, 22 nt, Human
ucucucagaggaagaggcagug

SEQ ID NO: 352249 - RNA, 22 nt, Human
gagggcugauaaaugcgcaugg

SEQ ID NO: 352250 - RNA, 22 nt, Human
gcucaggagcugacagccucaa

SEQ ID NO: 352251 - RNA, 22 nt, Human
uaguuaggaauagcagcgacuc

SEQ ID NO: 352252 - RNA, 21 nt, Human
auuuucauuaauucagugugg

SEQ ID NO: 352253 - RNA, 19 nt, Human
agggaguuuauauuugcac

SEQ ID NO: 352254 - RNA, 22 nt, Human
gccagacacuccccugggcagg

SEQ ID NO: 352255 - RNA, 23 nt, Human
cugaggccugcugcguucagguu

SEQ ID NO: 352256 - RNA, 22 nt, Human
ugauuucauaguauauacauga

SEQ ID NO: 352257 - RNA, 22 nt, Human
uacuguuuuuuagacucauggu

SEQ ID NO: 352258 - RNA, 22 nt, Human
uuugaagacagaucaauauaag

SEQ ID NO: 352259 - RNA, 22 nt, Human
cagaaugcaaauuuuauaauau

SEQ ID NO: 352260 - RNA, 22 nt, Human
aucuauacucagaguuaauauc

SEQ ID NO: 352261 - RNA, 22 nt, Human
cuggcagcucuacucagagccu

SEQ ID NO: 352262 - RNA, 22 nt, Human
guccucugaaguugugcaaugc

SEQ ID NO: 352263 - RNA, 22 nt, Human
guaguucugcagugucaccuga

SEQ ID NO: 352264 - RNA, 19 nt, Human
cagcugccuuuucuuugca

SEQ ID NO: 352265 - RNA, 22 nt, Human
gcuggagcugaguucccugggc

SEQ ID NO: 352266 - RNA, 22 nt, Human
caggcagggagcuggaaaggau

SEQ ID NO: 352267 - RNA, 22 nt, Human
guucuucaggcugugcucuaga

SEQ ID NO: 352268 - RNA, 22 nt, Human
gggcaguggcucacgccuguaa

SEQ ID NO: 352269 - RNA, 22 nt, Human
uccucugccaaagggaguugcc

SEQ ID NO: 352270 - RNA, 22 nt, Human
ugcucacugaacucuugcuguc

SEQ ID NO: 352271 - RNA, 22 nt, Human
gcaggagucacugacuuggucc

SEQ ID NO: 352272 - RNA, 22 nt, Human
aacuggauuaacuggcucaaau

SEQ ID NO: 352273 - RNA, 22 nt, Human
cucugggcaccaaagagcagcu

SEQ ID NO: 352274 - RNA, 22 nt, Human
uguuccaugucuuuguaggacu

SEQ ID NO: 352275 - RNA, 22 nt, Human
acauuucugucuuagggacugu

SEQ ID NO: 352276 - RNA, 22 nt, Human
uccuucagcuacucaguuucca

SEQ ID NO: 352277 - RNA, 21 nt, Human
aggugcaggccucaagcccca

SEQ ID NO: 352278 - RNA, 22 nt, Human
cagggccacacggaagggaaca

SEQ ID NO: 352279 - RNA, 21 nt, Human
gcaggaugcaucuuggugucu

SEQ ID NO: 352280 - RNA, 22 nt, Human
ucagcaaugugauacugugcaa

SEQ ID NO: 352281 - RNA, 22 nt, Human
gccucugcggggcccgagcccg

SEQ ID NO: 352282 - RNA, 22 nt, Human
agcagccagaaagggcagucga

SEQ ID NO: 352283 - RNA, 22 nt, Human
gggccuggcaugcagccccguu

SEQ ID NO: 352284 - RNA, 22 nt, Human
agaguggagagaaacaacucug

SEQ ID NO: 352285 - RNA, 22 nt, Human
agcucccaauugacuugaacua

SEQ ID NO: 352286 - RNA, 22 nt, Human
uccaaacacccuccaugcugca

SEQ ID NO: 352287 - RNA, 22 nt, Human
ggugggcaggcgaggcccaggu

SEQ ID NO: 352288 - RNA, 22 nt, Human
cugacccauauaagaguggagg

SEQ ID NO: 352289 - RNA, 22 nt, Human
aaggcagccucugccagccggg

SEQ ID NO: 352290 - RNA, 22 nt, Human
uuuagaaugugacuguauuuga

SEQ ID NO: 352291 - RNA, 21 nt, Human
caauuucaugggaagauggga

SEQ ID NO: 352292 - RNA, 22 nt, Human
uuaagaauggaaugaggaauuu

SEQ ID NO: 352293 - RNA, 22 nt, Human
caaggcaguuccccagagggcu

SEQ ID NO: 352294 - RNA, 22 nt, Human
aagcgccacgagaagcuggacc

SEQ ID NO: 352295 - RNA, 22 nt, Human
agccaaggacacggagccuccu

SEQ ID NO: 352296 - RNA, 20 nt, Human
caggaugauuggacacgaug

SEQ ID NO: 352297 - RNA, 22 nt, Human
auuuccagacuuuuuccaggaa

SEQ ID NO: 352298 - RNA, 22 nt, Human
ggaagaagggucauuggcagcc

SEQ ID NO: 352299 - RNA, 23 nt, Human
ugcucugugaauaguuggugacu

SEQ ID NO: 352300 - RNA, 22 nt, Human
ggccugucucacccccgggugc

SEQ ID NO: 352301 - RNA, 20 nt, Human
accauaauguuaauuacaaa

SEQ ID NO: 352302 - RNA, 22 nt, Human
acauuaucccuggcacaacugc

SEQ ID NO: 352303 - RNA, 22 nt, Human
uaugcccagcuuaaaguacaca

SEQ ID NO: 352304 - RNA, 22 nt, Human
ugggcugcagagcccggccuuc

SEQ ID NO: 352305 - RNA, 22 nt, Human
aggcagcugugaggacuggauu

SEQ ID NO: 352306 - RNA, 23 nt, Human
uggagcugacagucagagggagg

SEQ ID NO: 352307 - RNA, 22 nt, Human
uggagggcaucuguggucaggc

SEQ ID NO: 352308 - RNA, 22 nt, Human
agcugccuguccuaggccauca

SEQ ID NO: 352309 - RNA, 22 nt, Human
ucacacacauggauaguauuuu

SEQ ID NO: 352310 - RNA, 22 nt, Human
aagucagagcaacugagacauu

SEQ ID NO: 352311 - RNA, 22 nt, Human
gaaagccagagagaaagggcuc

SEQ ID NO: 352312 - RNA, 22 nt, Human
ggaagccacccagcuuugauag

SEQ ID NO: 352313 - RNA, 22 nt, Human
ucaauuaugccauugcaauauu

SEQ ID NO: 352314 - RNA, 22 nt, Human
auacaaguugugauaauguaaa

SEQ ID NO: 352315 - RNA, 22 nt, Human
uuuaaagaaauuccucaucuuu

SEQ ID NO: 352316 - RNA, 22 nt, Human
ccaggccugauugggaaucuug

SEQ ID NO: 352317 - RNA, 21 nt, Human
uagcuuuaauauucccacauu

SEQ ID NO: 352318 - RNA, 22 nt, Human
uggugcugauaauggcaggauu

SEQ ID NO: 352319 - RNA, 22 nt, Human
ggggcccagcaccccuccucgc

SEQ ID NO: 352320 - RNA, 22 nt, Human
auuccaaaaggauguuagaaug

SEQ ID NO: 352321 - RNA, 19 nt, Human
aguagcagaaagugcagug

SEQ ID NO: 352322 - RNA, 22 nt, Human
caggaggaacaagagguucugg

SEQ ID NO: 352323 - RNA, 22 nt, Human
aguggcaguggggcagggcccu

SEQ ID NO: 352324 - RNA, 22 nt, Human
acagugugguuugagcacuggg

SEQ ID NO: 352325 - RNA, 22 nt, Human
ggaggagacggagugauuagug

SEQ ID NO: 352326 - RNA, 22 nt, Human
gauauuuugagaaauccuauga

SEQ ID NO: 352327 - RNA, 22 nt, Human
cagcauggcuugaguguuuccu

SEQ ID NO: 352328 - RNA, 22 nt, Human
ucugagaguacgggcugcgcgc

SEQ ID NO: 352329 - RNA, 22 nt, Human
aagcuuuaagugucagucagcc

SEQ ID NO: 352330 - RNA, 22 nt, Human
uagaaaguaaaucaguuuuauu

SEQ ID NO: 352331 - RNA, 22 nt, Human
uccuggaguauuucuguggugu

SEQ ID NO: 352332 - RNA, 22 nt, Human
gcaggaagcauagaagaaugcc

SEQ ID NO: 352333 - RNA, 22 nt, Human
cugaggcugcccagggccaggu

SEQ ID NO: 352334 - RNA, 22 nt, Human
cugccucaugcugccugcagcc

SEQ ID NO: 352335 - RNA, 22 nt, Human
acacuguguggucucucucgga

SEQ ID NO: 352336 - RNA, 21 nt, Human
aggagcuguguuagcuggucg

SEQ ID NO: 352337 - RNA, 17 nt, Human
aggugcuggagcaucag

SEQ ID NO: 352338 - RNA, 22 nt, Human
gaggcccaggucaagcagccac

SEQ ID NO: 352339 - RNA, 22 nt, Human
gaagaaucugaggacagucauu

SEQ ID NO: 352340 - RNA, 16 nt, Human
gaggcuggcagauguc

SEQ ID NO: 352341 - RNA, 22 nt, Human
uucucagagcacugcugacaaa

SEQ ID NO: 352342 - RNA, 22 nt, Human
gcuggugagcaaaggagaagga

SEQ ID NO: 352343 - RNA, 22 nt, Human
augcacaagcaagagauaaugg

SEQ ID NO: 352344 - RNA, 22 nt, Human
uggcagagaugaagaguuguuu

SEQ ID NO: 352345 - RNA, 22 nt, Human
uuacucagucucccauacauug

SEQ ID NO: 352346 - RNA, 22 nt, Human
agucagcagugaaagcacagcc

SEQ ID NO: 352347 - RNA, 22 nt, Human
aggcacugaagugguaaaugua

SEQ ID NO: 352348 - RNA, 22 nt, Human
uagagcuauuuagagcauuuua

SEQ ID NO: 352349 - RNA, 22 nt, Human
ggcagcuccuccuagucugccc

SEQ ID NO: 352350 - RNA, 22 nt, Human
cagcauggggaucacuguaggc

SEQ ID NO: 352351 - RNA, 22 nt, Human
gagccagguuugaaucucaguc

SEQ ID NO: 352352 - RNA, 22 nt, Human
agggcugcaggcaagauauggc

SEQ ID NO: 352353 - RNA, 22 nt, Human
agaggucauaucucagaagaga

SEQ ID NO: 352354 - RNA, 22 nt, Human
acuuuugguucuguaacuguga

SEQ ID NO: 352355 - RNA, 22 nt, Human
cccuggagugccggaaucaaga

SEQ ID NO: 352356 - RNA, 22 nt, Human
cugcccuguggcucugagucau

SEQ ID NO: 352357 - RNA, 22 nt, Human
cugccuggaaggagcaagggga

SEQ ID NO: 352358 - RNA, 22 nt, Human
agccaggccuuagggagaggca

SEQ ID NO: 352359 - RNA, 22 nt, Human
agcagagcuauucuugugcaau

SEQ ID NO: 352360 - RNA, 22 nt, Human
agugugagccuacaggccaaag

SEQ ID NO: 352361 - RNA, 22 nt, Human
augugcuucauucuacaugaca

SEQ ID NO: 352362 - RNA, 22 nt, Human
aagggcuggaucucucugagca

SEQ ID NO: 352363 - RNA, 21 nt, Human
aaucauacaaaacaugucagg

SEQ ID NO: 352364 - RNA, 19 nt, Human
gaggucagcaagaaguauu

SEQ ID NO: 352365 - RNA, 20 nt, Human
caggccagagguuugauggc

SEQ ID NO: 352366 - RNA, 22 nt, Human
aaaggucauugaaaaggaggaa

SEQ ID NO: 352367 - RNA, 22 nt, Human
gggccucucccuucucacgcau

SEQ ID NO: 352368 - RNA, 22 nt, Human
cuuagcaugugguguccuugua

SEQ ID NO: 352369 - RNA, 22 nt, Human
cccaggaacagcacagaacagc

SEQ ID NO: 352370 - RNA, 22 nt, Human
gccugucaauuuuguguacaau

SEQ ID NO: 352371 - RNA, 18 nt, Human
acauuucucucugcguga

SEQ ID NO: 352372 - RNA, 22 nt, Human
aagggcucacccaacucacuuc

SEQ ID NO: 352373 - RNA, 22 nt, Human
cuagggaguggcagagcuggga

SEQ ID NO: 352374 - RNA, 20 nt, Human
uccaggagaacugggagccg

SEQ ID NO: 352375 - RNA, 22 nt, Human
ugggaccucucuugagagagca

SEQ ID NO: 352376 - RNA, 22 nt, Human
gacaugcaugaaugcaggucuc

SEQ ID NO: 352377 - RNA, 22 nt, Human
uuugaacuucuaccugucauau

SEQ ID NO: 352378 - RNA, 22 nt, Human
agugaguggacccugcaaggaa

SEQ ID NO: 352379 - RNA, 22 nt, Human
aggaggaggugggacacaguga

SEQ ID NO: 352380 - RNA, 22 nt, Human
uaggcagcuuagguuagaagug

SEQ ID NO: 352381 - RNA, 23 nt, Human
ucccuggaggcagguccagggcc

SEQ ID NO: 352382 - RNA, 19 nt, Human
ugaagcaauaccauuuuug

SEQ ID NO: 352383 - RNA, 22 nt, Human
ucaguuuuucuauacuuuguag

SEQ ID NO: 352384 - RNA, 22 nt, Human
ccagcuucucucugaugcagcu

SEQ ID NO: 352385 - RNA, 22 nt, Human
gccuggagcucuccacuugggg

SEQ ID NO: 352386 - RNA, 22 nt, Human
aagagccagugggaaagucuug

SEQ ID NO: 352387 - RNA, 22 nt, Human
cauaccuuucucaagcacaugu

SEQ ID NO: 352388 - RNA, 22 nt, Human
gucaccagugcuaagaggugga

SEQ ID NO: 352389 - RNA, 22 nt, Human
ggguuccuccaguuccuagagc

SEQ ID NO: 352390 - RNA, 22 nt, Human
acuuccugcuaugagcuucugu

SEQ ID NO: 352391 - RNA, 21 nt, Human
ucucugggaggacuugugaga

SEQ ID NO: 352392 - RNA, 22 nt, Human
ccuuccaggugcaggcaagccu

SEQ ID NO: 352393 - RNA, 22 nt, Human
guuuucauuacugcugugauuu

SEQ ID NO: 352394 - RNA, 22 nt, Human
agagagggcauagaaaaaggga

SEQ ID NO: 352395 - RNA, 22 nt, Human
uggcuucagacuucugcuacgu

SEQ ID NO: 352396 - RNA, 22 nt, Human
aagggcagggaguuugugucua

SEQ ID NO: 352397 - RNA, 22 nt, Human
cccagccaaggugcugguguug

SEQ ID NO: 352398 - RNA, 22 nt, Human
acagggucauuuuaugaucugu

SEQ ID NO: 352399 - RNA, 22 nt, Human
aggcaggggagcuggaagggua

SEQ ID NO: 352400 - RNA, 22 nt, Human
uuuaaauaggacuccugggggu

SEQ ID NO: 352401 - RNA, 22 nt, Human
ccaguggaguuuuuauacccag

SEQ ID NO: 352402 - RNA, 22 nt, Human
aaugaacacagcccucuacuuu

SEQ ID NO: 352403 - RNA, 22 nt, Human
uggcagagacuccuccugggag

SEQ ID NO: 352404 - RNA, 22 nt, Human
aaaaaugugaccacaggguguu

SEQ ID NO: 352405 - RNA, 22 nt, Human
cuggauuuuagaaggcuuccua

SEQ ID NO: 352406 - RNA, 22 nt, Human
uucuaugccauguucagcuacu

SEQ ID NO: 352407 - RNA, 22 nt, Human
uucuccagagggcucugcagga

SEQ ID NO: 352408 - RNA, 18 nt, Human
cucaccauucugcccaau

SEQ ID NO: 352409 - RNA, 22 nt, Human
ugucucugaggugagggucagc

SEQ ID NO: 352410 - RNA, 22 nt, Human
ucagccagcaucagcuaagugc

SEQ ID NO: 352411 - RNA, 22 nt, Human
ucagaagccggaagugcuccuc

SEQ ID NO: 352412 - RNA, 22 nt, Human
ggcuggcacugaggagagcucu

SEQ ID NO: 352413 - RNA, 22 nt, Human
ggccuggaaugcuuuccuacca

SEQ ID NO: 352414 - RNA, 22 nt, Human
uggaaggagacugggaagugug

SEQ ID NO: 352415 - RNA, 22 nt, Human
uggcaccugaacuuagaggugu

SEQ ID NO: 352416 - RNA, 17 nt, Human
agagggaaaaugcgguu

SEQ ID NO: 352417 - RNA, 22 nt, Human
aggcaggaaaaucgcuugaacc

SEQ ID NO: 352418 - RNA, 22 nt, Human
aagauucucagagugaaagaau

SEQ ID NO: 352419 - RNA, 22 nt, Human
cugaggcaugaaugugggcuuu

SEQ ID NO: 352420 - RNA, 22 nt, Human
cuggccuucagacucggacuga

SEQ ID NO: 352421 - RNA, 18 nt, Human
gucaccuggaucagauua

SEQ ID NO: 352422 - RNA, 22 nt, Human
aaguguauauaugacuuauaaa

SEQ ID NO: 352423 - RNA, 22 nt, Human
cugggguggugcaggccucaug

SEQ ID NO: 352424 - RNA, 22 nt, Human
agcacaauagagcaguuaaaaa

SEQ ID NO: 352425 - RNA, 22 nt, Human
aaagauucgagcgauguauaaa

SEQ ID NO: 352426 - RNA, 22 nt, Human
aucaggaugcugucaguuacca

SEQ ID NO: 352427 - RNA, 22 nt, Human
uggacaggaucugagacugaga

SEQ ID NO: 352428 - RNA, 22 nt, Human
ugaaggccagcagagugaaggc

SEQ ID NO: 352429 - RNA, 22 nt, Human
aaaugguguuucuaaugcuaga

SEQ ID NO: 352430 - RNA, 22 nt, Human
gcagugcugaucccauggcaga

SEQ ID NO: 352431 - RNA, 22 nt, Human
gagcaggcauucuaguggcuga

SEQ ID NO: 352432 - RNA, 22 nt, Human
agccagcuggagaccacuguuu

SEQ ID NO: 352433 - RNA, 22 nt, Human
cugucucucuaggacacugggg

SEQ ID NO: 352434 - RNA, 20 nt, Human
agagcagcaguuggugaggu

SEQ ID NO: 352435 - RNA, 22 nt, Human
gcucuguguccacagcuggaaa

SEQ ID NO: 352436 - RNA, 22 nt, Human
ucuucaucucagauuaacagga

SEQ ID NO: 352437 - RNA, 22 nt, Human
aggguggccaugagggagagau

SEQ ID NO: 352438 - RNA, 22 nt, Human
cuguguggacugguugaggccc

SEQ ID NO: 352439 - RNA, 22 nt, Human
gcuggguggaucggaggcucug

SEQ ID NO: 352440 - RNA, 22 nt, Human
agcuugccucuuaaucaccuca

SEQ ID NO: 352441 - RNA, 22 nt, Human
agcaccaugaccuugccauuga

SEQ ID NO: 352442 - RNA, 22 nt, Human
ggcagggugccuggcuccuguu

SEQ ID NO: 352443 - RNA, 22 nt, Human
uuauuccauuauuucacuuagg

SEQ ID NO: 352444 - RNA, 18 nt, Human
cagucccaaaccuuagga

SEQ ID NO: 352445 - RNA, 22 nt, Human
gacccuguuucuacaaauaauu

SEQ ID NO: 352446 - RNA, 21 nt, Human
gcccagcaaggugagaaggcc

SEQ ID NO: 352447 - RNA, 22 nt, Human
auccaugaucaauuuauuacua

SEQ ID NO: 352448 - RNA, 22 nt, Human
aaggcacuguacuaguuaguua

SEQ ID NO: 352449 - RNA, 22 nt, Human
agccuucacugggaccuuggau

SEQ ID NO: 352450 - RNA, 22 nt, Human
ccaaagucuggagcagcagagc

SEQ ID NO: 352451 - RNA, 23 nt, Human
ggccauuucauuugguucaaacu

SEQ ID NO: 352452 - RNA, 23 nt, Human
uuuaacuuuccaauaauucauug

SEQ ID NO: 352453 - RNA, 22 nt, Human
auucuucauaccuacugagguu

SEQ ID NO: 352454 - RNA, 22 nt, Human
gcuucauuacugacagucugug

SEQ ID NO: 352455 - RNA, 22 nt, Human
cacccagcauuggcuaagagag

SEQ ID NO: 352456 - RNA, 22 nt, Human
agaggggaguccuaaucugauu

SEQ ID NO: 352457 - RNA, 22 nt, Human
agcuggaggauaacucacuucu

SEQ ID NO: 352458 - RNA, 19 nt, Human
aggcucugagcuccuggag

SEQ ID NO: 352459 - RNA, 22 nt, Human
acaaaugugucuaauugugccu

SEQ ID NO: 352460 - RNA, 22 nt, Human
uuaacauuucuuuuccacucau

SEQ ID NO: 352461 - RNA, 21 nt, Human
acagaguaguugaaacagaga

SEQ ID NO: 352462 - RNA, 22 nt, Human
guuauauauaguauuucucuga

SEQ ID NO: 352463 - RNA, 22 nt, Human
uccucuggggcgugguccugga

SEQ ID NO: 352464 - RNA, 22 nt, Human
aggcagugcucaagacagcagc

SEQ ID NO: 352465 - RNA, 22 nt, Human
uccucaggaugugggguagaau

SEQ ID NO: 352466 - RNA, 18 nt, Human
ugaggcagucagugaugg

SEQ ID NO: 352467 - RNA, 22 nt, Human
cuacauggagaagaaaauucuu

SEQ ID NO: 352468 - RNA, 22 nt, Human
cuuucauuugauaagaaugcca

SEQ ID NO: 352469 - RNA, 22 nt, Human
ccagcaggcagucauauccuuu

SEQ ID NO: 352470 - RNA, 21 nt, Human
cacuauuuauauaugccagcu

SEQ ID NO: 352471 - RNA, 22 nt, Human
uucuuguauguaugcaaaauca

SEQ ID NO: 352472 - RNA, 22 nt, Human
aggcugagccacggggcuggcu

SEQ ID NO: 352473 - RNA, 22 nt, Human
agaucugaccuaaccccaccac

SEQ ID NO: 352474 - RNA, 18 nt, Human
guccugagcucugcugua

SEQ ID NO: 352475 - RNA, 22 nt, Human
uacaguaaccagucuacuuaga

SEQ ID NO: 352476 - RNA, 20 nt, Human
agaaaucagaccacacacua

SEQ ID NO: 352477 - RNA, 21 nt, Human
uuagaagcuaaugcagcuggu

SEQ ID NO: 352478 - RNA, 22 nt, Human
uagaaguuaaaggaauacagaa

SEQ ID NO: 352479 - RNA, 22 nt, Human
caguccuggggaccaggcugag

SEQ ID NO: 352480 - RNA, 22 nt, Human
ggggccuguagagcuucaggga

SEQ ID NO: 352481 - RNA, 22 nt, Human
cuggccugagaaugcuacccuu

SEQ ID NO: 352482 - RNA, 22 nt, Human
gcagggucuugagaggcagcca

SEQ ID NO: 352483 - RNA, 22 nt, Human
ccagcuuuuccucucauugcuu

SEQ ID NO: 352484 - RNA, 22 nt, Human
caggugaccuuuguccuaaguu

SEQ ID NO: 352485 - RNA, 22 nt, Human
ccagaagaccccguccaccucc

SEQ ID NO: 352486 - RNA, 22 nt, Human
cagcuggguuuaguggggugug

SEQ ID NO: 352487 - RNA, 22 nt, Human
acaggcugccuaccaaguauca

SEQ ID NO: 352488 - RNA, 22 nt, Human
ggcugccuugacccuggcuccg

SEQ ID NO: 352489 - RNA, 22 nt, Human
ucaguaaacagguuuaaguccu

SEQ ID NO: 352490 - RNA, 22 nt, Human
uggcagaaguucacuaguagcu

SEQ ID NO: 352491 - RNA, 22 nt, Human
gcagaggauagcauaugaaccu

SEQ ID NO: 352492 - RNA, 23 nt, Human
ccuggcagcaaacgaggagguua

SEQ ID NO: 352493 - RNA, 22 nt, Human
gggcuggugaggcugcccugca

SEQ ID NO: 352494 - RNA, 22 nt, Human
ccugcagcuccggauuucuggg

SEQ ID NO: 352495 - RNA, 22 nt, Human
ucucagaggugcccuggcaucu

SEQ ID NO: 352496 - RNA, 22 nt, Human
uguaugcagggcuuguaugcag

SEQ ID NO: 352497 - RNA, 22 nt, Human
acuccagggcuccaucccuugu

SEQ ID NO: 352498 - RNA, 21 nt, Human
cccaagggaggcaggauaagg

SEQ ID NO: 352499 - RNA, 22 nt, Human
acagaauucuaguauguggcuu

SEQ ID NO: 352500 - RNA, 22 nt, Human
cagagccauuauggagacuugc

SEQ ID NO: 352501 - RNA, 22 nt, Human
ccucagaugucuuaaggcacug

SEQ ID NO: 352502 - RNA, 20 nt, Human
cuuugccuauucucugccug

SEQ ID NO: 352503 - RNA, 22 nt, Human
ucuucagacccuuagcugugau

SEQ ID NO: 352504 - RNA, 22 nt, Human
cauuuguagcuauuuacuguau

SEQ ID NO: 352505 - RNA, 22 nt, Human
gugaacuauuggguaucauaaa

SEQ ID NO: 352506 - RNA, 22 nt, Human
ggcuccuggggaggugagcuug

SEQ ID NO: 352507 - RNA, 22 nt, Human
uguaauauuguagugacaguac

SEQ ID NO: 352508 - RNA, 22 nt, Human
aagacagagggaagcaaugaug

SEQ ID NO: 352509 - RNA, 21 nt, Human
ucaggcagugcaaauacaugg

SEQ ID NO: 352510 - RNA, 23 nt, Human
cuagggcaguauuucacagacac

SEQ ID NO: 352511 - RNA, 22 nt, Human
aucuaacacuguaaacugucuu

SEQ ID NO: 352512 - RNA, 22 nt, Human
ccugcagguccccggaugcgca

SEQ ID NO: 352513 - RNA, 22 nt, Human
aagcuggaacaucuugaggaag

SEQ ID NO: 352514 - RNA, 22 nt, Human
ugggcuccuugggagcaaguga

SEQ ID NO: 352515 - RNA, 22 nt, Human
auuuccagcagcauauuugucu

SEQ ID NO: 352516 - RNA, 22 nt, Human
gcugcugugccuggcguccugu

SEQ ID NO: 352517 - RNA, 22 nt, Human
uaauuucaauagcuugcauaau

SEQ ID NO: 352518 - RNA, 22 nt, Human
uuuauuguuguuagucauaagu

SEQ ID NO: 352519 - RNA, 22 nt, Human
ucagagugguagccuauuuucu

SEQ ID NO: 352520 - RNA, 22 nt, Human
uccugcagagucccacugauuu

SEQ ID NO: 352521 - RNA, 22 nt, Human
gcaucuucacacaaagccagug

SEQ ID NO: 352522 - RNA, 22 nt, Human
aaauuuaagaagugugugcgug

SEQ ID NO: 352523 - RNA, 22 nt, Human
agcccuccucacaucagcgucc

SEQ ID NO: 352524 - RNA, 22 nt, Human
cugccagcucaaagcgcagcua

SEQ ID NO: 352525 - RNA, 22 nt, Human
cuggccagcugacagcagggcu

SEQ ID NO: 352526 - RNA, 22 nt, Human
gugggaugcaguggugaguggc

SEQ ID NO: 352527 - RNA, 22 nt, Human
cccagcuugcgggcggcaggag

SEQ ID NO: 352528 - RNA, 23 nt, Human
auauuagggagauuagcccucua

SEQ ID NO: 352529 - RNA, 22 nt, Human
ggcucaggggccaggccugucc

SEQ ID NO: 352530 - RNA, 22 nt, Human
gcauggcaaauaucgagggcag

SEQ ID NO: 352531 - RNA, 23 nt, Human
gggggcugguugacucucugcag

SEQ ID NO: 352532 - RNA, 22 nt, Human
gucucagaccacccucuuuggc

SEQ ID NO: 352533 - RNA, 22 nt, Human
agggagaaugaccaagguauau

SEQ ID NO: 352534 - RNA, 22 nt, Human
gcuggccugaccugaggcuggg

SEQ ID NO: 352535 - RNA, 20 nt, Human
gggcagcuccccucauucug

SEQ ID NO: 352536 - RNA, 22 nt, Human
agaaaucucaguaucucaggga

SEQ ID NO: 352537 - RNA, 22 nt, Human
aagcacuuagaagagugccugc

SEQ ID NO: 352538 - RNA, 22 nt, Human
gcuguccagagcaugggagcaa

SEQ ID NO: 352539 - RNA, 22 nt, Human
aaguucuacuguggguaaaaug

SEQ ID NO: 352540 - RNA, 22 nt, Human
uggcaggagguuuucuccagga

SEQ ID NO: 352541 - RNA, 22 nt, Human
ugccugccaugcagaaagcuga

SEQ ID NO: 352542 - RNA, 22 nt, Human
cugaaggaagcagguggccugu

SEQ ID NO: 352543 - RNA, 22 nt, Human
aggcuggcgacaucuggcgggc

SEQ ID NO: 352544 - RNA, 22 nt, Human
auucaguucuaaggucagugcc

SEQ ID NO: 352545 - RNA, 22 nt, Human
cagccaggagccucugcaacua

SEQ ID NO: 352546 - RNA, 22 nt, Human
cccuggagggacagcugcucua

SEQ ID NO: 352547 - RNA, 22 nt, Human
cacugcagaucagaggcugaga

SEQ ID NO: 352548 - RNA, 22 nt, Human
aaauacagauuccagggucuua

SEQ ID NO: 352549 - RNA, 22 nt, Human
caguggcuguuucuggaaggca

SEQ ID NO: 352550 - RNA, 22 nt, Human
aggcacugacaauucuggacug

SEQ ID NO: 352551 - RNA, 22 nt, Human
ucuuuguaacugucuauugaga

SEQ ID NO: 352552 - RNA, 18 nt, Human
gcccugguggagcuggug

SEQ ID NO: 352553 - RNA, 22 nt, Human
agucugucuacuuaaagucugu

SEQ ID NO: 352554 - RNA, 22 nt, Human
uuuacagaugaggaaacugaga

SEQ ID NO: 352555 - RNA, 22 nt, Human
ugggcagaguagcucagaagaa

SEQ ID NO: 352556 - RNA, 22 nt, Human
gauuuccaggucauuaauaaag

SEQ ID NO: 352557 - RNA, 22 nt, Human
cugccagcacugccuccugagg

SEQ ID NO: 352558 - RNA, 22 nt, Human
agugcacagcgugauguauugg

SEQ ID NO: 352559 - RNA, 22 nt, Human
aauggccagcugggagaguuga

SEQ ID NO: 352560 - RNA, 21 nt, Human
agcugggccucagccugcagu

SEQ ID NO: 352561 - RNA, 22 nt, Human
uagggcagaguccaggaugggc

SEQ ID NO: 352562 - RNA, 22 nt, Human
aggccuccuggcuccaggccuu

SEQ ID NO: 352563 - RNA, 21 nt, Human
agggccugugcucuccagguc

SEQ ID NO: 352564 - RNA, 22 nt, Human
agggccagcugaugagaaugag

SEQ ID NO: 352565 - RNA, 22 nt, Human
ugaaacaaauuuggaaaaucua

SEQ ID NO: 352566 - RNA, 22 nt, Human
agucuugcucuugcaucugcuu

SEQ ID NO: 352567 - RNA, 20 nt, Human
auaauuuacccugcaccacu

SEQ ID NO: 352568 - RNA, 22 nt, Human
uuuggaaaguguacaaauuuga

SEQ ID NO: 352569 - RNA, 22 nt, Human
aaggcacuugcccagagcugca

SEQ ID NO: 352570 - RNA, 22 nt, Human
ccuaugccugucacucugcgcu

SEQ ID NO: 352571 - RNA, 22 nt, Human
uagcagggaaggugugcugagc

SEQ ID NO: 352572 - RNA, 22 nt, Human
aguucacauuccgagguacugg

SEQ ID NO: 352573 - RNA, 22 nt, Human
ugaauaauuccuuuuugucaag

SEQ ID NO: 352574 - RNA, 22 nt, Human
agcaggcuccuuccuucucugg

SEQ ID NO: 352575 - RNA, 22 nt, Human
gaauuacaugacccugaguaga

SEQ ID NO: 352576 - RNA, 22 nt, Human
uuuccaaauaaggucacauucu

SEQ ID NO: 352577 - RNA, 22 nt, Human
cuccacagccccuccaguggca

SEQ ID NO: 352578 - RNA, 22 nt, Human
uggcugggcccccaccugccuc

SEQ ID NO: 352579 - RNA, 22 nt, Human
aaggaagacuugagaagguucc

SEQ ID NO: 352580 - RNA, 22 nt, Human
agggaggucuggcugcccugag

SEQ ID NO: 352581 - RNA, 22 nt, Human
augguuuauugcuuuaaugaaa

SEQ ID NO: 352582 - RNA, 22 nt, Human
cagaggccuauccaguguccau

SEQ ID NO: 352583 - RNA, 22 nt, Human
uauuuguauguguguacauaua

SEQ ID NO: 352584 - RNA, 22 nt, Human
ccaggaugacccccacuuuccu

SEQ ID NO: 352585 - RNA, 22 nt, Human
ggcacugaucugauuucccucc

SEQ ID NO: 352586 - RNA, 22 nt, Human
gggcagagagcuggaacuccuu

SEQ ID NO: 352587 - RNA, 22 nt, Human
gggcugcuuauacugaugauaa

SEQ ID NO: 352588 - RNA, 22 nt, Human
ucauugcagcuucagguguuca

SEQ ID NO: 352589 - RNA, 22 nt, Human
aaugaacaggugaaugucagau

SEQ ID NO: 352590 - RNA, 22 nt, Human
guggccuggcgagcuggcgcgg

SEQ ID NO: 352591 - RNA, 22 nt, Human
aaccugcauguuucuaaaagca

SEQ ID NO: 352592 - RNA, 22 nt, Human
cucccugggccucaguuucucu

SEQ ID NO: 352593 - RNA, 19 nt, Human
aaaguuuuauucucauuug

SEQ ID NO: 352594 - RNA, 22 nt, Human
ucaauaaaucccucugacccug

SEQ ID NO: 352595 - RNA, 22 nt, Human
gaucagaauucuuguguguuuc

SEQ ID NO: 352596 - RNA, 22 nt, Human
guccaugacugugacucacaug

SEQ ID NO: 352597 - RNA, 22 nt, Human
ccuccaaguuugacucaggaca

SEQ ID NO: 352598 - RNA, 22 nt, Human
ggcauuuaguuuucauauucug

SEQ ID NO: 352599 - RNA, 22 nt, Human
uuaaaaccaucagcuguaagau

SEQ ID NO: 352600 - RNA, 22 nt, Human
aaucagaacuccuaccacagag

SEQ ID NO: 352601 - RNA, 22 nt, Human
ugcagggcccuugggguugaac

SEQ ID NO: 352602 - RNA, 22 nt, Human
auuaaauuuucacuaggcuccc

SEQ ID NO: 352603 - RNA, 19 nt, Human
uggggccuccugucccugg

SEQ ID NO: 352604 - RNA, 22 nt, Human
guuguauucuucaauaucagag

SEQ ID NO: 352605 - RNA, 18 nt, Human
cagaugagaugcaaucuc

SEQ ID NO: 352606 - RNA, 20 nt, Human
uccuugaaagugggguauau

SEQ ID NO: 352607 - RNA, 22 nt, Human
ugccuguguugauuacuuuguc

SEQ ID NO: 352608 - RNA, 22 nt, Human
aacagaaugcaggggaugcugc

SEQ ID NO: 352609 - RNA, 22 nt, Human
agaaaugcauuagcacauauag

SEQ ID NO: 352610 - RNA, 19 nt, Human
uguagcaguuuaaaacaac

SEQ ID NO: 352611 - RNA, 22 nt, Human
ggaggcugagaaguccaagauc

SEQ ID NO: 352612 - RNA, 22 nt, Human
caggcagaagaaguggaaggac

SEQ ID NO: 352613 - RNA, 22 nt, Human
ccucucaucauuaucgcuuugu

SEQ ID NO: 352614 - RNA, 22 nt, Human
ccaggcugggcuacaaguugag

SEQ ID NO: 352615 - RNA, 22 nt, Human
cagcuggcugcaugaugccaaa

SEQ ID NO: 352616 - RNA, 21 nt, Human
uacagaaugcgcuucagucug

SEQ ID NO: 352617 - RNA, 22 nt, Human
ucuggagccacaaaccucagcu

SEQ ID NO: 352618 - RNA, 22 nt, Human
cccugcagccggccagcucauu

SEQ ID NO: 352619 - RNA, 22 nt, Human
uacauaguuccauuuacaggaa

SEQ ID NO: 352620 - RNA, 21 nt, Human
ccuucuccacagggucuccgg

SEQ ID NO: 352621 - RNA, 22 nt, Human
aaagacuuggcuuaugauuugc

SEQ ID NO: 352622 - RNA, 22 nt, Human
aagggcucucugcauugaaauu

SEQ ID NO: 352623 - RNA, 22 nt, Human
uuccucuuucucugugcuaugu

SEQ ID NO: 352624 - RNA, 22 nt, Human
gaggcccaguccugcaagcacg

SEQ ID NO: 352625 - RNA, 22 nt, Human
ugggcagaggcucugaagucca

SEQ ID NO: 352626 - RNA, 17 nt, Human
gaggagcuccaguaggu

SEQ ID NO: 352627 - RNA, 22 nt, Human
gccaggcauuuauugauugaau

SEQ ID NO: 352628 - RNA, 22 nt, Human
uggcacugccuggcagggcccc

SEQ ID NO: 352629 - RNA, 22 nt, Human
uaugaaacauucauacaaauaa

SEQ ID NO: 352630 - RNA, 22 nt, Human
uuucagauuaucucaacuuugg

SEQ ID NO: 352631 - RNA, 20 nt, Human
cugggaggucuuccaaauca

SEQ ID NO: 352632 - RNA, 22 nt, Human
uugaauaauaugcuucguucuc

SEQ ID NO: 352633 - RNA, 22 nt, Human
ugaaaggugacauuucuuggau

SEQ ID NO: 352634 - RNA, 22 nt, Human
gcagcauuucucaaaggguggu

SEQ ID NO: 352635 - RNA, 22 nt, Human
aaagagcuaacauugccgagau

SEQ ID NO: 352636 - RNA, 22 nt, Human
cuggcugcaggaugaggcugcc

SEQ ID NO: 352637 - RNA, 22 nt, Human
cucaccaggaacagcugcggag

SEQ ID NO: 352638 - RNA, 22 nt, Human
acaguggauauauuaaaugaga

SEQ ID NO: 352639 - RNA, 22 nt, Human
uguaggacauguacuuguaaca

SEQ ID NO: 352640 - RNA, 22 nt, Human
gaaaaugugucaucccuacugu

SEQ ID NO: 352641 - RNA, 22 nt, Human
uggcagaguucgcuccuauuca

SEQ ID NO: 352642 - RNA, 20 nt, Human
ugcagagcuggcuggcuccu

SEQ ID NO: 352643 - RNA, 22 nt, Human
aucacauugccagugauuaccc

SEQ ID NO: 352644 - RNA, 22 nt, Human
uagcuuuaggcacguuugaauu

SEQ ID NO: 352645 - RNA, 22 nt, Human
auggcuuuccugggacaugggc

SEQ ID NO: 352646 - RNA, 22 nt, Human
cuuucuuauaccugucagggcc

SEQ ID NO: 352647 - RNA, 21 nt, Human
uuuuuucuugcgugaggccug

SEQ ID NO: 352648 - RNA, 19 nt, Human
gagcccucuccauggccac

SEQ ID NO: 352649 - RNA, 22 nt, Human
uccaggcaaagggacuagcagg

SEQ ID NO: 352650 - RNA, 22 nt, Human
ucagaauaugcuaaugacauuu

SEQ ID NO: 352651 - RNA, 19 nt, Human
cagagcugcuggccucguc

SEQ ID NO: 352652 - RNA, 22 nt, Human
ggcuccacccugcuuccagaag

SEQ ID NO: 352653 - RNA, 22 nt, Human
acagaccaaguuuccagcaggu

SEQ ID NO: 352654 - RNA, 22 nt, Human
uuucauaauacuguacaugaaa

SEQ ID NO: 352655 - RNA, 22 nt, Human
gaaaugugugacaaguuucaau

SEQ ID NO: 352656 - RNA, 22 nt, Human
ugaggcuugucucagauggggg

SEQ ID NO: 352657 - RNA, 22 nt, Human
uaacagaauccuguuauugcca

SEQ ID NO: 352658 - RNA, 22 nt, Human
uucaaugaggauagaacuggau

SEQ ID NO: 352659 - RNA, 22 nt, Human
uuguccuuggaugaagcuggga

SEQ ID NO: 352660 - RNA, 22 nt, Human
ggaggagguggguuaaguugua

SEQ ID NO: 352661 - RNA, 19 nt, Human
ucaggacugacuugaaguc

SEQ ID NO: 352662 - RNA, 22 nt, Human
cauuuguuaaccaguguggauu

SEQ ID NO: 352663 - RNA, 22 nt, Human
cuugcuuuguccagaaauucag

SEQ ID NO: 352664 - RNA, 22 nt, Human
guagaaauguaaccaggagaua

SEQ ID NO: 352665 - RNA, 22 nt, Human
cuggcagggugggcuuugcuuu

SEQ ID NO: 352666 - RNA, 22 nt, Human
agcugcucucacuggacgccug

SEQ ID NO: 352667 - RNA, 22 nt, Human
caggagcccagaguccucagcu

SEQ ID NO: 352668 - RNA, 22 nt, Human
cucugugauuuugugagccaga

SEQ ID NO: 352669 - RNA, 22 nt, Human
gaggagagaacauuccuccaua

SEQ ID NO: 352670 - RNA, 22 nt, Human
ucccaaggugcucggcaacagg

SEQ ID NO: 352671 - RNA, 22 nt, Human
gagcagggccacuucuguaccu

SEQ ID NO: 352672 - RNA, 22 nt, Human
uccuuugguucucuaagaugcu

SEQ ID NO: 352673 - RNA, 22 nt, Human
uugaaaguagcagcugcauaug

SEQ ID NO: 352674 - RNA, 22 nt, Human
agcagcauuuaaguuucuucua

SEQ ID NO: 352675 - RNA, 22 nt, Human
uugacaauugggagauauaaag

SEQ ID NO: 352676 - RNA, 22 nt, Human
cagagggaaaaggggaguaaua

SEQ ID NO: 352677 - RNA, 22 nt, Human
gcauggcagugaggauggugcu

SEQ ID NO: 352678 - RNA, 22 nt, Human
cagaccuggaaaacaggcuugc

SEQ ID NO: 352679 - RNA, 22 nt, Human
uccugaggcacaauccuagaau

SEQ ID NO: 352680 - RNA, 22 nt, Human
uggaggccagagguacugggac

SEQ ID NO: 352681 - RNA, 22 nt, Human
uucaugugaucacagauuguaa

SEQ ID NO: 352682 - RNA, 22 nt, Human
ccaaggagcaaguuuacaccug

SEQ ID NO: 352683 - RNA, 22 nt, Human
uuccaggauggcaauaaugaau

SEQ ID NO: 352684 - RNA, 22 nt, Human
aggugccagugcuguggucccc

SEQ ID NO: 352685 - RNA, 22 nt, Human
aggaaaaaccuguuaaugguag

SEQ ID NO: 352686 - RNA, 22 nt, Human
auaugugugaugcauggacuaa

SEQ ID NO: 352687 - RNA, 20 nt, Human
aggcacuggggauagguaag

SEQ ID NO: 352688 - RNA, 22 nt, Human
auugaaagauauacuguucuca

SEQ ID NO: 352689 - RNA, 22 nt, Human
cagcacaauuuucaggagucca

SEQ ID NO: 352690 - RNA, 22 nt, Human
guccucuguguaggcugcagac

SEQ ID NO: 352691 - RNA, 18 nt, Human
cauaauuuucuuucuuua

SEQ ID NO: 352692 - RNA, 22 nt, Human
caggggcuguuugccucaggcc

SEQ ID NO: 352693 - RNA, 22 nt, Human
agagacaggguuuugccauguu

SEQ ID NO: 352694 - RNA, 22 nt, Human
ccuggaggagcgcugaccagcu

SEQ ID NO: 352695 - RNA, 18 nt, Human
cuuguucuucucuuggcg

SEQ ID NO: 352696 - RNA, 22 nt, Human
augaggcaaggaucagguaagg

SEQ ID NO: 352697 - RNA, 22 nt, Human
ucacagacaauuguuuuggugu

SEQ ID NO: 352698 - RNA, 22 nt, Human
cugcugugcaggugccuaugau

SEQ ID NO: 352699 - RNA, 22 nt, Human
ugcagccuugccuccucccagc

SEQ ID NO: 352700 - RNA, 22 nt, Human
gcuucacacuaaaaauguuaaa

SEQ ID NO: 352701 - RNA, 22 nt, Human
guuucaaagcacagcucacauu

SEQ ID NO: 352702 - RNA, 22 nt, Human
uccaggagaaggccauccagcg

SEQ ID NO: 352703 - RNA, 22 nt, Human
uggagcugguaaacagugacau

SEQ ID NO: 352704 - RNA, 21 nt, Human
aucauucuggaaaauucaagc

SEQ ID NO: 352705 - RNA, 22 nt, Human
uuugaaagcaggugugggaggg

SEQ ID NO: 352706 - RNA, 22 nt, Human
uggcaagagggaugcaagguuu

SEQ ID NO: 352707 - RNA, 22 nt, Human
auauauuugagaauauucauga

SEQ ID NO: 352708 - RNA, 22 nt, Human
ccuggcucucugcagauccugg

SEQ ID NO: 352709 - RNA, 22 nt, Human
ggcagcuguaagaugagugaau

SEQ ID NO: 352710 - RNA, 22 nt, Human
aucuggcuuuuaccccacggcc

SEQ ID NO: 352711 - RNA, 22 nt, Human
cagcaggacguccaagugcuau

SEQ ID NO: 352712 - RNA, 22 nt, Human
uaaauguauaggcacuaaaccu

SEQ ID NO: 352713 - RNA, 22 nt, Human
gaggccaggggccuggagauga

SEQ ID NO: 352714 - RNA, 22 nt, Human
aaugucugcucuacucaggagg

SEQ ID NO: 352715 - RNA, 20 nt, Human
acugagcugcauggagagga

SEQ ID NO: 352716 - RNA, 23 nt, Human
gacagagugagaccuugucuuac

SEQ ID NO: 352717 - RNA, 22 nt, Human
ggccagcagucacagggucaga

SEQ ID NO: 352718 - RNA, 22 nt, Human
cagaggcagacccuccagggcg

SEQ ID NO: 352719 - RNA, 22 nt, Human
ggccagagaagucagacccuug

SEQ ID NO: 352720 - RNA, 21 nt, Human
ugcugccauagaccugaggga

SEQ ID NO: 352721 - RNA, 22 nt, Human
acauuucuuagccuaguuccag

SEQ ID NO: 352722 - RNA, 22 nt, Human
gcugggagucgcgucuguggcc

SEQ ID NO: 352723 - RNA, 22 nt, Human
agucucugggcaugguugugac

SEQ ID NO: 352724 - RNA, 22 nt, Human
uaaaaguauacuuucaaaggag

SEQ ID NO: 352725 - RNA, 22 nt, Human
ugucacaaacauacauuauaga

SEQ ID NO: 352726 - RNA, 22 nt, Human
acccaggaggcagagguugcag

SEQ ID NO: 352727 - RNA, 22 nt, Human
aaaaguuuaagacucauucuag

SEQ ID NO: 352728 - RNA, 22 nt, Human
gaguguggugaacaggagcacc

SEQ ID NO: 352729 - RNA, 22 nt, Human
cugcugcauuccucuuuaugag

SEQ ID NO: 352730 - RNA, 20 nt, Human
ccucucugaagaggucaucu

SEQ ID NO: 352731 - RNA, 21 nt, Human
agcugcuuucagcuccuagag

SEQ ID NO: 352732 - RNA, 22 nt, Human
ucccaggcuaggccucugcguu

SEQ ID NO: 352733 - RNA, 22 nt, Human
cagggugccaaagaacaaauau

SEQ ID NO: 352734 - RNA, 22 nt, Human
uugcuauuuugagagucauagu

SEQ ID NO: 352735 - RNA, 22 nt, Human
aucccuggacggcgccucccca

SEQ ID NO: 352736 - RNA, 22 nt, Human
ccacagagagugucagccuuug

SEQ ID NO: 352737 - RNA, 22 nt, Human
agagcuguggauaguccuggau

SEQ ID NO: 352738 - RNA, 22 nt, Human
acaggcuucucacagaaaaggg

SEQ ID NO: 352739 - RNA, 22 nt, Human
ucaucacauaugucaugauuug

SEQ ID NO: 352740 - RNA, 22 nt, Human
ugaggcaggagaaucaccggaa

SEQ ID NO: 352741 - RNA, 22 nt, Human
uaaagucaucuuuacaucuuug

SEQ ID NO: 352742 - RNA, 22 nt, Human
gaggcugcaggcaaugcugccc

SEQ ID NO: 352743 - RNA, 22 nt, Human
ccuggcuuccuggagcucacaa

SEQ ID NO: 352744 - RNA, 22 nt, Human
uacaaagccugguagauaucug

SEQ ID NO: 352745 - RNA, 22 nt, Human
gagccaggguuugaaacuagac

SEQ ID NO: 352746 - RNA, 23 nt, Human
caggacaugggaggaaguauggc

SEQ ID NO: 352747 - RNA, 22 nt, Human
cuuugaagauggcaaauuuaga

SEQ ID NO: 352748 - RNA, 22 nt, Human
agaggcuccuagccacuggcuu

SEQ ID NO: 352749 - RNA, 22 nt, Human
aguugacauccagagacauucu

SEQ ID NO: 352750 - RNA, 22 nt, Human
cacaggcagccuuguagaagaa

SEQ ID NO: 352751 - RNA, 22 nt, Human
gacauguugaagaauauuugga

SEQ ID NO: 352752 - RNA, 22 nt, Human
gggcaggugccagcucccuguc

SEQ ID NO: 352753 - RNA, 22 nt, Human
gaaggccacaaaaaaugucaua

SEQ ID NO: 352754 - RNA, 22 nt, Human
uagggaugacgaaaggacagag

SEQ ID NO: 352755 - RNA, 22 nt, Human
agaggggaaguaaugaaugaua

SEQ ID NO: 352756 - RNA, 22 nt, Human
uggagugaaguaaagaggacaa

SEQ ID NO: 352757 - RNA, 22 nt, Human
uggggccuggucagagcugcac

SEQ ID NO: 352758 - RNA, 22 nt, Human
cagggcuguggcuuugugcugu

SEQ ID NO: 352759 - RNA, 22 nt, Human
uggcuggacagugggcagugga

SEQ ID NO: 352760 - RNA, 22 nt, Human
uggcagcugauuagauggugcc

SEQ ID NO: 352761 - RNA, 22 nt, Human
ugcagucuccaccuccugggug

SEQ ID NO: 352762 - RNA, 22 nt, Human
aucaguuugagugcugugucaa

SEQ ID NO: 352763 - RNA, 22 nt, Human
gaaggccucacucugcagcaua

SEQ ID NO: 352764 - RNA, 22 nt, Human
gaggcaguggucugaugcaagg

SEQ ID NO: 352765 - RNA, 22 nt, Human
ucauuuucaaguuugaacagga

SEQ ID NO: 352766 - RNA, 22 nt, Human
cugcucuggucucuucauguuu

SEQ ID NO: 352767 - RNA, 22 nt, Human
ucagggcacaggccuguggguu

SEQ ID NO: 352768 - RNA, 22 nt, Human
aaucaguuaggguguuaaugag

SEQ ID NO: 352769 - RNA, 22 nt, Human
uuucuagggcucuugucuucug

SEQ ID NO: 352770 - RNA, 22 nt, Human
accaugccaguggcagccagac

SEQ ID NO: 352771 - RNA, 22 nt, Human
gucuucuuguguugccugucuu

SEQ ID NO: 352772 - RNA, 22 nt, Human
augcuuaacuuccuagucuaua

SEQ ID NO: 352773 - RNA, 22 nt, Human
auaagcauguuagaauauuuga

SEQ ID NO: 352774 - RNA, 22 nt, Human
ucucccagaggaucccagugga

SEQ ID NO: 352775 - RNA, 22 nt, Human
aggcugggcaccguuuugaucc

SEQ ID NO: 352776 - RNA, 20 nt, Human
uggaccugucucuuuaggga

SEQ ID NO: 352777 - RNA, 22 nt, Human
uuuuuccaccguacuuccugag

SEQ ID NO: 352778 - RNA, 22 nt, Human
agcacccuccaacuucccugua

SEQ ID NO: 352779 - RNA, 22 nt, Human
cugcagggugacguugcccacc

SEQ ID NO: 352780 - RNA, 22 nt, Human
acacaguaugaaaagucuaguu

SEQ ID NO: 352781 - RNA, 22 nt, Human
caugcugugugguuagaacugu

SEQ ID NO: 352782 - RNA, 22 nt, Human
gcuggcuuugcacugggugcau

SEQ ID NO: 352783 - RNA, 21 nt, Human
aagcaggacauaugaugcccu

SEQ ID NO: 352784 - RNA, 22 nt, Human
ccccuuccgucucuugaguguc

SEQ ID NO: 352785 - RNA, 22 nt, Human
ugaggcaguauuuuagugacuu

SEQ ID NO: 352786 - RNA, 22 nt, Human
uuacuuuggauggucaagaaag

SEQ ID NO: 352787 - RNA, 22 nt, Human
cacauggaagagauacagugag

SEQ ID NO: 352788 - RNA, 22 nt, Human
uucacacacagcuuccuauugu

SEQ ID NO: 352789 - RNA, 22 nt, Human
ugggggacugcacuggcgucag

SEQ ID NO: 352790 - RNA, 22 nt, Human
ucccaggaagaucccagggacc

SEQ ID NO: 352791 - RNA, 19 nt, Human
cagaguacaccagauagga

SEQ ID NO: 352792 - RNA, 22 nt, Human
uuucacaaugcaauccuacuuc

SEQ ID NO: 352793 - RNA, 22 nt, Human
gcaaggcugugcacuuugcauu

SEQ ID NO: 352794 - RNA, 22 nt, Human
ucaggagggugacaggcccugg

SEQ ID NO: 352795 - RNA, 22 nt, Human
gucccuuggcucacaaacagcu

SEQ ID NO: 352796 - RNA, 22 nt, Human
augguuuuagaaucaggaaaaa

SEQ ID NO: 352797 - RNA, 23 nt, Human
uuucacaaugagcauuacagaau

SEQ ID NO: 352798 - RNA, 22 nt, Human
cuuauguauaauguuccacaua

SEQ ID NO: 352799 - RNA, 22 nt, Human
ugugaauacagcaugugcuucu

SEQ ID NO: 352800 - RNA, 22 nt, Human
aauuuuauuaacuggauguagc

SEQ ID NO: 352801 - RNA, 22 nt, Human
agagcugcccacacagcagauu

SEQ ID NO: 352802 - RNA, 22 nt, Human
cccuggggcugagggauggccg

SEQ ID NO: 352803 - RNA, 22 nt, Human
gcuugcucaacccccgucucuc

SEQ ID NO: 352804 - RNA, 22 nt, Human
ucuggcucccuggagcuccaca

SEQ ID NO: 352805 - RNA, 22 nt, Human
ccugggcauaaaucacuccaag

SEQ ID NO: 352806 - RNA, 23 nt, Human
agcagcaaaaauuuaucuuucug

SEQ ID NO: 352807 - RNA, 22 nt, Human
caguuuauuuccaagaugacaa

SEQ ID NO: 352808 - RNA, 22 nt, Human
gggagagaugcugauugccaau

SEQ ID NO: 352809 - RNA, 22 nt, Human
ccuuucucuuugcugaucaugu

SEQ ID NO: 352810 - RNA, 22 nt, Human
ucauuucuauugcuacugucug

SEQ ID NO: 352811 - RNA, 22 nt, Human
uggcuccuucauucuccugcca

SEQ ID NO: 352812 - RNA, 20 nt, Human
cccuggagagaagcuccacg

SEQ ID NO: 352813 - RNA, 19 nt, Human
uccugcagguggcuugcag

SEQ ID NO: 352814 - RNA, 22 nt, Human
caugggaggucugcaaggugcu

SEQ ID NO: 352815 - RNA, 22 nt, Human
uggcagcuaucuuuaaugagau

SEQ ID NO: 352816 - RNA, 22 nt, Human
uuuugaaagccagguuuguaug

SEQ ID NO: 352817 - RNA, 22 nt, Human
uccaugagacagauacuguaag

SEQ ID NO: 352818 - RNA, 22 nt, Human
ggccaggcgaugaccccuccac

SEQ ID NO: 352819 - RNA, 20 nt, Human
gcagagccucacugcaaggg

SEQ ID NO: 352820 - RNA, 22 nt, Human
cucaaggaaagucuggagaaga

SEQ ID NO: 352821 - RNA, 22 nt, Human
aauuccugucuuaacaguucug

SEQ ID NO: 352822 - RNA, 22 nt, Human
ccuggaaggugaugguacagca

SEQ ID NO: 352823 - RNA, 22 nt, Human
gcuggauccacaaauaacuuug

SEQ ID NO: 352824 - RNA, 22 nt, Human
cuuuauguuggggugucuuagu

SEQ ID NO: 352825 - RNA, 22 nt, Human
cucccuggaggcccagaccugg

SEQ ID NO: 352826 - RNA, 22 nt, Human
gagaggaguuacuauuuccgag

SEQ ID NO: 352827 - RNA, 22 nt, Human
caggcagccugagggaucuggg

SEQ ID NO: 352828 - RNA, 22 nt, Human
cuggugggagcagcaggcagcu

SEQ ID NO: 352829 - RNA, 22 nt, Human
ucccuggccauuccucuaggcc

SEQ ID NO: 352830 - RNA, 22 nt, Human
ugccaggcgugguggugcgcac

SEQ ID NO: 352831 - RNA, 22 nt, Human
ggcaggcugcuugggucauguc

SEQ ID NO: 352832 - RNA, 22 nt, Human
aauuaugagguagauaucacau

SEQ ID NO: 352833 - RNA, 18 nt, Human
gcaggcuuuuccuggguc

SEQ ID NO: 352834 - RNA, 22 nt, Human
guucuuaagaccacaauaaaaa

SEQ ID NO: 352835 - RNA, 22 nt, Human
auguacaguuucuagacucaaa

SEQ ID NO: 352836 - RNA, 22 nt, Human
agaagccacuggagguugagau

SEQ ID NO: 352837 - RNA, 22 nt, Human
aggggugugcauccuggaggau

SEQ ID NO: 352838 - RNA, 22 nt, Human
auggcauuugaccgcuuugugg

SEQ ID NO: 352839 - RNA, 22 nt, Human
gcuggagccauuggcuuggccu

SEQ ID NO: 352840 - RNA, 22 nt, Human
cagcagcaacaacggaagccuu

SEQ ID NO: 352841 - RNA, 23 nt, Human
ggauuuaguggaugagcugagug

SEQ ID NO: 352842 - RNA, 21 nt, Human
agagcugggacuugccugaga

SEQ ID NO: 352843 - RNA, 22 nt, Human
acagauuuguucuuuugggcua

SEQ ID NO: 352844 - RNA, 22 nt, Human
gcagagccagaauggccaggac

SEQ ID NO: 352845 - RNA, 22 nt, Human
ggagacagugacuuagagacug

SEQ ID NO: 352846 - RNA, 22 nt, Human
cccaggaaugagcaggcagggg

SEQ ID NO: 352847 - RNA, 22 nt, Human
uuugacauugccaauuugcuca

SEQ ID NO: 352848 - RNA, 22 nt, Human
uccagccuaggggaacagcugc

SEQ ID NO: 352849 - RNA, 22 nt, Human
agugugagcccuggaguggugc

SEQ ID NO: 352850 - RNA, 22 nt, Human
uaaacauggauucugaucacag

SEQ ID NO: 352851 - RNA, 21 nt, Human
ggcagcccgcccucuccuggc

SEQ ID NO: 352852 - RNA, 22 nt, Human
ccagcugggauuaagggaaaau

SEQ ID NO: 352853 - RNA, 22 nt, Human
ucagucucuggggcuucuguuu

SEQ ID NO: 352854 - RNA, 22 nt, Human
ugcuggaauaauuucauguuaa

SEQ ID NO: 352855 - RNA, 22 nt, Human
uuccaaagaaauugaccaagac

SEQ ID NO: 352856 - RNA, 22 nt, Human
cagaaaaggaagagcuauguaa

SEQ ID NO: 352857 - RNA, 22 nt, Human
aggcucagagagcuguguccau

SEQ ID NO: 352858 - RNA, 22 nt, Human
cuccaugaauuugagcuuugug

SEQ ID NO: 352859 - RNA, 22 nt, Human
gcaggagcuggaaagugauguu

SEQ ID NO: 352860 - RNA, 19 nt, Human
ugcugcuguccuugcaggg

SEQ ID NO: 352861 - RNA, 22 nt, Human
agugcuuucuugcuccaucagu

SEQ ID NO: 352862 - RNA, 22 nt, Human
gccaggagagcuccuucagguu

SEQ ID NO: 352863 - RNA, 22 nt, Human
uccuguggucuggaaggaaugg

SEQ ID NO: 352864 - RNA, 21 nt, Human
ucuugaaaauuguagcaguuu

SEQ ID NO: 352865 - RNA, 22 nt, Human
cuggaaauuggagaugauguuu

SEQ ID NO: 352866 - RNA, 21 nt, Human
uucucagaucgaguagugaga

SEQ ID NO: 352867 - RNA, 22 nt, Human
ucagaggacuaccuucuccagu

SEQ ID NO: 352868 - RNA, 21 nt, Human
agucuguuaggaugacucuga

SEQ ID NO: 352869 - RNA, 22 nt, Human
guggagccaggggcuguaggua

SEQ ID NO: 352870 - RNA, 22 nt, Human
auuugcuuucagguauaaaagg

SEQ ID NO: 352871 - RNA, 22 nt, Human
caguuucuacgaaggucaaccc

SEQ ID NO: 352872 - RNA, 19 nt, Human
ggcuggcaagugacagugu

SEQ ID NO: 352873 - RNA, 22 nt, Human
aaggccaacuaggaugagcuag

SEQ ID NO: 352874 - RNA, 22 nt, Human
gcucagagggaacaaggggcug

SEQ ID NO: 352875 - RNA, 22 nt, Human
cagcagagcuuauguuggguca

SEQ ID NO: 352876 - RNA, 21 nt, Human
gggccacaccuucugcagacc

SEQ ID NO: 352877 - RNA, 22 nt, Human
cugcucucuguuccccuggauc

SEQ ID NO: 352878 - RNA, 22 nt, Human
agggcagcaaugcagcugcugc

SEQ ID NO: 352879 - RNA, 22 nt, Human
ucaggcagaggauggggagcgu

SEQ ID NO: 352880 - RNA, 22 nt, Human
gcugagaguguaggauguuuac

SEQ ID NO: 352881 - RNA, 22 nt, Human
auacagaaaaugaugcagaguu

SEQ ID NO: 352882 - RNA, 22 nt, Human
cacagaaguuucauagucucga

SEQ ID NO: 352883 - RNA, 23 nt, Human
agcacacuuguacaaugcccuag

SEQ ID NO: 352884 - RNA, 22 nt, Human
uggaauggaaacaaacugagga

SEQ ID NO: 352885 - RNA, 22 nt, Human
aacacuuucuauuauuaugguu

SEQ ID NO: 352886 - RNA, 22 nt, Human
acaggccugagauuuugcauuu

SEQ ID NO: 352887 - RNA, 22 nt, Human
cuuagggaaucuuagagcugga

SEQ ID NO: 352888 - RNA, 22 nt, Human
aucuuucuauuucuaaaaacua

SEQ ID NO: 352889 - RNA, 22 nt, Human
agcaccugccugcauuggcuau

SEQ ID NO: 352890 - RNA, 22 nt, Human
ugccagaguuacaugaggguca

SEQ ID NO: 352891 - RNA, 22 nt, Human
gccucugcugacaagauggaca

SEQ ID NO: 352892 - RNA, 22 nt, Human
uggcugagagcaauugacucug

SEQ ID NO: 352893 - RNA, 22 nt, Human
aguuauccgaaggcacugagau

SEQ ID NO: 352894 - RNA, 22 nt, Human
ugaggcucagugagcccugcag

SEQ ID NO: 352895 - RNA, 22 nt, Human
cagcagcaaggugaggguggag

SEQ ID NO: 352896 - RNA, 19 nt, Human
ucaaaugccaaugucacag

SEQ ID NO: 352897 - RNA, 22 nt, Human
aggugcagcaugaguccaacgg

SEQ ID NO: 352898 - RNA, 22 nt, Human
aaagcucuuauagcagagugug

SEQ ID NO: 352899 - RNA, 22 nt, Human
gcagcuuuaaaggaggcucuga

SEQ ID NO: 352900 - RNA, 20 nt, Human
guccugggagccacagcaca

SEQ ID NO: 352901 - RNA, 22 nt, Human
gcaguggcuaggagucuggcgu

SEQ ID NO: 352902 - RNA, 22 nt, Human
guccuggguccccgcaggucag

SEQ ID NO: 352903 - RNA, 22 nt, Human
uccuugaauccuagcauccuau

SEQ ID NO: 352904 - RNA, 22 nt, Human
agccagugaugaagacucugga

SEQ ID NO: 352905 - RNA, 22 nt, Human
gcagagcucaagguguucagcu

SEQ ID NO: 352906 - RNA, 22 nt, Human
agugggcagcccaggaggucuu

SEQ ID NO: 352907 - RNA, 22 nt, Human
gaaaugugcagaauguguuaga

SEQ ID NO: 352908 - RNA, 22 nt, Human
caaguccucugguuucaaauag

SEQ ID NO: 352909 - RNA, 22 nt, Human
cuagagaggcagauguccugug

SEQ ID NO: 352910 - RNA, 22 nt, Human
uugggugcugucauggggcacg

SEQ ID NO: 352911 - RNA, 22 nt, Human
ggagggcucaauugacuccuga

SEQ ID NO: 352912 - RNA, 22 nt, Human
uggcccugucccuggagccugg

SEQ ID NO: 352913 - RNA, 20 nt, Human
acuguucaagggccuggugg

SEQ ID NO: 352914 - RNA, 22 nt, Human
cagugcccaagaugugccaugc

SEQ ID NO: 352915 - RNA, 22 nt, Human
agugaaauagcauuuaugaagc

SEQ ID NO: 352916 - RNA, 22 nt, Human
aggcucaggucucaggucuggc

SEQ ID NO: 352917 - RNA, 22 nt, Human
cacagcugccauggcugcacuu

SEQ ID NO: 352918 - RNA, 22 nt, Human
cagggccugagggcugcucugc

SEQ ID NO: 352919 - RNA, 22 nt, Human
gucccaggugggcuccaccucu

SEQ ID NO: 352920 - RNA, 20 nt, Human
aacagggggcugcagagggc

SEQ ID NO: 352921 - RNA, 22 nt, Human
ugggacagagugagcuuuggcc

SEQ ID NO: 352922 - RNA, 22 nt, Human
uagccucucuccuccacaaccu

SEQ ID NO: 352923 - RNA, 22 nt, Human
auuguauuuccagcuugaaugu

SEQ ID NO: 352924 - RNA, 22 nt, Human
auuugauuagcuguguaauuuu

SEQ ID NO: 352925 - RNA, 22 nt, Human
ucccugcucagcucaccuggca

SEQ ID NO: 352926 - RNA, 21 nt, Human
ggcaggauggcaguggacccc

SEQ ID NO: 352927 - RNA, 22 nt, Human
acaguguguuggaggagacugu

SEQ ID NO: 352928 - RNA, 22 nt, Human
gaagagcugcaguuuccugggc

SEQ ID NO: 352929 - RNA, 22 nt, Human
ucacuggggccuuuggucagga

SEQ ID NO: 352930 - RNA, 19 nt, Human
ucuaacagaagugucgucc

SEQ ID NO: 352931 - RNA, 19 nt, Human
agucccaggcccgaaagag

SEQ ID NO: 352932 - RNA, 22 nt, Human
uuccaaaccucaaauaauuaau

SEQ ID NO: 352933 - RNA, 22 nt, Human
ucccaggaauugaagccagugu

SEQ ID NO: 352934 - RNA, 22 nt, Human
ccaggagagcucucguucagug

SEQ ID NO: 352935 - RNA, 22 nt, Human
gggcagaggcucuggcccaucc

SEQ ID NO: 352936 - RNA, 22 nt, Human
uggcagagguaauucaaauccc

SEQ ID NO: 352937 - RNA, 22 nt, Human
cagggccagccgcagcauccac

SEQ ID NO: 352938 - RNA, 19 nt, Human
ggccccucucacaggaguu

SEQ ID NO: 352939 - RNA, 22 nt, Human
cuguaaauaugaagaauauaug

SEQ ID NO: 352940 - RNA, 22 nt, Human
ugugauauuugaguauugucaa

SEQ ID NO: 352941 - RNA, 22 nt, Human
gaaaugcauggaucuuggcaga

SEQ ID NO: 352942 - RNA, 22 nt, Human
aggcugaggcagguggaucacc

SEQ ID NO: 352943 - RNA, 22 nt, Human
uuuaggcagcagugaggaugaa

SEQ ID NO: 352944 - RNA, 22 nt, Human
aggucagaagugccagggaauu

SEQ ID NO: 352945 - RNA, 22 nt, Human
aggaguggugcaggaccugcca

SEQ ID NO: 352946 - RNA, 22 nt, Human
cagguggagcugacugagggca

SEQ ID NO: 352947 - RNA, 22 nt, Human
gagggcugccacguugggcgag

SEQ ID NO: 352948 - RNA, 22 nt, Human
gcuggccagggcugcucgcgga

SEQ ID NO: 352949 - RNA, 22 nt, Human
uaaguccuagaugauucacaga

SEQ ID NO: 352950 - RNA, 22 nt, Human
cugggcaguaugaauauucaaa

SEQ ID NO: 352951 - RNA, 22 nt, Human
auuucauugaaguuaauucuuc

SEQ ID NO: 352952 - RNA, 23 nt, Human
ugcagggcaaguuagagacccca

SEQ ID NO: 352953 - RNA, 19 nt, Human
aggaaagguggccuuagca

SEQ ID NO: 352954 - RNA, 22 nt, Human
ucacagcuaagcuuggucacug

SEQ ID NO: 352955 - RNA, 22 nt, Human
gaggcucagagggacuuucaag

SEQ ID NO: 352956 - RNA, 22 nt, Human
guucuaauuuggggcuccuuag

SEQ ID NO: 352957 - RNA, 22 nt, Human
gucccacaccuugaggggucuu

SEQ ID NO: 352958 - RNA, 22 nt, Human
gggcugagggccaauuccuacu

SEQ ID NO: 352959 - RNA, 21 nt, Human
ucuuccuccacagcgugccac

SEQ ID NO: 352960 - RNA, 22 nt, Human
gccacaugcaauugcagcacgu

SEQ ID NO: 352961 - RNA, 22 nt, Human
gaaggcuaaaggggcagagguu

SEQ ID NO: 352962 - RNA, 22 nt, Human
ucaauaaauagcuuggcucagc

SEQ ID NO: 352963 - RNA, 22 nt, Human
uaaaaucauucuggugucagua

SEQ ID NO: 352964 - RNA, 22 nt, Human
aaggagcuuguucgccuuccuc

SEQ ID NO: 352965 - RNA, 22 nt, Human
ggucaggguauaaucaagugag

SEQ ID NO: 352966 - RNA, 22 nt, Human
ggggagugacgcagggccauag

SEQ ID NO: 352967 - RNA, 22 nt, Human
ccugugccauccugagcauccc

SEQ ID NO: 352968 - RNA, 17 nt, Human
uggcuucccugggccac

SEQ ID NO: 352969 - RNA, 22 nt, Human
uagggcuguuuaaaagugaggu

SEQ ID NO: 352970 - RNA, 22 nt, Human
ugggagaugguucugagacuuu

SEQ ID NO: 352971 - RNA, 22 nt, Human
agcagcauagaagcugggagga

SEQ ID NO: 352972 - RNA, 22 nt, Human
gaggagcugggucagggagaca

SEQ ID NO: 352973 - RNA, 22 nt, Human
ggaggaagugcaguucuacuac

SEQ ID NO: 352974 - RNA, 20 nt, Human
uccuggccuucucgggcagu

SEQ ID NO: 352975 - RNA, 22 nt, Human
agggcucugggguggcagagau

SEQ ID NO: 352976 - RNA, 22 nt, Human
aggcuccuaucgcuuucagcaa

SEQ ID NO: 352977 - RNA, 22 nt, Human
cauuguuauagcauuacacacc

SEQ ID NO: 352978 - RNA, 21 nt, Human
uucaaaguuugccuaaagauu

SEQ ID NO: 352979 - RNA, 22 nt, Human
cugcucuggcguacucggcauc

SEQ ID NO: 352980 - RNA, 22 nt, Human
auccuuagguggugcaucaggg

SEQ ID NO: 352981 - RNA, 22 nt, Human
gggagggaucugcuaggcaaug

SEQ ID NO: 352982 - RNA, 22 nt, Human
auagauacauuagguaacuugu

SEQ ID NO: 352983 - RNA, 22 nt, Human
caaucaguaaccggaucauggu

SEQ ID NO: 352984 - RNA, 22 nt, Human
agcagcugaccagugaguccug

SEQ ID NO: 352985 - RNA, 22 nt, Human
agcuggugcucaggggcaugga

SEQ ID NO: 352986 - RNA, 22 nt, Human
auucaaguccagcuucucuaca

SEQ ID NO: 352987 - RNA, 22 nt, Human
agggagcuucuggccucagccu

SEQ ID NO: 352988 - RNA, 22 nt, Human
uuugaagacauauuguuacaua

SEQ ID NO: 352989 - RNA, 22 nt, Human
gagagggagccagccaggaacc

SEQ ID NO: 352990 - RNA, 22 nt, Human
agggcgaggagacggaggcaca

SEQ ID NO: 352991 - RNA, 22 nt, Human
caggauagaaaggccauggagu

SEQ ID NO: 352992 - RNA, 22 nt, Human
ugaguaauaaacugucuugcuc

SEQ ID NO: 352993 - RNA, 22 nt, Human
aucagcaagcaugguuaggugu

SEQ ID NO: 352994 - RNA, 22 nt, Human
agcagggcaugaauaaggguuu

SEQ ID NO: 352995 - RNA, 22 nt, Human
ucaggcagguggcuggcuaugg

SEQ ID NO: 352996 - RNA, 22 nt, Human
auacagaaguuuuccacuuauu

SEQ ID NO: 352997 - RNA, 23 nt, Human
cacaccaggagccgucugggcca

SEQ ID NO: 352998 - RNA, 22 nt, Human
agcagccaauuggaggaugaag

SEQ ID NO: 352999 - RNA, 22 nt, Human
cccaggagagaggccaguuggc

SEQ ID NO: 353000 - RNA, 22 nt, Human
gcagcugguuaaugggagaauu

SEQ ID NO: 353001 - RNA, 22 nt, Human
uccaggaguuugaccugugggc

SEQ ID NO: 353002 - RNA, 22 nt, Human
auauaaguuaguggucauguuu

SEQ ID NO: 353003 - RNA, 22 nt, Human
aguuauauuccauagauucaga

SEQ ID NO: 353004 - RNA, 22 nt, Human
gaauucugggagagaucugaca

SEQ ID NO: 353005 - RNA, 22 nt, Human
uuugaaagaauuuauguacuuu

SEQ ID NO: 353006 - RNA, 22 nt, Human
agggagcaugggugaagcaggc

SEQ ID NO: 353007 - RNA, 21 nt, Human
uuacagaauccaugggaaguc

SEQ ID NO: 353008 - RNA, 22 nt, Human
cugggcugucccaaccccaucc

SEQ ID NO: 353009 - RNA, 22 nt, Human
cauugcacucuggcuggaacgg

SEQ ID NO: 353010 - RNA, 22 nt, Human
aacagaaaagguagguggcuuu

SEQ ID NO: 353011 - RNA, 22 nt, Human
ucaaaggcgguccaggaauaaa

SEQ ID NO: 353012 - RNA, 22 nt, Human
cacauaauacauguuccacuua

SEQ ID NO: 353013 - RNA, 22 nt, Human
gaucagaaucuucauuuucagu

SEQ ID NO: 353014 - RNA, 22 nt, Human
uccagcaguccaugugagacac

SEQ ID NO: 353015 - RNA, 22 nt, Human
ugauuucuuccuugucauuaga

SEQ ID NO: 353016 - RNA, 22 nt, Human
cacucaggguacaauggagggc

SEQ ID NO: 353017 - RNA, 22 nt, Human
cuccagugcacccagaggauuu

SEQ ID NO: 353018 - RNA, 22 nt, Human
ccccaggagaaaucuuaaacua

SEQ ID NO: 353019 - RNA, 22 nt, Human
gcucagagauguucaguagcuu

SEQ ID NO: 353020 - RNA, 22 nt, Human
agagggcauuaacucugucuug

SEQ ID NO: 353021 - RNA, 22 nt, Human
aggcugagucaaguuaggguga

SEQ ID NO: 353022 - RNA, 22 nt, Human
ccagaagggcuauugcagugac

SEQ ID NO: 353023 - RNA, 22 nt, Human
cucuccagaucugcugagccag

SEQ ID NO: 353024 - RNA, 22 nt, Human
agugaaaugacugaaucagaua

SEQ ID NO: 353025 - RNA, 20 nt, Human
accaauguuagcuuaguacu

SEQ ID NO: 353026 - RNA, 22 nt, Human
agccuuguuggucugaguuugg

SEQ ID NO: 353027 - RNA, 22 nt, Human
agcagcuucuuucacuccugga

SEQ ID NO: 353028 - RNA, 22 nt, Human
agagccuggggauuggcaaggg

SEQ ID NO: 353029 - RNA, 16 nt, Human
auuuccagauuaugca

SEQ ID NO: 353030 - RNA, 22 nt, Human
agucucugugagcucccaaugg

SEQ ID NO: 353031 - RNA, 22 nt, Human
auccuucaaggggcugacagcu

SEQ ID NO: 353032 - RNA, 22 nt, Human
auggaaagcuaagccauuuacc

SEQ ID NO: 353033 - RNA, 17 nt, Human
cagggcugucugccuag

SEQ ID NO: 353034 - RNA, 22 nt, Human
caagaauuguacaaacugggug

SEQ ID NO: 353035 - RNA, 22 nt, Human
gggcugcacguauucugcucac

SEQ ID NO: 353036 - RNA, 22 nt, Human
caggaaauaucuccuggcagag

SEQ ID NO: 353037 - RNA, 23 nt, Human
agcacagacuagaaaggucuuuc

SEQ ID NO: 353038 - RNA, 23 nt, Human
uguagcaucucuuauuucucagc

SEQ ID NO: 353039 - RNA, 22 nt, Human
ccugucagaugaaguaauugug

SEQ ID NO: 353040 - RNA, 22 nt, Human
cccaggcagugcugaucccuca

SEQ ID NO: 353041 - RNA, 22 nt, Human
agcagaacugaugagacuugag

SEQ ID NO: 353042 - RNA, 23 nt, Human
ugcucugggaggcccuggagagc

SEQ ID NO: 353043 - RNA, 21 nt, Human
ugcagccauucagcccuaugc

SEQ ID NO: 353044 - RNA, 20 nt, Human
ccugucuggagacaaagaga

SEQ ID NO: 353045 - RNA, 22 nt, Human
cagcuucuggcguggagccuga

SEQ ID NO: 353046 - RNA, 22 nt, Human
ucagugucuugaccugggugug

SEQ ID NO: 353047 - RNA, 22 nt, Human
gauuuacagguuagguccugua

SEQ ID NO: 353048 - RNA, 22 nt, Human
auuuucaucgcuagguuggccu

SEQ ID NO: 353049 - RNA, 22 nt, Human
ucacagugaugacgugggagca

SEQ ID NO: 353050 - RNA, 22 nt, Human
cuuuauuagauguagacuuucu

SEQ ID NO: 353051 - RNA, 20 nt, Human
aggaagcugagauguagagg

SEQ ID NO: 353052 - RNA, 22 nt, Human
acucagaggcagcugcucaccc

SEQ ID NO: 353053 - RNA, 22 nt, Human
ggugugccuggggcuuagcugc

SEQ ID NO: 353054 - RNA, 22 nt, Human
ugaaaugacaaagguuuuucuu

SEQ ID NO: 353055 - RNA, 22 nt, Human
ucaggagagaguuggguaggcu

SEQ ID NO: 353056 - RNA, 22 nt, Human
ugaaugauacagaauuauguag

SEQ ID NO: 353057 - RNA, 22 nt, Human
gggcagcucuggcugugggaag

SEQ ID NO: 353058 - RNA, 22 nt, Human
uguggugagaaacugguagauu

SEQ ID NO: 353059 - RNA, 22 nt, Human
cucccaagauaaauaaggcagu

SEQ ID NO: 353060 - RNA, 22 nt, Human
uccugggguccugacugcuucc

SEQ ID NO: 353061 - RNA, 22 nt, Human
uuuauuaugauggacaccuucg

SEQ ID NO: 353062 - RNA, 22 nt, Human
uaacagaaauaguaggugaggg

SEQ ID NO: 353063 - RNA, 22 nt, Human
aaagcagcagcacguggaagag

SEQ ID NO: 353064 - RNA, 22 nt, Human
uuugcauaggauggacauuuua

SEQ ID NO: 353065 - RNA, 22 nt, Human
caacuuuaugauugguuuguca

SEQ ID NO: 353066 - RNA, 22 nt, Human
cugggcuccuaaccauccaggu

SEQ ID NO: 353067 - RNA, 22 nt, Human
cagcuuccgaccgggggcugca

SEQ ID NO: 353068 - RNA, 23 nt, Human
ggaguuggauuguacuugcugcu

SEQ ID NO: 353069 - RNA, 22 nt, Human
cugcuuugaaaauaaacuuguc

SEQ ID NO: 353070 - RNA, 22 nt, Human
cugccacuuucacccagugcuc

SEQ ID NO: 353071 - RNA, 22 nt, Human
cugagagaugauauagcuuaau

SEQ ID NO: 353072 - RNA, 22 nt, Human
ccagcccuugagauggaaggga

SEQ ID NO: 353073 - RNA, 22 nt, Human
guucuucagauuccauuucagu

SEQ ID NO: 353074 - RNA, 22 nt, Human
cuuuaagacucugcucuuggug

SEQ ID NO: 353075 - RNA, 22 nt, Human
auuuguugcuagcagcacugau

SEQ ID NO: 353076 - RNA, 22 nt, Human
cugugugcugaaaugcagugag

SEQ ID NO: 353077 - RNA, 22 nt, Human
cuugaaagaagggucuuuuaau

SEQ ID NO: 353078 - RNA, 20 nt, Human
uccaggagguuaguguggcu

SEQ ID NO: 353079 - RNA, 22 nt, Human
caggguggggcuggcuaucaaa

SEQ ID NO: 353080 - RNA, 22 nt, Human
cggcagagcccugagucagccu

SEQ ID NO: 353081 - RNA, 22 nt, Human
gggcugucaugugucagugacc

SEQ ID NO: 353082 - RNA, 22 nt, Human
agagcugcaauuucauguggug

SEQ ID NO: 353083 - RNA, 22 nt, Human
gcugagagaucaaggcaggauu

SEQ ID NO: 353084 - RNA, 22 nt, Human
uuucauuacguguuugacuugu

SEQ ID NO: 353085 - RNA, 22 nt, Human
ccaggccagcaggcacaccugc

SEQ ID NO: 353086 - RNA, 22 nt, Human
cugcugugugaccauggacagg

SEQ ID NO: 353087 - RNA, 22 nt, Human
agggccuggcgcguggccgccg

SEQ ID NO: 353088 - RNA, 22 nt, Human
aucuacaggauuuuacagaguu

SEQ ID NO: 353089 - RNA, 22 nt, Human
cagaggccauauuucuucacuc

SEQ ID NO: 353090 - RNA, 20 nt, Human
acuggagccaucucagccua

SEQ ID NO: 353091 - RNA, 22 nt, Human
uagaaaagauaacauucugugc

SEQ ID NO: 353092 - RNA, 22 nt, Human
agugaaauccuggucaacaggu

SEQ ID NO: 353093 - RNA, 22 nt, Human
aguguccccuccaagggccugg

SEQ ID NO: 353094 - RNA, 22 nt, Human
uccuugaauggacauuacacug

SEQ ID NO: 353095 - RNA, 22 nt, Human
gcuguucagggcacucaugggc

SEQ ID NO: 353096 - RNA, 22 nt, Human
uuccaguuaaggaagcuauucu

SEQ ID NO: 353097 - RNA, 22 nt, Human
uaauuucagugggcucugggcu

SEQ ID NO: 353098 - RNA, 22 nt, Human
cccaucaggaacccaggagccc

SEQ ID NO: 353099 - RNA, 22 nt, Human
uuuuccagauuggacuuagucc

SEQ ID NO: 353100 - RNA, 22 nt, Human
acuuucuaggucucaguccuuu

SEQ ID NO: 353101 - RNA, 22 nt, Human
acagagcuucccagccugagca

SEQ ID NO: 353102 - RNA, 22 nt, Human
ccagcuuuaucaagucugagcu

SEQ ID NO: 353103 - RNA, 22 nt, Human
ggagaggagauuguggcauuuu

SEQ ID NO: 353104 - RNA, 22 nt, Human
cauugcacagcccuguggugau

SEQ ID NO: 353105 - RNA, 22 nt, Human
auucuaggcuugaaacaugaag

SEQ ID NO: 353106 - RNA, 22 nt, Human
ugccuggcaagaggggcuggcu

SEQ ID NO: 353107 - RNA, 22 nt, Human
augggugugaaaauggucaucu

SEQ ID NO: 353108 - RNA, 22 nt, Human
uuccuuaggggacagggggaua

SEQ ID NO: 353109 - RNA, 22 nt, Human
caggacagagcccagacugugu

SEQ ID NO: 353110 - RNA, 21 nt, Human
gauugaaaccauggcagugag

SEQ ID NO: 353111 - RNA, 22 nt, Human
ucauacaucuuguauaucuauc

SEQ ID NO: 353112 - RNA, 19 nt, Human
uuagaaacuguugacacug

SEQ ID NO: 353113 - RNA, 22 nt, Human
cuccaguaucuguaggaaaagg

SEQ ID NO: 353114 - RNA, 22 nt, Human
cccaggagccaucugucuuggc

SEQ ID NO: 353115 - RNA, 22 nt, Human
gucauucuuaacaacucaguag

SEQ ID NO: 353116 - RNA, 22 nt, Human
ccagcagagggucuuggccauu

SEQ ID NO: 353117 - RNA, 22 nt, Human
ccagucccaggcagaaauccag

SEQ ID NO: 353118 - RNA, 22 nt, Human
ugaccaaagaguugcuuguauu

SEQ ID NO: 353119 - RNA, 22 nt, Human
uacauguuauuucacuauuggu

SEQ ID NO: 353120 - RNA, 22 nt, Human
uggccgggccgggcgccuccac

SEQ ID NO: 353121 - RNA, 22 nt, Human
agucuugcauuuucugaagaug

SEQ ID NO: 353122 - RNA, 21 nt, Human
guuauuuuaagugagcuuugc

SEQ ID NO: 353123 - RNA, 22 nt, Human
cgggcagugcccagcggggcag

SEQ ID NO: 353124 - RNA, 22 nt, Human
augggcaguguauuggaaggaa

SEQ ID NO: 353125 - RNA, 23 nt, Human
aggcugcagaagaauagggucau

SEQ ID NO: 353126 - RNA, 22 nt, Human
caggugggccgggguuuguucu

SEQ ID NO: 353127 - RNA, 22 nt, Human
cagcaauaagguaagcuucucc

SEQ ID NO: 353128 - RNA, 22 nt, Human
ccaaggagaaaugcugugcuuu

SEQ ID NO: 353129 - RNA, 21 nt, Human
ugcugaugucagagaagcaag

SEQ ID NO: 353130 - RNA, 22 nt, Human
cuucagaauccagaaucagaau

SEQ ID NO: 353131 - RNA, 22 nt, Human
gggauggcuuuguggcugacuc

SEQ ID NO: 353132 - RNA, 22 nt, Human
ucacauaaauuauacaauuuca

SEQ ID NO: 353133 - RNA, 19 nt, Human
cauaauacaguggaucuga

SEQ ID NO: 353134 - RNA, 22 nt, Human
ccacugcccaccccgacgucua

SEQ ID NO: 353135 - RNA, 21 nt, Human
uggcagaguugaguaguuaug

SEQ ID NO: 353136 - RNA, 22 nt, Human
cucuggaauuaaggaagccugu

SEQ ID NO: 353137 - RNA, 22 nt, Human
gugcagcugugugagagcucca

SEQ ID NO: 353138 - RNA, 21 nt, Human
caggaaaagcggaagucuagc

SEQ ID NO: 353139 - RNA, 22 nt, Human
aggauuuaucaggaacucucuu

SEQ ID NO: 353140 - RNA, 22 nt, Human
ugccaggccaauucuauuugac

SEQ ID NO: 353141 - RNA, 22 nt, Human
ugagagagccugaaucucuuac

SEQ ID NO: 353142 - RNA, 22 nt, Human
gccagcugguaggcaccuagcc

SEQ ID NO: 353143 - RNA, 22 nt, Human
uuuauccauaucauuaaaaucu

SEQ ID NO: 353144 - RNA, 22 nt, Human
ggagaugcuauguaguuugguu

SEQ ID NO: 353145 - RNA, 22 nt, Human
uccucuggcucuuucccuagga

SEQ ID NO: 353146 - RNA, 22 nt, Human
cccagcaucuccaggcauggcc

SEQ ID NO: 353147 - RNA, 19 nt, Human
acauuuagaauguacuugc

SEQ ID NO: 353148 - RNA, 22 nt, Human
accaggaggccuugguucugag

SEQ ID NO: 353149 - RNA, 22 nt, Human
ugucaugcuuauguuacauacu

SEQ ID NO: 353150 - RNA, 22 nt, Human
gagagcugggggacuguggaug

SEQ ID NO: 353151 - RNA, 22 nt, Human
uguaugcaccauuguauuaccu

SEQ ID NO: 353152 - RNA, 22 nt, Human
uccaggagguaugaguggcccc

SEQ ID NO: 353153 - RNA, 22 nt, Human
auucucuuuguauaacaucuug

SEQ ID NO: 353154 - RNA, 22 nt, Human
caaggccacguucugcaugcgg

SEQ ID NO: 353155 - RNA, 22 nt, Human
auagacauuuugcauucaagca

SEQ ID NO: 353156 - RNA, 22 nt, Human
agcauauaaauggacauauuug

SEQ ID NO: 353157 - RNA, 22 nt, Human
uuuugagauggagucuugcucu

SEQ ID NO: 353158 - RNA, 22 nt, Human
ucuggcuccugaguccaugcuc

SEQ ID NO: 353159 - RNA, 22 nt, Human
uuuaauuuguauuucuagaggg

SEQ ID NO: 353160 - RNA, 22 nt, Human
ggcucuggcaaggggaggcuac

SEQ ID NO: 353161 - RNA, 22 nt, Human
ccaaggagcucauauucuuguu

SEQ ID NO: 353162 - RNA, 22 nt, Human
aaaaugaggucaauauccuuuu

SEQ ID NO: 353163 - RNA, 22 nt, Human
gugucauguagaaauugaugaa

SEQ ID NO: 353164 - RNA, 22 nt, Human
aaaaugaugcuguaauuuggca

SEQ ID NO: 353165 - RNA, 22 nt, Human
gccagaaacauacacaucacuu

SEQ ID NO: 353166 - RNA, 21 nt, Human
gugucaugguugacuuuggca

SEQ ID NO: 353167 - RNA, 19 nt, Human
ucucccagcugagaagggc

SEQ ID NO: 353168 - RNA, 22 nt, Human
ucagaagaagagacuccacagc

SEQ ID NO: 353169 - RNA, 22 nt, Human
ugaaacauuugaugaucuuugg

SEQ ID NO: 353170 - RNA, 22 nt, Human
aaugcuuuuugcgaaaugugca

SEQ ID NO: 353171 - RNA, 22 nt, Human
gcagccaggaaagcuggacccu

SEQ ID NO: 353172 - RNA, 22 nt, Human
aggaucugugagugcugcagac

SEQ ID NO: 353173 - RNA, 22 nt, Human
cucuuccucucaugcggucaua

SEQ ID NO: 353174 - RNA, 20 nt, Human
ucccaagggcugagaggauc

SEQ ID NO: 353175 - RNA, 22 nt, Human
acagaaggcggggacaaggcgg

SEQ ID NO: 353176 - RNA, 18 nt, Human
aagcugcccucaggcagg

SEQ ID NO: 353177 - RNA, 22 nt, Human
ugcacagcgggugucugucagg

SEQ ID NO: 353178 - RNA, 22 nt, Human
acaugucuuuuaaagucuaaua

SEQ ID NO: 353179 - RNA, 22 nt, Human
caguccagcccccugcuaaaag

SEQ ID NO: 353180 - RNA, 22 nt, Human
ccucccagugccuccagagcag

SEQ ID NO: 353181 - RNA, 22 nt, Human
gcagauggcugagccugcagau

SEQ ID NO: 353182 - RNA, 22 nt, Human
cccucugcucaggugcauaggc

SEQ ID NO: 353183 - RNA, 22 nt, Human
gaggcaugcagagcuggagcag

SEQ ID NO: 353184 - RNA, 22 nt, Human
aauaauuuugagagccuggaaa

SEQ ID NO: 353185 - RNA, 22 nt, Human
uugcaucuaccauaucaaagau

SEQ ID NO: 353186 - RNA, 22 nt, Human
cugggccuggcguuccaggcug

SEQ ID NO: 353187 - RNA, 22 nt, Human
ggaggccaaggagggcggauca

SEQ ID NO: 353188 - RNA, 22 nt, Human
ccacugucugcaggccucagca

SEQ ID NO: 353189 - RNA, 22 nt, Human
agucuccuuggccucaaugccu

SEQ ID NO: 353190 - RNA, 22 nt, Human
gcuguguuggugaagcuguagc

SEQ ID NO: 353191 - RNA, 22 nt, Human
ucaggcagguuggcugcagguc

SEQ ID NO: 353192 - RNA, 22 nt, Human
cuugcugggguaagucugugcu

SEQ ID NO: 353193 - RNA, 22 nt, Human
aagggugggcaccgccagguca

SEQ ID NO: 353194 - RNA, 22 nt, Human
ggcugcagggcagcuggugugg

SEQ ID NO: 353195 - RNA, 22 nt, Human
auugauggcggccucuccauau

SEQ ID NO: 353196 - RNA, 19 nt, Human
ugugaaagcuaguguucuu

SEQ ID NO: 353197 - RNA, 22 nt, Human
agggcagugggaaagccugcuc

SEQ ID NO: 353198 - RNA, 22 nt, Human
gcccagcuccucugcagacccu

SEQ ID NO: 353199 - RNA, 22 nt, Human
acagagagaauuggguuuacag

SEQ ID NO: 353200 - RNA, 23 nt, Human
cuggcucauccugguugcagugg

SEQ ID NO: 353201 - RNA, 22 nt, Human
uggcagcuggcucugcgcaggc

SEQ ID NO: 353202 - RNA, 19 nt, Human
ccugugugggguagagauc

SEQ ID NO: 353203 - RNA, 22 nt, Human
aaaugcauaucaaagacuugaa

SEQ ID NO: 353204 - RNA, 22 nt, Human
ggcaccaggcugggcauaggcc

SEQ ID NO: 353205 - RNA, 22 nt, Human
aggacagcagugcuggcacuug

SEQ ID NO: 353206 - RNA, 22 nt, Human
guggaggguuugcaaugugcag

SEQ ID NO: 353207 - RNA, 22 nt, Human
ucuggcucuguguccucaccca

SEQ ID NO: 353208 - RNA, 22 nt, Human
cugcagccuccugggguacaug

SEQ ID NO: 353209 - RNA, 22 nt, Human
uauuaggguuuugaagguuugu

SEQ ID NO: 353210 - RNA, 23 nt, Human
ugagaagccauuagagcaggugg

SEQ ID NO: 353211 - RNA, 22 nt, Human
uagagugguuaacaguuuagaa

SEQ ID NO: 353212 - RNA, 22 nt, Human
guggcacagugggagagcccca

SEQ ID NO: 353213 - RNA, 22 nt, Human
cuucaagagaaugcagggaugu

SEQ ID NO: 353214 - RNA, 22 nt, Human
acagaauuaaaguguuugugga

SEQ ID NO: 353215 - RNA, 22 nt, Human
gauggcuucacuuacauggcug

SEQ ID NO: 353216 - RNA, 22 nt, Human
uacauguauugauuucucuucu

SEQ ID NO: 353217 - RNA, 22 nt, Human
ugcucuguaacaaauugacaug

SEQ ID NO: 353218 - RNA, 22 nt, Human
ccaaagugcugagauuacaggu

SEQ ID NO: 353219 - RNA, 22 nt, Human
agggccuggcuucacuuucuca

SEQ ID NO: 353220 - RNA, 22 nt, Human
aggcggcuccgggagugugggc

SEQ ID NO: 353221 - RNA, 22 nt, Human
cuucccacuaguaucacagagc

SEQ ID NO: 353222 - RNA, 22 nt, Human
uuuaguaaguucacugcaaagc

SEQ ID NO: 353223 - RNA, 22 nt, Human
guaucacuuuugagagugagaa

SEQ ID NO: 353224 - RNA, 23 nt, Human
cccagagcacagccuccagaugc

SEQ ID NO: 353225 - RNA, 23 nt, Human
cuucucagaagucugugccagga

SEQ ID NO: 353226 - RNA, 22 nt, Human
uccagccacucagcagggauug

SEQ ID NO: 353227 - RNA, 22 nt, Human
gagcagcucugugccuggagac

SEQ ID NO: 353228 - RNA, 22 nt, Human
gggugggguguaucggauccua

SEQ ID NO: 353229 - RNA, 22 nt, Human
uuacaaaguguuaugauaaaca

SEQ ID NO: 353230 - RNA, 17 nt, Human
cagugcagagcccuuuc

SEQ ID NO: 353231 - RNA, 22 nt, Human
agggccagggaaacgaucagca

SEQ ID NO: 353232 - RNA, 22 nt, Human
ugccaggcuccggaacgacagu

SEQ ID NO: 353233 - RNA, 22 nt, Human
gaaaugcagauucugauucugu

SEQ ID NO: 353234 - RNA, 21 nt, Human
ugucagagcuuguaggacauu

SEQ ID NO: 353235 - RNA, 22 nt, Human
agagccuggacuuuucugagcc

SEQ ID NO: 353236 - RNA, 22 nt, Human
uuguuuugcuaaagggucauca

SEQ ID NO: 353237 - RNA, 22 nt, Human
acacagggaggaggugcugugc

SEQ ID NO: 353238 - RNA, 17 nt, Human
gcugcagcgguaggcag

SEQ ID NO: 353239 - RNA, 22 nt, Human
ccaggagauuuuuccauagcac

SEQ ID NO: 353240 - RNA, 22 nt, Human
cagccagguucaaguccuuaua

SEQ ID NO: 353241 - RNA, 22 nt, Human
gggagaaggagcuaguucuuga

SEQ ID NO: 353242 - RNA, 22 nt, Human
ggaggggcagccauggaacucc

SEQ ID NO: 353243 - RNA, 22 nt, Human
ccagagcugauuccugggacuu

SEQ ID NO: 353244 - RNA, 22 nt, Human
ugauacagucagcucacaauug

SEQ ID NO: 353245 - RNA, 22 nt, Human
agcccaggucucaaaguacagg

SEQ ID NO: 353246 - RNA, 22 nt, Human
cacaggcuuccaguccccagcu

SEQ ID NO: 353247 - RNA, 22 nt, Human
ucaaacuguuuacagugagaua

SEQ ID NO: 353248 - RNA, 22 nt, Human
ucccagagccucugccacucug

SEQ ID NO: 353249 - RNA, 22 nt, Human
agggucugacugaauggaaaag

SEQ ID NO: 353250 - RNA, 22 nt, Human
auguguagaacuguaaugccca

SEQ ID NO: 353251 - RNA, 22 nt, Human
gggcugacucaaccuugcaaag

SEQ ID NO: 353252 - RNA, 22 nt, Human
gcacugcagguggguggagagg

SEQ ID NO: 353253 - RNA, 20 nt, Human
caguccaaucagaggccacc

SEQ ID NO: 353254 - RNA, 22 nt, Human
cuggcuuccucaggagcagugg

SEQ ID NO: 353255 - RNA, 22 nt, Human
acuucuugggacccuggcaccg

SEQ ID NO: 353256 - RNA, 22 nt, Human
aaagucuuuauuuuguaucuuu

SEQ ID NO: 353257 - RNA, 22 nt, Human
uagggcagagcuuguacacgau

SEQ ID NO: 353258 - RNA, 22 nt, Human
cugaggaugguguggucuucuc

SEQ ID NO: 353259 - RNA, 22 nt, Human
caggcagcguccugcuuccugu

SEQ ID NO: 353260 - RNA, 22 nt, Human
cacagccugcugcacucaagaa

SEQ ID NO: 353261 - RNA, 22 nt, Human
gguggccuuucaguggaucagg

SEQ ID NO: 353262 - RNA, 22 nt, Human
aggccugcagcaggagcaaacc

SEQ ID NO: 353263 - RNA, 22 nt, Human
acucucagaggguggcagcaau

SEQ ID NO: 353264 - RNA, 22 nt, Human
cccugccuuguuggagccuaug

SEQ ID NO: 353265 - RNA, 22 nt, Human
cuuauuuugcugaugacccagg

SEQ ID NO: 353266 - RNA, 22 nt, Human
guguacauagaauugugcuuug

SEQ ID NO: 353267 - RNA, 23 nt, Human
gccugccugaccugugcaaaguc

SEQ ID NO: 353268 - RNA, 22 nt, Human
gcagcguggggacaggagcuca

SEQ ID NO: 353269 - RNA, 22 nt, Human
cugaaggaagcagaagcgaggu

SEQ ID NO: 353270 - RNA, 22 nt, Human
ugaguucucacccauucuucuu

SEQ ID NO: 353271 - RNA, 22 nt, Human
uagccaggcgaggucagugucg

SEQ ID NO: 353272 - RNA, 22 nt, Human
uucccaugccuggccccuaucc

SEQ ID NO: 353273 - RNA, 22 nt, Human
cugcugugacagcugccguguu

SEQ ID NO: 353274 - RNA, 22 nt, Human
ggcagccuugagggaggccugg

SEQ ID NO: 353275 - RNA, 22 nt, Human
ggagccagugcccucuggugga

SEQ ID NO: 353276 - RNA, 22 nt, Human
gcugccugccuugccuggagga

SEQ ID NO: 353277 - RNA, 22 nt, Human
ggcuuuauuucacuguaccaua

SEQ ID NO: 353278 - RNA, 22 nt, Human
ggggaccuggccacccauccuu

SEQ ID NO: 353279 - RNA, 22 nt, Human
gccuucaggaaaucaguccuug

SEQ ID NO: 353280 - RNA, 20 nt, Human
gagccuuccccucaccacug

SEQ ID NO: 353281 - RNA, 22 nt, Human
ccugaggcccuggcugugcuga

SEQ ID NO: 353282 - RNA, 22 nt, Human
uugggggaagaggauagacagu

SEQ ID NO: 353283 - RNA, 22 nt, Human
ugaggccagucucaucacaggc

SEQ ID NO: 353284 - RNA, 22 nt, Human
cagcugugcuagaagccacgaa

SEQ ID NO: 353285 - RNA, 22 nt, Human
agugggaccggugcuauuccag

SEQ ID NO: 353286 - RNA, 22 nt, Human
ugaaagggguugaguuacagcu

SEQ ID NO: 353287 - RNA, 22 nt, Human
uuuguuagagugugggaggcug

SEQ ID NO: 353288 - RNA, 22 nt, Human
agucucagggccacccggggaa

SEQ ID NO: 353289 - RNA, 22 nt, Human
agaaacuucagcuauucuuuug

SEQ ID NO: 353290 - RNA, 22 nt, Human
ucaggagauggucuuuauaggc

SEQ ID NO: 353291 - RNA, 22 nt, Human
caaauuccucagaaucagaaaa

SEQ ID NO: 353292 - RNA, 22 nt, Human
aagcagcacgcuuugccaacaa

SEQ ID NO: 353293 - RNA, 22 nt, Human
gagugcaguaucuucugugucc

SEQ ID NO: 353294 - RNA, 22 nt, Human
gcaaaaaaugcuuguugcuuag

SEQ ID NO: 353295 - RNA, 19 nt, Human
agggccaggauucuggaac

SEQ ID NO: 353296 - RNA, 22 nt, Human
aaagauuugaaauuaggcauca

SEQ ID NO: 353297 - RNA, 22 nt, Human
cacagcauaaugaaauauacuu

SEQ ID NO: 353298 - RNA, 22 nt, Human
cccuggagcugcuugcauguug

SEQ ID NO: 353299 - RNA, 20 nt, Human
cucuccuugccgacuuggca

SEQ ID NO: 353300 - RNA, 22 nt, Human
auucaacggguagaagggucuu

SEQ ID NO: 353301 - RNA, 22 nt, Human
uagugcacacgcauguagcagu

SEQ ID NO: 353302 - RNA, 22 nt, Human
gagacacacacaggagguggca

SEQ ID NO: 353303 - RNA, 22 nt, Human
uaugcacauuaucuaauccauu

SEQ ID NO: 353304 - RNA, 22 nt, Human
acccaggaggcaagguugcagu

SEQ ID NO: 353305 - RNA, 22 nt, Human
agccagccaguucacuaggaaa

SEQ ID NO: 353306 - RNA, 22 nt, Human
acaugcauaggagaagucuuua

SEQ ID NO: 353307 - RNA, 21 nt, Human
agcagcugggcaacauggagg

SEQ ID NO: 353308 - RNA, 22 nt, Human
agccuucaaccuagcuagagca

SEQ ID NO: 353309 - RNA, 22 nt, Human
uaauuuuuccacguacacuggg

SEQ ID NO: 353310 - RNA, 22 nt, Human
uacaggcacugaaaugcuuauu

SEQ ID NO: 353311 - RNA, 22 nt, Human
cagagccugccaccuuucuccc

SEQ ID NO: 353312 - RNA, 22 nt, Human
uaggcagauguuaacaggaaaa

SEQ ID NO: 353313 - RNA, 22 nt, Human
agggagaacaguugcagcagac

SEQ ID NO: 353314 - RNA, 21 nt, Human
ccugggccaaauucccuggac

SEQ ID NO: 353315 - RNA, 21 nt, Human
uuuagggaccaggucauaggc

SEQ ID NO: 353316 - RNA, 22 nt, Human
cagagagcuuagugugcugcau

SEQ ID NO: 353317 - RNA, 22 nt, Human
uuugcauuaguuuagauuucaa

SEQ ID NO: 353318 - RNA, 22 nt, Human
cucuggaaaaccacuagcagga

SEQ ID NO: 353319 - RNA, 22 nt, Human
ucucauucauacccuacaugcu

SEQ ID NO: 353320 - RNA, 22 nt, Human
guucaaagcuccugguacagua

SEQ ID NO: 353321 - RNA, 22 nt, Human
agcugggcagacugcagugguu

SEQ ID NO: 353322 - RNA, 22 nt, Human
uaauuuuaacugugcuguuugg

SEQ ID NO: 353323 - RNA, 22 nt, Human
uuuuucauugcagccucucucc

SEQ ID NO: 353324 - RNA, 22 nt, Human
auugaaaauauaauucuaggag

SEQ ID NO: 353325 - RNA, 22 nt, Human
caguggaauauauaggggauuu

SEQ ID NO: 353326 - RNA, 22 nt, Human
guuugcauaaaguggaugcagg

SEQ ID NO: 353327 - RNA, 22 nt, Human
aggcucagggacucccucccuc

SEQ ID NO: 353328 - RNA, 22 nt, Human
gaggcugggaaguccaagacca

SEQ ID NO: 353329 - RNA, 22 nt, Human
gacaggcuuccuaagugccaga

SEQ ID NO: 353330 - RNA, 22 nt, Human
uaaauuaugucacaugacucug

SEQ ID NO: 353331 - RNA, 22 nt, Human
agucagugaaggcauugcucaa

SEQ ID NO: 353332 - RNA, 22 nt, Human
uucuaccuacccucugcauaca

SEQ ID NO: 353333 - RNA, 18 nt, Human
ugcuuggagcauuuacca

SEQ ID NO: 353334 - RNA, 22 nt, Human
cauuucugcagaauugcucuuc

SEQ ID NO: 353335 - RNA, 22 nt, Human
gggcuggaggaccggccucgga

SEQ ID NO: 353336 - RNA, 22 nt, Human
uccagucaggcugaauucaagg

SEQ ID NO: 353337 - RNA, 22 nt, Human
gagcugcagcggcugacgcaac

SEQ ID NO: 353338 - RNA, 17 nt, Human
ccucacagggaccagac

SEQ ID NO: 353339 - RNA, 17 nt, Human
uuugaaaggaugucagu

SEQ ID NO: 353340 - RNA, 22 nt, Human
agcccaggagguggagguugca

SEQ ID NO: 353341 - RNA, 22 nt, Human
acagagcaguucuggagcuggc

SEQ ID NO: 353342 - RNA, 22 nt, Human
ugugccuggcauucugggcuuc

SEQ ID NO: 353343 - RNA, 22 nt, Human
caaggccaagucucugugaaga

SEQ ID NO: 353344 - RNA, 23 nt, Human
agaagcagcuucuggaguaucgg

SEQ ID NO: 353345 - RNA, 21 nt, Human
uaauaauuccacuacagagua

SEQ ID NO: 353346 - RNA, 22 nt, Human
cccaggcugaugggaugggcca

SEQ ID NO: 353347 - RNA, 22 nt, Human
cuuagggaauugggaggaugcc

SEQ ID NO: 353348 - RNA, 22 nt, Human
gugggccuugcagggugcaggg

SEQ ID NO: 353349 - RNA, 22 nt, Human
gccugcagccccucugcaguag

SEQ ID NO: 353350 - RNA, 22 nt, Human
ugccugggguuggcaaacugcu

SEQ ID NO: 353351 - RNA, 22 nt, Human
agggaggugguuccccagugga

SEQ ID NO: 353352 - RNA, 22 nt, Human
ugcugcauuuaucuucucaaac

SEQ ID NO: 353353 - RNA, 22 nt, Human
ucugcuguauuagguugaacug

SEQ ID NO: 353354 - RNA, 22 nt, Human
caggaggagcauuagcgucuca

SEQ ID NO: 353355 - RNA, 22 nt, Human
cuucuggaggacacuggcccca

SEQ ID NO: 353356 - RNA, 22 nt, Human
agccuggaagaaccugaagucu

SEQ ID NO: 353357 - RNA, 22 nt, Human
gggaccuggcgagggucacaca

SEQ ID NO: 353358 - RNA, 22 nt, Human
acccacgaagaugagcggcaug

SEQ ID NO: 353359 - RNA, 22 nt, Human
ccugucaguugcugucagggau

SEQ ID NO: 353360 - RNA, 22 nt, Human
uccugcagccauuagaggucaa

SEQ ID NO: 353361 - RNA, 22 nt, Human
gagccuggauugucaccgacuu

SEQ ID NO: 353362 - RNA, 22 nt, Human
cuggagccaugucuugacugcu

SEQ ID NO: 353363 - RNA, 23 nt, Human
cccuguagcccaggacaggcuuu

SEQ ID NO: 353364 - RNA, 22 nt, Human
gcacccagaggucagcagugcu

SEQ ID NO: 353365 - RNA, 22 nt, Human
acagcagggggagcuguuggac

SEQ ID NO: 353366 - RNA, 19 nt, Human
agggagaauuccaagagga

SEQ ID NO: 353367 - RNA, 22 nt, Human
gauuucuucauuuguggugaau

SEQ ID NO: 353368 - RNA, 23 nt, Human
ucuauacauacugcagccucugg

SEQ ID NO: 353369 - RNA, 22 nt, Human
cagcagaggcacgucugugaau

SEQ ID NO: 353370 - RNA, 22 nt, Human
uccugaggaaaguucaugaaug

SEQ ID NO: 353371 - RNA, 22 nt, Human
cuggcucucugagauauugagu

SEQ ID NO: 353372 - RNA, 19 nt, Human
agggaaggauucugucauu

SEQ ID NO: 353373 - RNA, 22 nt, Human
aauguugaggauaucagaaaau

SEQ ID NO: 353374 - RNA, 22 nt, Human
gcaggggaguggcaggcccgga

SEQ ID NO: 353375 - RNA, 22 nt, Human
ugcagggccgcuggaggucaug

SEQ ID NO: 353376 - RNA, 22 nt, Human
cacugaaucucaaggggagggu

SEQ ID NO: 353377 - RNA, 22 nt, Human
ugaggcaggaguuaaugugcuc

SEQ ID NO: 353378 - RNA, 22 nt, Human
uccaggagcauccaggugaagc

SEQ ID NO: 353379 - RNA, 22 nt, Human
aucugaagggaaguggaaggca

SEQ ID NO: 353380 - RNA, 22 nt, Human
gcagagugggagcccagggcug

SEQ ID NO: 353381 - RNA, 22 nt, Human
gccaggcagcuagcaaccccug

SEQ ID NO: 353382 - RNA, 22 nt, Human
uuauguaccugaauuaguaaag

SEQ ID NO: 353383 - RNA, 22 nt, Human
cuaauacacccuauugcuuguu

SEQ ID NO: 353384 - RNA, 22 nt, Human
ucaagagauugaauaauaacug

SEQ ID NO: 353385 - RNA, 22 nt, Human
agauguaguagugggucuuuua

SEQ ID NO: 353386 - RNA, 22 nt, Human
ccaggagaauaauggcagauua

SEQ ID NO: 353387 - RNA, 22 nt, Human
aacucagucauaaagcgaaugc

SEQ ID NO: 353388 - RNA, 22 nt, Human
uuagccauuuuauacaagugua

SEQ ID NO: 353389 - RNA, 22 nt, Human
uugggcaaaguguuucuggagc

SEQ ID NO: 353390 - RNA, 22 nt, Human
gagucugagucuaauggcccca

SEQ ID NO: 353391 - RNA, 20 nt, Human
gauuucaaagcagaguggcc

SEQ ID NO: 353392 - RNA, 22 nt, Human
aucagaaauugcccagcuguuu

SEQ ID NO: 353393 - RNA, 22 nt, Human
uuucaugagauuccuccacauc

SEQ ID NO: 353394 - RNA, 22 nt, Human
gacaauuucucaauauagaaac

SEQ ID NO: 353395 - RNA, 22 nt, Human
aaugcaaagcaagcagagauuu

SEQ ID NO: 353396 - RNA, 22 nt, Human
cccagggcuuuucucacuagac

SEQ ID NO: 353397 - RNA, 22 nt, Human
caggcagaguuagugauuuagg

SEQ ID NO: 353398 - RNA, 19 nt, Human
uuucaauggcuuagagaaa

SEQ ID NO: 353399 - RNA, 22 nt, Human
accugccuauggagccacaugg

SEQ ID NO: 353400 - RNA, 22 nt, Human
aggcucagaggugagcaucugc

SEQ ID NO: 353401 - RNA, 22 nt, Human
aagccaggccauucucugguuc

SEQ ID NO: 353402 - RNA, 22 nt, Human
gaaaggccagcucacagaugag

SEQ ID NO: 353403 - RNA, 22 nt, Human
aggaaaacacaguauugaugga

SEQ ID NO: 353404 - RNA, 22 nt, Human
aucaccaggcaaaaugucagag

SEQ ID NO: 353405 - RNA, 22 nt, Human
agucccagcccaguccuguaag

SEQ ID NO: 353406 - RNA, 22 nt, Human
acaggcugcugagccauuugcu

SEQ ID NO: 353407 - RNA, 22 nt, Human
cagagcugauuggauccagaga

SEQ ID NO: 353408 - RNA, 22 nt, Human
cugggggcaauggucagagugu

SEQ ID NO: 353409 - RNA, 22 nt, Human
gcagauggugggggaggaguac

SEQ ID NO: 353410 - RNA, 22 nt, Human
ucugccugcaguguggcagggc

SEQ ID NO: 353411 - RNA, 22 nt, Human
aagauuuaccacuuuauucaag

SEQ ID NO: 353412 - RNA, 22 nt, Human
auauuucuugagcaccugguau

SEQ ID NO: 353413 - RNA, 22 nt, Human
caguacuugggaaugcugggga

SEQ ID NO: 353414 - RNA, 22 nt, Human
ucaccagggagcuuguccucug

SEQ ID NO: 353415 - RNA, 22 nt, Human
ugcuguagcccugcacagugca

SEQ ID NO: 353416 - RNA, 23 nt, Human
aagcugccuucgcaguuggucug

SEQ ID NO: 353417 - RNA, 22 nt, Human
aaagcugcugccaaucaggcuu

SEQ ID NO: 353418 - RNA, 22 nt, Human
uggcagaggagaauuaagauua

SEQ ID NO: 353419 - RNA, 22 nt, Human
aucuggcucucucauuuacaaa

SEQ ID NO: 353420 - RNA, 22 nt, Human
acguuuucagccuuaauguaga

SEQ ID NO: 353421 - RNA, 22 nt, Human
guaaauuauuucaagaucaucu

SEQ ID NO: 353422 - RNA, 22 nt, Human
uguauguguauguacauaugca

SEQ ID NO: 353423 - RNA, 22 nt, Human
guacagaaauggggccccaggu

SEQ ID NO: 353424 - RNA, 22 nt, Human
agcuuccuguugagagagggag

SEQ ID NO: 353425 - RNA, 22 nt, Human
aaguucaagucuccugaguaua

SEQ ID NO: 353426 - RNA, 23 nt, Human
uugauacagaagaaucaguuugu

SEQ ID NO: 353427 - RNA, 19 nt, Human
ucaaggcucccugagggau

SEQ ID NO: 353428 - RNA, 22 nt, Human
uggcucagaacuacuucuaguu

SEQ ID NO: 353429 - RNA, 22 nt, Human
augcugugccuggaaagcggcu

SEQ ID NO: 353430 - RNA, 22 nt, Human
agucccagcuucccccaugcag

SEQ ID NO: 353431 - RNA, 22 nt, Human
cagugaggugcccagccugccc

SEQ ID NO: 353432 - RNA, 22 nt, Human
cugccugugccaccgccucauu

SEQ ID NO: 353433 - RNA, 22 nt, Human
ugcagaggaccauuguccugga

SEQ ID NO: 353434 - RNA, 22 nt, Human
gaaguacaguuuuaucuagcca

SEQ ID NO: 353435 - RNA, 22 nt, Human
caaauaucuuuggcaaagagaa

SEQ ID NO: 353436 - RNA, 22 nt, Human
ucagaggaaaggucagauggcu

SEQ ID NO: 353437 - RNA, 22 nt, Human
cagccagggagggcaaaugaga

SEQ ID NO: 353438 - RNA, 22 nt, Human
ccaggccuuucuucuuggucug

SEQ ID NO: 353439 - RNA, 22 nt, Human
ugaagcaguuacuggguguuaa

SEQ ID NO: 353440 - RNA, 22 nt, Human
ugccaggccucaggagucucca

SEQ ID NO: 353441 - RNA, 20 nt, Human
accccagccccucuaucuga

SEQ ID NO: 353442 - RNA, 22 nt, Human
cccagcugcaccucuauggccu

SEQ ID NO: 353443 - RNA, 22 nt, Human
uggccagguugggcuuugcagc

SEQ ID NO: 353444 - RNA, 22 nt, Human
cccaggcaguagaaagaagagg

SEQ ID NO: 353445 - RNA, 22 nt, Human
gggcagcuagcccucuagccca

SEQ ID NO: 353446 - RNA, 22 nt, Human
gucuucuuguuuugaaggaaau

SEQ ID NO: 353447 - RNA, 20 nt, Human
augauuuugcacuaacuuca

SEQ ID NO: 353448 - RNA, 22 nt, Human
agaugugguaguugaagggaag

SEQ ID NO: 353449 - RNA, 22 nt, Human
auguaucagauaaagcaugugg

SEQ ID NO: 353450 - RNA, 22 nt, Human
ggcuuuaucaaaugagacccug

SEQ ID NO: 353451 - RNA, 22 nt, Human
aggcacugaagaacucuuuuug

SEQ ID NO: 353452 - RNA, 22 nt, Human
aaagcaaugggucuaagguaaa

SEQ ID NO: 353453 - RNA, 22 nt, Human
aagggcucuguugccauuucag

SEQ ID NO: 353454 - RNA, 22 nt, Human
uaagaaucaguagauauagauu

SEQ ID NO: 353455 - RNA, 22 nt, Human
aggaagccaugguggacgucua

SEQ ID NO: 353456 - RNA, 22 nt, Human
uauuucugucagccagauaugg

SEQ ID NO: 353457 - RNA, 22 nt, Human
ugcucuggagggugaagcuuuu

SEQ ID NO: 353458 - RNA, 22 nt, Human
aaggugucacugggacaggaaa

SEQ ID NO: 353459 - RNA, 22 nt, Human
ucucagagugacaaugagaauu

SEQ ID NO: 353460 - RNA, 22 nt, Human
gccaggcuguuuuuauuacugu

SEQ ID NO: 353461 - RNA, 22 nt, Human
uaugagaaaauaaauaucuguu

SEQ ID NO: 353462 - RNA, 17 nt, Human
uccaggcagcaacugag

SEQ ID NO: 353463 - RNA, 22 nt, Human
cauuuguuuagaagucuuuaua

SEQ ID NO: 353464 - RNA, 22 nt, Human
uaguacaguuuaaauauuaaua

SEQ ID NO: 353465 - RNA, 22 nt, Human
ccagcuugaagaugugcugguu

SEQ ID NO: 353466 - RNA, 22 nt, Human
uugaagcauuugcuauagcauu

SEQ ID NO: 353467 - RNA, 21 nt, Human
agccaggcaagcacccccacu

SEQ ID NO: 353468 - RNA, 20 nt, Human
gcuuuuucuaauagcagucc

SEQ ID NO: 353469 - RNA, 22 nt, Human
uucauucaucucuaaaaugccu

SEQ ID NO: 353470 - RNA, 22 nt, Human
gggcagguggcagggucucugg

SEQ ID NO: 353471 - RNA, 22 nt, Human
gggugggccugucuggccaugu

SEQ ID NO: 353472 - RNA, 22 nt, Human
ggagccugacagugcccagcau

SEQ ID NO: 353473 - RNA, 22 nt, Human
ugcgcaggagcucugccaggag

SEQ ID NO: 353474 - RNA, 22 nt, Human
aucucagacauguuguccauga

SEQ ID NO: 353475 - RNA, 22 nt, Human
cccugagagugagugccaccuu

SEQ ID NO: 353476 - RNA, 22 nt, Human
ccaaggaguagagcaggaagcu

SEQ ID NO: 353477 - RNA, 22 nt, Human
uggcuuuacacauccacugccu

SEQ ID NO: 353478 - RNA, 19 nt, Human
ucucuggggacacuuucac

SEQ ID NO: 353479 - RNA, 22 nt, Human
uagacagauuuaaaggaaugga

SEQ ID NO: 353480 - RNA, 22 nt, Human
ccucagggacuccaugcugcag

SEQ ID NO: 353481 - RNA, 20 nt, Human
gggcuagaccagggcagagg

SEQ ID NO: 353482 - RNA, 22 nt, Human
cgcagggccgcgagcgggacca

SEQ ID NO: 353483 - RNA, 22 nt, Human
guuauaaauaccuaauaggauu

SEQ ID NO: 353484 - RNA, 20 nt, Human
aagaaacuugaaaguacaag

SEQ ID NO: 353485 - RNA, 22 nt, Human
ggaggaggggugacugaaugcu

SEQ ID NO: 353486 - RNA, 19 nt, Human
gagcugagaguagcacugg

SEQ ID NO: 353487 - RNA, 22 nt, Human
uuauuauuggugaguuaaggaa

SEQ ID NO: 353488 - RNA, 22 nt, Human
ggagcuguaacgagccauugcu

SEQ ID NO: 353489 - RNA, 23 nt, Human
gugcaugugucuuuacaguagca

SEQ ID NO: 353490 - RNA, 19 nt, Human
ucagaggauuuggcuauga

SEQ ID NO: 353491 - RNA, 22 nt, Human
ggcuggcaagugucugcucaug

SEQ ID NO: 353492 - RNA, 22 nt, Human
ugcacagagagaugagacacgu

SEQ ID NO: 353493 - RNA, 22 nt, Human
caagauggguguugugaugguu

SEQ ID NO: 353494 - RNA, 22 nt, Human
aguaaaauuucugcugaggaga

SEQ ID NO: 353495 - RNA, 22 nt, Human
auguaucaacaaauuguacagu

SEQ ID NO: 353496 - RNA, 22 nt, Human
guggaauguccuugaucauaag

SEQ ID NO: 353497 - RNA, 22 nt, Human
gccagcucagaugcaggaagga

SEQ ID NO: 353498 - RNA, 22 nt, Human
uauaaaauucucaguuuggggu

SEQ ID NO: 353499 - RNA, 22 nt, Human
ucagggcauucaagaggccugg

SEQ ID NO: 353500 - RNA, 22 nt, Human
cuggcagcauuaacagagagca

SEQ ID NO: 353501 - RNA, 22 nt, Human
gccugcuguuaacugcaggaau

SEQ ID NO: 353502 - RNA, 22 nt, Human
gccuucaguaguauccucauga

SEQ ID NO: 353503 - RNA, 22 nt, Human
gcagggaccucacuacccccag

SEQ ID NO: 353504 - RNA, 22 nt, Human
ccuccuggcccugggccuggaa

SEQ ID NO: 353505 - RNA, 22 nt, Human
cagcuuauucaguaagcacaua

SEQ ID NO: 353506 - RNA, 22 nt, Human
uuuuagauugggaaauguaaag

SEQ ID NO: 353507 - RNA, 22 nt, Human
cagucccacuagugccaauacc

SEQ ID NO: 353508 - RNA, 19 nt, Human
cccucaggucugagcaguc

SEQ ID NO: 353509 - RNA, 22 nt, Human
uauuucagcaagaagaaugugg

SEQ ID NO: 353510 - RNA, 22 nt, Human
cauaauauacuacauugaugaa

SEQ ID NO: 353511 - RNA, 22 nt, Human
uauuccaaaaucccaaacugcc

SEQ ID NO: 353512 - RNA, 21 nt, Human
aggaaaggccagcacguaggg

SEQ ID NO: 353513 - RNA, 18 nt, Human
acucaggaaaugaugaca

SEQ ID NO: 353514 - RNA, 22 nt, Human
guacagaaaugugaugacgcaa

SEQ ID NO: 353515 - RNA, 22 nt, Human
guggccugaugccagcccugug

SEQ ID NO: 353516 - RNA, 19 nt, Human
aggcagucauuggaauaua

SEQ ID NO: 353517 - RNA, 22 nt, Human
agcccaggaaucugcaucuuga

SEQ ID NO: 353518 - RNA, 21 nt, Human
gggcaggucucugaugucaac

SEQ ID NO: 353519 - RNA, 22 nt, Human
uugcauuucccauugaguaaug

SEQ ID NO: 353520 - RNA, 22 nt, Human
ucacagugagccaugucagaga

SEQ ID NO: 353521 - RNA, 22 nt, Human
ggugcucaagagggcauccucu

SEQ ID NO: 353522 - RNA, 22 nt, Human
cugugucucuccuuacaagacu

SEQ ID NO: 353523 - RNA, 22 nt, Human
cacauaauugaacgugaugagu

SEQ ID NO: 353524 - RNA, 17 nt, Human
ggccuguguggcugcag

SEQ ID NO: 353525 - RNA, 22 nt, Human
caugcuuuuuucuaguauaaau

SEQ ID NO: 353526 - RNA, 19 nt, Human
aacuagaaagguuuugaga

SEQ ID NO: 353527 - RNA, 22 nt, Human
uucagaaaaagaccauugcaau

SEQ ID NO: 353528 - RNA, 22 nt, Human
gagggucccugcucagggccag

SEQ ID NO: 353529 - RNA, 22 nt, Human
aaggcuaugaucuuuuucauga

SEQ ID NO: 353530 - RNA, 22 nt, Human
cagcccuuuccuucucagcuuu

SEQ ID NO: 353531 - RNA, 22 nt, Human
ggaggggucucuagcgaggaga

SEQ ID NO: 353532 - RNA, 22 nt, Human
ugcuuuaagacacuaaguuuga

SEQ ID NO: 353533 - RNA, 22 nt, Human
uugaaaggugaacaugaugcac

SEQ ID NO: 353534 - RNA, 22 nt, Human
aaguguguugacugaauugggg

SEQ ID NO: 353535 - RNA, 22 nt, Human
gccugccucaaaaucccaguuc

SEQ ID NO: 353536 - RNA, 22 nt, Human
cagggcucgcucuugcccuucg

SEQ ID NO: 353537 - RNA, 22 nt, Human
guaaaguucuacuagaaucaac

SEQ ID NO: 353538 - RNA, 22 nt, Human
ggucaggggcugcucuacagag

SEQ ID NO: 353539 - RNA, 22 nt, Human
agcagcugucccuuaacaucag

SEQ ID NO: 353540 - RNA, 22 nt, Human
gcagagacuccacugucuugug

SEQ ID NO: 353541 - RNA, 22 nt, Human
gaggcugcccaacuggagugga

SEQ ID NO: 353542 - RNA, 22 nt, Human
aauuccaggcagaaaugugagu

SEQ ID NO: 353543 - RNA, 22 nt, Human
ucauagaagcaccagaagauau

SEQ ID NO: 353544 - RNA, 22 nt, Human
ugcaccauuuugucaggcuacu

SEQ ID NO: 353545 - RNA, 22 nt, Human
acagggcagagaggcaggcuug

SEQ ID NO: 353546 - RNA, 22 nt, Human
ugggaggacuugugggcuucau

SEQ ID NO: 353547 - RNA, 22 nt, Human
agagcaucuaacacauaagccu

SEQ ID NO: 353548 - RNA, 22 nt, Human
ccugagagcgaguggccucaug

SEQ ID NO: 353549 - RNA, 22 nt, Human
aucugguuuggggauccuugug

SEQ ID NO: 353550 - RNA, 22 nt, Human
uaggccauucuuggagcuuacu

SEQ ID NO: 353551 - RNA, 21 nt, Human
cuacuuaaguaggggauuagg

SEQ ID NO: 353552 - RNA, 22 nt, Human
agaggcugagaaacccucuucu

SEQ ID NO: 353553 - RNA, 22 nt, Human
caaggcaggcaguucacuugag

SEQ ID NO: 353554 - RNA, 19 nt, Human
aaucagaaauaucgaggcc

SEQ ID NO: 353555 - RNA, 22 nt, Human
agacaggcuuugcuguauauca

SEQ ID NO: 353556 - RNA, 22 nt, Human
agauuuccuaugguaauuauag

SEQ ID NO: 353557 - RNA, 22 nt, Human
ucaaugaugcugaagguagcgu

SEQ ID NO: 353558 - RNA, 22 nt, Human
caaugucaugauuuuccauuag

SEQ ID NO: 353559 - RNA, 22 nt, Human
agggcucugagugggaaagagg

SEQ ID NO: 353560 - RNA, 22 nt, Human
ugcacacaaaugugaacgugcc

SEQ ID NO: 353561 - RNA, 22 nt, Human
cuggacagaaaaggccacugga

SEQ ID NO: 353562 - RNA, 22 nt, Human
gaggccuggaauuccagccugg

SEQ ID NO: 353563 - RNA, 22 nt, Human
ccuaggcccuaggcuuccauca

SEQ ID NO: 353564 - RNA, 21 nt, Human
gagcugggcgaggcuccgggg

SEQ ID NO: 353565 - RNA, 22 nt, Human
gcccaggacucagggugucgcg

SEQ ID NO: 353566 - RNA, 22 nt, Human
cccuggugguacggcacuggca

SEQ ID NO: 353567 - RNA, 22 nt, Human
acaguguuuuagaaaagcuuga

SEQ ID NO: 353568 - RNA, 22 nt, Human
guucuucacauuucauugagga

SEQ ID NO: 353569 - RNA, 22 nt, Human
caccugcaaggagcuuucauuu

SEQ ID NO: 353570 - RNA, 22 nt, Human
ggcuuuauauuguuugagcaga

SEQ ID NO: 353571 - RNA, 22 nt, Human
uuaugcuaguauaguccuuaga

SEQ ID NO: 353572 - RNA, 22 nt, Human
auacaagacucagcacagacgg

SEQ ID NO: 353573 - RNA, 22 nt, Human
ccagugggugcugggcucugcc

SEQ ID NO: 353574 - RNA, 22 nt, Human
ggaggccaaggcagguggauca

SEQ ID NO: 353575 - RNA, 20 nt, Human
caguagcaauaauuagaagc

SEQ ID NO: 353576 - RNA, 22 nt, Human
ugaagccaucaggaagccagca

SEQ ID NO: 353577 - RNA, 22 nt, Human
ccaggaaauagugcugugaucu

SEQ ID NO: 353578 - RNA, 22 nt, Human
uuugaauaaucacugggcauua

SEQ ID NO: 353579 - RNA, 22 nt, Human
auuucauacuaaggcucaaaaa

SEQ ID NO: 353580 - RNA, 22 nt, Human
ggacagcucugccaggagcuca

SEQ ID NO: 353581 - RNA, 22 nt, Human
ggguaauuggggccuugcagug

SEQ ID NO: 353582 - RNA, 15 nt, Human
ugauuuccuacuaac

SEQ ID NO: 353583 - RNA, 22 nt, Human
cuacccagcaccuaggcugccu

SEQ ID NO: 353584 - RNA, 22 nt, Human
accaaggagccacauacaaccu

SEQ ID NO: 353585 - RNA, 19 nt, Human
uggagaggaaaugcugcuc

SEQ ID NO: 353586 - RNA, 22 nt, Human
gccuuucaguuccaucaaagga

SEQ ID NO: 353587 - RNA, 22 nt, Human
aguccuuagaacagugccuggg

SEQ ID NO: 353588 - RNA, 22 nt, Human
gcugagccccccugcguggguc

SEQ ID NO: 353589 - RNA, 22 nt, Human
cugccagcaaugugaccaugcu

SEQ ID NO: 353590 - RNA, 22 nt, Human
accagggcugacaaucugaugg

SEQ ID NO: 353591 - RNA, 22 nt, Human
uucagcaaacacgaugcuuguu

SEQ ID NO: 353592 - RNA, 18 nt, Human
aggcuucccaggcaggcc

SEQ ID NO: 353593 - RNA, 22 nt, Human
cugcaucacagcaggaggcaca

SEQ ID NO: 353594 - RNA, 18 nt, Human
acagcagguuucauucuu

SEQ ID NO: 353595 - RNA, 22 nt, Human
cagaggcauuacugaaaaggug

SEQ ID NO: 353596 - RNA, 22 nt, Human
uccugagaugagacagugcugc

SEQ ID NO: 353597 - RNA, 20 nt, Human
acaguggaaauugaugucug

SEQ ID NO: 353598 - RNA, 22 nt, Human
aaaaugaauaaguuaacccagg

SEQ ID NO: 353599 - RNA, 22 nt, Human
uauuuauaaucugccaaagaga

SEQ ID NO: 353600 - RNA, 22 nt, Human
ucaggcaggcucagaggaaaac

SEQ ID NO: 353601 - RNA, 22 nt, Human
auuggcaggaaccgaggagggg

SEQ ID NO: 353602 - RNA, 22 nt, Human
ugaguuuuuucaacauaugaag

SEQ ID NO: 353603 - RNA, 22 nt, Human
agcagcauuaugauauaucuua

SEQ ID NO: 353604 - RNA, 22 nt, Human
agcaaggcagucagcuggcugg

SEQ ID NO: 353605 - RNA, 22 nt, Human
agaauuccuccucugggacacu

SEQ ID NO: 353606 - RNA, 22 nt, Human
ugaggaaguuguuucucuucua

SEQ ID NO: 353607 - RNA, 22 nt, Human
agcaucuggugagggccuaguu

SEQ ID NO: 353608 - RNA, 22 nt, Human
aaggccagacaggaccacaucu

SEQ ID NO: 353609 - RNA, 22 nt, Human
cuguccuccggccaccuacagu

SEQ ID NO: 353610 - RNA, 22 nt, Human
cgaggcaggcaggcggaggaua

SEQ ID NO: 353611 - RNA, 22 nt, Human
aagggcagagggaaucccacau

SEQ ID NO: 353612 - RNA, 22 nt, Human
cagcccagcacuaaguagauuu

SEQ ID NO: 353613 - RNA, 22 nt, Human
ggcuucagugagcugagcucac

SEQ ID NO: 353614 - RNA, 18 nt, Human
caugucugcgccacaagg

SEQ ID NO: 353615 - RNA, 22 nt, Human
uguccugcaacugaaggagaag

SEQ ID NO: 353616 - RNA, 22 nt, Human
ggugggugagcccugggagcug

SEQ ID NO: 353617 - RNA, 22 nt, Human
acagugcuggcuacaacccugg

SEQ ID NO: 353618 - RNA, 22 nt, Human
acuuuauuuccuauugcaucca

SEQ ID NO: 353619 - RNA, 22 nt, Human
uguguucuggaaagcucacuga

SEQ ID NO: 353620 - RNA, 22 nt, Human
gagcuggaagucuguggucaga

SEQ ID NO: 353621 - RNA, 22 nt, Human
uagaaacccauguuuauucagu

SEQ ID NO: 353622 - RNA, 22 nt, Human
aaauguguuucuuugugaaugg

SEQ ID NO: 353623 - RNA, 22 nt, Human
cugcugugugcuuacuuggguu

SEQ ID NO: 353624 - RNA, 22 nt, Human
ccuuuuucccuggagggacagc

SEQ ID NO: 353625 - RNA, 22 nt, Human
aggcugaggcagguggaucacu

SEQ ID NO: 353626 - RNA, 22 nt, Human
cuugccuucuguuccuauagaa

SEQ ID NO: 353627 - RNA, 22 nt, Human
gagacauggcaaaagcacuggu

SEQ ID NO: 353628 - RNA, 22 nt, Human
uggggacaggagacuuacagcu

SEQ ID NO: 353629 - RNA, 22 nt, Human
aaaauacuguggaguguugaaa

SEQ ID NO: 353630 - RNA, 22 nt, Human
gcucccacaaccuucuugcucc

SEQ ID NO: 353631 - RNA, 22 nt, Human
cuacagaaggagaaauggguaa

SEQ ID NO: 353632 - RNA, 20 nt, Human
ggcagcucacuacuuucugu

SEQ ID NO: 353633 - RNA, 22 nt, Human
ugguacacauguccaaggucag

SEQ ID NO: 353634 - RNA, 22 nt, Human
ccagggucucugcugccugaga

SEQ ID NO: 353635 - RNA, 22 nt, Human
aggcacaggaaugucauccagu

SEQ ID NO: 353636 - RNA, 22 nt, Human
ccagagcccagcacacggugcu

SEQ ID NO: 353637 - RNA, 23 nt, Human
uuugaaguugacugccuuccaga

SEQ ID NO: 353638 - RNA, 22 nt, Human
ccagucccaucucugucgcuua

SEQ ID NO: 353639 - RNA, 22 nt, Human
caauauauaaugaguacuuucc

SEQ ID NO: 353640 - RNA, 22 nt, Human
ggccuugggcagacacgucaca

SEQ ID NO: 353641 - RNA, 22 nt, Human
ggcagcucugaugaugcucugg

SEQ ID NO: 353642 - RNA, 22 nt, Human
uagacagauuucuuguuagaca

SEQ ID NO: 353643 - RNA, 22 nt, Human
gcagggcagcucacugugguuc

SEQ ID NO: 353644 - RNA, 22 nt, Human
aggcucaguucuguggugagcc

SEQ ID NO: 353645 - RNA, 20 nt, Human
ucacaggggaccaggagcag

SEQ ID NO: 353646 - RNA, 22 nt, Human
uggcauuuagaaaacaacaugu

SEQ ID NO: 353647 - RNA, 22 nt, Human
uuugcagucuggccugcuuugg

SEQ ID NO: 353648 - RNA, 22 nt, Human
gcaggcugugaggcucagaugg

SEQ ID NO: 353649 - RNA, 22 nt, Human
uuccugggacuggagcagccca

SEQ ID NO: 353650 - RNA, 22 nt, Human
ucacauuuguuccucugcacuu

SEQ ID NO: 353651 - RNA, 22 nt, Human
aagggcucccugccugaggugg

SEQ ID NO: 353652 - RNA, 22 nt, Human
gcagaauuuggggguaaccuuu

SEQ ID NO: 353653 - RNA, 22 nt, Human
ucuuccaguguagacaucugcc

SEQ ID NO: 353654 - RNA, 22 nt, Human
uagggacccucccugcucuaac

SEQ ID NO: 353655 - RNA, 21 nt, Human
aaugcauuaacauaaagcuga

SEQ ID NO: 353656 - RNA, 22 nt, Human
cacagggcaccaguuggccauc

SEQ ID NO: 353657 - RNA, 22 nt, Human
gcucucugccuuucucaaugac

SEQ ID NO: 353658 - RNA, 22 nt, Human
aagcugccuugcugaggagaaa

SEQ ID NO: 353659 - RNA, 22 nt, Human
ugggcagaaaucaguaucagau

SEQ ID NO: 353660 - RNA, 22 nt, Human
ccaggccuggaccaugccaggg

SEQ ID NO: 353661 - RNA, 22 nt, Human
caaauucaaauuucaucagugu

SEQ ID NO: 353662 - RNA, 22 nt, Human
ccuggcagcgccgaagcuggcc

SEQ ID NO: 353663 - RNA, 22 nt, Human
aguuuuucuccccuggcuucau

SEQ ID NO: 353664 - RNA, 22 nt, Human
ccagguaggagagagggauccu

SEQ ID NO: 353665 - RNA, 22 nt, Human
uuccagggcuaauuccugugga

SEQ ID NO: 353666 - RNA, 22 nt, Human
aucacauucuuucaaagcaguc

SEQ ID NO: 353667 - RNA, 19 nt, Human
ugcaagugucuuggacaag

SEQ ID NO: 353668 - RNA, 22 nt, Human
caggagaggaggcuacuucuua

SEQ ID NO: 353669 - RNA, 22 nt, Human
cagcugggcuaagaguagaggc

SEQ ID NO: 353670 - RNA, 22 nt, Human
auuccaguuggguucuaauaca

SEQ ID NO: 353671 - RNA, 21 nt, Human
uugcaccaugauaaauucaga

SEQ ID NO: 353672 - RNA, 22 nt, Human
aaggcaguacuuuauguccaua

SEQ ID NO: 353673 - RNA, 22 nt, Human
cuguugucccugggagcucagc

SEQ ID NO: 353674 - RNA, 22 nt, Human
gcugagguggcugccuuaguaa

SEQ ID NO: 353675 - RNA, 22 nt, Human
aggcagcuggcaaauucuagag

SEQ ID NO: 353676 - RNA, 22 nt, Human
cagguuuagguggacgugcagg

SEQ ID NO: 353677 - RNA, 22 nt, Human
aguguuccuugcuuucccagag

SEQ ID NO: 353678 - RNA, 22 nt, Human
agcuugauuucucugcagugug

SEQ ID NO: 353679 - RNA, 22 nt, Human
uuguggcagaccaugagucuaa

SEQ ID NO: 353680 - RNA, 22 nt, Human
ugagaagcaguuucaguaagaa

SEQ ID NO: 353681 - RNA, 22 nt, Human
caggaggcuccuagggcucugu

SEQ ID NO: 353682 - RNA, 21 nt, Human
aaaaugugagcgugaugcuua

SEQ ID NO: 353683 - RNA, 22 nt, Human
gcccaggaguuugcauuuuaac

SEQ ID NO: 353684 - RNA, 22 nt, Human
aacucagcauccugcacagaga

SEQ ID NO: 353685 - RNA, 22 nt, Human
cuggcuuucuguuauaaagaca

SEQ ID NO: 353686 - RNA, 22 nt, Human
uggcaguggcucagagugcaga

SEQ ID NO: 353687 - RNA, 21 nt, Human
uaaauaauaaguugcugagau

SEQ ID NO: 353688 - RNA, 22 nt, Human
ggccuuuaagcaauugaaaaga

SEQ ID NO: 353689 - RNA, 22 nt, Human
ugcacacacaugaaguagcaug

SEQ ID NO: 353690 - RNA, 22 nt, Human
cucuugaagcaggggccaguuc

SEQ ID NO: 353691 - RNA, 23 nt, Human
cccagcagauuguaaagugucca

SEQ ID NO: 353692 - RNA, 23 nt, Human
aucauucuccaaucuggagcagg

SEQ ID NO: 353693 - RNA, 22 nt, Human
aguggcaggcagaagcuucuca

SEQ ID NO: 353694 - RNA, 22 nt, Human
ucucccacgguacaggauaaac

SEQ ID NO: 353695 - RNA, 22 nt, Human
gcucccagggcagcgcagaaga

SEQ ID NO: 353696 - RNA, 23 nt, Human
gcucagagguuuuucucuggaug

SEQ ID NO: 353697 - RNA, 22 nt, Human
agccucugcuggcccuggcacu

SEQ ID NO: 353698 - RNA, 22 nt, Human
ucugugcucuucucaguaucac

SEQ ID NO: 353699 - RNA, 22 nt, Human
ugugccuucucaguccugcuca

SEQ ID NO: 353700 - RNA, 22 nt, Human
ucaaauaugugauagaagcuaa

SEQ ID NO: 353701 - RNA, 22 nt, Human
gaggaggaggaaguggaaccca

SEQ ID NO: 353702 - RNA, 22 nt, Human
ccauuucacucuuccugaagga

SEQ ID NO: 353703 - RNA, 22 nt, Human
cccucccaggaguggccagaga

SEQ ID NO: 353704 - RNA, 20 nt, Human
cagaccugcacccacuucga

SEQ ID NO: 353705 - RNA, 22 nt, Human
uccugcaggccagaggggugag

SEQ ID NO: 353706 - RNA, 22 nt, Human
cagugggcugugauggauucac

SEQ ID NO: 353707 - RNA, 22 nt, Human
uuugcaauuugugcugcaaaug

SEQ ID NO: 353708 - RNA, 22 nt, Human
uguacaaugcugagguuugggg

SEQ ID NO: 353709 - RNA, 22 nt, Human
ggugcagugguguggcaaaggg

SEQ ID NO: 353710 - RNA, 22 nt, Human
auauacugauagcugcacuucu

SEQ ID NO: 353711 - RNA, 22 nt, Human
caggggcucuaaugcaugauca

SEQ ID NO: 353712 - RNA, 22 nt, Human
cagcagguauguuuguucagca

SEQ ID NO: 353713 - RNA, 22 nt, Human
agugucauuccagggacccucg

SEQ ID NO: 353714 - RNA, 18 nt, Human
gagagggaucccucagga

SEQ ID NO: 353715 - RNA, 22 nt, Human
uggagcaggugcucaggguaau

SEQ ID NO: 353716 - RNA, 22 nt, Human
ucaggccacuucacaggugauu

SEQ ID NO: 353717 - RNA, 22 nt, Human
ggcagugguuagaaacaugagc

SEQ ID NO: 353718 - RNA, 21 nt, Human
ccaagacucccaucuaguggu

SEQ ID NO: 353719 - RNA, 22 nt, Human
accugggagucacaccugagaa

SEQ ID NO: 353720 - RNA, 22 nt, Human
ugucacuucaggaaugcaggga

SEQ ID NO: 353721 - RNA, 22 nt, Human
ggagauuuauagcacacuucag

SEQ ID NO: 353722 - RNA, 22 nt, Human
caggaggcccaaagggcgcaga

SEQ ID NO: 353723 - RNA, 22 nt, Human
gggcaugccugcgcagugcaug

SEQ ID NO: 353724 - RNA, 22 nt, Human
uguacaauggcuauaauacccu

SEQ ID NO: 353725 - RNA, 22 nt, Human
agcuuuaccugccuuggggcac

SEQ ID NO: 353726 - RNA, 22 nt, Human
uucugggagagaaagggccuug

SEQ ID NO: 353727 - RNA, 22 nt, Human
cuguccuguagcuccaucaguc

SEQ ID NO: 353728 - RNA, 22 nt, Human
ccccagcugcauacuugccaag

SEQ ID NO: 353729 - RNA, 22 nt, Human
uuucuuccuuaccuuacuagag

SEQ ID NO: 353730 - RNA, 22 nt, Human
cugauacauaguagcaugucau

SEQ ID NO: 353731 - RNA, 22 nt, Human
guggccuggaugagcuucgaca

SEQ ID NO: 353732 - RNA, 22 nt, Human
aaggcacuuuucuaaagaccuu

SEQ ID NO: 353733 - RNA, 22 nt, Human
uuuguuuucaaugugucauuca

SEQ ID NO: 353734 - RNA, 22 nt, Human
ucaggcagaugcagggauggau

SEQ ID NO: 353735 - RNA, 22 nt, Human
ccuccuagaggaaccccagggc

SEQ ID NO: 353736 - RNA, 22 nt, Human
auagaauucuuugaaauuuaug

SEQ ID NO: 353737 - RNA, 22 nt, Human
agggcugccugcucugcauuga

SEQ ID NO: 353738 - RNA, 22 nt, Human
uuugcaguuucauugcugaaau

SEQ ID NO: 353739 - RNA, 22 nt, Human
caggagccccaggcugacaaua

SEQ ID NO: 353740 - RNA, 22 nt, Human
ucagggcaggcgagcagcugcu

SEQ ID NO: 353741 - RNA, 22 nt, Human
uagagcugauaaugaggccaag

SEQ ID NO: 353742 - RNA, 22 nt, Human
uaauuccaaguugagacaugca

SEQ ID NO: 353743 - RNA, 22 nt, Human
aaaucacuaaguuauagugugg

SEQ ID NO: 353744 - RNA, 23 nt, Human
gcagaggagcaagcuggacacca

SEQ ID NO: 353745 - RNA, 22 nt, Human
gaugaagccugacuucucggug

SEQ ID NO: 353746 - RNA, 17 nt, Human
uagcugccccgaaugcu

SEQ ID NO: 353747 - RNA, 22 nt, Human
uuuuuccuaagcaguggagcug

SEQ ID NO: 353748 - RNA, 22 nt, Human
ggagaaggaauauuggaguagg

SEQ ID NO: 353749 - RNA, 22 nt, Human
agggugcagaaggagccuagga

SEQ ID NO: 353750 - RNA, 22 nt, Human
agcucccagagcucgagaguaa

SEQ ID NO: 353751 - RNA, 22 nt, Human
ggcuuggaaauugcaggacaca

SEQ ID NO: 353752 - RNA, 22 nt, Human
uguguuauugccacugaagacc

SEQ ID NO: 353753 - RNA, 22 nt, Human
uuuccauauucugcgucugcca

SEQ ID NO: 353754 - RNA, 22 nt, Human
cugccuuggaaaaugugguaau

SEQ ID NO: 353755 - RNA, 22 nt, Human
cugcaggggccucgagcacagg

SEQ ID NO: 353756 - RNA, 22 nt, Human
acuauacaguauguacgugcac

SEQ ID NO: 353757 - RNA, 22 nt, Human
cuuacauuuaaucaugugucau

SEQ ID NO: 353758 - RNA, 22 nt, Human
ucccuuaaaacucauguguugu

SEQ ID NO: 353759 - RNA, 23 nt, Human
cccauuuucauguuaacuccugg

SEQ ID NO: 353760 - RNA, 22 nt, Human
uuauagaacagccuccucuaga

SEQ ID NO: 353761 - RNA, 20 nt, Human
ugcagggcugccucccagcu

SEQ ID NO: 353762 - RNA, 22 nt, Human
uugccucccagcaugggcagcu

SEQ ID NO: 353763 - RNA, 22 nt, Human
ucacaggguuuggaagccuccu

SEQ ID NO: 353764 - RNA, 22 nt, Human
ugcaggagcugugcggugaggg

SEQ ID NO: 353765 - RNA, 23 nt, Human
uuccuuaacuguuaagauugucu

SEQ ID NO: 353766 - RNA, 22 nt, Human
gcucagagaugucugcugccuu

SEQ ID NO: 353767 - RNA, 22 nt, Human
aacauuuaugguagucauugca

SEQ ID NO: 353768 - RNA, 22 nt, Human
uuugaaaucuaaucaaggaaca

SEQ ID NO: 353769 - RNA, 22 nt, Human
uucaggauaugugauaucugaa

SEQ ID NO: 353770 - RNA, 22 nt, Human
gcagacagccagacugcacugg

SEQ ID NO: 353771 - RNA, 23 nt, Human
ggcacugaagcuacaauggugag

SEQ ID NO: 353772 - RNA, 22 nt, Human
uccuggugucgccuggucaguu

SEQ ID NO: 353773 - RNA, 22 nt, Human
gacuaugugaagugugaauagg

SEQ ID NO: 353774 - RNA, 22 nt, Human
agaagccagauuguagugggac

SEQ ID NO: 353775 - RNA, 22 nt, Human
uggccugccccgagauccuggc

SEQ ID NO: 353776 - RNA, 22 nt, Human
uauguacaugauuucauuugcu

SEQ ID NO: 353777 - RNA, 22 nt, Human
cagcuggcuggucagugcacaa

SEQ ID NO: 353778 - RNA, 22 nt, Human
agucccaggcagccgagccggu

SEQ ID NO: 353779 - RNA, 22 nt, Human
cuguggaaauaaacaaugcuaa

SEQ ID NO: 353780 - RNA, 21 nt, Human
uccagggaacuucucaggaau

SEQ ID NO: 353781 - RNA, 22 nt, Human
uaaagguaacaugaacugcuuu

SEQ ID NO: 353782 - RNA, 22 nt, Human
cccuucagcugagugggacagc

SEQ ID NO: 353783 - RNA, 21 nt, Human
ucuuuccugcccaguugcccu

SEQ ID NO: 353784 - RNA, 22 nt, Human
cucugcauuuuaacagaugauu

SEQ ID NO: 353785 - RNA, 22 nt, Human
gcuguguccucacacagccuuu

SEQ ID NO: 353786 - RNA, 22 nt, Human
ugacacagauuagagacauacc

SEQ ID NO: 353787 - RNA, 22 nt, Human
uaauuucuaauucauuuucagu

SEQ ID NO: 353788 - RNA, 22 nt, Human
gcugugcagguccccacugccu

SEQ ID NO: 353789 - RNA, 22 nt, Human
uuccagagaaaagguuuauuuc

SEQ ID NO: 353790 - RNA, 22 nt, Human
ugaaaucugucccacuuuagcu

SEQ ID NO: 353791 - RNA, 22 nt, Human
cuuaauuacccaaugugguagg

SEQ ID NO: 353792 - RNA, 22 nt, Human
gaggcacugcaguacagugacu

SEQ ID NO: 353793 - RNA, 22 nt, Human
aggaaaaaagucugugauuaua

SEQ ID NO: 353794 - RNA, 21 nt, Human
gcagacugcccugcugucccc

SEQ ID NO: 353795 - RNA, 22 nt, Human
gcaggcagagaaggaacauuua

SEQ ID NO: 353796 - RNA, 22 nt, Human
aggagaggaaucauuauuacaa

SEQ ID NO: 353797 - RNA, 17 nt, Human
cucuccuuccucugagg

SEQ ID NO: 353798 - RNA, 22 nt, Human
ggcagccauacucagaccuggg

SEQ ID NO: 353799 - RNA, 21 nt, Human
ugguggagugugcugagcaug

SEQ ID NO: 353800 - RNA, 23 nt, Human
ccugaagggucaggguccucagc

SEQ ID NO: 353801 - RNA, 22 nt, Human
gcuggagguuucaccugaguuu

SEQ ID NO: 353802 - RNA, 22 nt, Human
acagcagccuuguugguuucga

SEQ ID NO: 353803 - RNA, 22 nt, Human
gcagcccaauggacugagacag

SEQ ID NO: 353804 - RNA, 22 nt, Human
cagagcugcuucccaguuugug

SEQ ID NO: 353805 - RNA, 22 nt, Human
cauggccugccuccuccuggug

SEQ ID NO: 353806 - RNA, 22 nt, Human
ugugaaggagcaugcagagggg

SEQ ID NO: 353807 - RNA, 22 nt, Human
gcucccagcaauugaggcagcc

SEQ ID NO: 353808 - RNA, 21 nt, Human
uacugagaccucacagugugc

SEQ ID NO: 353809 - RNA, 22 nt, Human
gaauuguagagggaacagaagc

SEQ ID NO: 353810 - RNA, 22 nt, Human
ugaggggagcuagcaugccuug

SEQ ID NO: 353811 - RNA, 22 nt, Human
aguuauaugugaaaacacguau

SEQ ID NO: 353812 - RNA, 22 nt, Human
gagucaccuuggccgcuguccc

SEQ ID NO: 353813 - RNA, 22 nt, Human
aggaaggagggcagauauuaag

SEQ ID NO: 353814 - RNA, 22 nt, Human
gggaccuggggacuccuuguuc

SEQ ID NO: 353815 - RNA, 22 nt, Human
ccacugaaggucaacauagagc

SEQ ID NO: 353816 - RNA, 22 nt, Human
gggcaaguccggugcccagagc

SEQ ID NO: 353817 - RNA, 22 nt, Human
aguacagaccugucucuuccug

SEQ ID NO: 353818 - RNA, 22 nt, Human
gagugcaguuggggugagggga

SEQ ID NO: 353819 - RNA, 22 nt, Human
agcuucuugaccaagccuguaa

SEQ ID NO: 353820 - RNA, 22 nt, Human
agcugcuguggggcucggccug

SEQ ID NO: 353821 - RNA, 22 nt, Human
aaggugucggguuagcucagcc

SEQ ID NO: 353822 - RNA, 22 nt, Human
gggcugagucaucuggggccuc

SEQ ID NO: 353823 - RNA, 20 nt, Human
ggguggaguugcggucugug

SEQ ID NO: 353824 - RNA, 22 nt, Human
ucaccacugaacagaccuuugg

SEQ ID NO: 353825 - RNA, 22 nt, Human
gggcuggcucugucuagaaagg

SEQ ID NO: 353826 - RNA, 22 nt, Human
gcccaggaggcagagguugugg

SEQ ID NO: 353827 - RNA, 22 nt, Human
ggcuguggcagcuggaaguggu

SEQ ID NO: 353828 - RNA, 22 nt, Human
ggcaggcaaugaggaugggaag

SEQ ID NO: 353829 - RNA, 22 nt, Human
agcagccaaaugaagauuuuac

SEQ ID NO: 353830 - RNA, 22 nt, Human
augauacaucuucaugucagug

SEQ ID NO: 353831 - RNA, 22 nt, Human
acaggagugaaucuggcacuua

SEQ ID NO: 353832 - RNA, 22 nt, Human
agaaacagcauuagcaucaauu

SEQ ID NO: 353833 - RNA, 22 nt, Human
ucagaaaauaacuguuaguuug

SEQ ID NO: 353834 - RNA, 22 nt, Human
ucagaggacagcagcuaaauaa

SEQ ID NO: 353835 - RNA, 22 nt, Human
agugggcagugcgcucggaugc

SEQ ID NO: 353836 - RNA, 22 nt, Human
gagcugccugugugccaugaug

SEQ ID NO: 353837 - RNA, 22 nt, Human
cuggcucuaucuccaaggcugg

SEQ ID NO: 353838 - RNA, 22 nt, Human
auaaggcagucacuggaauguu

SEQ ID NO: 353839 - RNA, 22 nt, Human
gccaggcuggcaaaaggaaacc

SEQ ID NO: 353840 - RNA, 22 nt, Human
gaguuauucuagguccuuugua

SEQ ID NO: 353841 - RNA, 23 nt, Human
gccucugcagccuaguuaguguc

SEQ ID NO: 353842 - RNA, 22 nt, Human
agaugaaaagauaagcagcaau

SEQ ID NO: 353843 - RNA, 22 nt, Human
aaaugcaucagcucauaagaga

SEQ ID NO: 353844 - RNA, 22 nt, Human
aggccuggccccaguugcuagg

SEQ ID NO: 353845 - RNA, 22 nt, Human
cccagcucaagcagagagcuaa

SEQ ID NO: 353846 - RNA, 22 nt, Human
uggcaggaaaaacauuggagau

SEQ ID NO: 353847 - RNA, 22 nt, Human
cagcucugugggagcguaugug

SEQ ID NO: 353848 - RNA, 22 nt, Human
aaaugcagauugucauucagga

SEQ ID NO: 353849 - RNA, 22 nt, Human
cccagccucagcuuuacuucca

SEQ ID NO: 353850 - RNA, 22 nt, Human
aaauugcauuuuaaagguagau

SEQ ID NO: 353851 - RNA, 22 nt, Human
ucagaauuuuuguuacccuuga

SEQ ID NO: 353852 - RNA, 22 nt, Human
ggccagaaaguuaagcuguggc

SEQ ID NO: 353853 - RNA, 22 nt, Human
gcaaugauauugaagugaugaa

SEQ ID NO: 353854 - RNA, 20 nt, Human
ugcugcaguuucaugggacu

SEQ ID NO: 353855 - RNA, 22 nt, Human
gcagcugcagguggucccaugc

SEQ ID NO: 353856 - RNA, 22 nt, Human
acauucuuaacaguuaaaaacu

SEQ ID NO: 353857 - RNA, 22 nt, Human
ucaucaaagcgcuuggaguagg

SEQ ID NO: 353858 - RNA, 22 nt, Human
agccaggggauucaucagggac

SEQ ID NO: 353859 - RNA, 22 nt, Human
ccagcuuuccaggguugacugg

SEQ ID NO: 353860 - RNA, 22 nt, Human
cugcuguguuggcauuggauag

SEQ ID NO: 353861 - RNA, 22 nt, Human
ggagauggaauagauucugacu

SEQ ID NO: 353862 - RNA, 22 nt, Human
gcacugaaugccaaaguguagg

SEQ ID NO: 353863 - RNA, 19 nt, Human
ccucugccagcccgccucu

SEQ ID NO: 353864 - RNA, 22 nt, Human
aagcagcagaccugauuuugaa

SEQ ID NO: 353865 - RNA, 22 nt, Human
agcagccagagaaugaugcagu

SEQ ID NO: 353866 - RNA, 22 nt, Human
acuuugcaaugggcagaaccca

SEQ ID NO: 353867 - RNA, 18 nt, Human
gugccaggaggcgcagcc

SEQ ID NO: 353868 - RNA, 22 nt, Human
agaaaagggcaggagggauaca

SEQ ID NO: 353869 - RNA, 22 nt, Human
ccagagaguaggaggcauuauu

SEQ ID NO: 353870 - RNA, 22 nt, Human
agaggaggccaggcccacaccu

SEQ ID NO: 353871 - RNA, 20 nt, Human
agaguaacuggcacauaggg

SEQ ID NO: 353872 - RNA, 22 nt, Human
caauuucaauacaaaauacauu

SEQ ID NO: 353873 - RNA, 22 nt, Human
uuucacauucagauauagacuu

SEQ ID NO: 353874 - RNA, 22 nt, Human
cggggcugcucguccuccugug

SEQ ID NO: 353875 - RNA, 22 nt, Human
cugccuggguucaaguccuguu

SEQ ID NO: 353876 - RNA, 22 nt, Human
ucugucaccauucagcuugaau

SEQ ID NO: 353877 - RNA, 22 nt, Human
agagacuggagaugggcagugu

SEQ ID NO: 353878 - RNA, 22 nt, Human
cucuggacagcaggugcugugg

SEQ ID NO: 353879 - RNA, 22 nt, Human
cacugccuggaaggagagacau

SEQ ID NO: 353880 - RNA, 22 nt, Human
caucagaacaaaucgguuaaga

SEQ ID NO: 353881 - RNA, 22 nt, Human
auuuguaauuucuuaucugugu

SEQ ID NO: 353882 - RNA, 20 nt, Human
acuugcugggcuuuguuacc

SEQ ID NO: 353883 - RNA, 22 nt, Human
aggcuucagaaagaguaauugg

SEQ ID NO: 353884 - RNA, 22 nt, Human
auguuucaucaguaagguuuug

SEQ ID NO: 353885 - RNA, 22 nt, Human
ccuuccuggcuguccgccugau

SEQ ID NO: 353886 - RNA, 22 nt, Human
caggugcccagcuccugcugug

SEQ ID NO: 353887 - RNA, 22 nt, Human
gccucugcugcaagccugguug

SEQ ID NO: 353888 - RNA, 22 nt, Human
cagacacaccaggcccauucug

SEQ ID NO: 353889 - RNA, 22 nt, Human
ggaagaggcugagccagguccc

SEQ ID NO: 353890 - RNA, 22 nt, Human
ggagaagccacacauugggugu

SEQ ID NO: 353891 - RNA, 22 nt, Human
ggcagcuggggcagugcccugu

SEQ ID NO: 353892 - RNA, 22 nt, Human
ccaggagcaaagaucacuggga

SEQ ID NO: 353893 - RNA, 22 nt, Human
guguacauauugagucugcuga

SEQ ID NO: 353894 - RNA, 22 nt, Human
gcccaggaguucaagucuagug

SEQ ID NO: 353895 - RNA, 22 nt, Human
uggcugaguaaguugugauaug

SEQ ID NO: 353896 - RNA, 22 nt, Human
gccccagcucugccacaacuag

SEQ ID NO: 353897 - RNA, 22 nt, Human
uguguuuugaacucaucuacug

SEQ ID NO: 353898 - RNA, 22 nt, Human
ugguggccuugauggcaucugc

SEQ ID NO: 353899 - RNA, 22 nt, Human
cugcaggcugagcgccugccgg

SEQ ID NO: 353900 - RNA, 22 nt, Human
agugcuuuccuucuugugacau

SEQ ID NO: 353901 - RNA, 22 nt, Human
gaggaagaauugguuauuggag

SEQ ID NO: 353902 - RNA, 17 nt, Human
ucagagggaugagcagg

SEQ ID NO: 353903 - RNA, 22 nt, Human
aggaccagccuccaggucucuu

SEQ ID NO: 353904 - RNA, 22 nt, Human
ggcagcaggcgacuucccuauu

SEQ ID NO: 353905 - RNA, 20 nt, Human
guauuaggagguaaauguaa

SEQ ID NO: 353906 - RNA, 22 nt, Human
gaggcacauauauacagagccc

SEQ ID NO: 353907 - RNA, 22 nt, Human
uucuuuccacagaggggaugau

SEQ ID NO: 353908 - RNA, 22 nt, Human
agagccuguuuugugggagaug

SEQ ID NO: 353909 - RNA, 22 nt, Human
gugucccaauguucaggacggc

SEQ ID NO: 353910 - RNA, 22 nt, Human
aaggaagggaaauagugauguc

SEQ ID NO: 353911 - RNA, 22 nt, Human
caaggaaaaagcgagcucgggg

SEQ ID NO: 353912 - RNA, 22 nt, Human
uccugccuuagagcaaggaaaa

SEQ ID NO: 353913 - RNA, 22 nt, Human
ggugccaggcuguagucagggu

SEQ ID NO: 353914 - RNA, 22 nt, Human
caggacccaaccucccugcucu

SEQ ID NO: 353915 - RNA, 22 nt, Human
gccagcuggagacuggcagggg

SEQ ID NO: 353916 - RNA, 22 nt, Human
uaaggcacccauguucauacag

SEQ ID NO: 353917 - RNA, 23 nt, Human
agaucugauguuaccaagaauug

SEQ ID NO: 353918 - RNA, 22 nt, Human
agguaguguagcugagugggau

SEQ ID NO: 353919 - RNA, 22 nt, Human
uuuagaaauucaucuauggccu

SEQ ID NO: 353920 - RNA, 22 nt, Human
accaggaguuuugaccaggggc

SEQ ID NO: 353921 - RNA, 22 nt, Human
ucccagccugacagugcaucaa

SEQ ID NO: 353922 - RNA, 22 nt, Human
cuauuauuuccucaucuauaaa

SEQ ID NO: 353923 - RNA, 22 nt, Human
gggagagagaaaacguggcgca

SEQ ID NO: 353924 - RNA, 22 nt, Human
aggagggacaccaauauauguu

SEQ ID NO: 353925 - RNA, 22 nt, Human
uucuucaaaauccagcaugauu

SEQ ID NO: 353926 - RNA, 22 nt, Human
auuccaguucuccucucuaaag

SEQ ID NO: 353927 - RNA, 22 nt, Human
agggcagcacaaggcauggacu

SEQ ID NO: 353928 - RNA, 22 nt, Human
acauaccauacauggugagaug

SEQ ID NO: 353929 - RNA, 22 nt, Human
acauuucuggaguuucucaaca

SEQ ID NO: 353930 - RNA, 22 nt, Human
ggccugagaaccauggggccaa

SEQ ID NO: 353931 - RNA, 22 nt, Human
accagagcucuucagcacagga

SEQ ID NO: 353932 - RNA, 22 nt, Human
uguacaauguguuuguuggcuu

SEQ ID NO: 353933 - RNA, 22 nt, Human
ccuauacaggcuucuuuacaug

SEQ ID NO: 353934 - RNA, 17 nt, Human
gugcagggaugaaggau

SEQ ID NO: 353935 - RNA, 22 nt, Human
uuucaguguaucuuccaaaagc

SEQ ID NO: 353936 - RNA, 22 nt, Human
gaugggauuuuuuauguguuca

SEQ ID NO: 353937 - RNA, 22 nt, Human
acaguaauuaaaauggaucugc

SEQ ID NO: 353938 - RNA, 22 nt, Human
gcauggcaagaucaggagacca

SEQ ID NO: 353939 - RNA, 22 nt, Human
guggaggacaaaagaagccuuu

SEQ ID NO: 353940 - RNA, 22 nt, Human
ugcuaaauaaguggaauagaca

SEQ ID NO: 353941 - RNA, 22 nt, Human
uugauggcugugauuuacucag

SEQ ID NO: 353942 - RNA, 22 nt, Human
agcccagggacagggcggaugu

SEQ ID NO: 353943 - RNA, 22 nt, Human
agggcucccgcgguguccggga

SEQ ID NO: 353944 - RNA, 22 nt, Human
aauuagggaaaacauuugcuuu

SEQ ID NO: 353945 - RNA, 22 nt, Human
agucucuuuaaucacagugucu

SEQ ID NO: 353946 - RNA, 22 nt, Human
agccuggcuaaauucucccaug

SEQ ID NO: 353947 - RNA, 21 nt, Human
gggugggaggacacagcaggc

SEQ ID NO: 353948 - RNA, 22 nt, Human
ccaggcaggcuagaauguaaau

SEQ ID NO: 353949 - RNA, 22 nt, Human
ggacuccucuagaaguugaggc

SEQ ID NO: 353950 - RNA, 22 nt, Human
ucugaaggugcuagagaaagcu

SEQ ID NO: 353951 - RNA, 22 nt, Human
ugcugccacaaauucagcugcc

SEQ ID NO: 353952 - RNA, 22 nt, Human
agaacuguccuuggaggagagu

SEQ ID NO: 353953 - RNA, 22 nt, Human
agaaggggagaagcuaccagga

SEQ ID NO: 353954 - RNA, 22 nt, Human
uggccuggaaccuggcagggac

SEQ ID NO: 353955 - RNA, 22 nt, Human
aguaaaauuguauuggaaaaca

SEQ ID NO: 353956 - RNA, 22 nt, Human
cuucuuuccuuccuccaguggc

SEQ ID NO: 353957 - RNA, 22 nt, Human
cugaauaaagcccucgcgcgcu

SEQ ID NO: 353958 - RNA, 22 nt, Human
ggcugggccagggccuguggac

SEQ ID NO: 353959 - RNA, 22 nt, Human
uacugugaauacaaaauaaauu

SEQ ID NO: 353960 - RNA, 22 nt, Human
cauucucaauaguagaugagua

SEQ ID NO: 353961 - RNA, 22 nt, Human
cauacauuuugcauauuuacca

SEQ ID NO: 353962 - RNA, 22 nt, Human
accauuugacucucuaaggaua

SEQ ID NO: 353963 - RNA, 22 nt, Human
cagcucccuauggugaggcgac

SEQ ID NO: 353964 - RNA, 18 nt, Human
gccugggaggaggaaaug

SEQ ID NO: 353965 - RNA, 22 nt, Human
aaauuucuguuguuuugagcca

SEQ ID NO: 353966 - RNA, 22 nt, Human
acaguaauaaguguuggugagg

SEQ ID NO: 353967 - RNA, 22 nt, Human
cuugcaggauuuugcugcugua

SEQ ID NO: 353968 - RNA, 22 nt, Human
ccugagugccaugagagcaccc

SEQ ID NO: 353969 - RNA, 22 nt, Human
aagagcuggcucuugcagcagc

SEQ ID NO: 353970 - RNA, 22 nt, Human
aaauauagcaauuaugccuacu

SEQ ID NO: 353971 - RNA, 22 nt, Human
gaaggcugagcagacaggccaa

SEQ ID NO: 353972 - RNA, 22 nt, Human
ccaauacacuuuauagaagaaa

SEQ ID NO: 353973 - RNA, 22 nt, Human
uccagggcugacuugggagagg

SEQ ID NO: 353974 - RNA, 22 nt, Human
ccugcugugaccggggagcagg

SEQ ID NO: 353975 - RNA, 22 nt, Human
cccuccagccauggacccaggu

SEQ ID NO: 353976 - RNA, 22 nt, Human
cucagggucugguccuuagauu

SEQ ID NO: 353977 - RNA, 22 nt, Human
uuugugaagggaacagaagugu

SEQ ID NO: 353978 - RNA, 22 nt, Human
cccaggcugauguucagcgggu

SEQ ID NO: 353979 - RNA, 22 nt, Human
cagggccagccauccugcuggg

SEQ ID NO: 353980 - RNA, 22 nt, Human
guggcccugucccaggccuccu

SEQ ID NO: 353981 - RNA, 22 nt, Human
ugagagugaaaugucacauguc

SEQ ID NO: 353982 - RNA, 22 nt, Human
gcuuuaaugcaauuucaccuca

SEQ ID NO: 353983 - RNA, 17 nt, Human
aggccagaugaggcaag

SEQ ID NO: 353984 - RNA, 22 nt, Human
caguccuucuccauuaaggcuc

SEQ ID NO: 353985 - RNA, 22 nt, Human
caggcaggagccagggauucca

SEQ ID NO: 353986 - RNA, 22 nt, Human
augggguggaguccgggcagcg

SEQ ID NO: 353987 - RNA, 22 nt, Human
uggcagcucuguucaacaugag

SEQ ID NO: 353988 - RNA, 22 nt, Human
aggcagccagauggcagccugc

SEQ ID NO: 353989 - RNA, 22 nt, Human
agacagcugggaaauggagugu

SEQ ID NO: 353990 - RNA, 22 nt, Human
uaauaaacugcuacgcuuaguu

SEQ ID NO: 353991 - RNA, 22 nt, Human
auguacaaaauguuuugaaaug

SEQ ID NO: 353992 - RNA, 22 nt, Human
agaugcugccucuccucacaag

SEQ ID NO: 353993 - RNA, 22 nt, Human
uucaagauggcugcaaauacuu

SEQ ID NO: 353994 - RNA, 22 nt, Human
ucugaggcuauguucaggcuaa

SEQ ID NO: 353995 - RNA, 22 nt, Human
caggugggcguggcgagaaggc

SEQ ID NO: 353996 - RNA, 22 nt, Human
accagccugucugagucguggg

SEQ ID NO: 353997 - RNA, 21 nt, Human
uccucugcagugagguggccu

SEQ ID NO: 353998 - RNA, 22 nt, Human
gggcuacauugugagagaaguu

SEQ ID NO: 353999 - RNA, 22 nt, Human
aagagcugcaucuaagccauga

SEQ ID NO: 354000 - RNA, 22 nt, Human
caaaugcaaaauauaacccugu

SEQ ID NO: 354001 - RNA, 22 nt, Human
uaucaauacauguuaucagugu

SEQ ID NO: 354002 - RNA, 22 nt, Human
gcagcuggggaggucgugggga

SEQ ID NO: 354003 - RNA, 22 nt, Human
caaauacuggguaaguuaauuu

SEQ ID NO: 354004 - RNA, 22 nt, Human
agggcugccauuucuggcccaa

SEQ ID NO: 354005 - RNA, 22 nt, Human
acugcuuuagaccuagagcucu

SEQ ID NO: 354006 - RNA, 17 nt, Human
uucaagauauugaaaug

SEQ ID NO: 354007 - RNA, 22 nt, Human
acagaaguuggaauuagauacu

SEQ ID NO: 354008 - RNA, 22 nt, Human
ugcucuggggagcuccucugcg

SEQ ID NO: 354009 - RNA, 22 nt, Human
cauagaaaagaguagguaaugu

SEQ ID NO: 354010 - RNA, 22 nt, Human
uccuucaaagcuccuagugagc

SEQ ID NO: 354011 - RNA, 22 nt, Human
uguaccuuuuucugugcaugcu

SEQ ID NO: 354012 - RNA, 22 nt, Human
cauguuaaaauauacauucuga

SEQ ID NO: 354013 - RNA, 21 nt, Human
gggcuggacaugguggcucau

SEQ ID NO: 354014 - RNA, 22 nt, Human
ggguggaguagaaagaugaauu

SEQ ID NO: 354015 - RNA, 22 nt, Human
guacaaaguggaccugauagua

SEQ ID NO: 354016 - RNA, 22 nt, Human
ucagaggucccuagcaggagug

SEQ ID NO: 354017 - RNA, 17 nt, Human
uaaguccuaguuauuuu

SEQ ID NO: 354018 - RNA, 22 nt, Human
cuggccagguuuugaacaguug

SEQ ID NO: 354019 - RNA, 22 nt, Human
gaaaguuuauagguuauauaau

SEQ ID NO: 354020 - RNA, 22 nt, Human
uggaaggaaagguagcagagaa

SEQ ID NO: 354021 - RNA, 22 nt, Human
gcuggcagaagagcugguucaa

SEQ ID NO: 354022 - RNA, 22 nt, Human
accauguguuuuacacauggua

SEQ ID NO: 354023 - RNA, 22 nt, Human
uggccugggcaugaagcaucgu

SEQ ID NO: 354024 - RNA, 22 nt, Human
cauaucauaggucuuggauaau

SEQ ID NO: 354025 - RNA, 22 nt, Human
gaggccugguuuccagcauccu

SEQ ID NO: 354026 - RNA, 22 nt, Human
gccugcagauauauaggauggu

SEQ ID NO: 354027 - RNA, 22 nt, Human
ucagaaaagguagcugugacaa

SEQ ID NO: 354028 - RNA, 22 nt, Human
ccuguucaaguugcagggcugg

SEQ ID NO: 354029 - RNA, 22 nt, Human
ucagaaauacaaaacacuuacu

SEQ ID NO: 354030 - RNA, 23 nt, Human
ccucccaggcugcgagucccgag

SEQ ID NO: 354031 - RNA, 22 nt, Human
aggaggccccuccuggguugcu

SEQ ID NO: 354032 - RNA, 22 nt, Human
ucuuaaaccacaaaauucagag

SEQ ID NO: 354033 - RNA, 22 nt, Human
augggcagagcuggugggaggc

SEQ ID NO: 354034 - RNA, 18 nt, Human
ucugggcuucccgaggcu

SEQ ID NO: 354035 - RNA, 22 nt, Human
aaaucucaggccucuauuuacu

SEQ ID NO: 354036 - RNA, 22 nt, Human
aucaaaguccaucagaagguag

SEQ ID NO: 354037 - RNA, 22 nt, Human
uggauuaguuaagaaauguuag

SEQ ID NO: 354038 - RNA, 22 nt, Human
uggaggaaguggcuggccagaa

SEQ ID NO: 354039 - RNA, 22 nt, Human
ggagcugugcagugacuacaga

SEQ ID NO: 354040 - RNA, 22 nt, Human
ucuuugcaaaauacaacaaugg

SEQ ID NO: 354041 - RNA, 22 nt, Human
cacugccuccccaggcuccaca

SEQ ID NO: 354042 - RNA, 22 nt, Human
uugaauaauuaauuacacucag

SEQ ID NO: 354043 - RNA, 22 nt, Human
uggagagcaagucgcagacaug

SEQ ID NO: 354044 - RNA, 23 nt, Human
acacaaggguaacugccagccau

SEQ ID NO: 354045 - RNA, 22 nt, Human
gagggagucugugcaaagaauu

SEQ ID NO: 354046 - RNA, 22 nt, Human
ccagggaggguccuguggcuuc

SEQ ID NO: 354047 - RNA, 22 nt, Human
gaaauauucuugucuuguuuuc

SEQ ID NO: 354048 - RNA, 22 nt, Human
aagacauugucauuuuauaauu

SEQ ID NO: 354049 - RNA, 22 nt, Human
accaggagccauagagucaggc

SEQ ID NO: 354050 - RNA, 22 nt, Human
auuuauuaugggauuuggcuca

SEQ ID NO: 354051 - RNA, 22 nt, Human
caucagaagauggcucuggaaa

SEQ ID NO: 354052 - RNA, 22 nt, Human
ucuauacaaguuucacuuugac

SEQ ID NO: 354053 - RNA, 19 nt, Human
ugaggccaaggucacagau

SEQ ID NO: 354054 - RNA, 22 nt, Human
agggaagugaaugacagauauc

SEQ ID NO: 354055 - RNA, 22 nt, Human
uuucaguuguccuguuaauagc

SEQ ID NO: 354056 - RNA, 22 nt, Human
ugaagcagauggucuggucauu

SEQ ID NO: 354057 - RNA, 23 nt, Human
uauuacaauuggucuuauuaaga

SEQ ID NO: 354058 - RNA, 21 nt, Human
aggugggagaccauguagguc

SEQ ID NO: 354059 - RNA, 22 nt, Human
cuggcagcuuccuuugcaucug

SEQ ID NO: 354060 - RNA, 22 nt, Human
uuacuacugcuuuacuacuggg

SEQ ID NO: 354061 - RNA, 22 nt, Human
cagaggcucuuccucacugccc

SEQ ID NO: 354062 - RNA, 22 nt, Human
ugcagggcacacgcacgggugu

SEQ ID NO: 354063 - RNA, 22 nt, Human
cagcauggugccagugagucca

SEQ ID NO: 354064 - RNA, 22 nt, Human
ggcugccacgucgaggguccaa

SEQ ID NO: 354065 - RNA, 23 nt, Human
uccuggugacaugccugagcauc

SEQ ID NO: 354066 - RNA, 22 nt, Human
cucuggaauguuuacaugcccu

SEQ ID NO: 354067 - RNA, 22 nt, Human
agaugaagacucaggagcaggu

SEQ ID NO: 354068 - RNA, 22 nt, Human
agcagcaucuucuaaguaaggc

SEQ ID NO: 354069 - RNA, 19 nt, Human
guuucauuaagauaggaaa

SEQ ID NO: 354070 - RNA, 22 nt, Human
uauucugugugauauguaaaug

SEQ ID NO: 354071 - RNA, 22 nt, Human
caggcagccugcggucugcaca

SEQ ID NO: 354072 - RNA, 22 nt, Human
ugagaguauuuuggcauuauca

SEQ ID NO: 354073 - RNA, 22 nt, Human
aaugcuguaaagaugcuaucug

SEQ ID NO: 354074 - RNA, 22 nt, Human
gccaggcagcaggaagccagug

SEQ ID NO: 354075 - RNA, 22 nt, Human
uagauauaucugucauacuggu

SEQ ID NO: 354076 - RNA, 22 nt, Human
uagaaagugaagguuaauuaau

SEQ ID NO: 354077 - RNA, 22 nt, Human
uggcugagguaacuaugaauaa

SEQ ID NO: 354078 - RNA, 22 nt, Human
caggguugcaugcaucuguggg

SEQ ID NO: 354079 - RNA, 22 nt, Human
agcuuuaugggagcuuagauaa

SEQ ID NO: 354080 - RNA, 22 nt, Human
uucuuucccagaagauauguuu

SEQ ID NO: 354081 - RNA, 22 nt, Human
aaaguguggagauugaacuaaa

SEQ ID NO: 354082 - RNA, 20 nt, Human
ucuuauacagaaaacauuuu

SEQ ID NO: 354083 - RNA, 21 nt, Human
gccugcagaccccaccaggcu

SEQ ID NO: 354084 - RNA, 19 nt, Human
uucauucucuuauuguugu

SEQ ID NO: 354085 - RNA, 22 nt, Human
ugaaagcacaaguucuaacagg

SEQ ID NO: 354086 - RNA, 22 nt, Human
agugaccaaucaugguuagauu

SEQ ID NO: 354087 - RNA, 20 nt, Human
agagugagacuccaucucag

SEQ ID NO: 354088 - RNA, 22 nt, Human
aggcaguuucugggacagcaua

SEQ ID NO: 354089 - RNA, 22 nt, Human
gggcagguuggcaucccgggca

SEQ ID NO: 354090 - RNA, 22 nt, Human
cagcagagaaauuaaacuucug

SEQ ID NO: 354091 - RNA, 17 nt, Human
ccaggagagaugcuugu

SEQ ID NO: 354092 - RNA, 22 nt, Human
aacaguaaagacagaauuuauc

SEQ ID NO: 354093 - RNA, 22 nt, Human
aaguucaagucugcaucuuuuu

SEQ ID NO: 354094 - RNA, 22 nt, Human
cauuucaaggaccacccuggga

SEQ ID NO: 354095 - RNA, 22 nt, Human
gccuucccaagacgccugaguu

SEQ ID NO: 354096 - RNA, 22 nt, Human
ucucaggaaauaggauuugagu

SEQ ID NO: 354097 - RNA, 22 nt, Human
uuuccaaaggcuaaacucaguu

SEQ ID NO: 354098 - RNA, 22 nt, Human
aaggaaccauuugugugcaugg

SEQ ID NO: 354099 - RNA, 22 nt, Human
uuauccaaacuggugaaucauu

SEQ ID NO: 354100 - RNA, 22 nt, Human
gcagaggcaaucagguaugugg

SEQ ID NO: 354101 - RNA, 22 nt, Human
gauuauauaauggaagcucuug

SEQ ID NO: 354102 - RNA, 22 nt, Human
aggguggagggagucccugagc

SEQ ID NO: 354103 - RNA, 20 nt, Human
uauuuacaacuuagagccuc

SEQ ID NO: 354104 - RNA, 22 nt, Human
agggcugcccagugugagagcu

SEQ ID NO: 354105 - RNA, 22 nt, Human
auccacagucuuagccaucaaa

SEQ ID NO: 354106 - RNA, 22 nt, Human
uucuuugcccuuaaugaaauaa

SEQ ID NO: 354107 - RNA, 22 nt, Human
acuggcaguggcagcagaaaga

SEQ ID NO: 354108 - RNA, 22 nt, Human
uuugacaucuaagaauucuuac

SEQ ID NO: 354109 - RNA, 22 nt, Human
gcuggcuguguuccuucugcca

SEQ ID NO: 354110 - RNA, 22 nt, Human
cuugaaagucacaugcagcccu

SEQ ID NO: 354111 - RNA, 22 nt, Human
aguacuuugcacuuugcucaga

SEQ ID NO: 354112 - RNA, 22 nt, Human
ugcuucagaggaaaggcaaaag

SEQ ID NO: 354113 - RNA, 22 nt, Human
uggcuuuacugucauucuuaug

SEQ ID NO: 354114 - RNA, 22 nt, Human
ccugacucuggccaggccagcu

SEQ ID NO: 354115 - RNA, 22 nt, Human
uuccucagcuggccugauuggg

SEQ ID NO: 354116 - RNA, 22 nt, Human
gccugagcccaggugugcagag

SEQ ID NO: 354117 - RNA, 22 nt, Human
acauuguauaaugauuaucaca

SEQ ID NO: 354118 - RNA, 22 nt, Human
gcucuggaagcaucugagagga

SEQ ID NO: 354119 - RNA, 22 nt, Human
gauucugagcugguguuuuacg

SEQ ID NO: 354120 - RNA, 22 nt, Human
aaugcacaaaaauuguauguaa

SEQ ID NO: 354121 - RNA, 22 nt, Human
gcugucuggaggcucugaggga

SEQ ID NO: 354122 - RNA, 17 nt, Human
ugaaacaccaagacugu

SEQ ID NO: 354123 - RNA, 22 nt, Human
uguggccuccuguuccugggua

SEQ ID NO: 354124 - RNA, 22 nt, Human
gaggcucacuaggcauccuggg

SEQ ID NO: 354125 - RNA, 22 nt, Human
acagagccuccaggagugcugg

SEQ ID NO: 354126 - RNA, 22 nt, Human
aggcugagcaaagggccuuacc

SEQ ID NO: 354127 - RNA, 22 nt, Human
ccaggagacccagggaaggagc

SEQ ID NO: 354128 - RNA, 22 nt, Human
aagaguuaagcaacagauacca

SEQ ID NO: 354129 - RNA, 22 nt, Human
aggcagcagccacaaggccuga

SEQ ID NO: 354130 - RNA, 22 nt, Human
aagcagccuggacuugggcugg

SEQ ID NO: 354131 - RNA, 22 nt, Human
ucaggagcagcaugggugagag

SEQ ID NO: 354132 - RNA, 22 nt, Human
caucagcaggcaacacucuugg

SEQ ID NO: 354133 - RNA, 22 nt, Human
guggccugucagaagccguggg

SEQ ID NO: 354134 - RNA, 22 nt, Human
ccuggcagcagcacaugccuuc

SEQ ID NO: 354135 - RNA, 22 nt, Human
gagguagcaugcuggaagggac

SEQ ID NO: 354136 - RNA, 22 nt, Human
agggccugggccagcacccuuu

SEQ ID NO: 354137 - RNA, 22 nt, Human
ccugggcagggagaccaggcuc

SEQ ID NO: 354138 - RNA, 22 nt, Human
ggcaguggaggacccugugucu

SEQ ID NO: 354139 - RNA, 22 nt, Human
ucacugcagagaccucuaguca

SEQ ID NO: 354140 - RNA, 22 nt, Human
ggggcagagucuggacuguugu

SEQ ID NO: 354141 - RNA, 22 nt, Human
ugcuuaaaaugaugauuauuuu

SEQ ID NO: 354142 - RNA, 22 nt, Human
gcacugaaugcuuuuacuguaa

SEQ ID NO: 354143 - RNA, 22 nt, Human
ucuucucaguuucucuaggaug

SEQ ID NO: 354144 - RNA, 22 nt, Human
gcccacacaccagcucaggagg

SEQ ID NO: 354145 - RNA, 22 nt, Human
gccuguuggugacuuucuguug

SEQ ID NO: 354146 - RNA, 22 nt, Human
uaaccauauuuuccauuaaguu

SEQ ID NO: 354147 - RNA, 20 nt, Human
ggccuuggguuucgccuguu

SEQ ID NO: 354148 - RNA, 22 nt, Human
ccaggagcuggagggugcagug

SEQ ID NO: 354149 - RNA, 22 nt, Human
aaggcagcagugcacgacugau

SEQ ID NO: 354150 - RNA, 22 nt, Human
ugcuugagacacauaugaauuu

SEQ ID NO: 354151 - RNA, 22 nt, Human
cagggugcagugucgcugcuag

SEQ ID NO: 354152 - RNA, 22 nt, Human
cuuucucuguguuucacaugcu

SEQ ID NO: 354153 - RNA, 19 nt, Human
agacaaguuuccagaagcc

SEQ ID NO: 354154 - RNA, 22 nt, Human
caguccuuagucuggauggcuu

SEQ ID NO: 354155 - RNA, 22 nt, Human
ugcaucuuacguuuugaaaggg

SEQ ID NO: 354156 - RNA, 22 nt, Human
uauuauuaaauggcagaauuuu

SEQ ID NO: 354157 - RNA, 22 nt, Human
guuugcauguauuaagucaaua

SEQ ID NO: 354158 - RNA, 21 nt, Human
aagaaguuuggauuuuguccu

SEQ ID NO: 354159 - RNA, 22 nt, Human
gcucugcucuaacauuccugac

SEQ ID NO: 354160 - RNA, 22 nt, Human
cugacagucucauugauuugcu

SEQ ID NO: 354161 - RNA, 22 nt, Human
ugcagaagcugcaggucagugg

SEQ ID NO: 354162 - RNA, 22 nt, Human
uguagcauguaaauugguuauu

SEQ ID NO: 354163 - RNA, 22 nt, Human
uccucccugaguggggacagcu

SEQ ID NO: 354164 - RNA, 22 nt, Human
cagucaccuagacagaacuuac

SEQ ID NO: 354165 - RNA, 22 nt, Human
ucccugggcaucacguugcuuc

SEQ ID NO: 354166 - RNA, 22 nt, Human
ccagggugaggaggcucccacg

SEQ ID NO: 354167 - RNA, 22 nt, Human
cccagacuccucuggcuggugg

SEQ ID NO: 354168 - RNA, 22 nt, Human
caggaagagguaucaccgagca

SEQ ID NO: 354169 - RNA, 22 nt, Human
cagcccagcagggucuggcccu

SEQ ID NO: 354170 - RNA, 22 nt, Human
uggaggaauaacagcaaccuua

SEQ ID NO: 354171 - RNA, 22 nt, Human
uggccucucuaccaggcagccu

SEQ ID NO: 354172 - RNA, 22 nt, Human
uaagaacaguagaacaguaggu

SEQ ID NO: 354173 - RNA, 22 nt, Human
gggacagacccaugggccaggu

SEQ ID NO: 354174 - RNA, 22 nt, Human
uuagccauugucagcacauggc

SEQ ID NO: 354175 - RNA, 22 nt, Human
ccacaaguuucagcacccagag

SEQ ID NO: 354176 - RNA, 20 nt, Human
uggcccuguuuucuccaggc

SEQ ID NO: 354177 - RNA, 22 nt, Human
agcugguucagaaauuagaugg

SEQ ID NO: 354178 - RNA, 22 nt, Human
gcagggacaucuuugucuagua

SEQ ID NO: 354179 - RNA, 22 nt, Human
cugggcugcaucaaagaggcau

SEQ ID NO: 354180 - RNA, 22 nt, Human
acaugcuuugcacuuacaucau

SEQ ID NO: 354181 - RNA, 22 nt, Human
ggauuucuuccuuccucagaag

SEQ ID NO: 354182 - RNA, 22 nt, Human
uggccuggccacauccagcagg

SEQ ID NO: 354183 - RNA, 22 nt, Human
ucagcugagcuccagcucauag

SEQ ID NO: 354184 - RNA, 22 nt, Human
aaaugcagaucccugaaucuca

SEQ ID NO: 354185 - RNA, 22 nt, Human
ugcagcugaggccagcuaugcc

SEQ ID NO: 354186 - RNA, 22 nt, Human
agagugaaguucaucgugcagc

SEQ ID NO: 354187 - RNA, 22 nt, Human
caugauuuugucuuguguuaau

SEQ ID NO: 354188 - RNA, 18 nt, Human
ggccugaggauuucagca

SEQ ID NO: 354189 - RNA, 22 nt, Human
aucuggcuuaccuagggugccu

SEQ ID NO: 354190 - RNA, 22 nt, Human
caaauguguagagcuuuugggg

SEQ ID NO: 354191 - RNA, 22 nt, Human
cucugagcuccuggaagcgugc

SEQ ID NO: 354192 - RNA, 22 nt, Human
aacaacugaaaagcuuuuucug

SEQ ID NO: 354193 - RNA, 22 nt, Human
aagcuuuagagaugaguuccuu

SEQ ID NO: 354194 - RNA, 22 nt, Human
aguacauuuauuaaugguaaaa

SEQ ID NO: 354195 - RNA, 22 nt, Human
acacagccaggguaguaaggcu

SEQ ID NO: 354196 - RNA, 22 nt, Human
cugagcugguggaagcaugcag

SEQ ID NO: 354197 - RNA, 22 nt, Human
aagucuggaagucucaguuuuc

SEQ ID NO: 354198 - RNA, 22 nt, Human
cccaggagguggaguucacagu

SEQ ID NO: 354199 - RNA, 19 nt, Human
gcaggcaguggcauucgga

SEQ ID NO: 354200 - RNA, 20 nt, Human
accuugaacccgccagccau

SEQ ID NO: 354201 - RNA, 22 nt, Human
acaauucuggguauuuauauag

SEQ ID NO: 354202 - RNA, 22 nt, Human
aaugaacaucaaaugccuacca

SEQ ID NO: 354203 - RNA, 22 nt, Human
aagauuucucuccuggaaagca

SEQ ID NO: 354204 - RNA, 22 nt, Human
gucagugucuuaacagagauua

SEQ ID NO: 354205 - RNA, 22 nt, Human
ccugccugucccucaguccaca

SEQ ID NO: 354206 - RNA, 17 nt, Human
ugaggccugcaucagug

SEQ ID NO: 354207 - RNA, 22 nt, Human
auagacauagccguaauuuauu

SEQ ID NO: 354208 - RNA, 22 nt, Human
ucugucacccagagugcagugg

SEQ ID NO: 354209 - RNA, 22 nt, Human
auuauguagguuaggugguugu

SEQ ID NO: 354210 - RNA, 22 nt, Human
uauucauaguaaacaaaagugg

SEQ ID NO: 354211 - RNA, 22 nt, Human
ugcagccaucgcagagucugua

SEQ ID NO: 354212 - RNA, 22 nt, Human
caggccuggagugcaauggcac

SEQ ID NO: 354213 - RNA, 22 nt, Human
gcagagaccccgcagugaggcc

SEQ ID NO: 354214 - RNA, 22 nt, Human
gggcugccaagccugccugccu

SEQ ID NO: 354215 - RNA, 22 nt, Human
aggagaggguggcauuaaguuu

SEQ ID NO: 354216 - RNA, 22 nt, Human
auucauaaguaaaugauuaccu

SEQ ID NO: 354217 - RNA, 22 nt, Human
uuaguaaauaaagucuacuuuc

SEQ ID NO: 354218 - RNA, 20 nt, Human
agggcagcuugaggagccgg

SEQ ID NO: 354219 - RNA, 18 nt, Human
acauuucuccuucugacc

SEQ ID NO: 354220 - RNA, 22 nt, Human
aagcagggcuuuaagcgguuuu

SEQ ID NO: 354221 - RNA, 20 nt, Human
ugccaugguaacagagugug

SEQ ID NO: 354222 - RNA, 22 nt, Human
caguguggugugcacagcuuag

SEQ ID NO: 354223 - RNA, 22 nt, Human
cagagcaguccuugucaaucag

SEQ ID NO: 354224 - RNA, 22 nt, Human
caggguggcacucagcgcaucu

SEQ ID NO: 354225 - RNA, 22 nt, Human
ccagcuuucugggugguuucug

SEQ ID NO: 354226 - RNA, 22 nt, Human
guucuucaguaaaauuaaaugu

SEQ ID NO: 354227 - RNA, 22 nt, Human
cacaaaugugcagaaaugugag

SEQ ID NO: 354228 - RNA, 22 nt, Human
ccucucauagucuguauccuuu

SEQ ID NO: 354229 - RNA, 22 nt, Human
acauguggucaaucuguguagg

SEQ ID NO: 354230 - RNA, 22 nt, Human
ggcuggccuguguggccgccac

SEQ ID NO: 354231 - RNA, 21 nt, Human
ggccucugucauccugggaag

SEQ ID NO: 354232 - RNA, 22 nt, Human
cugagcuuccaguuccuccagg

SEQ ID NO: 354233 - RNA, 19 nt, Human
aacuggauaauggccacau

SEQ ID NO: 354234 - RNA, 22 nt, Human
uagcacauuguugaccagaagg

SEQ ID NO: 354235 - RNA, 22 nt, Human
ucucaagaucucaagauggccc

SEQ ID NO: 354236 - RNA, 22 nt, Human
auggcuuaugguaaauauuucu

SEQ ID NO: 354237 - RNA, 22 nt, Human
cucagagaagucuuugcuaaac

SEQ ID NO: 354238 - RNA, 22 nt, Human
uggccagguguggguucucaga

SEQ ID NO: 354239 - RNA, 22 nt, Human
auuaggcagacaacguagccgg

SEQ ID NO: 354240 - RNA, 20 nt, Human
acugcuucuuucucugaccu

SEQ ID NO: 354241 - RNA, 18 nt, Human
ggagagugagaucaaaca

SEQ ID NO: 354242 - RNA, 21 nt, Human
gccugccugcgugacccucuu

SEQ ID NO: 354243 - RNA, 22 nt, Human
ugaaauauuuagagaguaaguu

SEQ ID NO: 354244 - RNA, 22 nt, Human
gggcuaggcuuggccagcacug

SEQ ID NO: 354245 - RNA, 22 nt, Human
gggcucucaaggcagggcccca

SEQ ID NO: 354246 - RNA, 22 nt, Human
gagggcugugaaggagcggguu

SEQ ID NO: 354247 - RNA, 22 nt, Human
ggaggccaggaaggcucggaga

SEQ ID NO: 354248 - RNA, 22 nt, Human
ccucucuguguggccucuccau

SEQ ID NO: 354249 - RNA, 22 nt, Human
gcagcagcccagggcucucaga

SEQ ID NO: 354250 - RNA, 22 nt, Human
cagggaggcugucuuaugccug

SEQ ID NO: 354251 - RNA, 22 nt, Human
uaagagaauguuguggcuaggu

SEQ ID NO: 354252 - RNA, 22 nt, Human
ccagcccugccagagagagcug

SEQ ID NO: 354253 - RNA, 22 nt, Human
agaagcagacucugaggcaagg

SEQ ID NO: 354254 - RNA, 22 nt, Human
ucaaguguaguggugucagguc

SEQ ID NO: 354255 - RNA, 22 nt, Human
ggcucagguuaccagucccucc

SEQ ID NO: 354256 - RNA, 23 nt, Human
cugcuguuuucuguaccugaagc

SEQ ID NO: 354257 - RNA, 22 nt, Human
gagcugcuucugugugccgggu

SEQ ID NO: 354258 - RNA, 22 nt, Human
uacaugcaugucacagaaugaa

SEQ ID NO: 354259 - RNA, 22 nt, Human
ugaaggaaugagggaguggguc

SEQ ID NO: 354260 - RNA, 22 nt, Human
ggcuucaccaggugcaugcaug

SEQ ID NO: 354261 - RNA, 22 nt, Human
ucugggugaugaaaugcacugu

SEQ ID NO: 354262 - RNA, 22 nt, Human
aggcagguuucccggcugucaa

SEQ ID NO: 354263 - RNA, 22 nt, Human
cccugcagaucagugagaacuu

SEQ ID NO: 354264 - RNA, 22 nt, Human
uaucuuguaauagguccacuug

SEQ ID NO: 354265 - RNA, 22 nt, Human
gagcagcugguaggugaaccca

SEQ ID NO: 354266 - RNA, 22 nt, Human
gugcagauccugauugcaguuc

SEQ ID NO: 354267 - RNA, 22 nt, Human
gccugccuuuuggaggcacauu

SEQ ID NO: 354268 - RNA, 22 nt, Human
caguauuuguucccuaucaaug

SEQ ID NO: 354269 - RNA, 22 nt, Human
gaaggcuggaaggcaaguagga

SEQ ID NO: 354270 - RNA, 22 nt, Human
ugaggcucuccaagcagaugag

SEQ ID NO: 354271 - RNA, 22 nt, Human
acauuguagacuuuucauaugu

SEQ ID NO: 354272 - RNA, 22 nt, Human
ucugaaagaagggcagucuuuu

SEQ ID NO: 354273 - RNA, 22 nt, Human
aaaaaugcugugguagcugugu

SEQ ID NO: 354274 - RNA, 22 nt, Human
caccuagggcaucccugcccca

SEQ ID NO: 354275 - RNA, 22 nt, Human
ucaucaguuuagaaaaaauaug

SEQ ID NO: 354276 - RNA, 22 nt, Human
aaaugaaaugagugccuggagg

SEQ ID NO: 354277 - RNA, 22 nt, Human
acagucucuccacacugcaggg

SEQ ID NO: 354278 - RNA, 22 nt, Human
ggaccugaacauaaaacgaggc

SEQ ID NO: 354279 - RNA, 22 nt, Human
gugcagggcuggcaccggaggc

SEQ ID NO: 354280 - RNA, 22 nt, Human
cuugccuguggcuaguuggcuc

SEQ ID NO: 354281 - RNA, 22 nt, Human
cagagacagggcagggagugug

SEQ ID NO: 354282 - RNA, 22 nt, Human
aucauuacuccuguaaaauugu

SEQ ID NO: 354283 - RNA, 22 nt, Human
uuccauaacugaccgaaugcau

SEQ ID NO: 354284 - RNA, 23 nt, Human
ugcauuauccucucugaagacca

SEQ ID NO: 354285 - RNA, 22 nt, Human
acuguucauccuuuuugaacaa

SEQ ID NO: 354286 - RNA, 22 nt, Human
uggcccuguggaggucagugag

SEQ ID NO: 354287 - RNA, 22 nt, Human
gcagccacuuugcaaccaagag

SEQ ID NO: 354288 - RNA, 22 nt, Human
auggcccaggccuccuguggcu

SEQ ID NO: 354289 - RNA, 22 nt, Human
gggggcucugacucccucagcu

SEQ ID NO: 354290 - RNA, 22 nt, Human
uagcugucagcaaucaaguggu

SEQ ID NO: 354291 - RNA, 18 nt, Human
ugaauuaguuugugguuu

SEQ ID NO: 354292 - RNA, 22 nt, Human
cagaggcacaagaaagcaaggc

SEQ ID NO: 354293 - RNA, 22 nt, Human
aaggagaguacaggaguuggua

SEQ ID NO: 354294 - RNA, 22 nt, Human
gcugaagcugcagcaggaggaa

SEQ ID NO: 354295 - RNA, 22 nt, Human
ucucuuucuauugcaccaugcu

SEQ ID NO: 354296 - RNA, 22 nt, Human
uggcauuuggcuuacuuauguu

SEQ ID NO: 354297 - RNA, 22 nt, Human
caggaggccaacugugggacuu

SEQ ID NO: 354298 - RNA, 22 nt, Human
uaucagaaacucuggggcaggg

SEQ ID NO: 354299 - RNA, 22 nt, Human
uuucuucugagaucagggagaa

SEQ ID NO: 354300 - RNA, 22 nt, Human
ucgccagggaugcuguaaggaa

SEQ ID NO: 354301 - RNA, 22 nt, Human
acaauucugaugguuucccagu

SEQ ID NO: 354302 - RNA, 22 nt, Human
uggggagugaugccucggauaa

SEQ ID NO: 354303 - RNA, 22 nt, Human
ugaggcagguggauuacaaggu

SEQ ID NO: 354304 - RNA, 22 nt, Human
auuacagaaugcaguuccuuau

SEQ ID NO: 354305 - RNA, 23 nt, Human
ggacagggcccugcccuauggcc

SEQ ID NO: 354306 - RNA, 19 nt, Human
uccaggcauccuucaggcu

SEQ ID NO: 354307 - RNA, 22 nt, Human
uuucaguguaagguuuccagga

SEQ ID NO: 354308 - RNA, 22 nt, Human
ccuggaucgaugccgagggaaa

SEQ ID NO: 354309 - RNA, 22 nt, Human
uacauguaggugacauuuuaau

SEQ ID NO: 354310 - RNA, 22 nt, Human
ucugcagcuucuugccagagag

SEQ ID NO: 354311 - RNA, 22 nt, Human
ccugggaggcuguuuccagccu

SEQ ID NO: 354312 - RNA, 22 nt, Human
cagggcagggagcuuagaauga

SEQ ID NO: 354313 - RNA, 22 nt, Human
ccucuucuagguuucagccugc

SEQ ID NO: 354314 - RNA, 22 nt, Human
ccuuugggugaauuccucucuu

SEQ ID NO: 354315 - RNA, 22 nt, Human
cucuguagaaacagggcagaag

SEQ ID NO: 354316 - RNA, 22 nt, Human
uagggcaguuauaacauuagug

SEQ ID NO: 354317 - RNA, 22 nt, Human
caaugauucugcaacugugugc

SEQ ID NO: 354318 - RNA, 22 nt, Human
ucaugccacuuacaaaauaaug

SEQ ID NO: 354319 - RNA, 22 nt, Human
cugagccagggccacacaugga

SEQ ID NO: 354320 - RNA, 22 nt, Human
cucuggccagagccugcgggaa

SEQ ID NO: 354321 - RNA, 22 nt, Human
agguggcaggaggucagagaaa

SEQ ID NO: 354322 - RNA, 22 nt, Human
ugcuuggccuacuuguccuuug

SEQ ID NO: 354323 - RNA, 22 nt, Human
cugcccugggauggucugugcg

SEQ ID NO: 354324 - RNA, 22 nt, Human
uccucaggagagcuccuaugcc

SEQ ID NO: 354325 - RNA, 21 nt, Human
gaguggaacgcucuucacacc

SEQ ID NO: 354326 - RNA, 22 nt, Human
cuuuccaacucuagugaaauuu

SEQ ID NO: 354327 - RNA, 22 nt, Human
aaguggagccagggaaacugaa

SEQ ID NO: 354328 - RNA, 22 nt, Human
aggcucugguuggcaaguaaag

SEQ ID NO: 354329 - RNA, 19 nt, Human
gugaggauacugcucagag

SEQ ID NO: 354330 - RNA, 17 nt, Human
acacagggagagggagc

SEQ ID NO: 354331 - RNA, 22 nt, Human
ccuuggagcggucagcacuggu

SEQ ID NO: 354332 - RNA, 22 nt, Human
aagugagugguaaggagcaugg

SEQ ID NO: 354333 - RNA, 22 nt, Human
uccucuggauauaagccucacc

SEQ ID NO: 354334 - RNA, 22 nt, Human
uacaggaaguaaguaaugaaau

SEQ ID NO: 354335 - RNA, 23 nt, Human
cugcccugaucuugaucuauugu

SEQ ID NO: 354336 - RNA, 22 nt, Human
uaaguuuuaagcaaucugauaa

SEQ ID NO: 354337 - RNA, 22 nt, Human
auacaacagaaaaugauuauuc

SEQ ID NO: 354338 - RNA, 22 nt, Human
ucccagaggacuguuggugcua

SEQ ID NO: 354339 - RNA, 22 nt, Human
cuccaguggcaaguccgggcgg

SEQ ID NO: 354340 - RNA, 22 nt, Human
gagcagagacaguacaacuggc

SEQ ID NO: 354341 - RNA, 22 nt, Human
gcuguggaugcuauggaucauc

SEQ ID NO: 354342 - RNA, 22 nt, Human
ucaguuuucucaucuguaauuu

SEQ ID NO: 354343 - RNA, 22 nt, Human
acagacauuuucuguauugccu

SEQ ID NO: 354344 - RNA, 22 nt, Human
ggcugcagaggcgaucugaggu

SEQ ID NO: 354345 - RNA, 22 nt, Human
aucuagauuagguauaagagcu

SEQ ID NO: 354346 - RNA, 22 nt, Human
gcucugcuguguuuguucagca

SEQ ID NO: 354347 - RNA, 23 nt, Human
uaugaacugcauugcuggugugu

SEQ ID NO: 354348 - RNA, 22 nt, Human
ucccuggagauaacuucuggga

SEQ ID NO: 354349 - RNA, 22 nt, Human
gacucguucauaguuccaauuu

SEQ ID NO: 354350 - RNA, 20 nt, Human
agcugguuaucuuaauucuu

SEQ ID NO: 354351 - RNA, 22 nt, Human
guguuuccucuagaagccaugg

SEQ ID NO: 354352 - RNA, 22 nt, Human
gcacggcuaauuuuuguauuuu

SEQ ID NO: 354353 - RNA, 22 nt, Human
auauuugucaauucacuguuca

SEQ ID NO: 354354 - RNA, 22 nt, Human
agcagcugcagagggcuccccc

SEQ ID NO: 354355 - RNA, 22 nt, Human
uaaugucaaggugauagauuug

SEQ ID NO: 354356 - RNA, 22 nt, Human
ugcccugugugugcaagcacug

SEQ ID NO: 354357 - RNA, 22 nt, Human
aagcagaugggacuccaaggca

SEQ ID NO: 354358 - RNA, 22 nt, Human
ggggcacacuuuugguagauau

SEQ ID NO: 354359 - RNA, 22 nt, Human
uggcucuggggacaguaagucc

SEQ ID NO: 354360 - RNA, 21 nt, Human
aaaguucaugcuuuaauauuc

SEQ ID NO: 354361 - RNA, 21 nt, Human
aaacugaccuugccugagaca

SEQ ID NO: 354362 - RNA, 21 nt, Human
gcucccuggcugugugaccug

SEQ ID NO: 354363 - RNA, 22 nt, Human
aggugcuuggcucgugcacaca

SEQ ID NO: 354364 - RNA, 22 nt, Human
gaaggcugaguggguacggagg

SEQ ID NO: 354365 - RNA, 22 nt, Human
uuauuuaauuuucucacucaga

SEQ ID NO: 354366 - RNA, 22 nt, Human
aguuacagugaccauuuauuua

SEQ ID NO: 354367 - RNA, 22 nt, Human
uggagcauauucuggagcuugg

SEQ ID NO: 354368 - RNA, 23 nt, Human
acagugugguggacaaggagcag

SEQ ID NO: 354369 - RNA, 22 nt, Human
uaucagaaaugccuuaaauugg

SEQ ID NO: 354370 - RNA, 22 nt, Human
agguggggugagcugcagacua

SEQ ID NO: 354371 - RNA, 22 nt, Human
ugaggcagcauucuucaagaca

SEQ ID NO: 354372 - RNA, 22 nt, Human
agucucugcacaguaagaagca

SEQ ID NO: 354373 - RNA, 22 nt, Human
ggugaaggucagagcaggaaaa

SEQ ID NO: 354374 - RNA, 22 nt, Human
cuggcucagacagcugugcagu

SEQ ID NO: 354375 - RNA, 22 nt, Human
uuugaaagaaaccagugaguga

SEQ ID NO: 354376 - RNA, 22 nt, Human
uggcuuccaaaggaaugggccu

SEQ ID NO: 354377 - RNA, 18 nt, Human
ccucagggagagagacgc

SEQ ID NO: 354378 - RNA, 22 nt, Human
ucagggcaaagggcagaguuug

SEQ ID NO: 354379 - RNA, 22 nt, Human
uccaguggugguuugaagggca

SEQ ID NO: 354380 - RNA, 22 nt, Human
cagguggguguaugaaugcaaa

SEQ ID NO: 354381 - RNA, 22 nt, Human
cugcaggaauucaaagugagcu

SEQ ID NO: 354382 - RNA, 22 nt, Human
ucaacuuuaguguagcuauuua

SEQ ID NO: 354383 - RNA, 22 nt, Human
caggcaccccaggugagcacug

SEQ ID NO: 354384 - RNA, 22 nt, Human
agacaaaggauuaaugaugaug

SEQ ID NO: 354385 - RNA, 22 nt, Human
gaggcugaggguuagagaguca

SEQ ID NO: 354386 - RNA, 22 nt, Human
agggccuggaacugugggcagg

SEQ ID NO: 354387 - RNA, 22 nt, Human
uuagggaaggcugcugucagcu

SEQ ID NO: 354388 - RNA, 22 nt, Human
cuccagggagcuuggaaagacc

SEQ ID NO: 354389 - RNA, 22 nt, Human
aggcagggugaugauaaugauu

SEQ ID NO: 354390 - RNA, 22 nt, Human
uguuccaagcugcuggauaagc

SEQ ID NO: 354391 - RNA, 22 nt, Human
gggcugggauugcuugcuguga

SEQ ID NO: 354392 - RNA, 22 nt, Human
auacuuucugaccaauuaauug

SEQ ID NO: 354393 - RNA, 22 nt, Human
aggcaauccccugaggauacuu

SEQ ID NO: 354394 - RNA, 22 nt, Human
ugcuuaaacauacuauuuauau

SEQ ID NO: 354395 - RNA, 22 nt, Human
gaaggccugugguagugagacg

SEQ ID NO: 354396 - RNA, 22 nt, Human
gcucugaggcugugaggugcug

SEQ ID NO: 354397 - RNA, 22 nt, Human
ccagcuuuagguugccugccag

SEQ ID NO: 354398 - RNA, 22 nt, Human
cugccagcagaggccagcgcug

SEQ ID NO: 354399 - RNA, 22 nt, Human
ucuggccugaaaguccaugcuu

SEQ ID NO: 354400 - RNA, 23 nt, Human
uggagcugggcucagacccuggg

SEQ ID NO: 354401 - RNA, 22 nt, Human
uucagaaguagcuaagcaguca

SEQ ID NO: 354402 - RNA, 22 nt, Human
ucagaaaagagaaaaucuuaua

SEQ ID NO: 354403 - RNA, 22 nt, Human
gaaaggagaggguuaaggagcu

SEQ ID NO: 354404 - RNA, 22 nt, Human
uuagcucagaaaauuuaaacuu

SEQ ID NO: 354405 - RNA, 22 nt, Human
agacugaauaacaagcaaauaa

SEQ ID NO: 354406 - RNA, 22 nt, Human
augaggcagauguugcaugagg

SEQ ID NO: 354407 - RNA, 22 nt, Human
acauuuguaugcguuuuuacug

SEQ ID NO: 354408 - RNA, 22 nt, Human
ucccaggauguuggcggcaggu

SEQ ID NO: 354409 - RNA, 22 nt, Human
ccuuggcccuagccucaggcaa

SEQ ID NO: 354410 - RNA, 22 nt, Human
cucuugggagugcucuggagaa

SEQ ID NO: 354411 - RNA, 22 nt, Human
cugcagcugucucuacugggca

SEQ ID NO: 354412 - RNA, 22 nt, Human
uuugacauuggcuuauucuguu

SEQ ID NO: 354413 - RNA, 22 nt, Human
agcagcagaagggagacccagg

SEQ ID NO: 354414 - RNA, 22 nt, Human
aucugacaaccuauugacuuga

SEQ ID NO: 354415 - RNA, 22 nt, Human
cagcacagggacaauagcagau

SEQ ID NO: 354416 - RNA, 22 nt, Human
ugcucuguauucuauggcaguu

SEQ ID NO: 354417 - RNA, 19 nt, Human
uuugaauccagcugguaac

SEQ ID NO: 354418 - RNA, 22 nt, Human
aggcuggcuuggcucuccugug

SEQ ID NO: 354419 - RNA, 22 nt, Human
ucccuggacaacagacuucacu

SEQ ID NO: 354420 - RNA, 22 nt, Human
cccugcagccuugcaugccuuc

SEQ ID NO: 354421 - RNA, 22 nt, Human
ugucaaaaauaagagagauugu

SEQ ID NO: 354422 - RNA, 22 nt, Human
aggccagaaauuuggaguaugu

SEQ ID NO: 354423 - RNA, 22 nt, Human
ugcaggagcagagauggcugga

SEQ ID NO: 354424 - RNA, 22 nt, Human
gggagccacaguuuauagugau

SEQ ID NO: 354425 - RNA, 22 nt, Human
ucuggcagggguucugcacuug

SEQ ID NO: 354426 - RNA, 22 nt, Human
caggagacaauggcuguggggc

SEQ ID NO: 354427 - RNA, 22 nt, Human
ugcuauugugaacagugccaca

SEQ ID NO: 354428 - RNA, 22 nt, Human
caaagguauucucauuuuggaa

SEQ ID NO: 354429 - RNA, 22 nt, Human
ucuuuaauucagcaugaugcgg

SEQ ID NO: 354430 - RNA, 19 nt, Human
cacaucagcagggcugugg

SEQ ID NO: 354431 - RNA, 22 nt, Human
aaguccagacuccuuugcgugg

SEQ ID NO: 354432 - RNA, 22 nt, Human
gauggcuucagucuccuugggu

SEQ ID NO: 354433 - RNA, 22 nt, Human
ccugggagagucuguggucucc

SEQ ID NO: 354434 - RNA, 20 nt, Human
ugcuccaucuaaagugauua

SEQ ID NO: 354435 - RNA, 22 nt, Human
cagagccugccucuggcugugg

SEQ ID NO: 354436 - RNA, 22 nt, Human
aaauuucaguuggaaugagcuc

SEQ ID NO: 354437 - RNA, 22 nt, Human
agaagccauagucugggaggca

SEQ ID NO: 354438 - RNA, 22 nt, Human
cuggagcccugaaugggcagga

SEQ ID NO: 354439 - RNA, 22 nt, Human
cagaaggcaaacaaaaggauuu

SEQ ID NO: 354440 - RNA, 22 nt, Human
gucaggauuuacaaacuucagu

SEQ ID NO: 354441 - RNA, 22 nt, Human
caggcuggagugaguguagugg

SEQ ID NO: 354442 - RNA, 22 nt, Human
ucaggacagccagggugcagac

SEQ ID NO: 354443 - RNA, 22 nt, Human
uggccugauuuugcuaagagaa

SEQ ID NO: 354444 - RNA, 22 nt, Human
uuuauguuugacaaugaucugg

SEQ ID NO: 354445 - RNA, 22 nt, Human
cagagcucuauguucauggagg

SEQ ID NO: 354446 - RNA, 22 nt, Human
cucagggcaguauggcugagag

SEQ ID NO: 354447 - RNA, 22 nt, Human
ugcacuggggucccagcgcacg

SEQ ID NO: 354448 - RNA, 22 nt, Human
uguucaauccccagguccugaa

SEQ ID NO: 354449 - RNA, 22 nt, Human
ccagccuggacugggucuugug

SEQ ID NO: 354450 - RNA, 22 nt, Human
gucccuggaucugggacagcug

SEQ ID NO: 354451 - RNA, 22 nt, Human
ggcucagguuuaaagugcuuua

SEQ ID NO: 354452 - RNA, 21 nt, Human
ugugucacuaacuagaggcua

SEQ ID NO: 354453 - RNA, 22 nt, Human
acccugagucagacagccugac

SEQ ID NO: 354454 - RNA, 22 nt, Human
augauuucuauauaaacuuaaa

SEQ ID NO: 354455 - RNA, 22 nt, Human
aaagauuucagaagccugugcc

SEQ ID NO: 354456 - RNA, 18 nt, Human
uggagccauugccaccau

SEQ ID NO: 354457 - RNA, 22 nt, Human
caaaggagguaaugggugugag

SEQ ID NO: 354458 - RNA, 23 nt, Human
ucagggacaugaugugucauauc

SEQ ID NO: 354459 - RNA, 22 nt, Human
accacccucagcagagcugaaa

SEQ ID NO: 354460 - RNA, 22 nt, Human
gagaggcaggcgcugcaauggu

SEQ ID NO: 354461 - RNA, 22 nt, Human
agggcugaccuaagcuccacuu

SEQ ID NO: 354462 - RNA, 22 nt, Human
gggagggaggugaugcuuggcu

SEQ ID NO: 354463 - RNA, 22 nt, Human
gaaugaaaaccuuggcucaaau

SEQ ID NO: 354464 - RNA, 22 nt, Human
gugguaauagagcuccaaacua

SEQ ID NO: 354465 - RNA, 19 nt, Human
aaaauugcguauuuugagg

SEQ ID NO: 354466 - RNA, 22 nt, Human
agggcucuguccccagaggccc

SEQ ID NO: 354467 - RNA, 22 nt, Human
aaggccaucuacuuacggaauu

SEQ ID NO: 354468 - RNA, 22 nt, Human
guauucauauuaaacauaucaa

SEQ ID NO: 354469 - RNA, 22 nt, Human
ggcugcuugcuguuucuuggau

SEQ ID NO: 354470 - RNA, 22 nt, Human
uggcagcacuugaacuugagcc

SEQ ID NO: 354471 - RNA, 22 nt, Human
cugggccaucagaggggcugga

SEQ ID NO: 354472 - RNA, 20 nt, Human
ucugucucugagcuagacuu

SEQ ID NO: 354473 - RNA, 22 nt, Human
ucauaauacaaagaguucugca

SEQ ID NO: 354474 - RNA, 22 nt, Human
agaguguuauuugcucuguauu

SEQ ID NO: 354475 - RNA, 22 nt, Human
uuugcuauuuuucugugcagcu

SEQ ID NO: 354476 - RNA, 22 nt, Human
agcuagccuaggcagagugcau

SEQ ID NO: 354477 - RNA, 22 nt, Human
aggcagccaaucagaggcugac

SEQ ID NO: 354478 - RNA, 23 nt, Human
gccugggacugguagugugaccu

SEQ ID NO: 354479 - RNA, 22 nt, Human
auaaagucauuaugaagaucua

SEQ ID NO: 354480 - RNA, 22 nt, Human
ugaauaauccacagucauucau

SEQ ID NO: 354481 - RNA, 22 nt, Human
ucccagccuuucuuuucugcug

SEQ ID NO: 354482 - RNA, 22 nt, Human
uggcagcaaguucuugggaggu

SEQ ID NO: 354483 - RNA, 22 nt, Human
ccagcagccaccuucucgaaau

SEQ ID NO: 354484 - RNA, 22 nt, Human
ggaggaguguggggcacucugc

SEQ ID NO: 354485 - RNA, 22 nt, Human
cacaugcaucugucauguuugg

SEQ ID NO: 354486 - RNA, 19 nt, Human
uugcauuguaguuggacug

SEQ ID NO: 354487 - RNA, 22 nt, Human
aggagcugggcugcugcuggga

SEQ ID NO: 354488 - RNA, 22 nt, Human
agccacagcccacaggacucuu

SEQ ID NO: 354489 - RNA, 22 nt, Human
gagcuuuaagggauaaaaugau

SEQ ID NO: 354490 - RNA, 22 nt, Human
ugaaggccuaacuuccagugcu

SEQ ID NO: 354491 - RNA, 22 nt, Human
ugggacagggaaucugaucccc

SEQ ID NO: 354492 - RNA, 22 nt, Human
aaauuagucgguuuaggaauuu

SEQ ID NO: 354493 - RNA, 22 nt, Human
caggagaaacauaauuuucugg

SEQ ID NO: 354494 - RNA, 22 nt, Human
ggagccuggcaaugcugcgucc

SEQ ID NO: 354495 - RNA, 22 nt, Human
aggcccaguuauccuacuuguu

SEQ ID NO: 354496 - RNA, 20 nt, Human
ccagucccugagcaccaggg

SEQ ID NO: 354497 - RNA, 19 nt, Human
ccugggaggcggagguugc

SEQ ID NO: 354498 - RNA, 22 nt, Human
gucuucaacaauaacuaccacu

SEQ ID NO: 354499 - RNA, 21 nt, Human
cccaggagaagaaaagaugca

SEQ ID NO: 354500 - RNA, 22 nt, Human
agagugggccucugagucccag

SEQ ID NO: 354501 - RNA, 22 nt, Human
gaggcagcugggcuggugguuu

SEQ ID NO: 354502 - RNA, 22 nt, Human
cacuguuuuauuccaacauagg

SEQ ID NO: 354503 - RNA, 22 nt, Human
caaauucucuuacuguuugaca

SEQ ID NO: 354504 - RNA, 22 nt, Human
cagcauuggguuaccuuuguuu

SEQ ID NO: 354505 - RNA, 22 nt, Human
gaaguccugguccucucauuca

SEQ ID NO: 354506 - RNA, 22 nt, Human
gcuguccucugaucucuggagg

SEQ ID NO: 354507 - RNA, 22 nt, Human
gccugagaguugaaguucagug

SEQ ID NO: 354508 - RNA, 21 nt, Human
cacuggaauuuucugugacau

SEQ ID NO: 354509 - RNA, 18 nt, Human
cccagcuggugggucagu

SEQ ID NO: 354510 - RNA, 22 nt, Human
accucugcaacccuggaauggg

SEQ ID NO: 354511 - RNA, 22 nt, Human
agggacugagcuaggaucuagu

SEQ ID NO: 354512 - RNA, 22 nt, Human
augaaaaguucgaucuagaagg

SEQ ID NO: 354513 - RNA, 22 nt, Human
uucagggagagcgggacgggug

SEQ ID NO: 354514 - RNA, 22 nt, Human
uaguaugggaagaacuuuguag

SEQ ID NO: 354515 - RNA, 22 nt, Human
ugugucaauuuucauuccuacu

SEQ ID NO: 354516 - RNA, 22 nt, Human
cuuuacauccuguuucccguuu

SEQ ID NO: 354517 - RNA, 22 nt, Human
ugcugggcuugaaagcugcuaa

SEQ ID NO: 354518 - RNA, 22 nt, Human
ugaagcuuuccuguggucagga

SEQ ID NO: 354519 - RNA, 22 nt, Human
cugcugugagcacuccagccug

SEQ ID NO: 354520 - RNA, 18 nt, Human
gagacacaagggccugga

SEQ ID NO: 354521 - RNA, 22 nt, Human
ccugaggggcugcaggccagcu

SEQ ID NO: 354522 - RNA, 22 nt, Human
uaaaacuuaacuauccagauua

SEQ ID NO: 354523 - RNA, 22 nt, Human
ugaugguuuuauuaauaggacc

SEQ ID NO: 354524 - RNA, 22 nt, Human
augcugaggacaaagagaucaa

SEQ ID NO: 354525 - RNA, 22 nt, Human
agaaauguuguggguuuuguua

SEQ ID NO: 354526 - RNA, 22 nt, Human
ucuuccaagguugcacacuauc

SEQ ID NO: 354527 - RNA, 22 nt, Human
uguacauacauagauauacaca

SEQ ID NO: 354528 - RNA, 22 nt, Human
ucccugcagacguccugcgggu

SEQ ID NO: 354529 - RNA, 22 nt, Human
uucaagaugucuucacaauagu

SEQ ID NO: 354530 - RNA, 22 nt, Human
ggcuucugguaaagaccacacc

SEQ ID NO: 354531 - RNA, 22 nt, Human
cagugcagaggccagggaggau

SEQ ID NO: 354532 - RNA, 22 nt, Human
ggcccuguuagagcucccacaa

SEQ ID NO: 354533 - RNA, 22 nt, Human
cagagcuguugcggggcuuggc

SEQ ID NO: 354534 - RNA, 21 nt, Human
gauuuuaaagagacugccaca

SEQ ID NO: 354535 - RNA, 22 nt, Human
uugaagaaauuauuuuauauag

SEQ ID NO: 354536 - RNA, 20 nt, Human
uagaaaucuuauaaaagacu

SEQ ID NO: 354537 - RNA, 22 nt, Human
ugucccaguucccaggguugcu

SEQ ID NO: 354538 - RNA, 18 nt, Human
aggugcagccucugaggc

SEQ ID NO: 354539 - RNA, 22 nt, Human
ugagguggcuagggaggcacuc

SEQ ID NO: 354540 - RNA, 22 nt, Human
gagagcuggccagcuucaguau

SEQ ID NO: 354541 - RNA, 22 nt, Human
aggccugagccccagguuuguu

SEQ ID NO: 354542 - RNA, 19 nt, Human
ugcucauggggacuucucc

SEQ ID NO: 354543 - RNA, 22 nt, Human
acucaggaaaugaagacugguu

SEQ ID NO: 354544 - RNA, 22 nt, Human
cagguggaucucuaaggacuga

SEQ ID NO: 354545 - RNA, 22 nt, Human
uaaaugcaagugcuccugggag

SEQ ID NO: 354546 - RNA, 22 nt, Human
ggcaggcaguguggugugaaac

SEQ ID NO: 354547 - RNA, 21 nt, Human
agagucugcauuucugacaag

SEQ ID NO: 354548 - RNA, 22 nt, Human
agggcaguucaacuucauagug

SEQ ID NO: 354549 - RNA, 22 nt, Human
ccagcucucagcgggagacuca

SEQ ID NO: 354550 - RNA, 22 nt, Human
accugcaggcacaggugugcgc

SEQ ID NO: 354551 - RNA, 22 nt, Human
uuagggcaggcaugagagaacu

SEQ ID NO: 354552 - RNA, 22 nt, Human
aaugcacauaaauauggucuua

SEQ ID NO: 354553 - RNA, 22 nt, Human
gugauuuaguguuaaguauguu

SEQ ID NO: 354554 - RNA, 20 nt, Human
aaaguguaagcauauaauua

SEQ ID NO: 354555 - RNA, 22 nt, Human
ccuguucaugaaacugcuuucc

SEQ ID NO: 354556 - RNA, 22 nt, Human
acagaguuaauggauaggcagg

SEQ ID NO: 354557 - RNA, 17 nt, Human
acagagguuauacagac

SEQ ID NO: 354558 - RNA, 22 nt, Human
ucagagugugagacauauugga

SEQ ID NO: 354559 - RNA, 22 nt, Human
accagagcuggcagaguaucaa

SEQ ID NO: 354560 - RNA, 22 nt, Human
cugcugugcauauuuaucuagg

SEQ ID NO: 354561 - RNA, 22 nt, Human
aaggcucucugauggcagcagu

SEQ ID NO: 354562 - RNA, 22 nt, Human
gagggcuccucacauucucuau

SEQ ID NO: 354563 - RNA, 22 nt, Human
ucaacacucuuuggcacaguua

SEQ ID NO: 354564 - RNA, 22 nt, Human
guggcagcggcccaggccgucu

SEQ ID NO: 354565 - RNA, 22 nt, Human
gaggggcuggcuguggucccau

SEQ ID NO: 354566 - RNA, 19 nt, Human
gcuguauuaaagauacaug

SEQ ID NO: 354567 - RNA, 22 nt, Human
aagagcuggauugugcugcaga

SEQ ID NO: 354568 - RNA, 22 nt, Human
uccaggagggauugggcugugg

SEQ ID NO: 354569 - RNA, 22 nt, Human
uuuuugcaccaaccuaauagaa

SEQ ID NO: 354570 - RNA, 22 nt, Human
cagcagagcugugugggaaggg

SEQ ID NO: 354571 - RNA, 22 nt, Human
ggaugcaggacggcauggaugu

SEQ ID NO: 354572 - RNA, 23 nt, Human
ugcaggggaggcuuaaagcaggu

SEQ ID NO: 354573 - RNA, 22 nt, Human
ggcugccuucccugagccccgg

SEQ ID NO: 354574 - RNA, 22 nt, Human
gcuggaggaucacuugagccca

SEQ ID NO: 354575 - RNA, 22 nt, Human
ugagcagggacuuugaguguag

SEQ ID NO: 354576 - RNA, 22 nt, Human
uuccauauuuguguggcaaaag

SEQ ID NO: 354577 - RNA, 22 nt, Human
acugcagccuugaacucugggc

SEQ ID NO: 354578 - RNA, 22 nt, Human
cugggagcuagcucugagcuga

SEQ ID NO: 354579 - RNA, 22 nt, Human
aaagaaggaugggagaaauccu

SEQ ID NO: 354580 - RNA, 23 nt, Human
cagcccuuccugcauguuuuugu

SEQ ID NO: 354581 - RNA, 22 nt, Human
ccauggccgccgcugcucagga

SEQ ID NO: 354582 - RNA, 22 nt, Human
cagggcccagucccugcuguca

SEQ ID NO: 354583 - RNA, 22 nt, Human
ggcaccagccaccuauuucuag

SEQ ID NO: 354584 - RNA, 22 nt, Human
cucaggauguacuacagaaggc

SEQ ID NO: 354585 - RNA, 22 nt, Human
aaaggugacacucugccagcug

SEQ ID NO: 354586 - RNA, 22 nt, Human
cacagggccuugugugacugca

SEQ ID NO: 354587 - RNA, 22 nt, Human
auucagcauaaucaguagcuug

SEQ ID NO: 354588 - RNA, 22 nt, Human
aaacaugcauucaagaaaaucu

SEQ ID NO: 354589 - RNA, 22 nt, Human
ucuggaucggguuccucagguc

SEQ ID NO: 354590 - RNA, 22 nt, Human
ugggcagcagcaaagccagacu

SEQ ID NO: 354591 - RNA, 22 nt, Human
uguuugaauuuugcuaacgugu

SEQ ID NO: 354592 - RNA, 22 nt, Human
auggcauuccaagucuucuuuu

SEQ ID NO: 354593 - RNA, 22 nt, Human
uaauacagaaguguauuaaaau

SEQ ID NO: 354594 - RNA, 22 nt, Human
agagcugaggauccagcugagc

SEQ ID NO: 354595 - RNA, 22 nt, Human
uagauuucucauucauagauug

SEQ ID NO: 354596 - RNA, 22 nt, Human
gacccggcuccaggcccagcag

SEQ ID NO: 354597 - RNA, 22 nt, Human
gcagggcugcagagggcacugu

SEQ ID NO: 354598 - RNA, 22 nt, Human
gcugucccaugguugcaagaug

SEQ ID NO: 354599 - RNA, 22 nt, Human
cugcccagaagcuuagagcuua

SEQ ID NO: 354600 - RNA, 22 nt, Human
agccaaagaucagugugcaagu

SEQ ID NO: 354601 - RNA, 22 nt, Human
uucugagacaauugagagucua

SEQ ID NO: 354602 - RNA, 18 nt, Human
gguggccuugacuucucu

SEQ ID NO: 354603 - RNA, 22 nt, Human
ccuggagcuuggucacgcugcg

SEQ ID NO: 354604 - RNA, 22 nt, Human
ucagaaaugaucguuauucauu

SEQ ID NO: 354605 - RNA, 22 nt, Human
uugugucccccuuugagagcca

SEQ ID NO: 354606 - RNA, 22 nt, Human
ggccucacccaucggugccuuu

SEQ ID NO: 354607 - RNA, 22 nt, Human
cccaguuguugccggcucugga

SEQ ID NO: 354608 - RNA, 22 nt, Human
agaagcagcuuucaaggugauu

SEQ ID NO: 354609 - RNA, 23 nt, Human
agcagugaguaaacagauaggau

SEQ ID NO: 354610 - RNA, 22 nt, Human
uuguuucugaguuuucauguau

SEQ ID NO: 354611 - RNA, 19 nt, Human
gagguggguccccgcagcc

SEQ ID NO: 354612 - RNA, 22 nt, Human
agcauuuaggagaauuugagaa

SEQ ID NO: 354613 - RNA, 22 nt, Human
gcugccacucugagcuugcuuc

SEQ ID NO: 354614 - RNA, 22 nt, Human
uccugccuguuuaccuguacuu

SEQ ID NO: 354615 - RNA, 22 nt, Human
uacauaauaaggggcauggugu

SEQ ID NO: 354616 - RNA, 22 nt, Human
cuacauuuguucuauagcuuuu

SEQ ID NO: 354617 - RNA, 22 nt, Human
uggcagcuauggucuaagggcc

SEQ ID NO: 354618 - RNA, 22 nt, Human
cuccugaguaguagcauuguca

SEQ ID NO: 354619 - RNA, 22 nt, Human
agucucagaguaccugagggac

SEQ ID NO: 354620 - RNA, 21 nt, Human
ccacaggggcuccccugucag

SEQ ID NO: 354621 - RNA, 22 nt, Human
cagaaugagauaacccagauug

SEQ ID NO: 354622 - RNA, 22 nt, Human
agagccacggcaggccuaggaa

SEQ ID NO: 354623 - RNA, 22 nt, Human
agccccacacucucucugagaa

SEQ ID NO: 354624 - RNA, 22 nt, Human
ggcaaaaaguucccaucagugu

SEQ ID NO: 354625 - RNA, 22 nt, Human
cauggcugcgagaagagugggu

SEQ ID NO: 354626 - RNA, 22 nt, Human
cucaggggaccuggcuccgagu

SEQ ID NO: 354627 - RNA, 22 nt, Human
ucucaggcuaccuugcacaagg

SEQ ID NO: 354628 - RNA, 22 nt, Human
ugucucagggcagcagcagggg

SEQ ID NO: 354629 - RNA, 23 nt, Human
accaugaugggagugcaaauaag

SEQ ID NO: 354630 - RNA, 22 nt, Human
aggcgcagacauacagggucug

SEQ ID NO: 354631 - RNA, 22 nt, Human
gcagcuggaagugacacucugu

SEQ ID NO: 354632 - RNA, 22 nt, Human
ccuggccuuaagggcagggagc

SEQ ID NO: 354633 - RNA, 22 nt, Human
cagcucccgccaucgggaggca

SEQ ID NO: 354634 - RNA, 17 nt, Human
ucccaggaacagggaau

SEQ ID NO: 354635 - RNA, 22 nt, Human
cuggagcucuccagagccccgu

SEQ ID NO: 354636 - RNA, 22 nt, Human
gggauggggggaagcguccaug

SEQ ID NO: 354637 - RNA, 22 nt, Human
ccagcuccaaguuugggcauca

SEQ ID NO: 354638 - RNA, 22 nt, Human
augcugugucaccuuaggauuu

SEQ ID NO: 354639 - RNA, 22 nt, Human
aaagacuagcauuuauauguac

SEQ ID NO: 354640 - RNA, 22 nt, Human
ucucagagaggggccgggccuu

SEQ ID NO: 354641 - RNA, 22 nt, Human
agcagggguaacagaaggaaag

SEQ ID NO: 354642 - RNA, 22 nt, Human
augaaggauggcuggcugcccu

SEQ ID NO: 354643 - RNA, 22 nt, Human
cuuauguacacacauauauugu

SEQ ID NO: 354644 - RNA, 22 nt, Human
ccagauuugagcgucuuaaacc

SEQ ID NO: 354645 - RNA, 22 nt, Human
ucaggaggccaccaggaccugu

SEQ ID NO: 354646 - RNA, 22 nt, Human
gugugccaggaacuggcugcug

SEQ ID NO: 354647 - RNA, 22 nt, Human
uacaaaugaccauagccacuua

SEQ ID NO: 354648 - RNA, 22 nt, Human
ucagccuggcaggauggccugg

SEQ ID NO: 354649 - RNA, 22 nt, Human
ugcaccauguaaguggccacgu

SEQ ID NO: 354650 - RNA, 22 nt, Human
gaguccuuuguuccuugccaca

SEQ ID NO: 354651 - RNA, 22 nt, Human
aauuaaaugacaggggaagaug

SEQ ID NO: 354652 - RNA, 21 nt, Human
cacugcagccuugaccugggc

SEQ ID NO: 354653 - RNA, 22 nt, Human
agguggggaggagugucucuuu

SEQ ID NO: 354654 - RNA, 22 nt, Human
aaguuauugcagcaauccaagu

SEQ ID NO: 354655 - RNA, 22 nt, Human
caagggcagaggcagggccccg

SEQ ID NO: 354656 - RNA, 22 nt, Human
cagucccuaguggagcucacag

SEQ ID NO: 354657 - RNA, 22 nt, Human
gguccuggaaauugacggaaag

SEQ ID NO: 354658 - RNA, 22 nt, Human
cuacagaaaccuuuuucauaca

SEQ ID NO: 354659 - RNA, 22 nt, Human
uggcuuuaaaucuguauucaua

SEQ ID NO: 354660 - RNA, 22 nt, Human
uugcaccaaaugaguuaaaauu

SEQ ID NO: 354661 - RNA, 22 nt, Human
aggcccugcccagugccacaag

SEQ ID NO: 354662 - RNA, 22 nt, Human
acaugauucuugauaggcauug

SEQ ID NO: 354663 - RNA, 22 nt, Human
uaaucugaagaaacaggacuug

SEQ ID NO: 354664 - RNA, 22 nt, Human
uccucacauggugagccacaca

SEQ ID NO: 354665 - RNA, 22 nt, Human
accagagcagacuacuggaggu

SEQ ID NO: 354666 - RNA, 22 nt, Human
gcagccacuaguuuuccuguuu

SEQ ID NO: 354667 - RNA, 22 nt, Human
cuucuucaucuguaaaacuugg

SEQ ID NO: 354668 - RNA, 22 nt, Human
guaaaauagaauaacguggcua

SEQ ID NO: 354669 - RNA, 22 nt, Human
ggccucucuccuuggcuugcag

SEQ ID NO: 354670 - RNA, 22 nt, Human
gcagagccaggagcccaggauc

SEQ ID NO: 354671 - RNA, 22 nt, Human
gaauuugaaaagugaugggaau

SEQ ID NO: 354672 - RNA, 22 nt, Human
gggcagaggggcgcuucccucu

SEQ ID NO: 354673 - RNA, 18 nt, Human
guaggucaguaccaagca

SEQ ID NO: 354674 - RNA, 20 nt, Human
agcuggagaagggcccuucc

SEQ ID NO: 354675 - RNA, 18 nt, Human
gaaagccaugcagcagug

SEQ ID NO: 354676 - RNA, 19 nt, Human
uccuccuuacuuccucuug

SEQ ID NO: 354677 - RNA, 22 nt, Human
ccuguguggccaggcuggaguc

SEQ ID NO: 354678 - RNA, 22 nt, Human
uuuauguaaguggaaugaugcc

SEQ ID NO: 354679 - RNA, 21 nt, Human
gcacagugccaggcacacagu

SEQ ID NO: 354680 - RNA, 22 nt, Human
gccaggggacgcggagcgacga

SEQ ID NO: 354681 - RNA, 22 nt, Human
ggcugaguugagaggauuacuu

SEQ ID NO: 354682 - RNA, 22 nt, Human
gagguggucgaggagggguacc

SEQ ID NO: 354683 - RNA, 22 nt, Human
gugaggugggcuggccagagac

SEQ ID NO: 354684 - RNA, 22 nt, Human
ugggggagccuucacaguagcu

SEQ ID NO: 354685 - RNA, 22 nt, Human
uucaguaaaacacugcaauguc

SEQ ID NO: 354686 - RNA, 22 nt, Human
uuuguuaaauauuuauugagug

SEQ ID NO: 354687 - RNA, 22 nt, Human
cuucuucaagagaaugggagac

SEQ ID NO: 354688 - RNA, 22 nt, Human
agauguggauccuaggguagaa

SEQ ID NO: 354689 - RNA, 22 nt, Human
uaacacugguauuucauuuagu

SEQ ID NO: 354690 - RNA, 22 nt, Human
cucucugguuucagcgaagggg

SEQ ID NO: 354691 - RNA, 22 nt, Human
ccaaggaggccccaggucagcu

SEQ ID NO: 354692 - RNA, 20 nt, Human
uccugggguaagccaugguc

SEQ ID NO: 354693 - RNA, 19 nt, Human
gccugccuggguuucugag

SEQ ID NO: 354694 - RNA, 22 nt, Human
uaguccuugcugggcacagagu

SEQ ID NO: 354695 - RNA, 22 nt, Human
cuuucacacacauacauuugga

SEQ ID NO: 354696 - RNA, 22 nt, Human
ggucacugcucuaaacaaaagu

SEQ ID NO: 354697 - RNA, 22 nt, Human
ugaagccuuguguggccucucu

SEQ ID NO: 354698 - RNA, 22 nt, Human
ccucacucugcacccugcagca

SEQ ID NO: 354699 - RNA, 22 nt, Human
ucaggagaaaauaucaggaagu

SEQ ID NO: 354700 - RNA, 20 nt, Human
uacagacaugacaauaaugg

SEQ ID NO: 354701 - RNA, 22 nt, Human
acaugcuucauauuauaaccaa

SEQ ID NO: 354702 - RNA, 22 nt, Human
agggacacaugugauuauuuau

SEQ ID NO: 354703 - RNA, 22 nt, Human
caguccuuccuugccccuuggg

SEQ ID NO: 354704 - RNA, 22 nt, Human
ugggcuggcugaggcauucacu

SEQ ID NO: 354705 - RNA, 21 nt, Human
agaaaaacacgauauaagccc

SEQ ID NO: 354706 - RNA, 22 nt, Human
ugcagggccuugggucuuucuu

SEQ ID NO: 354707 - RNA, 22 nt, Human
agugaaauuccuggucuuuguu

SEQ ID NO: 354708 - RNA, 22 nt, Human
uuucacaacugcuuauuugaga

SEQ ID NO: 354709 - RNA, 21 nt, Human
ucagcagcaucugccuagagu

SEQ ID NO: 354710 - RNA, 22 nt, Human
ugucuucaucuccaugcacaga

SEQ ID NO: 354711 - RNA, 22 nt, Human
agagggagugaaauggaauaga

SEQ ID NO: 354712 - RNA, 22 nt, Human
cgagcaugaugacggcuguggc

SEQ ID NO: 354713 - RNA, 20 nt, Human
gcugggggugugcugaguga

SEQ ID NO: 354714 - RNA, 18 nt, Human
ugugaacacauuuuucug

SEQ ID NO: 354715 - RNA, 22 nt, Human
gucaccaggucugaugcagcca

SEQ ID NO: 354716 - RNA, 22 nt, Human
aauguguagggugccuguuuuu

SEQ ID NO: 354717 - RNA, 18 nt, Human
uguacaguuaugagcauu

SEQ ID NO: 354718 - RNA, 22 nt, Human
ccagagccucuuaugaagaucg

SEQ ID NO: 354719 - RNA, 22 nt, Human
gucccagaaacauauugcuggu

SEQ ID NO: 354720 - RNA, 22 nt, Human
gaggccagggaugcaaugagag

SEQ ID NO: 354721 - RNA, 22 nt, Human
ucauuacaguguuuauaugucu

SEQ ID NO: 354722 - RNA, 22 nt, Human
accacuguaucuccagcacauu

SEQ ID NO: 354723 - RNA, 22 nt, Human
ugaagccacacuagcuuguccu

SEQ ID NO: 354724 - RNA, 22 nt, Human
agagccaggaucuguuuugggg

SEQ ID NO: 354725 - RNA, 22 nt, Human
gcugcucugcuguguaagcagg

SEQ ID NO: 354726 - RNA, 22 nt, Human
uggcugaguucuccaggaguag

SEQ ID NO: 354727 - RNA, 22 nt, Human
caagggaguuacugagggcggg

SEQ ID NO: 354728 - RNA, 22 nt, Human
guaggcagggcuguggggagaa

SEQ ID NO: 354729 - RNA, 22 nt, Human
uucagaaaucgaguuucauguc

SEQ ID NO: 354730 - RNA, 22 nt, Human
gcagcugggacacugaggccag

SEQ ID NO: 354731 - RNA, 22 nt, Human
agaguguaauaagggcaagggc

SEQ ID NO: 354732 - RNA, 22 nt, Human
auuauuauuguugauguuaggg

SEQ ID NO: 354733 - RNA, 22 nt, Human
guaaacaugcuguguacucagc

SEQ ID NO: 354734 - RNA, 22 nt, Human
agaggcugggaaggguccccgg

SEQ ID NO: 354735 - RNA, 22 nt, Human
uuccagagcaguuuucagauca

SEQ ID NO: 354736 - RNA, 22 nt, Human
ggccgggcaggucucagccagc

SEQ ID NO: 354737 - RNA, 22 nt, Human
ucacugcaaccucugccuuccg

SEQ ID NO: 354738 - RNA, 22 nt, Human
acauuucuaguuguucaucucc

SEQ ID NO: 354739 - RNA, 22 nt, Human
cagcaggauuugaaaggaagag

SEQ ID NO: 354740 - RNA, 22 nt, Human
caggucagagucccccuguccu

SEQ ID NO: 354741 - RNA, 22 nt, Human
acagcagagugugagauagcca

SEQ ID NO: 354742 - RNA, 22 nt, Human
agguggcucugacagcucuggu

SEQ ID NO: 354743 - RNA, 22 nt, Human
auuucucaucaagugccaacuc

SEQ ID NO: 354744 - RNA, 22 nt, Human
ccagggcugguggcugcagagg

SEQ ID NO: 354745 - RNA, 22 nt, Human
agcagggcuggggcacgagcca

SEQ ID NO: 354746 - RNA, 22 nt, Human
ggccagaaguuggaaaagagcc

SEQ ID NO: 354747 - RNA, 21 nt, Human
caaucaguuggcauuugagca

SEQ ID NO: 354748 - RNA, 22 nt, Human
gaggccaggagugcuguaaguu

SEQ ID NO: 354749 - RNA, 22 nt, Human
ugaaaagacugcaagagagcau

SEQ ID NO: 354750 - RNA, 22 nt, Human
ucucagagauuuuguuucccuu

SEQ ID NO: 354751 - RNA, 18 nt, Human
auuuugaacaaugcugua

SEQ ID NO: 354752 - RNA, 22 nt, Human
cagggccagcgcccaggcccag

SEQ ID NO: 354753 - RNA, 22 nt, Human
agagugggugaucucuguuguc

SEQ ID NO: 354754 - RNA, 22 nt, Human
agaggcugcacuugcucaugau

SEQ ID NO: 354755 - RNA, 22 nt, Human
agucccagccuguaggauuggg

SEQ ID NO: 354756 - RNA, 17 nt, Human
ucaugcccaacuauuac

SEQ ID NO: 354757 - RNA, 18 nt, Human
ugcuggcaacuacuauug

SEQ ID NO: 354758 - RNA, 22 nt, Human
uaaguucauaagcuuauucuua

SEQ ID NO: 354759 - RNA, 22 nt, Human
uuaugaaagacauuucuguugg

SEQ ID NO: 354760 - RNA, 18 nt, Human
aaauguacuguccauggc

SEQ ID NO: 354761 - RNA, 19 nt, Human
ggccaggcugacugugguc

SEQ ID NO: 354762 - RNA, 22 nt, Human
acagcauugagagcuaaauuua

SEQ ID NO: 354763 - RNA, 22 nt, Human
cguauacaugaagacauugcug

SEQ ID NO: 354764 - RNA, 22 nt, Human
gggccagguggaccccagccuc

SEQ ID NO: 354765 - RNA, 22 nt, Human
gggagggaaggaggcgccgugu

SEQ ID NO: 354766 - RNA, 22 nt, Human
cugcuuugggcagcuuuguggc

SEQ ID NO: 354767 - RNA, 22 nt, Human
augaguucaauuguuucaguca

SEQ ID NO: 354768 - RNA, 22 nt, Human
auguaucaauuaucugucugca

SEQ ID NO: 354769 - RNA, 22 nt, Human
ccuauacagccucagcugagau

SEQ ID NO: 354770 - RNA, 22 nt, Human
gaggacaggagacucacuguuu

SEQ ID NO: 354771 - RNA, 20 nt, Human
gccagcacagggagcaguuc

SEQ ID NO: 354772 - RNA, 22 nt, Human
uuggaggcaaugggaaggaggc

SEQ ID NO: 354773 - RNA, 22 nt, Human
uugcauaaagauuuuauugcau

SEQ ID NO: 354774 - RNA, 20 nt, Human
auccaugagagucuggauuc

SEQ ID NO: 354775 - RNA, 22 nt, Human
guuggccugaauggucaagagg

SEQ ID NO: 354776 - RNA, 22 nt, Human
aucacuguguauguauaugcag

SEQ ID NO: 354777 - RNA, 22 nt, Human
guugaaugaaucauucuaugua

SEQ ID NO: 354778 - RNA, 22 nt, Human
auucuccacacauccagaccuu

SEQ ID NO: 354779 - RNA, 22 nt, Human
caugcacaacauacucaagagg

SEQ ID NO: 354780 - RNA, 22 nt, Human
uuucagaaccgcuaaaauaaau

SEQ ID NO: 354781 - RNA, 22 nt, Human
cucacaggcaucucaucaggcu

SEQ ID NO: 354782 - RNA, 22 nt, Human
uaauuauaacaguuacaucuua

SEQ ID NO: 354783 - RNA, 20 nt, Human
aggcucagauacccagggaa

SEQ ID NO: 354784 - RNA, 23 nt, Human
agucaguguaaguuuggaaugca

SEQ ID NO: 354785 - RNA, 22 nt, Human
uuucuauaugaggagcuaaagu

SEQ ID NO: 354786 - RNA, 22 nt, Human
uguacaguaggaacuuguuauu

SEQ ID NO: 354787 - RNA, 22 nt, Human
agcaguccaacugagguggcau

SEQ ID NO: 354788 - RNA, 22 nt, Human
acaacaaaaucacuagucuucc

SEQ ID NO: 354789 - RNA, 22 nt, Human
gagcaggccagcaauggaaggg

SEQ ID NO: 354790 - RNA, 22 nt, Human
caggguuucaccauguuagcag

SEQ ID NO: 354791 - RNA, 21 nt, Human
ggugucaguuuuggucauuag

SEQ ID NO: 354792 - RNA, 22 nt, Human
caagagcuggagaggcagucua

SEQ ID NO: 354793 - RNA, 22 nt, Human
aaggcagcucagcucauggcag

SEQ ID NO: 354794 - RNA, 22 nt, Human
cagccaggccuggugaccaaag

SEQ ID NO: 354795 - RNA, 22 nt, Human
uguguauucagcaagcgaaaca

SEQ ID NO: 354796 - RNA, 22 nt, Human
ccagagggcaaaaugaagcuua

SEQ ID NO: 354797 - RNA, 22 nt, Human
aguauguagugcaaucagucag

SEQ ID NO: 354798 - RNA, 22 nt, Human
cccagcccugaccuauuggaaa

SEQ ID NO: 354799 - RNA, 21 nt, Human
guauugcagaguuaugugcuc

SEQ ID NO: 354800 - RNA, 22 nt, Human
uguuaggguccugugcaggggc

SEQ ID NO: 354801 - RNA, 22 nt, Human
agccuggaccaggggccucaga

SEQ ID NO: 354802 - RNA, 22 nt, Human
gauuuagagaauguuuuguaag

SEQ ID NO: 354803 - RNA, 22 nt, Human
ugcacauuaguguuugagaugc

SEQ ID NO: 354804 - RNA, 22 nt, Human
ucucuguacaguacaugccgug

SEQ ID NO: 354805 - RNA, 22 nt, Human
cugggugguuuugaugugaauu

SEQ ID NO: 354806 - RNA, 22 nt, Human
gcugcccacaaugauuacaugg

SEQ ID NO: 354807 - RNA, 22 nt, Human
gaaauauuucucuugagccccu

SEQ ID NO: 354808 - RNA, 22 nt, Human
ucugggagguaaccaugcugau

SEQ ID NO: 354809 - RNA, 22 nt, Human
uuacuuugaugaucaaugagcg

SEQ ID NO: 354810 - RNA, 22 nt, Human
acauuucucuuagaguuggacu

SEQ ID NO: 354811 - RNA, 22 nt, Human
aggcagaggaaggguggauuug

SEQ ID NO: 354812 - RNA, 22 nt, Human
cauacauugcucauucaguauc

SEQ ID NO: 354813 - RNA, 22 nt, Human
gauggacagccuggaaggaaag

SEQ ID NO: 354814 - RNA, 22 nt, Human
ggccugaggccaccagcagccc

SEQ ID NO: 354815 - RNA, 22 nt, Human
uuucauaaugucacagucaaaa

SEQ ID NO: 354816 - RNA, 22 nt, Human
ccaggagagcauugcacagagg

SEQ ID NO: 354817 - RNA, 22 nt, Human
aauguguagcauuuaaugcagu

SEQ ID NO: 354818 - RNA, 22 nt, Human
aggcagcucuguggccucccag

SEQ ID NO: 354819 - RNA, 17 nt, Human
gcuuccugugcugggga

SEQ ID NO: 354820 - RNA, 22 nt, Human
ugacagaaauaguucuuaauuu

SEQ ID NO: 354821 - RNA, 22 nt, Human
caggcagaaggaaguaccaggc

SEQ ID NO: 354822 - RNA, 22 nt, Human
ggaggggaggauuaaugacaaa

SEQ ID NO: 354823 - RNA, 22 nt, Human
cuuugcaaacugucacacuuuc

SEQ ID NO: 354824 - RNA, 22 nt, Human
acacugaagagcacuuucaaag

SEQ ID NO: 354825 - RNA, 22 nt, Human
agguacaaaagaguauaugaga

SEQ ID NO: 354826 - RNA, 22 nt, Human
gccaugcuugguaugcugugag

SEQ ID NO: 354827 - RNA, 22 nt, Human
ucuaaacaguuucacucuuaau

SEQ ID NO: 354828 - RNA, 22 nt, Human
ggggugggguuacucauugugc

SEQ ID NO: 354829 - RNA, 22 nt, Human
ccugugcauccgguggucauug

SEQ ID NO: 354830 - RNA, 22 nt, Human
ucacauuuuuuacuggacuuaa

SEQ ID NO: 354831 - RNA, 22 nt, Human
gcugggagccguaccugucacg

SEQ ID NO: 354832 - RNA, 20 nt, Human
uggggccuguuucugugguu

SEQ ID NO: 354833 - RNA, 22 nt, Human
accccaagacaguagaagagaa

SEQ ID NO: 354834 - RNA, 22 nt, Human
aagacauuuauuugaaucaauu

SEQ ID NO: 354835 - RNA, 22 nt, Human
cccuggcaaaacacucucuuga

SEQ ID NO: 354836 - RNA, 22 nt, Human
uuauuagguuuacauaaagguu

SEQ ID NO: 354837 - RNA, 22 nt, Human
uccuucaguuaaagaucucaca

SEQ ID NO: 354838 - RNA, 22 nt, Human
guaggcagguggaggagugaag

SEQ ID NO: 354839 - RNA, 21 nt, Human
ucucugguuggaguugugcca

SEQ ID NO: 354840 - RNA, 22 nt, Human
guccuuaguuacuuuucauguc

SEQ ID NO: 354841 - RNA, 22 nt, Human
ccacagggaacaugacagccuu

SEQ ID NO: 354842 - RNA, 22 nt, Human
uauguacacauacacuuguaau

SEQ ID NO: 354843 - RNA, 22 nt, Human
agacuucuuugugagcauuuuc

SEQ ID NO: 354844 - RNA, 22 nt, Human
gcugagguggagauugcaguga

SEQ ID NO: 354845 - RNA, 22 nt, Human
uagggcaggugaagaaaagcua

SEQ ID NO: 354846 - RNA, 22 nt, Human
acguggagagaauagggcacca

SEQ ID NO: 354847 - RNA, 22 nt, Human
auggcuuugaaguaauguaauu

SEQ ID NO: 354848 - RNA, 22 nt, Human
uccagggaaggugugaggcugg

SEQ ID NO: 354849 - RNA, 22 nt, Human
gcagggccagguacaagaagca

SEQ ID NO: 354850 - RNA, 22 nt, Human
cucaggauugugccuagggaga

SEQ ID NO: 354851 - RNA, 22 nt, Human
cccucugcugccuggcuggguc

SEQ ID NO: 354852 - RNA, 22 nt, Human
gcuguucacggaggaggauggg

SEQ ID NO: 354853 - RNA, 22 nt, Human
cuuaggcaaccaggucaaugcu

SEQ ID NO: 354854 - RNA, 22 nt, Human
cuuuauguccaccagacugcaa

SEQ ID NO: 354855 - RNA, 22 nt, Human
aaauggaucuguggaauacauu

SEQ ID NO: 354856 - RNA, 22 nt, Human
cagcugaguuacucugaggucu

SEQ ID NO: 354857 - RNA, 22 nt, Human
ucugucacugagcucaggauuc

SEQ ID NO: 354858 - RNA, 22 nt, Human
cacccacccacugcucauuggc

SEQ ID NO: 354859 - RNA, 22 nt, Human
uccucaggucaaagcaggagaa

SEQ ID NO: 354860 - RNA, 17 nt, Human
agcugccagggagugug

SEQ ID NO: 354861 - RNA, 22 nt, Human
gauuuuauauggcauacugugg

SEQ ID NO: 354862 - RNA, 18 nt, Human
gaagggagcuggaaugca

SEQ ID NO: 354863 - RNA, 22 nt, Human
gcaccugguuuauauaaucaua

SEQ ID NO: 354864 - RNA, 22 nt, Human
cuggugugauugagcccaggug

SEQ ID NO: 354865 - RNA, 22 nt, Human
ucucugcucugugccucaguuu

SEQ ID NO: 354866 - RNA, 22 nt, Human
gcucaggacccaggugugaccu

SEQ ID NO: 354867 - RNA, 22 nt, Human
gccaggcuggucuugaacuccu

SEQ ID NO: 354868 - RNA, 22 nt, Human
gcuuccuaaaugcacagggcag

SEQ ID NO: 354869 - RNA, 22 nt, Human
gagaggagucccuaucacaguu

SEQ ID NO: 354870 - RNA, 22 nt, Human
gccagaagacuggagucagcug

SEQ ID NO: 354871 - RNA, 22 nt, Human
uaacauguuaagaaauuagaua

SEQ ID NO: 354872 - RNA, 22 nt, Human
gcugggagcaaagccaugcaua

SEQ ID NO: 354873 - RNA, 22 nt, Human
uggcugagccuuuggggcuuuc

SEQ ID NO: 354874 - RNA, 22 nt, Human
cugagccagcgggcucacuuuu

SEQ ID NO: 354875 - RNA, 22 nt, Human
agacagaacagaauaauuguug

SEQ ID NO: 354876 - RNA, 22 nt, Human
uuaauauguugaaauuuauuag

SEQ ID NO: 354877 - RNA, 22 nt, Human
gggggcuguccugugcauugua

SEQ ID NO: 354878 - RNA, 22 nt, Human
aggucauugaaguuauuuucuu

SEQ ID NO: 354879 - RNA, 22 nt, Human
cuucauuaaccaaaaugcaaua

SEQ ID NO: 354880 - RNA, 22 nt, Human
ucucagucagccuugauguccc

SEQ ID NO: 354881 - RNA, 22 nt, Human
ggugaagggugucauggcauuu

SEQ ID NO: 354882 - RNA, 22 nt, Human
ccuccucugggaagauucagag

SEQ ID NO: 354883 - RNA, 22 nt, Human
aggcagcuuucuguaggggugu

SEQ ID NO: 354884 - RNA, 22 nt, Human
uuguuucagcuguaugcuaugu

SEQ ID NO: 354885 - RNA, 22 nt, Human
ccugaggacacacgcugcagga

SEQ ID NO: 354886 - RNA, 17 nt, Human
agguggcugcugcgccu

SEQ ID NO: 354887 - RNA, 22 nt, Human
gugcauauaugcacauaugugu

SEQ ID NO: 354888 - RNA, 22 nt, Human
caaauaguaugagcaaugauuc

SEQ ID NO: 354889 - RNA, 17 nt, Human
uguggccuucugagcuu

SEQ ID NO: 354890 - RNA, 18 nt, Human
aucucccauuggccaagg

SEQ ID NO: 354891 - RNA, 22 nt, Human
ccccuuccaggaagcagaaucg

SEQ ID NO: 354892 - RNA, 22 nt, Human
gagcccucucuguaggcaagua

SEQ ID NO: 354893 - RNA, 22 nt, Human
cucccugguguccccuccagga

SEQ ID NO: 354894 - RNA, 22 nt, Human
uuugcauuguaauauuuaguuc

SEQ ID NO: 354895 - RNA, 22 nt, Human
aauggccagcaacaggagugaa

SEQ ID NO: 354896 - RNA, 22 nt, Human
gccagcagcccagaaggacuuu

SEQ ID NO: 354897 - RNA, 22 nt, Human
agcagcagaggucagaaaggua

SEQ ID NO: 354898 - RNA, 22 nt, Human
uccagagguauguagagaguau

SEQ ID NO: 354899 - RNA, 22 nt, Human
ggcagccagagggcagcuggau

SEQ ID NO: 354900 - RNA, 22 nt, Human
cucaggauggaagccuacagga

SEQ ID NO: 354901 - RNA, 22 nt, Human
agucaccauuuucaccugccuc

SEQ ID NO: 354902 - RNA, 22 nt, Human
ccuggccucagccuagggcuga

SEQ ID NO: 354903 - RNA, 21 nt, Human
cugcuguggcccccgacaugc

SEQ ID NO: 354904 - RNA, 20 nt, Human
ccacaggaguccagucgacc

SEQ ID NO: 354905 - RNA, 22 nt, Human
auguguccacaggugugagaga

SEQ ID NO: 354906 - RNA, 22 nt, Human
aggacagcccuugagagcacau

SEQ ID NO: 354907 - RNA, 22 nt, Human
ucaaugauaucagcaggaugug

SEQ ID NO: 354908 - RNA, 22 nt, Human
guguccuuauuucugucucuca

SEQ ID NO: 354909 - RNA, 22 nt, Human
ugcaggaaauuccaggguggcc

SEQ ID NO: 354910 - RNA, 22 nt, Human
ccagccaggcauugcaaacuga

SEQ ID NO: 354911 - RNA, 22 nt, Human
uugugcauuucucugagugugu

SEQ ID NO: 354912 - RNA, 22 nt, Human
uaucagaaggaagugccuuuaa

SEQ ID NO: 354913 - RNA, 22 nt, Human
ugccagcacaaguuaagagauc

SEQ ID NO: 354914 - RNA, 22 nt, Human
ucaaauaaugccauucaucauc

SEQ ID NO: 354915 - RNA, 22 nt, Human
gugccaaaagcuauaauuuggu

SEQ ID NO: 354916 - RNA, 22 nt, Human
uuuaucuuuggaucuucagaaa

SEQ ID NO: 354917 - RNA, 21 nt, Human
ucauuugugaucugauuucca

SEQ ID NO: 354918 - RNA, 17 nt, Human
gcaaucucagucuccuu

SEQ ID NO: 354919 - RNA, 22 nt, Human
aaaacucugcaguuaguuucua

SEQ ID NO: 354920 - RNA, 17 nt, Human
caauuucauagguuuug

SEQ ID NO: 354921 - RNA, 22 nt, Human
gcagaggagugauuaugccgug

SEQ ID NO: 354922 - RNA, 18 nt, Human
gucuggaggucaggagcu

SEQ ID NO: 354923 - RNA, 22 nt, Human
ucucuucacaugcuugcuccaa

SEQ ID NO: 354924 - RNA, 22 nt, Human
aggaagcuggugugaggaugaa

SEQ ID NO: 354925 - RNA, 22 nt, Human
uauguguuugacacccugcaag

SEQ ID NO: 354926 - RNA, 22 nt, Human
gcugccucuguagcuuuggacc

SEQ ID NO: 354927 - RNA, 22 nt, Human
gaggaagcugcguggcauuuca

SEQ ID NO: 354928 - RNA, 22 nt, Human
ugaaaugauuauaugguguuug

SEQ ID NO: 354929 - RNA, 22 nt, Human
uccagccaacugccuagggagc

SEQ ID NO: 354930 - RNA, 22 nt, Human
uuccgcuggggccgccuggcgg

SEQ ID NO: 354931 - RNA, 21 nt, Human
gccugcaguuuugaagcccuu

SEQ ID NO: 354932 - RNA, 22 nt, Human
agugaaaucagguuuugacugc

SEQ ID NO: 354933 - RNA, 22 nt, Human
augaaaacggaccagagcuauu

SEQ ID NO: 354934 - RNA, 22 nt, Human
caguuaaaggcccaauaucugg

SEQ ID NO: 354935 - RNA, 22 nt, Human
gcucucugguuccagucaggaa

SEQ ID NO: 354936 - RNA, 22 nt, Human
agaggcuccaccuucucugucc

SEQ ID NO: 354937 - RNA, 22 nt, Human
agggucagguuaagggagucau

SEQ ID NO: 354938 - RNA, 22 nt, Human
auggcagggcagccucucagag

SEQ ID NO: 354939 - RNA, 22 nt, Human
gaaguggaauuacugggucaua

SEQ ID NO: 354940 - RNA, 22 nt, Human
accaggagcauuuuuuauuagu

SEQ ID NO: 354941 - RNA, 22 nt, Human
uuccucugaaauggcuuggaaa

SEQ ID NO: 354942 - RNA, 22 nt, Human
cugugcuuaccugcccagguga

SEQ ID NO: 354943 - RNA, 22 nt, Human
ugggaugggaucucgcuguguc

SEQ ID NO: 354944 - RNA, 22 nt, Human
uuccaguugguagaauguaagg

SEQ ID NO: 354945 - RNA, 23 nt, Human
ccacuagcaccuguucaacuucu

SEQ ID NO: 354946 - RNA, 22 nt, Human
ucugucacuuauuaagauggau

SEQ ID NO: 354947 - RNA, 22 nt, Human
uauuaaagggaaguuaugcaug

SEQ ID NO: 354948 - RNA, 22 nt, Human
gagggagggccaggucccaacc

SEQ ID NO: 354949 - RNA, 22 nt, Human
guuuccaaccccaccaaagugc

SEQ ID NO: 354950 - RNA, 22 nt, Human
gggccacacagaaccuccuggu

SEQ ID NO: 354951 - RNA, 22 nt, Human
gcugcugugaauuuuuuaaaug

SEQ ID NO: 354952 - RNA, 18 nt, Human
gaggauggaaggagaugc

SEQ ID NO: 354953 - RNA, 22 nt, Human
ggucccaggaagugcggcggcg

SEQ ID NO: 354954 - RNA, 23 nt, Human
cuuuuaacuugaucugagaccag

SEQ ID NO: 354955 - RNA, 22 nt, Human
gaaaugugggucaugacccauu

SEQ ID NO: 354956 - RNA, 22 nt, Human
uuugagaaaugggcucugugcu

SEQ ID NO: 354957 - RNA, 22 nt, Human
cguguacagucuaucuuuuuuc

SEQ ID NO: 354958 - RNA, 22 nt, Human
uagggcugcugcagaugacagg

SEQ ID NO: 354959 - RNA, 22 nt, Human
uagugcuuggcccuaccagaua

SEQ ID NO: 354960 - RNA, 22 nt, Human
ggauucuaacugaacagaauau

SEQ ID NO: 354961 - RNA, 22 nt, Human
ccucugggagacugcuacugag

SEQ ID NO: 354962 - RNA, 22 nt, Human
agccuggaggaggaguugagca

SEQ ID NO: 354963 - RNA, 22 nt, Human
aagcagaggaccgacggaggga

SEQ ID NO: 354964 - RNA, 22 nt, Human
cccagccugucuuucccaauga

SEQ ID NO: 354965 - RNA, 22 nt, Human
uaacaucuuuagcagcucgaac

SEQ ID NO: 354966 - RNA, 18 nt, Human
caguuuuuauaucuggca

SEQ ID NO: 354967 - RNA, 22 nt, Human
acaugcuuugauguauuuugca

SEQ ID NO: 354968 - RNA, 19 nt, Human
ucaguuuuagucaucaguu

SEQ ID NO: 354969 - RNA, 22 nt, Human
gucuggaguggggccugagaau

SEQ ID NO: 354970 - RNA, 22 nt, Human
guggaggagaggcgccuugcgg

SEQ ID NO: 354971 - RNA, 22 nt, Human
gagcacaggcuuugguggacac

SEQ ID NO: 354972 - RNA, 22 nt, Human
ucugcucuccauacuuccgcac

SEQ ID NO: 354973 - RNA, 22 nt, Human
gggaggcuggcucuggccacag

SEQ ID NO: 354974 - RNA, 22 nt, Human
aggcagugcaugcaaaggucgg

SEQ ID NO: 354975 - RNA, 22 nt, Human
uugcacuccagcccgagcaaca

SEQ ID NO: 354976 - RNA, 22 nt, Human
ugccucagcugaggccgcucca

SEQ ID NO: 354977 - RNA, 22 nt, Human
cuuccccaaccccgacugugug

SEQ ID NO: 354978 - RNA, 22 nt, Human
cugaggccuaagacaugaauga

SEQ ID NO: 354979 - RNA, 21 nt, Human
aagccagcccacagugguuug

SEQ ID NO: 354980 - RNA, 22 nt, Human
gcaggggcaggagaucucaggc

SEQ ID NO: 354981 - RNA, 22 nt, Human
uggcucugcaccucaguguacc

SEQ ID NO: 354982 - RNA, 22 nt, Human
aggcagagagcaguggccgucu

SEQ ID NO: 354983 - RNA, 22 nt, Human
accagggcccgggagagcucuc

SEQ ID NO: 354984 - RNA, 22 nt, Human
uugcauuugagaaaguucuccu

SEQ ID NO: 354985 - RNA, 22 nt, Human
acaggggcuccgaaggugaggg

SEQ ID NO: 354986 - RNA, 22 nt, Human
agaugcugucacacacacuguu

SEQ ID NO: 354987 - RNA, 22 nt, Human
gccucacugcagccccaggaag

SEQ ID NO: 354988 - RNA, 22 nt, Human
gagccaggcaccuucuguguug

SEQ ID NO: 354989 - RNA, 21 nt, Human
cauuucaaagagcuggaaauc

SEQ ID NO: 354990 - RNA, 21 nt, Human
ccuauugaauauaggaagauu

SEQ ID NO: 354991 - RNA, 22 nt, Human
uuaauacagucuccagaaguaa

SEQ ID NO: 354992 - RNA, 22 nt, Human
uacuuuuuagcacagugugugc

SEQ ID NO: 354993 - RNA, 22 nt, Human
guguuuccuaguuuaaugaaug

SEQ ID NO: 354994 - RNA, 22 nt, Human
cagaguggcacucugcuggaug

SEQ ID NO: 354995 - RNA, 22 nt, Human
gcagaagggaauaaggagcuuu

SEQ ID NO: 354996 - RNA, 22 nt, Human
agcuuuaugcuuccuacaagcu

SEQ ID NO: 354997 - RNA, 22 nt, Human
aggccugggacgggagccguga

SEQ ID NO: 354998 - RNA, 22 nt, Human
uggcucuguugugcugagccag

SEQ ID NO: 354999 - RNA, 21 nt, Human
uuagaaagcucacuacaguua

SEQ ID NO: 355000 - RNA, 22 nt, Human
agcugccaucagccuuuggaug

SEQ ID NO: 355001 - RNA, 22 nt, Human
gauuucaaggauguuagaggug

SEQ ID NO: 355002 - RNA, 22 nt, Human
ggagcagagcugggcuuggcug

SEQ ID NO: 355003 - RNA, 22 nt, Human
uuucauaugggcauuggcaaua

SEQ ID NO: 355004 - RNA, 22 nt, Human
gugaauaauauuguuuauaaaa

SEQ ID NO: 355005 - RNA, 22 nt, Human
uugaacaguuuugucagguuca

SEQ ID NO: 355006 - RNA, 22 nt, Human
acauccagaucucagcauggcu

SEQ ID NO: 355007 - RNA, 22 nt, Human
uuagccauggacugaauugacu

SEQ ID NO: 355008 - RNA, 22 nt, Human
cuccucuuuggggauuuacaca

SEQ ID NO: 355009 - RNA, 22 nt, Human
aaggcuuuuguuccuauuuagu

SEQ ID NO: 355010 - RNA, 22 nt, Human
cagggccugcuuccuucuuguu

SEQ ID NO: 355011 - RNA, 22 nt, Human
gauuucaaguaucuugggcgag

SEQ ID NO: 355012 - RNA, 22 nt, Human
ugagaacugaggauuugaauuc

SEQ ID NO: 355013 - RNA, 22 nt, Human
uccaucagauucccuccugaga

SEQ ID NO: 355014 - RNA, 22 nt, Human
uccuggaggggacagcaugggc

SEQ ID NO: 355015 - RNA, 22 nt, Human
cugagcagcaacccagagccuc

SEQ ID NO: 355016 - RNA, 22 nt, Human
ggcugccucaaagcucaagcuc

SEQ ID NO: 355017 - RNA, 22 nt, Human
aagagcuguaugccauaugauu

SEQ ID NO: 355018 - RNA, 22 nt, Human
gccuggagcucggcugagggcg

SEQ ID NO: 355019 - RNA, 22 nt, Human
auaaacaguagagaaagguggu

SEQ ID NO: 355020 - RNA, 22 nt, Human
aaugaugggaaggagaaaagca

SEQ ID NO: 355021 - RNA, 22 nt, Human
aagccaagaguuaacuauuugu

SEQ ID NO: 355022 - RNA, 23 nt, Human
uugauuucaaaugcagagaacac

SEQ ID NO: 355023 - RNA, 22 nt, Human
uucaggauuguguuuuuccuga

SEQ ID NO: 355024 - RNA, 22 nt, Human
aacauugcagcuuaauugcagg

SEQ ID NO: 355025 - RNA, 22 nt, Human
gggugaagcuccugcaggggcc

SEQ ID NO: 355026 - RNA, 23 nt, Human
uggacgccgacuuuggaggcgcu

SEQ ID NO: 355027 - RNA, 22 nt, Human
gcauuccuacaggcugcuauga

SEQ ID NO: 355028 - RNA, 22 nt, Human
ucagggcaucucuuaaguggug

SEQ ID NO: 355029 - RNA, 22 nt, Human
gcugcucuggcucugcaguguc

SEQ ID NO: 355030 - RNA, 22 nt, Human
guguaauugaaauugagaacca

SEQ ID NO: 355031 - RNA, 22 nt, Human
gaggcaccucgcgggaggaggc

SEQ ID NO: 355032 - RNA, 22 nt, Human
cccagggagguagcaggagaaa

SEQ ID NO: 355033 - RNA, 18 nt, Human
ucaagacaucaugaaaua

SEQ ID NO: 355034 - RNA, 22 nt, Human
ugaaagguguccaauauuucuc

SEQ ID NO: 355035 - RNA, 21 nt, Human
cuugaaagguagagucuacag

SEQ ID NO: 355036 - RNA, 22 nt, Human
caagcuggcugggagaggcacg

SEQ ID NO: 355037 - RNA, 22 nt, Human
gggcuuggcacaugggcucagc

SEQ ID NO: 355038 - RNA, 22 nt, Human
ugggcagcauccuccacaguca

SEQ ID NO: 355039 - RNA, 22 nt, Human
ccauuugucaccucugcacucc

SEQ ID NO: 355040 - RNA, 22 nt, Human
ucaccuuagcuagaggaagaga

SEQ ID NO: 355041 - RNA, 22 nt, Human
ccuguggcucucuuuggagguc

SEQ ID NO: 355042 - RNA, 22 nt, Human
gcuucucuggccugcagggcau

SEQ ID NO: 355043 - RNA, 22 nt, Human
ggcaggcaggucuucauggccc

SEQ ID NO: 355044 - RNA, 22 nt, Human
auucucaguucacuaguuucuu

SEQ ID NO: 355045 - RNA, 22 nt, Human
ugaagcaggaaacuucuuguuu

SEQ ID NO: 355046 - RNA, 22 nt, Human
guaacacagaaaugaaauucca

SEQ ID NO: 355047 - RNA, 22 nt, Human
aagcagccuggcaugaugcuuu

SEQ ID NO: 355048 - RNA, 19 nt, Human
gagcacagcggcauuuggu

SEQ ID NO: 355049 - RNA, 22 nt, Human
uuucaguggguuuauuucaugu

SEQ ID NO: 355050 - RNA, 22 nt, Human
aguguggcugcguagggcucuc

SEQ ID NO: 355051 - RNA, 22 nt, Human
uuugacauggaauaacucauuu

SEQ ID NO: 355052 - RNA, 22 nt, Human
cuauuagguuggugcaaaagua

SEQ ID NO: 355053 - RNA, 22 nt, Human
uuuuaccugaaccacacaguau

SEQ ID NO: 355054 - RNA, 22 nt, Human
acaaaguuauucuuucagagga

SEQ ID NO: 355055 - RNA, 22 nt, Human
acagaagagcacauuuaguaug

SEQ ID NO: 355056 - RNA, 22 nt, Human
uguccucuuccagugcuccuuc

SEQ ID NO: 355057 - RNA, 22 nt, Human
uuuuagcacuaagugauaugcu

SEQ ID NO: 355058 - RNA, 22 nt, Human
uggcugcuuguuuuagugaggc

SEQ ID NO: 355059 - RNA, 22 nt, Human
ggcagcagcaagguuggagcug

SEQ ID NO: 355060 - RNA, 22 nt, Human
ugccaggcuguccugggccugg

SEQ ID NO: 355061 - RNA, 22 nt, Human
ggcagcuuccuaggagagggca

SEQ ID NO: 355062 - RNA, 22 nt, Human
agggaaaguaagcauuucauua

SEQ ID NO: 355063 - RNA, 21 nt, Human
ucaggagagcccaucuacaaa

SEQ ID NO: 355064 - RNA, 22 nt, Human
acaugcuuccaaauuauguugg

SEQ ID NO: 355065 - RNA, 22 nt, Human
agaagccauguuuaguaggaug

SEQ ID NO: 355066 - RNA, 21 nt, Human
cucuggagucaagagcuucca

SEQ ID NO: 355067 - RNA, 22 nt, Human
aaugaucuacucucauuaucuc

SEQ ID NO: 355068 - RNA, 22 nt, Human
cuuaacauccugcauuuuucuu

SEQ ID NO: 355069 - RNA, 22 nt, Human
gcacagggagcaggucucuggu

SEQ ID NO: 355070 - RNA, 22 nt, Human
aaagccaugggucuuuggcaua

SEQ ID NO: 355071 - RNA, 22 nt, Human
cacaggaggaggugcccgggcc

SEQ ID NO: 355072 - RNA, 22 nt, Human
uuuucauuuacauuagggaaga

SEQ ID NO: 355073 - RNA, 22 nt, Human
cuccaggccagggaaguggaca

SEQ ID NO: 355074 - RNA, 22 nt, Human
gccaucacauccaggcuaccuc

SEQ ID NO: 355075 - RNA, 22 nt, Human
gcuggcagguccaagauagagc

SEQ ID NO: 355076 - RNA, 22 nt, Human
cagcugugagcagccaguugcc

SEQ ID NO: 355077 - RNA, 22 nt, Human
agcauccaacaggagggaaggg

SEQ ID NO: 355078 - RNA, 22 nt, Human
cccaggaggcagauguugcagu

SEQ ID NO: 355079 - RNA, 22 nt, Human
aguggcagacacaaugugggca

SEQ ID NO: 355080 - RNA, 22 nt, Human
acaggcaggcuucggccagagc

SEQ ID NO: 355081 - RNA, 22 nt, Human
ucagcuuugaucucaggcaauc

SEQ ID NO: 355082 - RNA, 22 nt, Human
gcucugugcaguucagggacac

SEQ ID NO: 355083 - RNA, 22 nt, Human
cagugucuccagaugcuccaau

SEQ ID NO: 355084 - RNA, 21 nt, Human
uagagaaaagaagcuguuccu

SEQ ID NO: 355085 - RNA, 18 nt, Human
gguggcaggucagaugcc

SEQ ID NO: 355086 - RNA, 22 nt, Human
ucucaggagccacagcgggagu

SEQ ID NO: 355087 - RNA, 22 nt, Human
uucagagauggaaggcagaaug

SEQ ID NO: 355088 - RNA, 22 nt, Human
ugaggcaguauucuccauucca

SEQ ID NO: 355089 - RNA, 22 nt, Human
gcuggccucuacaggccggcca

SEQ ID NO: 355090 - RNA, 22 nt, Human
agagaaaagaguucaggcuuug

SEQ ID NO: 355091 - RNA, 22 nt, Human
accacugggcgggcagccugcu

SEQ ID NO: 355092 - RNA, 22 nt, Human
uuucuaggucuuccauacugcc

SEQ ID NO: 355093 - RNA, 19 nt, Human
uggagacugagagugagca

SEQ ID NO: 355094 - RNA, 22 nt, Human
ccaggugucaugcgugugaccc

SEQ ID NO: 355095 - RNA, 22 nt, Human
cuuguacaggaauccaugguau

SEQ ID NO: 355096 - RNA, 22 nt, Human
ggacacaagcuccggggcugca

SEQ ID NO: 355097 - RNA, 22 nt, Human
ccccaggacguggcccucauag

SEQ ID NO: 355098 - RNA, 19 nt, Human
ccaggccuccugggagguc

SEQ ID NO: 355099 - RNA, 22 nt, Human
agggccugcaucaggagcuugg

SEQ ID NO: 355100 - RNA, 22 nt, Human
auuuauuaugggauuuggcaca

SEQ ID NO: 355101 - RNA, 22 nt, Human
ucugaacauccagcaaugcaca

SEQ ID NO: 355102 - RNA, 22 nt, Human
gcugccuggagcucagccugcc

SEQ ID NO: 355103 - RNA, 22 nt, Human
agaaaucauucccaaacccaua

SEQ ID NO: 355104 - RNA, 20 nt, Human
guguuucaugugauacaaug

SEQ ID NO: 355105 - RNA, 22 nt, Human
auguguacaaccaagcacuaaa

SEQ ID NO: 355106 - RNA, 22 nt, Human
ggagucaccaaguaggagucuu

SEQ ID NO: 355107 - RNA, 21 nt, Human
gauuugcagaaacuagacagg

SEQ ID NO: 355108 - RNA, 22 nt, Human
agcacauucugccuugcuuugc

SEQ ID NO: 355109 - RNA, 22 nt, Human
augaagcugaccuugucuugcu

SEQ ID NO: 355110 - RNA, 21 nt, Human
agagagggagaugaaacaucc

SEQ ID NO: 355111 - RNA, 22 nt, Human
ucaccagucuuucuuaccauug

SEQ ID NO: 355112 - RNA, 22 nt, Human
ccuggagauuauuugguccaau

SEQ ID NO: 355113 - RNA, 22 nt, Human
caguuucuauggcugggcucug

SEQ ID NO: 355114 - RNA, 17 nt, Human
ggugaguguccaggugg

SEQ ID NO: 355115 - RNA, 22 nt, Human
acauaauaccuaggacaguuug

SEQ ID NO: 355116 - RNA, 22 nt, Human
uggcucuguucgccaucaggag

SEQ ID NO: 355117 - RNA, 22 nt, Human
uugaagcauuguggcuuguauu

SEQ ID NO: 355118 - RNA, 22 nt, Human
uccugccucuuuucuuauucca

SEQ ID NO: 355119 - RNA, 22 nt, Human
gccuccuggccuuugcuccuca

SEQ ID NO: 355120 - RNA, 22 nt, Human
gcccucugcuggccucaccucg

SEQ ID NO: 355121 - RNA, 22 nt, Human
cccaggacucuucacugcagcc

SEQ ID NO: 355122 - RNA, 22 nt, Human
agcagagguguuuauuauggga

SEQ ID NO: 355123 - RNA, 23 nt, Human
cccaggagccugaguccucucug

SEQ ID NO: 355124 - RNA, 17 nt, Human
cuguuaauucauuuccc

SEQ ID NO: 355125 - RNA, 22 nt, Human
caaaucuauauguugauauucu

SEQ ID NO: 355126 - RNA, 22 nt, Human
uccaugggaagauuuugagugg

SEQ ID NO: 355127 - RNA, 22 nt, Human
uucacagauuucccugcacaug

SEQ ID NO: 355128 - RNA, 22 nt, Human
ucaggauggcuucugcaucaaa

SEQ ID NO: 355129 - RNA, 22 nt, Human
cacaggagagcugggaggugcc

SEQ ID NO: 355130 - RNA, 22 nt, Human
auugagaauccauuugagauga

SEQ ID NO: 355131 - RNA, 22 nt, Human
cagcuuuaggacucauaauaaa

SEQ ID NO: 355132 - RNA, 22 nt, Human
ucagaggacgcacuaggguugu

SEQ ID NO: 355133 - RNA, 22 nt, Human
ggaccugcauuuuaacaagauc

SEQ ID NO: 355134 - RNA, 22 nt, Human
ugaggaagaacaagaauuuaga

SEQ ID NO: 355135 - RNA, 22 nt, Human
cauuuuaagaugaccugguuuc

SEQ ID NO: 355136 - RNA, 22 nt, Human
cucaggauucucgacacucaca

SEQ ID NO: 355137 - RNA, 22 nt, Human
uuucaauguaugucuuucugag

SEQ ID NO: 355138 - RNA, 22 nt, Human
caguggcagagaacagagaccu

SEQ ID NO: 355139 - RNA, 22 nt, Human
ccagaaaaugcagaacauagaa

SEQ ID NO: 355140 - RNA, 22 nt, Human
ggaucauuaacacauccaucac

SEQ ID NO: 355141 - RNA, 22 nt, Human
acagcaggauuuggcgauguug

SEQ ID NO: 355142 - RNA, 22 nt, Human
uugcugaaaacaguggguauug

SEQ ID NO: 355143 - RNA, 22 nt, Human
gaaucucaaggcuugugaggau

SEQ ID NO: 355144 - RNA, 17 nt, Human
aggcaggagauuggaga

SEQ ID NO: 355145 - RNA, 22 nt, Human
ggggaggaagcuggaacacggg

SEQ ID NO: 355146 - RNA, 22 nt, Human
uauguguacaucugguugagca

SEQ ID NO: 355147 - RNA, 23 nt, Human
ggggccugcaccggucugcgcgg

SEQ ID NO: 355148 - RNA, 22 nt, Human
cuccuugguguaguacugagca

SEQ ID NO: 355149 - RNA, 20 nt, Human
ucacuaguaaccaucugcuu

SEQ ID NO: 355150 - RNA, 22 nt, Human
gagcugccggcccacaguacua

SEQ ID NO: 355151 - RNA, 22 nt, Human
ccaggccuguguuguguggagg

SEQ ID NO: 355152 - RNA, 22 nt, Human
aggcuucuaggguuggcagcgg

SEQ ID NO: 355153 - RNA, 19 nt, Human
uucuccaggcugcagaggg

SEQ ID NO: 355154 - RNA, 22 nt, Human
acaaagucugaaaccugaggca

SEQ ID NO: 355155 - RNA, 22 nt, Human
ucugccuuuucacugccacuaa

SEQ ID NO: 355156 - RNA, 17 nt, Human
ggccuugggcugcucuu

SEQ ID NO: 355157 - RNA, 22 nt, Human
cagaggacaauagaauggaaag

SEQ ID NO: 355158 - RNA, 23 nt, Human
acauacauggagauaaagugaug

SEQ ID NO: 355159 - RNA, 22 nt, Human
caaauccagaucccagucguag

SEQ ID NO: 355160 - RNA, 22 nt, Human
aucaggaagccagucuaaugga

SEQ ID NO: 355161 - RNA, 22 nt, Human
ggccugaggcaauagucagaca

SEQ ID NO: 355162 - RNA, 21 nt, Human
ccauaccuaccucaccugguu

SEQ ID NO: 355163 - RNA, 22 nt, Human
gcagagcacccugcagugguau

SEQ ID NO: 355164 - RNA, 22 nt, Human
cagcugaggucaaagaagcagg

SEQ ID NO: 355165 - RNA, 19 nt, Human
cccagcuugaccaccugcu

SEQ ID NO: 355166 - RNA, 22 nt, Human
auaugaaaagaagucaccauug

SEQ ID NO: 355167 - RNA, 22 nt, Human
gaguccuuuugugccacaggga

SEQ ID NO: 355168 - RNA, 22 nt, Human
cccaggagaucuggaucucguc

SEQ ID NO: 355169 - RNA, 22 nt, Human
ucuuuaauuguggaagagcagc

SEQ ID NO: 355170 - RNA, 22 nt, Human
uuacaaagcguugagacaagua

SEQ ID NO: 355171 - RNA, 22 nt, Human
caggccacaaguuggguucaag

SEQ ID NO: 355172 - RNA, 22 nt, Human
agcugcucccuauccuuuccuu

SEQ ID NO: 355173 - RNA, 22 nt, Human
ggcagugagcuggagggaagga

SEQ ID NO: 355174 - RNA, 22 nt, Human
gagcaggaugggagcuggggcc

SEQ ID NO: 355175 - RNA, 22 nt, Human
gagagugagauaauuucacaua

SEQ ID NO: 355176 - RNA, 22 nt, Human
aagcaaagaguuuaguggguga

SEQ ID NO: 355177 - RNA, 20 nt, Human
uccugcaguuccuaggaggg

SEQ ID NO: 355178 - RNA, 22 nt, Human
cagcuuugccaaguaaggucuu

SEQ ID NO: 355179 - RNA, 21 nt, Human
uucuucaguuuaauauaaaau

SEQ ID NO: 355180 - RNA, 19 nt, Human
gugauuucuuuccacaagc

SEQ ID NO: 355181 - RNA, 22 nt, Human
aauuaggaauaaaugaguacuu

SEQ ID NO: 355182 - RNA, 22 nt, Human
cucaucugauaaaucacucuua

SEQ ID NO: 355183 - RNA, 22 nt, Human
caaggccugccucuggcagaaa

SEQ ID NO: 355184 - RNA, 20 nt, Human
gccuggaggcaaugggaaga

SEQ ID NO: 355185 - RNA, 22 nt, Human
gagagaggccuccauguacuga

SEQ ID NO: 355186 - RNA, 22 nt, Human
ugccaggcucagccccuaucuu

SEQ ID NO: 355187 - RNA, 22 nt, Human
uacccaggggcugagcagaggu

SEQ ID NO: 355188 - RNA, 22 nt, Human
caucacuguccaaaguucaguu

SEQ ID NO: 355189 - RNA, 22 nt, Human
uuccucagagggcgcuggggaa

SEQ ID NO: 355190 - RNA, 22 nt, Human
cuggguggcagagccugcagug

SEQ ID NO: 355191 - RNA, 22 nt, Human
guucagcccacagagggggccg

SEQ ID NO: 355192 - RNA, 22 nt, Human
ggguacaaagauuucauaagau

SEQ ID NO: 355193 - RNA, 22 nt, Human
ggagccuguggccgucacgacu

SEQ ID NO: 355194 - RNA, 19 nt, Human
agcauuuggaauucuacac

SEQ ID NO: 355195 - RNA, 22 nt, Human
uggaggcagucaaaugacugac

SEQ ID NO: 355196 - RNA, 22 nt, Human
cacugagcugauagaauuccag

SEQ ID NO: 355197 - RNA, 22 nt, Human
agccaggcuacuccuugcugac

SEQ ID NO: 355198 - RNA, 22 nt, Human
auguacauuuuccuaauguuuu

SEQ ID NO: 355199 - RNA, 22 nt, Human
uuugcauaagucauguccagug

SEQ ID NO: 355200 - RNA, 22 nt, Human
gggaaggacauucugggcucag

SEQ ID NO: 355201 - RNA, 17 nt, Human
cagugaggccuuuccuc

SEQ ID NO: 355202 - RNA, 22 nt, Human
cccaggcagccugcagggaagg

SEQ ID NO: 355203 - RNA, 22 nt, Human
aaaggccaauaaagacaagcug

SEQ ID NO: 355204 - RNA, 22 nt, Human
uggcucagaugcucuuccagug

SEQ ID NO: 355205 - RNA, 22 nt, Human
aaguccuucuuuauaugagagu

SEQ ID NO: 355206 - RNA, 22 nt, Human
gugacucacacaggccugggcu

SEQ ID NO: 355207 - RNA, 22 nt, Human
ccaaagcaagucacaugaucaa

SEQ ID NO: 355208 - RNA, 22 nt, Human
ucuucauuuuauagcaucugug

SEQ ID NO: 355209 - RNA, 19 nt, Human
uggcauugguccagauaaa

SEQ ID NO: 355210 - RNA, 22 nt, Human
cagcuugcaguacuuguuuuug

SEQ ID NO: 355211 - RNA, 22 nt, Human
augguuuugaagggaggucaaa

SEQ ID NO: 355212 - RNA, 22 nt, Human
aggggcagccucacaauccucu

SEQ ID NO: 355213 - RNA, 22 nt, Human
cuguauuuucaugccuacguac

SEQ ID NO: 355214 - RNA, 22 nt, Human
cccuggagggcagacagaugcc

SEQ ID NO: 355215 - RNA, 22 nt, Human
uuugaaauuaagauauugucca

SEQ ID NO: 355216 - RNA, 22 nt, Human
ugcacacacucugcauauacuu

SEQ ID NO: 355217 - RNA, 22 nt, Human
gaggcagccucaguggaccucg

SEQ ID NO: 355218 - RNA, 22 nt, Human
gaggccugaaaggggaccuaug

SEQ ID NO: 355219 - RNA, 22 nt, Human
cucccucugucuuguccagaaa

SEQ ID NO: 355220 - RNA, 22 nt, Human
guuguuuugcaggauccuuaca

SEQ ID NO: 355221 - RNA, 22 nt, Human
ucaggcagaauuaucaaaagau

SEQ ID NO: 355222 - RNA, 22 nt, Human
cagucccaugagcccagaacau

SEQ ID NO: 355223 - RNA, 23 nt, Human
aagaauaaaugacauuaaaggug

SEQ ID NO: 355224 - RNA, 22 nt, Human
aggcagauuuaggagaaaagaa

SEQ ID NO: 355225 - RNA, 22 nt, Human
ucagcuuucucucgccaucagg

SEQ ID NO: 355226 - RNA, 22 nt, Human
ucccagcccagauuugugugac

SEQ ID NO: 355227 - RNA, 22 nt, Human
gagcugaaauaugaagccaauu

SEQ ID NO: 355228 - RNA, 22 nt, Human
ggccucugccucaucugggcac

SEQ ID NO: 355229 - RNA, 22 nt, Human
ggcucuggugaggguaggagau

SEQ ID NO: 355230 - RNA, 19 nt, Human
gcauuucucuuuacagcca

SEQ ID NO: 355231 - RNA, 22 nt, Human
gaccugccugagcugccucugc

SEQ ID NO: 355232 - RNA, 22 nt, Human
agaggggcucaagcaguggucu

SEQ ID NO: 355233 - RNA, 22 nt, Human
aauaauauuugaagcuucaaag

SEQ ID NO: 355234 - RNA, 22 nt, Human
uggacucaaguccaaguucacg

SEQ ID NO: 355235 - RNA, 20 nt, Human
aaaaacaguaaugcugaaga

SEQ ID NO: 355236 - RNA, 22 nt, Human
cagggacugagauccagacugu

SEQ ID NO: 355237 - RNA, 22 nt, Human
ugccugucagggggagugggaa

SEQ ID NO: 355238 - RNA, 22 nt, Human
uucaagaugcacaguggcauuc

SEQ ID NO: 355239 - RNA, 22 nt, Human
agcugcugcggaaagaugccac

SEQ ID NO: 355240 - RNA, 22 nt, Human
ucccagggucaguggugaggcc

SEQ ID NO: 355241 - RNA, 22 nt, Human
ccagccucacuggcaucaccua

SEQ ID NO: 355242 - RNA, 20 nt, Human
uaggcagagcugugcagccu

SEQ ID NO: 355243 - RNA, 22 nt, Human
gcauuucugugcauacacauga

SEQ ID NO: 355244 - RNA, 22 nt, Human
agcaccuugcucuuggccuucc

SEQ ID NO: 355245 - RNA, 22 nt, Human
gccuuggccuuccuaggccuga

SEQ ID NO: 355246 - RNA, 22 nt, Human
cauuuaguuauacuaaaacauu

SEQ ID NO: 355247 - RNA, 22 nt, Human
aacucaguguguuucuuaguau

SEQ ID NO: 355248 - RNA, 23 nt, Human
ucucaggacacacaugucuauca

SEQ ID NO: 355249 - RNA, 22 nt, Human
uggaagaauaggauagaagaac

SEQ ID NO: 355250 - RNA, 22 nt, Human
ucuauuuuauacucaaaucuuc

SEQ ID NO: 355251 - RNA, 22 nt, Human
ugcaggaauagcuacagagcug

SEQ ID NO: 355252 - RNA, 22 nt, Human
acuccuggggcugccaucacag

SEQ ID NO: 355253 - RNA, 22 nt, Human
cuuuucaugccagcccaucaca

SEQ ID NO: 355254 - RNA, 22 nt, Human
uguugagacugagggagucagc

SEQ ID NO: 355255 - RNA, 22 nt, Human
uuugaagucaaagauugauucc

SEQ ID NO: 355256 - RNA, 22 nt, Human
ccuggcugaaccaaugaagugg

SEQ ID NO: 355257 - RNA, 22 nt, Human
uaaucuaccacuauugcaauau

SEQ ID NO: 355258 - RNA, 20 nt, Human
aauguauauuuuaugccagg

SEQ ID NO: 355259 - RNA, 22 nt, Human
aaaucugguucaguaaguccuc

SEQ ID NO: 355260 - RNA, 22 nt, Human
ucucagggcgcagugaggcagu

SEQ ID NO: 355261 - RNA, 22 nt, Human
uaaagguagcaugaaacugcaa

SEQ ID NO: 355262 - RNA, 22 nt, Human
accaggagccacaggaggagcc

SEQ ID NO: 355263 - RNA, 22 nt, Human
uuccauaaucaccuuauucuuu

SEQ ID NO: 355264 - RNA, 22 nt, Human
gggcugagcuaagcuggguuga

SEQ ID NO: 355265 - RNA, 22 nt, Human
gguggccucgguggugcacagg

SEQ ID NO: 355266 - RNA, 22 nt, Human
aggugcugccccgagaaggaug

SEQ ID NO: 355267 - RNA, 22 nt, Human
agcugcccuucucuugcccuug

SEQ ID NO: 355268 - RNA, 22 nt, Human
gcagaggaggacccaggaauua

SEQ ID NO: 355269 - RNA, 22 nt, Human
acagccaggaggaacucaguga

SEQ ID NO: 355270 - RNA, 22 nt, Human
gccuggaguggacuuggccccu

SEQ ID NO: 355271 - RNA, 22 nt, Human
guagccauuggcaaugaagccu

SEQ ID NO: 355272 - RNA, 22 nt, Human
agguggagacccagagaaggcg

SEQ ID NO: 355273 - RNA, 22 nt, Human
uccaggcaucuguauuuuuuaa

SEQ ID NO: 355274 - RNA, 22 nt, Human
ucugccagugguuuggcccuga

SEQ ID NO: 355275 - RNA, 22 nt, Human
cagugguugguagauacuugag

SEQ ID NO: 355276 - RNA, 22 nt, Human
uauuccagugugaucuuuguag

SEQ ID NO: 355277 - RNA, 22 nt, Human
gcagaggacagggauuuagauu

SEQ ID NO: 355278 - RNA, 22 nt, Human
uauuccagguauucuucaagag

SEQ ID NO: 355279 - RNA, 22 nt, Human
aggcugcguuagccucacuccc

SEQ ID NO: 355280 - RNA, 22 nt, Human
cagaguggcgacccccucagcu

SEQ ID NO: 355281 - RNA, 22 nt, Human
uugaacauuggcaauuucauau

SEQ ID NO: 355282 - RNA, 22 nt, Human
cuggcagcaguuaugaaacaau

SEQ ID NO: 355283 - RNA, 22 nt, Human
gagggcugcuggaaaaaugcag

SEQ ID NO: 355284 - RNA, 22 nt, Human
agggcucccgugaggugacugc

SEQ ID NO: 355285 - RNA, 22 nt, Human
ggagauagacuuggugagccac

SEQ ID NO: 355286 - RNA, 21 nt, Human
uuugaaagugggugauucuuu

SEQ ID NO: 355287 - RNA, 22 nt, Human
uggcucagccauucguguugcc

SEQ ID NO: 355288 - RNA, 22 nt, Human
gauuuuucaguauaaaauauau

SEQ ID NO: 355289 - RNA, 22 nt, Human
cagaaauaaacuucucacaucg

SEQ ID NO: 355290 - RNA, 22 nt, Human
gcagcuggcucagagagguggg

SEQ ID NO: 355291 - RNA, 22 nt, Human
uugcuuuguuacugcaguuucc

SEQ ID NO: 355292 - RNA, 22 nt, Human
uccagcuugccuggucuuuugg

SEQ ID NO: 355293 - RNA, 22 nt, Human
caggccagguggcaggcaaaac

SEQ ID NO: 355294 - RNA, 22 nt, Human
aguuuagaguucaaauuaguuc

SEQ ID NO: 355295 - RNA, 22 nt, Human
uagcaggguccaaugugaggca

SEQ ID NO: 355296 - RNA, 22 nt, Human
gccugccugcugucaucugccu

SEQ ID NO: 355297 - RNA, 22 nt, Human
aggcacaguggcucacaccugu

SEQ ID NO: 355298 - RNA, 22 nt, Human
uccaggaguggggcagaggucu

SEQ ID NO: 355299 - RNA, 22 nt, Human
guguaaggccccagguucuuua

SEQ ID NO: 355300 - RNA, 22 nt, Human
aaggcaguuaauuuggcuagaa

SEQ ID NO: 355301 - RNA, 22 nt, Human
ugauuuccaauaaggagaaugu

SEQ ID NO: 355302 - RNA, 22 nt, Human
gaaucauuggaaccacauccaa

SEQ ID NO: 355303 - RNA, 22 nt, Human
ucagaggaugcuguucuuuaau

SEQ ID NO: 355304 - RNA, 20 nt, Human
aggcacuguugucuguaucc

SEQ ID NO: 355305 - RNA, 22 nt, Human
auagcuuuacagaagaguuuag

SEQ ID NO: 355306 - RNA, 22 nt, Human
acagguggagugguuagcaggc

SEQ ID NO: 355307 - RNA, 22 nt, Human
caggcagcugcgacaagagagc

SEQ ID NO: 355308 - RNA, 22 nt, Human
agcagccacccagcugcucauu

SEQ ID NO: 355309 - RNA, 22 nt, Human
uccuguggaagacaguguuggg

SEQ ID NO: 355310 - RNA, 22 nt, Human
guuugcauuccaauuuagggga

SEQ ID NO: 355311 - RNA, 22 nt, Human
aucuucaaagcacaucguuugu

SEQ ID NO: 355312 - RNA, 21 nt, Human
ugaagccugaggcauagcccc

SEQ ID NO: 355313 - RNA, 22 nt, Human
ugcauauuauguguaucugucu

SEQ ID NO: 355314 - RNA, 22 nt, Human
ccugggugaaaucucuccugca

SEQ ID NO: 355315 - RNA, 22 nt, Human
caggaugguggcaugaucagaa

SEQ ID NO: 355316 - RNA, 22 nt, Human
ggcugccugcuccuccugcacg

SEQ ID NO: 355317 - RNA, 22 nt, Human
ucccucuguguugggcaugccu

SEQ ID NO: 355318 - RNA, 22 nt, Human
ugcucuggguccugggccuccu

SEQ ID NO: 355319 - RNA, 22 nt, Human
cugaaauuccauuucagccaca

SEQ ID NO: 355320 - RNA, 22 nt, Human
cucccagggccaucgagucacu

SEQ ID NO: 355321 - RNA, 22 nt, Human
acaccagggccuagccagggcg

SEQ ID NO: 355322 - RNA, 22 nt, Human
ccauuguaaagaguauacuuug

SEQ ID NO: 355323 - RNA, 22 nt, Human
ugauaauauuuugaaucauaag

SEQ ID NO: 355324 - RNA, 22 nt, Human
gaggggcugggcagucccugga

SEQ ID NO: 355325 - RNA, 22 nt, Human
cucccagagaccaagcugagaa

SEQ ID NO: 355326 - RNA, 22 nt, Human
uggcucuggugcgggcuccugc

SEQ ID NO: 355327 - RNA, 22 nt, Human
acaggcuuacaggcugcaagua

SEQ ID NO: 355328 - RNA, 22 nt, Human
ccugucucccuggcauggcuca

SEQ ID NO: 355329 - RNA, 22 nt, Human
ggcggggguccaggagccugca

SEQ ID NO: 355330 - RNA, 22 nt, Human
gccucccuggcccacagcagcg

SEQ ID NO: 355331 - RNA, 22 nt, Human
ucuguuccaguagaaaggugca

SEQ ID NO: 355332 - RNA, 22 nt, Human
acauuucuccuugcaggaguca

SEQ ID NO: 355333 - RNA, 22 nt, Human
uuguuuuggaagaacuuacucu

SEQ ID NO: 355334 - RNA, 22 nt, Human
cagcacaguacaaggcacggau

SEQ ID NO: 355335 - RNA, 22 nt, Human
cuggaaggcucugcugccuguc

SEQ ID NO: 355336 - RNA, 22 nt, Human
ccagucagccaagcugcagcgg

SEQ ID NO: 355337 - RNA, 23 nt, Human
ccugcagcugcuggggcuccacc

SEQ ID NO: 355338 - RNA, 22 nt, Human
aaaguauucuugacuguuuuuc

SEQ ID NO: 355339 - RNA, 22 nt, Human
gggcagagacucagaaacagaa

SEQ ID NO: 355340 - RNA, 22 nt, Human
auuuacagaugaugcuauuuga

SEQ ID NO: 355341 - RNA, 22 nt, Human
uagauauaagguccuuagaaca

SEQ ID NO: 355342 - RNA, 22 nt, Human
agugaaauuuguuuagauaggu

SEQ ID NO: 355343 - RNA, 22 nt, Human
ugggccugaguuugggaacugg

SEQ ID NO: 355344 - RNA, 22 nt, Human
uuucagaaagcaucaucaaagu

SEQ ID NO: 355345 - RNA, 19 nt, Human
acagaaauguaagugagac

SEQ ID NO: 355346 - RNA, 22 nt, Human
aauguuaauguguuugcuuaug

SEQ ID NO: 355347 - RNA, 22 nt, Human
cccaggaugucgaggcugcagu

SEQ ID NO: 355348 - RNA, 22 nt, Human
gagugucugaauuagagcacaa

SEQ ID NO: 355349 - RNA, 22 nt, Human
cagcaggagcagucagacuccu

SEQ ID NO: 355350 - RNA, 22 nt, Human
caguuucuacgacuuaagcaca

SEQ ID NO: 355351 - RNA, 22 nt, Human
uaagacacaugcguacaagaua

SEQ ID NO: 355352 - RNA, 22 nt, Human
cacagcuuccauuagaaugaga

SEQ ID NO: 355353 - RNA, 22 nt, Human
caugcacuuaccugaaauucaa

SEQ ID NO: 355354 - RNA, 22 nt, Human
caaagugcugagauuacaggua

SEQ ID NO: 355355 - RNA, 23 nt, Human
uggggagaguuacccuggaagcg

SEQ ID NO: 355356 - RNA, 22 nt, Human
ccugcugugaaacuggcauaug

SEQ ID NO: 355357 - RNA, 22 nt, Human
gugccugugccaggggugugcu

SEQ ID NO: 355358 - RNA, 22 nt, Human
uuauuuugccacaggugaccuu

SEQ ID NO: 355359 - RNA, 22 nt, Human
cuguguggccucaagccagccu

SEQ ID NO: 355360 - RNA, 21 nt, Human
ucagcagcuuuugcagucccu

SEQ ID NO: 355361 - RNA, 22 nt, Human
uucucuuauucuggauaugcag

SEQ ID NO: 355362 - RNA, 22 nt, Human
agucaaaugaguaaauauauaa

SEQ ID NO: 355363 - RNA, 22 nt, Human
ucagggcaagauugguuaauaa

SEQ ID NO: 355364 - RNA, 22 nt, Human
uugaaagacuucuccugugaaa

SEQ ID NO: 355365 - RNA, 22 nt, Human
ggcucacgcaauuaucccggcc

SEQ ID NO: 355366 - RNA, 22 nt, Human
gucacuggggccacaugcagaa

SEQ ID NO: 355367 - RNA, 22 nt, Human
agauggggcucaguguggaggc

SEQ ID NO: 355368 - RNA, 22 nt, Human
agaagcugacagaugcagcagg

SEQ ID NO: 355369 - RNA, 19 nt, Human
acuuucuccaggaccuguu

SEQ ID NO: 355370 - RNA, 22 nt, Human
gugggcagacagugcuuugcag

SEQ ID NO: 355371 - RNA, 22 nt, Human
uguuccaucaguuuuugguuga

SEQ ID NO: 355372 - RNA, 22 nt, Human
uggcugucagcugccuggugcg

SEQ ID NO: 355373 - RNA, 20 nt, Human
ucccuggaggugguggcauc

SEQ ID NO: 355374 - RNA, 22 nt, Human
gccucugcccuccugggacugc

SEQ ID NO: 355375 - RNA, 22 nt, Human
cagcugacccagugaggaggca

SEQ ID NO: 355376 - RNA, 22 nt, Human
uauguacacacacaugcaugua

SEQ ID NO: 355377 - RNA, 22 nt, Human
ucuccuuuaagauuuccucagg

SEQ ID NO: 355378 - RNA, 22 nt, Human
guuauguacuuuuuaaaucuug

SEQ ID NO: 355379 - RNA, 22 nt, Human
cugcagugcaagcccagaugga

SEQ ID NO: 355380 - RNA, 22 nt, Human
cuacagacccaccuuggaagaa

SEQ ID NO: 355381 - RNA, 22 nt, Human
cagucucagaggugggaguggg

SEQ ID NO: 355382 - RNA, 17 nt, Human
aagacagaagccaugag

SEQ ID NO: 355383 - RNA, 20 nt, Human
cucuccucacccgugucagg

SEQ ID NO: 355384 - RNA, 22 nt, Human
cagcucccaguggcagcuccuu

SEQ ID NO: 355385 - RNA, 22 nt, Human
agcaagcuaccuagauagucua

SEQ ID NO: 355386 - RNA, 22 nt, Human
cacaggagguuaggaagugguc

SEQ ID NO: 355387 - RNA, 22 nt, Human
ggagccuguggcugcuugaagc

SEQ ID NO: 355388 - RNA, 19 nt, Human
uccucaggggcucacagac

SEQ ID NO: 355389 - RNA, 22 nt, Human
uggagcagggcaucacugugcg

SEQ ID NO: 355390 - RNA, 22 nt, Human
gcaggguccauggaggcagccc

SEQ ID NO: 355391 - RNA, 21 nt, Human
ccuuuacaauuuugcauuccu

SEQ ID NO: 355392 - RNA, 22 nt, Human
gugcuugggggaaguaacagac

SEQ ID NO: 355393 - RNA, 22 nt, Human
ugggacuuguguggcaguauuu

SEQ ID NO: 355394 - RNA, 22 nt, Human
ugucauaacuuagugacaaauc

SEQ ID NO: 355395 - RNA, 22 nt, Human
ggcagugagucccggagaggcc

SEQ ID NO: 355396 - RNA, 22 nt, Human
guacauuuugagguuaaaacaa

SEQ ID NO: 355397 - RNA, 22 nt, Human
uuagaaaauuugcuucuuugga

SEQ ID NO: 355398 - RNA, 22 nt, Human
ucacugcaaggaggcuucucaa

SEQ ID NO: 355399 - RNA, 22 nt, Human
uaaugucagcauaguuuauuuu

SEQ ID NO: 355400 - RNA, 22 nt, Human
aguccagugaacuguaaauagg

SEQ ID NO: 355401 - RNA, 22 nt, Human
acccaggaaaacauggugcaga

SEQ ID NO: 355402 - RNA, 22 nt, Human
ugcauugauagaaaaacaugga

SEQ ID NO: 355403 - RNA, 20 nt, Human
auucuacaagaauaagcaug

SEQ ID NO: 355404 - RNA, 22 nt, Human
aaggucauugguucugaauucu

SEQ ID NO: 355405 - RNA, 21 nt, Human
ggcagaaguagcauggacggg

SEQ ID NO: 355406 - RNA, 22 nt, Human
aaugcacaugucuuggccucac

SEQ ID NO: 355407 - RNA, 22 nt, Human
acccaggacaaaauaaccaggu

SEQ ID NO: 355408 - RNA, 22 nt, Human
uuuaaugaauaauucaaaucug

SEQ ID NO: 355409 - RNA, 22 nt, Human
uacagcuaggcaaaaaugacau

SEQ ID NO: 355410 - RNA, 22 nt, Human
ugggcugccagcucuccagaug

SEQ ID NO: 355411 - RNA, 22 nt, Human
cuuuguagcugcuucugauuua

SEQ ID NO: 355412 - RNA, 22 nt, Human
ugaagaauaagauagauggagc

SEQ ID NO: 355413 - RNA, 22 nt, Human
auagaacagaaacagaugcaca

SEQ ID NO: 355414 - RNA, 19 nt, Human
aaggcagcaguagcaucca

SEQ ID NO: 355415 - RNA, 22 nt, Human
cagggugcgccacucagaugua

SEQ ID NO: 355416 - RNA, 19 nt, Human
ucauaaggagagaggaaau

SEQ ID NO: 355417 - RNA, 22 nt, Human
accugagccuagggagguugag

SEQ ID NO: 355418 - RNA, 22 nt, Human
caagaugaucccugaaggcagc

SEQ ID NO: 355419 - RNA, 22 nt, Human
uuacagaagugaaggccuuuaa

SEQ ID NO: 355420 - RNA, 22 nt, Human
cugaggaguuuggguuguucaa

SEQ ID NO: 355421 - RNA, 22 nt, Human
gauuuucaugauaaacuuguga

SEQ ID NO: 355422 - RNA, 22 nt, Human
gaggaaccacucugagaagcca

SEQ ID NO: 355423 - RNA, 22 nt, Human
cugagagcagggacuugagcca

SEQ ID NO: 355424 - RNA, 22 nt, Human
agcuguguguuuccacugagcu

SEQ ID NO: 355425 - RNA, 22 nt, Human
agaagagccuggggaccauggc

SEQ ID NO: 355426 - RNA, 20 nt, Human
uauuuagauucaaguaugga

SEQ ID NO: 355427 - RNA, 22 nt, Human
cagcuggaggagcagcuuccag

SEQ ID NO: 355428 - RNA, 22 nt, Human
cuguugucuucauugucauauc

SEQ ID NO: 355429 - RNA, 22 nt, Human
aagagguugucugugaugaguu

SEQ ID NO: 355430 - RNA, 22 nt, Human
ggucucagcuggaguccuuggu

SEQ ID NO: 355431 - RNA, 22 nt, Human
auuaggcagggcaugguggcuc

SEQ ID NO: 355432 - RNA, 22 nt, Human
acuguagcugccacuggaugca

SEQ ID NO: 355433 - RNA, 22 nt, Human
augcaccugaacuccaucagcu

SEQ ID NO: 355434 - RNA, 22 nt, Human
uacagaaaucacaucgcuuuga

SEQ ID NO: 355435 - RNA, 22 nt, Human
agagccugucugccuuucuacc

SEQ ID NO: 355436 - RNA, 22 nt, Human
uucugcaggagcccuaguguau

SEQ ID NO: 355437 - RNA, 22 nt, Human
ugaaacagucuccagacuugga

SEQ ID NO: 355438 - RNA, 23 nt, Human
uggaggaaacacaucagaagacc

SEQ ID NO: 355439 - RNA, 22 nt, Human
ucucaggguuuccugggggcug

SEQ ID NO: 355440 - RNA, 22 nt, Human
ggggacaguuaaagaccaagac

SEQ ID NO: 355441 - RNA, 22 nt, Human
uccuggagagugggcgagcaca

SEQ ID NO: 355442 - RNA, 22 nt, Human
cugaaggauguguggugggagu

SEQ ID NO: 355443 - RNA, 22 nt, Human
aaaugucuaucuggcauauucc

SEQ ID NO: 355444 - RNA, 21 nt, Human
aaugaaguggcuauuuugagg

SEQ ID NO: 355445 - RNA, 22 nt, Human
caguaaagcauguaugucuuca

SEQ ID NO: 355446 - RNA, 22 nt, Human
cagugcagaacacauggaaaau

SEQ ID NO: 355447 - RNA, 22 nt, Human
guacauguugguuguuuccagu

SEQ ID NO: 355448 - RNA, 22 nt, Human
gccagggaaacugcagaccagc

SEQ ID NO: 355449 - RNA, 22 nt, Human
agcaggugacccaagcaggcug

SEQ ID NO: 355450 - RNA, 22 nt, Human
cuuacauugugugcaugagggg

SEQ ID NO: 355451 - RNA, 22 nt, Human
ugcugguggagaaaguggaggu

SEQ ID NO: 355452 - RNA, 22 nt, Human
cuggugccauucuguggccuag

SEQ ID NO: 355453 - RNA, 22 nt, Human
uauuuccugcauggugauguaa

SEQ ID NO: 355454 - RNA, 19 nt, Human
aagcagcccuggcaagagc

SEQ ID NO: 355455 - RNA, 22 nt, Human
gcaagauguuaacauagggaga

SEQ ID NO: 355456 - RNA, 22 nt, Human
uucuucuuuccuauaauuaauu

SEQ ID NO: 355457 - RNA, 22 nt, Human
ucuggaaguuagaggaggaaag

SEQ ID NO: 355458 - RNA, 22 nt, Human
gugcagagaaaugagaagucga

SEQ ID NO: 355459 - RNA, 22 nt, Human
ugaguccaauaggggccuggaa

SEQ ID NO: 355460 - RNA, 22 nt, Human
cuggccaguuguccuggcuugg

SEQ ID NO: 355461 - RNA, 22 nt, Human
gagagcuguaauagucaugucu

SEQ ID NO: 355462 - RNA, 22 nt, Human
cacauguuuggcaugucaccaa

SEQ ID NO: 355463 - RNA, 22 nt, Human
uggccucugggaaagcagauuc

SEQ ID NO: 355464 - RNA, 22 nt, Human
cagacuggccacaucugcacug

SEQ ID NO: 355465 - RNA, 22 nt, Human
aggacagaccuaggacuggagc

SEQ ID NO: 355466 - RNA, 22 nt, Human
guccucugggagccuugagccu

SEQ ID NO: 355467 - RNA, 22 nt, Human
aaugggagagaacacaaagucc

SEQ ID NO: 355468 - RNA, 22 nt, Human
uacuguuuucuauaauggcugu

SEQ ID NO: 355469 - RNA, 22 nt, Human
auuugaagucuucaugauuucu

SEQ ID NO: 355470 - RNA, 22 nt, Human
uccagggccaagucauggaacc

SEQ ID NO: 355471 - RNA, 22 nt, Human
ucuaaccuuugaaacugcuuuc

SEQ ID NO: 355472 - RNA, 22 nt, Human
cacaaaugacugaaacgacugu

SEQ ID NO: 355473 - RNA, 22 nt, Human
gugcaugugucuuuauaguaga

SEQ ID NO: 355474 - RNA, 22 nt, Human
agcucucaagauaagaaagaac

SEQ ID NO: 355475 - RNA, 22 nt, Human
aagcagcuuaaauuagagccug

SEQ ID NO: 355476 - RNA, 22 nt, Human
ugcuggccaacaaggcuccaag

SEQ ID NO: 355477 - RNA, 22 nt, Human
agcucccauuaucuucugaaac

SEQ ID NO: 355478 - RNA, 22 nt, Human
cuggaguguaaagagcauagaa

SEQ ID NO: 355479 - RNA, 22 nt, Human
cugggccuagcaacagaggagu

SEQ ID NO: 355480 - RNA, 22 nt, Human
gugcugucaauugcuuucagua

SEQ ID NO: 355481 - RNA, 22 nt, Human
aggagcuguuuuguucagcaaa

SEQ ID NO: 355482 - RNA, 22 nt, Human
auuucaggauagccuaguuuug

SEQ ID NO: 355483 - RNA, 22 nt, Human
aagaugcacaauguggcaauua

SEQ ID NO: 355484 - RNA, 22 nt, Human
gcagauggacuguaugaccuga

SEQ ID NO: 355485 - RNA, 22 nt, Human
cugaggccucucuccugggcuu

SEQ ID NO: 355486 - RNA, 22 nt, Human
aggcagguuggugagaagacug

SEQ ID NO: 355487 - RNA, 19 nt, Human
gcuucccaccagccagccc

SEQ ID NO: 355488 - RNA, 22 nt, Human
ucaacacuauccaggcaaucuu

SEQ ID NO: 355489 - RNA, 22 nt, Human
cugcccugacugaccuuuugaa

SEQ ID NO: 355490 - RNA, 22 nt, Human
uucuuguaauuuggagaaauga

SEQ ID NO: 355491 - RNA, 22 nt, Human
ucuuugaauccuuuacaucuga

SEQ ID NO: 355492 - RNA, 22 nt, Human
uucacauuggugauauguuucu

SEQ ID NO: 355493 - RNA, 22 nt, Human
ucagagagcuggugggcagagg

SEQ ID NO: 355494 - RNA, 22 nt, Human
uugaaaguuuauggagucugca

SEQ ID NO: 355495 - RNA, 22 nt, Human
agaacagcagcacgucaagcug

SEQ ID NO: 355496 - RNA, 22 nt, Human
cugggcaguuuauucaguucug

SEQ ID NO: 355497 - RNA, 22 nt, Human
acauuuaaauaccuauguuucu

SEQ ID NO: 355498 - RNA, 22 nt, Human
uucuucuuucccccugugguac

SEQ ID NO: 355499 - RNA, 22 nt, Human
ucccaggcugggggccugaagu

SEQ ID NO: 355500 - RNA, 22 nt, Human
uagccuucucaagacaaaguug

SEQ ID NO: 355501 - RNA, 22 nt, Human
uccugggaagagaccugagcau

SEQ ID NO: 355502 - RNA, 22 nt, Human
uuugguccugagcaaaacuaug

SEQ ID NO: 355503 - RNA, 22 nt, Human
caccaucagcagcaggugucaa

SEQ ID NO: 355504 - RNA, 22 nt, Human
ugcauuuuuaacaaggcuaauu

SEQ ID NO: 355505 - RNA, 22 nt, Human
gggaccuggucuagcacugagc

SEQ ID NO: 355506 - RNA, 20 nt, Human
uugagcuuuuaguacagaca

SEQ ID NO: 355507 - RNA, 22 nt, Human
uggcucaguaaucgagucuccu

SEQ ID NO: 355508 - RNA, 22 nt, Human
ggcuucugaaaucucugugcgu

SEQ ID NO: 355509 - RNA, 22 nt, Human
caggagugucuccacacagcaa

SEQ ID NO: 355510 - RNA, 22 nt, Human
acaaggaggucuggggggcccu

SEQ ID NO: 355511 - RNA, 22 nt, Human
aaaugucugagacuucugaacu

SEQ ID NO: 355512 - RNA, 22 nt, Human
aaaacugaaauacgauccaaug

SEQ ID NO: 355513 - RNA, 22 nt, Human
cccaggaguaagugacauuguu

SEQ ID NO: 355514 - RNA, 22 nt, Human
gcugucaggaacaugccuuggu

SEQ ID NO: 355515 - RNA, 22 nt, Human
agggauggaagcucgucugcaa

SEQ ID NO: 355516 - RNA, 22 nt, Human
guaucuuuugguggaaaaauaa

SEQ ID NO: 355517 - RNA, 22 nt, Human
uugcagaggcaaaaaugaacuc

SEQ ID NO: 355518 - RNA, 22 nt, Human
gccaggagcaugucauuguuga

SEQ ID NO: 355519 - RNA, 22 nt, Human
uagccgcuuaauuauuugguga

SEQ ID NO: 355520 - RNA, 22 nt, Human
cagucaccauagaauaaaacau

SEQ ID NO: 355521 - RNA, 22 nt, Human
auuucaguagaaaaucuugauu

SEQ ID NO: 355522 - RNA, 22 nt, Human
agguuuaugccuuggagcuggg

SEQ ID NO: 355523 - RNA, 22 nt, Human
ugaggcagugauguuuaagcac

SEQ ID NO: 355524 - RNA, 22 nt, Human
ugccaggagucaggccaggcag

SEQ ID NO: 355525 - RNA, 22 nt, Human
agcagagguuuguuggaaaccu

SEQ ID NO: 355526 - RNA, 22 nt, Human
aaugguauuugucaagcauagu

SEQ ID NO: 355527 - RNA, 22 nt, Human
caggccagugugcuucccaggc

SEQ ID NO: 355528 - RNA, 22 nt, Human
ugucauguguucuuaaauacau

SEQ ID NO: 355529 - RNA, 22 nt, Human
cacauccuucagcugagcccag

SEQ ID NO: 355530 - RNA, 22 nt, Human
caagagcugaggcuggagaggu

SEQ ID NO: 355531 - RNA, 22 nt, Human
auuccaaagacagaagcagcug

SEQ ID NO: 355532 - RNA, 22 nt, Human
aguagaaagaaggcacugggcc

SEQ ID NO: 355533 - RNA, 22 nt, Human
uaccugagcccagugcagcaua

SEQ ID NO: 355534 - RNA, 21 nt, Human
agggcagauuagcuguaagag

SEQ ID NO: 355535 - RNA, 22 nt, Human
ucucuuccaguaagagucuuua

SEQ ID NO: 355536 - RNA, 22 nt, Human
cauagaaaguauuauggaauuu

SEQ ID NO: 355537 - RNA, 22 nt, Human
cagcaugcaaguccagaugugg

SEQ ID NO: 355538 - RNA, 22 nt, Human
aggacuuagaacauuauguacu

SEQ ID NO: 355539 - RNA, 22 nt, Human
aggcugaugcuggcugaggcug

SEQ ID NO: 355540 - RNA, 22 nt, Human
uaauccacaauagagauuaucu

SEQ ID NO: 355541 - RNA, 22 nt, Human
uccagggacacagaguccuucu

SEQ ID NO: 355542 - RNA, 22 nt, Human
ugcugcuguuuccuacaucuca

SEQ ID NO: 355543 - RNA, 22 nt, Human
aucaguuuaaaugggcuguugg

SEQ ID NO: 355544 - RNA, 19 nt, Human
cugucaggggcuggauguu

SEQ ID NO: 355545 - RNA, 22 nt, Human
ggagaggauguuuuaguaacuu

SEQ ID NO: 355546 - RNA, 22 nt, Human
ccaguggacuucucccuguggu

SEQ ID NO: 355547 - RNA, 22 nt, Human
caacugcugacaccaucacucc

SEQ ID NO: 355548 - RNA, 22 nt, Human
auuccaaacagugcugcagacu

SEQ ID NO: 355549 - RNA, 23 nt, Human
aaugauuucaugaugauagcagc

SEQ ID NO: 355550 - RNA, 22 nt, Human
gccagccugugggggcucugug

SEQ ID NO: 355551 - RNA, 22 nt, Human
ugaggccagugacauauauuaa

SEQ ID NO: 355552 - RNA, 22 nt, Human
cuugaaagcacuuaguaaauua

SEQ ID NO: 355553 - RNA, 20 nt, Human
aggaggggauagaaucaaag

SEQ ID NO: 355554 - RNA, 22 nt, Human
caguacuuaguucucaugguuu

SEQ ID NO: 355555 - RNA, 22 nt, Human
ggaaaaggccacagggacacau

SEQ ID NO: 355556 - RNA, 22 nt, Human
ggcugccuacuuucccagaguu

SEQ ID NO: 355557 - RNA, 20 nt, Human
auguagaugaaagcaaaggc

SEQ ID NO: 355558 - RNA, 22 nt, Human
ggccucugggguccugagccca

SEQ ID NO: 355559 - RNA, 22 nt, Human
cauuucaauuauuugcucuucu

SEQ ID NO: 355560 - RNA, 22 nt, Human
uguaggauuuucaccagaccuu

SEQ ID NO: 355561 - RNA, 22 nt, Human
aaguccuuguauacagaaucaa

SEQ ID NO: 355562 - RNA, 22 nt, Human
uagggacaaagagcugaggccu

SEQ ID NO: 355563 - RNA, 20 nt, Human
agcccuguuuccuggagaga

SEQ ID NO: 355564 - RNA, 22 nt, Human
guucaaggaagggaggaaagcc

SEQ ID NO: 355565 - RNA, 22 nt, Human
ugccugucucugacugccauua

SEQ ID NO: 355566 - RNA, 22 nt, Human
gcccucucuucugcagccucca

SEQ ID NO: 355567 - RNA, 22 nt, Human
aucagcaucuuuaacaauuacc

SEQ ID NO: 355568 - RNA, 22 nt, Human
acuguucaagcaaaugacauug

SEQ ID NO: 355569 - RNA, 22 nt, Human
auucaguuaaaaacuguacuuc

SEQ ID NO: 355570 - RNA, 22 nt, Human
cugacucagcagcugaugaucc

SEQ ID NO: 355571 - RNA, 22 nt, Human
gcucccaggaagagaagggcca

SEQ ID NO: 355572 - RNA, 19 nt, Human
gggaccugacuaauuggca

SEQ ID NO: 355573 - RNA, 22 nt, Human
ugaagacacauacaagggaaug

SEQ ID NO: 355574 - RNA, 22 nt, Human
uuuuuccuuggaugugucucuc

SEQ ID NO: 355575 - RNA, 19 nt, Human
agucucaguguacagaggc

SEQ ID NO: 355576 - RNA, 22 nt, Human
agccugucugucuccaaagcug

SEQ ID NO: 355577 - RNA, 22 nt, Human
auucuucaguauguguggauug

SEQ ID NO: 355578 - RNA, 22 nt, Human
uggcagcuccggguaggggcug

SEQ ID NO: 355579 - RNA, 22 nt, Human
uagaugcuguagaaauacuuau

SEQ ID NO: 355580 - RNA, 22 nt, Human
ucucauugguauauacaugugu

SEQ ID NO: 355581 - RNA, 22 nt, Human
aagcugccuuccaugugaggaa

SEQ ID NO: 355582 - RNA, 22 nt, Human
uauuagguaaaggacuugcagg

SEQ ID NO: 355583 - RNA, 22 nt, Human
ggaggccaucuggcuggaggcu

SEQ ID NO: 355584 - RNA, 22 nt, Human
ugcauuguugaugaguugaaua

SEQ ID NO: 355585 - RNA, 18 nt, Human
gaugggagcaagagaaga

SEQ ID NO: 355586 - RNA, 22 nt, Human
uuuaaauuauaguuaaugucug

SEQ ID NO: 355587 - RNA, 22 nt, Human
cuucagggugacgcaggcugca

SEQ ID NO: 355588 - RNA, 23 nt, Human
aaauuauugcucuucaauugccu

SEQ ID NO: 355589 - RNA, 22 nt, Human
ccagccuggguguuagaagaca

SEQ ID NO: 355590 - RNA, 23 nt, Human
guuuucaacacaauaaauguaac

SEQ ID NO: 355591 - RNA, 22 nt, Human
aagcugccagcugagcugaggc

SEQ ID NO: 355592 - RNA, 22 nt, Human
ugauuucaaguagugacaugcu

SEQ ID NO: 355593 - RNA, 22 nt, Human
aguguuucucagaagggccuau

SEQ ID NO: 355594 - RNA, 22 nt, Human
gggacuggcacagggcugggag

SEQ ID NO: 355595 - RNA, 22 nt, Human
ugaaggaaagagggaacauccc

SEQ ID NO: 355596 - RNA, 22 nt, Human
agccucaguuucaggccuccuc

SEQ ID NO: 355597 - RNA, 22 nt, Human
acuauacauaaaacauuugggu

SEQ ID NO: 355598 - RNA, 22 nt, Human
ggagcuguugcgcaugcgcucg

SEQ ID NO: 355599 - RNA, 22 nt, Human
caguaggaaggaugcagaaaaa

SEQ ID NO: 355600 - RNA, 22 nt, Human
gcuggccacauugugccguccu

SEQ ID NO: 355601 - RNA, 22 nt, Human
uagucaccugugagcugcguag

SEQ ID NO: 355602 - RNA, 22 nt, Human
cagcuguguagaugcaggguca

SEQ ID NO: 355603 - RNA, 22 nt, Human
aaguccagcagugcuuguugau

SEQ ID NO: 355604 - RNA, 22 nt, Human
aggcccugggcaguucuguagc

SEQ ID NO: 355605 - RNA, 22 nt, Human
aguccccucuaacccaacuuua

SEQ ID NO: 355606 - RNA, 22 nt, Human
cagggagaucuuggcuccuggu

SEQ ID NO: 355607 - RNA, 22 nt, Human
aguccuuacaccuggaaccuau

SEQ ID NO: 355608 - RNA, 22 nt, Human
gugacagaguuuuagaucucau

SEQ ID NO: 355609 - RNA, 22 nt, Human
gaggcucacugggcaaagacuc

SEQ ID NO: 355610 - RNA, 22 nt, Human
acuuugaaucucagauaaccaa

SEQ ID NO: 355611 - RNA, 22 nt, Human
cauaaguuggguaauauaauga

SEQ ID NO: 355612 - RNA, 22 nt, Human
ucagggacugcagagggaagcu

SEQ ID NO: 355613 - RNA, 22 nt, Human
aagaugauagaucugucaaugu

SEQ ID NO: 355614 - RNA, 22 nt, Human
ucugucacccgagcaggcgaga

SEQ ID NO: 355615 - RNA, 22 nt, Human
accaggcaacugugaaugggcu

SEQ ID NO: 355616 - RNA, 22 nt, Human
uagcagaagaacaacaugaucu

SEQ ID NO: 355617 - RNA, 22 nt, Human
uguggcaggaagagcuucugag

SEQ ID NO: 355618 - RNA, 22 nt, Human
acuucuggugucauacugcauu

SEQ ID NO: 355619 - RNA, 22 nt, Human
caucagaauguuagagaaggga

SEQ ID NO: 355620 - RNA, 22 nt, Human
uuuagggacaagggucuggggu

SEQ ID NO: 355621 - RNA, 22 nt, Human
gaaggggacuggcagcugcaga

SEQ ID NO: 355622 - RNA, 22 nt, Human
caggggacauuaaagcuccaua

SEQ ID NO: 355623 - RNA, 22 nt, Human
ucugagaguagagcugccucuu

SEQ ID NO: 355624 - RNA, 22 nt, Human
aagauuucuuacuuauugaugc

SEQ ID NO: 355625 - RNA, 22 nt, Human
caagaugccccugguagggauc

SEQ ID NO: 355626 - RNA, 22 nt, Human
ucugucuccucugaggugccag

SEQ ID NO: 355627 - RNA, 22 nt, Human
ugggacaguuguccuccacucu

SEQ ID NO: 355628 - RNA, 22 nt, Human
uagcuuuaaugaguugguaaga

SEQ ID NO: 355629 - RNA, 22 nt, Human
gcucccaggcauggagguaauu

SEQ ID NO: 355630 - RNA, 22 nt, Human
uugacacagaucaauauucaac

SEQ ID NO: 355631 - RNA, 22 nt, Human
cagccugcccuggaagcccagc

SEQ ID NO: 355632 - RNA, 22 nt, Human
aauuuacaguugcugaugguac

SEQ ID NO: 355633 - RNA, 22 nt, Human
augguuuuguccucuuugguuc

SEQ ID NO: 355634 - RNA, 22 nt, Human
gcuguccucuuggacucagggc

SEQ ID NO: 355635 - RNA, 22 nt, Human
ugcuuuauaggggauugcaggc

SEQ ID NO: 355636 - RNA, 22 nt, Human
ccagccugaaaugccucauccu

SEQ ID NO: 355637 - RNA, 22 nt, Human
aaaaugugcaguuuuuaagcug

SEQ ID NO: 355638 - RNA, 23 nt, Human
uccaggcaugagcucuggaugga

SEQ ID NO: 355639 - RNA, 20 nt, Human
ugcuuccuggccacugcggg

SEQ ID NO: 355640 - RNA, 22 nt, Human
uucaggauucuuucagacuggg

SEQ ID NO: 355641 - RNA, 22 nt, Human
acaaaguccugguguauggcca

SEQ ID NO: 355642 - RNA, 22 nt, Human
auuggcagaaacagcagggcca

SEQ ID NO: 355643 - RNA, 22 nt, Human
cuucuuaaugcauaaacugugu

SEQ ID NO: 355644 - RNA, 22 nt, Human
cucagugugaaugcucaguaaa

SEQ ID NO: 355645 - RNA, 22 nt, Human
cagcuucugagcaagccagggg

SEQ ID NO: 355646 - RNA, 22 nt, Human
gucacacuagggccaaguggag

SEQ ID NO: 355647 - RNA, 22 nt, Human
uuauuucauugauuucuaagac

SEQ ID NO: 355648 - RNA, 22 nt, Human
uucacaggugacuggggauaac

SEQ ID NO: 355649 - RNA, 22 nt, Human
gcuuucuugguucugcaggggc

SEQ ID NO: 355650 - RNA, 22 nt, Human
ucagaggauugccucagcgagc

SEQ ID NO: 355651 - RNA, 22 nt, Human
guggguggaggcgucgagggca

SEQ ID NO: 355652 - RNA, 22 nt, Human
auuacaagaugcauccauauuu

SEQ ID NO: 355653 - RNA, 22 nt, Human
agugcuuuaccuagauaauguu

SEQ ID NO: 355654 - RNA, 22 nt, Human
ugggcugcugucugcacaugcu

SEQ ID NO: 355655 - RNA, 22 nt, Human
gaggucaggggagaggcugaug

SEQ ID NO: 355656 - RNA, 23 nt, Human
ggggaaguggcagugagugaggc

SEQ ID NO: 355657 - RNA, 22 nt, Human
aauagguagccagauauauaaa

SEQ ID NO: 355658 - RNA, 22 nt, Human
ugcacacaaguuggagaaugaa

SEQ ID NO: 355659 - RNA, 22 nt, Human
aaaugcaaggccaugugaagga

SEQ ID NO: 355660 - RNA, 22 nt, Human
ucagaauucugaccuuggguca

SEQ ID NO: 355661 - RNA, 22 nt, Human
gagcugccaagauuacaaucag

SEQ ID NO: 355662 - RNA, 22 nt, Human
acuugauuuugaaccuuucuac

SEQ ID NO: 355663 - RNA, 22 nt, Human
ugagccuggccugcagagacca

SEQ ID NO: 355664 - RNA, 22 nt, Human
caugucuguguacacaugcaca

SEQ ID NO: 355665 - RNA, 22 nt, Human
gcuuuccuggcccugucccugc

SEQ ID NO: 355666 - RNA, 22 nt, Human
gcagaauuggauaguugugaua

SEQ ID NO: 355667 - RNA, 22 nt, Human
gcaggggaguccacucuaugca

SEQ ID NO: 355668 - RNA, 22 nt, Human
uaggcagcgcuuggcugugcuu

SEQ ID NO: 355669 - RNA, 22 nt, Human
ucucuucauagugacacccauc

SEQ ID NO: 355670 - RNA, 22 nt, Human
cagauggaacacagaaaggaga

SEQ ID NO: 355671 - RNA, 22 nt, Human
caauuucagucucagagaguuc

SEQ ID NO: 355672 - RNA, 22 nt, Human
cacaauuuggugcuaaagaaag

SEQ ID NO: 355673 - RNA, 17 nt, Human
gaauuucuuggucaaaa

SEQ ID NO: 355674 - RNA, 23 nt, Human
ugggccuggaaagccuuagagag

SEQ ID NO: 355675 - RNA, 22 nt, Human
agggugccuggaagccacucac

SEQ ID NO: 355676 - RNA, 22 nt, Human
ggcaaaguuuucaucucauaac

SEQ ID NO: 355677 - RNA, 22 nt, Human
uauauagaaaagcagauguugg

SEQ ID NO: 355678 - RNA, 22 nt, Human
ucuggaucccaccgccacacac

SEQ ID NO: 355679 - RNA, 19 nt, Human
gcaggguguugacuguccc

SEQ ID NO: 355680 - RNA, 22 nt, Human
cagggcucagggacugcagaaa

SEQ ID NO: 355681 - RNA, 21 nt, Human
acagaacuguauagugauaaa

SEQ ID NO: 355682 - RNA, 22 nt, Human
caggcuggaguuaccuuuaggg

SEQ ID NO: 355683 - RNA, 22 nt, Human
caaggccagagccagcgauaag

SEQ ID NO: 355684 - RNA, 22 nt, Human
gcucucugggugugucuagaua

SEQ ID NO: 355685 - RNA, 22 nt, Human
aaagaaggaccuggaggaggau

SEQ ID NO: 355686 - RNA, 22 nt, Human
ugcuuuggccacuagaauucag

SEQ ID NO: 355687 - RNA, 22 nt, Human
guggccaggccgacugccaggc

SEQ ID NO: 355688 - RNA, 22 nt, Human
agcuaggacagguagagauggg

SEQ ID NO: 355689 - RNA, 22 nt, Human
gcuggcaggagccuuucccuuu

SEQ ID NO: 355690 - RNA, 22 nt, Human
uguucauuuggcccuuuuguau

SEQ ID NO: 355691 - RNA, 22 nt, Human
guuauuuucauuggcucagacu

SEQ ID NO: 355692 - RNA, 22 nt, Human
caggaaaaaugccaggagucag

SEQ ID NO: 355693 - RNA, 22 nt, Human
uacauauacugagugauuugcu

SEQ ID NO: 355694 - RNA, 16 nt, Human
ccccaggacuuggcac

SEQ ID NO: 355695 - RNA, 22 nt, Human
gaaggaaaggucucaugccuuu

SEQ ID NO: 355696 - RNA, 22 nt, Human
guucaagguuuuacagagugua

SEQ ID NO: 355697 - RNA, 22 nt, Human
gcagcuuucugcaaugucaucc

SEQ ID NO: 355698 - RNA, 22 nt, Human
ggccugcuccgggggcugagcu

SEQ ID NO: 355699 - RNA, 22 nt, Human
uccagggcuggguuggcucagc

SEQ ID NO: 355700 - RNA, 21 nt, Human
agcuuguguguaucacagugu

SEQ ID NO: 355701 - RNA, 22 nt, Human
uuuccucauuuaucugcuggga

SEQ ID NO: 355702 - RNA, 22 nt, Human
ccaggcucugcgcuggacaugg

SEQ ID NO: 355703 - RNA, 22 nt, Human
aggggaugauccucccgcagcg

SEQ ID NO: 355704 - RNA, 22 nt, Human
uggagaugcacgagcaggugga

SEQ ID NO: 355705 - RNA, 22 nt, Human
auuuauuaccucggaguuucug

SEQ ID NO: 355706 - RNA, 22 nt, Human
agaggccuuucuguugagugaa

SEQ ID NO: 355707 - RNA, 22 nt, Human
ugagccuggguggucgaggcug

SEQ ID NO: 355708 - RNA, 22 nt, Human
aagauucagccaaauuguucau

SEQ ID NO: 355709 - RNA, 22 nt, Human
agagagagggaaacugcuaaac

SEQ ID NO: 355710 - RNA, 22 nt, Human
gcucacuggccugaagaggacg

SEQ ID NO: 355711 - RNA, 22 nt, Human
ucucagagcaucauuuucuuag

SEQ ID NO: 355712 - RNA, 21 nt, Human
ucuuugcaucaguuguuuucu

SEQ ID NO: 355713 - RNA, 22 nt, Human
acagaaagaagguguauuugag

SEQ ID NO: 355714 - RNA, 22 nt, Human
acccagagcugggcuuggcaaa

SEQ ID NO: 355715 - RNA, 22 nt, Human
uaaaugcaguacaaauuguucu

SEQ ID NO: 355716 - RNA, 22 nt, Human
agcagggcuccugaaagccgcg

SEQ ID NO: 355717 - RNA, 22 nt, Human
gcagcccaaaaaagagguagau

SEQ ID NO: 355718 - RNA, 22 nt, Human
uacagaauuagauuauuagaga

SEQ ID NO: 355719 - RNA, 22 nt, Human
ccagcagcccucuuccaagacu

SEQ ID NO: 355720 - RNA, 22 nt, Human
acucaggaagaaagcagcuggu

SEQ ID NO: 355721 - RNA, 22 nt, Human
ccagcugguguuccuuaggacc

SEQ ID NO: 355722 - RNA, 22 nt, Human
gggcaugguggugcacaccugu

SEQ ID NO: 355723 - RNA, 22 nt, Human
auuucuguauccugcugucaga

SEQ ID NO: 355724 - RNA, 22 nt, Human
ccagaggcuggguucaccucag

SEQ ID NO: 355725 - RNA, 22 nt, Human
aagugguaggaagagagcacug

SEQ ID NO: 355726 - RNA, 22 nt, Human
uuaugacaggaaaaucacagaa

SEQ ID NO: 355727 - RNA, 22 nt, Human
cuuauuagugucugucugaguu

SEQ ID NO: 355728 - RNA, 18 nt, Human
cagcagagacauucaaaa

SEQ ID NO: 355729 - RNA, 22 nt, Human
cacccaggcuggagugcagggg

SEQ ID NO: 355730 - RNA, 22 nt, Human
aauucauccaugaacaauucca

SEQ ID NO: 355731 - RNA, 22 nt, Human
aggcgcaggguuuggacccagg

SEQ ID NO: 355732 - RNA, 22 nt, Human
gugccugggguugagcuaugaa

SEQ ID NO: 355733 - RNA, 21 nt, Human
aaaaagcuggggcaugcaugc

SEQ ID NO: 355734 - RNA, 22 nt, Human
gaggccugguuugcaugagaau

SEQ ID NO: 355735 - RNA, 22 nt, Human
caggccaggcugcauuugcccc

SEQ ID NO: 355736 - RNA, 22 nt, Human
cagcagcaguggcugcagaaca

SEQ ID NO: 355737 - RNA, 23 nt, Human
agccuucaggcaaugucaguaga

SEQ ID NO: 355738 - RNA, 17 nt, Human
aagagaggcugagcugg

SEQ ID NO: 355739 - RNA, 22 nt, Human
ugcaccauuaauuuaugugaga

SEQ ID NO: 355740 - RNA, 22 nt, Human
ugaagccauuacuguguuaggg

SEQ ID NO: 355741 - RNA, 22 nt, Human
gcugagcugggacaguccuggg

SEQ ID NO: 355742 - RNA, 22 nt, Human
cucugggcaggaccaguggacc

SEQ ID NO: 355743 - RNA, 23 nt, Human
aggcagugucucuuauccugucc

SEQ ID NO: 355744 - RNA, 23 nt, Human
gggcagguuuuuauaggcuucag

SEQ ID NO: 355745 - RNA, 22 nt, Human
aaagccuuggucaucugguucc

SEQ ID NO: 355746 - RNA, 22 nt, Human
cucacuggcaagacuacaggug

SEQ ID NO: 355747 - RNA, 22 nt, Human
ugguagggacacuaugcagaaa

SEQ ID NO: 355748 - RNA, 22 nt, Human
aggcugagauagguggaucauu

SEQ ID NO: 355749 - RNA, 22 nt, Human
ucuccuccuuuuuucaacauag

SEQ ID NO: 355750 - RNA, 22 nt, Human
ugcauaaagugccauaguauua

SEQ ID NO: 355751 - RNA, 22 nt, Human
agccuucaguaaauccacugug

SEQ ID NO: 355752 - RNA, 22 nt, Human
caauuucuuguuaauucucagg

SEQ ID NO: 355753 - RNA, 22 nt, Human
cuugcugucuugcauuuagagc

SEQ ID NO: 355754 - RNA, 21 nt, Human
cccagggaagccgcagucacc

SEQ ID NO: 355755 - RNA, 22 nt, Human
acagggcaccugagguaggaag

SEQ ID NO: 355756 - RNA, 22 nt, Human
acaggcuguugggguccagggu

SEQ ID NO: 355757 - RNA, 22 nt, Human
guuugcauauuugcacaggaau

SEQ ID NO: 355758 - RNA, 22 nt, Human
aagcugccagauucagucugcu

SEQ ID NO: 355759 - RNA, 20 nt, Human
uucauucauuccacaacuuc

SEQ ID NO: 355760 - RNA, 22 nt, Human
aaucagaaagaggucauguugc

SEQ ID NO: 355761 - RNA, 22 nt, Human
cagcagaggugguucacauugu

SEQ ID NO: 355762 - RNA, 22 nt, Human
augggcaguaacaguggcaguc

SEQ ID NO: 355763 - RNA, 22 nt, Human
gcuaggagauugagcucugaag

SEQ ID NO: 355764 - RNA, 22 nt, Human
aucagcaagauugugucuugua

SEQ ID NO: 355765 - RNA, 20 nt, Human
ugaaggccauuuguuccaga

SEQ ID NO: 355766 - RNA, 22 nt, Human
uccugccugcaaucccagcacu

SEQ ID NO: 355767 - RNA, 22 nt, Human
gccuggugcuaugagggccagc

SEQ ID NO: 355768 - RNA, 22 nt, Human
uuacauuagacccacuuucaug

SEQ ID NO: 355769 - RNA, 22 nt, Human
gcaccugggacccagaggcacc

SEQ ID NO: 355770 - RNA, 22 nt, Human
cauggacucugguuuggggagc

SEQ ID NO: 355771 - RNA, 16 nt, Human
uccaggcauaucugag

SEQ ID NO: 355772 - RNA, 19 nt, Human
auggaaaaugccagacuga

SEQ ID NO: 355773 - RNA, 22 nt, Human
cagaguucaaagccugcuggga

SEQ ID NO: 355774 - RNA, 22 nt, Human
acauuucucccugcaugccugc

SEQ ID NO: 355775 - RNA, 21 nt, Human
uccucagggccccagagcacu

SEQ ID NO: 355776 - RNA, 22 nt, Human
uccuguggagaggacuggaggu

SEQ ID NO: 355777 - RNA, 22 nt, Human
uuaauucugccuuucauguaac

SEQ ID NO: 355778 - RNA, 22 nt, Human
auuguacuuuuauuacauguag

SEQ ID NO: 355779 - RNA, 22 nt, Human
gcugccagcuuuccuuggcuga

SEQ ID NO: 355780 - RNA, 18 nt, Human
gggcucugauccuucacc

SEQ ID NO: 355781 - RNA, 22 nt, Human
guggugcaggccagcaggggcg

SEQ ID NO: 355782 - RNA, 22 nt, Human
aaaucuguaagcaauugcucag

SEQ ID NO: 355783 - RNA, 22 nt, Human
ggcuucucgugccgaagcaaga

SEQ ID NO: 355784 - RNA, 22 nt, Human
ggaagaggaggagccaggcuuu

SEQ ID NO: 355785 - RNA, 22 nt, Human
gggucuccauguuaacaucacu

SEQ ID NO: 355786 - RNA, 17 nt, Human
uuucaucugggaccacc

SEQ ID NO: 355787 - RNA, 22 nt, Human
ccacagcugaccgcaggugagc

SEQ ID NO: 355788 - RNA, 22 nt, Human
gcucugucauuuugcagacacu

SEQ ID NO: 355789 - RNA, 22 nt, Human
augaaacaguguguauagcaaa

SEQ ID NO: 355790 - RNA, 20 nt, Human
ucucugagcuucucuugggg

SEQ ID NO: 355791 - RNA, 22 nt, Human
ugucauugaggaaaacuaggug

SEQ ID NO: 355792 - RNA, 21 nt, Human
cuguuucuugugaagugacac

SEQ ID NO: 355793 - RNA, 22 nt, Human
ucaggcagaaaaaucacuaauu

SEQ ID NO: 355794 - RNA, 21 nt, Human
uggccaaacuggagcauuuga

SEQ ID NO: 355795 - RNA, 22 nt, Human
cagagcugcgcuuuuuccuggu

SEQ ID NO: 355796 - RNA, 22 nt, Human
uuucauaaggguuucuagacuu

SEQ ID NO: 355797 - RNA, 22 nt, Human
auauuccauugguuucccuucu

SEQ ID NO: 355798 - RNA, 22 nt, Human
agggccagaugaagccacaagc

SEQ ID NO: 355799 - RNA, 22 nt, Human
gugcaggggaucagguugcagc

SEQ ID NO: 355800 - RNA, 22 nt, Human
uuugaaaggaaguuaauacuuu

SEQ ID NO: 355801 - RNA, 22 nt, Human
gcuguucaagacuaggaaauuu

SEQ ID NO: 355802 - RNA, 18 nt, Human
gcagcuuuugauucaccc

SEQ ID NO: 355803 - RNA, 23 nt, Human
accaggagccaagaucucccugg

SEQ ID NO: 355804 - RNA, 18 nt, Human
ugggauggagaguaacug

SEQ ID NO: 355805 - RNA, 21 nt, Human
agagacugucacugcaguacc

SEQ ID NO: 355806 - RNA, 22 nt, Human
uuuagaaauugcagagugggug

SEQ ID NO: 355807 - RNA, 22 nt, Human
agggucagcuggcugucagggg

SEQ ID NO: 355808 - RNA, 22 nt, Human
uccaggaguuugagacugcagu

SEQ ID NO: 355809 - RNA, 22 nt, Human
agcccagcagaaaguccagccu

SEQ ID NO: 355810 - RNA, 22 nt, Human
agccucucuguuagucacuggg

SEQ ID NO: 355811 - RNA, 22 nt, Human
gcaggugauucacccugggccu

SEQ ID NO: 355812 - RNA, 21 nt, Human
ccugggagaucagcugccuuc

SEQ ID NO: 355813 - RNA, 22 nt, Human
ggccaggcugcccugggagcag

SEQ ID NO: 355814 - RNA, 20 nt, Human
agugacagagacuguguggc

SEQ ID NO: 355815 - RNA, 22 nt, Human
cuuguucaguccugacuuccug

SEQ ID NO: 355816 - RNA, 22 nt, Human
aggacugggugcagagggcauc

SEQ ID NO: 355817 - RNA, 22 nt, Human
uuguuucaugaguguaaaggga

SEQ ID NO: 355818 - RNA, 22 nt, Human
cugaggcaguuuaauuuuugaa

SEQ ID NO: 355819 - RNA, 22 nt, Human
agcagccagugggagugauaca

SEQ ID NO: 355820 - RNA, 22 nt, Human
gaaggcugcgaggggagugccg

SEQ ID NO: 355821 - RNA, 22 nt, Human
gugauuuucuccuccuagaagu

SEQ ID NO: 355822 - RNA, 22 nt, Human
uaucuacuccucuuucagaugc

SEQ ID NO: 355823 - RNA, 22 nt, Human
ucacugcugcugccaugaugga

SEQ ID NO: 355824 - RNA, 22 nt, Human
ugaggcucaagaaucugcauuu

SEQ ID NO: 355825 - RNA, 22 nt, Human
guuuuguugcugcagagcucaa

SEQ ID NO: 355826 - RNA, 22 nt, Human
uuuauguaauuucauaggugug

SEQ ID NO: 355827 - RNA, 22 nt, Human
ucucugggugauggcagggcac

SEQ ID NO: 355828 - RNA, 22 nt, Human
gggcagcugcagggauggugac

SEQ ID NO: 355829 - RNA, 22 nt, Human
uuugaacuucuccauucugaug

SEQ ID NO: 355830 - RNA, 22 nt, Human
agcagugaaacagcugcauaug

SEQ ID NO: 355831 - RNA, 22 nt, Human
ucauuugugugagugauuugac

SEQ ID NO: 355832 - RNA, 22 nt, Human
aauugugcuaugauuaugaaag

SEQ ID NO: 355833 - RNA, 22 nt, Human
ugagccugggagauggaggcug

SEQ ID NO: 355834 - RNA, 21 nt, Human
ggacuuacauagguaaggggu

SEQ ID NO: 355835 - RNA, 22 nt, Human
cugaggugcuauggaggauacg

SEQ ID NO: 355836 - RNA, 22 nt, Human
cuggagcagguuuaggaguccc

SEQ ID NO: 355837 - RNA, 22 nt, Human
ugcuggcuguauaugugagagu

SEQ ID NO: 355838 - RNA, 22 nt, Human
aggacagcaguuggugagguuc

SEQ ID NO: 355839 - RNA, 22 nt, Human
gggaagguauuuagcugcugaa

SEQ ID NO: 355840 - RNA, 22 nt, Human
accccagaggcggaggcugcag

SEQ ID NO: 355841 - RNA, 22 nt, Human
ggaugcacgaaggcgccucgga

SEQ ID NO: 355842 - RNA, 22 nt, Human
gcugugugaaaacugggccugg

SEQ ID NO: 355843 - RNA, 22 nt, Human
uggccacccagcugacgccuuc

SEQ ID NO: 355844 - RNA, 22 nt, Human
uuauucuucuucucuugccagg

SEQ ID NO: 355845 - RNA, 22 nt, Human
ccuccugggccuugcucuguga

SEQ ID NO: 355846 - RNA, 22 nt, Human
ucugggaacucugucauuuccc

SEQ ID NO: 355847 - RNA, 22 nt, Human
agcuggaggggccagcaggugu

SEQ ID NO: 355848 - RNA, 22 nt, Human
ugaaccaggaggcagccagcac

SEQ ID NO: 355849 - RNA, 22 nt, Human
acauuucucaucuaguagagua

SEQ ID NO: 355850 - RNA, 22 nt, Human
accagagauggggcuucucugu

SEQ ID NO: 355851 - RNA, 22 nt, Human
ugcuggcccuggcucagggaac

SEQ ID NO: 355852 - RNA, 22 nt, Human
aucuuucagggccauuuguauu

SEQ ID NO: 355853 - RNA, 22 nt, Human
aucagaaaucuaggauucagaa

SEQ ID NO: 355854 - RNA, 22 nt, Human
cugagccaaaaagcagagcuug

SEQ ID NO: 355855 - RNA, 22 nt, Human
gcagagugagccgaggcugcuc

SEQ ID NO: 355856 - RNA, 22 nt, Human
uauuagggaacugcaagacuaa

SEQ ID NO: 355857 - RNA, 22 nt, Human
ugggcagaggacagggaagauc

SEQ ID NO: 355858 - RNA, 22 nt, Human
aaacucuggagauguuuaugca

SEQ ID NO: 355859 - RNA, 22 nt, Human
augucuuucucacagccaguuc

SEQ ID NO: 355860 - RNA, 22 nt, Human
cagaucuguuugccagaucagc

SEQ ID NO: 355861 - RNA, 22 nt, Human
gcagacaggcccaguggaggga

SEQ ID NO: 355862 - RNA, 22 nt, Human
ugagggagagggcgaaaaugaa

SEQ ID NO: 355863 - RNA, 21 nt, Human
gcaugccugcaucuuaguguu

SEQ ID NO: 355864 - RNA, 22 nt, Human
uacagagacuuuauggcacaaa

SEQ ID NO: 355865 - RNA, 22 nt, Human
gggagggaggugcugguucacg

SEQ ID NO: 355866 - RNA, 22 nt, Human
ggggauggaggcgugugguccu

SEQ ID NO: 355867 - RNA, 22 nt, Human
ccauggaguuccucuggucuau

SEQ ID NO: 355868 - RNA, 22 nt, Human
ggagaggagcuauugggggcuc

SEQ ID NO: 355869 - RNA, 22 nt, Human
ugugggcacuaaugacaugcag

SEQ ID NO: 355870 - RNA, 22 nt, Human
uggugaagucagcggagcccgg

SEQ ID NO: 355871 - RNA, 22 nt, Human
gcugucagcgcccaaggagcuc

SEQ ID NO: 355872 - RNA, 22 nt, Human
uucuuaaagaggcaaaacacag

SEQ ID NO: 355873 - RNA, 22 nt, Human
gagagugucgggggccccagga

SEQ ID NO: 355874 - RNA, 22 nt, Human
ugccaggcucaggaugucccug

SEQ ID NO: 355875 - RNA, 22 nt, Human
agcagccauuuaaaaugaauug

SEQ ID NO: 355876 - RNA, 22 nt, Human
uuugcauuuguuuagaaccuga

SEQ ID NO: 355877 - RNA, 22 nt, Human
uuucaacuugaagaauugauac

SEQ ID NO: 355878 - RNA, 22 nt, Human
cuggcucaggguggucuggguc

SEQ ID NO: 355879 - RNA, 22 nt, Human
ugaaagguagcuggccucauag

SEQ ID NO: 355880 - RNA, 22 nt, Human
aucauguuccagaaacagugau

SEQ ID NO: 355881 - RNA, 22 nt, Human
uaagugcaauguuuuacuuaaa

SEQ ID NO: 355882 - RNA, 21 nt, Human
agccagucuguuuucuagugc

SEQ ID NO: 355883 - RNA, 22 nt, Human
uaaugcacaugacugaacuauu

SEQ ID NO: 355884 - RNA, 19 nt, Human
cucagcuguagcucaugug

SEQ ID NO: 355885 - RNA, 22 nt, Human
agucucugccagcuuguccucu

SEQ ID NO: 355886 - RNA, 22 nt, Human
uagucuuuuuaauaaauaaugc

SEQ ID NO: 355887 - RNA, 22 nt, Human
cugagccagcuggcaugugcua

SEQ ID NO: 355888 - RNA, 23 nt, Human
cuuugccacccagagccugacag

SEQ ID NO: 355889 - RNA, 22 nt, Human
caguggaggcucaagugugcuu

SEQ ID NO: 355890 - RNA, 19 nt, Human
ugaguucugugguucucaa

SEQ ID NO: 355891 - RNA, 22 nt, Human
cccugggcaagcccuauuuucc

SEQ ID NO: 355892 - RNA, 22 nt, Human
cccagggucccugcucucugug

SEQ ID NO: 355893 - RNA, 22 nt, Human
cuuucucugugugguaaagggc

SEQ ID NO: 355894 - RNA, 22 nt, Human
ucccaggaugugcgugccgccg

SEQ ID NO: 355895 - RNA, 22 nt, Human
cacagcugcccuacuccaugug

SEQ ID NO: 355896 - RNA, 22 nt, Human
ucucugagguuguuuccagcac

SEQ ID NO: 355897 - RNA, 22 nt, Human
acugcuuuucuaagauucugug

SEQ ID NO: 355898 - RNA, 22 nt, Human
agucaacaaaaauguggagccu

SEQ ID NO: 355899 - RNA, 22 nt, Human
acagugugugcuuucccuuacg

SEQ ID NO: 355900 - RNA, 22 nt, Human
aauugcuaaagauuauguuuuc

SEQ ID NO: 355901 - RNA, 22 nt, Human
ucagaggugguaaaggacagca

SEQ ID NO: 355902 - RNA, 22 nt, Human
aggagcuggguuccuuuggugg

SEQ ID NO: 355903 - RNA, 19 nt, Human
cuugcugggugguuucugc

SEQ ID NO: 355904 - RNA, 22 nt, Human
cugguuuagcuguaagguuccc

SEQ ID NO: 355905 - RNA, 22 nt, Human
ggcagaagauaggacagggaau

SEQ ID NO: 355906 - RNA, 22 nt, Human
aaaguccugacugcaggggaug

SEQ ID NO: 355907 - RNA, 22 nt, Human
gaggcucaaaccuggacagagc

SEQ ID NO: 355908 - RNA, 22 nt, Human
gcuggggagcuagaccucagca

SEQ ID NO: 355909 - RNA, 22 nt, Human
cugcuuuguguggucccuccag

SEQ ID NO: 355910 - RNA, 22 nt, Human
uccaugagcuagcuuuccaaag

SEQ ID NO: 355911 - RNA, 21 nt, Human
aggaggggucuuucccacuga

SEQ ID NO: 355912 - RNA, 22 nt, Human
uacaguauuaugagugauugaa

SEQ ID NO: 355913 - RNA, 21 nt, Human
aggcagcaggauccagggaca

SEQ ID NO: 355914 - RNA, 22 nt, Human
gcagggagguuugcugaccugg

SEQ ID NO: 355915 - RNA, 22 nt, Human
caguggugaagagcaggggcuc

SEQ ID NO: 355916 - RNA, 22 nt, Human
ugccuggguccaggccaagccu

SEQ ID NO: 355917 - RNA, 22 nt, Human
acuuccugcagcuucucagccc

SEQ ID NO: 355918 - RNA, 22 nt, Human
augggaggcagacacuaaguuc

SEQ ID NO: 355919 - RNA, 22 nt, Human
agaagggccagcuggacaccug

SEQ ID NO: 355920 - RNA, 22 nt, Human
ucccaaagcuacucuucugacu

SEQ ID NO: 355921 - RNA, 19 nt, Human
aggcagcaggccagggaug

SEQ ID NO: 355922 - RNA, 22 nt, Human
ccagagccucaacacagguccu

SEQ ID NO: 355923 - RNA, 22 nt, Human
cucugagaaagcugugagcuaa

SEQ ID NO: 355924 - RNA, 22 nt, Human
acuuguguaacacagaaagaac

SEQ ID NO: 355925 - RNA, 20 nt, Human
gucaucgccggcagcaaaga

SEQ ID NO: 355926 - RNA, 22 nt, Human
caucccugcccucaugccuaua

SEQ ID NO: 355927 - RNA, 22 nt, Human
cagcccugcacgcugccuccgc

SEQ ID NO: 355928 - RNA, 20 nt, Human
cucuggcuccgcgugaccgc

SEQ ID NO: 355929 - RNA, 22 nt, Human
aagccgggccugagaaaugaca

SEQ ID NO: 355930 - RNA, 21 nt, Human
aagggagauaggaaucaggcc

SEQ ID NO: 355931 - RNA, 22 nt, Human
cccaggagguagagguugcagu

SEQ ID NO: 355932 - RNA, 22 nt, Human
caguucuuauuuggccaguguc

SEQ ID NO: 355933 - RNA, 22 nt, Human
aaggcugcuuuuaacaugcaua

SEQ ID NO: 355934 - RNA, 22 nt, Human
agggcugagugggagagaguug

SEQ ID NO: 355935 - RNA, 22 nt, Human
ggaggaggcggcagaaguuccu

SEQ ID NO: 355936 - RNA, 20 nt, Human
uauuccaaggguagagaaaa

SEQ ID NO: 355937 - RNA, 22 nt, Human
uucacauuucauaccacagcuu

SEQ ID NO: 355938 - RNA, 20 nt, Human
agccagaagaaggcuggaga

SEQ ID NO: 355939 - RNA, 22 nt, Human
ccuguucacgguguguuguuag

SEQ ID NO: 355940 - RNA, 22 nt, Human
ugaacucgggaggaggcugcag

SEQ ID NO: 355941 - RNA, 22 nt, Human
cgcccagggcaggaggccgcuc

SEQ ID NO: 355942 - RNA, 22 nt, Human
aguaaugucccuuaaauguggu

SEQ ID NO: 355943 - RNA, 22 nt, Human
cucaggguaaugaaagacgaau

SEQ ID NO: 355944 - RNA, 22 nt, Human
ucccagagcugauaagccuuua

SEQ ID NO: 355945 - RNA, 22 nt, Human
ugacacauuaaaugcucacaaa

SEQ ID NO: 355946 - RNA, 22 nt, Human
cacauauuguaguucaccagga

SEQ ID NO: 355947 - RNA, 23 nt, Human
ccagcuccgugagccucgggcuc

SEQ ID NO: 355948 - RNA, 22 nt, Human
uguuuaaucuauaaaauggaga

SEQ ID NO: 355949 - RNA, 22 nt, Human
ccagaucuaguguuguaaagcu

SEQ ID NO: 355950 - RNA, 22 nt, Human
uauaagaaacaaggcaaauuuu

SEQ ID NO: 355951 - RNA, 22 nt, Human
gcccaggagguugggcugugca

SEQ ID NO: 355952 - RNA, 22 nt, Human
agcuggagccagugugaggcuu

SEQ ID NO: 355953 - RNA, 22 nt, Human
aggcaugugacccuggacucag

SEQ ID NO: 355954 - RNA, 22 nt, Human
ccagcagcagcguccaaggaga

SEQ ID NO: 355955 - RNA, 22 nt, Human
gcccaggauaaugcugucccug

SEQ ID NO: 355956 - RNA, 22 nt, Human
ggcugucucugugacugccacc

SEQ ID NO: 355957 - RNA, 22 nt, Human
ugccaggcuuagagcaggggcu

SEQ ID NO: 355958 - RNA, 22 nt, Human
ucaaaugcaggucuggucuugg

SEQ ID NO: 355959 - RNA, 22 nt, Human
ugugaccucaucuuaacuggaa

SEQ ID NO: 355960 - RNA, 22 nt, Human
aggcaguuuaggcagcgauuua

SEQ ID NO: 355961 - RNA, 22 nt, Human
uugcauuugaucuuggguucuc

SEQ ID NO: 355962 - RNA, 22 nt, Human
auuucuguaguccacauucuuu

SEQ ID NO: 355963 - RNA, 21 nt, Human
gccaaggggguagcuauuccu

SEQ ID NO: 355964 - RNA, 20 nt, Human
ucagagucaucaaagauggu

SEQ ID NO: 355965 - RNA, 19 nt, Human
aaaagucuauucaauuaca

SEQ ID NO: 355966 - RNA, 22 nt, Human
gcagaacauuucacaguaucuu

SEQ ID NO: 355967 - RNA, 22 nt, Human
uuugugcagauguauauuugug

SEQ ID NO: 355968 - RNA, 22 nt, Human
agcagcauauugugucuucaua

SEQ ID NO: 355969 - RNA, 22 nt, Human
ugucuccucauacugucauauu

SEQ ID NO: 355970 - RNA, 22 nt, Human
uggcagcugucuguggggucuc

SEQ ID NO: 355971 - RNA, 22 nt, Human
caaagucagcugccagucccaa

SEQ ID NO: 355972 - RNA, 22 nt, Human
ccagaauuuggaucaugauuuu

SEQ ID NO: 355973 - RNA, 22 nt, Human
uuccauauguauauagcuguua

SEQ ID NO: 355974 - RNA, 22 nt, Human
uguuuuaaagccauugccuuuc

SEQ ID NO: 355975 - RNA, 22 nt, Human
auguauuucuauguagugaaga

SEQ ID NO: 355976 - RNA, 22 nt, Human
gcagagccccauugcuggcggg

SEQ ID NO: 355977 - RNA, 17 nt, Human
ggcaccagacggagagu

SEQ ID NO: 355978 - RNA, 22 nt, Human
cuucauuaaugucuauaaguuu

SEQ ID NO: 355979 - RNA, 22 nt, Human
uagaaaugaauguuuaaaaguc

SEQ ID NO: 355980 - RNA, 22 nt, Human
agaaguuguagguuugcauauu

SEQ ID NO: 355981 - RNA, 22 nt, Human
ggccccugcggacugccuagag

SEQ ID NO: 355982 - RNA, 22 nt, Human
cauuuucagcacccaucugaaa

SEQ ID NO: 355983 - RNA, 22 nt, Human
uccaggagugcugguuagagua

SEQ ID NO: 355984 - RNA, 22 nt, Human
uauuuugagguauuuuugagcu

SEQ ID NO: 355985 - RNA, 22 nt, Human
uccaugagaacccuuggagaua

SEQ ID NO: 355986 - RNA, 22 nt, Human
ucaggcugcccguucagggcuc

SEQ ID NO: 355987 - RNA, 22 nt, Human
auggauuugcuuauacacaugu

SEQ ID NO: 355988 - RNA, 22 nt, Human
gcaccuggcugcccagguggag

SEQ ID NO: 355989 - RNA, 19 nt, Human
gucacauuugucucccagg

SEQ ID NO: 355990 - RNA, 17 nt, Human
gagaguguauuggaugc

SEQ ID NO: 355991 - RNA, 22 nt, Human
ggagccuggucagguuggcucc

SEQ ID NO: 355992 - RNA, 22 nt, Human
aagaacuuccuaauauauuuuc

SEQ ID NO: 355993 - RNA, 22 nt, Human
gcccagcuuuucacuuccacac

SEQ ID NO: 355994 - RNA, 22 nt, Human
uaauuauuugaagacauuagag

SEQ ID NO: 355995 - RNA, 22 nt, Human
gcucaaagaauauucagaauga

SEQ ID NO: 355996 - RNA, 22 nt, Human
cugcuguguuucacaccucugg

SEQ ID NO: 355997 - RNA, 22 nt, Human
uugggguguuggauggagcaag

SEQ ID NO: 355998 - RNA, 18 nt, Human
caaagcucacguuccauc

SEQ ID NO: 355999 - RNA, 22 nt, Human
ccaggguaccccaagggcaggu

SEQ ID NO: 356000 - RNA, 22 nt, Human
agcugaaggcuagaacagcugg

SEQ ID NO: 356001 - RNA, 22 nt, Human
aguaucaaggaucuccagcacc

SEQ ID NO: 356002 - RNA, 22 nt, Human
uggcagcugaggggaggcuuug

SEQ ID NO: 356003 - RNA, 17 nt, Human
ucaggauccaggguucu

SEQ ID NO: 356004 - RNA, 22 nt, Human
gccuggaggggccaggguggua

SEQ ID NO: 356005 - RNA, 22 nt, Human
uuaaauuagucaagcuucucug

SEQ ID NO: 356006 - RNA, 22 nt, Human
cacagcugugagaagggagccu

SEQ ID NO: 356007 - RNA, 22 nt, Human
gccuggagaauuaaaaggaagg

SEQ ID NO: 356008 - RNA, 21 nt, Human
agagaauugccuuagauguuc

SEQ ID NO: 356009 - RNA, 22 nt, Human
ugcacacacgcggcacaucugu

SEQ ID NO: 356010 - RNA, 22 nt, Human
uguuuuaagagcgcacuuuaua

SEQ ID NO: 356011 - RNA, 22 nt, Human
ccagcaccuugaucuuggaguu

SEQ ID NO: 356012 - RNA, 21 nt, Human
gggcagcucuguuuuauuuuc

SEQ ID NO: 356013 - RNA, 22 nt, Human
ccaucagcaugggagcaugggc

SEQ ID NO: 356014 - RNA, 22 nt, Human
ccaggcagcaaauuuucugaau

SEQ ID NO: 356015 - RNA, 22 nt, Human
gcugaggcuccucgggaggaca

SEQ ID NO: 356016 - RNA, 22 nt, Human
gcugauguuuaguugauguuac

SEQ ID NO: 356017 - RNA, 22 nt, Human
gccuuccuuacaccugcucagc

SEQ ID NO: 356018 - RNA, 22 nt, Human
uccuucagcuuauuucuuagga

SEQ ID NO: 356019 - RNA, 22 nt, Human
ugcagcuccucuggcugccuga

SEQ ID NO: 356020 - RNA, 19 nt, Human
ggcagaagguguaggggga

SEQ ID NO: 356021 - RNA, 23 nt, Human
ucagagaggcccccugcagagau

SEQ ID NO: 356022 - RNA, 22 nt, Human
uuagagucaagcugcauguucu

SEQ ID NO: 356023 - RNA, 22 nt, Human
ugggcaggcaagugaauaccuu

SEQ ID NO: 356024 - RNA, 21 nt, Human
uccaggaguucuaauaggugu

SEQ ID NO: 356025 - RNA, 22 nt, Human
auacuuuggggguuaguguaga

SEQ ID NO: 356026 - RNA, 22 nt, Human
ugaggcuggcaaggcugguauu

SEQ ID NO: 356027 - RNA, 21 nt, Human
ggagaaggacaauguugagua

SEQ ID NO: 356028 - RNA, 22 nt, Human
auguuucaccagcaaauuaccu

SEQ ID NO: 356029 - RNA, 22 nt, Human
ggcaguagccagggacuggcag

SEQ ID NO: 356030 - RNA, 22 nt, Human
acccaggaggugacacagggcu

SEQ ID NO: 356031 - RNA, 22 nt, Human
cagcuggcagcccuggcccugc

SEQ ID NO: 356032 - RNA, 22 nt, Human
aaaacaggugucagcaaacuau

SEQ ID NO: 356033 - RNA, 22 nt, Human
caggguggcaggcaccauggcc

SEQ ID NO: 356034 - RNA, 22 nt, Human
uagcuuuaccauagaagaguau

SEQ ID NO: 356035 - RNA, 22 nt, Human
gccuguccuggaugcucugcaa

SEQ ID NO: 356036 - RNA, 22 nt, Human
gccaccagugggggccugggca

SEQ ID NO: 356037 - RNA, 22 nt, Human
uuuaccaagcuuuaauuacaua

SEQ ID NO: 356038 - RNA, 22 nt, Human
cugggcugcaggaguggggcaa

SEQ ID NO: 356039 - RNA, 22 nt, Human
gcugcagugagccaagaucgug

SEQ ID NO: 356040 - RNA, 22 nt, Human
gggcaugguggcaggcaccugu

SEQ ID NO: 356041 - RNA, 22 nt, Human
ugcuggggguucagaugaguaa

SEQ ID NO: 356042 - RNA, 22 nt, Human
ugcuggccaauggcagaggcgg

SEQ ID NO: 356043 - RNA, 22 nt, Human
aguauucuggaauucuauguga

SEQ ID NO: 356044 - RNA, 22 nt, Human
aaaagaggagugguuuaugaca

SEQ ID NO: 356045 - RNA, 22 nt, Human
ccagagagggcgccaccuggag

SEQ ID NO: 356046 - RNA, 22 nt, Human
cucuccuccaacagcccugccg

SEQ ID NO: 356047 - RNA, 19 nt, Human
aggagaaguagcagaaauu

SEQ ID NO: 356048 - RNA, 22 nt, Human
cugggaggugcagcaaaaauca

SEQ ID NO: 356049 - RNA, 19 nt, Human
ccugcagggaugagagguu

SEQ ID NO: 356050 - RNA, 22 nt, Human
cccaggaagaggggucaggugu

SEQ ID NO: 356051 - RNA, 22 nt, Human
gggccaggucggugaaugguca

SEQ ID NO: 356052 - RNA, 22 nt, Human
gaggaagaagggauuagaacuc

SEQ ID NO: 356053 - RNA, 22 nt, Human
gcugcucuugaggggcucacug

SEQ ID NO: 356054 - RNA, 22 nt, Human
aacuuuauuguuaggggcuaaa

SEQ ID NO: 356055 - RNA, 21 nt, Human
agcugagcccagaagacuggu

SEQ ID NO: 356056 - RNA, 17 nt, Human
agugaaauuuacauugc

SEQ ID NO: 356057 - RNA, 22 nt, Human
ucaacuuugaaaccauagugaa

SEQ ID NO: 356058 - RNA, 22 nt, Human
uauagaagagacaugugcauag

SEQ ID NO: 356059 - RNA, 22 nt, Human
uuucauguuuucuuaaauggca

SEQ ID NO: 356060 - RNA, 22 nt, Human
aggcugcucaguagauggagcu

SEQ ID NO: 356061 - RNA, 22 nt, Human
ucucacugcaaauauuauguau

SEQ ID NO: 356062 - RNA, 22 nt, Human
aggcccagagagccaguuagug

SEQ ID NO: 356063 - RNA, 22 nt, Human
gagaaggggugauguggguaau

SEQ ID NO: 356064 - RNA, 22 nt, Human
auuguggugucaguuauaggca

SEQ ID NO: 356065 - RNA, 22 nt, Human
agcagggggccacagucacagc

SEQ ID NO: 356066 - RNA, 20 nt, Human
gggguuggcuggcacaggga

SEQ ID NO: 356067 - RNA, 20 nt, Human
uaugaguauuacuuucagga

SEQ ID NO: 356068 - RNA, 22 nt, Human
cagggccauaucuugugcacca

SEQ ID NO: 356069 - RNA, 22 nt, Human
gaaggcaacaccaggaugcacu

SEQ ID NO: 356070 - RNA, 18 nt, Human
uccagcgugcuccagggc

SEQ ID NO: 356071 - RNA, 22 nt, Human
cucuguccuccaccugcuuuca

SEQ ID NO: 356072 - RNA, 22 nt, Human
aaguucaagagugacauauuag

SEQ ID NO: 356073 - RNA, 22 nt, Human
gcacaauaauuuuuuuaagagg

SEQ ID NO: 356074 - RNA, 23 nt, Human
ucugucaccuauggcugcucuuc

SEQ ID NO: 356075 - RNA, 22 nt, Human
caggagacuauggcccaaggcc

SEQ ID NO: 356076 - RNA, 22 nt, Human
uuugggaaacuuaggggucaga

SEQ ID NO: 356077 - RNA, 22 nt, Human
ugaggggaaggcaugauaaaua

SEQ ID NO: 356078 - RNA, 22 nt, Human
agggcagagaucugagugggca

SEQ ID NO: 356079 - RNA, 22 nt, Human
ugucaugcccaggagcaaggua

SEQ ID NO: 356080 - RNA, 22 nt, Human
gcucucugccauaugaggauac

SEQ ID NO: 356081 - RNA, 22 nt, Human
agaagccaccagcugaggaaga

SEQ ID NO: 356082 - RNA, 22 nt, Human
gcugccugucccaggaugagga

SEQ ID NO: 356083 - RNA, 22 nt, Human
uggauuaaagauuaaaaugaca

SEQ ID NO: 356084 - RNA, 22 nt, Human
ucuuagaaugucaacugauguu

SEQ ID NO: 356085 - RNA, 22 nt, Human
ccugagagagaagcgaccuggu

SEQ ID NO: 356086 - RNA, 22 nt, Human
uugauguacagaauuguucaca

SEQ ID NO: 356087 - RNA, 22 nt, Human
uaggcagagguaugguaaggac

SEQ ID NO: 356088 - RNA, 22 nt, Human
gcagggugaaggucacauagaa

SEQ ID NO: 356089 - RNA, 22 nt, Human
aagggcucuucuauuuauggcc

SEQ ID NO: 356090 - RNA, 22 nt, Human
cuucuugcugggggccucagug

SEQ ID NO: 356091 - RNA, 22 nt, Human
cacaugaguccugccagguaug

SEQ ID NO: 356092 - RNA, 22 nt, Human
acccagaggugucuagcaagcu

SEQ ID NO: 356093 - RNA, 21 nt, Human
ucuuguccuugcucucccacu

SEQ ID NO: 356094 - RNA, 22 nt, Human
ccugccagggccuuggaagaaa

SEQ ID NO: 356095 - RNA, 21 nt, Human
ucuccaguauccuucucugag

SEQ ID NO: 356096 - RNA, 22 nt, Human
gcugucuugcucacucuugcag

SEQ ID NO: 356097 - RNA, 22 nt, Human
ccucuggggguccucagagucu

SEQ ID NO: 356098 - RNA, 23 nt, Human
uacaugcuauaauuucacccuca

SEQ ID NO: 356099 - RNA, 22 nt, Human
uuccuuaggcuguuugcagugc

SEQ ID NO: 356100 - RNA, 20 nt, Human
gccugcagagaaggucagag

SEQ ID NO: 356101 - RNA, 22 nt, Human
agggcagaggcggacacggaag

SEQ ID NO: 356102 - RNA, 22 nt, Human
ccagucugugugccagccugcg

SEQ ID NO: 356103 - RNA, 22 nt, Human
cucacuguuuaauagcuggauc

SEQ ID NO: 356104 - RNA, 22 nt, Human
gaagugaagagauuagaaauca

SEQ ID NO: 356105 - RNA, 22 nt, Human
uuuuccuucugauacuccauuu

SEQ ID NO: 356106 - RNA, 22 nt, Human
aggcuuccgaguagcugggacu

SEQ ID NO: 356107 - RNA, 19 nt, Human
ucucagaggaaaaauugcu

SEQ ID NO: 356108 - RNA, 22 nt, Human
gccaccagggggugcaaggucc

SEQ ID NO: 356109 - RNA, 22 nt, Human
agcagggcaguuaaaggguccu

SEQ ID NO: 356110 - RNA, 22 nt, Human
acauacuaugaauacauguguc

SEQ ID NO: 356111 - RNA, 22 nt, Human
auggcuuuucacagaggguucu

SEQ ID NO: 356112 - RNA, 22 nt, Human
agcuggguguguaucagauaaa

SEQ ID NO: 356113 - RNA, 22 nt, Human
gugagggguggcugagcaguuu

SEQ ID NO: 356114 - RNA, 22 nt, Human
uaguggagguggucugugaacu

SEQ ID NO: 356115 - RNA, 22 nt, Human
gcaggccuuggcaaugagccug

SEQ ID NO: 356116 - RNA, 22 nt, Human
cccaagggagugccuggucaac

SEQ ID NO: 356117 - RNA, 22 nt, Human
uucuucuucauuucugacgaug

SEQ ID NO: 356118 - RNA, 22 nt, Human
uccaggaggugaggggaccaaa

SEQ ID NO: 356119 - RNA, 22 nt, Human
acaggccugacacacagagggc

SEQ ID NO: 356120 - RNA, 22 nt, Human
aggaagcuccuggagagccagu

SEQ ID NO: 356121 - RNA, 22 nt, Human
ccagcagcccacaggcgucccu

SEQ ID NO: 356122 - RNA, 22 nt, Human
cagucacacaaguggacuuggg

SEQ ID NO: 356123 - RNA, 22 nt, Human
ggccugggcccacugucaagag

SEQ ID NO: 356124 - RNA, 22 nt, Human
ggagaagcagcuucuugaugaa

SEQ ID NO: 356125 - RNA, 22 nt, Human
ucauuucaaugauacuacuaag

SEQ ID NO: 356126 - RNA, 21 nt, Human
gagauuuagaaggaucaauuu

SEQ ID NO: 356127 - RNA, 22 nt, Human
uggcagaggaaaaagucacugg

SEQ ID NO: 356128 - RNA, 22 nt, Human
uccagaguacggaagagucauc

SEQ ID NO: 356129 - RNA, 21 nt, Human
aaguaaaucagagaaauaacc

SEQ ID NO: 356130 - RNA, 22 nt, Human
ucacagggcauuauggcuccag

SEQ ID NO: 356131 - RNA, 22 nt, Human
cuuccucaugugcaaugcaagc

SEQ ID NO: 356132 - RNA, 22 nt, Human
cuaaaugacuuccagugguuau

SEQ ID NO: 356133 - RNA, 22 nt, Human
uucagagaagcaaaggcagauu

SEQ ID NO: 356134 - RNA, 22 nt, Human
gaggcagcaaaauauaucauaa

SEQ ID NO: 356135 - RNA, 18 nt, Human
ccugagcccugcuuacuu

SEQ ID NO: 356136 - RNA, 22 nt, Human
gcaggagaacaaagcaagcugc

SEQ ID NO: 356137 - RNA, 22 nt, Human
ucuguucagaauuguaacacuc

SEQ ID NO: 356138 - RNA, 22 nt, Human
cuggcucaauaaauauuagcug

SEQ ID NO: 356139 - RNA, 22 nt, Human
ggcuugggagcaggcaugugac

SEQ ID NO: 356140 - RNA, 22 nt, Human
agcuggggcugcagagaacagg

SEQ ID NO: 356141 - RNA, 22 nt, Human
gcacugaaaauguuggauucca

SEQ ID NO: 356142 - RNA, 22 nt, Human
ucuggcccagccccugagguca

SEQ ID NO: 356143 - RNA, 22 nt, Human
ccacccuuggguucggaggccg

SEQ ID NO: 356144 - RNA, 22 nt, Human
gggaucagcaagccacugcacc

SEQ ID NO: 356145 - RNA, 22 nt, Human
ucucugaguucuccuccagccc

SEQ ID NO: 356146 - RNA, 22 nt, Human
caacagcugaucuuugaugaag

SEQ ID NO: 356147 - RNA, 22 nt, Human
cuggagagggagcccuggcagu

SEQ ID NO: 356148 - RNA, 22 nt, Human
aucauuucccuuuagaucacaa

SEQ ID NO: 356149 - RNA, 22 nt, Human
aguggcagaagucacuggguag

SEQ ID NO: 356150 - RNA, 22 nt, Human
uguacacaauucuuaacauaca

SEQ ID NO: 356151 - RNA, 22 nt, Human
uugcauuguugcaaugaaguau

SEQ ID NO: 356152 - RNA, 22 nt, Human
ggcaugcugcguacagaugaac

SEQ ID NO: 356153 - RNA, 22 nt, Human
uucuuucucaacaugaauguuu

SEQ ID NO: 356154 - RNA, 22 nt, Human
aucaggauagucuguaaauugu

SEQ ID NO: 356155 - RNA, 22 nt, Human
uuaucauugucgcagucuaauu

SEQ ID NO: 356156 - RNA, 22 nt, Human
acagccugagaguggagcuggc

SEQ ID NO: 356157 - RNA, 22 nt, Human
aagggcuccacuugaaucacac

SEQ ID NO: 356158 - RNA, 22 nt, Human
ccaaacaaauccccauucuuag

SEQ ID NO: 356159 - RNA, 22 nt, Human
ucaaaauuucagcacuagcccu

SEQ ID NO: 356160 - RNA, 22 nt, Human
cagcagugucuccagcaucaca

SEQ ID NO: 356161 - RNA, 22 nt, Human
ugugaagcuggauccuggagcu

SEQ ID NO: 356162 - RNA, 22 nt, Human
uguccuuaaggagcuuaauguc

SEQ ID NO: 356163 - RNA, 19 nt, Human
ugcagcucagggcaggggc

SEQ ID NO: 356164 - RNA, 22 nt, Human
ugucccauggacacaacuucuu

SEQ ID NO: 356165 - RNA, 22 nt, Human
uaaaugugagugaugcggugaa

SEQ ID NO: 356166 - RNA, 22 nt, Human
ccaggacaaguguggccauggc

SEQ ID NO: 356167 - RNA, 22 nt, Human
uuaaagauucugaggcugauua

SEQ ID NO: 356168 - RNA, 22 nt, Human
aucuuucaguuucauaccaauu

SEQ ID NO: 356169 - RNA, 22 nt, Human
gcuuccuggagggagagagcug

SEQ ID NO: 356170 - RNA, 22 nt, Human
uggcagcuccuggggccagcac

SEQ ID NO: 356171 - RNA, 18 nt, Human
gcuuuauuucuuggggaa

SEQ ID NO: 356172 - RNA, 22 nt, Human
ugugcaguuucuauguugucca

SEQ ID NO: 356173 - RNA, 22 nt, Human
ucagggcauacucuucaagguc

SEQ ID NO: 356174 - RNA, 20 nt, Human
cacugaagacuucuugcuca

SEQ ID NO: 356175 - RNA, 22 nt, Human
agggcagacuaggauggaagug

SEQ ID NO: 356176 - RNA, 22 nt, Human
ucucacucauuuccuaggucuu

SEQ ID NO: 356177 - RNA, 22 nt, Human
auugaaaaaugacuauugcuua

SEQ ID NO: 356178 - RNA, 22 nt, Human
agaaaguucugugaguuguuca

SEQ ID NO: 356179 - RNA, 22 nt, Human
ggcucugccugcccagcagcac

SEQ ID NO: 356180 - RNA, 22 nt, Human
caaauguauaaauguacuuucu

SEQ ID NO: 356181 - RNA, 22 nt, Human
ggcaguggguuccccaaggcac

SEQ ID NO: 356182 - RNA, 22 nt, Human
uguugaagauaaaguucucauu

SEQ ID NO: 356183 - RNA, 22 nt, Human
agcaggagaacacuguggcucu

SEQ ID NO: 356184 - RNA, 22 nt, Human
cugggcagagcuaacaccugag

SEQ ID NO: 356185 - RNA, 22 nt, Human
caaaguccuagaacagugcuug

SEQ ID NO: 356186 - RNA, 22 nt, Human
ggccucuggucaagacaagcau

SEQ ID NO: 356187 - RNA, 22 nt, Human
augggcagaguggggacaggaa

SEQ ID NO: 356188 - RNA, 22 nt, Human
uuucacauacaguguauaguag

SEQ ID NO: 356189 - RNA, 22 nt, Human
uuugcaaagaaauuauugcugu

SEQ ID NO: 356190 - RNA, 22 nt, Human
gccauuuagggaggcaagguga

SEQ ID NO: 356191 - RNA, 20 nt, Human
caucagaaauccugacccac

SEQ ID NO: 356192 - RNA, 22 nt, Human
uauaauuuggggaaaguggugu

SEQ ID NO: 356193 - RNA, 22 nt, Human
uaguuauuauuguuacuaucag

SEQ ID NO: 356194 - RNA, 22 nt, Human
cugcccagaaucacucacucga

SEQ ID NO: 356195 - RNA, 22 nt, Human
gggcugagagcuggaaucugag

SEQ ID NO: 356196 - RNA, 22 nt, Human
cuucaggauuuaggaagaugaa

SEQ ID NO: 356197 - RNA, 22 nt, Human
uagaucugauacaauucaucug

SEQ ID NO: 356198 - RNA, 22 nt, Human
uccaggagcucauccacgucaa

SEQ ID NO: 356199 - RNA, 22 nt, Human
caaggcugugcaggguccauau

SEQ ID NO: 356200 - RNA, 22 nt, Human
aggcagugagugugacuucaca

SEQ ID NO: 356201 - RNA, 22 nt, Human
cagcuggcccuuugguagccuu

SEQ ID NO: 356202 - RNA, 22 nt, Human
uucuaacucuguuauguguuuc

SEQ ID NO: 356203 - RNA, 22 nt, Human
agagugauucuaguuagggaau

SEQ ID NO: 356204 - RNA, 22 nt, Human
ccuggcagcuguuuggcuuggc

SEQ ID NO: 356205 - RNA, 22 nt, Human
ugucacauugaauaugauuuau

SEQ ID NO: 356206 - RNA, 22 nt, Human
auaaacucaugccaagaaauga

SEQ ID NO: 356207 - RNA, 22 nt, Human
ucaggagaaagccaauuagagu

SEQ ID NO: 356208 - RNA, 19 nt, Human
acacagggaucagaggguu

SEQ ID NO: 356209 - RNA, 19 nt, Human
uggcuccugccugccuucu

SEQ ID NO: 356210 - RNA, 22 nt, Human
agccaggaauuggacaacacau

SEQ ID NO: 356211 - RNA, 22 nt, Human
gcccaucaucacuguggaggcu

SEQ ID NO: 356212 - RNA, 22 nt, Human
aaggugucggcagagccgcuuc

SEQ ID NO: 356213 - RNA, 22 nt, Human
uuuuccuacugauaaacaguua

SEQ ID NO: 356214 - RNA, 22 nt, Human
ugaaaugauguacaagaaggca

SEQ ID NO: 356215 - RNA, 22 nt, Human
aaugaugguauugaugagcuaa

SEQ ID NO: 356216 - RNA, 22 nt, Human
gaacagaagaggcuggugccac

SEQ ID NO: 356217 - RNA, 22 nt, Human
aaagucaucagaaccuuccaga

SEQ ID NO: 356218 - RNA, 19 nt, Human
uuccuuagaggaggcggug

SEQ ID NO: 356219 - RNA, 22 nt, Human
gcaaggcuuugugaauuuuaaa

SEQ ID NO: 356220 - RNA, 22 nt, Human
cagggcucaggaaaucagacgu

SEQ ID NO: 356221 - RNA, 22 nt, Human
ugcagaagacacaagguaacgu

SEQ ID NO: 356222 - RNA, 22 nt, Human
aaaauuauggaguaucccaaag

SEQ ID NO: 356223 - RNA, 22 nt, Human
ggggcagagaauaaaaaccuaa

SEQ ID NO: 356224 - RNA, 22 nt, Human
gccaaaucuggauuuagcaaga

SEQ ID NO: 356225 - RNA, 22 nt, Human
aggcagccugguuugaauggaa

SEQ ID NO: 356226 - RNA, 22 nt, Human
gacagaagaggaacuuggacag

SEQ ID NO: 356227 - RNA, 22 nt, Human
aaagagcuucauuuccauuuau

SEQ ID NO: 356228 - RNA, 22 nt, Human
gaaggaggcguuagcccuagga

SEQ ID NO: 356229 - RNA, 20 nt, Human
cuguggaauuuuaccaugcg

SEQ ID NO: 356230 - RNA, 22 nt, Human
cucagagaaaugucacaacaau

SEQ ID NO: 356231 - RNA, 19 nt, Human
acacugaauguagaauugg

SEQ ID NO: 356232 - RNA, 22 nt, Human
aaucagaaaggcuaaggaagca

SEQ ID NO: 356233 - RNA, 22 nt, Human
cccaggagauggugcguggucu

SEQ ID NO: 356234 - RNA, 22 nt, Human
agagcuguucaacguagcaaug

SEQ ID NO: 356235 - RNA, 22 nt, Human
gucaacuuuaagaugaucuuuu

SEQ ID NO: 356236 - RNA, 22 nt, Human
aggcagccuauggggagcucag

SEQ ID NO: 356237 - RNA, 22 nt, Human
gccacucaugggaggugugcaa

SEQ ID NO: 356238 - RNA, 22 nt, Human
ggcaaaaaccauaauuacuuuu

SEQ ID NO: 356239 - RNA, 22 nt, Human
ucaagcaucuuggucuacgauc

SEQ ID NO: 356240 - RNA, 22 nt, Human
gagcucugggaaacaaagugua

SEQ ID NO: 356241 - RNA, 22 nt, Human
augauauuugcaaugugcuugc

SEQ ID NO: 356242 - RNA, 20 nt, Human
cacagcuugccuuuuaugac

SEQ ID NO: 356243 - RNA, 20 nt, Human
uggagccaaggugugucugg

SEQ ID NO: 356244 - RNA, 22 nt, Human
aggaaagguagcgugccagcag

SEQ ID NO: 356245 - RNA, 22 nt, Human
ucagaacauuuaaaaagugguu

SEQ ID NO: 356246 - RNA, 22 nt, Human
agcuuuauucaugauuucaggg

SEQ ID NO: 356247 - RNA, 22 nt, Human
aggcacuguucccaguuauccu

SEQ ID NO: 356248 - RNA, 19 nt, Human
ugagacagggauucaggug

SEQ ID NO: 356249 - RNA, 22 nt, Human
gaggcagccagagguucucauu

SEQ ID NO: 356250 - RNA, 22 nt, Human
agagagcauugaggaaaucuuc

SEQ ID NO: 356251 - RNA, 22 nt, Human
gcccaugcucucaggcgggccu

SEQ ID NO: 356252 - RNA, 22 nt, Human
ugcagggccaugguggcggcug

SEQ ID NO: 356253 - RNA, 20 nt, Human
auacuuguuuucaggcuuuu

SEQ ID NO: 356254 - RNA, 22 nt, Human
cccuggaggaccccaauguggc

SEQ ID NO: 356255 - RNA, 22 nt, Human
uacugcaugguggaguggagcu

SEQ ID NO: 356256 - RNA, 22 nt, Human
ugcaguggaggccgugagacag

SEQ ID NO: 356257 - RNA, 22 nt, Human
uagugcuuaauaaauuucagaa

SEQ ID NO: 356258 - RNA, 22 nt, Human
aaucuuucccuauuaaaugugg

SEQ ID NO: 356259 - RNA, 22 nt, Human
gcaggaugagugaguacauuua

SEQ ID NO: 356260 - RNA, 20 nt, Human
gcccaggaauuugcauuucu

SEQ ID NO: 356261 - RNA, 22 nt, Human
caggcacuggggaugcugggau

SEQ ID NO: 356262 - RNA, 22 nt, Human
gacagcauggugucuguucagg

SEQ ID NO: 356263 - RNA, 22 nt, Human
ugcuuuauuaagagagaaauuu

SEQ ID NO: 356264 - RNA, 22 nt, Human
ucucagagaagugaugagcaau

SEQ ID NO: 356265 - RNA, 22 nt, Human
ucccaggacuuccaguuggagg

SEQ ID NO: 356266 - RNA, 22 nt, Human
ucuguucaucaucuggacacau

SEQ ID NO: 356267 - RNA, 22 nt, Human
agcagccacagucugggacagg

SEQ ID NO: 356268 - RNA, 22 nt, Human
aauuuuaucucuaagcaggcuu

SEQ ID NO: 356269 - RNA, 22 nt, Human
gccugcagggugaugggcugcc

SEQ ID NO: 356270 - RNA, 22 nt, Human
cugggcagugcagcuauagaac

SEQ ID NO: 356271 - RNA, 18 nt, Human
gggcaagcggcugucacc

SEQ ID NO: 356272 - RNA, 22 nt, Human
uucuuucacucaagaaggaucu

SEQ ID NO: 356273 - RNA, 18 nt, Human
uggcaggaaaugcacuuu

SEQ ID NO: 356274 - RNA, 22 nt, Human
gucccugcccuccugggacuca

SEQ ID NO: 356275 - RNA, 19 nt, Human
uggggcuguguuuugaccc

SEQ ID NO: 356276 - RNA, 22 nt, Human
agaaucugguagaaccaaggau

SEQ ID NO: 356277 - RNA, 22 nt, Human
agcuggcaguaugacuggugac

SEQ ID NO: 356278 - RNA, 17 nt, Human
gagccacccugugcgag

SEQ ID NO: 356279 - RNA, 22 nt, Human
ggucaugcugugaaucagugcu

SEQ ID NO: 356280 - RNA, 22 nt, Human
agcuuguuagaaauguagacuc

SEQ ID NO: 356281 - RNA, 22 nt, Human
ucugggcucugucagcaccucu

SEQ ID NO: 356282 - RNA, 22 nt, Human
cuguacucaagguaaaccagga

SEQ ID NO: 356283 - RNA, 21 nt, Human
ccugugugucugacugggcua

SEQ ID NO: 356284 - RNA, 22 nt, Human
ccugugcccucagccuggcucu

SEQ ID NO: 356285 - RNA, 22 nt, Human
augcugugucaggaauuugaua

SEQ ID NO: 356286 - RNA, 22 nt, Human
augaaggcaguuaaacgucauc

SEQ ID NO: 356287 - RNA, 22 nt, Human
aguggggacuuaugccagcauu

SEQ ID NO: 356288 - RNA, 22 nt, Human
ucugccugaaauucacauguaa

SEQ ID NO: 356289 - RNA, 22 nt, Human
aaugaacaaaauaugcuuugca

SEQ ID NO: 356290 - RNA, 22 nt, Human
ggucccugcugaagccuuggug

SEQ ID NO: 356291 - RNA, 22 nt, Human
agucacccuccaacucuccacu

SEQ ID NO: 356292 - RNA, 22 nt, Human
uagaaacaucagcuaaccaaaa

SEQ ID NO: 356293 - RNA, 22 nt, Human
acucaggaauggggcugggacu

SEQ ID NO: 356294 - RNA, 22 nt, Human
gccuggcacucacugaagaggc

SEQ ID NO: 356295 - RNA, 22 nt, Human
ggaggcacuucccgucucagcc

SEQ ID NO: 356296 - RNA, 22 nt, Human
gagggcucuaccaaguaacucu

SEQ ID NO: 356297 - RNA, 21 nt, Human
cgcagagcgaacuugcggcgc

SEQ ID NO: 356298 - RNA, 22 nt, Human
cacaccagagguuaccugcaaa

SEQ ID NO: 356299 - RNA, 22 nt, Human
aaggaagaagacucuuuacucc

SEQ ID NO: 356300 - RNA, 19 nt, Human
gcuccugggccucacucau

SEQ ID NO: 356301 - RNA, 22 nt, Human
guggccagaagacugcaaugcu

SEQ ID NO: 356302 - RNA, 22 nt, Human
ucacacagauugguagagcuga

SEQ ID NO: 356303 - RNA, 22 nt, Human
uggcccugcuggccaaaggcua

SEQ ID NO: 356304 - RNA, 22 nt, Human
cucuguccacagguuugucccu

SEQ ID NO: 356305 - RNA, 22 nt, Human
gucauuccuauccauuugauac

SEQ ID NO: 356306 - RNA, 22 nt, Human
ggugacuggagggacccaggcc

SEQ ID NO: 356307 - RNA, 22 nt, Human
ugugacaucgcugugucuguuu

SEQ ID NO: 356308 - RNA, 22 nt, Human
uguguacacaaugauugcagag

SEQ ID NO: 356309 - RNA, 20 nt, Human
guauuagguguuccucuuuc

SEQ ID NO: 356310 - RNA, 22 nt, Human
cagcugugcuguauuaagcucu

SEQ ID NO: 356311 - RNA, 20 nt, Human
agaaaaaguguggaaauuuc

SEQ ID NO: 356312 - RNA, 22 nt, Human
gcagcuuucuugcccuaaucuu

SEQ ID NO: 356313 - RNA, 22 nt, Human
aagggaggccagagguuuugca

SEQ ID NO: 356314 - RNA, 22 nt, Human
cuaauuauguuguuauaaucaa

SEQ ID NO: 356315 - RNA, 20 nt, Human
uuggcucugaucaguggagc

SEQ ID NO: 356316 - RNA, 22 nt, Human
auucuacaacccaauaauaauu

SEQ ID NO: 356317 - RNA, 22 nt, Human
agagugaagguugacacuucac

SEQ ID NO: 356318 - RNA, 22 nt, Human
aaauagcacagcagcugaggcu

SEQ ID NO: 356319 - RNA, 22 nt, Human
cuuucagagguuacucaggaaa

SEQ ID NO: 356320 - RNA, 22 nt, Human
uccacagaauguaagauccaca

SEQ ID NO: 356321 - RNA, 19 nt, Human
aggguggcaaaggagggug

SEQ ID NO: 356322 - RNA, 22 nt, Human
cccaggagaccugugaaaggac

SEQ ID NO: 356323 - RNA, 22 nt, Human
gggcuucucccuaaggacucug

SEQ ID NO: 356324 - RNA, 22 nt, Human
guuugauucaagaacaaagagu

SEQ ID NO: 356325 - RNA, 22 nt, Human
ugaagaaucccagggaauuugg

SEQ ID NO: 356326 - RNA, 22 nt, Human
ugucucaguacacuccgauguu

SEQ ID NO: 356327 - RNA, 22 nt, Human
uugucugaaagaucauuacauu

SEQ ID NO: 356328 - RNA, 22 nt, Human
gaaggaaaucugugauuuaugc

SEQ ID NO: 356329 - RNA, 22 nt, Human
uguggcaguauaagagcuagaa

SEQ ID NO: 356330 - RNA, 22 nt, Human
auggcuuaagaaugcuuuugug

SEQ ID NO: 356331 - RNA, 22 nt, Human
cagaggaaguuccuugaugaga

SEQ ID NO: 356332 - RNA, 20 nt, Human
aagagaagaagucuuugaaa

SEQ ID NO: 356333 - RNA, 22 nt, Human
uuauccaacaugacuuaugucc

SEQ ID NO: 356334 - RNA, 22 nt, Human
gguagcagggcugugagucaga

SEQ ID NO: 356335 - RNA, 22 nt, Human
ucauagaaugaguuaaugaacu

SEQ ID NO: 356336 - RNA, 22 nt, Human
uuugcauaaaggagcauuucuc

SEQ ID NO: 356337 - RNA, 23 nt, Human
ugggaccuguuugcccacagaug

SEQ ID NO: 356338 - RNA, 22 nt, Human
uucacaauagcuggcaucaucu

SEQ ID NO: 356339 - RNA, 22 nt, Human
uuucccagagguaugaauaagu

SEQ ID NO: 356340 - RNA, 22 nt, Human
gggcaagcacagcgagcgugcg

SEQ ID NO: 356341 - RNA, 22 nt, Human
uggcugcucaagggaggaggcu

SEQ ID NO: 356342 - RNA, 22 nt, Human
ugcagcauugcaaagcagucuu

SEQ ID NO: 356343 - RNA, 22 nt, Human
auguuauuaaaguacagauucu

SEQ ID NO: 356344 - RNA, 22 nt, Human
uggaggggcaauggagcgcgga

SEQ ID NO: 356345 - RNA, 22 nt, Human
uguagaaagaauauguuucaua

SEQ ID NO: 356346 - RNA, 23 nt, Human
ccuccugggcacaggccugaugg

SEQ ID NO: 356347 - RNA, 22 nt, Human
cagaaauucccauuucagauuc

SEQ ID NO: 356348 - RNA, 22 nt, Human
ccagcuauugcuguguaacagu

SEQ ID NO: 356349 - RNA, 22 nt, Human
ugaagccacuuuccagaaucac

SEQ ID NO: 356350 - RNA, 22 nt, Human
acaguaaaucaacagaauaucu

SEQ ID NO: 356351 - RNA, 20 nt, Human
gugugaagcccucaggagga

SEQ ID NO: 356352 - RNA, 22 nt, Human
aaacuguaaacacagcaguaca

SEQ ID NO: 356353 - RNA, 22 nt, Human
ccuugcguuuuacagcuucuag

SEQ ID NO: 356354 - RNA, 22 nt, Human
ggagccugggcauuaguaauuu

SEQ ID NO: 356355 - RNA, 22 nt, Human
gguggccugcccugaucccugg

SEQ ID NO: 356356 - RNA, 22 nt, Human
gagaggucaucucccaucagca

SEQ ID NO: 356357 - RNA, 22 nt, Human
ccacugggggcugcaggcacuc

SEQ ID NO: 356358 - RNA, 22 nt, Human
uccaaagggaagcgcuuucugu

SEQ ID NO: 356359 - RNA, 22 nt, Human
gccugguggugugcucaagugg

SEQ ID NO: 356360 - RNA, 22 nt, Human
ugaacagauggcccagcagagg

SEQ ID NO: 356361 - RNA, 22 nt, Human
cugccuuugcccuugacacugu

SEQ ID NO: 356362 - RNA, 22 nt, Human
gcccaggaguucaaggcugcag

SEQ ID NO: 356363 - RNA, 22 nt, Human
uccagggaccucccugagagcu

SEQ ID NO: 356364 - RNA, 22 nt, Human
ucccugcacagccgagccaugc

SEQ ID NO: 356365 - RNA, 22 nt, Human
uugcugugucauuuguuuaauc

SEQ ID NO: 356366 - RNA, 22 nt, Human
aucaggaucaugcuggguggga

SEQ ID NO: 356367 - RNA, 22 nt, Human
uggcucaggaucuaagcagaau

SEQ ID NO: 356368 - RNA, 22 nt, Human
cuuacagagaagaaaauguagu

SEQ ID NO: 356369 - RNA, 22 nt, Human
aaggcagauauaaagacuagag

SEQ ID NO: 356370 - RNA, 23 nt, Human
gccuggccaccccagggcugcuu

SEQ ID NO: 356371 - RNA, 22 nt, Human
uaugcauaugaccccaagcuug

SEQ ID NO: 356372 - RNA, 22 nt, Human
aggccuguuccaggccccuuuu

SEQ ID NO: 356373 - RNA, 22 nt, Human
auuuaaugucgagcuauuguag

SEQ ID NO: 356374 - RNA, 22 nt, Human
caggcugagcucuggccugggc

SEQ ID NO: 356375 - RNA, 22 nt, Human
ugauuuccugugcgcccuuagg

SEQ ID NO: 356376 - RNA, 22 nt, Human
agaauucuccuucagggcagga

SEQ ID NO: 356377 - RNA, 17 nt, Human
aauagcugcucagagag

SEQ ID NO: 356378 - RNA, 22 nt, Human
uggcugggagcuggaacugggc

SEQ ID NO: 356379 - RNA, 22 nt, Human
uucacuuaacaucauaucauga

SEQ ID NO: 356380 - RNA, 22 nt, Human
ccucccugcgcuccugcggcgg

SEQ ID NO: 356381 - RNA, 20 nt, Human
ugcuugucaugcacucaggc

SEQ ID NO: 356382 - RNA, 22 nt, Human
acauuucuaauuuaauguaaca

SEQ ID NO: 356383 - RNA, 22 nt, Human
gggcuucucuuaugcuaacugg

SEQ ID NO: 356384 - RNA, 22 nt, Human
augagacuaccuguaauguggc

SEQ ID NO: 356385 - RNA, 19 nt, Human
aucugagauuauaaacaga

SEQ ID NO: 356386 - RNA, 22 nt, Human
aauaauuagugggacagagaac

SEQ ID NO: 356387 - RNA, 22 nt, Human
aagagcaucuauuucacagugg

SEQ ID NO: 356388 - RNA, 22 nt, Human
aaaguguacuaugucaugaaca

SEQ ID NO: 356389 - RNA, 22 nt, Human
guacuuccguggacuaauuguu

SEQ ID NO: 356390 - RNA, 22 nt, Human
gugagaguguuuggaaauagaa

SEQ ID NO: 356391 - RNA, 22 nt, Human
gagggcuccauuccccgugccc

SEQ ID NO: 356392 - RNA, 22 nt, Human
auguagagcaguguuguccaau

SEQ ID NO: 356393 - RNA, 21 nt, Human
acuuuaauauacaugaggagg

SEQ ID NO: 356394 - RNA, 22 nt, Human
augcuuaaccuugguguacaau

SEQ ID NO: 356395 - RNA, 22 nt, Human
cuuuauguccuugaagaguugu

SEQ ID NO: 356396 - RNA, 22 nt, Human
caaugugucaggaaaagggcca

SEQ ID NO: 356397 - RNA, 22 nt, Human
caggaggaaaugugacccugcu

SEQ ID NO: 356398 - RNA, 22 nt, Human
ucagggcacguuucugcaaugc

SEQ ID NO: 356399 - RNA, 20 nt, Human
uaaggcuguuuuguauuccu

SEQ ID NO: 356400 - RNA, 22 nt, Human
augggaggaucacuugaggcca

SEQ ID NO: 356401 - RNA, 22 nt, Human
guggagacgggacagaagcuaa

SEQ ID NO: 356402 - RNA, 22 nt, Human
ggcacugacugugcagcgcacc

SEQ ID NO: 356403 - RNA, 22 nt, Human
ugccugaguuuaacccucagag

SEQ ID NO: 356404 - RNA, 22 nt, Human
cucugcaggggaggcaugcacu

SEQ ID NO: 356405 - RNA, 22 nt, Human
gcaggcaggagcccaacugccu

SEQ ID NO: 356406 - RNA, 20 nt, Human
agauuauuccuaagauuucu

SEQ ID NO: 356407 - RNA, 22 nt, Human
augaaacaugagaaauggagag

SEQ ID NO: 356408 - RNA, 22 nt, Human
ucucuuaaaagauuuuaaugac

SEQ ID NO: 356409 - RNA, 22 nt, Human
aaagccuugcccgucacuggga

SEQ ID NO: 356410 - RNA, 22 nt, Human
gcagggcuguggacacuuuggu

SEQ ID NO: 356411 - RNA, 22 nt, Human
cagcuuguuaccgagggagggu

SEQ ID NO: 356412 - RNA, 23 nt, Human
aguacaauaaguauaauucuuuc

SEQ ID NO: 356413 - RNA, 22 nt, Human
ugggcacaggggaauggaugaa

SEQ ID NO: 356414 - RNA, 22 nt, Human
ugugacagaucuuuaaauaaug

SEQ ID NO: 356415 - RNA, 22 nt, Human
guggcuucuggcugggccucag

SEQ ID NO: 356416 - RNA, 22 nt, Human
cugaggcuuugugugcaugccu

SEQ ID NO: 356417 - RNA, 22 nt, Human
cuucuuaacuguauauacuaug

SEQ ID NO: 356418 - RNA, 22 nt, Human
acacauuucucuuuuuguaagu

SEQ ID NO: 356419 - RNA, 22 nt, Human
uguuuuuaaauaaugauagaaa

SEQ ID NO: 356420 - RNA, 22 nt, Human
gaggcucacgacgggacgaacu

SEQ ID NO: 356421 - RNA, 22 nt, Human
ucagaagguggagguugcagug

SEQ ID NO: 356422 - RNA, 22 nt, Human
cccagccugugacagccguccu

SEQ ID NO: 356423 - RNA, 22 nt, Human
cucugucccagacccaccucuc

SEQ ID NO: 356424 - RNA, 22 nt, Human
uucacaggaggguggaugcaug

SEQ ID NO: 356425 - RNA, 22 nt, Human
ggcaggagaaaggucucuucuu

SEQ ID NO: 356426 - RNA, 18 nt, Human
cauuguacaaugcuuuau

SEQ ID NO: 356427 - RNA, 22 nt, Human
uaacagaaauuuuaguuagggg

SEQ ID NO: 356428 - RNA, 22 nt, Human
uuuauccaaggguuuuaacugu

SEQ ID NO: 356429 - RNA, 22 nt, Human
uuugaaaguccuaggagagucc

SEQ ID NO: 356430 - RNA, 20 nt, Human
ucccaggcugggcuccagcu

SEQ ID NO: 356431 - RNA, 22 nt, Human
ugugugucagagucuccauggu

SEQ ID NO: 356432 - RNA, 22 nt, Human
aucaguuuuuauuaauguagcu

SEQ ID NO: 356433 - RNA, 19 nt, Human
acagaagcauagaaaagga

SEQ ID NO: 356434 - RNA, 22 nt, Human
cagaccagcucuaugaacccaa

SEQ ID NO: 356435 - RNA, 22 nt, Human
caagaaauuucuuaagaacuaa

SEQ ID NO: 356436 - RNA, 22 nt, Human
ucccuggggauguuggccugcc

SEQ ID NO: 356437 - RNA, 18 nt, Human
ucuuggaguaaugaucaa

SEQ ID NO: 356438 - RNA, 22 nt, Human
uccaggcaaagugcugggcugc

SEQ ID NO: 356439 - RNA, 22 nt, Human
uuauguaauuuguuugcucuuc

SEQ ID NO: 356440 - RNA, 22 nt, Human
cagcugugcugauugcucagua

SEQ ID NO: 356441 - RNA, 22 nt, Human
ugucccagaucacaggagggga

SEQ ID NO: 356442 - RNA, 22 nt, Human
acuguggcgucaggaagaaauu

SEQ ID NO: 356443 - RNA, 22 nt, Human
accagcuguguccuggcugcag

SEQ ID NO: 356444 - RNA, 23 nt, Human
ucugcucugaaguucggcugagc

SEQ ID NO: 356445 - RNA, 22 nt, Human
ucagagugcagcgggaggcugg

SEQ ID NO: 356446 - RNA, 22 nt, Human
uaaguucaguuggucgaaguag

SEQ ID NO: 356447 - RNA, 22 nt, Human
uagcuuuacaaagugcugcacc

SEQ ID NO: 356448 - RNA, 22 nt, Human
gggcacagagggucuugaagaa

SEQ ID NO: 356449 - RNA, 22 nt, Human
agcaggaaagaaaaaucugugu

SEQ ID NO: 356450 - RNA, 23 nt, Human
uggcagcagaucuuaaagugacc

SEQ ID NO: 356451 - RNA, 21 nt, Human
uggccaaaaccauauuauuaa

SEQ ID NO: 356452 - RNA, 22 nt, Human
uuacagaaaggaaggacugacu

SEQ ID NO: 356453 - RNA, 22 nt, Human
uguacauugucacucaucaagu

SEQ ID NO: 356454 - RNA, 18 nt, Human
uaaaugcauguuaauaac

SEQ ID NO: 356455 - RNA, 22 nt, Human
cuguucucuggcgguggcuguu

SEQ ID NO: 356456 - RNA, 22 nt, Human
ucaggagacauucuuaaaguag

SEQ ID NO: 356457 - RNA, 22 nt, Human
gggcuggagccagcuguggcug

SEQ ID NO: 356458 - RNA, 22 nt, Human
aggcugaggcuggcagcuccag

SEQ ID NO: 356459 - RNA, 22 nt, Human
ucaguuuuuguuugccagauag

SEQ ID NO: 356460 - RNA, 20 nt, Human
ggggcagguuuuuauggcua

SEQ ID NO: 356461 - RNA, 22 nt, Human
ucagcauaucuugagcuucaug

SEQ ID NO: 356462 - RNA, 22 nt, Human
ggcagggaggaggugaaaguga

SEQ ID NO: 356463 - RNA, 22 nt, Human
gagcugagaucgugccauugca

SEQ ID NO: 356464 - RNA, 22 nt, Human
ggcugcugggaauaugccagcu

SEQ ID NO: 356465 - RNA, 22 nt, Human
ggugaagguggaacgcagagca

SEQ ID NO: 356466 - RNA, 22 nt, Human
cccaggcagcccuucugacgca

SEQ ID NO: 356467 - RNA, 22 nt, Human
aauaacuggcacauaucacaua

SEQ ID NO: 356468 - RNA, 22 nt, Human
agacaaagacagcaucucaggu

SEQ ID NO: 356469 - RNA, 23 nt, Human
gaggccacauuccccugcuugag

SEQ ID NO: 356470 - RNA, 22 nt, Human
uuuguaugugauaagacuauuc

SEQ ID NO: 356471 - RNA, 22 nt, Human
acagggccaggugagaggugcu

SEQ ID NO: 356472 - RNA, 22 nt, Human
gagcuuaggccagggacaggga

SEQ ID NO: 356473 - RNA, 22 nt, Human
uccuugaacagagggccugggu

SEQ ID NO: 356474 - RNA, 22 nt, Human
acagcuuuucugauagauccug

SEQ ID NO: 356475 - RNA, 22 nt, Human
cugcccugccuggccagugugg

SEQ ID NO: 356476 - RNA, 18 nt, Human
ucagcuggggcugcagcc

SEQ ID NO: 356477 - RNA, 22 nt, Human
ccagcuuuggaguguuguugcu

SEQ ID NO: 356478 - RNA, 22 nt, Human
cagcuucugucugauuagcaag

SEQ ID NO: 356479 - RNA, 22 nt, Human
gaagagcuauguccagggagca

SEQ ID NO: 356480 - RNA, 22 nt, Human
cugggaggauucauugagguga

SEQ ID NO: 356481 - RNA, 22 nt, Human
aaaagagucuuaggcagucaua

SEQ ID NO: 356482 - RNA, 22 nt, Human
aguccaugguucugacucaucu

SEQ ID NO: 356483 - RNA, 22 nt, Human
cuggcugcaggaaggagugggc

SEQ ID NO: 356484 - RNA, 22 nt, Human
uuguaacagcuguuuauauagu

SEQ ID NO: 356485 - RNA, 22 nt, Human
caucagcagucacaugaugcug

SEQ ID NO: 356486 - RNA, 22 nt, Human
uggcucaguuccaucaucugga

SEQ ID NO: 356487 - RNA, 22 nt, Human
ccucuggucccagcucugcugc

SEQ ID NO: 356488 - RNA, 19 nt, Human
aggcagcauucuggggcuu

SEQ ID NO: 356489 - RNA, 22 nt, Human
cagagccagaacuagaccuugu

SEQ ID NO: 356490 - RNA, 22 nt, Human
ugcagaaguauuccaggcccca

SEQ ID NO: 356491 - RNA, 21 nt, Human
gccucugcugucuuauuguga

SEQ ID NO: 356492 - RNA, 22 nt, Human
uggcucaguagcagugugguca

SEQ ID NO: 356493 - RNA, 22 nt, Human
gagagcugcagccgagaggggg

SEQ ID NO: 356494 - RNA, 22 nt, Human
cgcagaagagguugucuagucc

SEQ ID NO: 356495 - RNA, 22 nt, Human
ugcuucaggaagaaacgccagg

SEQ ID NO: 356496 - RNA, 22 nt, Human
uuaaaauuauggcccauuugga

SEQ ID NO: 356497 - RNA, 22 nt, Human
guggcucuccauugacauggaa

SEQ ID NO: 356498 - RNA, 22 nt, Human
cuggcaaguacugggccagcuc

SEQ ID NO: 356499 - RNA, 22 nt, Human
uggaaagaaaguaaaggcguau

SEQ ID NO: 356500 - RNA, 22 nt, Human
ucacugcucuccaauguggagu

SEQ ID NO: 356501 - RNA, 22 nt, Human
uguucagagacagaaauucuaa

SEQ ID NO: 356502 - RNA, 22 nt, Human
ugaaggagcucaaugaugaugc

SEQ ID NO: 356503 - RNA, 22 nt, Human
ccuggcugguggcagcgacaag

SEQ ID NO: 356504 - RNA, 22 nt, Human
cugaagaggacgcagcagcaag

SEQ ID NO: 356505 - RNA, 22 nt, Human
ugcuuuuaagaacaaugcugcu

SEQ ID NO: 356506 - RNA, 22 nt, Human
cauuuccacuucugaaaacugg

SEQ ID NO: 356507 - RNA, 22 nt, Human
cuggcucccguuguccuugaag

SEQ ID NO: 356508 - RNA, 22 nt, Human
uuaacacuccuaacuacagucu

SEQ ID NO: 356509 - RNA, 22 nt, Human
gagaugaauguaaacaaaggca

SEQ ID NO: 356510 - RNA, 22 nt, Human
augcugugguagacagcauucc

SEQ ID NO: 356511 - RNA, 22 nt, Human
auugcuaggaacagguugcacc

SEQ ID NO: 356512 - RNA, 22 nt, Human
uuucaaugacacaaaagagaaa

SEQ ID NO: 356513 - RNA, 22 nt, Human
agcucacagaaauccugcagga

SEQ ID NO: 356514 - RNA, 22 nt, Human
ccaggagagcagaagcccaggc

SEQ ID NO: 356515 - RNA, 22 nt, Human
uuugacaaaggaaaaaugcaca

SEQ ID NO: 356516 - RNA, 22 nt, Human
gagggccagcagccucagcaug

SEQ ID NO: 356517 - RNA, 22 nt, Human
auauuagggucucuaaauucua

SEQ ID NO: 356518 - RNA, 22 nt, Human
ccugggugaugugcugcccucg

SEQ ID NO: 356519 - RNA, 20 nt, Human
uccaggcagacagcuauggg

SEQ ID NO: 356520 - RNA, 22 nt, Human
caaaggcaguuacugaaugaag

SEQ ID NO: 356521 - RNA, 20 nt, Human
ccuccuggucaggugugcag

SEQ ID NO: 356522 - RNA, 22 nt, Human
uaaaggcucguauuguugugug

SEQ ID NO: 356523 - RNA, 19 nt, Human
uagucuuuauucuuaauuu

SEQ ID NO: 356524 - RNA, 22 nt, Human
gcacagaaguaaaauacaaguc

SEQ ID NO: 356525 - RNA, 22 nt, Human
gagccuggggacccuccugagu

SEQ ID NO: 356526 - RNA, 16 nt, Human
ucagggcagaauggca

SEQ ID NO: 356527 - RNA, 22 nt, Human
gugguuuugccauuacaaguaa

SEQ ID NO: 356528 - RNA, 22 nt, Human
uuagauaaauugcaacuugauu

SEQ ID NO: 356529 - RNA, 22 nt, Human
gcugagagcaaagcaugucuag

SEQ ID NO: 356530 - RNA, 19 nt, Human
accaggagacagugagcuu

SEQ ID NO: 356531 - RNA, 22 nt, Human
ugaugcuucacgcugaauaugc

SEQ ID NO: 356532 - RNA, 22 nt, Human
gguccccagcaguggcugcuuc

SEQ ID NO: 356533 - RNA, 20 nt, Human
gcaugaggaaucauugcagc

SEQ ID NO: 356534 - RNA, 22 nt, Human
cccaguggaaggaguagaagac

SEQ ID NO: 356535 - RNA, 21 nt, Human
ugucagaaauaagcaugugau

SEQ ID NO: 356536 - RNA, 22 nt, Human
cugucaucacaguugagcagcc

SEQ ID NO: 356537 - RNA, 22 nt, Human
aggaccugccaggugcaaagca

SEQ ID NO: 356538 - RNA, 22 nt, Human
cugcuucugggaugauggagua

SEQ ID NO: 356539 - RNA, 22 nt, Human
guuauuagaagugaaggauugu

SEQ ID NO: 356540 - RNA, 22 nt, Human
cuggcagguuuggugucuggug

SEQ ID NO: 356541 - RNA, 22 nt, Human
gaggccuggugugucucccgcu

SEQ ID NO: 356542 - RNA, 19 nt, Human
ugcagggcugcgccugggg

SEQ ID NO: 356543 - RNA, 22 nt, Human
ucggagcuguagaugaaacccu

SEQ ID NO: 356544 - RNA, 22 nt, Human
ugaaaucuacccuauucagggu

SEQ ID NO: 356545 - RNA, 22 nt, Human
gcucaggacuggaggagcgggg

SEQ ID NO: 356546 - RNA, 22 nt, Human
agggcagcagcccauggcucug

SEQ ID NO: 356547 - RNA, 22 nt, Human
gcagaauucuacagaugauaaa

SEQ ID NO: 356548 - RNA, 22 nt, Human
cugccagcucgccacaaugaca

SEQ ID NO: 356549 - RNA, 22 nt, Human
gcugccuugaacuuggccuggg

SEQ ID NO: 356550 - RNA, 22 nt, Human
ucugggaagcugcgugccuguu

SEQ ID NO: 356551 - RNA, 22 nt, Human
cuuuggcaaugucauuuucaau

SEQ ID NO: 356552 - RNA, 22 nt, Human
gucuucuguaagaugagguccc

SEQ ID NO: 356553 - RNA, 22 nt, Human
auucuucaaagagugucaaagu

SEQ ID NO: 356554 - RNA, 22 nt, Human
gcccagcacagcuggaagaguc

SEQ ID NO: 356555 - RNA, 22 nt, Human
gcagcuggacccacacggcuua

SEQ ID NO: 356556 - RNA, 22 nt, Human
agucaggagcugcugcauugua

SEQ ID NO: 356557 - RNA, 22 nt, Human
auggauaauggugauaguugca

SEQ ID NO: 356558 - RNA, 22 nt, Human
uacagaaaaacuggcauugaag

SEQ ID NO: 356559 - RNA, 21 nt, Human
ucuguucaaggaacuacggau

SEQ ID NO: 356560 - RNA, 22 nt, Human
uugcauugaaaauauauuuuaa

SEQ ID NO: 356561 - RNA, 22 nt, Human
cucugaacucuugggcagcaug

SEQ ID NO: 356562 - RNA, 22 nt, Human
ccagggcacuuaggcccagccc

SEQ ID NO: 356563 - RNA, 22 nt, Human
ugcagaggagcuggaaggcugg

SEQ ID NO: 356564 - RNA, 17 nt, Human
uccaggagaggcaaugg

SEQ ID NO: 356565 - RNA, 22 nt, Human
agaauuucuggaagauugcaag

SEQ ID NO: 356566 - RNA, 22 nt, Human
cuccagugcgcaggacagcccc

SEQ ID NO: 356567 - RNA, 22 nt, Human
caagugucuauaucagugcuug

SEQ ID NO: 356568 - RNA, 22 nt, Human
cuuaaagaaauugaggagagga

SEQ ID NO: 356569 - RNA, 22 nt, Human
cuacauaaauuuaucacagacu

SEQ ID NO: 356570 - RNA, 17 nt, Human
agccaggcauaugaagu

SEQ ID NO: 356571 - RNA, 20 nt, Human
agcccaggccugugugaguc

SEQ ID NO: 356572 - RNA, 22 nt, Human
aacaguaaaaaucauuuaguug

SEQ ID NO: 356573 - RNA, 22 nt, Human
uguacaaugccagggaacacca

SEQ ID NO: 356574 - RNA, 22 nt, Human
ucaggaaagaagaugcucagug

SEQ ID NO: 356575 - RNA, 22 nt, Human
ugaagcaggcauugacugauga

SEQ ID NO: 356576 - RNA, 22 nt, Human
aaauugugcucacacugauauu

SEQ ID NO: 356577 - RNA, 22 nt, Human
cuggauuuaauuaacuguugcu

SEQ ID NO: 356578 - RNA, 22 nt, Human
cauuucaaaagaauugccagaa

SEQ ID NO: 356579 - RNA, 22 nt, Human
ggcuucuccagguacugagcau

SEQ ID NO: 356580 - RNA, 22 nt, Human
agauuuagacugccuuaaucau

SEQ ID NO: 356581 - RNA, 22 nt, Human
uacugcauaacuggcauguggg

SEQ ID NO: 356582 - RNA, 22 nt, Human
aggcaggcuagucgcuugagcc

SEQ ID NO: 356583 - RNA, 22 nt, Human
cucauggauauaagaacuguuu

SEQ ID NO: 356584 - RNA, 22 nt, Human
cagaaggcauagaugaaggccu

SEQ ID NO: 356585 - RNA, 22 nt, Human
ggcacagggagccgcaguugca

SEQ ID NO: 356586 - RNA, 22 nt, Human
acugugcuuucucuggaggcau

SEQ ID NO: 356587 - RNA, 22 nt, Human
agaggcccucucucuccugaug

SEQ ID NO: 356588 - RNA, 22 nt, Human
ucauugucuugauaugauuguc

SEQ ID NO: 356589 - RNA, 22 nt, Human
cugagccagagggagucggguc

SEQ ID NO: 356590 - RNA, 22 nt, Human
ccaggagcaggagcuggacaga

SEQ ID NO: 356591 - RNA, 21 nt, Human
ccaggaaggacugagcucccu

SEQ ID NO: 356592 - RNA, 22 nt, Human
ugaggcagggaguuuaauuguc

SEQ ID NO: 356593 - RNA, 18 nt, Human
agucuucugauccauuuu

SEQ ID NO: 356594 - RNA, 22 nt, Human
cucgcaggacagugcuaggacu

SEQ ID NO: 356595 - RNA, 22 nt, Human
agcagcugagccccagcuguga

SEQ ID NO: 356596 - RNA, 22 nt, Human
auuaauuuccaggcacugugcu

SEQ ID NO: 356597 - RNA, 22 nt, Human
uaccauuucauucuuuccucau

SEQ ID NO: 356598 - RNA, 22 nt, Human
aauuucaagucuugaagaagua

SEQ ID NO: 356599 - RNA, 22 nt, Human
agggaaaggcugaugcuguggg

SEQ ID NO: 356600 - RNA, 22 nt, Human
gagggcugcaaugagacagaga

SEQ ID NO: 356601 - RNA, 23 nt, Human
cgcccagccucagugaccugggc

SEQ ID NO: 356602 - RNA, 22 nt, Human
cgaggcagacaaaaguuggaag

SEQ ID NO: 356603 - RNA, 22 nt, Human
aacaggcaaacugugggauccc

SEQ ID NO: 356604 - RNA, 22 nt, Human
acuuuuuacaggguguauacca

SEQ ID NO: 356605 - RNA, 22 nt, Human
cccaggcacaccccgaacggaa

SEQ ID NO: 356606 - RNA, 22 nt, Human
aaugaaugaaccacauauaaca

SEQ ID NO: 356607 - RNA, 22 nt, Human
uagggacacugcucaugaguuc

SEQ ID NO: 356608 - RNA, 22 nt, Human
uauguuaagugggauaaucaaa

SEQ ID NO: 356609 - RNA, 22 nt, Human
ggcugcagagcugggugggccu

SEQ ID NO: 356610 - RNA, 22 nt, Human
uccaggcuagguuuacaggaca

SEQ ID NO: 356611 - RNA, 22 nt, Human
ucaaaugcggucauggcuuuua

SEQ ID NO: 356612 - RNA, 17 nt, Human
accagccucuccugggg

SEQ ID NO: 356613 - RNA, 22 nt, Human
ucaggcugccuaucagacugug

SEQ ID NO: 356614 - RNA, 22 nt, Human
gccugcaggcuguaguuuguga

SEQ ID NO: 356615 - RNA, 22 nt, Human
uuucagaugcaauuaauuuuca

SEQ ID NO: 356616 - RNA, 22 nt, Human
ccuggacucaggcugugggcac

SEQ ID NO: 356617 - RNA, 22 nt, Human
gcugagcugcuguucauccugc

SEQ ID NO: 356618 - RNA, 22 nt, Human
acaugauauuaaugucuuauuu

SEQ ID NO: 356619 - RNA, 20 nt, Human
agcaggaaugaugcuuucau

SEQ ID NO: 356620 - RNA, 22 nt, Human
gcuggcccagggucaccuagga

SEQ ID NO: 356621 - RNA, 22 nt, Human
cugggugaguugaugaaggaga

SEQ ID NO: 356622 - RNA, 22 nt, Human
gcugucacaagcaucuggggca

SEQ ID NO: 356623 - RNA, 23 nt, Human
gcugucaguuguuuuugucucua

SEQ ID NO: 356624 - RNA, 22 nt, Human
ucaccaggauuccuaucaguag

SEQ ID NO: 356625 - RNA, 22 nt, Human
cauugcacuccagcuugggcaa

SEQ ID NO: 356626 - RNA, 22 nt, Human
aaggcagcuuuaaaaaagaugc

SEQ ID NO: 356627 - RNA, 22 nt, Human
ccagggcagcgccccuccacgc

SEQ ID NO: 356628 - RNA, 20 nt, Human
cuguccccgaggucaccagg

SEQ ID NO: 356629 - RNA, 22 nt, Human
aauguauuccucaugcaagagu

SEQ ID NO: 356630 - RNA, 23 nt, Human
gcaggugguucgaacagaaguuu

SEQ ID NO: 356631 - RNA, 22 nt, Human
gccaccucuuugucucugccgc

SEQ ID NO: 356632 - RNA, 22 nt, Human
aggcugugcacagggcaccugc

SEQ ID NO: 356633 - RNA, 22 nt, Human
uaaagcacauaucuuacaauaa

SEQ ID NO: 356634 - RNA, 22 nt, Human
cggaggggauacauuuucugaa

SEQ ID NO: 356635 - RNA, 22 nt, Human
ggaggggaacuaaucccgugac

SEQ ID NO: 356636 - RNA, 23 nt, Human
acaguuauagcugugaauaacau

SEQ ID NO: 356637 - RNA, 22 nt, Human
ucagccuuguggcccugcucca

SEQ ID NO: 356638 - RNA, 22 nt, Human
caggaggaagaacucugcaaca

SEQ ID NO: 356639 - RNA, 22 nt, Human
uugauagguuuuauguauaguu

SEQ ID NO: 356640 - RNA, 22 nt, Human
aggccuggugaaugaaguaucu

SEQ ID NO: 356641 - RNA, 22 nt, Human
aagcaggcauuccagagacaau

SEQ ID NO: 356642 - RNA, 22 nt, Human
ggaaaaggccauuguuucucug

SEQ ID NO: 356643 - RNA, 22 nt, Human
aucuaacagcaacaccagaaua

SEQ ID NO: 356644 - RNA, 22 nt, Human
uucuggaguauuccuggcaccu

SEQ ID NO: 356645 - RNA, 22 nt, Human
agucucugagguucagaugccu

SEQ ID NO: 356646 - RNA, 22 nt, Human
uuagaaauauggugcugccgcc

SEQ ID NO: 356647 - RNA, 22 nt, Human
uucuccaacacaagcaugaugu

SEQ ID NO: 356648 - RNA, 22 nt, Human
gccuucagcccugacuggccag

SEQ ID NO: 356649 - RNA, 22 nt, Human
uguggucucguuauguugccca

SEQ ID NO: 356650 - RNA, 23 nt, Human
cagugcagggcaacucagacucc

SEQ ID NO: 356651 - RNA, 22 nt, Human
guuauaaaaugcacaguuguuu

SEQ ID NO: 356652 - RNA, 21 nt, Human
uuucuuaggcucuaaaaugac

SEQ ID NO: 356653 - RNA, 23 nt, Human
uaaagacagccuucaggauucug

SEQ ID NO: 356654 - RNA, 22 nt, Human
uccaggcagagcaacaaaauau

SEQ ID NO: 356655 - RNA, 23 nt, Human
agggguggucaguacccgcagug

SEQ ID NO: 356656 - RNA, 22 nt, Human
ggagccagagucugcaguguaa

SEQ ID NO: 356657 - RNA, 18 nt, Human
ggcugugcguggaggcug

SEQ ID NO: 356658 - RNA, 22 nt, Human
ccagcugagaaguguaaaguga

SEQ ID NO: 356659 - RNA, 22 nt, Human
caaggccauaagagauacaaaa

SEQ ID NO: 356660 - RNA, 20 nt, Human
cauuaugguugggcacagug

SEQ ID NO: 356661 - RNA, 22 nt, Human
ucucugagcaugccauauugcu

SEQ ID NO: 356662 - RNA, 20 nt, Human
cuuagaaauuuuuacccugg

SEQ ID NO: 356663 - RNA, 22 nt, Human
ugaugaaacugagguuccaaga

SEQ ID NO: 356664 - RNA, 22 nt, Human
aacaggcaacaguugacucuga

SEQ ID NO: 356665 - RNA, 19 nt, Human
ggcugucuggcguguggau

SEQ ID NO: 356666 - RNA, 22 nt, Human
uggcagcucccagagcuuccaa

SEQ ID NO: 356667 - RNA, 22 nt, Human
aggacucaucccugcuugucag

SEQ ID NO: 356668 - RNA, 20 nt, Human
agccaggcucaagcuccccc

SEQ ID NO: 356669 - RNA, 22 nt, Human
agcagccuuugaucaucuggga

SEQ ID NO: 356670 - RNA, 22 nt, Human
ucauugcaggcauuccccugcc

SEQ ID NO: 356671 - RNA, 22 nt, Human
uuuauuuauaagccacuugcug

SEQ ID NO: 356672 - RNA, 22 nt, Human
aagagcaucaaugacucgcagu

SEQ ID NO: 356673 - RNA, 22 nt, Human
ccugagggaaggaugcuaccca

SEQ ID NO: 356674 - RNA, 23 nt, Human
cagugugacgaggugaggcaggc

SEQ ID NO: 356675 - RNA, 23 nt, Human
uaauacugcuucagaggcuuaga

SEQ ID NO: 356676 - RNA, 19 nt, Human
gcaugcuugguggcuucug

SEQ ID NO: 356677 - RNA, 22 nt, Human
gcagagccaggcuggggcaggu

SEQ ID NO: 356678 - RNA, 22 nt, Human
aaguucaaggcagguccugagg

SEQ ID NO: 356679 - RNA, 22 nt, Human
uggccugccugggagcagcagg

SEQ ID NO: 356680 - RNA, 22 nt, Human
ucacugcucagucuguacuaca

SEQ ID NO: 356681 - RNA, 22 nt, Human
uguauacaggauuacucauagc

SEQ ID NO: 356682 - RNA, 22 nt, Human
agggcuggagccacagcuggga

SEQ ID NO: 356683 - RNA, 22 nt, Human
gacauuucaaucucauuauggg

SEQ ID NO: 356684 - RNA, 22 nt, Human
uuauuccagcuaagaguccugg

SEQ ID NO: 356685 - RNA, 22 nt, Human
gguaacaguauguagaguaaga

SEQ ID NO: 356686 - RNA, 22 nt, Human
gcacagcaauuucuauaagcuc

SEQ ID NO: 356687 - RNA, 22 nt, Human
gccaggagggaaaggacaauuu

SEQ ID NO: 356688 - RNA, 22 nt, Human
aagcacagaaaaggagcaugga

SEQ ID NO: 356689 - RNA, 20 nt, Human
gcuguucacauuauuaguag

SEQ ID NO: 356690 - RNA, 22 nt, Human
gguuucaaaguggacaguuagu

SEQ ID NO: 356691 - RNA, 22 nt, Human
ccuguucacugcacaguuuccg

SEQ ID NO: 356692 - RNA, 22 nt, Human
ugaaggccacuuccugugagcu

SEQ ID NO: 356693 - RNA, 22 nt, Human
aaugcacagcguuccaugcuug

SEQ ID NO: 356694 - RNA, 22 nt, Human
uuccaagaguaaauucaaauug

SEQ ID NO: 356695 - RNA, 22 nt, Human
aaggcagccuuuugaguugauu

SEQ ID NO: 356696 - RNA, 22 nt, Human
aaauugugagcuauagaucuag

SEQ ID NO: 356697 - RNA, 21 nt, Human
uuacaaagcaagugcuguguc

SEQ ID NO: 356698 - RNA, 22 nt, Human
gggugaggagcugccagucaug

SEQ ID NO: 356699 - RNA, 22 nt, Human
ccauuguaaauucuguggaagu

SEQ ID NO: 356700 - RNA, 22 nt, Human
uguucaaaugaucuucuuaaau

SEQ ID NO: 356701 - RNA, 22 nt, Human
acagggcagugucuugaaaaau

SEQ ID NO: 356702 - RNA, 22 nt, Human
auggacagugugaagcagauag

SEQ ID NO: 356703 - RNA, 22 nt, Human
auuuucuauucugcugguuuag

SEQ ID NO: 356704 - RNA, 20 nt, Human
gacaggagaguuagguaggu

SEQ ID NO: 356705 - RNA, 22 nt, Human
uuugcauugccucugacuuaug

SEQ ID NO: 356706 - RNA, 22 nt, Human
uuccagcaggcagacaggagau

SEQ ID NO: 356707 - RNA, 22 nt, Human
gugcccaggcccaaggcaccac

SEQ ID NO: 356708 - RNA, 22 nt, Human
caggagcagaggguggucagca

SEQ ID NO: 356709 - RNA, 22 nt, Human
aguaaaucagaccucauuaugu

SEQ ID NO: 356710 - RNA, 22 nt, Human
ccaggaaaauaccaagcuuuaa

SEQ ID NO: 356711 - RNA, 22 nt, Human
uccaggcugauccaugaagaau

SEQ ID NO: 356712 - RNA, 22 nt, Human
aaucucuuuggcucaaggaucc

SEQ ID NO: 356713 - RNA, 22 nt, Human
aggcacugggggaugagcaagg

SEQ ID NO: 356714 - RNA, 20 nt, Human
ggaggguggaagaaagcaag

SEQ ID NO: 356715 - RNA, 22 nt, Human
ucauugcauuuauucacuggca

SEQ ID NO: 356716 - RNA, 22 nt, Human
aaugaugguuaaacacuggagg

SEQ ID NO: 356717 - RNA, 22 nt, Human
ccauaaucuggcuuugagagag

SEQ ID NO: 356718 - RNA, 22 nt, Human
ccuucugcucccuggccagggc

SEQ ID NO: 356719 - RNA, 22 nt, Human
acagcuuuuuacuaauagauug

SEQ ID NO: 356720 - RNA, 22 nt, Human
cuucucaguugcaagugucaga

SEQ ID NO: 356721 - RNA, 22 nt, Human
auugaaaguccuaucuaaggga

SEQ ID NO: 356722 - RNA, 22 nt, Human
agagccuggcucccagcuaccg

SEQ ID NO: 356723 - RNA, 22 nt, Human
guucauuuuacuguaaauagca

SEQ ID NO: 356724 - RNA, 22 nt, Human
uggcucugggcaccguguccac

SEQ ID NO: 356725 - RNA, 22 nt, Human
uccaggcaagggaggagcaugg

SEQ ID NO: 356726 - RNA, 22 nt, Human
uggcccgaccucugcucaugca

SEQ ID NO: 356727 - RNA, 22 nt, Human
caugauaauuguuaacaaagua

SEQ ID NO: 356728 - RNA, 22 nt, Human
uuugaacaugcugcaugauaau

SEQ ID NO: 356729 - RNA, 22 nt, Human
uagagcuggaauuugcagcaag

SEQ ID NO: 356730 - RNA, 22 nt, Human
uaucuguuguccaugcagaaag

SEQ ID NO: 356731 - RNA, 22 nt, Human
gcacagaagagcuuuggaauga

SEQ ID NO: 356732 - RNA, 22 nt, Human
aauguguguucggggcccagag

SEQ ID NO: 356733 - RNA, 22 nt, Human
uuuggaauauuaaaaugucuca

SEQ ID NO: 356734 - RNA, 22 nt, Human
aucacaggugguaggaaaagaa

SEQ ID NO: 356735 - RNA, 22 nt, Human
cagagggcucggcggccgcucc

SEQ ID NO: 356736 - RNA, 20 nt, Human
ggcucugcuugugagcagcc

SEQ ID NO: 356737 - RNA, 22 nt, Human
gcagagcagcaaauggaaagga

SEQ ID NO: 356738 - RNA, 22 nt, Human
cucagagucccuucccucgugg

SEQ ID NO: 356739 - RNA, 22 nt, Human
cagcugccccgcuggcugacca

SEQ ID NO: 356740 - RNA, 22 nt, Human
aaauguuucuacuugugagcau

SEQ ID NO: 356741 - RNA, 22 nt, Human
uauuuccaccuauuauuuucug

SEQ ID NO: 356742 - RNA, 20 nt, Human
acagaaagagagaaugucag

SEQ ID NO: 356743 - RNA, 22 nt, Human
guggccuuuccugaagaaauga

SEQ ID NO: 356744 - RNA, 22 nt, Human
caucagaacgugagcuccuugu

SEQ ID NO: 356745 - RNA, 22 nt, Human
cugugcuugcggguguggagcc

SEQ ID NO: 356746 - RNA, 22 nt, Human
aaaaucugcuuccuuuuacaga

SEQ ID NO: 356747 - RNA, 22 nt, Human
cuugaaagucagcagaguggau

SEQ ID NO: 356748 - RNA, 22 nt, Human
acagucuugcuguauggucagg

SEQ ID NO: 356749 - RNA, 22 nt, Human
auucuucaucacuaccuuguga

SEQ ID NO: 356750 - RNA, 22 nt, Human
gcagggcauagaggcacggagg

SEQ ID NO: 356751 - RNA, 22 nt, Human
agccacagucugaugccugaga

SEQ ID NO: 356752 - RNA, 22 nt, Human
ucaugacaacuauauuauucca

SEQ ID NO: 356753 - RNA, 22 nt, Human
cacauguacagaagcaggcugg

SEQ ID NO: 356754 - RNA, 22 nt, Human
aaggcagccagauccuuugggu

SEQ ID NO: 356755 - RNA, 22 nt, Human
gcaugggcaagaggacuggggg

SEQ ID NO: 356756 - RNA, 22 nt, Human
aggcccugaagucggccccuca

SEQ ID NO: 356757 - RNA, 22 nt, Human
agcuugaguuuuggaugaagug

SEQ ID NO: 356758 - RNA, 22 nt, Human
aaggucauuuuuuccucuguug

SEQ ID NO: 356759 - RNA, 22 nt, Human
cagccagugguugaagaugcag

SEQ ID NO: 356760 - RNA, 22 nt, Human
uuucaacuagccccuaaguccu

SEQ ID NO: 356761 - RNA, 22 nt, Human
aaaucugggagcagcucggcca

SEQ ID NO: 356762 - RNA, 21 nt, Human
auuuucauuuccaggggagga

SEQ ID NO: 356763 - RNA, 22 nt, Human
aaguaacaaugcuguugaauug

SEQ ID NO: 356764 - RNA, 22 nt, Human
gaugauuuuaugucuugucauu

SEQ ID NO: 356765 - RNA, 22 nt, Human
ggcaucuguccaucucuccagc

SEQ ID NO: 356766 - RNA, 22 nt, Human
gaagccacuauagauauucuaa

SEQ ID NO: 356767 - RNA, 22 nt, Human
augauguugauaaauuacuuua

SEQ ID NO: 356768 - RNA, 22 nt, Human
uaggacaggugaggggcugugg

SEQ ID NO: 356769 - RNA, 22 nt, Human
aaggccuggauuuagguuguga

SEQ ID NO: 356770 - RNA, 22 nt, Human
ugucagagagcaggcaguagaa

SEQ ID NO: 356771 - RNA, 19 nt, Human
ucugugcugggaggcagca

SEQ ID NO: 356772 - RNA, 19 nt, Human
cuuugucagaacaugcuuc

SEQ ID NO: 356773 - RNA, 22 nt, Human
aucagcaaucucguguauuagg

SEQ ID NO: 356774 - RNA, 19 nt, Human
cccagagcauccugaacuu

SEQ ID NO: 356775 - RNA, 22 nt, Human
cccaggagcuucucucugccuc

SEQ ID NO: 356776 - RNA, 22 nt, Human
uacaagagguauauagaaacag

SEQ ID NO: 356777 - RNA, 22 nt, Human
cagccugacaccagcuuugggc

SEQ ID NO: 356778 - RNA, 22 nt, Human
caauuucaucuugugcuucaau

SEQ ID NO: 356779 - RNA, 22 nt, Human
uaggggaacuggcacagggcag

SEQ ID NO: 356780 - RNA, 22 nt, Human
cagguggguacaucacagagac

SEQ ID NO: 356781 - RNA, 22 nt, Human
ucuggcucaucucuccagguaa

SEQ ID NO: 356782 - RNA, 22 nt, Human
ucagccaggccaccuucagcuu

SEQ ID NO: 356783 - RNA, 22 nt, Human
ggugaggcuaagugacacaggg

SEQ ID NO: 356784 - RNA, 22 nt, Human
ccaaagucugcauuuuaacaug
